United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 13

SEQ ID NO: 491304 - RNA, 13 nt, Chlamydophila pneumoniae CWL029
auaccaucaaggu

SEQ ID NO: 491305 - RNA, 13 nt, Chlamydophila pneumoniae CWL029
auaccaucuuuaa

SEQ ID NO: 491306 - RNA, 19 nt, Chlamydophila pneumoniae CWL029
auaccaccccaaagcagau

SEQ ID NO: 491307 - RNA, 21 nt, Chlamydophila pneumoniae CWL029
auauccaccuuaccaucgaca

SEQ ID NO: 491308 - RNA, 19 nt, Chlamydophila pneumoniae CWL029
auaucagcuucuugaugua

SEQ ID NO: 491309 - RNA, 13 nt, Chlamydophila pneumoniae CWL029
auaguauuuuuaa

SEQ ID NO: 491310 - RNA, 21 nt, Chlamydophila pneumoniae CWL029
auaguccuagcagagaaauua

SEQ ID NO: 491311 - RNA, 23 nt, Chlamydophila pneumoniae CWL029
auaauuaaaucguauugacuuug

SEQ ID NO: 491312 - RNA, 18 nt, Chlamydophila pneumoniae CWL029
auaaucucuuucauaaau

SEQ ID NO: 491313 - RNA, 22 nt, Chlamydophila pneumoniae CWL029
auaaugguacaauacuggagag

SEQ ID NO: 491314 - RNA, 19 nt, Chlamydophila pneumoniae CWL029
aguuguauccagcucaagg

SEQ ID NO: 491315 - RNA, 22 nt, Chlamydophila pneumoniae CWL029
auaaauacgugcuugaauauuu

SEQ ID NO: 491316 - RNA, 14 nt, Chlamydophila pneumoniae CWL029
agucgauaaaaacu

SEQ ID NO: 491317 - RNA, 23 nt, Chlamydophila pneumoniae CWL029
agucgcuagaucacaagaaagaa

SEQ ID NO: 491318 - RNA, 18 nt, Chlamydophila pneumoniae CWL029
aguccuguuugaaaauau

SEQ ID NO: 491319 - RNA, 21 nt, Chlamydophila pneumoniae CWL029
aguccuccauguacaguuugu

SEQ ID NO: 491320 - RNA, 20 nt, Chlamydophila pneumoniae CWL029
aguccucucccuuaaggaaa

SEQ ID NO: 491321 - RNA, 14 nt, Chlamydophila pneumoniae CWL029
agugauuccuguca

SEQ ID NO: 491322 - RNA, 18 nt, Chlamydophila pneumoniae CWL029
agguuauuaucaaaguga

SEQ ID NO: 491323 - RNA, 21 nt, Chlamydophila pneumoniae CWL029
aguacagauuucagauaaucu

SEQ ID NO: 491324 - RNA, 12 nt, Chlamydophila pneumoniae CWL029
agggcaucuuuu

SEQ ID NO: 491325 - RNA, 17 nt, Chlamydophila pneumoniae CWL029
agggcgcuucccuauaa

SEQ ID NO: 491326 - RNA, 14 nt, Chlamydophila pneumoniae CWL029
agggaaagaaacua

SEQ ID NO: 491327 - RNA, 15 nt, Chlamydophila pneumoniae CWL029
aggcaacaacgccua

SEQ ID NO: 491328 - RNA, 23 nt, Chlamydophila pneumoniae CWL029
aggcaagauuaugaugccucauu

SEQ ID NO: 491329 - RNA, 13 nt, Chlamydophila pneumoniae CWL029
aggagcuaaagcu

SEQ ID NO: 491330 - RNA, 17 nt, Chlamydophila pneumoniae CWL029
aggagcgggauaggcaa

SEQ ID NO: 491331 - RNA, 14 nt, Chlamydophila pneumoniae CWL029
aggagaagucgaaa

SEQ ID NO: 491332 - RNA, 19 nt, Chlamydophila pneumoniae CWL029
aggaguuuucaagucugua

SEQ ID NO: 491333 - RNA, 18 nt, Chlamydophila pneumoniae CWL029
aggaugcuugugagauga

SEQ ID NO: 491334 - RNA, 13 nt, Chlamydophila pneumoniae CWL029
aggaauuccucuc

SEQ ID NO: 491335 - RNA, 23 nt, Chlamydophila pneumoniae CWL029
aggaagucaccuuacauccaauu

SEQ ID NO: 491336 - RNA, 22 nt, Chlamydophila pneumoniae CWL029
agcuucuuuuccagcaaagcga

SEQ ID NO: 491337 - RNA, 14 nt, Chlamydophila pneumoniae CWL029
agcuugcguuuccu

SEQ ID NO: 491338 - RNA, 14 nt, Chlamydophila pneumoniae CWL029
agcuucaaguuucu

SEQ ID NO: 491339 - RNA, 21 nt, Chlamydophila pneumoniae CWL029
agcuguagugauacuuuagaa

SEQ ID NO: 491340 - RNA, 14 nt, Chlamydophila pneumoniae CWL029
agcucauuaucaag

SEQ ID NO: 491341 - RNA, 21 nt, Chlamydophila pneumoniae CWL029
agcguuuuuugaaaauuuucc

SEQ ID NO: 491342 - RNA, 20 nt, Chlamydophila pneumoniae CWL029
agcguuucgacgagaaggaa

SEQ ID NO: 491343 - RNA, 15 nt, Chlamydophila pneumoniae CWL029
agcguuucgauaauu

SEQ ID NO: 491344 - RNA, 19 nt, Chlamydophila pneumoniae CWL029
agcgaucucucuuccugcu

SEQ ID NO: 491345 - RNA, 23 nt, Chlamydophila pneumoniae CWL029
agccuauaucgccguuaaagacu

SEQ ID NO: 491346 - RNA, 19 nt, Chlamydophila pneumoniae CWL029
agccuccauuuagacaaga

SEQ ID NO: 491347 - RNA, 20 nt, Chlamydophila pneumoniae CWL029
agcauaguguuccaaaacag

SEQ ID NO: 491348 - RNA, 11 nt, Chlamydophila pneumoniae CWL029
agcauuucucu

SEQ ID NO: 491349 - RNA, 19 nt, Chlamydophila pneumoniae CWL029
agauucaccaagaacaaua

SEQ ID NO: 491350 - RNA, 13 nt, Chlamydophila pneumoniae CWL029
agauuuagggaag

SEQ ID NO: 491351 - RNA, 20 nt, Chlamydophila pneumoniae CWL029
agauugccuuugaucaggag

SEQ ID NO: 491352 - RNA, 16 nt, Chlamydophila pneumoniae CWL029
agauugaaucccauca

SEQ ID NO: 491353 - RNA, 16 nt, Chlamydophila pneumoniae CWL029
agauugaauucaucca

SEQ ID NO: 491354 - RNA, 18 nt, Chlamydophila pneumoniae CWL029
agcccuagauagcaaauc

SEQ ID NO: 491355 - RNA, 16 nt, Chlamydophila pneumoniae CWL029
agccaugacaaagggu

SEQ ID NO: 491356 - RNA, 11 nt, Chlamydophila pneumoniae CWL029
uuuuuucuaua

SEQ ID NO: 491357 - RNA, 16 nt, Chlamydophila pneumoniae CWL029
uuuuucaagguucucu

SEQ ID NO: 491358 - RNA, 13 nt, Chlamydophila pneumoniae CWL029
uuuuuauuuaaaa

SEQ ID NO: 491359 - RNA, 14 nt, Chlamydophila pneumoniae CWL029
uuuuuaucuccuga

SEQ ID NO: 491360 - RNA, 21 nt, Chlamydophila pneumoniae CWL029
uuuuuagaagguguuuuggcu

SEQ ID NO: 491361 - RNA, 21 nt, Chlamydophila pneumoniae CWL029
uuuuuaaccgagcuuuuugcu

SEQ ID NO: 491362 - RNA, 17 nt, Chlamydophila pneumoniae CWL029
uuuuuaaccucuuuucu

SEQ ID NO: 491363 - RNA, 12 nt, Chlamydophila pneumoniae CWL029
uuuuuaaaacuc

SEQ ID NO: 491364 - RNA, 17 nt, Chlamydophila pneumoniae CWL029
uuuuguuaaauucccaa

SEQ ID NO: 491365 - RNA, 16 nt, Chlamydophila pneumoniae CWL029
uuuugucgcaauaaca

SEQ ID NO: 491366 - RNA, 13 nt, Chlamydophila pneumoniae CWL029
uuuugucuucauc

SEQ ID NO: 491367 - RNA, 19 nt, Chlamydophila pneumoniae CWL029
uuuugugaauuuuauuuau

SEQ ID NO: 491368 - RNA, 16 nt, Chlamydophila pneumoniae CWL029
uuuuguggcuuuucua

SEQ ID NO: 491369 - RNA, 18 nt, Chlamydophila pneumoniae CWL029
uuuuguggcuuuucuaaa

SEQ ID NO: 491370 - RNA, 17 nt, Chlamydophila pneumoniae CWL029
uuuugcuaaacaaugca

SEQ ID NO: 491371 - RNA, 21 nt, Chlamydophila pneumoniae CWL029
uuuugcuaagagcucuuuccc

SEQ ID NO: 491372 - RNA, 16 nt, Chlamydophila pneumoniae CWL029
uuuugcuuuucccaca

SEQ ID NO: 491373 - RNA, 15 nt, Chlamydophila pneumoniae CWL029
uuuugcuuuucccuu

SEQ ID NO: 491374 - RNA, 13 nt, Chlamydophila pneumoniae CWL029
uuuuggagacaca

SEQ ID NO: 491375 - RNA, 18 nt, Chlamydophila pneumoniae CWL029
uuuucgaaucguuuuugg

SEQ ID NO: 491376 - RNA, 14 nt, Chlamydophila pneumoniae CWL029
uuuucauacuuauc

SEQ ID NO: 491377 - RNA, 15 nt, Chlamydophila pneumoniae CWL029
uuuucaggaacuuua

SEQ ID NO: 491378 - RNA, 22 nt, Chlamydophila pneumoniae CWL029
uuuucaggaggcgcguagaucc

SEQ ID NO: 491379 - RNA, 16 nt, Chlamydophila pneumoniae CWL029
uuuucacgagcucaca

SEQ ID NO: 491380 - RNA, 17 nt, Chlamydophila pneumoniae CWL029
uuuucaaaucaucaaaa

SEQ ID NO: 491381 - RNA, 22 nt, Chlamydophila pneumoniae CWL029
uuuucaaaucaucaaaaagauc

SEQ ID NO: 491382 - RNA, 23 nt, Chlamydophila pneumoniae CWL029
uuuucaaauauugcgaacuuuug

SEQ ID NO: 491383 - RNA, 12 nt, Chlamydophila pneumoniae CWL029
uuuucaaauucu

SEQ ID NO: 491384 - RNA, 19 nt, Chlamydophila pneumoniae CWL029
uuuucuuucuaagauaucu

SEQ ID NO: 491385 - RNA, 13 nt, Chlamydophila pneumoniae CWL029
uuuucuucuugca

SEQ ID NO: 491386 - RNA, 12 nt, Chlamydophila pneumoniae CWL029
uuuucugcuccu

SEQ ID NO: 491387 - RNA, 14 nt, Chlamydophila pneumoniae CWL029
uuuucuccuucucc

SEQ ID NO: 491388 - RNA, 16 nt, Chlamydophila pneumoniae CWL029
uuuucucgaauagaaa

SEQ ID NO: 491389 - RNA, 13 nt, Chlamydophila pneumoniae CWL029
uuuucucugagca

SEQ ID NO: 491390 - RNA, 20 nt, Chlamydophila pneumoniae CWL029
uuuugcagugauaaaccaag

SEQ ID NO: 491391 - RNA, 22 nt, Chlamydophila pneumoniae CWL029
uuuugccacaacucauccuaaa

SEQ ID NO: 491392 - RNA, 22 nt, Chlamydophila pneumoniae CWL029
uuuugccaguucuugaaacucu

SEQ ID NO: 491393 - RNA, 15 nt, Chlamydophila pneumoniae CWL029
uuuugagauucaaaa

SEQ ID NO: 491394 - RNA, 23 nt, Chlamydophila pneumoniae CWL029
uuuugaggaacuucagcuuugcu

SEQ ID NO: 491395 - RNA, 22 nt, Chlamydophila pneumoniae CWL029
uuuucuuuugcagcaacuuccc

SEQ ID NO: 491396 - RNA, 14 nt, Chlamydophila pneumoniae CWL029
uuuucuuuuuagaa

SEQ ID NO: 491397 - RNA, 22 nt, Chlamydophila pneumoniae CWL029
ugaaaauucgaauucucagaaa

SEQ ID NO: 491398 - RNA, 19 nt, Chlamydophila pneumoniae CWL029
ugaaaauucgaauucucag

SEQ ID NO: 491399 - RNA, 14 nt, Chlamydophila pneumoniae CWL029
ugaaaauuuuccca

SEQ ID NO: 491400 - RNA, 21 nt, Chlamydophila pneumoniae CWL029
ugaaaaucgcaccuugaccuc

SEQ ID NO: 491401 - RNA, 17 nt, Chlamydophila pneumoniae CWL029
ugaaaaugauucauaac

SEQ ID NO: 491402 - RNA, 18 nt, Chlamydophila pneumoniae CWL029
ugaaaaucaagaagagaa

SEQ ID NO: 491403 - RNA, 17 nt, Chlamydophila pneumoniae CWL029
ugaaaacaaggcaaaaa

SEQ ID NO: 491404 - RNA, 22 nt, Chlamydophila pneumoniae CWL029
ugaaaagcauucugcuagagcu

SEQ ID NO: 491405 - RNA, 13 nt, Chlamydophila pneumoniae CWL029
ugaaacuuuagga

SEQ ID NO: 491406 - RNA, 17 nt, Chlamydophila pneumoniae CWL029
ugaaacuuuaggauuca

SEQ ID NO: 491407 - RNA, 20 nt, Chlamydophila pneumoniae CWL029
ugaaacuuuuuuucuucucu

SEQ ID NO: 491408 - RNA, 21 nt, Chlamydophila pneumoniae CWL029
ugaaacuuuuuuucuucucua

SEQ ID NO: 491409 - RNA, 18 nt, Chlamydophila pneumoniae CWL029
ugaaacgcccuucaggac

SEQ ID NO: 491410 - RNA, 17 nt, Chlamydophila pneumoniae CWL029
ugaaaccguaacugagg

SEQ ID NO: 491411 - RNA, 18 nt, Chlamydophila pneumoniae CWL029
ugaaagucagcaagucau

SEQ ID NO: 491412 - RNA, 19 nt, Chlamydophila pneumoniae CWL029
ugaaagauuauucuagagu

SEQ ID NO: 491413 - RNA, 21 nt, Chlamydophila pneumoniae CWL029
ugaaagauuauucuagaguug

SEQ ID NO: 491414 - RNA, 21 nt, Chlamydophila pneumoniae CWL029
ugaaaguacaggcuccaucac

SEQ ID NO: 491415 - RNA, 13 nt, Chlamydophila pneumoniae CWL029
ugaacaucuccag

SEQ ID NO: 491416 - RNA, 14 nt, Chlamydophila pneumoniae CWL029
ugaacacucucuac

SEQ ID NO: 491417 - RNA, 19 nt, Chlamydophila pneumoniae CWL029
ugaaauuucauucucacag

SEQ ID NO: 491418 - RNA, 14 nt, Chlamydophila pneumoniae CWL029
ugaaauuucugaaa

SEQ ID NO: 491419 - RNA, 19 nt, Chlamydophila pneumoniae CWL029
ugaaauuucugaaacaaug

SEQ ID NO: 491420 - RNA, 21 nt, Chlamydophila pneumoniae CWL029
ugaaauuucugaaacaaugca

SEQ ID NO: 491421 - RNA, 14 nt, Chlamydophila pneumoniae CWL029
ugaacaaaaacugc

SEQ ID NO: 491422 - RNA, 20 nt, Chlamydophila pneumoniae CWL029
ugaaauacuccacuuuuuuc

SEQ ID NO: 491423 - RNA, 23 nt, Chlamydophila pneumoniae CWL029
ugaaauacuccacuuuuuucccu

SEQ ID NO: 491424 - RNA, 17 nt, Chlamydophila pneumoniae CWL029
ugaaauaguguuucuuu

SEQ ID NO: 491425 - RNA, 16 nt, Chlamydophila pneumoniae CWL029
ugaaaucguaucuuuu

SEQ ID NO: 491426 - RNA, 14 nt, Chlamydophila pneumoniae CWL029
ugaaaucuuuagaa

SEQ ID NO: 491427 - RNA, 13 nt, Chlamydophila pneumoniae CWL029
ucuuuuucagaaa

SEQ ID NO: 491428 - RNA, 15 nt, Chlamydophila pneumoniae CWL029
ucuuuuucagaaagc

SEQ ID NO: 491429 - RNA, 16 nt, Chlamydophila pneumoniae CWL029
ucuuuuucagcuucua

SEQ ID NO: 491430 - RNA, 20 nt, Chlamydophila pneumoniae CWL029
ucuuuuuaagguucucugaa

SEQ ID NO: 491431 - RNA, 20 nt, Chlamydophila pneumoniae CWL029
ucuuuuuauugauaaugauu

SEQ ID NO: 491432 - RNA, 17 nt, Chlamydophila pneumoniae CWL029
ucuuuucggaucagaau

SEQ ID NO: 491433 - RNA, 24 nt, Chlamydophila pneumoniae CWL029
ucuuuucggaucagaaugcaucuu

SEQ ID NO: 491434 - RNA, 14 nt, Chlamydophila pneumoniae CWL029
ucuuuucuagaaaa

SEQ ID NO: 491435 - RNA, 17 nt, Chlamydophila pneumoniae CWL029
ucuuuucugaagauuuu

SEQ ID NO: 491436 - RNA, 16 nt, Chlamydophila pneumoniae CWL029
ucuuuucuuuuuagaa

SEQ ID NO: 491437 - RNA, 16 nt, Chlamydophila pneumoniae CWL029
ucuuuugauaacuuug

SEQ ID NO: 491438 - RNA, 23 nt, Chlamydophila pneumoniae CWL029
ucuuuugguugugucaacccuuu

SEQ ID NO: 491439 - RNA, 18 nt, Chlamydophila pneumoniae CWL029
ucuuuuguaaucuaagaa

SEQ ID NO: 491440 - RNA, 17 nt, Chlamydophila pneumoniae CWL029
ucuuuuguuuuagcucu

SEQ ID NO: 491441 - RNA, 13 nt, Chlamydophila pneumoniae CWL029
ugaaaaaauucua

SEQ ID NO: 491442 - RNA, 13 nt, Chlamydophila pneumoniae CWL029
ucuuuuucuaaga

SEQ ID NO: 491443 - RNA, 17 nt, Chlamydophila pneumoniae CWL029
ucuuuuauauuaagaau

SEQ ID NO: 491444 - RNA, 16 nt, Chlamydophila pneumoniae CWL029
ucuuuuaacuuaaaga

SEQ ID NO: 491445 - RNA, 19 nt, Chlamydophila pneumoniae CWL029
ucuuugggauaaaaaguuu

SEQ ID NO: 491446 - RNA, 18 nt, Chlamydophila pneumoniae CWL029
ucuuugaggauacgaaua

SEQ ID NO: 491447 - RNA, 20 nt, Chlamydophila pneumoniae CWL029
ucuuugagaucuugaaugau

SEQ ID NO: 491448 - RNA, 22 nt, Chlamydophila pneumoniae CWL029
ucuuugaagaacaaaaaaucaa

SEQ ID NO: 491449 - RNA, 19 nt, Chlamydophila pneumoniae CWL029
ucuuugaacaacuccuuaa

SEQ ID NO: 491450 - RNA, 21 nt, Chlamydophila pneumoniae CWL029
ucuuugacaucuaauuuuaaa

SEQ ID NO: 491451 - RNA, 18 nt, Chlamydophila pneumoniae CWL029
ucuuucuugcucugacaa

SEQ ID NO: 491452 - RNA, 19 nt, Chlamydophila pneumoniae CWL029
ucuuuaagauuuuuagaau

SEQ ID NO: 491453 - RNA, 14 nt, Chlamydophila pneumoniae CWL029
ucuuguucuaaaau

SEQ ID NO: 491454 - RNA, 18 nt, Chlamydophila pneumoniae CWL029
ucuugugguuuuucuccu

SEQ ID NO: 491455 - RNA, 15 nt, Chlamydophila pneumoniae CWL029
ucuuguuaaaguaaa

SEQ ID NO: 491456 - RNA, 15 nt, Chlamydophila pneumoniae CWL029
ucuuguuccaauaga

SEQ ID NO: 491457 - RNA, 18 nt, Chlamydophila pneumoniae CWL029
ucuuggucggaguuuuuu

SEQ ID NO: 491458 - RNA, 16 nt, Chlamydophila pneumoniae CWL029
ucuugcuuauugucuu

SEQ ID NO: 491459 - RNA, 19 nt, Chlamydophila pneumoniae CWL029
ucuugcuuauugucuuaaa

SEQ ID NO: 491460 - RNA, 17 nt, Chlamydophila pneumoniae CWL029
ucuugcugauuuuugcu

SEQ ID NO: 491461 - RNA, 13 nt, Chlamydophila pneumoniae CWL029
ucuugcucugaca

SEQ ID NO: 491462 - RNA, 19 nt, Chlamydophila pneumoniae CWL029
ucuugcucaggagauacaa

SEQ ID NO: 491463 - RNA, 22 nt, Chlamydophila pneumoniae CWL029
ucuugcucuagucuuucaaccu

SEQ ID NO: 491464 - RNA, 17 nt, Chlamydophila pneumoniae CWL029
ucuucccauuucuucuu

SEQ ID NO: 491465 - RNA, 16 nt, Chlamydophila pneumoniae CWL029
ucuuccccccucacaa

SEQ ID NO: 491466 - RNA, 19 nt, Chlamydophila pneumoniae CWL029
ucuuucacaucuuuagaau

SEQ ID NO: 491467 - RNA, 20 nt, Chlamydophila pneumoniae CWL029
ucuuucaccaacuccucuaa

SEQ ID NO: 491468 - RNA, 12 nt, Chlamydophila pneumoniae CWL029
ucuuucauaaga

SEQ ID NO: 491469 - RNA, 14 nt, Chlamydophila pneumoniae CWL029
ucuuucauaagauu

SEQ ID NO: 491470 - RNA, 17 nt, Chlamydophila pneumoniae CWL029
ucuuucauaagauugcc

SEQ ID NO: 491471 - RNA, 15 nt, Chlamydophila pneumoniae CWL029
ucuuuaauuccaacu

SEQ ID NO: 491472 - RNA, 21 nt, Chlamydophila pneumoniae CWL029
ucuuuaucuagcucuucaagg

SEQ ID NO: 491473 - RNA, 20 nt, Chlamydophila pneumoniae CWL029
ucuuucugauuuaaaagguu

SEQ ID NO: 491474 - RNA, 14 nt, Chlamydophila pneumoniae CWL029
ucuuucugcucuuc

SEQ ID NO: 491475 - RNA, 11 nt, Chlamydophila pneumoniae CWL029
ucuuucucuaa

SEQ ID NO: 491476 - RNA, 14 nt, Chlamydophila pneumoniae CWL029
ucuuucuaagaaga

SEQ ID NO: 491477 - RNA, 18 nt, Chlamydophila pneumoniae CWL029
ucuuucggugucucuaga

SEQ ID NO: 491478 - RNA, 13 nt, Chlamydophila pneumoniae CWL029
ucuuucuaaaaca

SEQ ID NO: 491479 - RNA, 21 nt, Chlamydophila pneumoniae CWL029
ucuuucuaggaucucuaguaa

SEQ ID NO: 491480 - RNA, 20 nt, Chlamydophila pneumoniae CWL029
ucuuuccuuagcauuaggaa

SEQ ID NO: 491481 - RNA, 18 nt, Chlamydophila pneumoniae CWL029
ucuuuccauagccaagga

SEQ ID NO: 491482 - RNA, 19 nt, Chlamydophila pneumoniae CWL029
ucuuucaucaaugcgauua

SEQ ID NO: 491483 - RNA, 15 nt, Chlamydophila pneumoniae CWL029
ucuuaucaagagcuc

SEQ ID NO: 491484 - RNA, 18 nt, Chlamydophila pneumoniae CWL029
ucuuauagacagguacau

SEQ ID NO: 491485 - RNA, 13 nt, Chlamydophila pneumoniae CWL029
ucuuauauaaaac

SEQ ID NO: 491486 - RNA, 23 nt, Chlamydophila pneumoniae CWL029
ucuuauaaaaaagggaugaagau

SEQ ID NO: 491487 - RNA, 21 nt, Chlamydophila pneumoniae CWL029
ucuuagccccuccaacaaaca

SEQ ID NO: 491488 - RNA, 12 nt, Chlamydophila pneumoniae CWL029
ucuuagccuagg

SEQ ID NO: 491489 - RNA, 16 nt, Chlamydophila pneumoniae CWL029
ucuuaguaaagaauca

SEQ ID NO: 491490 - RNA, 16 nt, Chlamydophila pneumoniae CWL029
ucuuaucuaaagaaau

SEQ ID NO: 491491 - RNA, 15 nt, Chlamydophila pneumoniae CWL029
ucuuaucuggagaug

SEQ ID NO: 491492 - RNA, 15 nt, Chlamydophila pneumoniae CWL029
ucuuaucuucuaaaa

SEQ ID NO: 491493 - RNA, 13 nt, Chlamydophila pneumoniae CWL029
ucuuaucugcuau

SEQ ID NO: 491494 - RNA, 17 nt, Chlamydophila pneumoniae CWL029
ucuuaugaccaagaaca

SEQ ID NO: 491495 - RNA, 17 nt, Chlamydophila pneumoniae CWL029
ucuuauucacuggaaug

SEQ ID NO: 491496 - RNA, 16 nt, Chlamydophila pneumoniae CWL029
ucuuagaaacacaguu

SEQ ID NO: 491497 - RNA, 18 nt, Chlamydophila pneumoniae CWL029
ucuuagaagagaaaguag

SEQ ID NO: 491498 - RNA, 14 nt, Chlamydophila pneumoniae CWL029
ucuuagaauccucu

SEQ ID NO: 491499 - RNA, 22 nt, Chlamydophila pneumoniae CWL029
ucuuacuaaagaaagagucuca

SEQ ID NO: 491500 - RNA, 14 nt, Chlamydophila pneumoniae CWL029
ucuguuaaaaacaa

SEQ ID NO: 491501 - RNA, 16 nt, Chlamydophila pneumoniae CWL029
ucuuccacaauguuua

SEQ ID NO: 491502 - RNA, 16 nt, Chlamydophila pneumoniae CWL029
ucuucaugaaaaaaga

SEQ ID NO: 491503 - RNA, 22 nt, Chlamydophila pneumoniae CWL029
ucuucaugcugcuuugacgacu

SEQ ID NO: 491504 - RNA, 22 nt, Chlamydophila pneumoniae CWL029
ucuucaucaauacgaucuuuug

SEQ ID NO: 491505 - RNA, 15 nt, Chlamydophila pneumoniae CWL029
ucuucaucacaaaau

SEQ ID NO: 491506 - RNA, 19 nt, Chlamydophila pneumoniae CWL029
ucuucacgacauacaucaa

SEQ ID NO: 491507 - RNA, 19 nt, Chlamydophila pneumoniae CWL029
ucuucacuuauaagcugcu

SEQ ID NO: 491508 - RNA, 13 nt, Chlamydophila pneumoniae CWL029
ucuucagcccacu

SEQ ID NO: 491509 - RNA, 22 nt, Chlamydophila pneumoniae CWL029
ucuucagcccacuguuuugcuu

SEQ ID NO: 491510 - RNA, 21 nt, Chlamydophila pneumoniae CWL029
ucuucaaagcuacuaaucacc

SEQ ID NO: 491511 - RNA, 22 nt, Chlamydophila pneumoniae CWL029
ucuucaaagaacuuaaaauuca

SEQ ID NO: 491512 - RNA, 22 nt, Chlamydophila pneumoniae CWL029
ucuucaaagucaaauacuucuc

SEQ ID NO: 491513 - RNA, 20 nt, Chlamydophila pneumoniae CWL029
ucuucaaaagaccgccuucu

SEQ ID NO: 491514 - RNA, 21 nt, Chlamydophila pneumoniae CWL029
ucuucaauaggaauuagagaa

SEQ ID NO: 491515 - RNA, 13 nt, Chlamydophila pneumoniae CWL029
ucuucaauuucuu

SEQ ID NO: 491516 - RNA, 13 nt, Chlamydophila pneumoniae CWL029
ucuucaagaaaug

SEQ ID NO: 491517 - RNA, 22 nt, Chlamydophila pneumoniae CWL029
ucuucaagagcuuuuacaaacc

SEQ ID NO: 491518 - RNA, 17 nt, Chlamydophila pneumoniae CWL029
ucuguacaacaaaauuu

SEQ ID NO: 491519 - RNA, 20 nt, Chlamydophila pneumoniae CWL029
ucuguaagaacguggggaaa

SEQ ID NO: 491520 - RNA, 20 nt, Chlamydophila pneumoniae CWL029
ucugugugacgacaaaucac

SEQ ID NO: 491521 - RNA, 21 nt, Chlamydophila pneumoniae CWL029
ucuggagaaaaaauaucuccg

SEQ ID NO: 491522 - RNA, 13 nt, Chlamydophila pneumoniae CWL029
ucuggaaugacua

SEQ ID NO: 491523 - RNA, 17 nt, Chlamydophila pneumoniae CWL029
ucuggaccuuauaccca

SEQ ID NO: 491524 - RNA, 18 nt, Chlamydophila pneumoniae CWL029
ucuggcugagagaagcag

SEQ ID NO: 491525 - RNA, 18 nt, Chlamydophila pneumoniae CWL029
ucugguuaagcaccauaa

SEQ ID NO: 491526 - RNA, 17 nt, Chlamydophila pneumoniae CWL029
ucugcuagagcuuucag

SEQ ID NO: 491527 - RNA, 16 nt, Chlamydophila pneumoniae CWL029
ucugcguuucuuucug

SEQ ID NO: 491528 - RNA, 15 nt, Chlamydophila pneumoniae CWL029
ucugcugaagggaca

SEQ ID NO: 491529 - RNA, 16 nt, Chlamydophila pneumoniae CWL029
ucugcugaggagagua

SEQ ID NO: 491530 - RNA, 12 nt, Chlamydophila pneumoniae CWL029
ucugcugaaauc

SEQ ID NO: 491531 - RNA, 19 nt, Chlamydophila pneumoniae CWL029
ucugcuggaguagcucaau

SEQ ID NO: 491532 - RNA, 22 nt, Chlamydophila pneumoniae CWL029
ucuggaaaagccucgaaauuuu

SEQ ID NO: 491533 - RNA, 21 nt, Chlamydophila pneumoniae CWL029
ucugcgcugagguuauuuaau

SEQ ID NO: 491534 - RNA, 19 nt, Chlamydophila pneumoniae CWL029
ucugcaaucugaaugccug

SEQ ID NO: 491535 - RNA, 21 nt, Chlamydophila pneumoniae CWL029
ucugcaauuccgaagaagaaa

SEQ ID NO: 491536 - RNA, 19 nt, Chlamydophila pneumoniae CWL029
ucugcaauuccgaagaaga

SEQ ID NO: 491537 - RNA, 20 nt, Chlamydophila pneumoniae CWL029
ucucgaauagaaaagguauu

SEQ ID NO: 491538 - RNA, 15 nt, Chlamydophila pneumoniae CWL029
ucucgacacuaugug

SEQ ID NO: 491539 - RNA, 17 nt, Chlamydophila pneumoniae CWL029
ucucgacacuauguguu

SEQ ID NO: 491540 - RNA, 21 nt, Chlamydophila pneumoniae CWL029
ucuccuggagagcgaaauaga

SEQ ID NO: 491541 - RNA, 22 nt, Chlamydophila pneumoniae CWL029
ucuccugaaccgcaaaaagcuu

SEQ ID NO: 491542 - RNA, 21 nt, Chlamydophila pneumoniae CWL029
ucucgggagaacaugccccca

SEQ ID NO: 491543 - RNA, 21 nt, Chlamydophila pneumoniae CWL029
ucucuagcuguuaauucccgu

SEQ ID NO: 491544 - RNA, 16 nt, Chlamydophila pneumoniae CWL029
ucucuagggaaaggag

SEQ ID NO: 491545 - RNA, 17 nt, Chlamydophila pneumoniae CWL029
ucucuaguucuagaaag

SEQ ID NO: 491546 - RNA, 13 nt, Chlamydophila pneumoniae CWL029
ucucuaguuuuua

SEQ ID NO: 491547 - RNA, 16 nt, Chlamydophila pneumoniae CWL029
ucucuaugcgcucuaa

SEQ ID NO: 491548 - RNA, 18 nt, Chlamydophila pneumoniae CWL029
ucucuaugcgcucuaaga

SEQ ID NO: 491549 - RNA, 15 nt, Chlamydophila pneumoniae CWL029
ucucuaagaaauuuu

SEQ ID NO: 491550 - RNA, 20 nt, Chlamydophila pneumoniae CWL029
ucucuaagaaucuauagaac

SEQ ID NO: 491551 - RNA, 18 nt, Chlamydophila pneumoniae CWL029
ucucuaagcagccucuuc

SEQ ID NO: 491552 - RNA, 21 nt, Chlamydophila pneumoniae CWL029
ucucuaagcagccucuucucu

SEQ ID NO: 491553 - RNA, 23 nt, Chlamydophila pneumoniae CWL029
ucucuaagcagccucuucucuac

SEQ ID NO: 491554 - RNA, 16 nt, Chlamydophila pneumoniae CWL029
ucucuaagacuguguu

SEQ ID NO: 491555 - RNA, 20 nt, Chlamydophila pneumoniae CWL029
ucucuaagacuguguuuuau

SEQ ID NO: 491556 - RNA, 17 nt, Chlamydophila pneumoniae CWL029
ucucgguuuaaggcaau

SEQ ID NO: 491557 - RNA, 19 nt, Chlamydophila pneumoniae CWL029
ucucgugaauuacaggccc

SEQ ID NO: 491558 - RNA, 20 nt, Chlamydophila pneumoniae CWL029
ucucauggauuacugaagau

SEQ ID NO: 491559 - RNA, 14 nt, Chlamydophila pneumoniae CWL029
ucucauguaacuga

SEQ ID NO: 491560 - RNA, 20 nt, Chlamydophila pneumoniae CWL029
ucucaugaaauuuucuaaga

SEQ ID NO: 491561 - RNA, 22 nt, Chlamydophila pneumoniae CWL029
ucucaugcggacuuuauucucu

SEQ ID NO: 491562 - RNA, 20 nt, Chlamydophila pneumoniae CWL029
ucuacaucccaagggccaga

SEQ ID NO: 491563 - RNA, 18 nt, Chlamydophila pneumoniae CWL029
ucuacaucuucuuggcuu

SEQ ID NO: 491564 - RNA, 14 nt, Chlamydophila pneumoniae CWL029
ucuacaugcucaag

SEQ ID NO: 491565 - RNA, 21 nt, Chlamydophila pneumoniae CWL029
ucuacauuugcuauuuucccu

SEQ ID NO: 491566 - RNA, 22 nt, Chlamydophila pneumoniae CWL029
ucuacauuugcuauuuucccuu

SEQ ID NO: 491567 - RNA, 19 nt, Chlamydophila pneumoniae CWL029
ucuccagaaauuuuuacaa

SEQ ID NO: 491568 - RNA, 22 nt, Chlamydophila pneumoniae CWL029
ucucauugcggcaccaaagaug

SEQ ID NO: 491569 - RNA, 17 nt, Chlamydophila pneumoniae CWL029
ucuccagguagcagagu

SEQ ID NO: 491570 - RNA, 15 nt, Chlamydophila pneumoniae CWL029
ucuccgaagacuacc

SEQ ID NO: 491571 - RNA, 12 nt, Chlamydophila pneumoniae CWL029
ucucccucuaaa

SEQ ID NO: 491572 - RNA, 19 nt, Chlamydophila pneumoniae CWL029
ucucccgugagcaugcuca

SEQ ID NO: 491573 - RNA, 18 nt, Chlamydophila pneumoniae CWL029
ucucccgugagcaugcuc

SEQ ID NO: 491574 - RNA, 15 nt, Chlamydophila pneumoniae CWL029
ucucccucacaagaa

SEQ ID NO: 491575 - RNA, 18 nt, Chlamydophila pneumoniae CWL029
ucuccgggaacaacugug

SEQ ID NO: 491576 - RNA, 13 nt, Chlamydophila pneumoniae CWL029
ucucuuucacaaa

SEQ ID NO: 491577 - RNA, 17 nt, Chlamydophila pneumoniae CWL029
ucucuuuaacuucuaaa

SEQ ID NO: 491578 - RNA, 19 nt, Chlamydophila pneumoniae CWL029
ucucuuuagcaaucucuuu

SEQ ID NO: 491579 - RNA, 12 nt, Chlamydophila pneumoniae CWL029
ucucuuuaaaaa

SEQ ID NO: 491580 - RNA, 13 nt, Chlamydophila pneumoniae CWL029
ucucuucuucuca

SEQ ID NO: 491581 - RNA, 14 nt, Chlamydophila pneumoniae CWL029
ucucuugauuccuu

SEQ ID NO: 491582 - RNA, 14 nt, Chlamydophila pneumoniae CWL029
ucucuuccuucucc

SEQ ID NO: 491583 - RNA, 15 nt, Chlamydophila pneumoniae CWL029
ucucuuccuucuccu

SEQ ID NO: 491584 - RNA, 19 nt, Chlamydophila pneumoniae CWL029
ucucuucccuuguuaugaa

SEQ ID NO: 491585 - RNA, 22 nt, Chlamydophila pneumoniae CWL029
ucucuucaugaaaaaagaauaa

SEQ ID NO: 491586 - RNA, 17 nt, Chlamydophila pneumoniae CWL029
ucucuucacucuuuuau

SEQ ID NO: 491587 - RNA, 15 nt, Chlamydophila pneumoniae CWL029
ucucuguuuuuugaa

SEQ ID NO: 491588 - RNA, 16 nt, Chlamydophila pneumoniae CWL029
ucucuguuuuuugaaa

SEQ ID NO: 491589 - RNA, 13 nt, Chlamydophila pneumoniae CWL029
ucucuuaaaauau

SEQ ID NO: 491590 - RNA, 14 nt, Chlamydophila pneumoniae CWL029
ucucuuaaaauauu

SEQ ID NO: 491591 - RNA, 18 nt, Chlamydophila pneumoniae CWL029
ucucuuaaaauauuaaau

SEQ ID NO: 491592 - RNA, 17 nt, Chlamydophila pneumoniae CWL029
ucucucugccuaccaaa

SEQ ID NO: 491593 - RNA, 14 nt, Chlamydophila pneumoniae CWL029
ucucucucugcagc

SEQ ID NO: 491594 - RNA, 13 nt, Chlamydophila pneumoniae CWL029
ucucucuuuaaaa

SEQ ID NO: 491595 - RNA, 19 nt, Chlamydophila pneumoniae CWL029
ucucucgcauauucuuuug

SEQ ID NO: 491596 - RNA, 22 nt, Chlamydophila pneumoniae CWL029
ucucuccguccaguucuucauu

SEQ ID NO: 491597 - RNA, 18 nt, Chlamydophila pneumoniae CWL029
ucucucaagucuauuuga

SEQ ID NO: 491598 - RNA, 21 nt, Chlamydophila pneumoniae CWL029
ucucucaagucuauuugaaaa

SEQ ID NO: 491599 - RNA, 22 nt, Chlamydophila pneumoniae CWL029
ucucuaugaacgauuucuuuua

SEQ ID NO: 491600 - RNA, 21 nt, Chlamydophila pneumoniae CWL029
ucucuaugcacaaaauaaaac

SEQ ID NO: 491601 - RNA, 22 nt, Chlamydophila pneumoniae CWL029
ucucugaucccucaaaaucaca

SEQ ID NO: 491602 - RNA, 18 nt, Chlamydophila pneumoniae CWL029
ucucugcaacgcaguuua

SEQ ID NO: 491603 - RNA, 17 nt, Chlamydophila pneumoniae CWL029
ucucugcauauugcucu

SEQ ID NO: 491604 - RNA, 19 nt, Chlamydophila pneumoniae CWL029
ucucugcccccuguuugaa

SEQ ID NO: 491605 - RNA, 15 nt, Chlamydophila pneumoniae CWL029
ucucuggaauacauu

SEQ ID NO: 491606 - RNA, 15 nt, Chlamydophila pneumoniae CWL029
ucugaagagagaaua

SEQ ID NO: 491607 - RNA, 22 nt, Chlamydophila pneumoniae CWL029
ucugaagauauauuuuuaaaga

SEQ ID NO: 491608 - RNA, 15 nt, Chlamydophila pneumoniae CWL029
ucugaagauuuuuua

SEQ ID NO: 491609 - RNA, 19 nt, Chlamydophila pneumoniae CWL029
ucucuuugacaucuaauuu

SEQ ID NO: 491610 - RNA, 19 nt, Chlamydophila pneumoniae CWL029
ucucuuugacggauaggau

SEQ ID NO: 491611 - RNA, 23 nt, Chlamydophila pneumoniae CWL029
ucucuuucgaugcuauuuuucca

SEQ ID NO: 491612 - RNA, 19 nt, Chlamydophila pneumoniae CWL029
ucugacgucuccaacaguc

SEQ ID NO: 491613 - RNA, 23 nt, Chlamydophila pneumoniae CWL029
ucugcaaacgcaaugauuucucu

SEQ ID NO: 491614 - RNA, 15 nt, Chlamydophila pneumoniae CWL029
ucugaugcaccauaa

SEQ ID NO: 491615 - RNA, 21 nt, Chlamydophila pneumoniae CWL029
ucugaucguacaggacuguuu

SEQ ID NO: 491616 - RNA, 17 nt, Chlamydophila pneumoniae CWL029
ucugaucccucaaaauc

SEQ ID NO: 491617 - RNA, 15 nt, Chlamydophila pneumoniae CWL029
ucugaucguacagga

SEQ ID NO: 491618 - RNA, 20 nt, Chlamydophila pneumoniae CWL029
ucguuuuugauaguagacau

SEQ ID NO: 491619 - RNA, 19 nt, Chlamydophila pneumoniae CWL029
ucguuuuuucuuaucugcu

SEQ ID NO: 491620 - RNA, 14 nt, Chlamydophila pneumoniae CWL029
ucguuagagaagag

SEQ ID NO: 491621 - RNA, 19 nt, Chlamydophila pneumoniae CWL029
ucguuaugaagcuucuuua

SEQ ID NO: 491622 - RNA, 19 nt, Chlamydophila pneumoniae CWL029
ucgugagcgaguaccucau

SEQ ID NO: 491623 - RNA, 21 nt, Chlamydophila pneumoniae CWL029
ucuaagcagccucuucucuac

SEQ ID NO: 491624 - RNA, 16 nt, Chlamydophila pneumoniae CWL029
ucuaagacuucuggaa

SEQ ID NO: 491625 - RNA, 21 nt, Chlamydophila pneumoniae CWL029
ucuaagaaaggcacuccaaaa

SEQ ID NO: 491626 - RNA, 14 nt, Chlamydophila pneumoniae CWL029
ucuaagauauagag

SEQ ID NO: 491627 - RNA, 18 nt, Chlamydophila pneumoniae CWL029
ucuaaauggaugaucucc

SEQ ID NO: 491628 - RNA, 18 nt, Chlamydophila pneumoniae CWL029
ucuaaaaaugcacuuuga

SEQ ID NO: 491629 - RNA, 16 nt, Chlamydophila pneumoniae CWL029
ucuaaagguuuuaaau

SEQ ID NO: 491630 - RNA, 22 nt, Chlamydophila pneumoniae CWL029
ucuaaagguuuuaaauuuagag

SEQ ID NO: 491631 - RNA, 21 nt, Chlamydophila pneumoniae CWL029
ucuaaaggaagauauccuuuu

SEQ ID NO: 491632 - RNA, 14 nt, Chlamydophila pneumoniae CWL029
ucuaaaaacucuuc

SEQ ID NO: 491633 - RNA, 17 nt, Chlamydophila pneumoniae CWL029
ucuacauagauccccuu

SEQ ID NO: 491634 - RNA, 17 nt, Chlamydophila pneumoniae CWL029
ucuacaguaguaaauaa

SEQ ID NO: 491635 - RNA, 20 nt, Chlamydophila pneumoniae CWL029
ucuacaaacagauuuuucaa

SEQ ID NO: 491636 - RNA, 20 nt, Chlamydophila pneumoniae CWL029
ucuaauuugaugaucgaucc

SEQ ID NO: 491637 - RNA, 20 nt, Chlamydophila pneumoniae CWL029
ucuaauuucaggagcuccug

SEQ ID NO: 491638 - RNA, 22 nt, Chlamydophila pneumoniae CWL029
ucuaauuucaggagcuccugcg

SEQ ID NO: 491639 - RNA, 16 nt, Chlamydophila pneumoniae CWL029
ucuacaaaaacuagaa

SEQ ID NO: 491640 - RNA, 16 nt, Chlamydophila pneumoniae CWL029
ucuaaguccaacauca

SEQ ID NO: 491641 - RNA, 16 nt, Chlamydophila pneumoniae CWL029
ucuaaggcuuugccuu

SEQ ID NO: 491642 - RNA, 21 nt, Chlamydophila pneumoniae CWL029
ucuaagcugaaagaacacucc

SEQ ID NO: 491643 - RNA, 20 nt, Chlamydophila pneumoniae CWL029
ucuaagcugugcauuuucuu

SEQ ID NO: 491644 - RNA, 19 nt, Chlamydophila pneumoniae CWL029
ucuaagcuuauuucuguag

SEQ ID NO: 491645 - RNA, 21 nt, Chlamydophila pneumoniae CWL029
ucgguaaccugugaaaauuuu

SEQ ID NO: 491646 - RNA, 22 nt, Chlamydophila pneumoniae CWL029
ucguaauccuucuuucugcucu

SEQ ID NO: 491647 - RNA, 18 nt, Chlamydophila pneumoniae CWL029
ucguauagguacgcuuuu

SEQ ID NO: 491648 - RNA, 19 nt, Chlamydophila pneumoniae CWL029
ucguaaucuuuuuuaaagc

SEQ ID NO: 491649 - RNA, 13 nt, Chlamydophila pneumoniae CWL029
ucgugaacaaaau

SEQ ID NO: 491650 - RNA, 16 nt, Chlamydophila pneumoniae CWL029
ucggggauugcaaaau

SEQ ID NO: 491651 - RNA, 13 nt, Chlamydophila pneumoniae CWL029
ucggaucuguaau

SEQ ID NO: 491652 - RNA, 15 nt, Chlamydophila pneumoniae CWL029
ucggaguuaucaaaa

SEQ ID NO: 491653 - RNA, 15 nt, Chlamydophila pneumoniae CWL029
ucggagauuguuuca

SEQ ID NO: 491654 - RNA, 14 nt, Chlamydophila pneumoniae CWL029
ucgcuugugcaugc

SEQ ID NO: 491655 - RNA, 20 nt, Chlamydophila pneumoniae CWL029
ucgcuugugcaugcaucuua

SEQ ID NO: 491656 - RNA, 15 nt, Chlamydophila pneumoniae CWL029
ucgcuuaacaaacuu

SEQ ID NO: 491657 - RNA, 14 nt, Chlamydophila pneumoniae CWL029
ucgcuuuugcuaga

SEQ ID NO: 491658 - RNA, 13 nt, Chlamydophila pneumoniae CWL029
ucggagaccaaaa

SEQ ID NO: 491659 - RNA, 18 nt, Chlamydophila pneumoniae CWL029
ucgcuguaaauucaguga

SEQ ID NO: 491660 - RNA, 20 nt, Chlamydophila pneumoniae CWL029
ucggaucuuuucuuucuaag

SEQ ID NO: 491661 - RNA, 14 nt, Chlamydophila pneumoniae CWL029
ucgcaguaaugcca

SEQ ID NO: 491662 - RNA, 23 nt, Chlamydophila pneumoniae CWL029
ucgcaaauuuuucgagaauauac

SEQ ID NO: 491663 - RNA, 19 nt, Chlamydophila pneumoniae CWL029
ucgcacacuccauuucagc

SEQ ID NO: 491664 - RNA, 13 nt, Chlamydophila pneumoniae CWL029
ucgaucaaggugu

SEQ ID NO: 491665 - RNA, 19 nt, Chlamydophila pneumoniae CWL029
ucgauaacacuucuuucuu

SEQ ID NO: 491666 - RNA, 20 nt, Chlamydophila pneumoniae CWL029
ucgauaacacuucuuucuug

SEQ ID NO: 491667 - RNA, 17 nt, Chlamydophila pneumoniae CWL029
ucgaguauggcaaauaa

SEQ ID NO: 491668 - RNA, 16 nt, Chlamydophila pneumoniae CWL029
ucgacaaccaaaacag

SEQ ID NO: 491669 - RNA, 18 nt, Chlamydophila pneumoniae CWL029
ucgaauagcucuggagau

SEQ ID NO: 491670 - RNA, 23 nt, Chlamydophila pneumoniae CWL029
ucgaauccgauagaucacaucaa

SEQ ID NO: 491671 - RNA, 17 nt, Chlamydophila pneumoniae CWL029
ucgacaacaacauaaag

SEQ ID NO: 491672 - RNA, 12 nt, Chlamydophila pneumoniae CWL029
ucgacagcagca

SEQ ID NO: 491673 - RNA, 21 nt, Chlamydophila pneumoniae CWL029
ucgacacuauguguuuccuuu

SEQ ID NO: 491674 - RNA, 13 nt, Chlamydophila pneumoniae CWL029
ucgacagcagcau

SEQ ID NO: 491675 - RNA, 22 nt, Chlamydophila pneumoniae CWL029
ucgaaguugauuguagagacau

SEQ ID NO: 491676 - RNA, 17 nt, Chlamydophila pneumoniae CWL029
ucgaaauccuaaaaagg

SEQ ID NO: 491677 - RNA, 22 nt, Chlamydophila pneumoniae CWL029
ucgaaagaucagaggaaucuaa

SEQ ID NO: 491678 - RNA, 17 nt, Chlamydophila pneumoniae CWL029
ucgaaacucuuugagga

SEQ ID NO: 491679 - RNA, 18 nt, Chlamydophila pneumoniae CWL029
ucgaaaccacagcaaaga

SEQ ID NO: 491680 - RNA, 16 nt, Chlamydophila pneumoniae CWL029
ucgaaacacucaugaa

SEQ ID NO: 491681 - RNA, 14 nt, Chlamydophila pneumoniae CWL029
uccuuuaaauaaaa

SEQ ID NO: 491682 - RNA, 12 nt, Chlamydophila pneumoniae CWL029
uccuuguagaac

SEQ ID NO: 491683 - RNA, 19 nt, Chlamydophila pneumoniae CWL029
uccuuguacuguauagaaa

SEQ ID NO: 491684 - RNA, 17 nt, Chlamydophila pneumoniae CWL029
uccuuuguauucagugu

SEQ ID NO: 491685 - RNA, 20 nt, Chlamydophila pneumoniae CWL029
uccuuucuuuugcuuuuccc

SEQ ID NO: 491686 - RNA, 19 nt, Chlamydophila pneumoniae CWL029
uccuuugagucuuuuucag

SEQ ID NO: 491687 - RNA, 22 nt, Chlamydophila pneumoniae CWL029
uccuuugagucuuuuucagaaa

SEQ ID NO: 491688 - RNA, 15 nt, Chlamydophila pneumoniae CWL029
uccuuucuccagcau

SEQ ID NO: 491689 - RNA, 20 nt, Chlamydophila pneumoniae CWL029
uccuucucccucuaaacaua

SEQ ID NO: 491690 - RNA, 16 nt, Chlamydophila pneumoniae CWL029
uccuucuauagcaaga

SEQ ID NO: 491691 - RNA, 20 nt, Chlamydophila pneumoniae CWL029
uccuucuacagauugaugcu

SEQ ID NO: 491692 - RNA, 12 nt, Chlamydophila pneumoniae CWL029
uccuucuugcaa

SEQ ID NO: 491693 - RNA, 15 nt, Chlamydophila pneumoniae CWL029
uccuucuuucugcuc

SEQ ID NO: 491694 - RNA, 12 nt, Chlamydophila pneumoniae CWL029
uccuucuucuuc

SEQ ID NO: 491695 - RNA, 14 nt, Chlamydophila pneumoniae CWL029
uccuucuucuucaa

SEQ ID NO: 491696 - RNA, 13 nt, Chlamydophila pneumoniae CWL029
uccuucuguuuuc

SEQ ID NO: 491697 - RNA, 20 nt, Chlamydophila pneumoniae CWL029
uccuucugcaaucagugcug

SEQ ID NO: 491698 - RNA, 15 nt, Chlamydophila pneumoniae CWL029
uccuucuggagugac

SEQ ID NO: 491699 - RNA, 20 nt, Chlamydophila pneumoniae CWL029
uccuucuggagugacaccaa

SEQ ID NO: 491700 - RNA, 19 nt, Chlamydophila pneumoniae CWL029
uccuugacaaauaaguccu

SEQ ID NO: 491701 - RNA, 20 nt, Chlamydophila pneumoniae CWL029
uccuugaacuaacugagcaa

SEQ ID NO: 491702 - RNA, 17 nt, Chlamydophila pneumoniae CWL029
uccuugagggcuaucca

SEQ ID NO: 491703 - RNA, 20 nt, Chlamydophila pneumoniae CWL029
uccuugagggcuauccacaa

SEQ ID NO: 491704 - RNA, 19 nt, Chlamydophila pneumoniae CWL029
uccuugcaaaacagcauca

SEQ ID NO: 491705 - RNA, 17 nt, Chlamydophila pneumoniae CWL029
uccuuauuucaaagaag

SEQ ID NO: 491706 - RNA, 14 nt, Chlamydophila pneumoniae CWL029
uccuucaacacacc

SEQ ID NO: 491707 - RNA, 20 nt, Chlamydophila pneumoniae CWL029
uccuuaggggcguugagcaa

SEQ ID NO: 491708 - RNA, 22 nt, Chlamydophila pneumoniae CWL029
uccuuagcauuaggaaaguacc

SEQ ID NO: 491709 - RNA, 19 nt, Chlamydophila pneumoniae CWL029
uccuuaccuauauagcccu

SEQ ID NO: 491710 - RNA, 21 nt, Chlamydophila pneumoniae CWL029
uccuuaaugagaguuucuaau

SEQ ID NO: 491711 - RNA, 19 nt, Chlamydophila pneumoniae CWL029
uccuucaggauuuuccauu

SEQ ID NO: 491712 - RNA, 21 nt, Chlamydophila pneumoniae CWL029
uccuucauacguuuuuuuccu

SEQ ID NO: 491713 - RNA, 17 nt, Chlamydophila pneumoniae CWL029
uccuucauucacagcag

SEQ ID NO: 491714 - RNA, 17 nt, Chlamydophila pneumoniae CWL029
uccuuccuuaagggaag

SEQ ID NO: 491715 - RNA, 24 nt, Chlamydophila pneumoniae CWL029
uccuucgaccuauuugcaacaauc

SEQ ID NO: 491716 - RNA, 23 nt, Chlamydophila pneumoniae CWL029
uccugucuauuucuuaauuuccu

SEQ ID NO: 491717 - RNA, 20 nt, Chlamydophila pneumoniae CWL029
uccuguacaucgguguugca

SEQ ID NO: 491718 - RNA, 17 nt, Chlamydophila pneumoniae CWL029
uccuggaacaguauaau

SEQ ID NO: 491719 - RNA, 16 nt, Chlamydophila pneumoniae CWL029
uccuggagcaugagag

SEQ ID NO: 491720 - RNA, 22 nt, Chlamydophila pneumoniae CWL029
uccuggaagaauuucauaagag

SEQ ID NO: 491721 - RNA, 19 nt, Chlamydophila pneumoniae CWL029
uccugcuucuauagagaca

SEQ ID NO: 491722 - RNA, 11 nt, Chlamydophila pneumoniae CWL029
uccugcugcuu

SEQ ID NO: 491723 - RNA, 13 nt, Chlamydophila pneumoniae CWL029
uccugcagcagcc

SEQ ID NO: 491724 - RNA, 13 nt, Chlamydophila pneumoniae CWL029
uccugcauggcuu

SEQ ID NO: 491725 - RNA, 21 nt, Chlamydophila pneumoniae CWL029
uccugcagggggcauucccug

SEQ ID NO: 491726 - RNA, 19 nt, Chlamydophila pneumoniae CWL029
ugaaguugagucgauuucc

SEQ ID NO: 491727 - RNA, 22 nt, Chlamydophila pneumoniae CWL029
ugaaguugagucgauuucccag

SEQ ID NO: 491728 - RNA, 22 nt, Chlamydophila pneumoniae CWL029
ugaaguuuuuucucucuuuauc

SEQ ID NO: 491729 - RNA, 21 nt, Chlamydophila pneumoniae CWL029
ugaaguacauuaucacagcaa

SEQ ID NO: 491730 - RNA, 16 nt, Chlamydophila pneumoniae CWL029
ugaaguacauuaucac

SEQ ID NO: 491731 - RNA, 16 nt, Chlamydophila pneumoniae CWL029
ugaagucguuuagauu

SEQ ID NO: 491732 - RNA, 14 nt, Chlamydophila pneumoniae CWL029
ugaagucuucuugc

SEQ ID NO: 491733 - RNA, 13 nt, Chlamydophila pneumoniae CWL029
ugaauauaauucc

SEQ ID NO: 491734 - RNA, 23 nt, Chlamydophila pneumoniae CWL029
ugaauaguugugagacuuucuga

SEQ ID NO: 491735 - RNA, 18 nt, Chlamydophila pneumoniae CWL029
ugaauagcucuuuucaug

SEQ ID NO: 491736 - RNA, 21 nt, Chlamydophila pneumoniae CWL029
ugaauccuugaaagacucgcu

SEQ ID NO: 491737 - RNA, 22 nt, Chlamydophila pneumoniae CWL029
ugaaucgaagaacagaggaucu

SEQ ID NO: 491738 - RNA, 14 nt, Chlamydophila pneumoniae CWL029
ugaauccuucuaua

SEQ ID NO: 491739 - RNA, 17 nt, Chlamydophila pneumoniae CWL029
ugaauggcucugucacu

SEQ ID NO: 491740 - RNA, 19 nt, Chlamydophila pneumoniae CWL029
ugaauuagggcuuuuacuc

SEQ ID NO: 491741 - RNA, 23 nt, Chlamydophila pneumoniae CWL029
ugaauuacaggcccuaggacgua

SEQ ID NO: 491742 - RNA, 15 nt, Chlamydophila pneumoniae CWL029
ugaauuaauaaaaga

SEQ ID NO: 491743 - RNA, 16 nt, Chlamydophila pneumoniae CWL029
ugaauuaauaaaagag

SEQ ID NO: 491744 - RNA, 19 nt, Chlamydophila pneumoniae CWL029
ugaauuaauaaaagagcuc

SEQ ID NO: 491745 - RNA, 22 nt, Chlamydophila pneumoniae CWL029
ugaaggaucauaccgacaagca

SEQ ID NO: 491746 - RNA, 13 nt, Chlamydophila pneumoniae CWL029
ugaagcuucuuua

SEQ ID NO: 491747 - RNA, 13 nt, Chlamydophila pneumoniae CWL029
ugaagcuccucac

SEQ ID NO: 491748 - RNA, 19 nt, Chlamydophila pneumoniae CWL029
ugaagaucuccgaagacua

SEQ ID NO: 491749 - RNA, 18 nt, Chlamydophila pneumoniae CWL029
ugaagauggcaaggaaaa

SEQ ID NO: 491750 - RNA, 23 nt, Chlamydophila pneumoniae CWL029
ugaagagucaaacuuauacacuc

SEQ ID NO: 491751 - RNA, 14 nt, Chlamydophila pneumoniae CWL029
ugaagcagaaacuu

SEQ ID NO: 491752 - RNA, 20 nt, Chlamydophila pneumoniae CWL029
ugaagcagaggguuccaaga

SEQ ID NO: 491753 - RNA, 18 nt, Chlamydophila pneumoniae CWL029
ugaagcagggaaaaugcg

SEQ ID NO: 491754 - RNA, 19 nt, Chlamydophila pneumoniae CWL029
ugaagcagggaaaaugcga

SEQ ID NO: 491755 - RNA, 17 nt, Chlamydophila pneumoniae CWL029
ugaagcagcuucugcag

SEQ ID NO: 491756 - RNA, 23 nt, Chlamydophila pneumoniae CWL029
ugaagccaaaaggcacaacaaug

SEQ ID NO: 491757 - RNA, 15 nt, Chlamydophila pneumoniae CWL029
ugaacuaacugagca

SEQ ID NO: 491758 - RNA, 22 nt, Chlamydophila pneumoniae CWL029
ugaacuccaggguguuugcaua

SEQ ID NO: 491759 - RNA, 13 nt, Chlamydophila pneumoniae CWL029
ugaacggcucuuu

SEQ ID NO: 491760 - RNA, 18 nt, Chlamydophila pneumoniae CWL029
ugaagagugguuccugaa

SEQ ID NO: 491761 - RNA, 19 nt, Chlamydophila pneumoniae CWL029
ugaagacguucgacaacaa

SEQ ID NO: 491762 - RNA, 18 nt, Chlamydophila pneumoniae CWL029
ugaagaaguacaagugaa

SEQ ID NO: 491763 - RNA, 22 nt, Chlamydophila pneumoniae CWL029
ugaagacaaguaaacagcaaag

SEQ ID NO: 491764 - RNA, 19 nt, Chlamydophila pneumoniae CWL029
ugacucuuuuaagacaaua

SEQ ID NO: 491765 - RNA, 13 nt, Chlamydophila pneumoniae CWL029
ugacuauaaaaug

SEQ ID NO: 491766 - RNA, 12 nt, Chlamydophila pneumoniae CWL029
ugacgugcauug

SEQ ID NO: 491767 - RNA, 21 nt, Chlamydophila pneumoniae CWL029
ugacgugcauugaauccuucu

SEQ ID NO: 491768 - RNA, 18 nt, Chlamydophila pneumoniae CWL029
ugacgucuccaacagucu

SEQ ID NO: 491769 - RNA, 22 nt, Chlamydophila pneumoniae CWL029
ugacguugcgaacagcuccugg

SEQ ID NO: 491770 - RNA, 14 nt, Chlamydophila pneumoniae CWL029
ugacguaaugcaga

SEQ ID NO: 491771 - RNA, 21 nt, Chlamydophila pneumoniae CWL029
ugagaauuuucaugauauuuu

SEQ ID NO: 491772 - RNA, 13 nt, Chlamydophila pneumoniae CWL029
ugagaaauauaaa

SEQ ID NO: 491773 - RNA, 13 nt, Chlamydophila pneumoniae CWL029
ugacuucccgaag

SEQ ID NO: 491774 - RNA, 15 nt, Chlamydophila pneumoniae CWL029
ugacuuccuccaaaa

SEQ ID NO: 491775 - RNA, 15 nt, Chlamydophila pneumoniae CWL029
ugagaaagaaguccu

SEQ ID NO: 491776 - RNA, 11 nt, Chlamydophila pneumoniae CWL029
ugagaaagacc

SEQ ID NO: 491777 - RNA, 17 nt, Chlamydophila pneumoniae CWL029
ugagaaagaccaccuuc

SEQ ID NO: 491778 - RNA, 18 nt, Chlamydophila pneumoniae CWL029
ugagaaagaccaccuucc

SEQ ID NO: 491779 - RNA, 19 nt, Chlamydophila pneumoniae CWL029
ugagagcguuguggaagua

SEQ ID NO: 491780 - RNA, 19 nt, Chlamydophila pneumoniae CWL029
ugagagucaggaagaugcu

SEQ ID NO: 491781 - RNA, 22 nt, Chlamydophila pneumoniae CWL029
ugagaguguuguuggagcagaa

SEQ ID NO: 491782 - RNA, 19 nt, Chlamydophila pneumoniae CWL029
ugagagauuuuuucauacu

SEQ ID NO: 491783 - RNA, 13 nt, Chlamydophila pneumoniae CWL029
ugagcaacaagcu

SEQ ID NO: 491784 - RNA, 20 nt, Chlamydophila pneumoniae CWL029
ugaccuucucaagaucuuca

SEQ ID NO: 491785 - RNA, 22 nt, Chlamydophila pneumoniae CWL029
ugacgcaagagacaagaaaaua

SEQ ID NO: 491786 - RNA, 21 nt, Chlamydophila pneumoniae CWL029
ugacgcaagagacaagaaaau

SEQ ID NO: 491787 - RNA, 15 nt, Chlamydophila pneumoniae CWL029
ugacgcgcuucuuca

SEQ ID NO: 491788 - RNA, 19 nt, Chlamydophila pneumoniae CWL029
ugacgcgcuucuucaagaa

SEQ ID NO: 491789 - RNA, 22 nt, Chlamydophila pneumoniae CWL029
ugacgcgcuucuucaagaaaug

SEQ ID NO: 491790 - RNA, 17 nt, Chlamydophila pneumoniae CWL029
ugacacagagaacaaua

SEQ ID NO: 491791 - RNA, 11 nt, Chlamydophila pneumoniae CWL029
ugacacagaga

SEQ ID NO: 491792 - RNA, 20 nt, Chlamydophila pneumoniae CWL029
ugcacguuugacaaauuuau

SEQ ID NO: 491793 - RNA, 23 nt, Chlamydophila pneumoniae CWL029
ugcaagauuaucuuuacgaauca

SEQ ID NO: 491794 - RNA, 14 nt, Chlamydophila pneumoniae CWL029
ugcaagcaacucuu

SEQ ID NO: 491795 - RNA, 16 nt, Chlamydophila pneumoniae CWL029
ugcaauagcaauggcu

SEQ ID NO: 491796 - RNA, 12 nt, Chlamydophila pneumoniae CWL029
ugcaacaaaagg

SEQ ID NO: 491797 - RNA, 19 nt, Chlamydophila pneumoniae CWL029
ugcaacagagucagaagcu

SEQ ID NO: 491798 - RNA, 15 nt, Chlamydophila pneumoniae CWL029
ugauugaaaccguaa

SEQ ID NO: 491799 - RNA, 23 nt, Chlamydophila pneumoniae CWL029
ugauugaaacuuuuuuucuucuc

SEQ ID NO: 491800 - RNA, 22 nt, Chlamydophila pneumoniae CWL029
ugauugaaguucagacgugcuc

SEQ ID NO: 491801 - RNA, 23 nt, Chlamydophila pneumoniae CWL029
ugauucccggaggcaaagaucag

SEQ ID NO: 491802 - RNA, 15 nt, Chlamydophila pneumoniae CWL029
ugauucccuccuucc

SEQ ID NO: 491803 - RNA, 15 nt, Chlamydophila pneumoniae CWL029
ugauuccgcaaguaa

SEQ ID NO: 491804 - RNA, 17 nt, Chlamydophila pneumoniae CWL029
ugauucauaaagaggaa

SEQ ID NO: 491805 - RNA, 18 nt, Chlamydophila pneumoniae CWL029
ugauuagagccccaaccc

SEQ ID NO: 491806 - RNA, 13 nt, Chlamydophila pneumoniae CWL029
ugauuaggaacaa

SEQ ID NO: 491807 - RNA, 19 nt, Chlamydophila pneumoniae CWL029
ugauuaggcuucagagauu

SEQ ID NO: 491808 - RNA, 17 nt, Chlamydophila pneumoniae CWL029
ugauuaguucucuaaga

SEQ ID NO: 491809 - RNA, 20 nt, Chlamydophila pneumoniae CWL029
ugauuacagcaucuauagaa

SEQ ID NO: 491810 - RNA, 15 nt, Chlamydophila pneumoniae CWL029
ugaugccuuuuucuu

SEQ ID NO: 491811 - RNA, 14 nt, Chlamydophila pneumoniae CWL029
ugcaaauaagccag

SEQ ID NO: 491812 - RNA, 19 nt, Chlamydophila pneumoniae CWL029
ugcaaauaagccaguacua

SEQ ID NO: 491813 - RNA, 16 nt, Chlamydophila pneumoniae CWL029
ugcaaaugaaaagaga

SEQ ID NO: 491814 - RNA, 18 nt, Chlamydophila pneumoniae CWL029
ugcaaaugaagggauggg

SEQ ID NO: 491815 - RNA, 12 nt, Chlamydophila pneumoniae CWL029
ugcaaaauuuaa

SEQ ID NO: 491816 - RNA, 18 nt, Chlamydophila pneumoniae CWL029
ugcaaacacaauuguaaa

SEQ ID NO: 491817 - RNA, 15 nt, Chlamydophila pneumoniae CWL029
ugauuguauagcuua

SEQ ID NO: 491818 - RNA, 12 nt, Chlamydophila pneumoniae CWL029
ugauuguagaga

SEQ ID NO: 491819 - RNA, 20 nt, Chlamydophila pneumoniae CWL029
ugauuggaugauagcuauga

SEQ ID NO: 491820 - RNA, 16 nt, Chlamydophila pneumoniae CWL029
ugaucucuucaugaaa

SEQ ID NO: 491821 - RNA, 21 nt, Chlamydophila pneumoniae CWL029
ugaucugaaguugaaaugagu

SEQ ID NO: 491822 - RNA, 18 nt, Chlamydophila pneumoniae CWL029
ugaucuugcucaggagau

SEQ ID NO: 491823 - RNA, 21 nt, Chlamydophila pneumoniae CWL029
ugaucaaaaaugauaccaccu

SEQ ID NO: 491824 - RNA, 17 nt, Chlamydophila pneumoniae CWL029
ugaucaaaauuauccag

SEQ ID NO: 491825 - RNA, 12 nt, Chlamydophila pneumoniae CWL029
ugaucaaagaac

SEQ ID NO: 491826 - RNA, 20 nt, Chlamydophila pneumoniae CWL029
ugaucaagaggagugaaagc

SEQ ID NO: 491827 - RNA, 13 nt, Chlamydophila pneumoniae CWL029
ugaucaggagucu

SEQ ID NO: 491828 - RNA, 22 nt, Chlamydophila pneumoniae CWL029
ugauagaggaaguguuucuuug

SEQ ID NO: 491829 - RNA, 15 nt, Chlamydophila pneumoniae CWL029
ugauacuguuuuuua

SEQ ID NO: 491830 - RNA, 17 nt, Chlamydophila pneumoniae CWL029
ugauacgugcagugaau

SEQ ID NO: 491831 - RNA, 17 nt, Chlamydophila pneumoniae CWL029
ugauaccaccuaaaaug

SEQ ID NO: 491832 - RNA, 14 nt, Chlamydophila pneumoniae CWL029
ugauaacuuugcau

SEQ ID NO: 491833 - RNA, 22 nt, Chlamydophila pneumoniae CWL029
ugauaaggaagaauuucgucuu

SEQ ID NO: 491834 - RNA, 21 nt, Chlamydophila pneumoniae CWL029
ugaguuuacuaacucuguaau

SEQ ID NO: 491835 - RNA, 23 nt, Chlamydophila pneumoniae CWL029
ugaguucuuccuucuucuucaaa

SEQ ID NO: 491836 - RNA, 21 nt, Chlamydophila pneumoniae CWL029
ugaguucuuuuguuugucuuc

SEQ ID NO: 491837 - RNA, 14 nt, Chlamydophila pneumoniae CWL029
ugaguucuuccuuc

SEQ ID NO: 491838 - RNA, 16 nt, Chlamydophila pneumoniae CWL029
ugagucugaacauucu

SEQ ID NO: 491839 - RNA, 21 nt, Chlamydophila pneumoniae CWL029
ugagucgcgaccgaaaguccc

SEQ ID NO: 491840 - RNA, 10 nt, Chlamydophila pneumoniae CWL029
ugagucgaca

SEQ ID NO: 491841 - RNA, 14 nt, Chlamydophila pneumoniae CWL029
ugagcauccaaaau

SEQ ID NO: 491842 - RNA, 10 nt, Chlamydophila pneumoniae CWL029
ugcuuuuccc

SEQ ID NO: 491843 - RNA, 12 nt, Chlamydophila pneumoniae CWL029
ugcuuuucaaau

SEQ ID NO: 491844 - RNA, 15 nt, Chlamydophila pneumoniae CWL029
ugcuuuaauccugca

SEQ ID NO: 491845 - RNA, 20 nt, Chlamydophila pneumoniae CWL029
ugcuuuauggcucaacuuaa

SEQ ID NO: 491846 - RNA, 15 nt, Chlamydophila pneumoniae CWL029
ugcuugaauauuucc

SEQ ID NO: 491847 - RNA, 20 nt, Chlamydophila pneumoniae CWL029
ugcuuagcgaucucucuucc

SEQ ID NO: 491848 - RNA, 20 nt, Chlamydophila pneumoniae CWL029
ugcuguagauuguuagugag

SEQ ID NO: 491849 - RNA, 17 nt, Chlamydophila pneumoniae CWL029
ugcuguugauucaaugc

SEQ ID NO: 491850 - RNA, 13 nt, Chlamydophila pneumoniae CWL029
ugcuguuguaaua

SEQ ID NO: 491851 - RNA, 14 nt, Chlamydophila pneumoniae CWL029
ugcugcuucagaaa

SEQ ID NO: 491852 - RNA, 12 nt, Chlamydophila pneumoniae CWL029
ugcugcucucca

SEQ ID NO: 491853 - RNA, 18 nt, Chlamydophila pneumoniae CWL029
ugcugcucuccaaaggga

SEQ ID NO: 491854 - RNA, 23 nt, Chlamydophila pneumoniae CWL029
ugcugcagcaaaacuaggaaaag

SEQ ID NO: 491855 - RNA, 15 nt, Chlamydophila pneumoniae CWL029
ugcugccaugacaua

SEQ ID NO: 491856 - RNA, 18 nt, Chlamydophila pneumoniae CWL029
ugcugauuucuuuuucag

SEQ ID NO: 491857 - RNA, 21 nt, Chlamydophila pneumoniae CWL029
ugcugaggacgcagagaugcu

SEQ ID NO: 491858 - RNA, 20 nt, Chlamydophila pneumoniae CWL029
ugcugagggaucuucucuau

SEQ ID NO: 491859 - RNA, 22 nt, Chlamydophila pneumoniae CWL029
ugcugaaccuuugguagaaaga

SEQ ID NO: 491860 - RNA, 22 nt, Chlamydophila pneumoniae CWL029
ugcucuuuuaacuuaaagacuu

SEQ ID NO: 491861 - RNA, 14 nt, Chlamydophila pneumoniae CWL029
ugcucuuuugcaag

SEQ ID NO: 491862 - RNA, 14 nt, Chlamydophila pneumoniae CWL029
ugcuccuccaaaag

SEQ ID NO: 491863 - RNA, 15 nt, Chlamydophila pneumoniae CWL029
ugcuccucuucuucc

SEQ ID NO: 491864 - RNA, 15 nt, Chlamydophila pneumoniae CWL029
ugcucaguaaauauu

SEQ ID NO: 491865 - RNA, 20 nt, Chlamydophila pneumoniae CWL029
ugcggaccuuaagaugaggu

SEQ ID NO: 491866 - RNA, 23 nt, Chlamydophila pneumoniae CWL029
ugcggaugugccgugacuccaga

SEQ ID NO: 491867 - RNA, 18 nt, Chlamydophila pneumoniae CWL029
ugcgcuacacccaggaaa

SEQ ID NO: 491868 - RNA, 13 nt, Chlamydophila pneumoniae CWL029
ugcgcuagcucca

SEQ ID NO: 491869 - RNA, 14 nt, Chlamydophila pneumoniae CWL029
ugcggaacucauca

SEQ ID NO: 491870 - RNA, 16 nt, Chlamydophila pneumoniae CWL029
ugcggaaggcuaaaac

SEQ ID NO: 491871 - RNA, 15 nt, Chlamydophila pneumoniae CWL029
ugcgggcucaaagaa

SEQ ID NO: 491872 - RNA, 12 nt, Chlamydophila pneumoniae CWL029
ugccuucuucaa

SEQ ID NO: 491873 - RNA, 12 nt, Chlamydophila pneumoniae CWL029
ugccuucuuauc

SEQ ID NO: 491874 - RNA, 18 nt, Chlamydophila pneumoniae CWL029
ugccuucuuaucuucuaa

SEQ ID NO: 491875 - RNA, 13 nt, Chlamydophila pneumoniae CWL029
ugccuucuucuug

SEQ ID NO: 491876 - RNA, 14 nt, Chlamydophila pneumoniae CWL029
ugcgcccgagcuuc

SEQ ID NO: 491877 - RNA, 16 nt, Chlamydophila pneumoniae CWL029
ugcgcccgagcuucca

SEQ ID NO: 491878 - RNA, 18 nt, Chlamydophila pneumoniae CWL029
ugccucuuucauacuaaa

SEQ ID NO: 491879 - RNA, 13 nt, Chlamydophila pneumoniae CWL029
ugccugaaaacaa

SEQ ID NO: 491880 - RNA, 17 nt, Chlamydophila pneumoniae CWL029
ugccuaaagagauauag

SEQ ID NO: 491881 - RNA, 23 nt, Chlamydophila pneumoniae CWL029
ugccgugcucuuauguuaaaaau

SEQ ID NO: 491882 - RNA, 22 nt, Chlamydophila pneumoniae CWL029
ugccauugaucagaaucuaagu

SEQ ID NO: 491883 - RNA, 19 nt, Chlamydophila pneumoniae CWL029
ugcccuggauagcauacga

SEQ ID NO: 491884 - RNA, 20 nt, Chlamydophila pneumoniae CWL029
ugccaugaauccaugggauc

SEQ ID NO: 491885 - RNA, 16 nt, Chlamydophila pneumoniae CWL029
ugccaggcuuaaauau

SEQ ID NO: 491886 - RNA, 12 nt, Chlamydophila pneumoniae CWL029
ugccaaugugca

SEQ ID NO: 491887 - RNA, 16 nt, Chlamydophila pneumoniae CWL029
ugccaauuuuuguaga

SEQ ID NO: 491888 - RNA, 16 nt, Chlamydophila pneumoniae CWL029
ugccacaacucauccu

SEQ ID NO: 491889 - RNA, 22 nt, Chlamydophila pneumoniae CWL029
ugccacaacucauccuaaauua

SEQ ID NO: 491890 - RNA, 14 nt, Chlamydophila pneumoniae CWL029
ugccaaauaucucu

SEQ ID NO: 491891 - RNA, 21 nt, Chlamydophila pneumoniae CWL029
ugccaaaaguuuugaggauuu

SEQ ID NO: 491892 - RNA, 15 nt, Chlamydophila pneumoniae CWL029
ugcauuuucuucuug

SEQ ID NO: 491893 - RNA, 16 nt, Chlamydophila pneumoniae CWL029
ugcauuuucuucuugc

SEQ ID NO: 491894 - RNA, 18 nt, Chlamydophila pneumoniae CWL029
ugcauuuucuucuugcaa

SEQ ID NO: 491895 - RNA, 16 nt, Chlamydophila pneumoniae CWL029
ugcauggauccuucau

SEQ ID NO: 491896 - RNA, 17 nt, Chlamydophila pneumoniae CWL029
ugcaugauccuauuuuu

SEQ ID NO: 491897 - RNA, 17 nt, Chlamydophila pneumoniae CWL029
ugcaugcaucuuaucaa

SEQ ID NO: 491898 - RNA, 22 nt, Chlamydophila pneumoniae CWL029
ugcaugccuggccaucaucacc

SEQ ID NO: 491899 - RNA, 13 nt, Chlamydophila pneumoniae CWL029
ugcaugaggagac

SEQ ID NO: 491900 - RNA, 16 nt, Chlamydophila pneumoniae CWL029
ugcaugaaucucuucu

SEQ ID NO: 491901 - RNA, 17 nt, Chlamydophila pneumoniae CWL029
ugcaugaaucucuucug

SEQ ID NO: 491902 - RNA, 22 nt, Chlamydophila pneumoniae CWL029
ugcaucuugagguauuccuacc

SEQ ID NO: 491903 - RNA, 17 nt, Chlamydophila pneumoniae CWL029
ugcaugaauauagguua

SEQ ID NO: 491904 - RNA, 20 nt, Chlamydophila pneumoniae CWL029
ugcauuaagauaaacauuaa

SEQ ID NO: 491905 - RNA, 21 nt, Chlamydophila pneumoniae CWL029
ugcaucauuuucauagcagcu

SEQ ID NO: 491906 - RNA, 23 nt, Chlamydophila pneumoniae CWL029
ugcaucccccgcgccacaucaaa

SEQ ID NO: 491907 - RNA, 24 nt, Chlamydophila pneumoniae CWL029
ugcaucccaccgacaagaugguga

SEQ ID NO: 491908 - RNA, 18 nt, Chlamydophila pneumoniae CWL029
ugcaucccuggauuucuu

SEQ ID NO: 491909 - RNA, 20 nt, Chlamydophila pneumoniae CWL029
ugcaucccuggauuucuucu

SEQ ID NO: 491910 - RNA, 14 nt, Chlamydophila pneumoniae CWL029
ugcaucucugcaua

SEQ ID NO: 491911 - RNA, 17 nt, Chlamydophila pneumoniae CWL029
ugcaucucuuaaaacau

SEQ ID NO: 491912 - RNA, 18 nt, Chlamydophila pneumoniae CWL029
ugcaucuuauggaagaga

SEQ ID NO: 491913 - RNA, 23 nt, Chlamydophila pneumoniae CWL029
ugcauaguauggcauucuuuuuc

SEQ ID NO: 491914 - RNA, 16 nt, Chlamydophila pneumoniae CWL029
ugcauagaauaaagau

SEQ ID NO: 491915 - RNA, 13 nt, Chlamydophila pneumoniae CWL029
ugcauacccuucu

SEQ ID NO: 491916 - RNA, 20 nt, Chlamydophila pneumoniae CWL029
ugcauacccuucuucuucag

SEQ ID NO: 491917 - RNA, 17 nt, Chlamydophila pneumoniae CWL029
ugcauaauuuuucuuag

SEQ ID NO: 491918 - RNA, 23 nt, Chlamydophila pneumoniae CWL029
ugcauauugcucuuguauuccuu

SEQ ID NO: 491919 - RNA, 18 nt, Chlamydophila pneumoniae CWL029
ugcaguugcuguggcaua

SEQ ID NO: 491920 - RNA, 13 nt, Chlamydophila pneumoniae CWL029
uucaaagaagucg

SEQ ID NO: 491921 - RNA, 22 nt, Chlamydophila pneumoniae CWL029
uucaaagaagacacuguugcau

SEQ ID NO: 491922 - RNA, 18 nt, Chlamydophila pneumoniae CWL029
uucaaacuccuuuuaaaa

SEQ ID NO: 491923 - RNA, 12 nt, Chlamydophila pneumoniae CWL029
uucaaagauugc

SEQ ID NO: 491924 - RNA, 22 nt, Chlamydophila pneumoniae CWL029
uucaaagauauagauucaugaa

SEQ ID NO: 491925 - RNA, 17 nt, Chlamydophila pneumoniae CWL029
uucaaaauagaagccac

SEQ ID NO: 491926 - RNA, 16 nt, Chlamydophila pneumoniae CWL029
uucaacauguuaauaa

SEQ ID NO: 491927 - RNA, 22 nt, Chlamydophila pneumoniae CWL029
uucaacauguuaauaagcauau

SEQ ID NO: 491928 - RNA, 16 nt, Chlamydophila pneumoniae CWL029
uucaaccaaacgucag

SEQ ID NO: 491929 - RNA, 20 nt, Chlamydophila pneumoniae CWL029
uucaacaaaggcuccaaacg

SEQ ID NO: 491930 - RNA, 21 nt, Chlamydophila pneumoniae CWL029
uucaaauauugcgaacuuuug

SEQ ID NO: 491931 - RNA, 15 nt, Chlamydophila pneumoniae CWL029
uucaaaucaucaaaa

SEQ ID NO: 491932 - RNA, 18 nt, Chlamydophila pneumoniae CWL029
uucaaaucaucaaaaaga

SEQ ID NO: 491933 - RNA, 21 nt, Chlamydophila pneumoniae CWL029
uucaagauugugcucaauaca

SEQ ID NO: 491934 - RNA, 17 nt, Chlamydophila pneumoniae CWL029
uucaagaugauccgcau

SEQ ID NO: 491935 - RNA, 16 nt, Chlamydophila pneumoniae CWL029
uucaagcaaaucuccg

SEQ ID NO: 491936 - RNA, 21 nt, Chlamydophila pneumoniae CWL029
uucaacuuuguuaauagaaga

SEQ ID NO: 491937 - RNA, 23 nt, Chlamydophila pneumoniae CWL029
uucaacuuuguuaauagaagauc

SEQ ID NO: 491938 - RNA, 13 nt, Chlamydophila pneumoniae CWL029
uuauuauuaguua

SEQ ID NO: 491939 - RNA, 12 nt, Chlamydophila pneumoniae CWL029
uuauuacagaaa

SEQ ID NO: 491940 - RNA, 14 nt, Chlamydophila pneumoniae CWL029
uuauuauugaauaa

SEQ ID NO: 491941 - RNA, 21 nt, Chlamydophila pneumoniae CWL029
uuauucccuaagguagagucc

SEQ ID NO: 491942 - RNA, 16 nt, Chlamydophila pneumoniae CWL029
uuauugaauaagcuuu

SEQ ID NO: 491943 - RNA, 22 nt, Chlamydophila pneumoniae CWL029
uuauuuggacguacuaagauac

SEQ ID NO: 491944 - RNA, 22 nt, Chlamydophila pneumoniae CWL029
uuauuuguuucuuccauacagg

SEQ ID NO: 491945 - RNA, 15 nt, Chlamydophila pneumoniae CWL029
uuauuuuaaagucac

SEQ ID NO: 491946 - RNA, 18 nt, Chlamydophila pneumoniae CWL029
uuauuuuaaagucacuuu

SEQ ID NO: 491947 - RNA, 22 nt, Chlamydophila pneumoniae CWL029
uuauuuuaggaggaguauagca

SEQ ID NO: 491948 - RNA, 12 nt, Chlamydophila pneumoniae CWL029
uuauuuaaaauu

SEQ ID NO: 491949 - RNA, 14 nt, Chlamydophila pneumoniae CWL029
uuauccguggggac

SEQ ID NO: 491950 - RNA, 18 nt, Chlamydophila pneumoniae CWL029
uuaucccagauaaagaca

SEQ ID NO: 491951 - RNA, 17 nt, Chlamydophila pneumoniae CWL029
uuauccaccaagacuga

SEQ ID NO: 491952 - RNA, 21 nt, Chlamydophila pneumoniae CWL029
uuauccaccaagacugaauau

SEQ ID NO: 491953 - RNA, 19 nt, Chlamydophila pneumoniae CWL029
uuaucaugagaauuuucau

SEQ ID NO: 491954 - RNA, 23 nt, Chlamydophila pneumoniae CWL029
uuauaggaauaacaccaaaagaa

SEQ ID NO: 491955 - RNA, 17 nt, Chlamydophila pneumoniae CWL029
uuauauaccacuacuga

SEQ ID NO: 491956 - RNA, 15 nt, Chlamydophila pneumoniae CWL029
uuaucaaagugaacg

SEQ ID NO: 491957 - RNA, 15 nt, Chlamydophila pneumoniae CWL029
uuaucauagauguca

SEQ ID NO: 491958 - RNA, 22 nt, Chlamydophila pneumoniae CWL029
uuauagauagggccgugaagca

SEQ ID NO: 491959 - RNA, 14 nt, Chlamydophila pneumoniae CWL029
uuauacacuccaau

SEQ ID NO: 491960 - RNA, 22 nt, Chlamydophila pneumoniae CWL029
uuauaaacuucaaugaagaaaa

SEQ ID NO: 491961 - RNA, 13 nt, Chlamydophila pneumoniae CWL029
uuauaaacuucua

SEQ ID NO: 491962 - RNA, 15 nt, Chlamydophila pneumoniae CWL029
uuagagaaaucugca

SEQ ID NO: 491963 - RNA, 23 nt, Chlamydophila pneumoniae CWL029
uuagagaaauuuuuaauuuuucu

SEQ ID NO: 491964 - RNA, 14 nt, Chlamydophila pneumoniae CWL029
uuagaaucuuuucu

SEQ ID NO: 491965 - RNA, 16 nt, Chlamydophila pneumoniae CWL029
uuagaaucuuuucuag

SEQ ID NO: 491966 - RNA, 16 nt, Chlamydophila pneumoniae CWL029
uuagaguuuucuguag

SEQ ID NO: 491967 - RNA, 18 nt, Chlamydophila pneumoniae CWL029
uuaucuucuaaaacuuca

SEQ ID NO: 491968 - RNA, 18 nt, Chlamydophila pneumoniae CWL029
uuaucuuagggaaucucu

SEQ ID NO: 491969 - RNA, 15 nt, Chlamydophila pneumoniae CWL029
uuaucuguuaaaaac

SEQ ID NO: 491970 - RNA, 19 nt, Chlamydophila pneumoniae CWL029
uuaucugcguuucuuucug

SEQ ID NO: 491971 - RNA, 13 nt, Chlamydophila pneumoniae CWL029
uuaucucccaaga

SEQ ID NO: 491972 - RNA, 19 nt, Chlamydophila pneumoniae CWL029
uuaucuaagaauauggaca

SEQ ID NO: 491973 - RNA, 16 nt, Chlamydophila pneumoniae CWL029
uuaucuaagacuucug

SEQ ID NO: 491974 - RNA, 14 nt, Chlamydophila pneumoniae CWL029
uuaucuagcucuuc

SEQ ID NO: 491975 - RNA, 22 nt, Chlamydophila pneumoniae CWL029
uuaucucaaugcgauaaccacu

SEQ ID NO: 491976 - RNA, 22 nt, Chlamydophila pneumoniae CWL029
uuaucucccaagacgagaacau

SEQ ID NO: 491977 - RNA, 18 nt, Chlamydophila pneumoniae CWL029
uuaucgggggugccaaaa

SEQ ID NO: 491978 - RNA, 21 nt, Chlamydophila pneumoniae CWL029
uuauccugaacaucuccagca

SEQ ID NO: 491979 - RNA, 19 nt, Chlamydophila pneumoniae CWL029
uuauccuugaaauugcucu

SEQ ID NO: 491980 - RNA, 11 nt, Chlamydophila pneumoniae CWL029
uuauuaaaauc

SEQ ID NO: 491981 - RNA, 20 nt, Chlamydophila pneumoniae CWL029
uuauguuuucucgaagaaaa

SEQ ID NO: 491982 - RNA, 21 nt, Chlamydophila pneumoniae CWL029
uuauguuaaaaauaccaagau

SEQ ID NO: 491983 - RNA, 20 nt, Chlamydophila pneumoniae CWL029
uuauggaugcuaaauuuguc

SEQ ID NO: 491984 - RNA, 15 nt, Chlamydophila pneumoniae CWL029
uuaugaguuuuuaau

SEQ ID NO: 491985 - RNA, 20 nt, Chlamydophila pneumoniae CWL029
uuaugaguuuuuaauuuucu

SEQ ID NO: 491986 - RNA, 15 nt, Chlamydophila pneumoniae CWL029
uuaugaaaaucugcu

SEQ ID NO: 491987 - RNA, 23 nt, Chlamydophila pneumoniae CWL029
uuaauaagcauauuuaaauauaa

SEQ ID NO: 491988 - RNA, 19 nt, Chlamydophila pneumoniae CWL029
uuaauaagaaccucuaauu

SEQ ID NO: 491989 - RNA, 22 nt, Chlamydophila pneumoniae CWL029
uuaagcucuaaguccaacauca

SEQ ID NO: 491990 - RNA, 13 nt, Chlamydophila pneumoniae CWL029
uuaauaaaauuua

SEQ ID NO: 491991 - RNA, 16 nt, Chlamydophila pneumoniae CWL029
uuaagauaaacagcac

SEQ ID NO: 491992 - RNA, 20 nt, Chlamydophila pneumoniae CWL029
uuaagauaaacauuaaguga

SEQ ID NO: 491993 - RNA, 15 nt, Chlamydophila pneumoniae CWL029
uuaagauagacucuc

SEQ ID NO: 491994 - RNA, 21 nt, Chlamydophila pneumoniae CWL029
uuaagauagacucucacugag

SEQ ID NO: 491995 - RNA, 19 nt, Chlamydophila pneumoniae CWL029
uuaagauaucgaccuuaaa

SEQ ID NO: 491996 - RNA, 13 nt, Chlamydophila pneumoniae CWL029
uuaacguuucuuc

SEQ ID NO: 491997 - RNA, 14 nt, Chlamydophila pneumoniae CWL029
uuaaccucuuuucu

SEQ ID NO: 491998 - RNA, 19 nt, Chlamydophila pneumoniae CWL029
uuaaccgagcuuuuugcuu

SEQ ID NO: 491999 - RNA, 13 nt, Chlamydophila pneumoniae CWL029
uuaacaacaucac

SEQ ID NO: 492000 - RNA, 23 nt, Chlamydophila pneumoniae CWL029
uuaacaacuagguuauuaucaaa

SEQ ID NO: 492001 - RNA, 18 nt, Chlamydophila pneumoniae CWL029
uuaacaaguaccaagaaa

SEQ ID NO: 492002 - RNA, 16 nt, Chlamydophila pneumoniae CWL029
uuaaauguauugcaaa

SEQ ID NO: 492003 - RNA, 17 nt, Chlamydophila pneumoniae CWL029
uuaaauauaaauuuaua

SEQ ID NO: 492004 - RNA, 17 nt, Chlamydophila pneumoniae CWL029
uuaaauuuccaaagauc

SEQ ID NO: 492005 - RNA, 15 nt, Chlamydophila pneumoniae CWL029
uuaaaguaaaaaaua

SEQ ID NO: 492006 - RNA, 16 nt, Chlamydophila pneumoniae CWL029
uuaaagcuugagaaaa

SEQ ID NO: 492007 - RNA, 15 nt, Chlamydophila pneumoniae CWL029
uuaaagagaaucucc

SEQ ID NO: 492008 - RNA, 22 nt, Chlamydophila pneumoniae CWL029
uuaaaccuuuuuuuaaaaauau

SEQ ID NO: 492009 - RNA, 16 nt, Chlamydophila pneumoniae CWL029
uuaaacccuucaagca

SEQ ID NO: 492010 - RNA, 14 nt, Chlamydophila pneumoniae CWL029
uuaaacagaucuuu

SEQ ID NO: 492011 - RNA, 19 nt, Chlamydophila pneumoniae CWL029
uguugcggauuugcauuac

SEQ ID NO: 492012 - RNA, 20 nt, Chlamydophila pneumoniae CWL029
uguugcccuacaauuuccuu

SEQ ID NO: 492013 - RNA, 14 nt, Chlamydophila pneumoniae CWL029
uuaccaaaaacugg

SEQ ID NO: 492014 - RNA, 18 nt, Chlamydophila pneumoniae CWL029
uuacagccuauugcaggg

SEQ ID NO: 492015 - RNA, 18 nt, Chlamydophila pneumoniae CWL029
uuacagcaucuauagaau

SEQ ID NO: 492016 - RNA, 16 nt, Chlamydophila pneumoniae CWL029
uuacagaucugcauaa

SEQ ID NO: 492017 - RNA, 17 nt, Chlamydophila pneumoniae CWL029
uuaaugguagcuuaaga

SEQ ID NO: 492018 - RNA, 15 nt, Chlamydophila pneumoniae CWL029
uuaauacuuugccaa

SEQ ID NO: 492019 - RNA, 12 nt, Chlamydophila pneumoniae CWL029
uuacgcucucca

SEQ ID NO: 492020 - RNA, 19 nt, Chlamydophila pneumoniae CWL029
uuacuaaaggugaaaguac

SEQ ID NO: 492021 - RNA, 23 nt, Chlamydophila pneumoniae CWL029
uuacuaaagaaagagucucacuc

SEQ ID NO: 492022 - RNA, 14 nt, Chlamydophila pneumoniae CWL029
uuacgaugagguug

SEQ ID NO: 492023 - RNA, 19 nt, Chlamydophila pneumoniae CWL029
uuagaauccugaucuguag

SEQ ID NO: 492024 - RNA, 16 nt, Chlamydophila pneumoniae CWL029
uuagaaucuaagaucc

SEQ ID NO: 492025 - RNA, 21 nt, Chlamydophila pneumoniae CWL029
uuagaaucuuuucuagaaaac

SEQ ID NO: 492026 - RNA, 21 nt, Chlamydophila pneumoniae CWL029
uuagaauagaagauccucaaa

SEQ ID NO: 492027 - RNA, 15 nt, Chlamydophila pneumoniae CWL029
uuagaaaagauaaaa

SEQ ID NO: 492028 - RNA, 20 nt, Chlamydophila pneumoniae CWL029
uuagaagggaaaguaccuuu

SEQ ID NO: 492029 - RNA, 20 nt, Chlamydophila pneumoniae CWL029
uuacuuucuuuuagcuacuu

SEQ ID NO: 492030 - RNA, 14 nt, Chlamydophila pneumoniae CWL029
uuacuuucugauug

SEQ ID NO: 492031 - RNA, 17 nt, Chlamydophila pneumoniae CWL029
uuacugucugcaaagag

SEQ ID NO: 492032 - RNA, 18 nt, Chlamydophila pneumoniae CWL029
uuacugugguauacaucc

SEQ ID NO: 492033 - RNA, 21 nt, Chlamydophila pneumoniae CWL029
uuacugugguauacaucccau

SEQ ID NO: 492034 - RNA, 16 nt, Chlamydophila pneumoniae CWL029
uuacugaggaaaucgc

SEQ ID NO: 492035 - RNA, 18 nt, Chlamydophila pneumoniae CWL029
uuacugaggaaaucgcau

SEQ ID NO: 492036 - RNA, 16 nt, Chlamydophila pneumoniae CWL029
uuacuaggaaggaaau

SEQ ID NO: 492037 - RNA, 20 nt, Chlamydophila pneumoniae CWL029
uuacuaggaaggaaaucaca

SEQ ID NO: 492038 - RNA, 20 nt, Chlamydophila pneumoniae CWL029
uguucuucuucagucauucu

SEQ ID NO: 492039 - RNA, 13 nt, Chlamydophila pneumoniae CWL029
uguucuuccaacu

SEQ ID NO: 492040 - RNA, 16 nt, Chlamydophila pneumoniae CWL029
uguugauaauuacaga

SEQ ID NO: 492041 - RNA, 17 nt, Chlamydophila pneumoniae CWL029
uguugauccuucuuaug

SEQ ID NO: 492042 - RNA, 18 nt, Chlamydophila pneumoniae CWL029
uguugaucucuaaaugga

SEQ ID NO: 492043 - RNA, 21 nt, Chlamydophila pneumoniae CWL029
uguugauaaaagguauuucuc

SEQ ID NO: 492044 - RNA, 11 nt, Chlamydophila pneumoniae CWL029
uguucugcugc

SEQ ID NO: 492045 - RNA, 22 nt, Chlamydophila pneumoniae CWL029
uguguuauggaaaucaccagca

SEQ ID NO: 492046 - RNA, 14 nt, Chlamydophila pneumoniae CWL029
uguuaaucuaauuu

SEQ ID NO: 492047 - RNA, 22 nt, Chlamydophila pneumoniae CWL029
uguuagcaucgcuuaacaaacu

SEQ ID NO: 492048 - RNA, 18 nt, Chlamydophila pneumoniae CWL029
uguggaauaucaggacaa

SEQ ID NO: 492049 - RNA, 14 nt, Chlamydophila pneumoniae CWL029
ugugcuuuucucuu

SEQ ID NO: 492050 - RNA, 15 nt, Chlamydophila pneumoniae CWL029
ugugcuuuugguucu

SEQ ID NO: 492051 - RNA, 13 nt, Chlamydophila pneumoniae CWL029
uguguaaugagcu

SEQ ID NO: 492052 - RNA, 15 nt, Chlamydophila pneumoniae CWL029
ugugguuagaggaag

SEQ ID NO: 492053 - RNA, 16 nt, Chlamydophila pneumoniae CWL029
ugugcauuuucuucuu

SEQ ID NO: 492054 - RNA, 23 nt, Chlamydophila pneumoniae CWL029
ugugcauuuucuucuugcaaucu

SEQ ID NO: 492055 - RNA, 18 nt, Chlamydophila pneumoniae CWL029
ugugcugaagaccaugaa

SEQ ID NO: 492056 - RNA, 12 nt, Chlamydophila pneumoniae CWL029
ugucuuuuuaag

SEQ ID NO: 492057 - RNA, 15 nt, Chlamydophila pneumoniae CWL029
ugucuugcugauuuu

SEQ ID NO: 492058 - RNA, 20 nt, Chlamydophila pneumoniae CWL029
ugucugauuaguucucuaag

SEQ ID NO: 492059 - RNA, 13 nt, Chlamydophila pneumoniae CWL029
ugucuuaucuaaa

SEQ ID NO: 492060 - RNA, 19 nt, Chlamydophila pneumoniae CWL029
ugugauccuugcaaaacag

SEQ ID NO: 492061 - RNA, 20 nt, Chlamydophila pneumoniae CWL029
ugugauccuugcaaaacagc

SEQ ID NO: 492062 - RNA, 15 nt, Chlamydophila pneumoniae CWL029
ugugauguucugcug

SEQ ID NO: 492063 - RNA, 16 nt, Chlamydophila pneumoniae CWL029
ugugauguucugcugc

SEQ ID NO: 492064 - RNA, 14 nt, Chlamydophila pneumoniae CWL029
ugugauauucuugg

SEQ ID NO: 492065 - RNA, 18 nt, Chlamydophila pneumoniae CWL029
ugucgcuuuugcuagaga

SEQ ID NO: 492066 - RNA, 19 nt, Chlamydophila pneumoniae CWL029
ugucucugaagaccccucu

SEQ ID NO: 492067 - RNA, 21 nt, Chlamydophila pneumoniae CWL029
ugucuccaaauguucucucca

SEQ ID NO: 492068 - RNA, 23 nt, Chlamydophila pneumoniae CWL029
ugucucagcauuuuauccacugc

SEQ ID NO: 492069 - RNA, 23 nt, Chlamydophila pneumoniae CWL029
ugucuauuucuuaauuuccuucu

SEQ ID NO: 492070 - RNA, 14 nt, Chlamydophila pneumoniae CWL029
ugucuaaagauugg

SEQ ID NO: 492071 - RNA, 15 nt, Chlamydophila pneumoniae CWL029
ugucuaugauugcua

SEQ ID NO: 492072 - RNA, 12 nt, Chlamydophila pneumoniae CWL029
ugucgcaaaugc

SEQ ID NO: 492073 - RNA, 13 nt, Chlamydophila pneumoniae CWL029
ugucgcaaaugca

SEQ ID NO: 492074 - RNA, 17 nt, Chlamydophila pneumoniae CWL029
uguccuguuaagaugug

SEQ ID NO: 492075 - RNA, 21 nt, Chlamydophila pneumoniae CWL029
uguccuccauggaaagaaaca

SEQ ID NO: 492076 - RNA, 23 nt, Chlamydophila pneumoniae CWL029
uguccaugcacgagauucuugag

SEQ ID NO: 492077 - RNA, 22 nt, Chlamydophila pneumoniae CWL029
uguccagucuauagccucuucu

SEQ ID NO: 492078 - RNA, 17 nt, Chlamydophila pneumoniae CWL029
uguccauccaaauagag

SEQ ID NO: 492079 - RNA, 20 nt, Chlamydophila pneumoniae CWL029
uguccauccaaauagaguga

SEQ ID NO: 492080 - RNA, 15 nt, Chlamydophila pneumoniae CWL029
uguccaacuaaaaca

SEQ ID NO: 492081 - RNA, 19 nt, Chlamydophila pneumoniae CWL029
ugucauuaaaaauuuaaaa

SEQ ID NO: 492082 - RNA, 15 nt, Chlamydophila pneumoniae CWL029
ugucaucacaucagu

SEQ ID NO: 492083 - RNA, 13 nt, Chlamydophila pneumoniae CWL029
ugucaucucauag

SEQ ID NO: 492084 - RNA, 21 nt, Chlamydophila pneumoniae CWL029
ugucaagaggcuguccuugca

SEQ ID NO: 492085 - RNA, 20 nt, Chlamydophila pneumoniae CWL029
ugucaaguaagucuucgaaa

SEQ ID NO: 492086 - RNA, 13 nt, Chlamydophila pneumoniae CWL029
uguauugggaaug

SEQ ID NO: 492087 - RNA, 16 nt, Chlamydophila pneumoniae CWL029
uguauggaauucaaac

SEQ ID NO: 492088 - RNA, 18 nt, Chlamydophila pneumoniae CWL029
uguaucuguauccuuccu

SEQ ID NO: 492089 - RNA, 23 nt, Chlamydophila pneumoniae CWL029
uguacaguuuguaaaaagccuau

SEQ ID NO: 492090 - RNA, 20 nt, Chlamydophila pneumoniae CWL029
uguacaguaaaguaugcaua

SEQ ID NO: 492091 - RNA, 20 nt, Chlamydophila pneumoniae CWL029
uguacaguuuguaaaaagcc

SEQ ID NO: 492092 - RNA, 14 nt, Chlamydophila pneumoniae CWL029
uguacacuuucaag

SEQ ID NO: 492093 - RNA, 14 nt, Chlamydophila pneumoniae CWL029
uguaaguuacggaa

SEQ ID NO: 492094 - RNA, 19 nt, Chlamydophila pneumoniae CWL029
uguaaguuacggaacucau

SEQ ID NO: 492095 - RNA, 22 nt, Chlamydophila pneumoniae CWL029
uguaaucccagauuuuuuuggu

SEQ ID NO: 492096 - RNA, 17 nt, Chlamydophila pneumoniae CWL029
uguaaucuugaucagca

SEQ ID NO: 492097 - RNA, 16 nt, Chlamydophila pneumoniae CWL029
uguacacagagaugcu

SEQ ID NO: 492098 - RNA, 23 nt, Chlamydophila pneumoniae CWL029
uguaaaugaggcuccuccuuuga

SEQ ID NO: 492099 - RNA, 15 nt, Chlamydophila pneumoniae CWL029
uguaaauuuuuccuu

SEQ ID NO: 492100 - RNA, 18 nt, Chlamydophila pneumoniae CWL029
uguaagacuaaaaaagag

SEQ ID NO: 492101 - RNA, 16 nt, Chlamydophila pneumoniae CWL029
ugguuccugaaaagca

SEQ ID NO: 492102 - RNA, 18 nt, Chlamydophila pneumoniae CWL029
ugguuuaccuuguuuucc

SEQ ID NO: 492103 - RNA, 21 nt, Chlamydophila pneumoniae CWL029
ugguugcuucuaagaaacuuc

SEQ ID NO: 492104 - RNA, 19 nt, Chlamydophila pneumoniae CWL029
ugguagcgucucuucuucc

SEQ ID NO: 492105 - RNA, 16 nt, Chlamydophila pneumoniae CWL029
ugguagcuaaauuuag

SEQ ID NO: 492106 - RNA, 18 nt, Chlamydophila pneumoniae CWL029
ugguccauaauuucuuuc

SEQ ID NO: 492107 - RNA, 20 nt, Chlamydophila pneumoniae CWL029
ugguccaucgagaaaugcuc

SEQ ID NO: 492108 - RNA, 23 nt, Chlamydophila pneumoniae CWL029
uggucauugccuugcugcauacu

SEQ ID NO: 492109 - RNA, 14 nt, Chlamydophila pneumoniae CWL029
ugguaauuuuucag

SEQ ID NO: 492110 - RNA, 22 nt, Chlamydophila pneumoniae CWL029
ugguacaauacuggagagguaa

SEQ ID NO: 492111 - RNA, 17 nt, Chlamydophila pneumoniae CWL029
uggggcuuccagaaaca

SEQ ID NO: 492112 - RNA, 17 nt, Chlamydophila pneumoniae CWL029
uggucggaguuuuuuuc

SEQ ID NO: 492113 - RNA, 21 nt, Chlamydophila pneumoniae CWL029
uggucuucuguaauuuuuuuc

SEQ ID NO: 492114 - RNA, 17 nt, Chlamydophila pneumoniae CWL029
uggucuuggguuuuaaa

SEQ ID NO: 492115 - RNA, 15 nt, Chlamydophila pneumoniae CWL029
uggugaagaauaaua

SEQ ID NO: 492116 - RNA, 18 nt, Chlamydophila pneumoniae CWL029
uggggaucuuaggaaauu

SEQ ID NO: 492117 - RNA, 20 nt, Chlamydophila pneumoniae CWL029
uggggauuaucccaaacuuc

SEQ ID NO: 492118 - RNA, 23 nt, Chlamydophila pneumoniae CWL029
uggggaaauuaaauucuuuucua

SEQ ID NO: 492119 - RNA, 20 nt, Chlamydophila pneumoniae CWL029
ugggaauuugauuuuucaaa

SEQ ID NO: 492120 - RNA, 23 nt, Chlamydophila pneumoniae CWL029
ugggaauuugauuuuucaaauuc

SEQ ID NO: 492121 - RNA, 16 nt, Chlamydophila pneumoniae CWL029
ugggagcuuccuccaa

SEQ ID NO: 492122 - RNA, 18 nt, Chlamydophila pneumoniae CWL029
ugggaagccuggaaauga

SEQ ID NO: 492123 - RNA, 17 nt, Chlamydophila pneumoniae CWL029
ugggaauucuuuuccug

SEQ ID NO: 492124 - RNA, 17 nt, Chlamydophila pneumoniae CWL029
uggcuccuaaacucaau

SEQ ID NO: 492125 - RNA, 14 nt, Chlamydophila pneumoniae CWL029
uggcucuauagggg

SEQ ID NO: 492126 - RNA, 14 nt, Chlamydophila pneumoniae CWL029
uggcuauggaagau

SEQ ID NO: 492127 - RNA, 15 nt, Chlamydophila pneumoniae CWL029
uggcuauuuuuaaaa

SEQ ID NO: 492128 - RNA, 21 nt, Chlamydophila pneumoniae CWL029
uggcguuuucuagaaaagauu

SEQ ID NO: 492129 - RNA, 14 nt, Chlamydophila pneumoniae CWL029
uggcuaaaggauca

SEQ ID NO: 492130 - RNA, 19 nt, Chlamydophila pneumoniae CWL029
uucagaugauuuuaucugc

SEQ ID NO: 492131 - RNA, 17 nt, Chlamydophila pneumoniae CWL029
uucagauggucagucuc

SEQ ID NO: 492132 - RNA, 15 nt, Chlamydophila pneumoniae CWL029
uucagcaagaaaaua

SEQ ID NO: 492133 - RNA, 16 nt, Chlamydophila pneumoniae CWL029
uucagaguugauuguc

SEQ ID NO: 492134 - RNA, 21 nt, Chlamydophila pneumoniae CWL029
uucagaguugauugucucaac

SEQ ID NO: 492135 - RNA, 19 nt, Chlamydophila pneumoniae CWL029
uucagaaugcccuuuaggg

SEQ ID NO: 492136 - RNA, 16 nt, Chlamydophila pneumoniae CWL029
uucagaaggaucugau

SEQ ID NO: 492137 - RNA, 13 nt, Chlamydophila pneumoniae CWL029
uucagaauucuca

SEQ ID NO: 492138 - RNA, 15 nt, Chlamydophila pneumoniae CWL029
uucagaauucucaag

SEQ ID NO: 492139 - RNA, 23 nt, Chlamydophila pneumoniae CWL029
uucagaaagacgaucuugagcca

SEQ ID NO: 492140 - RNA, 11 nt, Chlamydophila pneumoniae CWL029
uucacuucauc

SEQ ID NO: 492141 - RNA, 13 nt, Chlamydophila pneumoniae CWL029
uucacuccugaag

SEQ ID NO: 492142 - RNA, 22 nt, Chlamydophila pneumoniae CWL029
uucacccucauuaagaggaguc

SEQ ID NO: 492143 - RNA, 16 nt, Chlamydophila pneumoniae CWL029
uucacgauaucuacca

SEQ ID NO: 492144 - RNA, 19 nt, Chlamydophila pneumoniae CWL029
uucaaucucuccuugacaa

SEQ ID NO: 492145 - RNA, 15 nt, Chlamydophila pneumoniae CWL029
uucaaugaagaaaaa

SEQ ID NO: 492146 - RNA, 15 nt, Chlamydophila pneumoniae CWL029
uucaaugagcaucug

SEQ ID NO: 492147 - RNA, 15 nt, Chlamydophila pneumoniae CWL029
uucaaugauguguug

SEQ ID NO: 492148 - RNA, 23 nt, Chlamydophila pneumoniae CWL029
uucaauccccugcaucucugcau

SEQ ID NO: 492149 - RNA, 19 nt, Chlamydophila pneumoniae CWL029
uucaauaucuugaauucuc

SEQ ID NO: 492150 - RNA, 23 nt, Chlamydophila pneumoniae CWL029
uucaauaggaauuagagaaauuu

SEQ ID NO: 492151 - RNA, 20 nt, Chlamydophila pneumoniae CWL029
uucaauaaccagaagacucc

SEQ ID NO: 492152 - RNA, 13 nt, Chlamydophila pneumoniae CWL029
uucaaguuucuuu

SEQ ID NO: 492153 - RNA, 20 nt, Chlamydophila pneumoniae CWL029
uucaaggaacauuugagcaa

SEQ ID NO: 492154 - RNA, 17 nt, Chlamydophila pneumoniae CWL029
uucaagucgagaaacaa

SEQ ID NO: 492155 - RNA, 19 nt, Chlamydophila pneumoniae CWL029
uucaagucgagaaacaaaa

SEQ ID NO: 492156 - RNA, 19 nt, Chlamydophila pneumoniae CWL029
uucacaaagaauucagaga

SEQ ID NO: 492157 - RNA, 15 nt, Chlamydophila pneumoniae CWL029
uucacaagaaaacaa

SEQ ID NO: 492158 - RNA, 21 nt, Chlamydophila pneumoniae CWL029
uucacaagcugguagacuucu

SEQ ID NO: 492159 - RNA, 16 nt, Chlamydophila pneumoniae CWL029
uucacaagugcauuau

SEQ ID NO: 492160 - RNA, 16 nt, Chlamydophila pneumoniae CWL029
uucaccauuaagauau

SEQ ID NO: 492161 - RNA, 13 nt, Chlamydophila pneumoniae CWL029
uucaccagaagca

SEQ ID NO: 492162 - RNA, 20 nt, Chlamydophila pneumoniae CWL029
uucaccagaagcauugagga

SEQ ID NO: 492163 - RNA, 17 nt, Chlamydophila pneumoniae CWL029
uucacauacauucuauu

SEQ ID NO: 492164 - RNA, 22 nt, Chlamydophila pneumoniae CWL029
uucacaucuuuagaaucaagag

SEQ ID NO: 492165 - RNA, 21 nt, Chlamydophila pneumoniae CWL029
uucacaucuuucucuaaaaua

SEQ ID NO: 492166 - RNA, 16 nt, Chlamydophila pneumoniae CWL029
uucacaucuuaaaaac

SEQ ID NO: 492167 - RNA, 12 nt, Chlamydophila pneumoniae CWL029
uucaucuucuuu

SEQ ID NO: 492168 - RNA, 16 nt, Chlamydophila pneumoniae CWL029
uucaucuucuuucuau

SEQ ID NO: 492169 - RNA, 15 nt, Chlamydophila pneumoniae CWL029
uucaugaaaaaagaa

SEQ ID NO: 492170 - RNA, 16 nt, Chlamydophila pneumoniae CWL029
uucaugaaaaaagaau

SEQ ID NO: 492171 - RNA, 22 nt, Chlamydophila pneumoniae CWL029
uucaugaaaaaagaauaaaaau

SEQ ID NO: 492172 - RNA, 15 nt, Chlamydophila pneumoniae CWL029
uucaucugucauuaa

SEQ ID NO: 492173 - RNA, 14 nt, Chlamydophila pneumoniae CWL029
uucaucuagaugau

SEQ ID NO: 492174 - RNA, 14 nt, Chlamydophila pneumoniae CWL029
uucaucgauaggau

SEQ ID NO: 492175 - RNA, 22 nt, Chlamydophila pneumoniae CWL029
uucauccccgagagagaucugg

SEQ ID NO: 492176 - RNA, 19 nt, Chlamydophila pneumoniae CWL029
uucaucccuacccucauca

SEQ ID NO: 492177 - RNA, 17 nt, Chlamydophila pneumoniae CWL029
uucaucaggagaacggu

SEQ ID NO: 492178 - RNA, 14 nt, Chlamydophila pneumoniae CWL029
uucauguccuccau

SEQ ID NO: 492179 - RNA, 12 nt, Chlamydophila pneumoniae CWL029
uucaugcaaaac

SEQ ID NO: 492180 - RNA, 13 nt, Chlamydophila pneumoniae CWL029
uucauuaagaucc

SEQ ID NO: 492181 - RNA, 15 nt, Chlamydophila pneumoniae CWL029
uucauucuuucgaua

SEQ ID NO: 492182 - RNA, 13 nt, Chlamydophila pneumoniae CWL029
uucauucacagca

SEQ ID NO: 492183 - RNA, 15 nt, Chlamydophila pneumoniae CWL029
uucauucacagcagu

SEQ ID NO: 492184 - RNA, 18 nt, Chlamydophila pneumoniae CWL029
uucauuccaggauucuau

SEQ ID NO: 492185 - RNA, 21 nt, Chlamydophila pneumoniae CWL029
uucauuguagaggucacuaua

SEQ ID NO: 492186 - RNA, 14 nt, Chlamydophila pneumoniae CWL029
uucaucaaaacaua

SEQ ID NO: 492187 - RNA, 15 nt, Chlamydophila pneumoniae CWL029
uucaucaaaacauaa

SEQ ID NO: 492188 - RNA, 20 nt, Chlamydophila pneumoniae CWL029
uucauacuaaaaucuuucaa

SEQ ID NO: 492189 - RNA, 21 nt, Chlamydophila pneumoniae CWL029
uucauaacacccugacaggua

SEQ ID NO: 492190 - RNA, 13 nt, Chlamydophila pneumoniae CWL029
uucauaaauucag

SEQ ID NO: 492191 - RNA, 13 nt, Chlamydophila pneumoniae CWL029
uucauaagauugc

SEQ ID NO: 492192 - RNA, 20 nt, Chlamydophila pneumoniae CWL029
uucaguuuuaucggcaauug

SEQ ID NO: 492193 - RNA, 13 nt, Chlamydophila pneumoniae CWL029
uucauaaaacugu

SEQ ID NO: 492194 - RNA, 13 nt, Chlamydophila pneumoniae CWL029
uucaguuccucau

SEQ ID NO: 492195 - RNA, 16 nt, Chlamydophila pneumoniae CWL029
uucaggacaugccuua

SEQ ID NO: 492196 - RNA, 21 nt, Chlamydophila pneumoniae CWL029
uucaggacgcacauuuagaag

SEQ ID NO: 492197 - RNA, 14 nt, Chlamydophila pneumoniae CWL029
uucaggauuuagag

SEQ ID NO: 492198 - RNA, 15 nt, Chlamydophila pneumoniae CWL029
uucaggauuuuccau

SEQ ID NO: 492199 - RNA, 16 nt, Chlamydophila pneumoniae CWL029
uucaggauuuuccauu

SEQ ID NO: 492200 - RNA, 21 nt, Chlamydophila pneumoniae CWL029
uucaguauugcaagccgcaaa

SEQ ID NO: 492201 - RNA, 15 nt, Chlamydophila pneumoniae CWL029
uucagccgcaucaug

SEQ ID NO: 492202 - RNA, 14 nt, Chlamydophila pneumoniae CWL029
uucagccugucuau

SEQ ID NO: 492203 - RNA, 13 nt, Chlamydophila pneumoniae CWL029
uucagcuuugcuu

SEQ ID NO: 492204 - RNA, 16 nt, Chlamydophila pneumoniae CWL029
uuccaauuguaaauca

SEQ ID NO: 492205 - RNA, 14 nt, Chlamydophila pneumoniae CWL029
uuccaauaauuuuc

SEQ ID NO: 492206 - RNA, 20 nt, Chlamydophila pneumoniae CWL029
uuccaauccauucugagaaa

SEQ ID NO: 492207 - RNA, 17 nt, Chlamydophila pneumoniae CWL029
uuccaauccauucugag

SEQ ID NO: 492208 - RNA, 16 nt, Chlamydophila pneumoniae CWL029
uuccaaaauaaaagga

SEQ ID NO: 492209 - RNA, 18 nt, Chlamydophila pneumoniae CWL029
uuccaagacaauaaaaaa

SEQ ID NO: 492210 - RNA, 13 nt, Chlamydophila pneumoniae CWL029
uuccaagagucuu

SEQ ID NO: 492211 - RNA, 21 nt, Chlamydophila pneumoniae CWL029
uuccaacuuuugaagauccug

SEQ ID NO: 492212 - RNA, 17 nt, Chlamydophila pneumoniae CWL029
uuccaagugaucagaaa

SEQ ID NO: 492213 - RNA, 15 nt, Chlamydophila pneumoniae CWL029
uuccaggcucuagga

SEQ ID NO: 492214 - RNA, 21 nt, Chlamydophila pneumoniae CWL029
uuccauaauuuuagcuucuuu

SEQ ID NO: 492215 - RNA, 23 nt, Chlamydophila pneumoniae CWL029
uuccauaauuuuagcuucuuuuu

SEQ ID NO: 492216 - RNA, 23 nt, Chlamydophila pneumoniae CWL029
uuccauagccaaggagcuauaga

SEQ ID NO: 492217 - RNA, 18 nt, Chlamydophila pneumoniae CWL029
uuccauaucaaagaucug

SEQ ID NO: 492218 - RNA, 20 nt, Chlamydophila pneumoniae CWL029
uuccaucgccgaccaucaua

SEQ ID NO: 492219 - RNA, 20 nt, Chlamydophila pneumoniae CWL029
uuccauccugucuauuucuu

SEQ ID NO: 492220 - RNA, 20 nt, Chlamydophila pneumoniae CWL029
uuccaggacguaaaaagaaa

SEQ ID NO: 492221 - RNA, 15 nt, Chlamydophila pneumoniae CWL029
uucccuaacaggaaa

SEQ ID NO: 492222 - RNA, 22 nt, Chlamydophila pneumoniae CWL029
uucccucuucuuccaauaauuu

SEQ ID NO: 492223 - RNA, 15 nt, Chlamydophila pneumoniae CWL029
uucccugacacagag

SEQ ID NO: 492224 - RNA, 16 nt, Chlamydophila pneumoniae CWL029
uucccuccuuccuuaa

SEQ ID NO: 492225 - RNA, 18 nt, Chlamydophila pneumoniae CWL029
uucccucaugaagaauua

SEQ ID NO: 492226 - RNA, 15 nt, Chlamydophila pneumoniae CWL029
uucccuauaaagcaa

SEQ ID NO: 492227 - RNA, 17 nt, Chlamydophila pneumoniae CWL029
uucccuggaugaacucc

SEQ ID NO: 492228 - RNA, 15 nt, Chlamydophila pneumoniae CWL029
uuccauuuucaggcu

SEQ ID NO: 492229 - RNA, 12 nt, Chlamydophila pneumoniae CWL029
uuccauuuuucc

SEQ ID NO: 492230 - RNA, 19 nt, Chlamydophila pneumoniae CWL029
uuccauuagggcauucugu

SEQ ID NO: 492231 - RNA, 17 nt, Chlamydophila pneumoniae CWL029
uuccccaaacuuagcuc

SEQ ID NO: 492232 - RNA, 22 nt, Chlamydophila pneumoniae CWL029
uucccaucuuguucuaaaauga

SEQ ID NO: 492233 - RNA, 23 nt, Chlamydophila pneumoniae CWL029
uucccgaaggggaagaggaaugc

SEQ ID NO: 492234 - RNA, 16 nt, Chlamydophila pneumoniae CWL029
uuccccuaauagggga

SEQ ID NO: 492235 - RNA, 17 nt, Chlamydophila pneumoniae CWL029
uuccccaugaaaauaca

SEQ ID NO: 492236 - RNA, 17 nt, Chlamydophila pneumoniae CWL029
uucgcggaucuucuucu

SEQ ID NO: 492237 - RNA, 21 nt, Chlamydophila pneumoniae CWL029
uucgccaaacgaauuucuugu

SEQ ID NO: 492238 - RNA, 18 nt, Chlamydophila pneumoniae CWL029
uucgauguuaaggcuucc

SEQ ID NO: 492239 - RNA, 18 nt, Chlamydophila pneumoniae CWL029
uucgaugucuuuccaggc

SEQ ID NO: 492240 - RNA, 19 nt, Chlamydophila pneumoniae CWL029
uucgaugcuauuuuuccau

SEQ ID NO: 492241 - RNA, 13 nt, Chlamydophila pneumoniae CWL029
uucgauuccugag

SEQ ID NO: 492242 - RNA, 16 nt, Chlamydophila pneumoniae CWL029
uucgcacuaauuuccu

SEQ ID NO: 492243 - RNA, 17 nt, Chlamydophila pneumoniae CWL029
uucgcacuaauuuccuu

SEQ ID NO: 492244 - RNA, 20 nt, Chlamydophila pneumoniae CWL029
uucgaaucguuuuuggaaaa

SEQ ID NO: 492245 - RNA, 18 nt, Chlamydophila pneumoniae CWL029
uucgaagcgcucuacaaa

SEQ ID NO: 492246 - RNA, 22 nt, Chlamydophila pneumoniae CWL029
uucgacaacaacauaaagaagg

SEQ ID NO: 492247 - RNA, 15 nt, Chlamydophila pneumoniae CWL029
uucgaccuauuugca

SEQ ID NO: 492248 - RNA, 21 nt, Chlamydophila pneumoniae CWL029
uucgacgagaaggaagaagaa

SEQ ID NO: 492249 - RNA, 13 nt, Chlamydophila pneumoniae CWL029
uucgacucuccac

SEQ ID NO: 492250 - RNA, 12 nt, Chlamydophila pneumoniae CWL029
uuccuucucaga

SEQ ID NO: 492251 - RNA, 22 nt, Chlamydophila pneumoniae CWL029
uuccuucuccagagcaagauuu

SEQ ID NO: 492252 - RNA, 15 nt, Chlamydophila pneumoniae CWL029
uuccuuggucuuauu

SEQ ID NO: 492253 - RNA, 23 nt, Chlamydophila pneumoniae CWL029
uuccuugacuaugguaagcauuu

SEQ ID NO: 492254 - RNA, 17 nt, Chlamydophila pneumoniae CWL029
uuccuugggaggaggag

SEQ ID NO: 492255 - RNA, 12 nt, Chlamydophila pneumoniae CWL029
uuccuuuucucc

SEQ ID NO: 492256 - RNA, 17 nt, Chlamydophila pneumoniae CWL029
uucgaaaaacgguaaau

SEQ ID NO: 492257 - RNA, 19 nt, Chlamydophila pneumoniae CWL029
uuccuuauccgucagccuu

SEQ ID NO: 492258 - RNA, 23 nt, Chlamydophila pneumoniae CWL029
uuccugcauggcuuugugagcug

SEQ ID NO: 492259 - RNA, 19 nt, Chlamydophila pneumoniae CWL029
uuccugcuugauuuccuga

SEQ ID NO: 492260 - RNA, 19 nt, Chlamydophila pneumoniae CWL029
uuccucauccucaucauca

SEQ ID NO: 492261 - RNA, 20 nt, Chlamydophila pneumoniae CWL029
uuccuaguccucuaugguuu

SEQ ID NO: 492262 - RNA, 17 nt, Chlamydophila pneumoniae CWL029
uuccuagugcuagauga

SEQ ID NO: 492263 - RNA, 16 nt, Chlamydophila pneumoniae CWL029
uuccuacgacaugccu

SEQ ID NO: 492264 - RNA, 21 nt, Chlamydophila pneumoniae CWL029
uuccuacgacaugccuaaaua

SEQ ID NO: 492265 - RNA, 17 nt, Chlamydophila pneumoniae CWL029
uuccucuucaauuucuu

SEQ ID NO: 492266 - RNA, 20 nt, Chlamydophila pneumoniae CWL029
uuccucuaucagggagcgga

SEQ ID NO: 492267 - RNA, 16 nt, Chlamydophila pneumoniae CWL029
uuccucucaugaaauu

SEQ ID NO: 492268 - RNA, 13 nt, Chlamydophila pneumoniae CWL029
uuccugaaucagc

SEQ ID NO: 492269 - RNA, 16 nt, Chlamydophila pneumoniae CWL029
uuccugacuauaaaau

SEQ ID NO: 492270 - RNA, 16 nt, Chlamydophila pneumoniae CWL029
uuccuaacuucugaag

SEQ ID NO: 492271 - RNA, 17 nt, Chlamydophila pneumoniae CWL029
uuccuaaccauugcucu

SEQ ID NO: 492272 - RNA, 13 nt, Chlamydophila pneumoniae CWL029
uuccuaacuucug

SEQ ID NO: 492273 - RNA, 14 nt, Chlamydophila pneumoniae CWL029
uuccuaaaucugcu

SEQ ID NO: 492274 - RNA, 22 nt, Chlamydophila pneumoniae CWL029
uuccuaaacgacguuuaauucc

SEQ ID NO: 492275 - RNA, 16 nt, Chlamydophila pneumoniae CWL029
uuccuaaaacaagaag

SEQ ID NO: 492276 - RNA, 20 nt, Chlamydophila pneumoniae CWL029
uuccgucugaauguaacucc

SEQ ID NO: 492277 - RNA, 19 nt, Chlamydophila pneumoniae CWL029
uuccggggagaacuucaac

SEQ ID NO: 492278 - RNA, 22 nt, Chlamydophila pneumoniae CWL029
uuuacaaucucugcgagaaucg

SEQ ID NO: 492279 - RNA, 16 nt, Chlamydophila pneumoniae CWL029
uuuacaaauaaaauga

SEQ ID NO: 492280 - RNA, 17 nt, Chlamydophila pneumoniae CWL029
uuuaccagaaaugggca

SEQ ID NO: 492281 - RNA, 20 nt, Chlamydophila pneumoniae CWL029
uuuaaucaagccuaaaucua

SEQ ID NO: 492282 - RNA, 23 nt, Chlamydophila pneumoniae CWL029
uuuaauccaaaaacuucuaacug

SEQ ID NO: 492283 - RNA, 15 nt, Chlamydophila pneumoniae CWL029
uuuaauccaguuuuu

SEQ ID NO: 492284 - RNA, 15 nt, Chlamydophila pneumoniae CWL029
uuuaaugaucacgug

SEQ ID NO: 492285 - RNA, 18 nt, Chlamydophila pneumoniae CWL029
uuuaagguugcuuuucua

SEQ ID NO: 492286 - RNA, 18 nt, Chlamydophila pneumoniae CWL029
uuuaagacaauauaagca

SEQ ID NO: 492287 - RNA, 14 nt, Chlamydophila pneumoniae CWL029
uuuaagauuuccuu

SEQ ID NO: 492288 - RNA, 12 nt, Chlamydophila pneumoniae CWL029
uuuaaagccucc

SEQ ID NO: 492289 - RNA, 19 nt, Chlamydophila pneumoniae CWL029
uuuaaaguguguaaauguu

SEQ ID NO: 492290 - RNA, 20 nt, Chlamydophila pneumoniae CWL029
uuuaaaguguguaaauguuu

SEQ ID NO: 492291 - RNA, 19 nt, Chlamydophila pneumoniae CWL029
uuuaaauuuuguuuuucca

SEQ ID NO: 492292 - RNA, 16 nt, Chlamydophila pneumoniae CWL029
uuuaaaaaauucuaau

SEQ ID NO: 492293 - RNA, 21 nt, Chlamydophila pneumoniae CWL029
uuuaaaaacucuuucauaaga

SEQ ID NO: 492294 - RNA, 21 nt, Chlamydophila pneumoniae CWL029
uuuaaaaauaggagaagcccc

SEQ ID NO: 492295 - RNA, 12 nt, Chlamydophila pneumoniae CWL029
uuuaaaaauaua

SEQ ID NO: 492296 - RNA, 17 nt, Chlamydophila pneumoniae CWL029
uuuaaaaauagaaauaa

SEQ ID NO: 492297 - RNA, 22 nt, Chlamydophila pneumoniae CWL029
uuguguaagacugaaauugaau

SEQ ID NO: 492298 - RNA, 18 nt, Chlamydophila pneumoniae CWL029
uuguguucccucuucuuc

SEQ ID NO: 492299 - RNA, 21 nt, Chlamydophila pneumoniae CWL029
uuguuagugagaucaaaaaua

SEQ ID NO: 492300 - RNA, 13 nt, Chlamydophila pneumoniae CWL029
uuguuaucaggaa

SEQ ID NO: 492301 - RNA, 22 nt, Chlamydophila pneumoniae CWL029
uuguggcuuuucuaaagcguuu

SEQ ID NO: 492302 - RNA, 12 nt, Chlamydophila pneumoniae CWL029
uugugaauuuua

SEQ ID NO: 492303 - RNA, 13 nt, Chlamydophila pneumoniae CWL029
uuguuucaucuuc

SEQ ID NO: 492304 - RNA, 17 nt, Chlamydophila pneumoniae CWL029
uuguuucaucuucuuuc

SEQ ID NO: 492305 - RNA, 18 nt, Chlamydophila pneumoniae CWL029
uuguuuaugcauacguua

SEQ ID NO: 492306 - RNA, 17 nt, Chlamydophila pneumoniae CWL029
uuguugcaucgccuuaa

SEQ ID NO: 492307 - RNA, 15 nt, Chlamydophila pneumoniae CWL029
uuguucagcuagagc

SEQ ID NO: 492308 - RNA, 20 nt, Chlamydophila pneumoniae CWL029
uuguucagcuagagcacaua

SEQ ID NO: 492309 - RNA, 18 nt, Chlamydophila pneumoniae CWL029
uuguaacuucguuagaaa

SEQ ID NO: 492310 - RNA, 17 nt, Chlamydophila pneumoniae CWL029
uuguaagaaucauaaca

SEQ ID NO: 492311 - RNA, 19 nt, Chlamydophila pneumoniae CWL029
uuguaagacuaaaaaagag

SEQ ID NO: 492312 - RNA, 21 nt, Chlamydophila pneumoniae CWL029
uuguaagcagugugcugauuu

SEQ ID NO: 492313 - RNA, 19 nt, Chlamydophila pneumoniae CWL029
uuguaacgcugcuaauguu

SEQ ID NO: 492314 - RNA, 23 nt, Chlamydophila pneumoniae CWL029
uuguaacgcugcuaauguugucu

SEQ ID NO: 492315 - RNA, 20 nt, Chlamydophila pneumoniae CWL029
uuguaaauaguauacaagcg

SEQ ID NO: 492316 - RNA, 14 nt, Chlamydophila pneumoniae CWL029
uuguaaauacaaaa

SEQ ID NO: 492317 - RNA, 19 nt, Chlamydophila pneumoniae CWL029
uuguauggcagccuggaaa

SEQ ID NO: 492318 - RNA, 16 nt, Chlamydophila pneumoniae CWL029
uuguauucagugucuu

SEQ ID NO: 492319 - RNA, 21 nt, Chlamydophila pneumoniae CWL029
uuguccuuugcuaagaacuag

SEQ ID NO: 492320 - RNA, 21 nt, Chlamydophila pneumoniae CWL029
uugugaaaaucgcaccuugac

SEQ ID NO: 492321 - RNA, 15 nt, Chlamydophila pneumoniae CWL029
uugucuuugauuuuc

SEQ ID NO: 492322 - RNA, 23 nt, Chlamydophila pneumoniae CWL029
uugucuuccacgaaggaaucuga

SEQ ID NO: 492323 - RNA, 13 nt, Chlamydophila pneumoniae CWL029
uugucuuccauaa

SEQ ID NO: 492324 - RNA, 14 nt, Chlamydophila pneumoniae CWL029
uugucugaggacag

SEQ ID NO: 492325 - RNA, 20 nt, Chlamydophila pneumoniae CWL029
uugucugauuaguucucuaa

SEQ ID NO: 492326 - RNA, 18 nt, Chlamydophila pneumoniae CWL029
uugguugcagucguauuc

SEQ ID NO: 492327 - RNA, 14 nt, Chlamydophila pneumoniae CWL029
uuggugcuuugccu

SEQ ID NO: 492328 - RNA, 16 nt, Chlamydophila pneumoniae CWL029
uugguuuucuccuucu

SEQ ID NO: 492329 - RNA, 17 nt, Chlamydophila pneumoniae CWL029
uuggcuuuugagauuca

SEQ ID NO: 492330 - RNA, 14 nt, Chlamydophila pneumoniae CWL029
uugggaaaagaaaa

SEQ ID NO: 492331 - RNA, 17 nt, Chlamydophila pneumoniae CWL029
uugggauaggugcauca

SEQ ID NO: 492332 - RNA, 16 nt, Chlamydophila pneumoniae CWL029
uuggcucuagaaauau

SEQ ID NO: 492333 - RNA, 23 nt, Chlamydophila pneumoniae CWL029
uugcuuccaacggacauuuucaa

SEQ ID NO: 492334 - RNA, 20 nt, Chlamydophila pneumoniae CWL029
uugcuucuaagaaacuucca

SEQ ID NO: 492335 - RNA, 15 nt, Chlamydophila pneumoniae CWL029
uugcugcucuccaaa

SEQ ID NO: 492336 - RNA, 16 nt, Chlamydophila pneumoniae CWL029
uugcugcucuccaaag

SEQ ID NO: 492337 - RNA, 14 nt, Chlamydophila pneumoniae CWL029
uuggaaaucagaau

SEQ ID NO: 492338 - RNA, 15 nt, Chlamydophila pneumoniae CWL029
uuggauaggauagga

SEQ ID NO: 492339 - RNA, 14 nt, Chlamydophila pneumoniae CWL029
uuggcacaauccuc

SEQ ID NO: 492340 - RNA, 14 nt, Chlamydophila pneumoniae CWL029
uuggcaauagcuuu

SEQ ID NO: 492341 - RNA, 17 nt, Chlamydophila pneumoniae CWL029
uugcucuagucuuucaa

SEQ ID NO: 492342 - RNA, 14 nt, Chlamydophila pneumoniae CWL029
uugcugaaaaugau

SEQ ID NO: 492343 - RNA, 13 nt, Chlamydophila pneumoniae CWL029
uugcucuuuagga

SEQ ID NO: 492344 - RNA, 18 nt, Chlamydophila pneumoniae CWL029
uugcugcggccacauuaa

SEQ ID NO: 492345 - RNA, 20 nt, Chlamydophila pneumoniae CWL029
uugcuaagagcucuuucccu

SEQ ID NO: 492346 - RNA, 22 nt, Chlamydophila pneumoniae CWL029
uugcuacagcuucuuuuccagc

SEQ ID NO: 492347 - RNA, 14 nt, Chlamydophila pneumoniae CWL029
uugcuauacagaaa

SEQ ID NO: 492348 - RNA, 15 nt, Chlamydophila pneumoniae CWL029
uugcgccagcaaaga

SEQ ID NO: 492349 - RNA, 19 nt, Chlamydophila pneumoniae CWL029
uugcggauuugcauuaccu

SEQ ID NO: 492350 - RNA, 22 nt, Chlamydophila pneumoniae CWL029
uugccaggaaacguucuuucaa

SEQ ID NO: 492351 - RNA, 18 nt, Chlamydophila pneumoniae CWL029
uugcauagcggcaacaag

SEQ ID NO: 492352 - RNA, 20 nt, Chlamydophila pneumoniae CWL029
uugccgugaguugcaauugc

SEQ ID NO: 492353 - RNA, 14 nt, Chlamydophila pneumoniae CWL029
uugcaaucuuugaa

SEQ ID NO: 492354 - RNA, 19 nt, Chlamydophila pneumoniae CWL029
uugauuuccaacaccagga

SEQ ID NO: 492355 - RNA, 12 nt, Chlamydophila pneumoniae CWL029
uugauuuuucaa

SEQ ID NO: 492356 - RNA, 15 nt, Chlamydophila pneumoniae CWL029
uugauuccaaugacg

SEQ ID NO: 492357 - RNA, 20 nt, Chlamydophila pneumoniae CWL029
uugauugcgaacaguuccua

SEQ ID NO: 492358 - RNA, 12 nt, Chlamydophila pneumoniae CWL029
uugaugagaaaa

SEQ ID NO: 492359 - RNA, 17 nt, Chlamydophila pneumoniae CWL029
uugaugagaaaaagaau

SEQ ID NO: 492360 - RNA, 16 nt, Chlamydophila pneumoniae CWL029
uugagucuuuuucaga

SEQ ID NO: 492361 - RNA, 13 nt, Chlamydophila pneumoniae CWL029
uugagcucucuag

SEQ ID NO: 492362 - RNA, 19 nt, Chlamydophila pneumoniae CWL029
uugagccaacagguucacu

SEQ ID NO: 492363 - RNA, 19 nt, Chlamydophila pneumoniae CWL029
uugagcuaacgacauugaa

SEQ ID NO: 492364 - RNA, 13 nt, Chlamydophila pneumoniae CWL029
uugagcaguaaug

SEQ ID NO: 492365 - RNA, 14 nt, Chlamydophila pneumoniae CWL029
uugagacaaagaau

SEQ ID NO: 492366 - RNA, 18 nt, Chlamydophila pneumoniae CWL029
uugagaauaaaacuuucu

SEQ ID NO: 492367 - RNA, 22 nt, Chlamydophila pneumoniae CWL029
uugagaaugaacaauagaaaga

SEQ ID NO: 492368 - RNA, 23 nt, Chlamydophila pneumoniae CWL029
uugauaacuuugcaugaggagac

SEQ ID NO: 492369 - RNA, 14 nt, Chlamydophila pneumoniae CWL029
uugauauuguucuu

SEQ ID NO: 492370 - RNA, 18 nt, Chlamydophila pneumoniae CWL029
uugauccuuuccaagaag

SEQ ID NO: 492371 - RNA, 21 nt, Chlamydophila pneumoniae CWL029
uugaucuacaaaaacuagaau

SEQ ID NO: 492372 - RNA, 14 nt, Chlamydophila pneumoniae CWL029
uugaacaugaggau

SEQ ID NO: 492373 - RNA, 21 nt, Chlamydophila pneumoniae CWL029
uucuuugaagaacaaaaaauc

SEQ ID NO: 492374 - RNA, 22 nt, Chlamydophila pneumoniae CWL029
uucuuugaagaacaaaaaauca

SEQ ID NO: 492375 - RNA, 12 nt, Chlamydophila pneumoniae CWL029
uucuuucuugcu

SEQ ID NO: 492376 - RNA, 14 nt, Chlamydophila pneumoniae CWL029
uucuuucugcucuu

SEQ ID NO: 492377 - RNA, 21 nt, Chlamydophila pneumoniae CWL029
uucuugguguauaguauuuuu

SEQ ID NO: 492378 - RNA, 22 nt, Chlamydophila pneumoniae CWL029
uucuuggagaagagguaauaau

SEQ ID NO: 492379 - RNA, 21 nt, Chlamydophila pneumoniae CWL029
uucuuggaauauagguuuaga

SEQ ID NO: 492380 - RNA, 15 nt, Chlamydophila pneumoniae CWL029
uucuugcaaagauaa

SEQ ID NO: 492381 - RNA, 22 nt, Chlamydophila pneumoniae CWL029
uucuugcgacauaaccaucgau

SEQ ID NO: 492382 - RNA, 15 nt, Chlamydophila pneumoniae CWL029
uugagaaaagaacag

SEQ ID NO: 492383 - RNA, 12 nt, Chlamydophila pneumoniae CWL029
uugacuuguccc

SEQ ID NO: 492384 - RNA, 13 nt, Chlamydophila pneumoniae CWL029
uugaauuuccaaa

SEQ ID NO: 492385 - RNA, 17 nt, Chlamydophila pneumoniae CWL029
uugaauuuccaaaggaa

SEQ ID NO: 492386 - RNA, 19 nt, Chlamydophila pneumoniae CWL029
uugacaauaagaaaauccu

SEQ ID NO: 492387 - RNA, 19 nt, Chlamydophila pneumoniae CWL029
uugacaaucgcuguaaauu

SEQ ID NO: 492388 - RNA, 18 nt, Chlamydophila pneumoniae CWL029
uugacaauaggcacccaa

SEQ ID NO: 492389 - RNA, 16 nt, Chlamydophila pneumoniae CWL029
uugaagagcuugcugu

SEQ ID NO: 492390 - RNA, 17 nt, Chlamydophila pneumoniae CWL029
uugaauuaaaaguucca

SEQ ID NO: 492391 - RNA, 23 nt, Chlamydophila pneumoniae CWL029
uugaauucauccagauuagaaaa

SEQ ID NO: 492392 - RNA, 13 nt, Chlamydophila pneumoniae CWL029
uugaauucucaag

SEQ ID NO: 492393 - RNA, 16 nt, Chlamydophila pneumoniae CWL029
uugaagaacaaaaaau

SEQ ID NO: 492394 - RNA, 19 nt, Chlamydophila pneumoniae CWL029
uugaacguagcuacaaaau

SEQ ID NO: 492395 - RNA, 13 nt, Chlamydophila pneumoniae CWL029
uucuucacaaucu

SEQ ID NO: 492396 - RNA, 20 nt, Chlamydophila pneumoniae CWL029
uucuucacaaucuaaauaag

SEQ ID NO: 492397 - RNA, 22 nt, Chlamydophila pneumoniae CWL029
uucuucaauaggaauuagagaa

SEQ ID NO: 492398 - RNA, 12 nt, Chlamydophila pneumoniae CWL029
uucuucaauauc

SEQ ID NO: 492399 - RNA, 14 nt, Chlamydophila pneumoniae CWL029
uucuucaagaaaug

SEQ ID NO: 492400 - RNA, 23 nt, Chlamydophila pneumoniae CWL029
uucuucaaagucaaauacuucuc

SEQ ID NO: 492401 - RNA, 19 nt, Chlamydophila pneumoniae CWL029
uucuuagcgcauguauugu

SEQ ID NO: 492402 - RNA, 14 nt, Chlamydophila pneumoniae CWL029
uucuuagaagagaa

SEQ ID NO: 492403 - RNA, 16 nt, Chlamydophila pneumoniae CWL029
uucuuagaagagaaag

SEQ ID NO: 492404 - RNA, 23 nt, Chlamydophila pneumoniae CWL029
uucuuacuaaagaaagagucuca

SEQ ID NO: 492405 - RNA, 13 nt, Chlamydophila pneumoniae CWL029
uucuuaauuuccu

SEQ ID NO: 492406 - RNA, 13 nt, Chlamydophila pneumoniae CWL029
uucuguaacacuu

SEQ ID NO: 492407 - RNA, 18 nt, Chlamydophila pneumoniae CWL029
uucuuaauauaaaagaag

SEQ ID NO: 492408 - RNA, 14 nt, Chlamydophila pneumoniae CWL029
uucuucaucaauac

SEQ ID NO: 492409 - RNA, 18 nt, Chlamydophila pneumoniae CWL029
uucuucagcacuuuuauu

SEQ ID NO: 492410 - RNA, 19 nt, Chlamydophila pneumoniae CWL029
uucuugaaguucuucaaga

SEQ ID NO: 492411 - RNA, 19 nt, Chlamydophila pneumoniae CWL029
uucuugacuuguuucuccu

SEQ ID NO: 492412 - RNA, 14 nt, Chlamydophila pneumoniae CWL029
uucugagcuugccu

SEQ ID NO: 492413 - RNA, 22 nt, Chlamydophila pneumoniae CWL029
uucugauuagagccccaacccu

SEQ ID NO: 492414 - RNA, 22 nt, Chlamydophila pneumoniae CWL029
uucugcuucuccaaauaaagca

SEQ ID NO: 492415 - RNA, 14 nt, Chlamydophila pneumoniae CWL029
uucugcuucuguaa

SEQ ID NO: 492416 - RNA, 15 nt, Chlamydophila pneumoniae CWL029
uucugcuucuguaaa

SEQ ID NO: 492417 - RNA, 15 nt, Chlamydophila pneumoniae CWL029
uucuggaauuuccca

SEQ ID NO: 492418 - RNA, 22 nt, Chlamydophila pneumoniae CWL029
uucuguaaagugaaauugaacu

SEQ ID NO: 492419 - RNA, 15 nt, Chlamydophila pneumoniae CWL029
uucucgggucuugga

SEQ ID NO: 492420 - RNA, 17 nt, Chlamydophila pneumoniae CWL029
uucucuaagcagccucu

SEQ ID NO: 492421 - RNA, 14 nt, Chlamydophila pneumoniae CWL029
uucugaauagcucu

SEQ ID NO: 492422 - RNA, 23 nt, Chlamydophila pneumoniae CWL029
uucugaaggaaaucccgaaugug

SEQ ID NO: 492423 - RNA, 14 nt, Chlamydophila pneumoniae CWL029
uucugaagauuuuu

SEQ ID NO: 492424 - RNA, 14 nt, Chlamydophila pneumoniae CWL029
uucugaaacaaugc

SEQ ID NO: 492425 - RNA, 15 nt, Chlamydophila pneumoniae CWL029
uucugaaacaaugca

SEQ ID NO: 492426 - RNA, 15 nt, Chlamydophila pneumoniae CWL029
uucugaaauugucuu

SEQ ID NO: 492427 - RNA, 19 nt, Chlamydophila pneumoniae CWL029
uucugaaauugucuucagu

SEQ ID NO: 492428 - RNA, 22 nt, Chlamydophila pneumoniae CWL029
uucuaacgcuuuuucaaacugu

SEQ ID NO: 492429 - RNA, 22 nt, Chlamydophila pneumoniae CWL029
uucgugaacaaaaucgaacaga

SEQ ID NO: 492430 - RNA, 17 nt, Chlamydophila pneumoniae CWL029
uucguggagugcucuac

SEQ ID NO: 492431 - RNA, 16 nt, Chlamydophila pneumoniae CWL029
uucgucuaaaauaacc

SEQ ID NO: 492432 - RNA, 15 nt, Chlamydophila pneumoniae CWL029
uucgucgucauccca

SEQ ID NO: 492433 - RNA, 19 nt, Chlamydophila pneumoniae CWL029
uucguaacgcuuuucuaau

SEQ ID NO: 492434 - RNA, 23 nt, Chlamydophila pneumoniae CWL029
uucguaagcugagguagcaucuc

SEQ ID NO: 492435 - RNA, 22 nt, Chlamydophila pneumoniae CWL029
uucguacaguuuuuuucuaaau

SEQ ID NO: 492436 - RNA, 19 nt, Chlamydophila pneumoniae CWL029
uucggaguuggaucaagga

SEQ ID NO: 492437 - RNA, 20 nt, Chlamydophila pneumoniae CWL029
uucuaggggagguaaaauaa

SEQ ID NO: 492438 - RNA, 16 nt, Chlamydophila pneumoniae CWL029
uucuaggaaucuuuua

SEQ ID NO: 492439 - RNA, 16 nt, Chlamydophila pneumoniae CWL029
uucuaggaauugcugu

SEQ ID NO: 492440 - RNA, 18 nt, Chlamydophila pneumoniae CWL029
uucuaggauuuagacuaa

SEQ ID NO: 492441 - RNA, 23 nt, Chlamydophila pneumoniae CWL029
uucuagggaucccaaaaaaugcc

SEQ ID NO: 492442 - RNA, 21 nt, Chlamydophila pneumoniae CWL029
uucuagcuaauaaugaagcag

SEQ ID NO: 492443 - RNA, 15 nt, Chlamydophila pneumoniae CWL029
uucuagcucauuauc

SEQ ID NO: 492444 - RNA, 20 nt, Chlamydophila pneumoniae CWL029
uucuagcauaguguuccaaa

SEQ ID NO: 492445 - RNA, 16 nt, Chlamydophila pneumoniae CWL029
uucuagcaaaucuaaa

SEQ ID NO: 492446 - RNA, 18 nt, Chlamydophila pneumoniae CWL029
uucuagaguucauuuuag

SEQ ID NO: 492447 - RNA, 16 nt, Chlamydophila pneumoniae CWL029
uucuagaaaagauucu

SEQ ID NO: 492448 - RNA, 18 nt, Chlamydophila pneumoniae CWL029
uucuagaaaagauucuaa

SEQ ID NO: 492449 - RNA, 21 nt, Chlamydophila pneumoniae CWL029
uucuagaaacugcuccugaag

SEQ ID NO: 492450 - RNA, 15 nt, Chlamydophila pneumoniae CWL029
uucuagaaugaugca

SEQ ID NO: 492451 - RNA, 12 nt, Chlamydophila pneumoniae CWL029
uucuaauacacc

SEQ ID NO: 492452 - RNA, 23 nt, Chlamydophila pneumoniae CWL029
uucuaauguagggggauugauaa

SEQ ID NO: 492453 - RNA, 18 nt, Chlamydophila pneumoniae CWL029
uucuaagcuuauuucugu

SEQ ID NO: 492454 - RNA, 20 nt, Chlamydophila pneumoniae CWL029
uucuaaggugcuauuuuaaa

SEQ ID NO: 492455 - RNA, 19 nt, Chlamydophila pneumoniae CWL029
uucuaagcugaaagaacac

SEQ ID NO: 492456 - RNA, 19 nt, Chlamydophila pneumoniae CWL029
uucuaagcaauauuucugu

SEQ ID NO: 492457 - RNA, 23 nt, Chlamydophila pneumoniae CWL029
uucuaagauuccuaacuucugaa

SEQ ID NO: 492458 - RNA, 14 nt, Chlamydophila pneumoniae CWL029
uucuaagcaauauu

SEQ ID NO: 492459 - RNA, 20 nt, Chlamydophila pneumoniae CWL029
uucuaacuguacacuuucaa

SEQ ID NO: 492460 - RNA, 13 nt, Chlamydophila pneumoniae CWL029
uucucgaaaaauu

SEQ ID NO: 492461 - RNA, 16 nt, Chlamydophila pneumoniae CWL029
uucucgaagcuugcug

SEQ ID NO: 492462 - RNA, 15 nt, Chlamydophila pneumoniae CWL029
uucuccucuuucuua

SEQ ID NO: 492463 - RNA, 23 nt, Chlamydophila pneumoniae CWL029
uucuccugaaccgcaaaaagcuu

SEQ ID NO: 492464 - RNA, 22 nt, Chlamydophila pneumoniae CWL029
uucuccugacucuuuuaagaca

SEQ ID NO: 492465 - RNA, 20 nt, Chlamydophila pneumoniae CWL029
uucuccucgcaauccaggaa

SEQ ID NO: 492466 - RNA, 19 nt, Chlamydophila pneumoniae CWL029
uucuccaacuuccauauga

SEQ ID NO: 492467 - RNA, 14 nt, Chlamydophila pneumoniae CWL029
uucuauaacuacaa

SEQ ID NO: 492468 - RNA, 17 nt, Chlamydophila pneumoniae CWL029
uucuauacgaacacaga

SEQ ID NO: 492469 - RNA, 23 nt, Chlamydophila pneumoniae CWL029
uucuauacgcuuaacaugaaaag

SEQ ID NO: 492470 - RNA, 15 nt, Chlamydophila pneumoniae CWL029
gcaaugcuucuucag

SEQ ID NO: 492471 - RNA, 19 nt, Chlamydophila pneumoniae CWL029
gcaaucguuucuauagacu

SEQ ID NO: 492472 - RNA, 14 nt, Chlamydophila pneumoniae CWL029
gcaaguaaagaaau

SEQ ID NO: 492473 - RNA, 14 nt, Chlamydophila pneumoniae CWL029
gcaagucauaaaga

SEQ ID NO: 492474 - RNA, 23 nt, Chlamydophila pneumoniae CWL029
gcaagugcgcuaccaggcugcgc

SEQ ID NO: 492475 - RNA, 24 nt, Chlamydophila pneumoniae CWL029
gcaagugcgcuaccaggcugcgcu

SEQ ID NO: 492476 - RNA, 17 nt, Chlamydophila pneumoniae CWL029
gcaagucgguaauaccu

SEQ ID NO: 492477 - RNA, 17 nt, Chlamydophila pneumoniae CWL029
gcaauaucuauagaagg

SEQ ID NO: 492478 - RNA, 14 nt, Chlamydophila pneumoniae CWL029
gcaauauauccagg

SEQ ID NO: 492479 - RNA, 15 nt, Chlamydophila pneumoniae CWL029
gcaagaucuaacuuc

SEQ ID NO: 492480 - RNA, 18 nt, Chlamydophila pneumoniae CWL029
gcaaauuucauuuagaca

SEQ ID NO: 492481 - RNA, 15 nt, Chlamydophila pneumoniae CWL029
gcaagggcggagaau

SEQ ID NO: 492482 - RNA, 17 nt, Chlamydophila pneumoniae CWL029
gcaaggggaguuuucuu

SEQ ID NO: 492483 - RNA, 16 nt, Chlamydophila pneumoniae CWL029
gcaagccgcaaaccau

SEQ ID NO: 492484 - RNA, 17 nt, Chlamydophila pneumoniae CWL029
gcaagccgcaaaccauc

SEQ ID NO: 492485 - RNA, 13 nt, Chlamydophila pneumoniae CWL029
gcacauaagauga

SEQ ID NO: 492486 - RNA, 20 nt, Chlamydophila pneumoniae CWL029
gcacacugcuuacaauugaa

SEQ ID NO: 492487 - RNA, 15 nt, Chlamydophila pneumoniae CWL029
gcaauuuucucaaua

SEQ ID NO: 492488 - RNA, 14 nt, Chlamydophila pneumoniae CWL029
gcacgucugcaccu

SEQ ID NO: 492489 - RNA, 14 nt, Chlamydophila pneumoniae CWL029
gcacugaugaaaaa

SEQ ID NO: 492490 - RNA, 19 nt, Chlamydophila pneumoniae CWL029
gcacggauucuaaaagagc

SEQ ID NO: 492491 - RNA, 15 nt, Chlamydophila pneumoniae CWL029
gcacgagagccucgg

SEQ ID NO: 492492 - RNA, 22 nt, Chlamydophila pneumoniae CWL029
gcauccuguagagcaagauucu

SEQ ID NO: 492493 - RNA, 14 nt, Chlamydophila pneumoniae CWL029
gcaucccuucuucu

SEQ ID NO: 492494 - RNA, 23 nt, Chlamydophila pneumoniae CWL029
gcaucacggaguguuugaagaug

SEQ ID NO: 492495 - RNA, 16 nt, Chlamydophila pneumoniae CWL029
gcaucacgaaaaggag

SEQ ID NO: 492496 - RNA, 19 nt, Chlamydophila pneumoniae CWL029
gcaucagaaucguucccau

SEQ ID NO: 492497 - RNA, 16 nt, Chlamydophila pneumoniae CWL029
gcaucaagagauagag

SEQ ID NO: 492498 - RNA, 22 nt, Chlamydophila pneumoniae CWL029
gcauauucuaagcuuauuucug

SEQ ID NO: 492499 - RNA, 16 nt, Chlamydophila pneumoniae CWL029
gcauauuuaaauauaa

SEQ ID NO: 492500 - RNA, 17 nt, Chlamydophila pneumoniae CWL029
gcauauuuaaauauaaa

SEQ ID NO: 492501 - RNA, 15 nt, Chlamydophila pneumoniae CWL029
gcauaguguuccaaa

SEQ ID NO: 492502 - RNA, 20 nt, Chlamydophila pneumoniae CWL029
gcauaguguuccaaaacagg

SEQ ID NO: 492503 - RNA, 15 nt, Chlamydophila pneumoniae CWL029
gcauagagcucuaaa

SEQ ID NO: 492504 - RNA, 21 nt, Chlamydophila pneumoniae CWL029
gcauaguauggcauucuuuuu

SEQ ID NO: 492505 - RNA, 19 nt, Chlamydophila pneumoniae CWL029
gcauaguauuaaucuuauu

SEQ ID NO: 492506 - RNA, 21 nt, Chlamydophila pneumoniae CWL029
gcauaauccugaauggcucug

SEQ ID NO: 492507 - RNA, 16 nt, Chlamydophila pneumoniae CWL029
gcauaaucuuuaacaa

SEQ ID NO: 492508 - RNA, 14 nt, Chlamydophila pneumoniae CWL029
gcauaauuuuucuu

SEQ ID NO: 492509 - RNA, 15 nt, Chlamydophila pneumoniae CWL029
gcauaauuuuucuua

SEQ ID NO: 492510 - RNA, 18 nt, Chlamydophila pneumoniae CWL029
gcaguagguaagaagcug

SEQ ID NO: 492511 - RNA, 20 nt, Chlamydophila pneumoniae CWL029
gcaggcaucacuaaucucag

SEQ ID NO: 492512 - RNA, 15 nt, Chlamydophila pneumoniae CWL029
gcaggaaaagcaaaa

SEQ ID NO: 492513 - RNA, 17 nt, Chlamydophila pneumoniae CWL029
gcacuuaaaaaacuucc

SEQ ID NO: 492514 - RNA, 13 nt, Chlamydophila pneumoniae CWL029
gcacuuacuucaa

SEQ ID NO: 492515 - RNA, 13 nt, Chlamydophila pneumoniae CWL029
gcagcagccuugg

SEQ ID NO: 492516 - RNA, 23 nt, Chlamydophila pneumoniae CWL029
gcaaauccugcucguaaaucugg

SEQ ID NO: 492517 - RNA, 19 nt, Chlamydophila pneumoniae CWL029
gcaaauccuguagaaacau

SEQ ID NO: 492518 - RNA, 15 nt, Chlamydophila pneumoniae CWL029
gcaaaucuaaaaccu

SEQ ID NO: 492519 - RNA, 18 nt, Chlamydophila pneumoniae CWL029
gcaaaucuaaaaccugac

SEQ ID NO: 492520 - RNA, 21 nt, Chlamydophila pneumoniae CWL029
gcaaaucuuacauaaaccuuu

SEQ ID NO: 492521 - RNA, 17 nt, Chlamydophila pneumoniae CWL029
gcaaauaaaguccucca

SEQ ID NO: 492522 - RNA, 13 nt, Chlamydophila pneumoniae CWL029
gcaaauaaaacaa

SEQ ID NO: 492523 - RNA, 16 nt, Chlamydophila pneumoniae CWL029
gcaaaguaucaacguu

SEQ ID NO: 492524 - RNA, 13 nt, Chlamydophila pneumoniae CWL029
gcaaagauuucca

SEQ ID NO: 492525 - RNA, 15 nt, Chlamydophila pneumoniae CWL029
gcaaaggaaaagaua

SEQ ID NO: 492526 - RNA, 23 nt, Chlamydophila pneumoniae CWL029
gcaaagcugacaacaaaugugac

SEQ ID NO: 492527 - RNA, 20 nt, Chlamydophila pneumoniae CWL029
gcaaaccgagacuauuuugg

SEQ ID NO: 492528 - RNA, 15 nt, Chlamydophila pneumoniae CWL029
gcaaagauaaagaag

SEQ ID NO: 492529 - RNA, 14 nt, Chlamydophila pneumoniae CWL029
gcaaagaucaguuu

SEQ ID NO: 492530 - RNA, 19 nt, Chlamydophila pneumoniae CWL029
gcaaagacauccaagccuc

SEQ ID NO: 492531 - RNA, 14 nt, Chlamydophila pneumoniae CWL029
gcaaacuccccagu

SEQ ID NO: 492532 - RNA, 15 nt, Chlamydophila pneumoniae CWL029
gcaaacggaacuaaa

SEQ ID NO: 492533 - RNA, 12 nt, Chlamydophila pneumoniae CWL029
gcaaacgcaaug

SEQ ID NO: 492534 - RNA, 19 nt, Chlamydophila pneumoniae CWL029
gauuucuucuucagagcuc

SEQ ID NO: 492535 - RNA, 13 nt, Chlamydophila pneumoniae CWL029
gauuucuucuucu

SEQ ID NO: 492536 - RNA, 16 nt, Chlamydophila pneumoniae CWL029
gauuucuucuucuaaa

SEQ ID NO: 492537 - RNA, 15 nt, Chlamydophila pneumoniae CWL029
gauuucuucuucaga

SEQ ID NO: 492538 - RNA, 20 nt, Chlamydophila pneumoniae CWL029
gauuucuuuuucagcuucua

SEQ ID NO: 492539 - RNA, 20 nt, Chlamydophila pneumoniae CWL029
gauuuuuagaauagaagauc

SEQ ID NO: 492540 - RNA, 11 nt, Chlamydophila pneumoniae CWL029
gauuuugugag

SEQ ID NO: 492541 - RNA, 17 nt, Chlamydophila pneumoniae CWL029
gcaaaaaugaaagaaac

SEQ ID NO: 492542 - RNA, 15 nt, Chlamydophila pneumoniae CWL029
gcaaaaauucuaggu

SEQ ID NO: 492543 - RNA, 21 nt, Chlamydophila pneumoniae CWL029
gauucucucugccuaccaaag

SEQ ID NO: 492544 - RNA, 20 nt, Chlamydophila pneumoniae CWL029
gauucucucugccuaccaaa

SEQ ID NO: 492545 - RNA, 19 nt, Chlamydophila pneumoniae CWL029
gauuauuuguuucuuccau

SEQ ID NO: 492546 - RNA, 22 nt, Chlamydophila pneumoniae CWL029
gauuauuuguuucuuccauaca

SEQ ID NO: 492547 - RNA, 21 nt, Chlamydophila pneumoniae CWL029
gauucuuuaaucuaucugcaa

SEQ ID NO: 492548 - RNA, 16 nt, Chlamydophila pneumoniae CWL029
gauucuguauaaacaa

SEQ ID NO: 492549 - RNA, 17 nt, Chlamydophila pneumoniae CWL029
gauucuuaucacaaauu

SEQ ID NO: 492550 - RNA, 13 nt, Chlamydophila pneumoniae CWL029
gauucuucagaau

SEQ ID NO: 492551 - RNA, 13 nt, Chlamydophila pneumoniae CWL029
gauugauaacaau

SEQ ID NO: 492552 - RNA, 18 nt, Chlamydophila pneumoniae CWL029
gauugaggauaaguucuu

SEQ ID NO: 492553 - RNA, 21 nt, Chlamydophila pneumoniae CWL029
gauugaggauaaguucuucca

SEQ ID NO: 492554 - RNA, 19 nt, Chlamydophila pneumoniae CWL029
gauuuaaaugcaagugcuu

SEQ ID NO: 492555 - RNA, 20 nt, Chlamydophila pneumoniae CWL029
gauuggaugauagcuaugag

SEQ ID NO: 492556 - RNA, 20 nt, Chlamydophila pneumoniae CWL029
gauguuuaauacaaaaaaua

SEQ ID NO: 492557 - RNA, 18 nt, Chlamydophila pneumoniae CWL029
gauguuuaugaaaaucug

SEQ ID NO: 492558 - RNA, 20 nt, Chlamydophila pneumoniae CWL029
gauuaaguucgucuaccauu

SEQ ID NO: 492559 - RNA, 23 nt, Chlamydophila pneumoniae CWL029
gauuaugaauccuugaaagacuc

SEQ ID NO: 492560 - RNA, 16 nt, Chlamydophila pneumoniae CWL029
gauuaucccaaacuuc

SEQ ID NO: 492561 - RNA, 19 nt, Chlamydophila pneumoniae CWL029
gauguacaagcuucaucaa

SEQ ID NO: 492562 - RNA, 15 nt, Chlamydophila pneumoniae CWL029
gauguaggugauauu

SEQ ID NO: 492563 - RNA, 12 nt, Chlamydophila pneumoniae CWL029
gauguagagucg

SEQ ID NO: 492564 - RNA, 22 nt, Chlamydophila pneumoniae CWL029
gaugucaccacgaacuucagca

SEQ ID NO: 492565 - RNA, 13 nt, Chlamydophila pneumoniae CWL029
gaugguugcuucu

SEQ ID NO: 492566 - RNA, 19 nt, Chlamydophila pneumoniae CWL029
gaugggaucggucuuuucu

SEQ ID NO: 492567 - RNA, 15 nt, Chlamydophila pneumoniae CWL029
gauggucaggaagaa

SEQ ID NO: 492568 - RNA, 17 nt, Chlamydophila pneumoniae CWL029
gauggucauaccaaccu

SEQ ID NO: 492569 - RNA, 17 nt, Chlamydophila pneumoniae CWL029
gaugcuaaagagucuuc

SEQ ID NO: 492570 - RNA, 16 nt, Chlamydophila pneumoniae CWL029
gaugacuuucagagca

SEQ ID NO: 492571 - RNA, 15 nt, Chlamydophila pneumoniae CWL029
gaugacuuucagagc

SEQ ID NO: 492572 - RNA, 14 nt, Chlamydophila pneumoniae CWL029
gaugaauaccagaa

SEQ ID NO: 492573 - RNA, 17 nt, Chlamydophila pneumoniae CWL029
gaucgucaguaaaacac

SEQ ID NO: 492574 - RNA, 21 nt, Chlamydophila pneumoniae CWL029
gaugauccacugcuuuaggcc

SEQ ID NO: 492575 - RNA, 22 nt, Chlamydophila pneumoniae CWL029
gaugaugcccugacguuuugau

SEQ ID NO: 492576 - RNA, 14 nt, Chlamydophila pneumoniae CWL029
gaugcaggccagga

SEQ ID NO: 492577 - RNA, 19 nt, Chlamydophila pneumoniae CWL029
gaugcaucucuuaaaacau

SEQ ID NO: 492578 - RNA, 13 nt, Chlamydophila pneumoniae CWL029
gaugccaagaaau

SEQ ID NO: 492579 - RNA, 14 nt, Chlamydophila pneumoniae CWL029
gaugccaagaaaua

SEQ ID NO: 492580 - RNA, 21 nt, Chlamydophila pneumoniae CWL029
gaucggaguuaucaaaaggau

SEQ ID NO: 492581 - RNA, 18 nt, Chlamydophila pneumoniae CWL029
gaucgggucuacaacagu

SEQ ID NO: 492582 - RNA, 14 nt, Chlamydophila pneumoniae CWL029
gauccuagaauagg

SEQ ID NO: 492583 - RNA, 12 nt, Chlamydophila pneumoniae CWL029
gaucgaaaaaua

SEQ ID NO: 492584 - RNA, 21 nt, Chlamydophila pneumoniae CWL029
gaucauuaaaguccaagauca

SEQ ID NO: 492585 - RNA, 23 nt, Chlamydophila pneumoniae CWL029
gaucauuagcaucaucuccugaa

SEQ ID NO: 492586 - RNA, 16 nt, Chlamydophila pneumoniae CWL029
gaucauucuuuauaaa

SEQ ID NO: 492587 - RNA, 16 nt, Chlamydophila pneumoniae CWL029
gaucauuuuugcuaga

SEQ ID NO: 492588 - RNA, 16 nt, Chlamydophila pneumoniae CWL029
gauauugcggaaauug

SEQ ID NO: 492589 - RNA, 14 nt, Chlamydophila pneumoniae CWL029
gauauugcggaaau

SEQ ID NO: 492590 - RNA, 22 nt, Chlamydophila pneumoniae CWL029
gauauguccgugagcaacaagc

SEQ ID NO: 492591 - RNA, 11 nt, Chlamydophila pneumoniae CWL029
gauaucaccag

SEQ ID NO: 492592 - RNA, 16 nt, Chlamydophila pneumoniae CWL029
gauauccaccuuacca

SEQ ID NO: 492593 - RNA, 17 nt, Chlamydophila pneumoniae CWL029
gauaucugcucccuccu

SEQ ID NO: 492594 - RNA, 20 nt, Chlamydophila pneumoniae CWL029
gauaucucuaccgaacagag

SEQ ID NO: 492595 - RNA, 19 nt, Chlamydophila pneumoniae CWL029
gauaucggaccuacguuuu

SEQ ID NO: 492596 - RNA, 15 nt, Chlamydophila pneumoniae CWL029
gauaucgaccuuaaa

SEQ ID NO: 492597 - RNA, 13 nt, Chlamydophila pneumoniae CWL029
gauagagauucuu

SEQ ID NO: 492598 - RNA, 22 nt, Chlamydophila pneumoniae CWL029
gauagaucacaucaagauagag

SEQ ID NO: 492599 - RNA, 13 nt, Chlamydophila pneumoniae CWL029
gauagcaaaucaa

SEQ ID NO: 492600 - RNA, 20 nt, Chlamydophila pneumoniae CWL029
gauacuuagcaaucaguaaa

SEQ ID NO: 492601 - RNA, 15 nt, Chlamydophila pneumoniae CWL029
gauacuuaucuuuaa

SEQ ID NO: 492602 - RNA, 17 nt, Chlamydophila pneumoniae CWL029
gauacuguuuuuuaucu

SEQ ID NO: 492603 - RNA, 13 nt, Chlamydophila pneumoniae CWL029
gauacuucuucca

SEQ ID NO: 492604 - RNA, 22 nt, Chlamydophila pneumoniae CWL029
gauacuucuuccacgagauucu

SEQ ID NO: 492605 - RNA, 15 nt, Chlamydophila pneumoniae CWL029
gauaccaucaccuuc

SEQ ID NO: 492606 - RNA, 17 nt, Chlamydophila pneumoniae CWL029
gauacccaaagagggga

SEQ ID NO: 492607 - RNA, 16 nt, Chlamydophila pneumoniae CWL029
gauaacguugccuguu

SEQ ID NO: 492608 - RNA, 12 nt, Chlamydophila pneumoniae CWL029
gauaaucagagg

SEQ ID NO: 492609 - RNA, 15 nt, Chlamydophila pneumoniae CWL029
gauaaucagaggagc

SEQ ID NO: 492610 - RNA, 16 nt, Chlamydophila pneumoniae CWL029
gauaaucagaggagcc

SEQ ID NO: 492611 - RNA, 10 nt, Chlamydophila pneumoniae CWL029
gauaaucaaa

SEQ ID NO: 492612 - RNA, 22 nt, Chlamydophila pneumoniae CWL029
gauaaucgcacuucuauuucug

SEQ ID NO: 492613 - RNA, 10 nt, Chlamydophila pneumoniae CWL029
gauaaugauu

SEQ ID NO: 492614 - RNA, 17 nt, Chlamydophila pneumoniae CWL029
gauaaaacuauaaaagc

SEQ ID NO: 492615 - RNA, 19 nt, Chlamydophila pneumoniae CWL029
gauaaaagguauuucucuc

SEQ ID NO: 492616 - RNA, 19 nt, Chlamydophila pneumoniae CWL029
gauaaaggcauaacugugc

SEQ ID NO: 492617 - RNA, 23 nt, Chlamydophila pneumoniae CWL029
gaguuccaagacaauaaaaaaga

SEQ ID NO: 492618 - RNA, 22 nt, Chlamydophila pneumoniae CWL029
gagugcucuaccccacgcuaaa

SEQ ID NO: 492619 - RNA, 21 nt, Chlamydophila pneumoniae CWL029
gaguucgcacuaauuuccuuc

SEQ ID NO: 492620 - RNA, 23 nt, Chlamydophila pneumoniae CWL029
gaguucgcacuaauuuccuucag

SEQ ID NO: 492621 - RNA, 20 nt, Chlamydophila pneumoniae CWL029
gaguucgcgaccugugauuu

SEQ ID NO: 492622 - RNA, 16 nt, Chlamydophila pneumoniae CWL029
gaguucuuccuucuuc

SEQ ID NO: 492623 - RNA, 18 nt, Chlamydophila pneumoniae CWL029
gaguccaagguucuggga

SEQ ID NO: 492624 - RNA, 18 nt, Chlamydophila pneumoniae CWL029
gagucagguaaagagcuu

SEQ ID NO: 492625 - RNA, 15 nt, Chlamydophila pneumoniae CWL029
gagugccuucuucaa

SEQ ID NO: 492626 - RNA, 19 nt, Chlamydophila pneumoniae CWL029
gaguaugaggagauaaaga

SEQ ID NO: 492627 - RNA, 14 nt, Chlamydophila pneumoniae CWL029
gaguaugaggagau

SEQ ID NO: 492628 - RNA, 16 nt, Chlamydophila pneumoniae CWL029
gaguauggcaaauaaa

SEQ ID NO: 492629 - RNA, 19 nt, Chlamydophila pneumoniae CWL029
gaguauuuugcaaaugaaa

SEQ ID NO: 492630 - RNA, 15 nt, Chlamydophila pneumoniae CWL029
gagucaggaagaugc

SEQ ID NO: 492631 - RNA, 19 nt, Chlamydophila pneumoniae CWL029
gaauuucggacgauauuua

SEQ ID NO: 492632 - RNA, 14 nt, Chlamydophila pneumoniae CWL029
gccgugaagcagag

SEQ ID NO: 492633 - RNA, 14 nt, Chlamydophila pneumoniae CWL029
gccggcgguggaaa

SEQ ID NO: 492634 - RNA, 17 nt, Chlamydophila pneumoniae CWL029
gccggcgguggaaaagg

SEQ ID NO: 492635 - RNA, 19 nt, Chlamydophila pneumoniae CWL029
gccgacucuacaucuucuu

SEQ ID NO: 492636 - RNA, 15 nt, Chlamydophila pneumoniae CWL029
gccgaccaucauaau

SEQ ID NO: 492637 - RNA, 22 nt, Chlamydophila pneumoniae CWL029
gcccuuucugcaaucugaaugc

SEQ ID NO: 492638 - RNA, 14 nt, Chlamydophila pneumoniae CWL029
gcccuucaggacau

SEQ ID NO: 492639 - RNA, 19 nt, Chlamydophila pneumoniae CWL029
gcccuugcagcgacaacac

SEQ ID NO: 492640 - RNA, 15 nt, Chlamydophila pneumoniae CWL029
gcccuagauagcaaa

SEQ ID NO: 492641 - RNA, 19 nt, Chlamydophila pneumoniae CWL029
gcccuagauagcaaaucaa

SEQ ID NO: 492642 - RNA, 14 nt, Chlamydophila pneumoniae CWL029
gcccuauaguauaa

SEQ ID NO: 492643 - RNA, 23 nt, Chlamydophila pneumoniae CWL029
gcccgucuuagaauccaaagacu

SEQ ID NO: 492644 - RNA, 17 nt, Chlamydophila pneumoniae CWL029
gcccgaaauucauuaaa

SEQ ID NO: 492645 - RNA, 16 nt, Chlamydophila pneumoniae CWL029
gccccuccgauugcua

SEQ ID NO: 492646 - RNA, 16 nt, Chlamydophila pneumoniae CWL029
gcccagauucugaaga

SEQ ID NO: 492647 - RNA, 20 nt, Chlamydophila pneumoniae CWL029
gccauuugguaguuuuucag

SEQ ID NO: 492648 - RNA, 21 nt, Chlamydophila pneumoniae CWL029
gcccaaggaaaaacaaaccuc

SEQ ID NO: 492649 - RNA, 11 nt, Chlamydophila pneumoniae CWL029
gccauuagaau

SEQ ID NO: 492650 - RNA, 15 nt, Chlamydophila pneumoniae CWL029
gccauugaucagaau

SEQ ID NO: 492651 - RNA, 15 nt, Chlamydophila pneumoniae CWL029
gccauucuuaucugc

SEQ ID NO: 492652 - RNA, 20 nt, Chlamydophila pneumoniae CWL029
gccaggagagcuaacagcac

SEQ ID NO: 492653 - RNA, 16 nt, Chlamydophila pneumoniae CWL029
gccagcccaugucuuu

SEQ ID NO: 492654 - RNA, 12 nt, Chlamydophila pneumoniae CWL029
gccacagagaau

SEQ ID NO: 492655 - RNA, 15 nt, Chlamydophila pneumoniae CWL029
gccaccaacaguccu

SEQ ID NO: 492656 - RNA, 21 nt, Chlamydophila pneumoniae CWL029
gccaauuuucaggcccaccag

SEQ ID NO: 492657 - RNA, 18 nt, Chlamydophila pneumoniae CWL029
gccaaucccuaagguuuc

SEQ ID NO: 492658 - RNA, 22 nt, Chlamydophila pneumoniae CWL029
gccaaucccuaagguuuccaug

SEQ ID NO: 492659 - RNA, 16 nt, Chlamydophila pneumoniae CWL029
gccaaggucuucccga

SEQ ID NO: 492660 - RNA, 15 nt, Chlamydophila pneumoniae CWL029
gcauuucuuucucuu

SEQ ID NO: 492661 - RNA, 16 nt, Chlamydophila pneumoniae CWL029
gccaaagaacagcacu

SEQ ID NO: 492662 - RNA, 20 nt, Chlamydophila pneumoniae CWL029
gccaaagucacucaaacccu

SEQ ID NO: 492663 - RNA, 14 nt, Chlamydophila pneumoniae CWL029
gccaaauaccaagg

SEQ ID NO: 492664 - RNA, 17 nt, Chlamydophila pneumoniae CWL029
gccaaaauuuccuaccu

SEQ ID NO: 492665 - RNA, 16 nt, Chlamydophila pneumoniae CWL029
gccaaacgaauuucuu

SEQ ID NO: 492666 - RNA, 15 nt, Chlamydophila pneumoniae CWL029
gccaagagagcuugu

SEQ ID NO: 492667 - RNA, 22 nt, Chlamydophila pneumoniae CWL029
gcauucuguaauuuugagaagu

SEQ ID NO: 492668 - RNA, 15 nt, Chlamydophila pneumoniae CWL029
gcauucucaauucug

SEQ ID NO: 492669 - RNA, 15 nt, Chlamydophila pneumoniae CWL029
gcauucgauuuguaa

SEQ ID NO: 492670 - RNA, 22 nt, Chlamydophila pneumoniae CWL029
gcauuccgagcugcaaacacaa

SEQ ID NO: 492671 - RNA, 21 nt, Chlamydophila pneumoniae CWL029
gcauugcaaauaagccaguac

SEQ ID NO: 492672 - RNA, 22 nt, Chlamydophila pneumoniae CWL029
gcauugcuugcgcagcuucugg

SEQ ID NO: 492673 - RNA, 23 nt, Chlamydophila pneumoniae CWL029
gcauuuaaaacggcuguacuucc

SEQ ID NO: 492674 - RNA, 22 nt, Chlamydophila pneumoniae CWL029
gcauguauuguguucccucuuc

SEQ ID NO: 492675 - RNA, 19 nt, Chlamydophila pneumoniae CWL029
gcauguccauuaauauccc

SEQ ID NO: 492676 - RNA, 19 nt, Chlamydophila pneumoniae CWL029
gcauuaagauaaacagcac

SEQ ID NO: 492677 - RNA, 12 nt, Chlamydophila pneumoniae CWL029
gcauuaauaacu

SEQ ID NO: 492678 - RNA, 22 nt, Chlamydophila pneumoniae CWL029
gcauuacgguuucugggaugca

SEQ ID NO: 492679 - RNA, 14 nt, Chlamydophila pneumoniae CWL029
gcauuaccuuaucg

SEQ ID NO: 492680 - RNA, 13 nt, Chlamydophila pneumoniae CWL029
gcauggucuccca

SEQ ID NO: 492681 - RNA, 21 nt, Chlamydophila pneumoniae CWL029
gcauggcuuugugagcugcug

SEQ ID NO: 492682 - RNA, 22 nt, Chlamydophila pneumoniae CWL029
gcaugccauaaucuauaggauu

SEQ ID NO: 492683 - RNA, 12 nt, Chlamydophila pneumoniae CWL029
gcaugaggagac

SEQ ID NO: 492684 - RNA, 16 nt, Chlamydophila pneumoniae CWL029
gcaugacuauuuucau

SEQ ID NO: 492685 - RNA, 18 nt, Chlamydophila pneumoniae CWL029
gcaugaacgugcaucucu

SEQ ID NO: 492686 - RNA, 16 nt, Chlamydophila pneumoniae CWL029
gcaucuuuucaaaaga

SEQ ID NO: 492687 - RNA, 13 nt, Chlamydophila pneumoniae CWL029
gcaucuucucgaa

SEQ ID NO: 492688 - RNA, 17 nt, Chlamydophila pneumoniae CWL029
gcaucuucgauuucuag

SEQ ID NO: 492689 - RNA, 15 nt, Chlamydophila pneumoniae CWL029
gcaucuuauggaaga

SEQ ID NO: 492690 - RNA, 16 nt, Chlamydophila pneumoniae CWL029
gcaucuuauggaagag

SEQ ID NO: 492691 - RNA, 16 nt, Chlamydophila pneumoniae CWL029
gcaucuuggcgcacac

SEQ ID NO: 492692 - RNA, 21 nt, Chlamydophila pneumoniae CWL029
gcaucuuuggcacaauccuca

SEQ ID NO: 492693 - RNA, 20 nt, Chlamydophila pneumoniae CWL029
gcaucuugagguauuccuac

SEQ ID NO: 492694 - RNA, 15 nt, Chlamydophila pneumoniae CWL029
gcaucuuucaucaau

SEQ ID NO: 492695 - RNA, 11 nt, Chlamydophila pneumoniae CWL029
gcaucucugca

SEQ ID NO: 492696 - RNA, 13 nt, Chlamydophila pneumoniae CWL029
gcaucucucuuua

SEQ ID NO: 492697 - RNA, 19 nt, Chlamydophila pneumoniae CWL029
gcaucuagagucucuuuca

SEQ ID NO: 492698 - RNA, 17 nt, Chlamydophila pneumoniae CWL029
gcaucgcuaucagcugg

SEQ ID NO: 492699 - RNA, 21 nt, Chlamydophila pneumoniae CWL029
gcucuccuagacgaucuucag

SEQ ID NO: 492700 - RNA, 14 nt, Chlamydophila pneumoniae CWL029
gcucuccauggcuu

SEQ ID NO: 492701 - RNA, 13 nt, Chlamydophila pneumoniae CWL029
gcucucuucuucu

SEQ ID NO: 492702 - RNA, 16 nt, Chlamydophila pneumoniae CWL029
gcucucuucuucucag

SEQ ID NO: 492703 - RNA, 23 nt, Chlamydophila pneumoniae CWL029
gcucucuucuucucaggauccca

SEQ ID NO: 492704 - RNA, 16 nt, Chlamydophila pneumoniae CWL029
gcucucugaagcuaaa

SEQ ID NO: 492705 - RNA, 15 nt, Chlamydophila pneumoniae CWL029
gcucucgcuaagcaa

SEQ ID NO: 492706 - RNA, 16 nt, Chlamydophila pneumoniae CWL029
gcucucgcuaagcaaa

SEQ ID NO: 492707 - RNA, 22 nt, Chlamydophila pneumoniae CWL029
gcucucgcuaagcaaagcggcu

SEQ ID NO: 492708 - RNA, 12 nt, Chlamydophila pneumoniae CWL029
gcucucuagauu

SEQ ID NO: 492709 - RNA, 22 nt, Chlamydophila pneumoniae CWL029
gcucucaaggucacagcauuuu

SEQ ID NO: 492710 - RNA, 22 nt, Chlamydophila pneumoniae CWL029
gcucuaagcugugcauuuucuu

SEQ ID NO: 492711 - RNA, 15 nt, Chlamydophila pneumoniae CWL029
gcucuacaggagaag

SEQ ID NO: 492712 - RNA, 23 nt, Chlamydophila pneumoniae CWL029
gcucuaccccacgcuaaacuaaa

SEQ ID NO: 492713 - RNA, 18 nt, Chlamydophila pneumoniae CWL029
gcucuagauauucugauu

SEQ ID NO: 492714 - RNA, 23 nt, Chlamydophila pneumoniae CWL029
gcucuaaacucucuuccuucucc

SEQ ID NO: 492715 - RNA, 18 nt, Chlamydophila pneumoniae CWL029
gcucuaaacucucuuccu

SEQ ID NO: 492716 - RNA, 19 nt, Chlamydophila pneumoniae CWL029
gcucuaaacucucuuccuu

SEQ ID NO: 492717 - RNA, 16 nt, Chlamydophila pneumoniae CWL029
gcucguaauccuucuu

SEQ ID NO: 492718 - RNA, 12 nt, Chlamydophila pneumoniae CWL029
gcucguacuguu

SEQ ID NO: 492719 - RNA, 17 nt, Chlamydophila pneumoniae CWL029
gcucuuacuucuggucc

SEQ ID NO: 492720 - RNA, 19 nt, Chlamydophila pneumoniae CWL029
gcucuggauugaaagagcu

SEQ ID NO: 492721 - RNA, 20 nt, Chlamydophila pneumoniae CWL029
gcucuuugggauaaaaaguu

SEQ ID NO: 492722 - RNA, 23 nt, Chlamydophila pneumoniae CWL029
gcucuuugggauaaaaaguuuuu

SEQ ID NO: 492723 - RNA, 16 nt, Chlamydophila pneumoniae CWL029
gcucuuuuaacuuaaa

SEQ ID NO: 492724 - RNA, 19 nt, Chlamydophila pneumoniae CWL029
gcucuugagaaagcuucua

SEQ ID NO: 492725 - RNA, 12 nt, Chlamydophila pneumoniae CWL029
gcugauaaaaua

SEQ ID NO: 492726 - RNA, 17 nt, Chlamydophila pneumoniae CWL029
gcugagauggucgagaa

SEQ ID NO: 492727 - RNA, 17 nt, Chlamydophila pneumoniae CWL029
gcugagacauauugaag

SEQ ID NO: 492728 - RNA, 15 nt, Chlamydophila pneumoniae CWL029
gcugaggacgcagag

SEQ ID NO: 492729 - RNA, 22 nt, Chlamydophila pneumoniae CWL029
gcugaaaucaugccgagauuuu

SEQ ID NO: 492730 - RNA, 22 nt, Chlamydophila pneumoniae CWL029
gcugaaccuuugguagaaagac

SEQ ID NO: 492731 - RNA, 17 nt, Chlamydophila pneumoniae CWL029
gcugacaucuccaagau

SEQ ID NO: 492732 - RNA, 15 nt, Chlamydophila pneumoniae CWL029
gcucgagaucuuuuu

SEQ ID NO: 492733 - RNA, 20 nt, Chlamydophila pneumoniae CWL029
gcucgagaucuuuuugccag

SEQ ID NO: 492734 - RNA, 14 nt, Chlamydophila pneumoniae CWL029
gcuccuugacuaaa

SEQ ID NO: 492735 - RNA, 20 nt, Chlamydophila pneumoniae CWL029
gcucgaggucuuuucuuuuu

SEQ ID NO: 492736 - RNA, 16 nt, Chlamydophila pneumoniae CWL029
gcucccguuccuuuag

SEQ ID NO: 492737 - RNA, 20 nt, Chlamydophila pneumoniae CWL029
gcuccagaaacgcagcuuuc

SEQ ID NO: 492738 - RNA, 20 nt, Chlamydophila pneumoniae CWL029
gcucaugaaauuucauucuc

SEQ ID NO: 492739 - RNA, 19 nt, Chlamydophila pneumoniae CWL029
gcucaucggaucuuuucuu

SEQ ID NO: 492740 - RNA, 18 nt, Chlamydophila pneumoniae CWL029
gcucaagagcaugcuuga

SEQ ID NO: 492741 - RNA, 19 nt, Chlamydophila pneumoniae CWL029
gcucaaaauuuccucgacu

SEQ ID NO: 492742 - RNA, 22 nt, Chlamydophila pneumoniae CWL029
gcuauuuuccucuauauuuuuu

SEQ ID NO: 492743 - RNA, 21 nt, Chlamydophila pneumoniae CWL029
gcucaaaaaguuccauagagu

SEQ ID NO: 492744 - RNA, 14 nt, Chlamydophila pneumoniae CWL029
gcuauugaaaaauc

SEQ ID NO: 492745 - RNA, 14 nt, Chlamydophila pneumoniae CWL029
gcuaugaugagaac

SEQ ID NO: 492746 - RNA, 20 nt, Chlamydophila pneumoniae CWL029
gcuauguaggcagauagaca

SEQ ID NO: 492747 - RNA, 16 nt, Chlamydophila pneumoniae CWL029
gcuagaucacaagaaa

SEQ ID NO: 492748 - RNA, 17 nt, Chlamydophila pneumoniae CWL029
gcuagaggcaaacaggu

SEQ ID NO: 492749 - RNA, 22 nt, Chlamydophila pneumoniae CWL029
gcuagaucacaagaaagaaugg

SEQ ID NO: 492750 - RNA, 14 nt, Chlamydophila pneumoniae CWL029
gcuagaugaagagu

SEQ ID NO: 492751 - RNA, 15 nt, Chlamydophila pneumoniae CWL029
gcuagaugaagagug

SEQ ID NO: 492752 - RNA, 22 nt, Chlamydophila pneumoniae CWL029
gcuagaguccaagguucuggga

SEQ ID NO: 492753 - RNA, 16 nt, Chlamydophila pneumoniae CWL029
gcuagagcagcuguag

SEQ ID NO: 492754 - RNA, 13 nt, Chlamydophila pneumoniae CWL029
gcuagcuccagca

SEQ ID NO: 492755 - RNA, 17 nt, Chlamydophila pneumoniae CWL029
gcuagcucuuaaaugug

SEQ ID NO: 492756 - RNA, 14 nt, Chlamydophila pneumoniae CWL029
gcuaguuuaauagu

SEQ ID NO: 492757 - RNA, 17 nt, Chlamydophila pneumoniae CWL029
gcuauaccuauauagag

SEQ ID NO: 492758 - RNA, 18 nt, Chlamydophila pneumoniae CWL029
gcuauaccuauauagaga

SEQ ID NO: 492759 - RNA, 18 nt, Chlamydophila pneumoniae CWL029
gcuauacaaccacuuccu

SEQ ID NO: 492760 - RNA, 20 nt, Chlamydophila pneumoniae CWL029
gcuauacagaaaagaaugug

SEQ ID NO: 492761 - RNA, 21 nt, Chlamydophila pneumoniae CWL029
gcuauagauacuuugcaauac

SEQ ID NO: 492762 - RNA, 18 nt, Chlamydophila pneumoniae CWL029
gcuauagccuuguaaaua

SEQ ID NO: 492763 - RNA, 19 nt, Chlamydophila pneumoniae CWL029
gcuauagauuuuggagaca

SEQ ID NO: 492764 - RNA, 20 nt, Chlamydophila pneumoniae CWL029
gcuaucaaagacucaugaaa

SEQ ID NO: 492765 - RNA, 16 nt, Chlamydophila pneumoniae CWL029
gcuaucaacauccccc

SEQ ID NO: 492766 - RNA, 20 nt, Chlamydophila pneumoniae CWL029
gcuaucccacuaacaagaua

SEQ ID NO: 492767 - RNA, 14 nt, Chlamydophila pneumoniae CWL029
gcguugcuaagcau

SEQ ID NO: 492768 - RNA, 20 nt, Chlamydophila pneumoniae CWL029
gcgucaauaagcuugccagc

SEQ ID NO: 492769 - RNA, 23 nt, Chlamydophila pneumoniae CWL029
gcgucaauaagcuugccagcaga

SEQ ID NO: 492770 - RNA, 14 nt, Chlamydophila pneumoniae CWL029
gcgucacauuuguu

SEQ ID NO: 492771 - RNA, 12 nt, Chlamydophila pneumoniae CWL029
gcggcuaauuuc

SEQ ID NO: 492772 - RNA, 17 nt, Chlamydophila pneumoniae CWL029
gcggaguccuucuugca

SEQ ID NO: 492773 - RNA, 12 nt, Chlamydophila pneumoniae CWL029
gcggaacucauc

SEQ ID NO: 492774 - RNA, 15 nt, Chlamydophila pneumoniae CWL029
gcgcuuccagcuucu

SEQ ID NO: 492775 - RNA, 15 nt, Chlamydophila pneumoniae CWL029
gcgccuccaccugca

SEQ ID NO: 492776 - RNA, 16 nt, Chlamydophila pneumoniae CWL029
gcgcauaugcuccaga

SEQ ID NO: 492777 - RNA, 18 nt, Chlamydophila pneumoniae CWL029
gcgcaguggacggggaga

SEQ ID NO: 492778 - RNA, 17 nt, Chlamydophila pneumoniae CWL029
gcgcacaccagcucgag

SEQ ID NO: 492779 - RNA, 14 nt, Chlamydophila pneumoniae CWL029
gcgacgucaucaua

SEQ ID NO: 492780 - RNA, 17 nt, Chlamydophila pneumoniae CWL029
gcgacaugagaaaucuu

SEQ ID NO: 492781 - RNA, 15 nt, Chlamydophila pneumoniae CWL029
gcgaaugucguuaaa

SEQ ID NO: 492782 - RNA, 17 nt, Chlamydophila pneumoniae CWL029
gcgaaugucguuaaaaa

SEQ ID NO: 492783 - RNA, 16 nt, Chlamydophila pneumoniae CWL029
gcgaauccuagagaac

SEQ ID NO: 492784 - RNA, 21 nt, Chlamydophila pneumoniae CWL029
gcgaaacauuagucaauguau

SEQ ID NO: 492785 - RNA, 19 nt, Chlamydophila pneumoniae CWL029
gccuaaagcuccgagaaac

SEQ ID NO: 492786 - RNA, 18 nt, Chlamydophila pneumoniae CWL029
ggcccugacuuagagucu

SEQ ID NO: 492787 - RNA, 17 nt, Chlamydophila pneumoniae CWL029
ggcccccuacagcagaa

SEQ ID NO: 492788 - RNA, 15 nt, Chlamydophila pneumoniae CWL029
ggcauguuuaauauc

SEQ ID NO: 492789 - RNA, 17 nt, Chlamydophila pneumoniae CWL029
ggcauacaguagaaaca

SEQ ID NO: 492790 - RNA, 19 nt, Chlamydophila pneumoniae CWL029
ggcaguagguaagaagcug

SEQ ID NO: 492791 - RNA, 16 nt, Chlamydophila pneumoniae CWL029
ggauucugucuauaag

SEQ ID NO: 492792 - RNA, 14 nt, Chlamydophila pneumoniae CWL029
ggauucuaaaaaga

SEQ ID NO: 492793 - RNA, 20 nt, Chlamydophila pneumoniae CWL029
ggauucuaaaaagaaaagac

SEQ ID NO: 492794 - RNA, 17 nt, Chlamydophila pneumoniae CWL029
ggaugucuuguugcaug

SEQ ID NO: 492795 - RNA, 15 nt, Chlamydophila pneumoniae CWL029
ggauggucaggaaga

SEQ ID NO: 492796 - RNA, 23 nt, Chlamydophila pneumoniae CWL029
ggaucuucuucuggcugagagaa

SEQ ID NO: 492797 - RNA, 20 nt, Chlamydophila pneumoniae CWL029
ggaucuuuucuuucuaagau

SEQ ID NO: 492798 - RNA, 19 nt, Chlamydophila pneumoniae CWL029
ggaugaagauaaaaucuuc

SEQ ID NO: 492799 - RNA, 22 nt, Chlamydophila pneumoniae CWL029
ggaugaagauaaaaucuucauc

SEQ ID NO: 492800 - RNA, 14 nt, Chlamydophila pneumoniae CWL029
ggaucauugaguuc

SEQ ID NO: 492801 - RNA, 17 nt, Chlamydophila pneumoniae CWL029
ggaucauuaaaguccaa

SEQ ID NO: 492802 - RNA, 15 nt, Chlamydophila pneumoniae CWL029
ggaucauguagcaga

SEQ ID NO: 492803 - RNA, 17 nt, Chlamydophila pneumoniae CWL029
ggaucauguagcagagc

SEQ ID NO: 492804 - RNA, 15 nt, Chlamydophila pneumoniae CWL029
ggauccaucggcauu

SEQ ID NO: 492805 - RNA, 12 nt, Chlamydophila pneumoniae CWL029
ggauccaggagu

SEQ ID NO: 492806 - RNA, 20 nt, Chlamydophila pneumoniae CWL029
ggauaaugcucacuucuuug

SEQ ID NO: 492807 - RNA, 13 nt, Chlamydophila pneumoniae CWL029
ggauaauuaaacu

SEQ ID NO: 492808 - RNA, 17 nt, Chlamydophila pneumoniae CWL029
ggauauugauaaauccc

SEQ ID NO: 492809 - RNA, 22 nt, Chlamydophila pneumoniae CWL029
ggauaucuucuggguucuccac

SEQ ID NO: 492810 - RNA, 16 nt, Chlamydophila pneumoniae CWL029
ggaggaacaauacucu

SEQ ID NO: 492811 - RNA, 14 nt, Chlamydophila pneumoniae CWL029
ggaguuuuccuaaa

SEQ ID NO: 492812 - RNA, 15 nt, Chlamydophila pneumoniae CWL029
ggagcucgcuaaaca

SEQ ID NO: 492813 - RNA, 13 nt, Chlamydophila pneumoniae CWL029
ggagcuaaagcug

SEQ ID NO: 492814 - RNA, 19 nt, Chlamydophila pneumoniae CWL029
ggagcucuuucuuggauug

SEQ ID NO: 492815 - RNA, 19 nt, Chlamydophila pneumoniae CWL029
ggagcauagacucuuccuu

SEQ ID NO: 492816 - RNA, 22 nt, Chlamydophila pneumoniae CWL029
ggacuccaagaauagcaggaag

SEQ ID NO: 492817 - RNA, 11 nt, Chlamydophila pneumoniae CWL029
ggagaagcccc

SEQ ID NO: 492818 - RNA, 10 nt, Chlamydophila pneumoniae CWL029
ggagaagccc

SEQ ID NO: 492819 - RNA, 23 nt, Chlamydophila pneumoniae CWL029
ggagaaguuguuuauuuagcauu

SEQ ID NO: 492820 - RNA, 15 nt, Chlamydophila pneumoniae CWL029
ggagaauagcaagca

SEQ ID NO: 492821 - RNA, 16 nt, Chlamydophila pneumoniae CWL029
ggagacucagagaaaa

SEQ ID NO: 492822 - RNA, 20 nt, Chlamydophila pneumoniae CWL029
ggagagcuugguuuucuccu

SEQ ID NO: 492823 - RNA, 11 nt, Chlamydophila pneumoniae CWL029
ggagagguaau

SEQ ID NO: 492824 - RNA, 19 nt, Chlamydophila pneumoniae CWL029
ggagagguaaccagagagc

SEQ ID NO: 492825 - RNA, 18 nt, Chlamydophila pneumoniae CWL029
ggacgcuaauccuccucg

SEQ ID NO: 492826 - RNA, 13 nt, Chlamydophila pneumoniae CWL029
ggacuacugaaac

SEQ ID NO: 492827 - RNA, 12 nt, Chlamydophila pneumoniae CWL029
ggacgugggaga

SEQ ID NO: 492828 - RNA, 20 nt, Chlamydophila pneumoniae CWL029
ggacuaaacaagaaaaagca

SEQ ID NO: 492829 - RNA, 14 nt, Chlamydophila pneumoniae CWL029
ggacaaucaacauu

SEQ ID NO: 492830 - RNA, 15 nt, Chlamydophila pneumoniae CWL029
ggacaaugaagaacu

SEQ ID NO: 492831 - RNA, 17 nt, Chlamydophila pneumoniae CWL029
ggacacaacucuuuaau

SEQ ID NO: 492832 - RNA, 19 nt, Chlamydophila pneumoniae CWL029
ggacacuauuaucugcaga

SEQ ID NO: 492833 - RNA, 18 nt, Chlamydophila pneumoniae CWL029
ggacaccagcuucccaag

SEQ ID NO: 492834 - RNA, 22 nt, Chlamydophila pneumoniae CWL029
ggaauugcagcaaggagagugc

SEQ ID NO: 492835 - RNA, 19 nt, Chlamydophila pneumoniae CWL029
ggaauggcuuuuguuuugu

SEQ ID NO: 492836 - RNA, 15 nt, Chlamydophila pneumoniae CWL029
ggaaucccuuuuuaa

SEQ ID NO: 492837 - RNA, 22 nt, Chlamydophila pneumoniae CWL029
ggaauaucaggacaaugaagaa

SEQ ID NO: 492838 - RNA, 16 nt, Chlamydophila pneumoniae CWL029
ggaagcuuaucaagaa

SEQ ID NO: 492839 - RNA, 14 nt, Chlamydophila pneumoniae CWL029
ggaagacuuuuuaa

SEQ ID NO: 492840 - RNA, 16 nt, Chlamydophila pneumoniae CWL029
ggaagcaaagaaaauu

SEQ ID NO: 492841 - RNA, 20 nt, Chlamydophila pneumoniae CWL029
ggaagaugaauaccagaagc

SEQ ID NO: 492842 - RNA, 21 nt, Chlamydophila pneumoniae CWL029
ggaagaaaggauuggaugaga

SEQ ID NO: 492843 - RNA, 13 nt, Chlamydophila pneumoniae CWL029
ggaagaagaagaa

SEQ ID NO: 492844 - RNA, 14 nt, Chlamydophila pneumoniae CWL029
ggaacgcucucuag

SEQ ID NO: 492845 - RNA, 21 nt, Chlamydophila pneumoniae CWL029
ggaacuaaaaguuuuuuauuu

SEQ ID NO: 492846 - RNA, 22 nt, Chlamydophila pneumoniae CWL029
ggaacuaaagagaucacaggga

SEQ ID NO: 492847 - RNA, 19 nt, Chlamydophila pneumoniae CWL029
ggaacuacaggaauucuca

SEQ ID NO: 492848 - RNA, 18 nt, Chlamydophila pneumoniae CWL029
ggaacaugccaaauaucu

SEQ ID NO: 492849 - RNA, 20 nt, Chlamydophila pneumoniae CWL029
ggaacauaucgauaggauuc

SEQ ID NO: 492850 - RNA, 14 nt, Chlamydophila pneumoniae CWL029
ggaacaguauaauc

SEQ ID NO: 492851 - RNA, 22 nt, Chlamydophila pneumoniae CWL029
ggaaaguugcaacucucuuuaa

SEQ ID NO: 492852 - RNA, 15 nt, Chlamydophila pneumoniae CWL029
ggaaauuauggaggg

SEQ ID NO: 492853 - RNA, 21 nt, Chlamydophila pneumoniae CWL029
ggaacaaagcucuccuucaga

SEQ ID NO: 492854 - RNA, 17 nt, Chlamydophila pneumoniae CWL029
ggaaacauagaaucauu

SEQ ID NO: 492855 - RNA, 16 nt, Chlamydophila pneumoniae CWL029
ggaaacguucuuucaa

SEQ ID NO: 492856 - RNA, 22 nt, Chlamydophila pneumoniae CWL029
ggaaacuagauuucuacaaaca

SEQ ID NO: 492857 - RNA, 19 nt, Chlamydophila pneumoniae CWL029
ggaaagacucaucuuugaa

SEQ ID NO: 492858 - RNA, 16 nt, Chlamydophila pneumoniae CWL029
ggaaaaaggaggaugu

SEQ ID NO: 492859 - RNA, 12 nt, Chlamydophila pneumoniae CWL029
ggaaaaagccuu

SEQ ID NO: 492860 - RNA, 22 nt, Chlamydophila pneumoniae CWL029
ggaaaaccaugaguuuuucaga

SEQ ID NO: 492861 - RNA, 23 nt, Chlamydophila pneumoniae CWL029
ggaaaagccucgaaauuuucaga

SEQ ID NO: 492862 - RNA, 12 nt, Chlamydophila pneumoniae CWL029
ggaaaagaaaag

SEQ ID NO: 492863 - RNA, 13 nt, Chlamydophila pneumoniae CWL029
ggaaaaggaggag

SEQ ID NO: 492864 - RNA, 13 nt, Chlamydophila pneumoniae CWL029
gcuuuuugaauga

SEQ ID NO: 492865 - RNA, 16 nt, Chlamydophila pneumoniae CWL029
gcuuuuugaaugaucc

SEQ ID NO: 492866 - RNA, 12 nt, Chlamydophila pneumoniae CWL029
gcuuuucuucuu

SEQ ID NO: 492867 - RNA, 12 nt, Chlamydophila pneumoniae CWL029
gcuuuucuuuuu

SEQ ID NO: 492868 - RNA, 14 nt, Chlamydophila pneumoniae CWL029
gcuuuucuuuuucu

SEQ ID NO: 492869 - RNA, 19 nt, Chlamydophila pneumoniae CWL029
gcuuuucuuuuucuaggga

SEQ ID NO: 492870 - RNA, 18 nt, Chlamydophila pneumoniae CWL029
gcuuuugagauucaaaag

SEQ ID NO: 492871 - RNA, 14 nt, Chlamydophila pneumoniae CWL029
gcuuuuguuguuuu

SEQ ID NO: 492872 - RNA, 18 nt, Chlamydophila pneumoniae CWL029
gcuuugugaguucuuccu

SEQ ID NO: 492873 - RNA, 21 nt, Chlamydophila pneumoniae CWL029
gcuuugugagcugcugguccu

SEQ ID NO: 492874 - RNA, 19 nt, Chlamydophila pneumoniae CWL029
gcuuugugaguucuuccuu

SEQ ID NO: 492875 - RNA, 20 nt, Chlamydophila pneumoniae CWL029
gcuuugugaguucuuccuuc

SEQ ID NO: 492876 - RNA, 16 nt, Chlamydophila pneumoniae CWL029
gcuuugauaauagucu

SEQ ID NO: 492877 - RNA, 14 nt, Chlamydophila pneumoniae CWL029
gcuuugcaucccua

SEQ ID NO: 492878 - RNA, 19 nt, Chlamydophila pneumoniae CWL029
gcuuugccgccucagcacc

SEQ ID NO: 492879 - RNA, 20 nt, Chlamydophila pneumoniae CWL029
gcuuucuagggcaucuuuua

SEQ ID NO: 492880 - RNA, 14 nt, Chlamydophila pneumoniae CWL029
gcuuuccuuuugau

SEQ ID NO: 492881 - RNA, 18 nt, Chlamydophila pneumoniae CWL029
gcuuuauguuuuguccuu

SEQ ID NO: 492882 - RNA, 15 nt, Chlamydophila pneumoniae CWL029
gcuuuccuaaccauu

SEQ ID NO: 492883 - RNA, 16 nt, Chlamydophila pneumoniae CWL029
gcuuuagaaaagugcc

SEQ ID NO: 492884 - RNA, 13 nt, Chlamydophila pneumoniae CWL029
gcuuguuuuugca

SEQ ID NO: 492885 - RNA, 17 nt, Chlamydophila pneumoniae CWL029
gcuuguugguuaaaaua

SEQ ID NO: 492886 - RNA, 21 nt, Chlamydophila pneumoniae CWL029
gcuuuaaauuuuuuaggaucu

SEQ ID NO: 492887 - RNA, 14 nt, Chlamydophila pneumoniae CWL029
gcuuuaaauuuuuu

SEQ ID NO: 492888 - RNA, 15 nt, Chlamydophila pneumoniae CWL029
gcuuuaaguguuucu

SEQ ID NO: 492889 - RNA, 16 nt, Chlamydophila pneumoniae CWL029
gcuuuaaguguuucuu

SEQ ID NO: 492890 - RNA, 21 nt, Chlamydophila pneumoniae CWL029
gcuugucuacagaggaaucua

SEQ ID NO: 492891 - RNA, 21 nt, Chlamydophila pneumoniae CWL029
gcuugugcaugcaucuuauca

SEQ ID NO: 492892 - RNA, 18 nt, Chlamydophila pneumoniae CWL029
gcuugugcuaaagcagga

SEQ ID NO: 492893 - RNA, 17 nt, Chlamydophila pneumoniae CWL029
gcuugucgcgacaagac

SEQ ID NO: 492894 - RNA, 16 nt, Chlamydophila pneumoniae CWL029
gcuugccagcagaagu

SEQ ID NO: 492895 - RNA, 20 nt, Chlamydophila pneumoniae CWL029
gcuugauuuccugagagcgu

SEQ ID NO: 492896 - RNA, 15 nt, Chlamydophila pneumoniae CWL029
gcuugcgagcuucuu

SEQ ID NO: 492897 - RNA, 13 nt, Chlamydophila pneumoniae CWL029
gcuugcgcagcuu

SEQ ID NO: 492898 - RNA, 23 nt, Chlamydophila pneumoniae CWL029
gcuugcugauuucuuuuucagcu

SEQ ID NO: 492899 - RNA, 15 nt, Chlamydophila pneumoniae CWL029
gcuugcguuuccuag

SEQ ID NO: 492900 - RNA, 17 nt, Chlamydophila pneumoniae CWL029
gcuucuuuuuuuuucuu

SEQ ID NO: 492901 - RNA, 14 nt, Chlamydophila pneumoniae CWL029
gcuucuuucaaagc

SEQ ID NO: 492902 - RNA, 15 nt, Chlamydophila pneumoniae CWL029
gcuucuuucaaagcc

SEQ ID NO: 492903 - RNA, 20 nt, Chlamydophila pneumoniae CWL029
gcuucuuucucggucuuucu

SEQ ID NO: 492904 - RNA, 11 nt, Chlamydophila pneumoniae CWL029
gcuucuuucuu

SEQ ID NO: 492905 - RNA, 14 nt, Chlamydophila pneumoniae CWL029
gcuucuaucuugaa

SEQ ID NO: 492906 - RNA, 18 nt, Chlamydophila pneumoniae CWL029
gcuucuacgguaagaucu

SEQ ID NO: 492907 - RNA, 16 nt, Chlamydophila pneumoniae CWL029
gcuucuauuuuagaau

SEQ ID NO: 492908 - RNA, 15 nt, Chlamydophila pneumoniae CWL029
gcuucuccaacuucc

SEQ ID NO: 492909 - RNA, 22 nt, Chlamydophila pneumoniae CWL029
gcuucuaagaaacuuccaaaac

SEQ ID NO: 492910 - RNA, 16 nt, Chlamydophila pneumoniae CWL029
gcuucuacagcaucgg

SEQ ID NO: 492911 - RNA, 16 nt, Chlamydophila pneumoniae CWL029
gcuucuggagaaaaaa

SEQ ID NO: 492912 - RNA, 23 nt, Chlamydophila pneumoniae CWL029
gcuucuggauucaaauuugcucu

SEQ ID NO: 492913 - RNA, 13 nt, Chlamydophila pneumoniae CWL029
gcuucgcaaucuu

SEQ ID NO: 492914 - RNA, 16 nt, Chlamydophila pneumoniae CWL029
gcuucgcaaucuuuga

SEQ ID NO: 492915 - RNA, 17 nt, Chlamydophila pneumoniae CWL029
gcuucgcaaucuuugau

SEQ ID NO: 492916 - RNA, 21 nt, Chlamydophila pneumoniae CWL029
gcuuccuuggucuuauugaag

SEQ ID NO: 492917 - RNA, 13 nt, Chlamydophila pneumoniae CWL029
gcuuccuguagug

SEQ ID NO: 492918 - RNA, 18 nt, Chlamydophila pneumoniae CWL029
gcuuccaucguuagauuu

SEQ ID NO: 492919 - RNA, 15 nt, Chlamydophila pneumoniae CWL029
gcuuccagcuucucc

SEQ ID NO: 492920 - RNA, 19 nt, Chlamydophila pneumoniae CWL029
gcuucauuccuacaucugu

SEQ ID NO: 492921 - RNA, 18 nt, Chlamydophila pneumoniae CWL029
gcuucaaggcaucuucuu

SEQ ID NO: 492922 - RNA, 16 nt, Chlamydophila pneumoniae CWL029
gcuucacaucuuucuc

SEQ ID NO: 492923 - RNA, 19 nt, Chlamydophila pneumoniae CWL029
gcuucaccauuaagauauc

SEQ ID NO: 492924 - RNA, 16 nt, Chlamydophila pneumoniae CWL029
gcuuacuuucuuuuag

SEQ ID NO: 492925 - RNA, 21 nt, Chlamydophila pneumoniae CWL029
gcuuagcgaucucucuuccug

SEQ ID NO: 492926 - RNA, 14 nt, Chlamydophila pneumoniae CWL029
gcuuauagagagaa

SEQ ID NO: 492927 - RNA, 22 nt, Chlamydophila pneumoniae CWL029
gcuguuucuucugaauagcucu

SEQ ID NO: 492928 - RNA, 13 nt, Chlamydophila pneumoniae CWL029
gcuguuccaagag

SEQ ID NO: 492929 - RNA, 20 nt, Chlamydophila pneumoniae CWL029
gcugucuagaacacucagag

SEQ ID NO: 492930 - RNA, 19 nt, Chlamydophila pneumoniae CWL029
gcugugcauuuucuucuug

SEQ ID NO: 492931 - RNA, 13 nt, Chlamydophila pneumoniae CWL029
gcugugcauuuuc

SEQ ID NO: 492932 - RNA, 13 nt, Chlamydophila pneumoniae CWL029
gcuguggugguga

SEQ ID NO: 492933 - RNA, 18 nt, Chlamydophila pneumoniae CWL029
gcuguguuauggaaauca

SEQ ID NO: 492934 - RNA, 11 nt, Chlamydophila pneumoniae CWL029
gcuguauuuuc

SEQ ID NO: 492935 - RNA, 20 nt, Chlamydophila pneumoniae CWL029
gcuguagugauacuuuagaa

SEQ ID NO: 492936 - RNA, 16 nt, Chlamydophila pneumoniae CWL029
gcuguccagucuauag

SEQ ID NO: 492937 - RNA, 12 nt, Chlamydophila pneumoniae CWL029
gcuguacagaac

SEQ ID NO: 492938 - RNA, 15 nt, Chlamydophila pneumoniae CWL029
gcuguacagaacaau

SEQ ID NO: 492939 - RNA, 11 nt, Chlamydophila pneumoniae CWL029
gcugcuuugac

SEQ ID NO: 492940 - RNA, 19 nt, Chlamydophila pneumoniae CWL029
gcugcuuuuguuguuuuug

SEQ ID NO: 492941 - RNA, 14 nt, Chlamydophila pneumoniae CWL029
gcugcuucucuacu

SEQ ID NO: 492942 - RNA, 13 nt, Chlamydophila pneumoniae CWL029
gcuggaucuucug

SEQ ID NO: 492943 - RNA, 22 nt, Chlamydophila pneumoniae CWL029
gcuggaggccaaagaacagcac

SEQ ID NO: 492944 - RNA, 18 nt, Chlamydophila pneumoniae CWL029
gcugcugauccaaaagcg

SEQ ID NO: 492945 - RNA, 16 nt, Chlamydophila pneumoniae CWL029
gcugcugaauauaguu

SEQ ID NO: 492946 - RNA, 16 nt, Chlamydophila pneumoniae CWL029
gcugcucuuuuagaau

SEQ ID NO: 492947 - RNA, 17 nt, Chlamydophila pneumoniae CWL029
gcugcucuuuuagaaug

SEQ ID NO: 492948 - RNA, 19 nt, Chlamydophila pneumoniae CWL029
gcugcgucaauaagcuugc

SEQ ID NO: 492949 - RNA, 16 nt, Chlamydophila pneumoniae CWL029
gcugauuucuuuuuca

SEQ ID NO: 492950 - RNA, 23 nt, Chlamydophila pneumoniae CWL029
uacacuguuguaauaaaaucaug

SEQ ID NO: 492951 - RNA, 14 nt, Chlamydophila pneumoniae CWL029
uacagccagcagaa

SEQ ID NO: 492952 - RNA, 22 nt, Chlamydophila pneumoniae CWL029
uacagcauaaaaauucucauaa

SEQ ID NO: 492953 - RNA, 15 nt, Chlamydophila pneumoniae CWL029
uacagcauaaaaauu

SEQ ID NO: 492954 - RNA, 18 nt, Chlamydophila pneumoniae CWL029
uacacuccaauaagacga

SEQ ID NO: 492955 - RNA, 20 nt, Chlamydophila pneumoniae CWL029
uacaguuuguaaaaagccua

SEQ ID NO: 492956 - RNA, 18 nt, Chlamydophila pneumoniae CWL029
uacaguuuuuuucuaaau

SEQ ID NO: 492957 - RNA, 17 nt, Chlamydophila pneumoniae CWL029
uacagugacauccggau

SEQ ID NO: 492958 - RNA, 17 nt, Chlamydophila pneumoniae CWL029
uacaguaguaaauaaua

SEQ ID NO: 492959 - RNA, 18 nt, Chlamydophila pneumoniae CWL029
uacacauugucucuuuua

SEQ ID NO: 492960 - RNA, 21 nt, Chlamydophila pneumoniae CWL029
uacaauuuccuugguauccca

SEQ ID NO: 492961 - RNA, 17 nt, Chlamydophila pneumoniae CWL029
uacaaguugagagagag

SEQ ID NO: 492962 - RNA, 13 nt, Chlamydophila pneumoniae CWL029
uacaauuaaaaaa

SEQ ID NO: 492963 - RNA, 23 nt, Chlamydophila pneumoniae CWL029
uacaauuagagauucauaaaacu

SEQ ID NO: 492964 - RNA, 18 nt, Chlamydophila pneumoniae CWL029
uacaagugaagacaagua

SEQ ID NO: 492965 - RNA, 20 nt, Chlamydophila pneumoniae CWL029
uacaagcuucaucaaaacau

SEQ ID NO: 492966 - RNA, 11 nt, Chlamydophila pneumoniae CWL029
uacaagcaauu

SEQ ID NO: 492967 - RNA, 21 nt, Chlamydophila pneumoniae CWL029
uacaaacccauauuugaauaa

SEQ ID NO: 492968 - RNA, 23 nt, Chlamydophila pneumoniae CWL029
uacaaacccauauuugaauaaag

SEQ ID NO: 492969 - RNA, 13 nt, Chlamydophila pneumoniae CWL029
uacaaaaaauaaa

SEQ ID NO: 492970 - RNA, 16 nt, Chlamydophila pneumoniae CWL029
uacaaaacaaaagcca

SEQ ID NO: 492971 - RNA, 15 nt, Chlamydophila pneumoniae CWL029
uacaaaauuauuaaa

SEQ ID NO: 492972 - RNA, 13 nt, Chlamydophila pneumoniae CWL029
uacaaaauuauua

SEQ ID NO: 492973 - RNA, 12 nt, Chlamydophila pneumoniae CWL029
uacaaacaagaa

SEQ ID NO: 492974 - RNA, 15 nt, Chlamydophila pneumoniae CWL029
uaauuuuucuuagua

SEQ ID NO: 492975 - RNA, 19 nt, Chlamydophila pneumoniae CWL029
uaauuuuugcuaaacaaug

SEQ ID NO: 492976 - RNA, 16 nt, Chlamydophila pneumoniae CWL029
uacaaaaaauaaaauc

SEQ ID NO: 492977 - RNA, 17 nt, Chlamydophila pneumoniae CWL029
uaauuuuaaauuuuguu

SEQ ID NO: 492978 - RNA, 22 nt, Chlamydophila pneumoniae CWL029
uaauuucuuucacaucuuuaga

SEQ ID NO: 492979 - RNA, 17 nt, Chlamydophila pneumoniae CWL029
uaauuucuccgucaaga

SEQ ID NO: 492980 - RNA, 17 nt, Chlamydophila pneumoniae CWL029
uaauuucaggagcuccu

SEQ ID NO: 492981 - RNA, 17 nt, Chlamydophila pneumoniae CWL029
uaauuuccuucuccaga

SEQ ID NO: 492982 - RNA, 20 nt, Chlamydophila pneumoniae CWL029
uaauuucuaaauagaaaaca

SEQ ID NO: 492983 - RNA, 22 nt, Chlamydophila pneumoniae CWL029
uaaugcuaucccacuaacaaga

SEQ ID NO: 492984 - RNA, 22 nt, Chlamydophila pneumoniae CWL029
uaauuaaaaguucagcaaagaa

SEQ ID NO: 492985 - RNA, 18 nt, Chlamydophila pneumoniae CWL029
uaauuacagaucugcaua

SEQ ID NO: 492986 - RNA, 13 nt, Chlamydophila pneumoniae CWL029
uaauucaaaaaga

SEQ ID NO: 492987 - RNA, 15 nt, Chlamydophila pneumoniae CWL029
uaauucaaaaagaga

SEQ ID NO: 492988 - RNA, 19 nt, Chlamydophila pneumoniae CWL029
uaaugacagcugagaaauu

SEQ ID NO: 492989 - RNA, 21 nt, Chlamydophila pneumoniae CWL029
uaaugaagcagggaaaaugcg

SEQ ID NO: 492990 - RNA, 16 nt, Chlamydophila pneumoniae CWL029
uaaucuuuuuuaaagc

SEQ ID NO: 492991 - RNA, 16 nt, Chlamydophila pneumoniae CWL029
uaaugcagccacagcc

SEQ ID NO: 492992 - RNA, 22 nt, Chlamydophila pneumoniae CWL029
uaauccuguugucacuaagaua

SEQ ID NO: 492993 - RNA, 21 nt, Chlamydophila pneumoniae CWL029
uaauccuucuuucugcucuuc

SEQ ID NO: 492994 - RNA, 21 nt, Chlamydophila pneumoniae CWL029
uaauccugaauggcucuguca

SEQ ID NO: 492995 - RNA, 23 nt, Chlamydophila pneumoniae CWL029
uaauccugaauggcucugucacu

SEQ ID NO: 492996 - RNA, 19 nt, Chlamydophila pneumoniae CWL029
uaauccuguugucacuaag

SEQ ID NO: 492997 - RNA, 15 nt, Chlamydophila pneumoniae CWL029
uaauccuugagggcu

SEQ ID NO: 492998 - RNA, 20 nt, Chlamydophila pneumoniae CWL029
uaauccuuucacaaagaauu

SEQ ID NO: 492999 - RNA, 16 nt, Chlamydophila pneumoniae CWL029
uaauccucgauacugu

SEQ ID NO: 493000 - RNA, 18 nt, Chlamydophila pneumoniae CWL029
uaauccucgauacuguug

SEQ ID NO: 493001 - RNA, 16 nt, Chlamydophila pneumoniae CWL029
uaaucaugauaaaaau

SEQ ID NO: 493002 - RNA, 19 nt, Chlamydophila pneumoniae CWL029
uaaucaugauaaaaauuuu

SEQ ID NO: 493003 - RNA, 16 nt, Chlamydophila pneumoniae CWL029
uaaucauuaagacuca

SEQ ID NO: 493004 - RNA, 15 nt, Chlamydophila pneumoniae CWL029
uaaucagaggagccu

SEQ ID NO: 493005 - RNA, 17 nt, Chlamydophila pneumoniae CWL029
uaauaucgguuccuaua

SEQ ID NO: 493006 - RNA, 16 nt, Chlamydophila pneumoniae CWL029
uaauaucgguuucuuu

SEQ ID NO: 493007 - RNA, 19 nt, Chlamydophila pneumoniae CWL029
uaauaucgguuucuuuuuu

SEQ ID NO: 493008 - RNA, 15 nt, Chlamydophila pneumoniae CWL029
uaacguauuucacaa

SEQ ID NO: 493009 - RNA, 14 nt, Chlamydophila pneumoniae CWL029
uaacguugccuguu

SEQ ID NO: 493010 - RNA, 14 nt, Chlamydophila pneumoniae CWL029
uaauaggauaagaa

SEQ ID NO: 493011 - RNA, 21 nt, Chlamydophila pneumoniae CWL029
uacuguagaguuuucuuucac

SEQ ID NO: 493012 - RNA, 20 nt, Chlamydophila pneumoniae CWL029
uacuuacaagaacaaggcuc

SEQ ID NO: 493013 - RNA, 15 nt, Chlamydophila pneumoniae CWL029
uacuuacaagaacaa

SEQ ID NO: 493014 - RNA, 13 nt, Chlamydophila pneumoniae CWL029
uacuguuuuucuu

SEQ ID NO: 493015 - RNA, 19 nt, Chlamydophila pneumoniae CWL029
uacuuaagcacugaugaaa

SEQ ID NO: 493016 - RNA, 19 nt, Chlamydophila pneumoniae CWL029
uacuucacucuuucuguag

SEQ ID NO: 493017 - RNA, 18 nt, Chlamydophila pneumoniae CWL029
uacuucguuaugaagcuu

SEQ ID NO: 493018 - RNA, 12 nt, Chlamydophila pneumoniae CWL029
uagaaaaagauc

SEQ ID NO: 493019 - RNA, 14 nt, Chlamydophila pneumoniae CWL029
uacuuuugugaaga

SEQ ID NO: 493020 - RNA, 16 nt, Chlamydophila pneumoniae CWL029
uacuuuuacugaaauu

SEQ ID NO: 493021 - RNA, 21 nt, Chlamydophila pneumoniae CWL029
uacuucuccucgcaauccagg

SEQ ID NO: 493022 - RNA, 16 nt, Chlamydophila pneumoniae CWL029
uacuuuacacuauaag

SEQ ID NO: 493023 - RNA, 15 nt, Chlamydophila pneumoniae CWL029
uacuugggagaugcu

SEQ ID NO: 493024 - RNA, 19 nt, Chlamydophila pneumoniae CWL029
uacugaaucccguuaaaaa

SEQ ID NO: 493025 - RNA, 17 nt, Chlamydophila pneumoniae CWL029
uacugaaaccuucucuc

SEQ ID NO: 493026 - RNA, 20 nt, Chlamydophila pneumoniae CWL029
uacucugaacaggaauagaa

SEQ ID NO: 493027 - RNA, 13 nt, Chlamydophila pneumoniae CWL029
uacucucugcuuc

SEQ ID NO: 493028 - RNA, 23 nt, Chlamydophila pneumoniae CWL029
uacucuacaguaguaaauaauaa

SEQ ID NO: 493029 - RNA, 19 nt, Chlamydophila pneumoniae CWL029
uacucucagcaaagacauc

SEQ ID NO: 493030 - RNA, 17 nt, Chlamydophila pneumoniae CWL029
uacugccagcgaucaca

SEQ ID NO: 493031 - RNA, 19 nt, Chlamydophila pneumoniae CWL029
uacugcugcuaagccaaau

SEQ ID NO: 493032 - RNA, 18 nt, Chlamydophila pneumoniae CWL029
uacugaggaaaucgcauu

SEQ ID NO: 493033 - RNA, 22 nt, Chlamydophila pneumoniae CWL029
uacugaggaaaucgcauuacaa

SEQ ID NO: 493034 - RNA, 12 nt, Chlamydophila pneumoniae CWL029
uacguuuucucu

SEQ ID NO: 493035 - RNA, 13 nt, Chlamydophila pneumoniae CWL029
uacguuuucucua

SEQ ID NO: 493036 - RNA, 15 nt, Chlamydophila pneumoniae CWL029
uacguuuuuuuccuu

SEQ ID NO: 493037 - RNA, 16 nt, Chlamydophila pneumoniae CWL029
uacucauauuuugucu

SEQ ID NO: 493038 - RNA, 15 nt, Chlamydophila pneumoniae CWL029
uacuccauuggcaua

SEQ ID NO: 493039 - RNA, 21 nt, Chlamydophila pneumoniae CWL029
uaccuauugugcuuuucucuu

SEQ ID NO: 493040 - RNA, 19 nt, Chlamydophila pneumoniae CWL029
uaccuacuaaacccugucc

SEQ ID NO: 493041 - RNA, 19 nt, Chlamydophila pneumoniae CWL029
uaccuagggucuucucgag

SEQ ID NO: 493042 - RNA, 22 nt, Chlamydophila pneumoniae CWL029
uaccuaguagagguugagugaa

SEQ ID NO: 493043 - RNA, 14 nt, Chlamydophila pneumoniae CWL029
uaccuugagacaaa

SEQ ID NO: 493044 - RNA, 20 nt, Chlamydophila pneumoniae CWL029
uacgauagccaucauaaaac

SEQ ID NO: 493045 - RNA, 17 nt, Chlamydophila pneumoniae CWL029
uacgaaaacaucuguau

SEQ ID NO: 493046 - RNA, 14 nt, Chlamydophila pneumoniae CWL029
uacgaauaaguuuu

SEQ ID NO: 493047 - RNA, 19 nt, Chlamydophila pneumoniae CWL029
uacgaauccaaaaaagagc

SEQ ID NO: 493048 - RNA, 15 nt, Chlamydophila pneumoniae CWL029
uaccuuucuaagaau

SEQ ID NO: 493049 - RNA, 12 nt, Chlamydophila pneumoniae CWL029
uaccuuucuaag

SEQ ID NO: 493050 - RNA, 20 nt, Chlamydophila pneumoniae CWL029
uacggaugggcacucuucca

SEQ ID NO: 493051 - RNA, 18 nt, Chlamydophila pneumoniae CWL029
uacguaccguauccucua

SEQ ID NO: 493052 - RNA, 19 nt, Chlamydophila pneumoniae CWL029
uacguaguccuuauuucaa

SEQ ID NO: 493053 - RNA, 20 nt, Chlamydophila pneumoniae CWL029
uacgcuauucuuaagcuacc

SEQ ID NO: 493054 - RNA, 12 nt, Chlamydophila pneumoniae CWL029
uacauaaaauga

SEQ ID NO: 493055 - RNA, 22 nt, Chlamydophila pneumoniae CWL029
uaccaggcugcgcuacacccag

SEQ ID NO: 493056 - RNA, 14 nt, Chlamydophila pneumoniae CWL029
uacccuucuucuuc

SEQ ID NO: 493057 - RNA, 20 nt, Chlamydophila pneumoniae CWL029
uacccaaauuucuucuggau

SEQ ID NO: 493058 - RNA, 22 nt, Chlamydophila pneumoniae CWL029
uagguccguuuuuucagaugau

SEQ ID NO: 493059 - RNA, 14 nt, Chlamydophila pneumoniae CWL029
uagggaaaaaguag

SEQ ID NO: 493060 - RNA, 20 nt, Chlamydophila pneumoniae CWL029
uaggugaaauauugaucuuu

SEQ ID NO: 493061 - RNA, 19 nt, Chlamydophila pneumoniae CWL029
uaggucuuaaaguagccau

SEQ ID NO: 493062 - RNA, 14 nt, Chlamydophila pneumoniae CWL029
uaggucucuugcca

SEQ ID NO: 493063 - RNA, 23 nt, Chlamydophila pneumoniae CWL029
uagguucuuuucggaucagaaug

SEQ ID NO: 493064 - RNA, 13 nt, Chlamydophila pneumoniae CWL029
uagguuucaggaa

SEQ ID NO: 493065 - RNA, 22 nt, Chlamydophila pneumoniae CWL029
uaggugaaauauugaucuuucc

SEQ ID NO: 493066 - RNA, 22 nt, Chlamydophila pneumoniae CWL029
uaggugauauuuucuugucucu

SEQ ID NO: 493067 - RNA, 17 nt, Chlamydophila pneumoniae CWL029
uaguaaaauaagaaauc

SEQ ID NO: 493068 - RNA, 12 nt, Chlamydophila pneumoniae CWL029
uaguaaagaauc

SEQ ID NO: 493069 - RNA, 21 nt, Chlamydophila pneumoniae CWL029
uaguaaagccacauucuucug

SEQ ID NO: 493070 - RNA, 20 nt, Chlamydophila pneumoniae CWL029
uaguaaaugccucuuucaua

SEQ ID NO: 493071 - RNA, 14 nt, Chlamydophila pneumoniae CWL029
uaguaacuaaauuc

SEQ ID NO: 493072 - RNA, 22 nt, Chlamydophila pneumoniae CWL029
uaguaauaucuccgccauaaca

SEQ ID NO: 493073 - RNA, 19 nt, Chlamydophila pneumoniae CWL029
uaguaaggagagacugugu

SEQ ID NO: 493074 - RNA, 20 nt, Chlamydophila pneumoniae CWL029
uaguaauuacagcuuuaauc

SEQ ID NO: 493075 - RNA, 14 nt, Chlamydophila pneumoniae CWL029
uaguauuuuuaaau

SEQ ID NO: 493076 - RNA, 13 nt, Chlamydophila pneumoniae CWL029
uaguauuuuuaaa

SEQ ID NO: 493077 - RNA, 15 nt, Chlamydophila pneumoniae CWL029
uagucaaaaauucuu

SEQ ID NO: 493078 - RNA, 23 nt, Chlamydophila pneumoniae CWL029
uagucaugauuuuucaaucaaua

SEQ ID NO: 493079 - RNA, 15 nt, Chlamydophila pneumoniae CWL029
uagugacuccugguu

SEQ ID NO: 493080 - RNA, 19 nt, Chlamydophila pneumoniae CWL029
uagugauacuuuagaaucc

SEQ ID NO: 493081 - RNA, 16 nt, Chlamydophila pneumoniae CWL029
uagugagauagucuug

SEQ ID NO: 493082 - RNA, 22 nt, Chlamydophila pneumoniae CWL029
uaguucguucaucugucauuaa

SEQ ID NO: 493083 - RNA, 17 nt, Chlamydophila pneumoniae CWL029
uaguucguucaucuguc

SEQ ID NO: 493084 - RNA, 12 nt, Chlamydophila pneumoniae CWL029
uaguucauuagc

SEQ ID NO: 493085 - RNA, 23 nt, Chlamydophila pneumoniae CWL029
uaguucucuaagacuguguuuua

SEQ ID NO: 493086 - RNA, 11 nt, Chlamydophila pneumoniae CWL029
uaguucuucuu

SEQ ID NO: 493087 - RNA, 18 nt, Chlamydophila pneumoniae CWL029
uaguugcaugacuauuuu

SEQ ID NO: 493088 - RNA, 21 nt, Chlamydophila pneumoniae CWL029
uaguugcaugacuauuuucau

SEQ ID NO: 493089 - RNA, 19 nt, Chlamydophila pneumoniae CWL029
uagugcauaccuuaccauc

SEQ ID NO: 493090 - RNA, 19 nt, Chlamydophila pneumoniae CWL029
uagugcgaugggaagagag

SEQ ID NO: 493091 - RNA, 20 nt, Chlamydophila pneumoniae CWL029
uaguucaucauauuuuucuu

SEQ ID NO: 493092 - RNA, 21 nt, Chlamydophila pneumoniae CWL029
uaguuguugcggauuugcauu

SEQ ID NO: 493093 - RNA, 17 nt, Chlamydophila pneumoniae CWL029
uauaacugcauacaagg

SEQ ID NO: 493094 - RNA, 13 nt, Chlamydophila pneumoniae CWL029
uauaaagguuaca

SEQ ID NO: 493095 - RNA, 23 nt, Chlamydophila pneumoniae CWL029
uauaaagauaaucuguaagaaaa

SEQ ID NO: 493096 - RNA, 16 nt, Chlamydophila pneumoniae CWL029
uauaaagcaaaugccu

SEQ ID NO: 493097 - RNA, 17 nt, Chlamydophila pneumoniae CWL029
uauaagugacuuuucuu

SEQ ID NO: 493098 - RNA, 19 nt, Chlamydophila pneumoniae CWL029
uauaagugacuuuucuucu

SEQ ID NO: 493099 - RNA, 17 nt, Chlamydophila pneumoniae CWL029
uauaagggggaucuuca

SEQ ID NO: 493100 - RNA, 23 nt, Chlamydophila pneumoniae CWL029
uauaagggggaucuucagagaga

SEQ ID NO: 493101 - RNA, 23 nt, Chlamydophila pneumoniae CWL029
uauaagauaauagagaagaagca

SEQ ID NO: 493102 - RNA, 17 nt, Chlamydophila pneumoniae CWL029
uagcuuacuuucuuuua

SEQ ID NO: 493103 - RNA, 16 nt, Chlamydophila pneumoniae CWL029
uagcuauuuuugagga

SEQ ID NO: 493104 - RNA, 21 nt, Chlamydophila pneumoniae CWL029
uaggagaaaucacacuuaaag

SEQ ID NO: 493105 - RNA, 18 nt, Chlamydophila pneumoniae CWL029
uaggacagcacauagagu

SEQ ID NO: 493106 - RNA, 22 nt, Chlamydophila pneumoniae CWL029
uaggaccuacugggaaaucuaa

SEQ ID NO: 493107 - RNA, 20 nt, Chlamydophila pneumoniae CWL029
uaggcccugacuuagagucu

SEQ ID NO: 493108 - RNA, 16 nt, Chlamydophila pneumoniae CWL029
uaggcauacaguagaa

SEQ ID NO: 493109 - RNA, 22 nt, Chlamydophila pneumoniae CWL029
uaggcaguggcucuauagggga

SEQ ID NO: 493110 - RNA, 22 nt, Chlamydophila pneumoniae CWL029
uaggcauacaguagaaacaugg

SEQ ID NO: 493111 - RNA, 18 nt, Chlamydophila pneumoniae CWL029
uaggagagcuugguuuuc

SEQ ID NO: 493112 - RNA, 21 nt, Chlamydophila pneumoniae CWL029
uaggagagcuugguuuucucc

SEQ ID NO: 493113 - RNA, 23 nt, Chlamydophila pneumoniae CWL029
uaggagagcuugguuuucuccuu

SEQ ID NO: 493114 - RNA, 12 nt, Chlamydophila pneumoniae CWL029
uaggauucggac

SEQ ID NO: 493115 - RNA, 18 nt, Chlamydophila pneumoniae CWL029
uaggauuugcauagaggg

SEQ ID NO: 493116 - RNA, 12 nt, Chlamydophila pneumoniae CWL029
uaggauuugcau

SEQ ID NO: 493117 - RNA, 19 nt, Chlamydophila pneumoniae CWL029
uaggcacaucauuaucaua

SEQ ID NO: 493118 - RNA, 19 nt, Chlamydophila pneumoniae CWL029
uagcccuacgaauccaaaa

SEQ ID NO: 493119 - RNA, 11 nt, Chlamydophila pneumoniae CWL029
uagcccuugca

SEQ ID NO: 493120 - RNA, 18 nt, Chlamydophila pneumoniae CWL029
uagcgcuuuuuuaaagug

SEQ ID NO: 493121 - RNA, 15 nt, Chlamydophila pneumoniae CWL029
uagcuacaagucccc

SEQ ID NO: 493122 - RNA, 14 nt, Chlamydophila pneumoniae CWL029
uagcgucucuucuu

SEQ ID NO: 493123 - RNA, 22 nt, Chlamydophila pneumoniae CWL029
uagcgguacuugcgaaagaucc

SEQ ID NO: 493124 - RNA, 19 nt, Chlamydophila pneumoniae CWL029
uagcauguucgauuuucuc

SEQ ID NO: 493125 - RNA, 14 nt, Chlamydophila pneumoniae CWL029
uagcauugcuugcg

SEQ ID NO: 493126 - RNA, 14 nt, Chlamydophila pneumoniae CWL029
uagcaucucucucc

SEQ ID NO: 493127 - RNA, 14 nt, Chlamydophila pneumoniae CWL029
uagcauuucucuau

SEQ ID NO: 493128 - RNA, 15 nt, Chlamydophila pneumoniae CWL029
uagcauuucuuucuc

SEQ ID NO: 493129 - RNA, 16 nt, Chlamydophila pneumoniae CWL029
uagcauuucuuucucu

SEQ ID NO: 493130 - RNA, 13 nt, Chlamydophila pneumoniae CWL029
uagccccauagag

SEQ ID NO: 493131 - RNA, 16 nt, Chlamydophila pneumoniae CWL029
uagccccauagagccu

SEQ ID NO: 493132 - RNA, 14 nt, Chlamydophila pneumoniae CWL029
uagccccuccaaca

SEQ ID NO: 493133 - RNA, 18 nt, Chlamydophila pneumoniae CWL029
uagcccgaaauucauuaa

SEQ ID NO: 493134 - RNA, 15 nt, Chlamydophila pneumoniae CWL029
uagauuuuucuuuua

SEQ ID NO: 493135 - RNA, 18 nt, Chlamydophila pneumoniae CWL029
uagauuuuucuuuuagag

SEQ ID NO: 493136 - RNA, 13 nt, Chlamydophila pneumoniae CWL029
uagcagagccuca

SEQ ID NO: 493137 - RNA, 21 nt, Chlamydophila pneumoniae CWL029
uagcagcccgcacaucaugcu

SEQ ID NO: 493138 - RNA, 19 nt, Chlamydophila pneumoniae CWL029
uagauuuuuacuugcccaa

SEQ ID NO: 493139 - RNA, 17 nt, Chlamydophila pneumoniae CWL029
uagauuguuagugagau

SEQ ID NO: 493140 - RNA, 15 nt, Chlamydophila pneumoniae CWL029
uagauuccccaaacu

SEQ ID NO: 493141 - RNA, 13 nt, Chlamydophila pneumoniae CWL029
uagaugucaguau

SEQ ID NO: 493142 - RNA, 10 nt, Chlamydophila pneumoniae CWL029
uagaaaagau

SEQ ID NO: 493143 - RNA, 12 nt, Chlamydophila pneumoniae CWL029
uagaucuucaau

SEQ ID NO: 493144 - RNA, 18 nt, Chlamydophila pneumoniae CWL029
uagaucuucugaaaucaa

SEQ ID NO: 493145 - RNA, 19 nt, Chlamydophila pneumoniae CWL029
uagaucuucugaaaucaaa

SEQ ID NO: 493146 - RNA, 19 nt, Chlamydophila pneumoniae CWL029
uagaucuuuucuacuucag

SEQ ID NO: 493147 - RNA, 16 nt, Chlamydophila pneumoniae CWL029
uaucugcgacaaaaau

SEQ ID NO: 493148 - RNA, 10 nt, Chlamydophila pneumoniae CWL029
uaucugcuau

SEQ ID NO: 493149 - RNA, 15 nt, Chlamydophila pneumoniae CWL029
uaucugcguuucuuu

SEQ ID NO: 493150 - RNA, 13 nt, Chlamydophila pneumoniae CWL029
uaucuucuaaaac

SEQ ID NO: 493151 - RNA, 21 nt, Chlamydophila pneumoniae CWL029
uaucuuguuucguaagagaau

SEQ ID NO: 493152 - RNA, 20 nt, Chlamydophila pneumoniae CWL029
uaucuuuaagauuuuuagaa

SEQ ID NO: 493153 - RNA, 14 nt, Chlamydophila pneumoniae CWL029
uaucuuuaagauuu

SEQ ID NO: 493154 - RNA, 19 nt, Chlamydophila pneumoniae CWL029
uaucuuuacuaacaaaauu

SEQ ID NO: 493155 - RNA, 22 nt, Chlamydophila pneumoniae CWL029
uaucuuuauuuaaauaaaacca

SEQ ID NO: 493156 - RNA, 19 nt, Chlamydophila pneumoniae CWL029
uaugaacgauuucuuuuag

SEQ ID NO: 493157 - RNA, 18 nt, Chlamydophila pneumoniae CWL029
uaugaacugccugagaaa

SEQ ID NO: 493158 - RNA, 16 nt, Chlamydophila pneumoniae CWL029
uaugaaucacaucuaa

SEQ ID NO: 493159 - RNA, 21 nt, Chlamydophila pneumoniae CWL029
uaugaaugauuuccauagagu

SEQ ID NO: 493160 - RNA, 19 nt, Chlamydophila pneumoniae CWL029
uaugaauuagggcuuuuac

SEQ ID NO: 493161 - RNA, 15 nt, Chlamydophila pneumoniae CWL029
uaugaaacccauaau

SEQ ID NO: 493162 - RNA, 21 nt, Chlamydophila pneumoniae CWL029
uaugacacagcuaaucaaucc

SEQ ID NO: 493163 - RNA, 15 nt, Chlamydophila pneumoniae CWL029
uaugaccaagaacau

SEQ ID NO: 493164 - RNA, 12 nt, Chlamydophila pneumoniae CWL029
uaugcaucaaug

SEQ ID NO: 493165 - RNA, 14 nt, Chlamydophila pneumoniae CWL029
uaugcacaaaauaa

SEQ ID NO: 493166 - RNA, 23 nt, Chlamydophila pneumoniae CWL029
uaugcacgcuuucgucuaaaaua

SEQ ID NO: 493167 - RNA, 16 nt, Chlamydophila pneumoniae CWL029
uaugcacaaaauaaaa

SEQ ID NO: 493168 - RNA, 22 nt, Chlamydophila pneumoniae CWL029
uaugcaaaacaacauucguuag

SEQ ID NO: 493169 - RNA, 15 nt, Chlamydophila pneumoniae CWL029
uaugaugccucauug

SEQ ID NO: 493170 - RNA, 17 nt, Chlamydophila pneumoniae CWL029
uaugaugccucauugcc

SEQ ID NO: 493171 - RNA, 16 nt, Chlamydophila pneumoniae CWL029
uaugauguauaaaguu

SEQ ID NO: 493172 - RNA, 15 nt, Chlamydophila pneumoniae CWL029
uaugauguauaaagu

SEQ ID NO: 493173 - RNA, 15 nt, Chlamydophila pneumoniae CWL029
uaugauuacaucuaa

SEQ ID NO: 493174 - RNA, 20 nt, Chlamydophila pneumoniae CWL029
uaugcugaauuccucugauu

SEQ ID NO: 493175 - RNA, 15 nt, Chlamydophila pneumoniae CWL029
uauggaagauaaaca

SEQ ID NO: 493176 - RNA, 19 nt, Chlamydophila pneumoniae CWL029
uauggcagccuggaaagcu

SEQ ID NO: 493177 - RNA, 18 nt, Chlamydophila pneumoniae CWL029
uaugcgacccauuugucu

SEQ ID NO: 493178 - RNA, 17 nt, Chlamydophila pneumoniae CWL029
uaugccauaaauacagg

SEQ ID NO: 493179 - RNA, 13 nt, Chlamydophila pneumoniae CWL029
uaugcccaaggaa

SEQ ID NO: 493180 - RNA, 14 nt, Chlamydophila pneumoniae CWL029
uaugcccaaggaaa

SEQ ID NO: 493181 - RNA, 15 nt, Chlamydophila pneumoniae CWL029
uaugcccaaggaaaa

SEQ ID NO: 493182 - RNA, 19 nt, Chlamydophila pneumoniae CWL029
uauguauaacaucuaaaaa

SEQ ID NO: 493183 - RNA, 20 nt, Chlamydophila pneumoniae CWL029
uaugggaggaauuccucuca

SEQ ID NO: 493184 - RNA, 17 nt, Chlamydophila pneumoniae CWL029
uaugguccauaauuucu

SEQ ID NO: 493185 - RNA, 20 nt, Chlamydophila pneumoniae CWL029
uauggucucccucacaagaa

SEQ ID NO: 493186 - RNA, 19 nt, Chlamydophila pneumoniae CWL029
uauguuuucucgaagaaaa

SEQ ID NO: 493187 - RNA, 23 nt, Chlamydophila pneumoniae CWL029
uauguuuucucgaagaaaauaaa

SEQ ID NO: 493188 - RNA, 13 nt, Chlamydophila pneumoniae CWL029
uauuaaaaauagc

SEQ ID NO: 493189 - RNA, 20 nt, Chlamydophila pneumoniae CWL029
uauuaaaaauagcuuacuuu

SEQ ID NO: 493190 - RNA, 14 nt, Chlamydophila pneumoniae CWL029
uauguuaaaaauac

SEQ ID NO: 493191 - RNA, 17 nt, Chlamydophila pneumoniae CWL029
uauccuguuucaacaua

SEQ ID NO: 493192 - RNA, 15 nt, Chlamydophila pneumoniae CWL029
uauccucgucuucaa

SEQ ID NO: 493193 - RNA, 18 nt, Chlamydophila pneumoniae CWL029
uauccugaacaucuccag

SEQ ID NO: 493194 - RNA, 20 nt, Chlamydophila pneumoniae CWL029
uaucggaccuacguuuucuc

SEQ ID NO: 493195 - RNA, 21 nt, Chlamydophila pneumoniae CWL029
uaucggaccuacguuuucucu

SEQ ID NO: 493196 - RNA, 17 nt, Chlamydophila pneumoniae CWL029
uaucggcaauuguuaaa

SEQ ID NO: 493197 - RNA, 18 nt, Chlamydophila pneumoniae CWL029
uaucucccaagacgagaa

SEQ ID NO: 493198 - RNA, 20 nt, Chlamydophila pneumoniae CWL029
uaucuccggaacgcagaguu

SEQ ID NO: 493199 - RNA, 19 nt, Chlamydophila pneumoniae CWL029
uaucuccgggaacaacugu

SEQ ID NO: 493200 - RNA, 18 nt, Chlamydophila pneumoniae CWL029
uaucuccguuaccaaaaa

SEQ ID NO: 493201 - RNA, 14 nt, Chlamydophila pneumoniae CWL029
uaucguuucaguuu

SEQ ID NO: 493202 - RNA, 13 nt, Chlamydophila pneumoniae CWL029
uaucuaaaacuuc

SEQ ID NO: 493203 - RNA, 15 nt, Chlamydophila pneumoniae CWL029
uaucuauuaagccgc

SEQ ID NO: 493204 - RNA, 19 nt, Chlamydophila pneumoniae CWL029
uauccaugacuuuuguugc

SEQ ID NO: 493205 - RNA, 12 nt, Chlamydophila pneumoniae CWL029
uaucccacagaa

SEQ ID NO: 493206 - RNA, 13 nt, Chlamydophila pneumoniae CWL029
uauccauacggua

SEQ ID NO: 493207 - RNA, 21 nt, Chlamydophila pneumoniae CWL029
uauccagaaagauucugccca

SEQ ID NO: 493208 - RNA, 23 nt, Chlamydophila pneumoniae CWL029
uauccaaagccggcccacucaaa

SEQ ID NO: 493209 - RNA, 14 nt, Chlamydophila pneumoniae CWL029
uauccaaugagaga

SEQ ID NO: 493210 - RNA, 21 nt, Chlamydophila pneumoniae CWL029
uaucauugcuauugaaaaauc

SEQ ID NO: 493211 - RNA, 18 nt, Chlamydophila pneumoniae CWL029
uaucagauccaugaacag

SEQ ID NO: 493212 - RNA, 15 nt, Chlamydophila pneumoniae CWL029
uaucagcaaaaaacu

SEQ ID NO: 493213 - RNA, 21 nt, Chlamydophila pneumoniae CWL029
uauaucagcaaaaaacugcaa

SEQ ID NO: 493214 - RNA, 20 nt, Chlamydophila pneumoniae CWL029
uauaguauaauagugagcuc

SEQ ID NO: 493215 - RNA, 22 nt, Chlamydophila pneumoniae CWL029
uauauguaauuucccuaauucu

SEQ ID NO: 493216 - RNA, 23 nt, Chlamydophila pneumoniae CWL029
uaucaaagcauugcaaauaagcc

SEQ ID NO: 493217 - RNA, 17 nt, Chlamydophila pneumoniae CWL029
uaucaaccauaaagaau

SEQ ID NO: 493218 - RNA, 15 nt, Chlamydophila pneumoniae CWL029
ucagcauagagagaa

SEQ ID NO: 493219 - RNA, 19 nt, Chlamydophila pneumoniae CWL029
ucagcagcugucaauccaa

SEQ ID NO: 493220 - RNA, 18 nt, Chlamydophila pneumoniae CWL029
ucagcagcuucuauugcu

SEQ ID NO: 493221 - RNA, 21 nt, Chlamydophila pneumoniae CWL029
ucagcagcuucuauugcugua

SEQ ID NO: 493222 - RNA, 15 nt, Chlamydophila pneumoniae CWL029
ucagcaagucgguaa

SEQ ID NO: 493223 - RNA, 19 nt, Chlamydophila pneumoniae CWL029
ucagcaagaucuaacuuca

SEQ ID NO: 493224 - RNA, 21 nt, Chlamydophila pneumoniae CWL029
ucagcaaccuuuccuaaaaua

SEQ ID NO: 493225 - RNA, 15 nt, Chlamydophila pneumoniae CWL029
ucagcacccaccauu

SEQ ID NO: 493226 - RNA, 19 nt, Chlamydophila pneumoniae CWL029
ucagcaccuuguauaagag

SEQ ID NO: 493227 - RNA, 17 nt, Chlamydophila pneumoniae CWL029
ucagccaagacaaaaaa

SEQ ID NO: 493228 - RNA, 13 nt, Chlamydophila pneumoniae CWL029
ucagccugucuau

SEQ ID NO: 493229 - RNA, 19 nt, Chlamydophila pneumoniae CWL029
ucagagauugccaggagag

SEQ ID NO: 493230 - RNA, 21 nt, Chlamydophila pneumoniae CWL029
ucagaggaaucuaagaacuag

SEQ ID NO: 493231 - RNA, 17 nt, Chlamydophila pneumoniae CWL029
ucagaggagccuccaua

SEQ ID NO: 493232 - RNA, 16 nt, Chlamydophila pneumoniae CWL029
ucagauaaucuucgau

SEQ ID NO: 493233 - RNA, 16 nt, Chlamydophila pneumoniae CWL029
ucagauaaaaagaagu

SEQ ID NO: 493234 - RNA, 17 nt, Chlamydophila pneumoniae CWL029
ucagaguugucaaguaa

SEQ ID NO: 493235 - RNA, 15 nt, Chlamydophila pneumoniae CWL029
ucagauccaugaaca

SEQ ID NO: 493236 - RNA, 17 nt, Chlamydophila pneumoniae CWL029
ucagcaaacggagagca

SEQ ID NO: 493237 - RNA, 14 nt, Chlamydophila pneumoniae CWL029
ucagcaaagaaguu

SEQ ID NO: 493238 - RNA, 14 nt, Chlamydophila pneumoniae CWL029
ucagauuuuuuaac

SEQ ID NO: 493239 - RNA, 18 nt, Chlamydophila pneumoniae CWL029
ucagcaaaaaacugcaaa

SEQ ID NO: 493240 - RNA, 14 nt, Chlamydophila pneumoniae CWL029
ucagauuagaguua

SEQ ID NO: 493241 - RNA, 16 nt, Chlamydophila pneumoniae CWL029
ucagaaucuuugugau

SEQ ID NO: 493242 - RNA, 15 nt, Chlamydophila pneumoniae CWL029
ucagaagcuccugag

SEQ ID NO: 493243 - RNA, 16 nt, Chlamydophila pneumoniae CWL029
ucagaagugaucuuga

SEQ ID NO: 493244 - RNA, 21 nt, Chlamydophila pneumoniae CWL029
ucagaagugaucuugagaaaa

SEQ ID NO: 493245 - RNA, 20 nt, Chlamydophila pneumoniae CWL029
ucagaauccugaguaaaauc

SEQ ID NO: 493246 - RNA, 15 nt, Chlamydophila pneumoniae CWL029
ucagaaaauguaaaa

SEQ ID NO: 493247 - RNA, 23 nt, Chlamydophila pneumoniae CWL029
ucagaaaauguaaaaaauuauuu

SEQ ID NO: 493248 - RNA, 18 nt, Chlamydophila pneumoniae CWL029
ucagaacaacgcugcuuc

SEQ ID NO: 493249 - RNA, 22 nt, Chlamydophila pneumoniae CWL029
ucagaaaugaagccaaaaggca

SEQ ID NO: 493250 - RNA, 14 nt, Chlamydophila pneumoniae CWL029
ucacguaagguguc

SEQ ID NO: 493251 - RNA, 21 nt, Chlamydophila pneumoniae CWL029
ucacguauagguugaauaaau

SEQ ID NO: 493252 - RNA, 15 nt, Chlamydophila pneumoniae CWL029
ucacuaagauaucuc

SEQ ID NO: 493253 - RNA, 21 nt, Chlamydophila pneumoniae CWL029
ucacguucugcaacaaguugc

SEQ ID NO: 493254 - RNA, 13 nt, Chlamydophila pneumoniae CWL029
ucacuaucaugga

SEQ ID NO: 493255 - RNA, 13 nt, Chlamydophila pneumoniae CWL029
ucacuacccugcc

SEQ ID NO: 493256 - RNA, 19 nt, Chlamydophila pneumoniae CWL029
ucacucguugccaaucuuu

SEQ ID NO: 493257 - RNA, 17 nt, Chlamydophila pneumoniae CWL029
ucacucuagaaaauauu

SEQ ID NO: 493258 - RNA, 23 nt, Chlamydophila pneumoniae CWL029
ucacucuagaaaauauuccugga

SEQ ID NO: 493259 - RNA, 13 nt, Chlamydophila pneumoniae CWL029
ucacucuuuaaaa

SEQ ID NO: 493260 - RNA, 14 nt, Chlamydophila pneumoniae CWL029
ucacucuuuaaaaa

SEQ ID NO: 493261 - RNA, 16 nt, Chlamydophila pneumoniae CWL029
ucacucaaacccucuc

SEQ ID NO: 493262 - RNA, 12 nt, Chlamydophila pneumoniae CWL029
ucacucuuuuau

SEQ ID NO: 493263 - RNA, 13 nt, Chlamydophila pneumoniae CWL029
ucacucuuuuauu

SEQ ID NO: 493264 - RNA, 18 nt, Chlamydophila pneumoniae CWL029
ucacuguuuuucguaagc

SEQ ID NO: 493265 - RNA, 16 nt, Chlamydophila pneumoniae CWL029
ucacuucugaugacgu

SEQ ID NO: 493266 - RNA, 20 nt, Chlamydophila pneumoniae CWL029
ucacuucgacacgaacuuug

SEQ ID NO: 493267 - RNA, 18 nt, Chlamydophila pneumoniae CWL029
ucacuuaauaauguuuua

SEQ ID NO: 493268 - RNA, 16 nt, Chlamydophila pneumoniae CWL029
ucacuuauaagcugcu

SEQ ID NO: 493269 - RNA, 17 nt, Chlamydophila pneumoniae CWL029
ucacuuauaagcugcuu

SEQ ID NO: 493270 - RNA, 16 nt, Chlamydophila pneumoniae CWL029
ucacgcaccauuccuu

SEQ ID NO: 493271 - RNA, 14 nt, Chlamydophila pneumoniae CWL029
ucacgauuucggga

SEQ ID NO: 493272 - RNA, 15 nt, Chlamydophila pneumoniae CWL029
ucacgcucucgcuaa

SEQ ID NO: 493273 - RNA, 13 nt, Chlamydophila pneumoniae CWL029
ucacgaaaaggag

SEQ ID NO: 493274 - RNA, 17 nt, Chlamydophila pneumoniae CWL029
ucacgaaaaggagaaua

SEQ ID NO: 493275 - RNA, 20 nt, Chlamydophila pneumoniae CWL029
ucacgaggagcuuuuaccuu

SEQ ID NO: 493276 - RNA, 21 nt, Chlamydophila pneumoniae CWL029
ucacgagucccuucuuucaau

SEQ ID NO: 493277 - RNA, 19 nt, Chlamydophila pneumoniae CWL029
ucaccugagcuauaaucua

SEQ ID NO: 493278 - RNA, 15 nt, Chlamydophila pneumoniae CWL029
ucaccuacaucagac

SEQ ID NO: 493279 - RNA, 16 nt, Chlamydophila pneumoniae CWL029
ucaccuacaucagacu

SEQ ID NO: 493280 - RNA, 18 nt, Chlamydophila pneumoniae CWL029
ucaccuacaucagacuga

SEQ ID NO: 493281 - RNA, 13 nt, Chlamydophila pneumoniae CWL029
ucaccuuaggcuu

SEQ ID NO: 493282 - RNA, 20 nt, Chlamydophila pneumoniae CWL029
ucaccuugaaguuuuuucuc

SEQ ID NO: 493283 - RNA, 18 nt, Chlamydophila pneumoniae CWL029
ucaccgcgcauagcaacu

SEQ ID NO: 493284 - RNA, 20 nt, Chlamydophila pneumoniae CWL029
ucaccagaagcaacuaaacu

SEQ ID NO: 493285 - RNA, 15 nt, Chlamydophila pneumoniae CWL029
ucaccagaagcauug

SEQ ID NO: 493286 - RNA, 22 nt, Chlamydophila pneumoniae CWL029
ucaccacgaacuucagcaagaa

SEQ ID NO: 493287 - RNA, 18 nt, Chlamydophila pneumoniae CWL029
ucaccauccaaagcuauu

SEQ ID NO: 493288 - RNA, 20 nt, Chlamydophila pneumoniae CWL029
ucaccauuaagauaucugcu

SEQ ID NO: 493289 - RNA, 19 nt, Chlamydophila pneumoniae CWL029
ucacaucaguuaacugugu

SEQ ID NO: 493290 - RNA, 14 nt, Chlamydophila pneumoniae CWL029
ucacaucuuucucu

SEQ ID NO: 493291 - RNA, 15 nt, Chlamydophila pneumoniae CWL029
ucacaucuuucucua

SEQ ID NO: 493292 - RNA, 21 nt, Chlamydophila pneumoniae CWL029
ucacaucuuucucuaaaauau

SEQ ID NO: 493293 - RNA, 20 nt, Chlamydophila pneumoniae CWL029
ucacauacauucuauucuau

SEQ ID NO: 493294 - RNA, 22 nt, Chlamydophila pneumoniae CWL029
ucacauacauucuauucuauac

SEQ ID NO: 493295 - RNA, 20 nt, Chlamydophila pneumoniae CWL029
ucacauaguuuaauaaaucu

SEQ ID NO: 493296 - RNA, 17 nt, Chlamydophila pneumoniae CWL029
ucacagggacaauggca

SEQ ID NO: 493297 - RNA, 14 nt, Chlamydophila pneumoniae CWL029
ucacagucuuaaau

SEQ ID NO: 493298 - RNA, 13 nt, Chlamydophila pneumoniae CWL029
ucacauaaaauaa

SEQ ID NO: 493299 - RNA, 14 nt, Chlamydophila pneumoniae CWL029
ucacauaaaauaau

SEQ ID NO: 493300 - RNA, 20 nt, Chlamydophila pneumoniae CWL029
ucaccacaaaccucuaaaaa

SEQ ID NO: 493301 - RNA, 18 nt, Chlamydophila pneumoniae CWL029
ucaccacaaaccucuaaa

SEQ ID NO: 493302 - RNA, 15 nt, Chlamydophila pneumoniae CWL029
ucaccaacuccucua

SEQ ID NO: 493303 - RNA, 22 nt, Chlamydophila pneumoniae CWL029
ucacauuugcuuuaacagaagc

SEQ ID NO: 493304 - RNA, 15 nt, Chlamydophila pneumoniae CWL029
ucacauguuucacuu

SEQ ID NO: 493305 - RNA, 17 nt, Chlamydophila pneumoniae CWL029
ucacauuccaagaaaaa

SEQ ID NO: 493306 - RNA, 18 nt, Chlamydophila pneumoniae CWL029
ucacauuccaagaaaaau

SEQ ID NO: 493307 - RNA, 15 nt, Chlamydophila pneumoniae CWL029
ucacaagugcauuau

SEQ ID NO: 493308 - RNA, 16 nt, Chlamydophila pneumoniae CWL029
ucacaauauaaaugcu

SEQ ID NO: 493309 - RNA, 17 nt, Chlamydophila pneumoniae CWL029
ucacaccaaauccugca

SEQ ID NO: 493310 - RNA, 19 nt, Chlamydophila pneumoniae CWL029
ucacacguaagaaaggaug

SEQ ID NO: 493311 - RNA, 15 nt, Chlamydophila pneumoniae CWL029
ucacagcaaucugca

SEQ ID NO: 493312 - RNA, 16 nt, Chlamydophila pneumoniae CWL029
ucacagauaccaucac

SEQ ID NO: 493313 - RNA, 15 nt, Chlamydophila pneumoniae CWL029
ucacagauguaaucu

SEQ ID NO: 493314 - RNA, 16 nt, Chlamydophila pneumoniae CWL029
ucacagcauuuucucu

SEQ ID NO: 493315 - RNA, 23 nt, Chlamydophila pneumoniae CWL029
ucacagagucugggauguucaaa

SEQ ID NO: 493316 - RNA, 14 nt, Chlamydophila pneumoniae CWL029
ucaaugccuugcgu

SEQ ID NO: 493317 - RNA, 17 nt, Chlamydophila pneumoniae CWL029
ucaauggcgauaaaugc

SEQ ID NO: 493318 - RNA, 18 nt, Chlamydophila pneumoniae CWL029
ucaauguuaaucuaauuu

SEQ ID NO: 493319 - RNA, 19 nt, Chlamydophila pneumoniae CWL029
ucaaugaagaaaaaucuac

SEQ ID NO: 493320 - RNA, 15 nt, Chlamydophila pneumoniae CWL029
ucaauccaacaaaga

SEQ ID NO: 493321 - RNA, 13 nt, Chlamydophila pneumoniae CWL029
ucaauccaagaau

SEQ ID NO: 493322 - RNA, 19 nt, Chlamydophila pneumoniae CWL029
ucaauccaagaauagccau

SEQ ID NO: 493323 - RNA, 13 nt, Chlamydophila pneumoniae CWL029
ucaaugaaagcug

SEQ ID NO: 493324 - RNA, 15 nt, Chlamydophila pneumoniae CWL029
ucaaugaagaaaaau

SEQ ID NO: 493325 - RNA, 18 nt, Chlamydophila pneumoniae CWL029
ucaaucucuuugacaucu

SEQ ID NO: 493326 - RNA, 20 nt, Chlamydophila pneumoniae CWL029
ucaauucgcucagaaaaugu

SEQ ID NO: 493327 - RNA, 14 nt, Chlamydophila pneumoniae CWL029
ucaauugaaucaga

SEQ ID NO: 493328 - RNA, 19 nt, Chlamydophila pneumoniae CWL029
ucaauuaugcccaaggaaa

SEQ ID NO: 493329 - RNA, 21 nt, Chlamydophila pneumoniae CWL029
ucaauuaugcccaaggaaaaa

SEQ ID NO: 493330 - RNA, 22 nt, Chlamydophila pneumoniae CWL029
ucaauuaugcccaaggaaaaac

SEQ ID NO: 493331 - RNA, 20 nt, Chlamydophila pneumoniae CWL029
ucacaaagaaccauagauuu

SEQ ID NO: 493332 - RNA, 15 nt, Chlamydophila pneumoniae CWL029
ucacaaacaacagaa

SEQ ID NO: 493333 - RNA, 19 nt, Chlamydophila pneumoniae CWL029
ucacaaacaacagaaaugu

SEQ ID NO: 493334 - RNA, 13 nt, Chlamydophila pneumoniae CWL029
ucaauuucuucau

SEQ ID NO: 493335 - RNA, 13 nt, Chlamydophila pneumoniae CWL029
ucaauagcaaaga

SEQ ID NO: 493336 - RNA, 14 nt, Chlamydophila pneumoniae CWL029
ucaaucaaauucaa

SEQ ID NO: 493337 - RNA, 14 nt, Chlamydophila pneumoniae CWL029
ucaaucaauaaaau

SEQ ID NO: 493338 - RNA, 13 nt, Chlamydophila pneumoniae CWL029
ucaauaauuucaa

SEQ ID NO: 493339 - RNA, 23 nt, Chlamydophila pneumoniae CWL029
ucaauaauuucaaagaugcagau

SEQ ID NO: 493340 - RNA, 16 nt, Chlamydophila pneumoniae CWL029
ucaauacgaucuuuug

SEQ ID NO: 493341 - RNA, 16 nt, Chlamydophila pneumoniae CWL029
ucaauagaagcuuguu

SEQ ID NO: 493342 - RNA, 21 nt, Chlamydophila pneumoniae CWL029
ucaauaaguagauuaaaggca

SEQ ID NO: 493343 - RNA, 15 nt, Chlamydophila pneumoniae CWL029
ucaaggccuauagau

SEQ ID NO: 493344 - RNA, 12 nt, Chlamydophila pneumoniae CWL029
ucaaggcaucua

SEQ ID NO: 493345 - RNA, 20 nt, Chlamydophila pneumoniae CWL029
ucaaggcaucuucuuugcca

SEQ ID NO: 493346 - RNA, 14 nt, Chlamydophila pneumoniae CWL029
ucaaggaguuuuaa

SEQ ID NO: 493347 - RNA, 16 nt, Chlamydophila pneumoniae CWL029
ucaaguuucuuuugca

SEQ ID NO: 493348 - RNA, 23 nt, Chlamydophila pneumoniae CWL029
ucaacauucuucugucuguauuu

SEQ ID NO: 493349 - RNA, 16 nt, Chlamydophila pneumoniae CWL029
ucaacauguuaauaag

SEQ ID NO: 493350 - RNA, 20 nt, Chlamydophila pneumoniae CWL029
ucaaccaaacgucaggcucc

SEQ ID NO: 493351 - RNA, 16 nt, Chlamydophila pneumoniae CWL029
ucaaccaagguugcuc

SEQ ID NO: 493352 - RNA, 19 nt, Chlamydophila pneumoniae CWL029
ucaacacccggcuuuucca

SEQ ID NO: 493353 - RNA, 22 nt, Chlamydophila pneumoniae CWL029
ucaaauaggaucucucuuuccu

SEQ ID NO: 493354 - RNA, 22 nt, Chlamydophila pneumoniae CWL029
ucaaauauaugaguuuacuaac

SEQ ID NO: 493355 - RNA, 16 nt, Chlamydophila pneumoniae CWL029
ucaaauuucaauaaga

SEQ ID NO: 493356 - RNA, 23 nt, Chlamydophila pneumoniae CWL029
ucaaauuggaauucgcauuuuug

SEQ ID NO: 493357 - RNA, 17 nt, Chlamydophila pneumoniae CWL029
ucaaauucaaaauagaa

SEQ ID NO: 493358 - RNA, 18 nt, Chlamydophila pneumoniae CWL029
ucaaauuccuucucagaa

SEQ ID NO: 493359 - RNA, 22 nt, Chlamydophila pneumoniae CWL029
ucaacaaguucuuggaaaaaag

SEQ ID NO: 493360 - RNA, 23 nt, Chlamydophila pneumoniae CWL029
ucaacaaguucuuggaaaaaagg

SEQ ID NO: 493361 - RNA, 21 nt, Chlamydophila pneumoniae CWL029
ucaacguuuguaguaaggaga

SEQ ID NO: 493362 - RNA, 13 nt, Chlamydophila pneumoniae CWL029
ucaacuacaucuc

SEQ ID NO: 493363 - RNA, 16 nt, Chlamydophila pneumoniae CWL029
ucaacguuuguaguaa

SEQ ID NO: 493364 - RNA, 16 nt, Chlamydophila pneumoniae CWL029
ucaacugguauagacu

SEQ ID NO: 493365 - RNA, 21 nt, Chlamydophila pneumoniae CWL029
ucaacugguauagacuccuua

SEQ ID NO: 493366 - RNA, 23 nt, Chlamydophila pneumoniae CWL029
ucaagaguuucgaauucaaugag

SEQ ID NO: 493367 - RNA, 18 nt, Chlamydophila pneumoniae CWL029
ucaagaggagugaaagcu

SEQ ID NO: 493368 - RNA, 17 nt, Chlamydophila pneumoniae CWL029
ucaagcaaaucuccguu

SEQ ID NO: 493369 - RNA, 11 nt, Chlamydophila pneumoniae CWL029
ucaagaaaugc

SEQ ID NO: 493370 - RNA, 20 nt, Chlamydophila pneumoniae CWL029
ucaagaaaugcccugucacu

SEQ ID NO: 493371 - RNA, 21 nt, Chlamydophila pneumoniae CWL029
ucaagaacaagagcuuguucu

SEQ ID NO: 493372 - RNA, 13 nt, Chlamydophila pneumoniae CWL029
ucaaaauuuaaau

SEQ ID NO: 493373 - RNA, 16 nt, Chlamydophila pneumoniae CWL029
ucaaaauuuaaauaua

SEQ ID NO: 493374 - RNA, 16 nt, Chlamydophila pneumoniae CWL029
ucaaaauuauccagaa

SEQ ID NO: 493375 - RNA, 14 nt, Chlamydophila pneumoniae CWL029
ucaaaaugcugcuu

SEQ ID NO: 493376 - RNA, 14 nt, Chlamydophila pneumoniae CWL029
ucaaaaucacauuu

SEQ ID NO: 493377 - RNA, 16 nt, Chlamydophila pneumoniae CWL029
ucaaaauagaagccac

SEQ ID NO: 493378 - RNA, 18 nt, Chlamydophila pneumoniae CWL029
ucaaaauaucauucacua

SEQ ID NO: 493379 - RNA, 20 nt, Chlamydophila pneumoniae CWL029
ucaaaccacggauuuucucu

SEQ ID NO: 493380 - RNA, 23 nt, Chlamydophila pneumoniae CWL029
ucaaaccacggauuuucucuaca

SEQ ID NO: 493381 - RNA, 17 nt, Chlamydophila pneumoniae CWL029
ucaaacccucuccagaa

SEQ ID NO: 493382 - RNA, 18 nt, Chlamydophila pneumoniae CWL029
ucaaacccucuccagaag

SEQ ID NO: 493383 - RNA, 17 nt, Chlamydophila pneumoniae CWL029
ucaaacuccuuuuaaaa

SEQ ID NO: 493384 - RNA, 18 nt, Chlamydophila pneumoniae CWL029
ucaaagcaaaagucauaa

SEQ ID NO: 493385 - RNA, 15 nt, Chlamydophila pneumoniae CWL029
ucaaagauuccuaag

SEQ ID NO: 493386 - RNA, 14 nt, Chlamydophila pneumoniae CWL029
ucaaagauuccuaa

SEQ ID NO: 493387 - RNA, 15 nt, Chlamydophila pneumoniae CWL029
ucaaagcauugcaaa

SEQ ID NO: 493388 - RNA, 21 nt, Chlamydophila pneumoniae CWL029
ucaaagauauagauucaugaa

SEQ ID NO: 493389 - RNA, 17 nt, Chlamydophila pneumoniae CWL029
ucaaagaugcagauacu

SEQ ID NO: 493390 - RNA, 22 nt, Chlamydophila pneumoniae CWL029
ucaaagauauagauucaugaaa

SEQ ID NO: 493391 - RNA, 15 nt, Chlamydophila pneumoniae CWL029
ucaaagacucaugaa

SEQ ID NO: 493392 - RNA, 18 nt, Chlamydophila pneumoniae CWL029
ucaaagacucaugaaaua

SEQ ID NO: 493393 - RNA, 20 nt, Chlamydophila pneumoniae CWL029
ucaaagaacugcauaaucuc

SEQ ID NO: 493394 - RNA, 16 nt, Chlamydophila pneumoniae CWL029
ucaaagaauacucuaa

SEQ ID NO: 493395 - RNA, 14 nt, Chlamydophila pneumoniae CWL029
ucaaagacaggcuc

SEQ ID NO: 493396 - RNA, 19 nt, Chlamydophila pneumoniae CWL029
ucaaauacuucuccugaac

SEQ ID NO: 493397 - RNA, 23 nt, Chlamydophila pneumoniae CWL029
ucaaaggcaacgcgauuuucaac

SEQ ID NO: 493398 - RNA, 21 nt, Chlamydophila pneumoniae CWL029
ucaaaggcaauagcagcagcg

SEQ ID NO: 493399 - RNA, 15 nt, Chlamydophila pneumoniae CWL029
ucaaaguauauauuu

SEQ ID NO: 493400 - RNA, 20 nt, Chlamydophila pneumoniae CWL029
uauuuuuuaagcuaauaaga

SEQ ID NO: 493401 - RNA, 24 nt, Chlamydophila pneumoniae CWL029
uauuuuuuacguucuuucuuucua

SEQ ID NO: 493402 - RNA, 19 nt, Chlamydophila pneumoniae CWL029
uauuuuuccagaaauggca

SEQ ID NO: 493403 - RNA, 13 nt, Chlamydophila pneumoniae CWL029
uauuuuuaaauaa

SEQ ID NO: 493404 - RNA, 14 nt, Chlamydophila pneumoniae CWL029
uauuuuuaaauaaa

SEQ ID NO: 493405 - RNA, 14 nt, Chlamydophila pneumoniae CWL029
uauuuuuaaauaca

SEQ ID NO: 493406 - RNA, 12 nt, Chlamydophila pneumoniae CWL029
uauuuuuaaaua

SEQ ID NO: 493407 - RNA, 23 nt, Chlamydophila pneumoniae CWL029
uauuuuuccauggcuauuuuuaa

SEQ ID NO: 493408 - RNA, 13 nt, Chlamydophila pneumoniae CWL029
uauuuuuccagaa

SEQ ID NO: 493409 - RNA, 19 nt, Chlamydophila pneumoniae CWL029
uauuuugcaaaugaaaaga

SEQ ID NO: 493410 - RNA, 15 nt, Chlamydophila pneumoniae CWL029
ucaaaaaacaacgau

SEQ ID NO: 493411 - RNA, 21 nt, Chlamydophila pneumoniae CWL029
ucaaaaaaaacgccauacuga

SEQ ID NO: 493412 - RNA, 13 nt, Chlamydophila pneumoniae CWL029
ucaaaaaaaagac

SEQ ID NO: 493413 - RNA, 13 nt, Chlamydophila pneumoniae CWL029
ucaaaaaauacau

SEQ ID NO: 493414 - RNA, 22 nt, Chlamydophila pneumoniae CWL029
ucaaaagucaugaggacugugg

SEQ ID NO: 493415 - RNA, 12 nt, Chlamydophila pneumoniae CWL029
ucaaaagaaaag

SEQ ID NO: 493416 - RNA, 11 nt, Chlamydophila pneumoniae CWL029
ucaaaagaaga

SEQ ID NO: 493417 - RNA, 21 nt, Chlamydophila pneumoniae CWL029
uauuuggacguacuaagauac

SEQ ID NO: 493418 - RNA, 15 nt, Chlamydophila pneumoniae CWL029
uauuugccaaaauaa

SEQ ID NO: 493419 - RNA, 15 nt, Chlamydophila pneumoniae CWL029
uauuucucuaucauc

SEQ ID NO: 493420 - RNA, 12 nt, Chlamydophila pneumoniae CWL029
uauuugaaauag

SEQ ID NO: 493421 - RNA, 16 nt, Chlamydophila pneumoniae CWL029
uauuugaauaaaggac

SEQ ID NO: 493422 - RNA, 13 nt, Chlamydophila pneumoniae CWL029
uauuucuauuauu

SEQ ID NO: 493423 - RNA, 14 nt, Chlamydophila pneumoniae CWL029
uauuucuauuauuu

SEQ ID NO: 493424 - RNA, 17 nt, Chlamydophila pneumoniae CWL029
uauuucucuaucaucaa

SEQ ID NO: 493425 - RNA, 20 nt, Chlamydophila pneumoniae CWL029
uauuuaccuacagauaugcu

SEQ ID NO: 493426 - RNA, 17 nt, Chlamydophila pneumoniae CWL029
uauuuacgaaaacaucu

SEQ ID NO: 493427 - RNA, 13 nt, Chlamydophila pneumoniae CWL029
uauuuagagagaa

SEQ ID NO: 493428 - RNA, 20 nt, Chlamydophila pneumoniae CWL029
uauuuagcauuucucuauga

SEQ ID NO: 493429 - RNA, 13 nt, Chlamydophila pneumoniae CWL029
uauuuaaauauaa

SEQ ID NO: 493430 - RNA, 15 nt, Chlamydophila pneumoniae CWL029
uauuuaaauauaaau

SEQ ID NO: 493431 - RNA, 22 nt, Chlamydophila pneumoniae CWL029
uauuguguucccucuucuucca

SEQ ID NO: 493432 - RNA, 23 nt, Chlamydophila pneumoniae CWL029
uauuguguucccucuucuuccaa

SEQ ID NO: 493433 - RNA, 15 nt, Chlamydophila pneumoniae CWL029
uauugccuucuucuu

SEQ ID NO: 493434 - RNA, 14 nt, Chlamydophila pneumoniae CWL029
uauugcucuuguau

SEQ ID NO: 493435 - RNA, 19 nt, Chlamydophila pneumoniae CWL029
uauugcggaaauugaauau

SEQ ID NO: 493436 - RNA, 18 nt, Chlamydophila pneumoniae CWL029
uauugacuagcucucuug

SEQ ID NO: 493437 - RNA, 19 nt, Chlamydophila pneumoniae CWL029
uauugacuuuggucuucug

SEQ ID NO: 493438 - RNA, 20 nt, Chlamydophila pneumoniae CWL029
uauugauaaugauuccuaga

SEQ ID NO: 493439 - RNA, 13 nt, Chlamydophila pneumoniae CWL029
uauugcagaaucu

SEQ ID NO: 493440 - RNA, 13 nt, Chlamydophila pneumoniae CWL029
uauuauugaauaa

SEQ ID NO: 493441 - RNA, 17 nt, Chlamydophila pneumoniae CWL029
uauuaggcuuuuuucua

SEQ ID NO: 493442 - RNA, 17 nt, Chlamydophila pneumoniae CWL029
uauuaaggauuccuuga

SEQ ID NO: 493443 - RNA, 15 nt, Chlamydophila pneumoniae CWL029
uauuaaaaucucuag

SEQ ID NO: 493444 - RNA, 21 nt, Chlamydophila pneumoniae CWL029
uauuacagaaaggcuuuucuu

SEQ ID NO: 493445 - RNA, 18 nt, Chlamydophila pneumoniae CWL029
uauuacagauuucuucuu

SEQ ID NO: 493446 - RNA, 17 nt, Chlamydophila pneumoniae CWL029
uauucuuaaugcgaugc

SEQ ID NO: 493447 - RNA, 13 nt, Chlamydophila pneumoniae CWL029
uauucuuggaaua

SEQ ID NO: 493448 - RNA, 20 nt, Chlamydophila pneumoniae CWL029
uauugaaaaaucccuguucu

SEQ ID NO: 493449 - RNA, 18 nt, Chlamydophila pneumoniae CWL029
uauugaaaaaucccuguu

SEQ ID NO: 493450 - RNA, 14 nt, Chlamydophila pneumoniae CWL029
uauucucgaaaaau

SEQ ID NO: 493451 - RNA, 16 nt, Chlamydophila pneumoniae CWL029
uauucugaaauuucug

SEQ ID NO: 493452 - RNA, 19 nt, Chlamydophila pneumoniae CWL029
uauucugaaauuucugaaa

SEQ ID NO: 493453 - RNA, 15 nt, Chlamydophila pneumoniae CWL029
uauucugaagcugca

SEQ ID NO: 493454 - RNA, 18 nt, Chlamydophila pneumoniae CWL029
uauucuaagcuuauuucu

SEQ ID NO: 493455 - RNA, 14 nt, Chlamydophila pneumoniae CWL029
uauuauuuuaaagu

SEQ ID NO: 493456 - RNA, 20 nt, Chlamydophila pneumoniae CWL029
uauucagguucugaaauugu

SEQ ID NO: 493457 - RNA, 19 nt, Chlamydophila pneumoniae CWL029
uauuccucuuaggagagcu

SEQ ID NO: 493458 - RNA, 18 nt, Chlamydophila pneumoniae CWL029
uaaagagaaucuccucau

SEQ ID NO: 493459 - RNA, 16 nt, Chlamydophila pneumoniae CWL029
uaaagacucucuucca

SEQ ID NO: 493460 - RNA, 17 nt, Chlamydophila pneumoniae CWL029
uaaagacucucuuccaa

SEQ ID NO: 493461 - RNA, 16 nt, Chlamydophila pneumoniae CWL029
uaaagaccaaauagag

SEQ ID NO: 493462 - RNA, 15 nt, Chlamydophila pneumoniae CWL029
uaaagacaucucuuu

SEQ ID NO: 493463 - RNA, 17 nt, Chlamydophila pneumoniae CWL029
uaaagacaucucuuuaa

SEQ ID NO: 493464 - RNA, 14 nt, Chlamydophila pneumoniae CWL029
uaaagaaucacucu

SEQ ID NO: 493465 - RNA, 13 nt, Chlamydophila pneumoniae CWL029
uaaagaagguuuc

SEQ ID NO: 493466 - RNA, 16 nt, Chlamydophila pneumoniae CWL029
uaaagaagguuucuag

SEQ ID NO: 493467 - RNA, 21 nt, Chlamydophila pneumoniae CWL029
uaaagaagguuucuagguucu

SEQ ID NO: 493468 - RNA, 19 nt, Chlamydophila pneumoniae CWL029
uaaagaaguuuacaaauaa

SEQ ID NO: 493469 - RNA, 21 nt, Chlamydophila pneumoniae CWL029
uaaacuuuguggggauuuuca

SEQ ID NO: 493470 - RNA, 13 nt, Chlamydophila pneumoniae CWL029
uaaacuuucuucu

SEQ ID NO: 493471 - RNA, 23 nt, Chlamydophila pneumoniae CWL029
uaaagcauacuuauauuggcuuu

SEQ ID NO: 493472 - RNA, 15 nt, Chlamydophila pneumoniae CWL029
uaaagcaucacggac

SEQ ID NO: 493473 - RNA, 17 nt, Chlamydophila pneumoniae CWL029
uaaagcauuggacaacg

SEQ ID NO: 493474 - RNA, 19 nt, Chlamydophila pneumoniae CWL029
uaaagccacauucuucuga

SEQ ID NO: 493475 - RNA, 23 nt, Chlamydophila pneumoniae CWL029
uaaagccccacccacuccagaaa

SEQ ID NO: 493476 - RNA, 13 nt, Chlamydophila pneumoniae CWL029
uaaagcuaacaac

SEQ ID NO: 493477 - RNA, 19 nt, Chlamydophila pneumoniae CWL029
uaaagccuccucaagauaa

SEQ ID NO: 493478 - RNA, 22 nt, Chlamydophila pneumoniae CWL029
uaaagccuccucaagauaaauc

SEQ ID NO: 493479 - RNA, 19 nt, Chlamydophila pneumoniae CWL029
uaaaaucuucuggagggag

SEQ ID NO: 493480 - RNA, 14 nt, Chlamydophila pneumoniae CWL029
uaaaaucuuucaau

SEQ ID NO: 493481 - RNA, 22 nt, Chlamydophila pneumoniae CWL029
uaaacuucaaugaagaaaaauc

SEQ ID NO: 493482 - RNA, 23 nt, Chlamydophila pneumoniae CWL029
uaaaccuaccucugggaagacuc

SEQ ID NO: 493483 - RNA, 19 nt, Chlamydophila pneumoniae CWL029
uaaaccuggcauugccaua

SEQ ID NO: 493484 - RNA, 19 nt, Chlamydophila pneumoniae CWL029
uaaaugcuauuuuccucua

SEQ ID NO: 493485 - RNA, 21 nt, Chlamydophila pneumoniae CWL029
uaaauguuuugcgauaucuau

SEQ ID NO: 493486 - RNA, 21 nt, Chlamydophila pneumoniae CWL029
uaaaugccucuuucauacuaa

SEQ ID NO: 493487 - RNA, 23 nt, Chlamydophila pneumoniae CWL029
uaaaugccucuuucauacuaaaa

SEQ ID NO: 493488 - RNA, 17 nt, Chlamydophila pneumoniae CWL029
uaaaugccuuaaaugua

SEQ ID NO: 493489 - RNA, 14 nt, Chlamydophila pneumoniae CWL029
uaaaucugcuuuua

SEQ ID NO: 493490 - RNA, 15 nt, Chlamydophila pneumoniae CWL029
uaaaucugcuuuuau

SEQ ID NO: 493491 - RNA, 14 nt, Chlamydophila pneumoniae CWL029
uaaaucuauucccc

SEQ ID NO: 493492 - RNA, 16 nt, Chlamydophila pneumoniae CWL029
uaaaucuauuccccuc

SEQ ID NO: 493493 - RNA, 15 nt, Chlamydophila pneumoniae CWL029
uaaauaucuaauaaa

SEQ ID NO: 493494 - RNA, 21 nt, Chlamydophila pneumoniae CWL029
uaaauaucuuaacgcuuagag

SEQ ID NO: 493495 - RNA, 20 nt, Chlamydophila pneumoniae CWL029
uaaauaugaauuagggcuuu

SEQ ID NO: 493496 - RNA, 12 nt, Chlamydophila pneumoniae CWL029
uaaaucaaaauu

SEQ ID NO: 493497 - RNA, 20 nt, Chlamydophila pneumoniae CWL029
uaaaucaacaucacaaucgu

SEQ ID NO: 493498 - RNA, 17 nt, Chlamydophila pneumoniae CWL029
uaaauagcucaguuggu

SEQ ID NO: 493499 - RNA, 23 nt, Chlamydophila pneumoniae CWL029
uaaauagaaaacauagagauucu

SEQ ID NO: 493500 - RNA, 14 nt, Chlamydophila pneumoniae CWL029
uaaauagaaaucuu

SEQ ID NO: 493501 - RNA, 18 nt, Chlamydophila pneumoniae CWL029
uaaauagaaaucuuaguc

SEQ ID NO: 493502 - RNA, 23 nt, Chlamydophila pneumoniae CWL029
uaaauacuuaggaauuuuucuag

SEQ ID NO: 493503 - RNA, 21 nt, Chlamydophila pneumoniae CWL029
uaaauacaaaacaaaagccau

SEQ ID NO: 493504 - RNA, 19 nt, Chlamydophila pneumoniae CWL029
uaaaguuugagcuaagcug

SEQ ID NO: 493505 - RNA, 18 nt, Chlamydophila pneumoniae CWL029
uaaagguuguaaggacga

SEQ ID NO: 493506 - RNA, 20 nt, Chlamydophila pneumoniae CWL029
uaaaguaacgauaagaagcu

SEQ ID NO: 493507 - RNA, 11 nt, Chlamydophila pneumoniae CWL029
uaaauaaaauc

SEQ ID NO: 493508 - RNA, 20 nt, Chlamydophila pneumoniae CWL029
uaacaccaaaagaauacuca

SEQ ID NO: 493509 - RNA, 19 nt, Chlamydophila pneumoniae CWL029
uaacaaaauuucuuauaaa

SEQ ID NO: 493510 - RNA, 20 nt, Chlamydophila pneumoniae CWL029
uaacaaaauuucuuauaaaa

SEQ ID NO: 493511 - RNA, 22 nt, Chlamydophila pneumoniae CWL029
uaacaaaauuucuuauaaaaaa

SEQ ID NO: 493512 - RNA, 21 nt, Chlamydophila pneumoniae CWL029
uaaauuugucaucacaucagu

SEQ ID NO: 493513 - RNA, 17 nt, Chlamydophila pneumoniae CWL029
uaaauuuaagucacuaa

SEQ ID NO: 493514 - RNA, 13 nt, Chlamydophila pneumoniae CWL029
uaaauuaaauauc

SEQ ID NO: 493515 - RNA, 14 nt, Chlamydophila pneumoniae CWL029
uaaauuaaauaucu

SEQ ID NO: 493516 - RNA, 13 nt, Chlamydophila pneumoniae CWL029
uaaauuaguaaau

SEQ ID NO: 493517 - RNA, 14 nt, Chlamydophila pneumoniae CWL029
uaaauuaguaaaug

SEQ ID NO: 493518 - RNA, 13 nt, Chlamydophila pneumoniae CWL029
uaaauucaaaauc

SEQ ID NO: 493519 - RNA, 20 nt, Chlamydophila pneumoniae CWL029
uaacauuucguuuuuucuua

SEQ ID NO: 493520 - RNA, 22 nt, Chlamydophila pneumoniae CWL029
uaacauuucguuuuuucuuauc

SEQ ID NO: 493521 - RNA, 18 nt, Chlamydophila pneumoniae CWL029
uaacauuucguuuuuucu

SEQ ID NO: 493522 - RNA, 18 nt, Chlamydophila pneumoniae CWL029
uaacagagcgccuccacc

SEQ ID NO: 493523 - RNA, 19 nt, Chlamydophila pneumoniae CWL029
uaacagagcgccuccaccu

SEQ ID NO: 493524 - RNA, 24 nt, Chlamydophila pneumoniae CWL029
uaacaugccaaaaguuuugaggau

SEQ ID NO: 493525 - RNA, 18 nt, Chlamydophila pneumoniae CWL029
uaacaugcgcagaauaaa

SEQ ID NO: 493526 - RNA, 20 nt, Chlamydophila pneumoniae CWL029
uaacaugcgcagaauaaaau

SEQ ID NO: 493527 - RNA, 22 nt, Chlamydophila pneumoniae CWL029
uaacaugcgcagaauaaaaugg

SEQ ID NO: 493528 - RNA, 20 nt, Chlamydophila pneumoniae CWL029
uaacgaagugaggagaauag

SEQ ID NO: 493529 - RNA, 20 nt, Chlamydophila pneumoniae CWL029
uaaccuuugacaacaccaca

SEQ ID NO: 493530 - RNA, 18 nt, Chlamydophila pneumoniae CWL029
uaacgaauugcuuucccc

SEQ ID NO: 493531 - RNA, 17 nt, Chlamydophila pneumoniae CWL029
uaaccgaaacuucucag

SEQ ID NO: 493532 - RNA, 21 nt, Chlamydophila pneumoniae CWL029
uaaccguggcuuuguaaaaau

SEQ ID NO: 493533 - RNA, 24 nt, Chlamydophila pneumoniae CWL029
uaaccuaauacaggagcuaaagcu

SEQ ID NO: 493534 - RNA, 14 nt, Chlamydophila pneumoniae CWL029
uaaaaucuccucuc

SEQ ID NO: 493535 - RNA, 17 nt, Chlamydophila pneumoniae CWL029
uaaaaucauaggcuaua

SEQ ID NO: 493536 - RNA, 14 nt, Chlamydophila pneumoniae CWL029
uaaaaucaacaagu

SEQ ID NO: 493537 - RNA, 18 nt, Chlamydophila pneumoniae CWL029
uaaaaucaagccacagag

SEQ ID NO: 493538 - RNA, 21 nt, Chlamydophila pneumoniae CWL029
uaaaaguuagguagauagaaa

SEQ ID NO: 493539 - RNA, 20 nt, Chlamydophila pneumoniae CWL029
uaaaaguuccaaaucucaau

SEQ ID NO: 493540 - RNA, 16 nt, Chlamydophila pneumoniae CWL029
uaaaaguuagguagau

SEQ ID NO: 493541 - RNA, 23 nt, Chlamydophila pneumoniae CWL029
uaaaaguuuuuuauuuucuggug

SEQ ID NO: 493542 - RNA, 18 nt, Chlamydophila pneumoniae CWL029
uaaaagguauuucucucc

SEQ ID NO: 493543 - RNA, 22 nt, Chlamydophila pneumoniae CWL029
uaaaagcauuuuugggaaaaga

SEQ ID NO: 493544 - RNA, 20 nt, Chlamydophila pneumoniae CWL029
uaaaacagccuagcaaaacu

SEQ ID NO: 493545 - RNA, 21 nt, Chlamydophila pneumoniae CWL029
uaaaacaucagcaacauaaag

SEQ ID NO: 493546 - RNA, 20 nt, Chlamydophila pneumoniae CWL029
uaaaacugcgcuaucaucau

SEQ ID NO: 493547 - RNA, 22 nt, Chlamydophila pneumoniae CWL029
uaaaagaaagaaugacacagag

SEQ ID NO: 493548 - RNA, 23 nt, Chlamydophila pneumoniae CWL029
uaaaagaacgucaccauuaaauu

SEQ ID NO: 493549 - RNA, 23 nt, Chlamydophila pneumoniae CWL029
uaaaaaauuaucuccaaagauca

SEQ ID NO: 493550 - RNA, 13 nt, Chlamydophila pneumoniae CWL029
uaaaaauauaucu

SEQ ID NO: 493551 - RNA, 14 nt, Chlamydophila pneumoniae CWL029
uaaaaauauaucuu

SEQ ID NO: 493552 - RNA, 19 nt, Chlamydophila pneumoniae CWL029
uaaaaaauacaggaaucuc

SEQ ID NO: 493553 - RNA, 19 nt, Chlamydophila pneumoniae CWL029
uaaaaaacuuccuaacuau

SEQ ID NO: 493554 - RNA, 20 nt, Chlamydophila pneumoniae CWL029
guuuuuugaaaacuucaaaa

SEQ ID NO: 493555 - RNA, 17 nt, Chlamydophila pneumoniae CWL029
guuuuuugaaaacuuca

SEQ ID NO: 493556 - RNA, 19 nt, Chlamydophila pneumoniae CWL029
uaaaaaaacccucaaagaa

SEQ ID NO: 493557 - RNA, 17 nt, Chlamydophila pneumoniae CWL029
uaaaaaaagacaagaga

SEQ ID NO: 493558 - RNA, 18 nt, Chlamydophila pneumoniae CWL029
uaaaaaaagcuagucuuu

SEQ ID NO: 493559 - RNA, 16 nt, Chlamydophila pneumoniae CWL029
guuuuguuucaucuuc

SEQ ID NO: 493560 - RNA, 18 nt, Chlamydophila pneumoniae CWL029
guuuuguuucaucuucuu

SEQ ID NO: 493561 - RNA, 15 nt, Chlamydophila pneumoniae CWL029
guuuuuaauuuucug

SEQ ID NO: 493562 - RNA, 15 nt, Chlamydophila pneumoniae CWL029
guuuuucaguuguuu

SEQ ID NO: 493563 - RNA, 19 nt, Chlamydophila pneumoniae CWL029
guuuuucaauuuggauuua

SEQ ID NO: 493564 - RNA, 12 nt, Chlamydophila pneumoniae CWL029
guuuuucuucca

SEQ ID NO: 493565 - RNA, 16 nt, Chlamydophila pneumoniae CWL029
guuuuugcuguuucuu

SEQ ID NO: 493566 - RNA, 22 nt, Chlamydophila pneumoniae CWL029
guuuuuggaaaaagccuuucuu

SEQ ID NO: 493567 - RNA, 19 nt, Chlamydophila pneumoniae CWL029
guuuuguggcuuuucuaaa

SEQ ID NO: 493568 - RNA, 17 nt, Chlamydophila pneumoniae CWL029
guuuucuuuucugaaga

SEQ ID NO: 493569 - RNA, 23 nt, Chlamydophila pneumoniae CWL029
guuuucuucuuuaagauuuccuu

SEQ ID NO: 493570 - RNA, 17 nt, Chlamydophila pneumoniae CWL029
guuuucguaagagaauu

SEQ ID NO: 493571 - RNA, 22 nt, Chlamydophila pneumoniae CWL029
guuuucuagaaaagauucuaaa

SEQ ID NO: 493572 - RNA, 22 nt, Chlamydophila pneumoniae CWL029
guuuuaagaagguuuauuagaa

SEQ ID NO: 493573 - RNA, 19 nt, Chlamydophila pneumoniae CWL029
guuuuacgaacuaaaggaa

SEQ ID NO: 493574 - RNA, 21 nt, Chlamydophila pneumoniae CWL029
guuuuaucggcaauuguuaaa

SEQ ID NO: 493575 - RNA, 11 nt, Chlamydophila pneumoniae CWL029
guuucuuucca

SEQ ID NO: 493576 - RNA, 15 nt, Chlamydophila pneumoniae CWL029
guuuggagaagcuca

SEQ ID NO: 493577 - RNA, 16 nt, Chlamydophila pneumoniae CWL029
guuuguucuaaagcug

SEQ ID NO: 493578 - RNA, 14 nt, Chlamydophila pneumoniae CWL029
guuuguuuucuauc

SEQ ID NO: 493579 - RNA, 13 nt, Chlamydophila pneumoniae CWL029
guuuguagaggua

SEQ ID NO: 493580 - RNA, 21 nt, Chlamydophila pneumoniae CWL029
guuuguaguguugaauaagau

SEQ ID NO: 493581 - RNA, 17 nt, Chlamydophila pneumoniae CWL029
guuugucguaauugcug

SEQ ID NO: 493582 - RNA, 13 nt, Chlamydophila pneumoniae CWL029
guuugucuuccau

SEQ ID NO: 493583 - RNA, 15 nt, Chlamydophila pneumoniae CWL029
guuugugggcauuua

SEQ ID NO: 493584 - RNA, 16 nt, Chlamydophila pneumoniae CWL029
guucuuagaaagcgca

SEQ ID NO: 493585 - RNA, 19 nt, Chlamydophila pneumoniae CWL029
guugucagcuuugcuuauu

SEQ ID NO: 493586 - RNA, 15 nt, Chlamydophila pneumoniae CWL029
guuguccuuuauaau

SEQ ID NO: 493587 - RNA, 18 nt, Chlamydophila pneumoniae CWL029
guuuaaguccuucuuccc

SEQ ID NO: 493588 - RNA, 23 nt, Chlamydophila pneumoniae CWL029
guuucuaaauacuuaggaauuuu

SEQ ID NO: 493589 - RNA, 15 nt, Chlamydophila pneumoniae CWL029
guuucguacaguuuu

SEQ ID NO: 493590 - RNA, 21 nt, Chlamydophila pneumoniae CWL029
guuuccaagacaacaccuccc

SEQ ID NO: 493591 - RNA, 21 nt, Chlamydophila pneumoniae CWL029
guuucaggaaacucaaucucu

SEQ ID NO: 493592 - RNA, 16 nt, Chlamydophila pneumoniae CWL029
guuuagaaaaagaucu

SEQ ID NO: 493593 - RNA, 14 nt, Chlamydophila pneumoniae CWL029
guuuagauuuuucu

SEQ ID NO: 493594 - RNA, 22 nt, Chlamydophila pneumoniae CWL029
guuucaaacaauaguaaagcau

SEQ ID NO: 493595 - RNA, 14 nt, Chlamydophila pneumoniae CWL029
guuucaacauaaca

SEQ ID NO: 493596 - RNA, 14 nt, Chlamydophila pneumoniae CWL029
guuucaaucucucc

SEQ ID NO: 493597 - RNA, 19 nt, Chlamydophila pneumoniae CWL029
guuucaaucucuccuugac

SEQ ID NO: 493598 - RNA, 20 nt, Chlamydophila pneumoniae CWL029
guucucccgugaacaaaaac

SEQ ID NO: 493599 - RNA, 17 nt, Chlamydophila pneumoniae CWL029
guucucccgugaacaaa

SEQ ID NO: 493600 - RNA, 18 nt, Chlamydophila pneumoniae CWL029
guucuccacaugcccaaa

SEQ ID NO: 493601 - RNA, 16 nt, Chlamydophila pneumoniae CWL029
guucuccacaugccca

SEQ ID NO: 493602 - RNA, 19 nt, Chlamydophila pneumoniae CWL029
guucucaaagaucaucuac

SEQ ID NO: 493603 - RNA, 15 nt, Chlamydophila pneumoniae CWL029
guucucaauaauaga

SEQ ID NO: 493604 - RNA, 17 nt, Chlamydophila pneumoniae CWL029
guucucuaugacuucuu

SEQ ID NO: 493605 - RNA, 20 nt, Chlamydophila pneumoniae CWL029
guucgacaacaacauaaaga

SEQ ID NO: 493606 - RNA, 16 nt, Chlamydophila pneumoniae CWL029
guucggucucuucucu

SEQ ID NO: 493607 - RNA, 18 nt, Chlamydophila pneumoniae CWL029
guucccuggaugaacucc

SEQ ID NO: 493608 - RNA, 17 nt, Chlamydophila pneumoniae CWL029
guucccaaauagaaaau

SEQ ID NO: 493609 - RNA, 18 nt, Chlamydophila pneumoniae CWL029
guucccacuggacuucgu

SEQ ID NO: 493610 - RNA, 13 nt, Chlamydophila pneumoniae CWL029
guuccauuuucag

SEQ ID NO: 493611 - RNA, 21 nt, Chlamydophila pneumoniae CWL029
guuccgaauaggcauuacaca

SEQ ID NO: 493612 - RNA, 22 nt, Chlamydophila pneumoniae CWL029
guucaccacuaccgaauuuuca

SEQ ID NO: 493613 - RNA, 19 nt, Chlamydophila pneumoniae CWL029
guuauuaauaaauuuaucu

SEQ ID NO: 493614 - RNA, 16 nt, Chlamydophila pneumoniae CWL029
guuauuaauaaauuua

SEQ ID NO: 493615 - RNA, 15 nt, Chlamydophila pneumoniae CWL029
guuauuaucaaagug

SEQ ID NO: 493616 - RNA, 20 nt, Chlamydophila pneumoniae CWL029
guuaucucccaagacgagaa

SEQ ID NO: 493617 - RNA, 15 nt, Chlamydophila pneumoniae CWL029
guuauauagacaaug

SEQ ID NO: 493618 - RNA, 21 nt, Chlamydophila pneumoniae CWL029
guuaucaaaagguuuuauaaa

SEQ ID NO: 493619 - RNA, 13 nt, Chlamydophila pneumoniae CWL029
guuauauuuuucu

SEQ ID NO: 493620 - RNA, 13 nt, Chlamydophila pneumoniae CWL029
guuaucaggaacu

SEQ ID NO: 493621 - RNA, 13 nt, Chlamydophila pneumoniae CWL029
guuaacuccuuca

SEQ ID NO: 493622 - RNA, 14 nt, Chlamydophila pneumoniae CWL029
guuaacgaauugcu

SEQ ID NO: 493623 - RNA, 20 nt, Chlamydophila pneumoniae CWL029
guuaacgaauugcuuucccc

SEQ ID NO: 493624 - RNA, 19 nt, Chlamydophila pneumoniae CWL029
guuaacaaguaccaagaaa

SEQ ID NO: 493625 - RNA, 11 nt, Chlamydophila pneumoniae CWL029
guuaacaucaa

SEQ ID NO: 493626 - RNA, 15 nt, Chlamydophila pneumoniae CWL029
guuaaucuaauuuua

SEQ ID NO: 493627 - RNA, 19 nt, Chlamydophila pneumoniae CWL029
guguggaucacguaagcuu

SEQ ID NO: 493628 - RNA, 16 nt, Chlamydophila pneumoniae CWL029
gugucauacgcagcac

SEQ ID NO: 493629 - RNA, 15 nt, Chlamydophila pneumoniae CWL029
guguauaguauuuuu

SEQ ID NO: 493630 - RNA, 23 nt, Chlamydophila pneumoniae CWL029
guguaucucuuaaaauauuaaau

SEQ ID NO: 493631 - RNA, 20 nt, Chlamydophila pneumoniae CWL029
gugggaauguuguuuuugau

SEQ ID NO: 493632 - RNA, 14 nt, Chlamydophila pneumoniae CWL029
gugggaggaauccu

SEQ ID NO: 493633 - RNA, 15 nt, Chlamydophila pneumoniae CWL029
guggaguaucuagcu

SEQ ID NO: 493634 - RNA, 16 nt, Chlamydophila pneumoniae CWL029
guggacggggagagcc

SEQ ID NO: 493635 - RNA, 14 nt, Chlamydophila pneumoniae CWL029
guggagguuaguau

SEQ ID NO: 493636 - RNA, 18 nt, Chlamydophila pneumoniae CWL029
guggaacgcauaagagac

SEQ ID NO: 493637 - RNA, 21 nt, Chlamydophila pneumoniae CWL029
gugccuguaauugauguuccu

SEQ ID NO: 493638 - RNA, 14 nt, Chlamydophila pneumoniae CWL029
gugcaucauuuuca

SEQ ID NO: 493639 - RNA, 14 nt, Chlamydophila pneumoniae CWL029
gugaucuugagaaa

SEQ ID NO: 493640 - RNA, 19 nt, Chlamydophila pneumoniae CWL029
gugccugguaaaggauauu

SEQ ID NO: 493641 - RNA, 16 nt, Chlamydophila pneumoniae CWL029
gugaucaaagaacaau

SEQ ID NO: 493642 - RNA, 20 nt, Chlamydophila pneumoniae CWL029
gugauauccaccuuaccauc

SEQ ID NO: 493643 - RNA, 14 nt, Chlamydophila pneumoniae CWL029
gugaguucuuccuu

SEQ ID NO: 493644 - RNA, 13 nt, Chlamydophila pneumoniae CWL029
gugaguugcaauu

SEQ ID NO: 493645 - RNA, 20 nt, Chlamydophila pneumoniae CWL029
gugacucuuaucuggagaug

SEQ ID NO: 493646 - RNA, 19 nt, Chlamydophila pneumoniae CWL029
gugaagauaagaccagaaa

SEQ ID NO: 493647 - RNA, 13 nt, Chlamydophila pneumoniae CWL029
gugaaaucugcuc

SEQ ID NO: 493648 - RNA, 13 nt, Chlamydophila pneumoniae CWL029
gugaacacucucu

SEQ ID NO: 493649 - RNA, 14 nt, Chlamydophila pneumoniae CWL029
gugaaugagcuuca

SEQ ID NO: 493650 - RNA, 19 nt, Chlamydophila pneumoniae CWL029
gucuuucuuuuuuuugccg

SEQ ID NO: 493651 - RNA, 16 nt, Chlamydophila pneumoniae CWL029
gucuuugcuuucuagg

SEQ ID NO: 493652 - RNA, 17 nt, Chlamydophila pneumoniae CWL029
gucuucuuagaagagaa

SEQ ID NO: 493653 - RNA, 23 nt, Chlamydophila pneumoniae CWL029
gucuugcuuugugaguucuuccu

SEQ ID NO: 493654 - RNA, 16 nt, Chlamydophila pneumoniae CWL029
gucuuccuagaccuau

SEQ ID NO: 493655 - RNA, 16 nt, Chlamydophila pneumoniae CWL029
gucuucccucuccuug

SEQ ID NO: 493656 - RNA, 15 nt, Chlamydophila pneumoniae CWL029
gucuuccguauaagu

SEQ ID NO: 493657 - RNA, 19 nt, Chlamydophila pneumoniae CWL029
gucuccuggaacaguauaa

SEQ ID NO: 493658 - RNA, 13 nt, Chlamydophila pneumoniae CWL029
gucuccuugauuu

SEQ ID NO: 493659 - RNA, 16 nt, Chlamydophila pneumoniae CWL029
gucucuuucagcucaa

SEQ ID NO: 493660 - RNA, 22 nt, Chlamydophila pneumoniae CWL029
gucucuugcgucacauuuguug

SEQ ID NO: 493661 - RNA, 19 nt, Chlamydophila pneumoniae CWL029
gucugauguaggugauauu

SEQ ID NO: 493662 - RNA, 21 nt, Chlamydophila pneumoniae CWL029
gucugccaucgcccaauuuuu

SEQ ID NO: 493663 - RNA, 17 nt, Chlamydophila pneumoniae CWL029
gucuuaucuaaagaaau

SEQ ID NO: 493664 - RNA, 20 nt, Chlamydophila pneumoniae CWL029
gucuuaucuaaagaaaugua

SEQ ID NO: 493665 - RNA, 21 nt, Chlamydophila pneumoniae CWL029
gucuucagcuuguuuuugcaa

SEQ ID NO: 493666 - RNA, 13 nt, Chlamydophila pneumoniae CWL029
gucuuccaucucu

SEQ ID NO: 493667 - RNA, 15 nt, Chlamydophila pneumoniae CWL029
gucuguuuuggaaag

SEQ ID NO: 493668 - RNA, 15 nt, Chlamydophila pneumoniae CWL029
gucuuaaaauuccug

SEQ ID NO: 493669 - RNA, 21 nt, Chlamydophila pneumoniae CWL029
gucucagcauuuuauccacug

SEQ ID NO: 493670 - RNA, 23 nt, Chlamydophila pneumoniae CWL029
gucucacucuuuucuagaaacug

SEQ ID NO: 493671 - RNA, 20 nt, Chlamydophila pneumoniae CWL029
gucuauucucuucauuuucu

SEQ ID NO: 493672 - RNA, 14 nt, Chlamydophila pneumoniae CWL029
gucuauuugaaaag

SEQ ID NO: 493673 - RNA, 17 nt, Chlamydophila pneumoniae CWL029
gucuccaaaaauuccca

SEQ ID NO: 493674 - RNA, 17 nt, Chlamydophila pneumoniae CWL029
gucuccauaauucugca

SEQ ID NO: 493675 - RNA, 13 nt, Chlamydophila pneumoniae CWL029
gucucccucacaa

SEQ ID NO: 493676 - RNA, 21 nt, Chlamydophila pneumoniae CWL029
gucucccuggucuguauuuuc

SEQ ID NO: 493677 - RNA, 12 nt, Chlamydophila pneumoniae CWL029
gucuaaaggagu

SEQ ID NO: 493678 - RNA, 12 nt, Chlamydophila pneumoniae CWL029
gucuaaucccca

SEQ ID NO: 493679 - RNA, 20 nt, Chlamydophila pneumoniae CWL029
gucuagcaguugcaauacca

SEQ ID NO: 493680 - RNA, 14 nt, Chlamydophila pneumoniae CWL029
gucgucuuuuaaag

SEQ ID NO: 493681 - RNA, 19 nt, Chlamydophila pneumoniae CWL029
gucgucuuuuaaagagcgc

SEQ ID NO: 493682 - RNA, 19 nt, Chlamydophila pneumoniae CWL029
gucguaaucuuuuuuaaag

SEQ ID NO: 493683 - RNA, 21 nt, Chlamydophila pneumoniae CWL029
gucguaaacggacgcuagaga

SEQ ID NO: 493684 - RNA, 14 nt, Chlamydophila pneumoniae CWL029
gucggcuuuagaaa

SEQ ID NO: 493685 - RNA, 22 nt, Chlamydophila pneumoniae CWL029
gucggcuuuagaaaagugcccu

SEQ ID NO: 493686 - RNA, 17 nt, Chlamydophila pneumoniae CWL029
gucgcgaccgaaagucc

SEQ ID NO: 493687 - RNA, 20 nt, Chlamydophila pneumoniae CWL029
gucgcgacaagacaaugacu

SEQ ID NO: 493688 - RNA, 18 nt, Chlamydophila pneumoniae CWL029
gucggagguucgaauccu

SEQ ID NO: 493689 - RNA, 20 nt, Chlamydophila pneumoniae CWL029
gucgcuagaucacaagaaag

SEQ ID NO: 493690 - RNA, 19 nt, Chlamydophila pneumoniae CWL029
guccuccauggaaagaaac

SEQ ID NO: 493691 - RNA, 13 nt, Chlamydophila pneumoniae CWL029
guccauucugacc

SEQ ID NO: 493692 - RNA, 21 nt, Chlamydophila pneumoniae CWL029
guccauuucauguaagaaugu

SEQ ID NO: 493693 - RNA, 22 nt, Chlamydophila pneumoniae CWL029
gucccucuaaugacagcugaga

SEQ ID NO: 493694 - RNA, 14 nt, Chlamydophila pneumoniae CWL029
guccgaagccuuca

SEQ ID NO: 493695 - RNA, 24 nt, Chlamydophila pneumoniae CWL029
gucccugauuccauccugucuauu

SEQ ID NO: 493696 - RNA, 12 nt, Chlamydophila pneumoniae CWL029
gucgaagauuca

SEQ ID NO: 493697 - RNA, 16 nt, Chlamydophila pneumoniae CWL029
gucgagaaccuccacc

SEQ ID NO: 493698 - RNA, 17 nt, Chlamydophila pneumoniae CWL029
gucgagaaccuccacca

SEQ ID NO: 493699 - RNA, 16 nt, Chlamydophila pneumoniae CWL029
guccagacuuuccucu

SEQ ID NO: 493700 - RNA, 12 nt, Chlamydophila pneumoniae CWL029
guccaaacccug

SEQ ID NO: 493701 - RNA, 16 nt, Chlamydophila pneumoniae CWL029
guccacaagccucccu

SEQ ID NO: 493702 - RNA, 23 nt, Chlamydophila pneumoniae CWL029
gucaucaguggcgacugcaacag

SEQ ID NO: 493703 - RNA, 13 nt, Chlamydophila pneumoniae CWL029
gucauauuuaaaa

SEQ ID NO: 493704 - RNA, 21 nt, Chlamydophila pneumoniae CWL029
gucaccuuaauggcuccuacu

SEQ ID NO: 493705 - RNA, 16 nt, Chlamydophila pneumoniae CWL029
gucaaagguuuuaaaa

SEQ ID NO: 493706 - RNA, 17 nt, Chlamydophila pneumoniae CWL029
gucaaauacuucuccug

SEQ ID NO: 493707 - RNA, 21 nt, Chlamydophila pneumoniae CWL029
gucaaauucauuaagaacauc

SEQ ID NO: 493708 - RNA, 16 nt, Chlamydophila pneumoniae CWL029
gucacagcauuuucuc

SEQ ID NO: 493709 - RNA, 17 nt, Chlamydophila pneumoniae CWL029
gucacagcauuuucucu

SEQ ID NO: 493710 - RNA, 19 nt, Chlamydophila pneumoniae CWL029
gucacacugcgagagaaag

SEQ ID NO: 493711 - RNA, 16 nt, Chlamydophila pneumoniae CWL029
gucaauaagcuugcca

SEQ ID NO: 493712 - RNA, 21 nt, Chlamydophila pneumoniae CWL029
gucaauaagcuugccagcaga

SEQ ID NO: 493713 - RNA, 22 nt, Chlamydophila pneumoniae CWL029
gucaauaagcuugccagcagaa

SEQ ID NO: 493714 - RNA, 13 nt, Chlamydophila pneumoniae CWL029
guauucuguaaga

SEQ ID NO: 493715 - RNA, 17 nt, Chlamydophila pneumoniae CWL029
guauucuguaagaaucc

SEQ ID NO: 493716 - RNA, 22 nt, Chlamydophila pneumoniae CWL029
guauuccuuggauuucuucuuc

SEQ ID NO: 493717 - RNA, 17 nt, Chlamydophila pneumoniae CWL029
guauugcaaauuucauu

SEQ ID NO: 493718 - RNA, 20 nt, Chlamydophila pneumoniae CWL029
guauuguguucccucuucuu

SEQ ID NO: 493719 - RNA, 18 nt, Chlamydophila pneumoniae CWL029
guauuuaccuacagauau

SEQ ID NO: 493720 - RNA, 19 nt, Chlamydophila pneumoniae CWL029
guauuuucuucaacauaca

SEQ ID NO: 493721 - RNA, 15 nt, Chlamydophila pneumoniae CWL029
guauuuuuaaauaca

SEQ ID NO: 493722 - RNA, 14 nt, Chlamydophila pneumoniae CWL029
guaucuccggaacg

SEQ ID NO: 493723 - RNA, 22 nt, Chlamydophila pneumoniae CWL029
guaucuucuucgguguagaucu

SEQ ID NO: 493724 - RNA, 13 nt, Chlamydophila pneumoniae CWL029
guaucuuuuugca

SEQ ID NO: 493725 - RNA, 19 nt, Chlamydophila pneumoniae CWL029
guaucuuuuugcagauccc

SEQ ID NO: 493726 - RNA, 17 nt, Chlamydophila pneumoniae CWL029
guaugaggagauaaaga

SEQ ID NO: 493727 - RNA, 13 nt, Chlamydophila pneumoniae CWL029
guauccuugauuu

SEQ ID NO: 493728 - RNA, 19 nt, Chlamydophila pneumoniae CWL029
guaucgagcucuuuaagaa

SEQ ID NO: 493729 - RNA, 21 nt, Chlamydophila pneumoniae CWL029
guaucgagcucuuuaagaacu

SEQ ID NO: 493730 - RNA, 19 nt, Chlamydophila pneumoniae CWL029
guauccuccuucugcauga

SEQ ID NO: 493731 - RNA, 23 nt, Chlamydophila pneumoniae CWL029
guauccgcugcccaugcuuaucu

SEQ ID NO: 493732 - RNA, 19 nt, Chlamydophila pneumoniae CWL029
guaucaagaauaugggugu

SEQ ID NO: 493733 - RNA, 23 nt, Chlamydophila pneumoniae CWL029
guaucaauaaugacucuagagua

SEQ ID NO: 493734 - RNA, 18 nt, Chlamydophila pneumoniae CWL029
guaggaccuacugggaaa

SEQ ID NO: 493735 - RNA, 12 nt, Chlamydophila pneumoniae CWL029
guaggagcagcg

SEQ ID NO: 493736 - RNA, 19 nt, Chlamydophila pneumoniae CWL029
guagcguacguuuucucuu

SEQ ID NO: 493737 - RNA, 13 nt, Chlamydophila pneumoniae CWL029
guauaggcauuaa

SEQ ID NO: 493738 - RNA, 22 nt, Chlamydophila pneumoniae CWL029
guauagacuccuuaacaaccgc

SEQ ID NO: 493739 - RNA, 23 nt, Chlamydophila pneumoniae CWL029
guagccccggucgucuuagaauc

SEQ ID NO: 493740 - RNA, 11 nt, Chlamydophila pneumoniae CWL029
guagccccagc

SEQ ID NO: 493741 - RNA, 16 nt, Chlamydophila pneumoniae CWL029
guagaauaacgcaagg

SEQ ID NO: 493742 - RNA, 13 nt, Chlamydophila pneumoniae CWL029
guagaauccuucu

SEQ ID NO: 493743 - RNA, 16 nt, Chlamydophila pneumoniae CWL029
guagaauccuucuccc

SEQ ID NO: 493744 - RNA, 12 nt, Chlamydophila pneumoniae CWL029
guacuuuuugcc

SEQ ID NO: 493745 - RNA, 14 nt, Chlamydophila pneumoniae CWL029
guacuuuacacuau

SEQ ID NO: 493746 - RNA, 20 nt, Chlamydophila pneumoniae CWL029
guacucuucuuuuuaucaug

SEQ ID NO: 493747 - RNA, 22 nt, Chlamydophila pneumoniae CWL029
guaauuucuaaauagaaaacau

SEQ ID NO: 493748 - RNA, 20 nt, Chlamydophila pneumoniae CWL029
guaauuucuagcuaauaaug

SEQ ID NO: 493749 - RNA, 20 nt, Chlamydophila pneumoniae CWL029
guacacauugucucuuuuaa

SEQ ID NO: 493750 - RNA, 23 nt, Chlamydophila pneumoniae CWL029
guacagaccguccuccccauaca

SEQ ID NO: 493751 - RNA, 18 nt, Chlamydophila pneumoniae CWL029
guacaggaaguccaugua

SEQ ID NO: 493752 - RNA, 16 nt, Chlamydophila pneumoniae CWL029
guaaugagcuggaaga

SEQ ID NO: 493753 - RNA, 20 nt, Chlamydophila pneumoniae CWL029
guaauuccaaaauaaaagga

SEQ ID NO: 493754 - RNA, 14 nt, Chlamydophila pneumoniae CWL029
guaauuacagaucu

SEQ ID NO: 493755 - RNA, 22 nt, Chlamydophila pneumoniae CWL029
guaauuauuuucuacacuguug

SEQ ID NO: 493756 - RNA, 16 nt, Chlamydophila pneumoniae CWL029
guaaaacuacaggaaa

SEQ ID NO: 493757 - RNA, 20 nt, Chlamydophila pneumoniae CWL029
guaaaacugcgcuaucauca

SEQ ID NO: 493758 - RNA, 22 nt, Chlamydophila pneumoniae CWL029
guaauagacaacgcaggaagaa

SEQ ID NO: 493759 - RNA, 21 nt, Chlamydophila pneumoniae CWL029
guaaucaugauaaaaauuuuc

SEQ ID NO: 493760 - RNA, 18 nt, Chlamydophila pneumoniae CWL029
guaauccagauuguucaa

SEQ ID NO: 493761 - RNA, 17 nt, Chlamydophila pneumoniae CWL029
gguuucuuuccaucaua

SEQ ID NO: 493762 - RNA, 23 nt, Chlamydophila pneumoniae CWL029
gguuucuuuuuuuugaagugcuu

SEQ ID NO: 493763 - RNA, 16 nt, Chlamydophila pneumoniae CWL029
gguuucuuuuuuuuga

SEQ ID NO: 493764 - RNA, 19 nt, Chlamydophila pneumoniae CWL029
gguuugcaugccuauuaag

SEQ ID NO: 493765 - RNA, 11 nt, Chlamydophila pneumoniae CWL029
gguuucuaggu

SEQ ID NO: 493766 - RNA, 12 nt, Chlamydophila pneumoniae CWL029
gguuucuaaaua

SEQ ID NO: 493767 - RNA, 21 nt, Chlamydophila pneumoniae CWL029
guaaaacacaaauagcaagag

SEQ ID NO: 493768 - RNA, 13 nt, Chlamydophila pneumoniae CWL029
guaaaaagaaaga

SEQ ID NO: 493769 - RNA, 14 nt, Chlamydophila pneumoniae CWL029
guaaaaauggcacu

SEQ ID NO: 493770 - RNA, 16 nt, Chlamydophila pneumoniae CWL029
gguuuugaagcuccuc

SEQ ID NO: 493771 - RNA, 21 nt, Chlamydophila pneumoniae CWL029
gguucuuccauaagaucaaua

SEQ ID NO: 493772 - RNA, 11 nt, Chlamydophila pneumoniae CWL029
gguucaaaucc

SEQ ID NO: 493773 - RNA, 22 nt, Chlamydophila pneumoniae CWL029
gguucauuuccaaauucuugca

SEQ ID NO: 493774 - RNA, 22 nt, Chlamydophila pneumoniae CWL029
gguuccacagagaccuucucuu

SEQ ID NO: 493775 - RNA, 19 nt, Chlamydophila pneumoniae CWL029
gguuccuuaaagaguuugu

SEQ ID NO: 493776 - RNA, 17 nt, Chlamydophila pneumoniae CWL029
gguguauaguauuuuua

SEQ ID NO: 493777 - RNA, 17 nt, Chlamydophila pneumoniae CWL029
gguggguagccaggaug

SEQ ID NO: 493778 - RNA, 18 nt, Chlamydophila pneumoniae CWL029
ggugcuguuguaauaaaa

SEQ ID NO: 493779 - RNA, 18 nt, Chlamydophila pneumoniae CWL029
ggucucccucacaagaag

SEQ ID NO: 493780 - RNA, 17 nt, Chlamydophila pneumoniae CWL029
ggucuaacuuagagcga

SEQ ID NO: 493781 - RNA, 16 nt, Chlamydophila pneumoniae CWL029
gguauagaaacaccgu

SEQ ID NO: 493782 - RNA, 13 nt, Chlamydophila pneumoniae CWL029
ggguguggcaaag

SEQ ID NO: 493783 - RNA, 14 nt, Chlamydophila pneumoniae CWL029
gguauuucucucca

SEQ ID NO: 493784 - RNA, 15 nt, Chlamydophila pneumoniae CWL029
gguauuucucuccac

SEQ ID NO: 493785 - RNA, 12 nt, Chlamydophila pneumoniae CWL029
ggguaaguccac

SEQ ID NO: 493786 - RNA, 18 nt, Chlamydophila pneumoniae CWL029
ggguaaggcgaaaucuuc

SEQ ID NO: 493787 - RNA, 19 nt, Chlamydophila pneumoniae CWL029
gggguccauucugaccaaa

SEQ ID NO: 493788 - RNA, 13 nt, Chlamydophila pneumoniae CWL029
ggggcuuuccuuc

SEQ ID NO: 493789 - RNA, 14 nt, Chlamydophila pneumoniae CWL029
gggccucuucccaa

SEQ ID NO: 493790 - RNA, 18 nt, Chlamydophila pneumoniae CWL029
gggcggacuauguuuaaa

SEQ ID NO: 493791 - RNA, 21 nt, Chlamydophila pneumoniae CWL029
gggccugccaugaauccaugg

SEQ ID NO: 493792 - RNA, 14 nt, Chlamydophila pneumoniae CWL029
ggggagucuuggau

SEQ ID NO: 493793 - RNA, 21 nt, Chlamydophila pneumoniae CWL029
ggggaucuucagagagaacag

SEQ ID NO: 493794 - RNA, 22 nt, Chlamydophila pneumoniae CWL029
gggcacucuuccacaauguuua

SEQ ID NO: 493795 - RNA, 12 nt, Chlamydophila pneumoniae CWL029
gggagaugcuau

SEQ ID NO: 493796 - RNA, 15 nt, Chlamydophila pneumoniae CWL029
gggauugauaacaau

SEQ ID NO: 493797 - RNA, 20 nt, Chlamydophila pneumoniae CWL029
gggauuguucuuuacuacau

SEQ ID NO: 493798 - RNA, 23 nt, Chlamydophila pneumoniae CWL029
gggaauuugauuuuucaaauucu

SEQ ID NO: 493799 - RNA, 20 nt, Chlamydophila pneumoniae CWL029
gggaauuaaacuuucuucuc

SEQ ID NO: 493800 - RNA, 18 nt, Chlamydophila pneumoniae CWL029
gggaauucuuuuccugca

SEQ ID NO: 493801 - RNA, 15 nt, Chlamydophila pneumoniae CWL029
gggacauuuccccau

SEQ ID NO: 493802 - RNA, 16 nt, Chlamydophila pneumoniae CWL029
gggaaggggagauucc

SEQ ID NO: 493803 - RNA, 14 nt, Chlamydophila pneumoniae CWL029
gggaagaggaaugc

SEQ ID NO: 493804 - RNA, 22 nt, Chlamydophila pneumoniae CWL029
ggcuucugagcuugccuaccca

SEQ ID NO: 493805 - RNA, 18 nt, Chlamydophila pneumoniae CWL029
ggcuucauuccuacaucu

SEQ ID NO: 493806 - RNA, 21 nt, Chlamydophila pneumoniae CWL029
cuacacuguuguaauaaaauc

SEQ ID NO: 493807 - RNA, 21 nt, Chlamydophila pneumoniae CWL029
cuacagaggaaucuauccuuc

SEQ ID NO: 493808 - RNA, 17 nt, Chlamydophila pneumoniae CWL029
cuacagagggcuucauu

SEQ ID NO: 493809 - RNA, 20 nt, Chlamydophila pneumoniae CWL029
cuacagagggcuucauuccu

SEQ ID NO: 493810 - RNA, 21 nt, Chlamydophila pneumoniae CWL029
cuacagaaagagcuaaagaaa

SEQ ID NO: 493811 - RNA, 17 nt, Chlamydophila pneumoniae CWL029
cuacagaauaggaacaa

SEQ ID NO: 493812 - RNA, 22 nt, Chlamydophila pneumoniae CWL029
cuacaauuuccuugguauccca

SEQ ID NO: 493813 - RNA, 14 nt, Chlamydophila pneumoniae CWL029
cuacaauuuccuug

SEQ ID NO: 493814 - RNA, 23 nt, Chlamydophila pneumoniae CWL029
cuacaaucgccuuacaauuuaaa

SEQ ID NO: 493815 - RNA, 13 nt, Chlamydophila pneumoniae CWL029
cuacaugaggaua

SEQ ID NO: 493816 - RNA, 14 nt, Chlamydophila pneumoniae CWL029
cuacaucugugauu

SEQ ID NO: 493817 - RNA, 14 nt, Chlamydophila pneumoniae CWL029
cuacaugcucaaga

SEQ ID NO: 493818 - RNA, 15 nt, Chlamydophila pneumoniae CWL029
cuacauucuaacgcu

SEQ ID NO: 493819 - RNA, 16 nt, Chlamydophila pneumoniae CWL029
cuacauagauccccuu

SEQ ID NO: 493820 - RNA, 19 nt, Chlamydophila pneumoniae CWL029
cuacauaguuuuuauuuuu

SEQ ID NO: 493821 - RNA, 21 nt, Chlamydophila pneumoniae CWL029
cuacauauacguggcuuccau

SEQ ID NO: 493822 - RNA, 20 nt, Chlamydophila pneumoniae CWL029
cuacauauucguguaaaucu

SEQ ID NO: 493823 - RNA, 15 nt, Chlamydophila pneumoniae CWL029
cuacaucagacugaa

SEQ ID NO: 493824 - RNA, 16 nt, Chlamydophila pneumoniae CWL029
cuacagcuucuuuucc

SEQ ID NO: 493825 - RNA, 19 nt, Chlamydophila pneumoniae CWL029
cuacagcuucuuuuccagc

SEQ ID NO: 493826 - RNA, 14 nt, Chlamydophila pneumoniae CWL029
cuacagcuucuuuu

SEQ ID NO: 493827 - RNA, 16 nt, Chlamydophila pneumoniae CWL029
cuacauaaaaugagcu

SEQ ID NO: 493828 - RNA, 13 nt, Chlamydophila pneumoniae CWL029
cuacagauaugcu

SEQ ID NO: 493829 - RNA, 22 nt, Chlamydophila pneumoniae CWL029
cuacagaucaggauucuaaaaa

SEQ ID NO: 493830 - RNA, 12 nt, Chlamydophila pneumoniae CWL029
cuacagcagaaa

SEQ ID NO: 493831 - RNA, 13 nt, Chlamydophila pneumoniae CWL029
cuacagcuucauu

SEQ ID NO: 493832 - RNA, 18 nt, Chlamydophila pneumoniae CWL029
cuacagcuaacgaaguga

SEQ ID NO: 493833 - RNA, 13 nt, Chlamydophila pneumoniae CWL029
cuaccagaugccu

SEQ ID NO: 493834 - RNA, 21 nt, Chlamydophila pneumoniae CWL029
cuaccaaagucgauacccaaa

SEQ ID NO: 493835 - RNA, 20 nt, Chlamydophila pneumoniae CWL029
cuacauuugcuauuuucccu

SEQ ID NO: 493836 - RNA, 19 nt, Chlamydophila pneumoniae CWL029
cuacccccagcuucuucaa

SEQ ID NO: 493837 - RNA, 18 nt, Chlamydophila pneumoniae CWL029
cuaccccacgcuaaacua

SEQ ID NO: 493838 - RNA, 19 nt, Chlamydophila pneumoniae CWL029
cuaccauuaaggaauccca

SEQ ID NO: 493839 - RNA, 14 nt, Chlamydophila pneumoniae CWL029
cuaccauaucuuga

SEQ ID NO: 493840 - RNA, 14 nt, Chlamydophila pneumoniae CWL029
cuaccaucaugaau

SEQ ID NO: 493841 - RNA, 24 nt, Chlamydophila pneumoniae CWL029
cuaccucugggaagacucucauca

SEQ ID NO: 493842 - RNA, 21 nt, Chlamydophila pneumoniae CWL029
cuaccuauuuaagggaaaugu

SEQ ID NO: 493843 - RNA, 13 nt, Chlamydophila pneumoniae CWL029
cuaccuaccuauu

SEQ ID NO: 493844 - RNA, 17 nt, Chlamydophila pneumoniae CWL029
cuaccuaccuauuuaag

SEQ ID NO: 493845 - RNA, 19 nt, Chlamydophila pneumoniae CWL029
cuaccuguagcuacagauu

SEQ ID NO: 493846 - RNA, 23 nt, Chlamydophila pneumoniae CWL029
cuaccuguguaaugagcuggaag

SEQ ID NO: 493847 - RNA, 20 nt, Chlamydophila pneumoniae CWL029
cuaccguucgguuauuugcu

SEQ ID NO: 493848 - RNA, 15 nt, Chlamydophila pneumoniae CWL029
cuacccucaucaucc

SEQ ID NO: 493849 - RNA, 13 nt, Chlamydophila pneumoniae CWL029
cuaccgaacagag

SEQ ID NO: 493850 - RNA, 16 nt, Chlamydophila pneumoniae CWL029
cuagaacuugggaugc

SEQ ID NO: 493851 - RNA, 23 nt, Chlamydophila pneumoniae CWL029
cuagaagagcgucguaacaauuc

SEQ ID NO: 493852 - RNA, 20 nt, Chlamydophila pneumoniae CWL029
cuagaagacauucauuuuuu

SEQ ID NO: 493853 - RNA, 12 nt, Chlamydophila pneumoniae CWL029
cuagaaauauac

SEQ ID NO: 493854 - RNA, 18 nt, Chlamydophila pneumoniae CWL029
cuagaaacugcuccugaa

SEQ ID NO: 493855 - RNA, 16 nt, Chlamydophila pneumoniae CWL029
cuagaacacucagaga

SEQ ID NO: 493856 - RNA, 18 nt, Chlamydophila pneumoniae CWL029
cuagaacacucagagaug

SEQ ID NO: 493857 - RNA, 14 nt, Chlamydophila pneumoniae CWL029
cuagaccaauaaau

SEQ ID NO: 493858 - RNA, 17 nt, Chlamydophila pneumoniae CWL029
cuagaccugccaagaua

SEQ ID NO: 493859 - RNA, 16 nt, Chlamydophila pneumoniae CWL029
cuagacacgccuccuu

SEQ ID NO: 493860 - RNA, 20 nt, Chlamydophila pneumoniae CWL029
cuagaaucaccaauuuuuuc

SEQ ID NO: 493861 - RNA, 23 nt, Chlamydophila pneumoniae CWL029
cuagaaucaccaauuuuuucccc

SEQ ID NO: 493862 - RNA, 16 nt, Chlamydophila pneumoniae CWL029
cuagaauggcguaaua

SEQ ID NO: 493863 - RNA, 19 nt, Chlamydophila pneumoniae CWL029
cuagagaucuuuuuauuaa

SEQ ID NO: 493864 - RNA, 20 nt, Chlamydophila pneumoniae CWL029
cuagagaucuuuuuauuaaa

SEQ ID NO: 493865 - RNA, 14 nt, Chlamydophila pneumoniae CWL029
cuagagauuuuucu

SEQ ID NO: 493866 - RNA, 19 nt, Chlamydophila pneumoniae CWL029
cuagagcacauagaaacag

SEQ ID NO: 493867 - RNA, 21 nt, Chlamydophila pneumoniae CWL029
cuagccaucgcgaagcuuucc

SEQ ID NO: 493868 - RNA, 23 nt, Chlamydophila pneumoniae CWL029
cuagaaaagauucuaaaucaacu

SEQ ID NO: 493869 - RNA, 14 nt, Chlamydophila pneumoniae CWL029
cuagaaacugcucc

SEQ ID NO: 493870 - RNA, 16 nt, Chlamydophila pneumoniae CWL029
cuagaaacugcuccug

SEQ ID NO: 493871 - RNA, 19 nt, Chlamydophila pneumoniae CWL029
cuacgguuuucugccuuac

SEQ ID NO: 493872 - RNA, 20 nt, Chlamydophila pneumoniae CWL029
cuacggaacggacaaugcua

SEQ ID NO: 493873 - RNA, 21 nt, Chlamydophila pneumoniae CWL029
cuacggaugggcacucuucca

SEQ ID NO: 493874 - RNA, 12 nt, Chlamydophila pneumoniae CWL029
cuaggauaucau

SEQ ID NO: 493875 - RNA, 12 nt, Chlamydophila pneumoniae CWL029
cuaggagagcua

SEQ ID NO: 493876 - RNA, 19 nt, Chlamydophila pneumoniae CWL029
cuaggacagcacauagagu

SEQ ID NO: 493877 - RNA, 19 nt, Chlamydophila pneumoniae CWL029
cuagcuuucuuggagaaga

SEQ ID NO: 493878 - RNA, 23 nt, Chlamydophila pneumoniae CWL029
cuagcuuugucucuauagugcau

SEQ ID NO: 493879 - RNA, 14 nt, Chlamydophila pneumoniae CWL029
cuagcuuuuuuuau

SEQ ID NO: 493880 - RNA, 15 nt, Chlamydophila pneumoniae CWL029
cuagcuuuuuuuaug

SEQ ID NO: 493881 - RNA, 17 nt, Chlamydophila pneumoniae CWL029
cuaggaaucuuuuagag

SEQ ID NO: 493882 - RNA, 12 nt, Chlamydophila pneumoniae CWL029
cuagucuucuua

SEQ ID NO: 493883 - RNA, 12 nt, Chlamydophila pneumoniae CWL029
cuaguuuuucuu

SEQ ID NO: 493884 - RNA, 19 nt, Chlamydophila pneumoniae CWL029
cuaguuuuucuuuagagau

SEQ ID NO: 493885 - RNA, 14 nt, Chlamydophila pneumoniae CWL029
cuaguucuucuuua

SEQ ID NO: 493886 - RNA, 12 nt, Chlamydophila pneumoniae CWL029
cuauaaaauaaa

SEQ ID NO: 493887 - RNA, 17 nt, Chlamydophila pneumoniae CWL029
cuauaaagcaaaugccu

SEQ ID NO: 493888 - RNA, 18 nt, Chlamydophila pneumoniae CWL029
cuauaagagguucucuua

SEQ ID NO: 493889 - RNA, 13 nt, Chlamydophila pneumoniae CWL029
cuauaauaaccuc

SEQ ID NO: 493890 - RNA, 15 nt, Chlamydophila pneumoniae CWL029
cuauaauaaccucca

SEQ ID NO: 493891 - RNA, 20 nt, Chlamydophila pneumoniae CWL029
cuauacucucuguagcacuu

SEQ ID NO: 493892 - RNA, 23 nt, Chlamydophila pneumoniae CWL029
cucagaaaggagauccacagacu

SEQ ID NO: 493893 - RNA, 21 nt, Chlamydophila pneumoniae CWL029
cucagaaaaaucuaacacagu

SEQ ID NO: 493894 - RNA, 18 nt, Chlamydophila pneumoniae CWL029
cucagaaaauguaaaaaa

SEQ ID NO: 493895 - RNA, 22 nt, Chlamydophila pneumoniae CWL029
cucagaaaauguaaaaaauuau

SEQ ID NO: 493896 - RNA, 14 nt, Chlamydophila pneumoniae CWL029
cucacgggauagcc

SEQ ID NO: 493897 - RNA, 22 nt, Chlamydophila pneumoniae CWL029
cucacuguuuuucguaagcuga

SEQ ID NO: 493898 - RNA, 16 nt, Chlamydophila pneumoniae CWL029
cucagcuaauuuaaau

SEQ ID NO: 493899 - RNA, 13 nt, Chlamydophila pneumoniae CWL029
cucaggaaaacuu

SEQ ID NO: 493900 - RNA, 22 nt, Chlamydophila pneumoniae CWL029
cucaggaaagguaguuuucuuc

SEQ ID NO: 493901 - RNA, 20 nt, Chlamydophila pneumoniae CWL029
cucaaagaaagucucucuaa

SEQ ID NO: 493902 - RNA, 12 nt, Chlamydophila pneumoniae CWL029
cucaaaauuuaa

SEQ ID NO: 493903 - RNA, 16 nt, Chlamydophila pneumoniae CWL029
cucaccagaagcaacu

SEQ ID NO: 493904 - RNA, 19 nt, Chlamydophila pneumoniae CWL029
cucaccagaagcaacuaaa

SEQ ID NO: 493905 - RNA, 17 nt, Chlamydophila pneumoniae CWL029
cucacaaacaacagaaa

SEQ ID NO: 493906 - RNA, 14 nt, Chlamydophila pneumoniae CWL029
cucacaaacaacag

SEQ ID NO: 493907 - RNA, 15 nt, Chlamydophila pneumoniae CWL029
cuauuucauauaaag

SEQ ID NO: 493908 - RNA, 17 nt, Chlamydophila pneumoniae CWL029
cuauuuacugaaacauu

SEQ ID NO: 493909 - RNA, 14 nt, Chlamydophila pneumoniae CWL029
cuauuuaaggacgu

SEQ ID NO: 493910 - RNA, 13 nt, Chlamydophila pneumoniae CWL029
cuauugugcuuuu

SEQ ID NO: 493911 - RNA, 20 nt, Chlamydophila pneumoniae CWL029
cuauucucaaauuucaauaa

SEQ ID NO: 493912 - RNA, 22 nt, Chlamydophila pneumoniae CWL029
cuauucugauuagagccccaac

SEQ ID NO: 493913 - RNA, 17 nt, Chlamydophila pneumoniae CWL029
cuauugggaaugcauuu

SEQ ID NO: 493914 - RNA, 14 nt, Chlamydophila pneumoniae CWL029
cuauuuuuaaaaug

SEQ ID NO: 493915 - RNA, 14 nt, Chlamydophila pneumoniae CWL029
cuauuuuugaggaa

SEQ ID NO: 493916 - RNA, 14 nt, Chlamydophila pneumoniae CWL029
cuauuuuuugugaa

SEQ ID NO: 493917 - RNA, 17 nt, Chlamydophila pneumoniae CWL029
cuauuuuuugugaauuu

SEQ ID NO: 493918 - RNA, 14 nt, Chlamydophila pneumoniae CWL029
cuauuuuaaacuua

SEQ ID NO: 493919 - RNA, 13 nt, Chlamydophila pneumoniae CWL029
cuauuugaaaaga

SEQ ID NO: 493920 - RNA, 21 nt, Chlamydophila pneumoniae CWL029
cuauuugcaacaaucuuucuu

SEQ ID NO: 493921 - RNA, 15 nt, Chlamydophila pneumoniae CWL029
cuauagccucuucua

SEQ ID NO: 493922 - RNA, 17 nt, Chlamydophila pneumoniae CWL029
cuauagccucuucuaca

SEQ ID NO: 493923 - RNA, 19 nt, Chlamydophila pneumoniae CWL029
cuauagccucuucuacacc

SEQ ID NO: 493924 - RNA, 16 nt, Chlamydophila pneumoniae CWL029
cuauagaacuaacugu

SEQ ID NO: 493925 - RNA, 12 nt, Chlamydophila pneumoniae CWL029
cuauagagacac

SEQ ID NO: 493926 - RNA, 23 nt, Chlamydophila pneumoniae CWL029
cuauagauacuuugcaauacacc

SEQ ID NO: 493927 - RNA, 17 nt, Chlamydophila pneumoniae CWL029
cuauagauugguaagga

SEQ ID NO: 493928 - RNA, 17 nt, Chlamydophila pneumoniae CWL029
cuauagauuuaagaguc

SEQ ID NO: 493929 - RNA, 15 nt, Chlamydophila pneumoniae CWL029
cuaucuuuacuaaca

SEQ ID NO: 493930 - RNA, 16 nt, Chlamydophila pneumoniae CWL029
cuaucuuuacuaacaa

SEQ ID NO: 493931 - RNA, 18 nt, Chlamydophila pneumoniae CWL029
cuaucuuuacuaacaaaa

SEQ ID NO: 493932 - RNA, 12 nt, Chlamydophila pneumoniae CWL029
cuaucuucaagu

SEQ ID NO: 493933 - RNA, 21 nt, Chlamydophila pneumoniae CWL029
cuauucccgacucggagacca

SEQ ID NO: 493934 - RNA, 22 nt, Chlamydophila pneumoniae CWL029
cuauuagcgcggucacuucaau

SEQ ID NO: 493935 - RNA, 18 nt, Chlamydophila pneumoniae CWL029
cuauuagcgcggucacuu

SEQ ID NO: 493936 - RNA, 14 nt, Chlamydophila pneumoniae CWL029
cuauuauuuuaaag

SEQ ID NO: 493937 - RNA, 14 nt, Chlamydophila pneumoniae CWL029
cuaugggaggaauu

SEQ ID NO: 493938 - RNA, 19 nt, Chlamydophila pneumoniae CWL029
cuaugggaggaauuccucu

SEQ ID NO: 493939 - RNA, 20 nt, Chlamydophila pneumoniae CWL029
cuaugggaggaauuccucuc

SEQ ID NO: 493940 - RNA, 23 nt, Chlamydophila pneumoniae CWL029
cuaugaggacgacgcaucuccuc

SEQ ID NO: 493941 - RNA, 19 nt, Chlamydophila pneumoniae CWL029
cuauggaagauaaacauac

SEQ ID NO: 493942 - RNA, 15 nt, Chlamydophila pneumoniae CWL029
cucgucugauagagg

SEQ ID NO: 493943 - RNA, 19 nt, Chlamydophila pneumoniae CWL029
cucgguuauuuuuccagaa

SEQ ID NO: 493944 - RNA, 21 nt, Chlamydophila pneumoniae CWL029
cucguguagaauucacucccu

SEQ ID NO: 493945 - RNA, 23 nt, Chlamydophila pneumoniae CWL029
cucgugcaaggccuaaucuugua

SEQ ID NO: 493946 - RNA, 21 nt, Chlamydophila pneumoniae CWL029
cucuaaacauaaagacccuuc

SEQ ID NO: 493947 - RNA, 19 nt, Chlamydophila pneumoniae CWL029
cucuaagcugugcauuuuc

SEQ ID NO: 493948 - RNA, 12 nt, Chlamydophila pneumoniae CWL029
cucuaagacugu

SEQ ID NO: 493949 - RNA, 14 nt, Chlamydophila pneumoniae CWL029
cucuaagaggguuu

SEQ ID NO: 493950 - RNA, 22 nt, Chlamydophila pneumoniae CWL029
cucuaaggacaaaucucccaaa

SEQ ID NO: 493951 - RNA, 17 nt, Chlamydophila pneumoniae CWL029
cucgauuugaucuugcu

SEQ ID NO: 493952 - RNA, 12 nt, Chlamydophila pneumoniae CWL029
cucgaagaaaau

SEQ ID NO: 493953 - RNA, 18 nt, Chlamydophila pneumoniae CWL029
cucgaaccacuguccaug

SEQ ID NO: 493954 - RNA, 22 nt, Chlamydophila pneumoniae CWL029
cuccucaucagaggccaccaaa

SEQ ID NO: 493955 - RNA, 16 nt, Chlamydophila pneumoniae CWL029
cuccuccaaucugcug

SEQ ID NO: 493956 - RNA, 18 nt, Chlamydophila pneumoniae CWL029
cuccuccaaugagcucua

SEQ ID NO: 493957 - RNA, 19 nt, Chlamydophila pneumoniae CWL029
cuccuccaaugagcucuau

SEQ ID NO: 493958 - RNA, 17 nt, Chlamydophila pneumoniae CWL029
cuccgaauggagaagga

SEQ ID NO: 493959 - RNA, 13 nt, Chlamydophila pneumoniae CWL029
cuccgagaaacaa

SEQ ID NO: 493960 - RNA, 13 nt, Chlamydophila pneumoniae CWL029
cuccgaggaggga

SEQ ID NO: 493961 - RNA, 19 nt, Chlamydophila pneumoniae CWL029
cuccgcuagaggaucuuca

SEQ ID NO: 493962 - RNA, 16 nt, Chlamydophila pneumoniae CWL029
cuccgauaugggcuuu

SEQ ID NO: 493963 - RNA, 21 nt, Chlamydophila pneumoniae CWL029
cuccgauagagauucuuucuc

SEQ ID NO: 493964 - RNA, 21 nt, Chlamydophila pneumoniae CWL029
cuccgcucuaagcugugcauu

SEQ ID NO: 493965 - RNA, 14 nt, Chlamydophila pneumoniae CWL029
cuccguagucuuag

SEQ ID NO: 493966 - RNA, 21 nt, Chlamydophila pneumoniae CWL029
cuccgucaagaacaagagcuu

SEQ ID NO: 493967 - RNA, 20 nt, Chlamydophila pneumoniae CWL029
cuccguccaguucuucauuc

SEQ ID NO: 493968 - RNA, 19 nt, Chlamydophila pneumoniae CWL029
cuccguggcggauaaucaa

SEQ ID NO: 493969 - RNA, 23 nt, Chlamydophila pneumoniae CWL029
cuccuaaggaaaccacguccauu

SEQ ID NO: 493970 - RNA, 12 nt, Chlamydophila pneumoniae CWL029
cuccuaaagcau

SEQ ID NO: 493971 - RNA, 19 nt, Chlamydophila pneumoniae CWL029
cuccuaaaccaucacuucc

SEQ ID NO: 493972 - RNA, 21 nt, Chlamydophila pneumoniae CWL029
cuccuaaaccaucacuuccug

SEQ ID NO: 493973 - RNA, 22 nt, Chlamydophila pneumoniae CWL029
cuccuaaacucaauuaugccca

SEQ ID NO: 493974 - RNA, 16 nt, Chlamydophila pneumoniae CWL029
cuccuaaaccaucacu

SEQ ID NO: 493975 - RNA, 23 nt, Chlamydophila pneumoniae CWL029
cuccucagaauccauuuugccca

SEQ ID NO: 493976 - RNA, 12 nt, Chlamydophila pneumoniae CWL029
cuccucaaaaga

SEQ ID NO: 493977 - RNA, 13 nt, Chlamydophila pneumoniae CWL029
cuccucaaaagau

SEQ ID NO: 493978 - RNA, 23 nt, Chlamydophila pneumoniae CWL029
cucccgugagcaugcucacggga

SEQ ID NO: 493979 - RNA, 19 nt, Chlamydophila pneumoniae CWL029
cucccuagguuuuaucuuu

SEQ ID NO: 493980 - RNA, 13 nt, Chlamydophila pneumoniae CWL029
cuccauuuagaau

SEQ ID NO: 493981 - RNA, 15 nt, Chlamydophila pneumoniae CWL029
cuccauuucuaggaa

SEQ ID NO: 493982 - RNA, 21 nt, Chlamydophila pneumoniae CWL029
cuccauuucuaggaauugcug

SEQ ID NO: 493983 - RNA, 22 nt, Chlamydophila pneumoniae CWL029
cuccauuggcauagagccuaga

SEQ ID NO: 493984 - RNA, 17 nt, Chlamydophila pneumoniae CWL029
cuccauuuagacaagac

SEQ ID NO: 493985 - RNA, 20 nt, Chlamydophila pneumoniae CWL029
cuccauuuagacaagacacc

SEQ ID NO: 493986 - RNA, 13 nt, Chlamydophila pneumoniae CWL029
cuccauuucuagg

SEQ ID NO: 493987 - RNA, 14 nt, Chlamydophila pneumoniae CWL029
cuccauuucuagga

SEQ ID NO: 493988 - RNA, 17 nt, Chlamydophila pneumoniae CWL029
cucccauagcaaugccu

SEQ ID NO: 493989 - RNA, 23 nt, Chlamydophila pneumoniae CWL029
cuccagcauaaggauucugagaa

SEQ ID NO: 493990 - RNA, 17 nt, Chlamydophila pneumoniae CWL029
cuccagaaacgcagcuu

SEQ ID NO: 493991 - RNA, 14 nt, Chlamydophila pneumoniae CWL029
cuccagaaauuuuu

SEQ ID NO: 493992 - RNA, 16 nt, Chlamydophila pneumoniae CWL029
cuccagaaauuuuuac

SEQ ID NO: 493993 - RNA, 22 nt, Chlamydophila pneumoniae CWL029
cuccagaaauuuuuacaaucuc

SEQ ID NO: 493994 - RNA, 12 nt, Chlamydophila pneumoniae CWL029
cuccagaagcaa

SEQ ID NO: 493995 - RNA, 16 nt, Chlamydophila pneumoniae CWL029
cuccagaagcaagaau

SEQ ID NO: 493996 - RNA, 22 nt, Chlamydophila pneumoniae CWL029
cuccacgccaaaguacucgcuu

SEQ ID NO: 493997 - RNA, 22 nt, Chlamydophila pneumoniae CWL029
cuccaccaggagcuccuccuug

SEQ ID NO: 493998 - RNA, 15 nt, Chlamydophila pneumoniae CWL029
cuccacagcuucuuc

SEQ ID NO: 493999 - RNA, 19 nt, Chlamydophila pneumoniae CWL029
cuccacaggaaugaaaccu

SEQ ID NO: 494000 - RNA, 12 nt, Chlamydophila pneumoniae CWL029
cuccaccagaag

SEQ ID NO: 494001 - RNA, 20 nt, Chlamydophila pneumoniae CWL029
cuccaaugagcucuauuucu

SEQ ID NO: 494002 - RNA, 20 nt, Chlamydophila pneumoniae CWL029
cuccaauuuucuucagcacu

SEQ ID NO: 494003 - RNA, 16 nt, Chlamydophila pneumoniae CWL029
cuccaaaaauucccau

SEQ ID NO: 494004 - RNA, 19 nt, Chlamydophila pneumoniae CWL029
cuccaaaagaccaaaaaua

SEQ ID NO: 494005 - RNA, 15 nt, Chlamydophila pneumoniae CWL029
cucauugcggcacca

SEQ ID NO: 494006 - RNA, 17 nt, Chlamydophila pneumoniae CWL029
cuccaaauguucucucc

SEQ ID NO: 494007 - RNA, 14 nt, Chlamydophila pneumoniae CWL029
cuccaaacauuuuu

SEQ ID NO: 494008 - RNA, 20 nt, Chlamydophila pneumoniae CWL029
cuccaaacauuuuuaaggaa

SEQ ID NO: 494009 - RNA, 17 nt, Chlamydophila pneumoniae CWL029
cuccaaaauaaucucgc

SEQ ID NO: 494010 - RNA, 23 nt, Chlamydophila pneumoniae CWL029
cuccaaaauaaucucgcaguccu

SEQ ID NO: 494011 - RNA, 15 nt, Chlamydophila pneumoniae CWL029
cuccaaaauauucuu

SEQ ID NO: 494012 - RNA, 20 nt, Chlamydophila pneumoniae CWL029
cuccaacuuccauaugaggu

SEQ ID NO: 494013 - RNA, 19 nt, Chlamydophila pneumoniae CWL029
cuccaagaauagcaggaag

SEQ ID NO: 494014 - RNA, 15 nt, Chlamydophila pneumoniae CWL029
cuccaagauaauuau

SEQ ID NO: 494015 - RNA, 16 nt, Chlamydophila pneumoniae CWL029
cucauuaucaagaaau

SEQ ID NO: 494016 - RNA, 17 nt, Chlamydophila pneumoniae CWL029
cucauuccagcaucuuc

SEQ ID NO: 494017 - RNA, 19 nt, Chlamydophila pneumoniae CWL029
cucauuccagcaucuucuc

SEQ ID NO: 494018 - RNA, 23 nt, Chlamydophila pneumoniae CWL029
cucaggaccuaagggcucuccua

SEQ ID NO: 494019 - RNA, 19 nt, Chlamydophila pneumoniae CWL029
cucaggagauacaagcaau

SEQ ID NO: 494020 - RNA, 15 nt, Chlamydophila pneumoniae CWL029
cucaggauauauaga

SEQ ID NO: 494021 - RNA, 19 nt, Chlamydophila pneumoniae CWL029
cucauuaagaggagucccc

SEQ ID NO: 494022 - RNA, 20 nt, Chlamydophila pneumoniae CWL029
cuaaacaagaaaaagcaucu

SEQ ID NO: 494023 - RNA, 13 nt, Chlamydophila pneumoniae CWL029
cuaaacaauuuca

SEQ ID NO: 494024 - RNA, 14 nt, Chlamydophila pneumoniae CWL029
cuaaaacuucuugu

SEQ ID NO: 494025 - RNA, 17 nt, Chlamydophila pneumoniae CWL029
cuaaaagcacuuaaaaa

SEQ ID NO: 494026 - RNA, 12 nt, Chlamydophila pneumoniae CWL029
cuaaaaccuaga

SEQ ID NO: 494027 - RNA, 16 nt, Chlamydophila pneumoniae CWL029
cguuuuuuuugauuuc

SEQ ID NO: 494028 - RNA, 20 nt, Chlamydophila pneumoniae CWL029
cguuuuuaggguucaucuga

SEQ ID NO: 494029 - RNA, 18 nt, Chlamydophila pneumoniae CWL029
cguuguaucccugugccu

SEQ ID NO: 494030 - RNA, 19 nt, Chlamydophila pneumoniae CWL029
cguuuccgaucauuuuugc

SEQ ID NO: 494031 - RNA, 12 nt, Chlamydophila pneumoniae CWL029
cguuuccuccuc

SEQ ID NO: 494032 - RNA, 15 nt, Chlamydophila pneumoniae CWL029
cguuaauaagaaccu

SEQ ID NO: 494033 - RNA, 14 nt, Chlamydophila pneumoniae CWL029
cguuaccaaaaacu

SEQ ID NO: 494034 - RNA, 17 nt, Chlamydophila pneumoniae CWL029
cguuagaacucgaauug

SEQ ID NO: 494035 - RNA, 12 nt, Chlamydophila pneumoniae CWL029
cguuauauuuuu

SEQ ID NO: 494036 - RNA, 22 nt, Chlamydophila pneumoniae CWL029
cguucgacaacaacauaaagaa

SEQ ID NO: 494037 - RNA, 13 nt, Chlamydophila pneumoniae CWL029
cuaacacaguccc

SEQ ID NO: 494038 - RNA, 13 nt, Chlamydophila pneumoniae CWL029
cuaacaacuucug

SEQ ID NO: 494039 - RNA, 16 nt, Chlamydophila pneumoniae CWL029
cuaacaacuucugaca

SEQ ID NO: 494040 - RNA, 20 nt, Chlamydophila pneumoniae CWL029
cuaacaacuucugacaauaa

SEQ ID NO: 494041 - RNA, 18 nt, Chlamydophila pneumoniae CWL029
cuaacaagauaaccugag

SEQ ID NO: 494042 - RNA, 23 nt, Chlamydophila pneumoniae CWL029
cuaaaccuucaaugauuucuuua

SEQ ID NO: 494043 - RNA, 22 nt, Chlamydophila pneumoniae CWL029
cuaaacccuguccaacuaaaac

SEQ ID NO: 494044 - RNA, 23 nt, Chlamydophila pneumoniae CWL029
cuaacgaagugaggagaauagca

SEQ ID NO: 494045 - RNA, 20 nt, Chlamydophila pneumoniae CWL029
cuaacgaugcaggccaggag

SEQ ID NO: 494046 - RNA, 15 nt, Chlamydophila pneumoniae CWL029
cuaacgcaacaucca

SEQ ID NO: 494047 - RNA, 17 nt, Chlamydophila pneumoniae CWL029
cuaacuguacacuuuca

SEQ ID NO: 494048 - RNA, 15 nt, Chlamydophila pneumoniae CWL029
cuaacuuaucgaaug

SEQ ID NO: 494049 - RNA, 20 nt, Chlamydophila pneumoniae CWL029
cuaagucuccauaauucugc

SEQ ID NO: 494050 - RNA, 21 nt, Chlamydophila pneumoniae CWL029
cuaagucuccauaauucugca

SEQ ID NO: 494051 - RNA, 18 nt, Chlamydophila pneumoniae CWL029
cuaaguccaacaucagcu

SEQ ID NO: 494052 - RNA, 18 nt, Chlamydophila pneumoniae CWL029
cuaagucguuaacaucaa

SEQ ID NO: 494053 - RNA, 13 nt, Chlamydophila pneumoniae CWL029
cuaaguaacaguc

SEQ ID NO: 494054 - RNA, 21 nt, Chlamydophila pneumoniae CWL029
cuaaguaacaguccucucccu

SEQ ID NO: 494055 - RNA, 18 nt, Chlamydophila pneumoniae CWL029
cuaagguagcuagcguuu

SEQ ID NO: 494056 - RNA, 19 nt, Chlamydophila pneumoniae CWL029
cuaaggugcuauuuuaaac

SEQ ID NO: 494057 - RNA, 20 nt, Chlamydophila pneumoniae CWL029
cuaaggugcuauuuuaaacu

SEQ ID NO: 494058 - RNA, 20 nt, Chlamydophila pneumoniae CWL029
cuaagcugugcauuuucuuc

SEQ ID NO: 494059 - RNA, 15 nt, Chlamydophila pneumoniae CWL029
cuaagcuuauuucug

SEQ ID NO: 494060 - RNA, 19 nt, Chlamydophila pneumoniae CWL029
cuaaggaaauuacaaucuc

SEQ ID NO: 494061 - RNA, 17 nt, Chlamydophila pneumoniae CWL029
cuaagauaucuuguaca

SEQ ID NO: 494062 - RNA, 17 nt, Chlamydophila pneumoniae CWL029
cuaagagcccuugaauc

SEQ ID NO: 494063 - RNA, 13 nt, Chlamydophila pneumoniae CWL029
cuaagacuagauc

SEQ ID NO: 494064 - RNA, 23 nt, Chlamydophila pneumoniae CWL029
cuaagacuagaucgucaagcucu

SEQ ID NO: 494065 - RNA, 18 nt, Chlamydophila pneumoniae CWL029
cuaagagcgucuucuuuu

SEQ ID NO: 494066 - RNA, 20 nt, Chlamydophila pneumoniae CWL029
cuaagaaaggcacuccaaaa

SEQ ID NO: 494067 - RNA, 18 nt, Chlamydophila pneumoniae CWL029
cuaagaagcucacucuuu

SEQ ID NO: 494068 - RNA, 21 nt, Chlamydophila pneumoniae CWL029
cuaagaagcucacucuuuaaa

SEQ ID NO: 494069 - RNA, 13 nt, Chlamydophila pneumoniae CWL029
cuaagaauaugga

SEQ ID NO: 494070 - RNA, 15 nt, Chlamydophila pneumoniae CWL029
cuaagaaucuauaaa

SEQ ID NO: 494071 - RNA, 20 nt, Chlamydophila pneumoniae CWL029
cuaagaaucuauaaauucaa

SEQ ID NO: 494072 - RNA, 13 nt, Chlamydophila pneumoniae CWL029
cuaagcaaaaacu

SEQ ID NO: 494073 - RNA, 14 nt, Chlamydophila pneumoniae CWL029
cuaagcaaaaacuu

SEQ ID NO: 494074 - RNA, 15 nt, Chlamydophila pneumoniae CWL029
cuaagaucuuuugua

SEQ ID NO: 494075 - RNA, 21 nt, Chlamydophila pneumoniae CWL029
cuaagaucuuuuguaaucguu

SEQ ID NO: 494076 - RNA, 17 nt, Chlamydophila pneumoniae CWL029
cuaagauuccuaacuuc

SEQ ID NO: 494077 - RNA, 17 nt, Chlamydophila pneumoniae CWL029
cuaagcagccucuucuc

SEQ ID NO: 494078 - RNA, 14 nt, Chlamydophila pneumoniae CWL029
cuaagcaucagaau

SEQ ID NO: 494079 - RNA, 13 nt, Chlamydophila pneumoniae CWL029
cuaagcauagccc

SEQ ID NO: 494080 - RNA, 16 nt, Chlamydophila pneumoniae CWL029
cuaagccaaauaccaa

SEQ ID NO: 494081 - RNA, 16 nt, Chlamydophila pneumoniae CWL029
cuaagcgcucuucaau

SEQ ID NO: 494082 - RNA, 17 nt, Chlamydophila pneumoniae CWL029
cuaaucucaggcauucu

SEQ ID NO: 494083 - RNA, 13 nt, Chlamydophila pneumoniae CWL029
cuaaucugauuca

SEQ ID NO: 494084 - RNA, 15 nt, Chlamydophila pneumoniae CWL029
cuaaucauuagaguu

SEQ ID NO: 494085 - RNA, 16 nt, Chlamydophila pneumoniae CWL029
cuaauaagauccaaaa

SEQ ID NO: 494086 - RNA, 18 nt, Chlamydophila pneumoniae CWL029
cuaauaagauccaaaaau

SEQ ID NO: 494087 - RNA, 16 nt, Chlamydophila pneumoniae CWL029
cuaauuccuucaaagc

SEQ ID NO: 494088 - RNA, 20 nt, Chlamydophila pneumoniae CWL029
cuaauguugaguagagaagg

SEQ ID NO: 494089 - RNA, 22 nt, Chlamydophila pneumoniae CWL029
cuacaaacagguaauacccuca

SEQ ID NO: 494090 - RNA, 16 nt, Chlamydophila pneumoniae CWL029
cuacaaauuaccuuga

SEQ ID NO: 494091 - RNA, 11 nt, Chlamydophila pneumoniae CWL029
cuacaacaguu

SEQ ID NO: 494092 - RNA, 18 nt, Chlamydophila pneumoniae CWL029
cuacaaggucuuuuccug

SEQ ID NO: 494093 - RNA, 22 nt, Chlamydophila pneumoniae CWL029
cuaauuuuaaauuuuguuuuuc

SEQ ID NO: 494094 - RNA, 21 nt, Chlamydophila pneumoniae CWL029
cuaauuucaggagcuccugcg

SEQ ID NO: 494095 - RNA, 12 nt, Chlamydophila pneumoniae CWL029
cuaauuuccuuc

SEQ ID NO: 494096 - RNA, 14 nt, Chlamydophila pneumoniae CWL029
cuaauuuuagaacu

SEQ ID NO: 494097 - RNA, 15 nt, Chlamydophila pneumoniae CWL029
cuaauuuuagaacuu

SEQ ID NO: 494098 - RNA, 12 nt, Chlamydophila pneumoniae CWL029
cgugcauaauga

SEQ ID NO: 494099 - RNA, 13 nt, Chlamydophila pneumoniae CWL029
cgugcaggagaac

SEQ ID NO: 494100 - RNA, 20 nt, Chlamydophila pneumoniae CWL029
cgugcaggagaacaauauca

SEQ ID NO: 494101 - RNA, 14 nt, Chlamydophila pneumoniae CWL029
cgugcucucuucuu

SEQ ID NO: 494102 - RNA, 21 nt, Chlamydophila pneumoniae CWL029
cgugcucccauuucuggagaa

SEQ ID NO: 494103 - RNA, 23 nt, Chlamydophila pneumoniae CWL029
cgugaauauguacugaugugaag

SEQ ID NO: 494104 - RNA, 19 nt, Chlamydophila pneumoniae CWL029
cgugagaggaucgugaagu

SEQ ID NO: 494105 - RNA, 15 nt, Chlamydophila pneumoniae CWL029
cgucuucucugcauc

SEQ ID NO: 494106 - RNA, 16 nt, Chlamydophila pneumoniae CWL029
cgucuuugcuuucuag

SEQ ID NO: 494107 - RNA, 17 nt, Chlamydophila pneumoniae CWL029
cgucuauuagauuuccu

SEQ ID NO: 494108 - RNA, 14 nt, Chlamydophila pneumoniae CWL029
cgucuccaacaguc

SEQ ID NO: 494109 - RNA, 18 nt, Chlamydophila pneumoniae CWL029
cgucuaagaaucguucuu

SEQ ID NO: 494110 - RNA, 22 nt, Chlamydophila pneumoniae CWL029
cgucuaaaauaaccccuccaaa

SEQ ID NO: 494111 - RNA, 24 nt, Chlamydophila pneumoniae CWL029
cgucuaaacgcgagcuauuuuacu

SEQ ID NO: 494112 - RNA, 16 nt, Chlamydophila pneumoniae CWL029
cgucgccccaugaauc

SEQ ID NO: 494113 - RNA, 17 nt, Chlamydophila pneumoniae CWL029
cgucgcuaaugcuaucc

SEQ ID NO: 494114 - RNA, 21 nt, Chlamydophila pneumoniae CWL029
cguauuucacaagcauaaacu

SEQ ID NO: 494115 - RNA, 23 nt, Chlamydophila pneumoniae CWL029
cgucaucgucgcgacugaaguca

SEQ ID NO: 494116 - RNA, 19 nt, Chlamydophila pneumoniae CWL029
cguagaggacgugcuccca

SEQ ID NO: 494117 - RNA, 18 nt, Chlamydophila pneumoniae CWL029
cguagcaggcaucacuaa

SEQ ID NO: 494118 - RNA, 15 nt, Chlamydophila pneumoniae CWL029
cguagguguuaaguu

SEQ ID NO: 494119 - RNA, 20 nt, Chlamydophila pneumoniae CWL029
cguaggguagccauccacga

SEQ ID NO: 494120 - RNA, 16 nt, Chlamydophila pneumoniae CWL029
cguaggguauccugcu

SEQ ID NO: 494121 - RNA, 19 nt, Chlamydophila pneumoniae CWL029
cguaggcauacaguagaaa

SEQ ID NO: 494122 - RNA, 14 nt, Chlamydophila pneumoniae CWL029
cguacuucacuucu

SEQ ID NO: 494123 - RNA, 12 nt, Chlamydophila pneumoniae CWL029
cguacucuucuu

SEQ ID NO: 494124 - RNA, 21 nt, Chlamydophila pneumoniae CWL029
cguacgagaucagauguaaag

SEQ ID NO: 494125 - RNA, 19 nt, Chlamydophila pneumoniae CWL029
cguaccagcugauauccuu

SEQ ID NO: 494126 - RNA, 14 nt, Chlamydophila pneumoniae CWL029
cguacaggacuguu

SEQ ID NO: 494127 - RNA, 23 nt, Chlamydophila pneumoniae CWL029
cguaaugcccgauauccucgaga

SEQ ID NO: 494128 - RNA, 17 nt, Chlamydophila pneumoniae CWL029
cguaaucuuuuuuaaag

SEQ ID NO: 494129 - RNA, 22 nt, Chlamydophila pneumoniae CWL029
cuucgaagcggagcaucuuuuc

SEQ ID NO: 494130 - RNA, 18 nt, Chlamydophila pneumoniae CWL029
cuucgaagcggagcaucu

SEQ ID NO: 494131 - RNA, 19 nt, Chlamydophila pneumoniae CWL029
cuucgaugucuuuccaggc

SEQ ID NO: 494132 - RNA, 18 nt, Chlamydophila pneumoniae CWL029
cuucgaugucuuuccagg

SEQ ID NO: 494133 - RNA, 14 nt, Chlamydophila pneumoniae CWL029
cuucgauuucuagu

SEQ ID NO: 494134 - RNA, 17 nt, Chlamydophila pneumoniae CWL029
cuucgcaaauauaguuu

SEQ ID NO: 494135 - RNA, 18 nt, Chlamydophila pneumoniae CWL029
cuuccucuucaauuucuu

SEQ ID NO: 494136 - RNA, 20 nt, Chlamydophila pneumoniae CWL029
cuuccugaaucagcuuaucu

SEQ ID NO: 494137 - RNA, 23 nt, Chlamydophila pneumoniae CWL029
cuuccucuucaauuucuucauca

SEQ ID NO: 494138 - RNA, 17 nt, Chlamydophila pneumoniae CWL029
cuuccuucuccuguaaa

SEQ ID NO: 494139 - RNA, 14 nt, Chlamydophila pneumoniae CWL029
cuuccuucuucuuc

SEQ ID NO: 494140 - RNA, 11 nt, Chlamydophila pneumoniae CWL029
cuuccuuguug

SEQ ID NO: 494141 - RNA, 20 nt, Chlamydophila pneumoniae CWL029
cuuccuuuuucugcuucucc

SEQ ID NO: 494142 - RNA, 16 nt, Chlamydophila pneumoniae CWL029
cuuccccaaacaugga

SEQ ID NO: 494143 - RNA, 15 nt, Chlamydophila pneumoniae CWL029
cuucccaucuuguuc

SEQ ID NO: 494144 - RNA, 16 nt, Chlamydophila pneumoniae CWL029
cuucccaucuuguucu

SEQ ID NO: 494145 - RNA, 20 nt, Chlamydophila pneumoniae CWL029
cuuccaucucuuuaaauguu

SEQ ID NO: 494146 - RNA, 21 nt, Chlamydophila pneumoniae CWL029
cuuccauagcuuuagaagccc

SEQ ID NO: 494147 - RNA, 11 nt, Chlamydophila pneumoniae CWL029
cuuccauacag

SEQ ID NO: 494148 - RNA, 16 nt, Chlamydophila pneumoniae CWL029
cuuccaacuucuguau

SEQ ID NO: 494149 - RNA, 18 nt, Chlamydophila pneumoniae CWL029
cuuccaacuucuguaucg

SEQ ID NO: 494150 - RNA, 23 nt, Chlamydophila pneumoniae CWL029
cuuccacaauguuuagaauuugu

SEQ ID NO: 494151 - RNA, 13 nt, Chlamydophila pneumoniae CWL029
cuucaauuucuuc

SEQ ID NO: 494152 - RNA, 15 nt, Chlamydophila pneumoniae CWL029
cuucacaaagaacca

SEQ ID NO: 494153 - RNA, 17 nt, Chlamydophila pneumoniae CWL029
cuucacaucuuucucua

SEQ ID NO: 494154 - RNA, 18 nt, Chlamydophila pneumoniae CWL029
cuucacgacauacaucaa

SEQ ID NO: 494155 - RNA, 22 nt, Chlamydophila pneumoniae CWL029
cuucacucuuuuauuuuaggaa

SEQ ID NO: 494156 - RNA, 14 nt, Chlamydophila pneumoniae CWL029
cuucacucuuucug

SEQ ID NO: 494157 - RNA, 18 nt, Chlamydophila pneumoniae CWL029
cuucacuuauaagcugcu

SEQ ID NO: 494158 - RNA, 22 nt, Chlamydophila pneumoniae CWL029
cuucaauacgcuagcucuuaaa

SEQ ID NO: 494159 - RNA, 19 nt, Chlamydophila pneumoniae CWL029
cuucaaguuucuuuugcaa

SEQ ID NO: 494160 - RNA, 16 nt, Chlamydophila pneumoniae CWL029
cuucaagguacuuuau

SEQ ID NO: 494161 - RNA, 18 nt, Chlamydophila pneumoniae CWL029
cuucaagucgagaaacaa

SEQ ID NO: 494162 - RNA, 21 nt, Chlamydophila pneumoniae CWL029
cuucaagucgagaaacaaaau

SEQ ID NO: 494163 - RNA, 20 nt, Chlamydophila pneumoniae CWL029
cuucaaagauauagauucau

SEQ ID NO: 494164 - RNA, 15 nt, Chlamydophila pneumoniae CWL029
cuuauugcagaaucu

SEQ ID NO: 494165 - RNA, 18 nt, Chlamydophila pneumoniae CWL029
cuucaaagucaaauacuu

SEQ ID NO: 494166 - RNA, 20 nt, Chlamydophila pneumoniae CWL029
cuucaaaggcaaccucugca

SEQ ID NO: 494167 - RNA, 17 nt, Chlamydophila pneumoniae CWL029
cuuauugaagucuucuu

SEQ ID NO: 494168 - RNA, 18 nt, Chlamydophila pneumoniae CWL029
cuuauugaagucuucuug

SEQ ID NO: 494169 - RNA, 16 nt, Chlamydophila pneumoniae CWL029
cuucagaaucuuugug

SEQ ID NO: 494170 - RNA, 16 nt, Chlamydophila pneumoniae CWL029
cuucagaauucucaag

SEQ ID NO: 494171 - RNA, 11 nt, Chlamydophila pneumoniae CWL029
cuucagagaga

SEQ ID NO: 494172 - RNA, 16 nt, Chlamydophila pneumoniae CWL029
cuucagagagaacagg

SEQ ID NO: 494173 - RNA, 18 nt, Chlamydophila pneumoniae CWL029
cuucagagagaacaggag

SEQ ID NO: 494174 - RNA, 21 nt, Chlamydophila pneumoniae CWL029
cuucauauaaaacgaucccua

SEQ ID NO: 494175 - RNA, 19 nt, Chlamydophila pneumoniae CWL029
cuuccaaaacgauccuguu

SEQ ID NO: 494176 - RNA, 17 nt, Chlamydophila pneumoniae CWL029
cuucaugcugcuuugac

SEQ ID NO: 494177 - RNA, 18 nt, Chlamydophila pneumoniae CWL029
cuucaucuucuaaauccc

SEQ ID NO: 494178 - RNA, 15 nt, Chlamydophila pneumoniae CWL029
cuucauaugcucucc

SEQ ID NO: 494179 - RNA, 17 nt, Chlamydophila pneumoniae CWL029
cuucauaugcucucccg

SEQ ID NO: 494180 - RNA, 13 nt, Chlamydophila pneumoniae CWL029
cuuaauuuccuuc

SEQ ID NO: 494181 - RNA, 17 nt, Chlamydophila pneumoniae CWL029
cuuaauaauguuuuaau

SEQ ID NO: 494182 - RNA, 20 nt, Chlamydophila pneumoniae CWL029
cuuaagaauaaaauaggaaa

SEQ ID NO: 494183 - RNA, 22 nt, Chlamydophila pneumoniae CWL029
cuuaagaauaaaauaggaaagu

SEQ ID NO: 494184 - RNA, 15 nt, Chlamydophila pneumoniae CWL029
cuuaagauacuucuc

SEQ ID NO: 494185 - RNA, 17 nt, Chlamydophila pneumoniae CWL029
cuuaagcucuaagucca

SEQ ID NO: 494186 - RNA, 22 nt, Chlamydophila pneumoniae CWL029
cuuaacuuuaggcccugacuua

SEQ ID NO: 494187 - RNA, 21 nt, Chlamydophila pneumoniae CWL029
cuuacagccaccuuggcuucu

SEQ ID NO: 494188 - RNA, 14 nt, Chlamydophila pneumoniae CWL029
cuuacagagaaauu

SEQ ID NO: 494189 - RNA, 19 nt, Chlamydophila pneumoniae CWL029
cuuacggccccuggaauuu

SEQ ID NO: 494190 - RNA, 23 nt, Chlamydophila pneumoniae CWL029
cuuacggccccuggaauuucucc

SEQ ID NO: 494191 - RNA, 16 nt, Chlamydophila pneumoniae CWL029
cuuacuaaagaaagag

SEQ ID NO: 494192 - RNA, 21 nt, Chlamydophila pneumoniae CWL029
cuuacuaaaggugaaaguaca

SEQ ID NO: 494193 - RNA, 17 nt, Chlamydophila pneumoniae CWL029
cuuauaacuauugggaa

SEQ ID NO: 494194 - RNA, 14 nt, Chlamydophila pneumoniae CWL029
cuuauaagcugcuu

SEQ ID NO: 494195 - RNA, 19 nt, Chlamydophila pneumoniae CWL029
cuuauacacuccaauaaga

SEQ ID NO: 494196 - RNA, 20 nt, Chlamydophila pneumoniae CWL029
cuuauacccacaaagaucac

SEQ ID NO: 494197 - RNA, 12 nt, Chlamydophila pneumoniae CWL029
cuuauaaaaaag

SEQ ID NO: 494198 - RNA, 21 nt, Chlamydophila pneumoniae CWL029
cuuaguccgguuucuucuacc

SEQ ID NO: 494199 - RNA, 14 nt, Chlamydophila pneumoniae CWL029
cuuagaauccaaag

SEQ ID NO: 494200 - RNA, 18 nt, Chlamydophila pneumoniae CWL029
cuuagaauccaaagacuu

SEQ ID NO: 494201 - RNA, 18 nt, Chlamydophila pneumoniae CWL029
cuuagaaucuaagauccu

SEQ ID NO: 494202 - RNA, 17 nt, Chlamydophila pneumoniae CWL029
cuuauuauugaauaagc

SEQ ID NO: 494203 - RNA, 14 nt, Chlamydophila pneumoniae CWL029
cuuaucuuuaaauu

SEQ ID NO: 494204 - RNA, 22 nt, Chlamydophila pneumoniae CWL029
cuuaucuugcugcccaaauuga

SEQ ID NO: 494205 - RNA, 19 nt, Chlamydophila pneumoniae CWL029
cuuaucuauagcauuguuu

SEQ ID NO: 494206 - RNA, 18 nt, Chlamydophila pneumoniae CWL029
cuuaucaugaaaaggauu

SEQ ID NO: 494207 - RNA, 17 nt, Chlamydophila pneumoniae CWL029
cuuaucuaaagaaaugu

SEQ ID NO: 494208 - RNA, 13 nt, Chlamydophila pneumoniae CWL029
cuuaucaggaaau

SEQ ID NO: 494209 - RNA, 16 nt, Chlamydophila pneumoniae CWL029
cuuaacuggcaaucua

SEQ ID NO: 494210 - RNA, 22 nt, Chlamydophila pneumoniae CWL029
cuuaacuggcaaucuaaaauca

SEQ ID NO: 494211 - RNA, 16 nt, Chlamydophila pneumoniae CWL029
aaacuguguuuucuag

SEQ ID NO: 494212 - RNA, 22 nt, Chlamydophila pneumoniae CWL029
aaacuguuaacaagauucucag

SEQ ID NO: 494213 - RNA, 23 nt, Chlamydophila pneumoniae CWL029
aaacuguuaacaagauucucagc

SEQ ID NO: 494214 - RNA, 20 nt, Chlamydophila pneumoniae CWL029
cuuaacaacaucacuuauau

SEQ ID NO: 494215 - RNA, 15 nt, Chlamydophila pneumoniae CWL029
cuguuuucuuuucug

SEQ ID NO: 494216 - RNA, 14 nt, Chlamydophila pneumoniae CWL029
cuguuuuggaaaga

SEQ ID NO: 494217 - RNA, 19 nt, Chlamydophila pneumoniae CWL029
cuuaaaagagaacauguuu

SEQ ID NO: 494218 - RNA, 17 nt, Chlamydophila pneumoniae CWL029
cuguuggucucuauuua

SEQ ID NO: 494219 - RNA, 18 nt, Chlamydophila pneumoniae CWL029
cuguuguaauaaaagaaa

SEQ ID NO: 494220 - RNA, 20 nt, Chlamydophila pneumoniae CWL029
cuguuguaauaaaagaaaga

SEQ ID NO: 494221 - RNA, 13 nt, Chlamydophila pneumoniae CWL029
cuguuuguuuauu

SEQ ID NO: 494222 - RNA, 14 nt, Chlamydophila pneumoniae CWL029
cuguugaucuucua

SEQ ID NO: 494223 - RNA, 16 nt, Chlamydophila pneumoniae CWL029
cuguucuucuucaguc

SEQ ID NO: 494224 - RNA, 16 nt, Chlamydophila pneumoniae CWL029
cuguguuuuauccacc

SEQ ID NO: 494225 - RNA, 14 nt, Chlamydophila pneumoniae CWL029
cuguguuuucuagu

SEQ ID NO: 494226 - RNA, 15 nt, Chlamydophila pneumoniae CWL029
cuguguuuucuaguc

SEQ ID NO: 494227 - RNA, 14 nt, Chlamydophila pneumoniae CWL029
cuguuaacaagauu

SEQ ID NO: 494228 - RNA, 15 nt, Chlamydophila pneumoniae CWL029
cugugguuuuuauuc

SEQ ID NO: 494229 - RNA, 13 nt, Chlamydophila pneumoniae CWL029
cuguguaugaauc

SEQ ID NO: 494230 - RNA, 14 nt, Chlamydophila pneumoniae CWL029
cugugguauacauc

SEQ ID NO: 494231 - RNA, 16 nt, Chlamydophila pneumoniae CWL029
cugugguuccuggauu

SEQ ID NO: 494232 - RNA, 14 nt, Chlamydophila pneumoniae CWL029
cugugguuccugga

SEQ ID NO: 494233 - RNA, 21 nt, Chlamydophila pneumoniae CWL029
cuguguaaaaguuagguagau

SEQ ID NO: 494234 - RNA, 14 nt, Chlamydophila pneumoniae CWL029
cuguggaauuuucc

SEQ ID NO: 494235 - RNA, 16 nt, Chlamydophila pneumoniae CWL029
cugugcuccauagcau

SEQ ID NO: 494236 - RNA, 12 nt, Chlamydophila pneumoniae CWL029
cugugcauuuuc

SEQ ID NO: 494237 - RNA, 13 nt, Chlamydophila pneumoniae CWL029
cugugcauuuucu

SEQ ID NO: 494238 - RNA, 20 nt, Chlamydophila pneumoniae CWL029
cugugcauuuucuucuugca

SEQ ID NO: 494239 - RNA, 21 nt, Chlamydophila pneumoniae CWL029
cugugauagguagcagcccgc

SEQ ID NO: 494240 - RNA, 16 nt, Chlamydophila pneumoniae CWL029
cugugaggaaaauucc

SEQ ID NO: 494241 - RNA, 17 nt, Chlamydophila pneumoniae CWL029
cugucuuaucuaaagaa

SEQ ID NO: 494242 - RNA, 18 nt, Chlamydophila pneumoniae CWL029
cugucuagaacacucaga

SEQ ID NO: 494243 - RNA, 17 nt, Chlamydophila pneumoniae CWL029
cuguccuugcagcccug

SEQ ID NO: 494244 - RNA, 14 nt, Chlamydophila pneumoniae CWL029
cuguccuccgagaa

SEQ ID NO: 494245 - RNA, 15 nt, Chlamydophila pneumoniae CWL029
cuguccuccgagaaa

SEQ ID NO: 494246 - RNA, 14 nt, Chlamydophila pneumoniae CWL029
cuguagccuuugau

SEQ ID NO: 494247 - RNA, 13 nt, Chlamydophila pneumoniae CWL029
cuguagauuuucc

SEQ ID NO: 494248 - RNA, 22 nt, Chlamydophila pneumoniae CWL029
cuguagaaacauuuaagucauu

SEQ ID NO: 494249 - RNA, 13 nt, Chlamydophila pneumoniae CWL029
cuguacgguaaau

SEQ ID NO: 494250 - RNA, 14 nt, Chlamydophila pneumoniae CWL029
cuguacuuccccaa

SEQ ID NO: 494251 - RNA, 20 nt, Chlamydophila pneumoniae CWL029
cuguaguuagcauugcuugc

SEQ ID NO: 494252 - RNA, 19 nt, Chlamydophila pneumoniae CWL029
cuguaguuagcauugcuug

SEQ ID NO: 494253 - RNA, 18 nt, Chlamydophila pneumoniae CWL029
aaacucucuuccuucucc

SEQ ID NO: 494254 - RNA, 19 nt, Chlamydophila pneumoniae CWL029
cuguaucgacuguacaaau

SEQ ID NO: 494255 - RNA, 21 nt, Chlamydophila pneumoniae CWL029
cuguaucgauaacgauuucuu

SEQ ID NO: 494256 - RNA, 21 nt, Chlamydophila pneumoniae CWL029
cuguaucgauaguuuuugcug

SEQ ID NO: 494257 - RNA, 21 nt, Chlamydophila pneumoniae CWL029
cuguccaacuaaaacagccua

SEQ ID NO: 494258 - RNA, 20 nt, Chlamydophila pneumoniae CWL029
cugucauguauccgaaaucu

SEQ ID NO: 494259 - RNA, 21 nt, Chlamydophila pneumoniae CWL029
cugucauuaaaaauuuaaaag

SEQ ID NO: 494260 - RNA, 15 nt, Chlamydophila pneumoniae CWL029
aaacucuuugaggau

SEQ ID NO: 494261 - RNA, 22 nt, Chlamydophila pneumoniae CWL029
aaacugauuaguuuguuuuaau

SEQ ID NO: 494262 - RNA, 19 nt, Chlamydophila pneumoniae CWL029
cugucaauccaacaaagau

SEQ ID NO: 494263 - RNA, 15 nt, Chlamydophila pneumoniae CWL029
cugucagaacaagaa

SEQ ID NO: 494264 - RNA, 17 nt, Chlamydophila pneumoniae CWL029
cugucacuaucuucuaa

SEQ ID NO: 494265 - RNA, 16 nt, Chlamydophila pneumoniae CWL029
cugucacuaucuucua

SEQ ID NO: 494266 - RNA, 15 nt, Chlamydophila pneumoniae CWL029
cugucacuaucuucu

SEQ ID NO: 494267 - RNA, 16 nt, Chlamydophila pneumoniae CWL029
cuguaccacauacucu

SEQ ID NO: 494268 - RNA, 21 nt, Chlamydophila pneumoniae CWL029
cuguaccacauacucuucauc

SEQ ID NO: 494269 - RNA, 23 nt, Chlamydophila pneumoniae CWL029
cuguaauuuuuuucaaaggagaa

SEQ ID NO: 494270 - RNA, 13 nt, Chlamydophila pneumoniae CWL029
cuguacagaacaa

SEQ ID NO: 494271 - RNA, 19 nt, Chlamydophila pneumoniae CWL029
cuguaaccaacaucaaaga

SEQ ID NO: 494272 - RNA, 15 nt, Chlamydophila pneumoniae CWL029
cuguaacacuuccua

SEQ ID NO: 494273 - RNA, 17 nt, Chlamydophila pneumoniae CWL029
cuguaagaauccuugcu

SEQ ID NO: 494274 - RNA, 15 nt, Chlamydophila pneumoniae CWL029
cuguaaagaccaaau

SEQ ID NO: 494275 - RNA, 13 nt, Chlamydophila pneumoniae CWL029
cuguaaagauucu

SEQ ID NO: 494276 - RNA, 16 nt, Chlamydophila pneumoniae CWL029
cuguaaauuucauuug

SEQ ID NO: 494277 - RNA, 16 nt, Chlamydophila pneumoniae CWL029
cugguuccuuaaagag

SEQ ID NO: 494278 - RNA, 18 nt, Chlamydophila pneumoniae CWL029
cugguccuaaaaaaagac

SEQ ID NO: 494279 - RNA, 16 nt, Chlamydophila pneumoniae CWL029
cuggucuccagaagca

SEQ ID NO: 494280 - RNA, 19 nt, Chlamydophila pneumoniae CWL029
cuggucuguauuuucuuca

SEQ ID NO: 494281 - RNA, 21 nt, Chlamydophila pneumoniae CWL029
cuggguaaguccacaagccuc

SEQ ID NO: 494282 - RNA, 16 nt, Chlamydophila pneumoniae CWL029
cugggcgucuucuucg

SEQ ID NO: 494283 - RNA, 22 nt, Chlamydophila pneumoniae CWL029
cugggggacuucaaaugaaauu

SEQ ID NO: 494284 - RNA, 23 nt, Chlamydophila pneumoniae CWL029
cugggcauaguggcucaguguau

SEQ ID NO: 494285 - RNA, 14 nt, Chlamydophila pneumoniae CWL029
cugggauucguaau

SEQ ID NO: 494286 - RNA, 14 nt, Chlamydophila pneumoniae CWL029
cugggaauucuuuu

SEQ ID NO: 494287 - RNA, 20 nt, Chlamydophila pneumoniae CWL029
cugggaauucuuuuccugca

SEQ ID NO: 494288 - RNA, 21 nt, Chlamydophila pneumoniae CWL029
cugggaauuguucuugaaguu

SEQ ID NO: 494289 - RNA, 15 nt, Chlamydophila pneumoniae CWL029
cugggaaaucuaaac

SEQ ID NO: 494290 - RNA, 23 nt, Chlamydophila pneumoniae CWL029
cugggaagaccacgaaauguuaa

SEQ ID NO: 494291 - RNA, 17 nt, Chlamydophila pneumoniae CWL029
cugggaagaccacgaaa

SEQ ID NO: 494292 - RNA, 14 nt, Chlamydophila pneumoniae CWL029
aaacuccauuguug

SEQ ID NO: 494293 - RNA, 18 nt, Chlamydophila pneumoniae CWL029
aaacuccuaggggaauua

SEQ ID NO: 494294 - RNA, 16 nt, Chlamydophila pneumoniae CWL029
aaacuccuuuuaaaau

SEQ ID NO: 494295 - RNA, 20 nt, Chlamydophila pneumoniae CWL029
aaacuccaaguguugccagc

SEQ ID NO: 494296 - RNA, 18 nt, Chlamydophila pneumoniae CWL029
cuggcuccuaaacucaau

SEQ ID NO: 494297 - RNA, 20 nt, Chlamydophila pneumoniae CWL029
cuggcuaaaggaucauuaaa

SEQ ID NO: 494298 - RNA, 18 nt, Chlamydophila pneumoniae CWL029
cuggauugauccacagau

SEQ ID NO: 494299 - RNA, 17 nt, Chlamydophila pneumoniae CWL029
cuggauacguuuuuccc

SEQ ID NO: 494300 - RNA, 24 nt, Chlamydophila pneumoniae CWL029
cuggaggcgguggcaugccauaau

SEQ ID NO: 494301 - RNA, 17 nt, Chlamydophila pneumoniae CWL029
cuggaggcuguguaaaa

SEQ ID NO: 494302 - RNA, 21 nt, Chlamydophila pneumoniae CWL029
cuggagacaacuauguuaucc

SEQ ID NO: 494303 - RNA, 21 nt, Chlamydophila pneumoniae CWL029
cuggagaaugccccuucguua

SEQ ID NO: 494304 - RNA, 15 nt, Chlamydophila pneumoniae CWL029
cuggaaugacuaaau

SEQ ID NO: 494305 - RNA, 12 nt, Chlamydophila pneumoniae CWL029
cugcuucuccaa

SEQ ID NO: 494306 - RNA, 15 nt, Chlamydophila pneumoniae CWL029
cugcuugugaggcua

SEQ ID NO: 494307 - RNA, 22 nt, Chlamydophila pneumoniae CWL029
cugcuugugaggcuauagcaua

SEQ ID NO: 494308 - RNA, 15 nt, Chlamydophila pneumoniae CWL029
cugcuugucuacaga

SEQ ID NO: 494309 - RNA, 18 nt, Chlamydophila pneumoniae CWL029
cuggaagaauuucauaag

SEQ ID NO: 494310 - RNA, 15 nt, Chlamydophila pneumoniae CWL029
cugcuucgaccauaa

SEQ ID NO: 494311 - RNA, 15 nt, Chlamydophila pneumoniae CWL029
cugcugauccaaaag

SEQ ID NO: 494312 - RNA, 23 nt, Chlamydophila pneumoniae CWL029
cugcugaggagaguaaggucauu

SEQ ID NO: 494313 - RNA, 15 nt, Chlamydophila pneumoniae CWL029
cugcugagcagcaaa

SEQ ID NO: 494314 - RNA, 20 nt, Chlamydophila pneumoniae CWL029
cugcugaggagaguaagguc

SEQ ID NO: 494315 - RNA, 14 nt, Chlamydophila pneumoniae CWL029
aaacuauacucucu

SEQ ID NO: 494316 - RNA, 14 nt, Chlamydophila pneumoniae CWL029
cugcuccaaaaugg

SEQ ID NO: 494317 - RNA, 13 nt, Chlamydophila pneumoniae CWL029
cugcuaccugugu

SEQ ID NO: 494318 - RNA, 23 nt, Chlamydophila pneumoniae CWL029
cugcuagagcuuucagaaaagaa

SEQ ID NO: 494319 - RNA, 16 nt, Chlamydophila pneumoniae CWL029
cugcgguagccuggag

SEQ ID NO: 494320 - RNA, 21 nt, Chlamydophila pneumoniae CWL029
cugcggccacauuaagcaauc

SEQ ID NO: 494321 - RNA, 15 nt, Chlamydophila pneumoniae CWL029
cugcggaaggcuaaa

SEQ ID NO: 494322 - RNA, 14 nt, Chlamydophila pneumoniae CWL029
cugcccuucggacu

SEQ ID NO: 494323 - RNA, 16 nt, Chlamydophila pneumoniae CWL029
cugcccgucuuagaau

SEQ ID NO: 494324 - RNA, 16 nt, Chlamydophila pneumoniae CWL029
cugcccccuguuugaa

SEQ ID NO: 494325 - RNA, 16 nt, Chlamydophila pneumoniae CWL029
cugcagcguuucuagg

SEQ ID NO: 494326 - RNA, 14 nt, Chlamydophila pneumoniae CWL029
cugcauauaaagac

SEQ ID NO: 494327 - RNA, 16 nt, Chlamydophila pneumoniae CWL029
cugcacuuucuuuuuu

SEQ ID NO: 494328 - RNA, 23 nt, Chlamydophila pneumoniae CWL029
cugcagcagccuuggcucuagaa

SEQ ID NO: 494329 - RNA, 20 nt, Chlamydophila pneumoniae CWL029
cugcacguggcuuuuguauu

SEQ ID NO: 494330 - RNA, 20 nt, Chlamydophila pneumoniae CWL029
cugcacgaucgcgauaagaa

SEQ ID NO: 494331 - RNA, 14 nt, Chlamydophila pneumoniae CWL029
cugcacaguucaca

SEQ ID NO: 494332 - RNA, 22 nt, Chlamydophila pneumoniae CWL029
cugauguugcccuacaauuucc

SEQ ID NO: 494333 - RNA, 20 nt, Chlamydophila pneumoniae CWL029
cugauuauuucuaaaaaaua

SEQ ID NO: 494334 - RNA, 14 nt, Chlamydophila pneumoniae CWL029
cugauucaauugag

SEQ ID NO: 494335 - RNA, 23 nt, Chlamydophila pneumoniae CWL029
cugauuccauccugucuauuucu

SEQ ID NO: 494336 - RNA, 16 nt, Chlamydophila pneumoniae CWL029
cugauuucuuuuucag

SEQ ID NO: 494337 - RNA, 22 nt, Chlamydophila pneumoniae CWL029
cugaugcugaggacgcagagau

SEQ ID NO: 494338 - RNA, 16 nt, Chlamydophila pneumoniae CWL029
cugaugaaaaagcuga

SEQ ID NO: 494339 - RNA, 14 nt, Chlamydophila pneumoniae CWL029
cugaugaccucauc

SEQ ID NO: 494340 - RNA, 16 nt, Chlamydophila pneumoniae CWL029
cugaugaccucaucuc

SEQ ID NO: 494341 - RNA, 17 nt, Chlamydophila pneumoniae CWL029
cugaugaccucaucucg

SEQ ID NO: 494342 - RNA, 15 nt, Chlamydophila pneumoniae CWL029
cugaugaccucaucu

SEQ ID NO: 494343 - RNA, 17 nt, Chlamydophila pneumoniae CWL029
cugaguauuuugcaaau

SEQ ID NO: 494344 - RNA, 21 nt, Chlamydophila pneumoniae CWL029
cugaguauuuugcaaaugaaa

SEQ ID NO: 494345 - RNA, 13 nt, Chlamydophila pneumoniae CWL029
cugauaaaauaaa

SEQ ID NO: 494346 - RNA, 21 nt, Chlamydophila pneumoniae CWL029
cugagguuauuuaauccaaaa

SEQ ID NO: 494347 - RNA, 21 nt, Chlamydophila pneumoniae CWL029
cugauagccuccauuuagaca

SEQ ID NO: 494348 - RNA, 12 nt, Chlamydophila pneumoniae CWL029
cugaggaaaucg

SEQ ID NO: 494349 - RNA, 14 nt, Chlamydophila pneumoniae CWL029
cugagcuaucuuca

SEQ ID NO: 494350 - RNA, 15 nt, Chlamydophila pneumoniae CWL029
cugaggacgcagaga

SEQ ID NO: 494351 - RNA, 19 nt, Chlamydophila pneumoniae CWL029
cugacuugcaagcuucuug

SEQ ID NO: 494352 - RNA, 18 nt, Chlamydophila pneumoniae CWL029
cugacgucuccaacaguc

SEQ ID NO: 494353 - RNA, 16 nt, Chlamydophila pneumoniae CWL029
cugacgugcauugaau

SEQ ID NO: 494354 - RNA, 23 nt, Chlamydophila pneumoniae CWL029
cugacgugcauugaauccuucua

SEQ ID NO: 494355 - RNA, 19 nt, Chlamydophila pneumoniae CWL029
cugacagcuccauuuaaau

SEQ ID NO: 494356 - RNA, 20 nt, Chlamydophila pneumoniae CWL029
cucuagcaccuaauaaagaa

SEQ ID NO: 494357 - RNA, 22 nt, Chlamydophila pneumoniae CWL029
cucuagaggagcgaugacuugg

SEQ ID NO: 494358 - RNA, 19 nt, Chlamydophila pneumoniae CWL029
cucuagaaaacgcucuccu

SEQ ID NO: 494359 - RNA, 22 nt, Chlamydophila pneumoniae CWL029
cucuagaaauauacucuugcuu

SEQ ID NO: 494360 - RNA, 15 nt, Chlamydophila pneumoniae CWL029
cucuaccaucaugaa

SEQ ID NO: 494361 - RNA, 18 nt, Chlamydophila pneumoniae CWL029
cucuacuaaaaucucauu

SEQ ID NO: 494362 - RNA, 20 nt, Chlamydophila pneumoniae CWL029
cucuacuaaaaucucauuuc

SEQ ID NO: 494363 - RNA, 12 nt, Chlamydophila pneumoniae CWL029
cucuacucuaca

SEQ ID NO: 494364 - RNA, 14 nt, Chlamydophila pneumoniae CWL029
cucuacucuacagu

SEQ ID NO: 494365 - RNA, 24 nt, Chlamydophila pneumoniae CWL029
cucuacaguaguaaauaauaaccu

SEQ ID NO: 494366 - RNA, 16 nt, Chlamydophila pneumoniae CWL029
cucuaccccacgcuaa

SEQ ID NO: 494367 - RNA, 16 nt, Chlamydophila pneumoniae CWL029
cucuaccaacugagcu

SEQ ID NO: 494368 - RNA, 20 nt, Chlamydophila pneumoniae CWL029
cugaagucagugcuucuugg

SEQ ID NO: 494369 - RNA, 23 nt, Chlamydophila pneumoniae CWL029
cugaauagcucuuuucaugauaa

SEQ ID NO: 494370 - RNA, 15 nt, Chlamydophila pneumoniae CWL029
cugaauagcucuuuu

SEQ ID NO: 494371 - RNA, 15 nt, Chlamydophila pneumoniae CWL029
cugaauguaacucca

SEQ ID NO: 494372 - RNA, 19 nt, Chlamydophila pneumoniae CWL029
cugaauguaacuccagagc

SEQ ID NO: 494373 - RNA, 23 nt, Chlamydophila pneumoniae CWL029
cugaauaugcuuuucaaauauug

SEQ ID NO: 494374 - RNA, 14 nt, Chlamydophila pneumoniae CWL029
cugaaucuuuuguu

SEQ ID NO: 494375 - RNA, 11 nt, Chlamydophila pneumoniae CWL029
gacaaaaaugc

SEQ ID NO: 494376 - RNA, 13 nt, Chlamydophila pneumoniae CWL029
gacaaaaaugccu

SEQ ID NO: 494377 - RNA, 21 nt, Chlamydophila pneumoniae CWL029
gacaaaaaagggaucuccuuc

SEQ ID NO: 494378 - RNA, 22 nt, Chlamydophila pneumoniae CWL029
gacaaaaaagggaucuccuuca

SEQ ID NO: 494379 - RNA, 20 nt, Chlamydophila pneumoniae CWL029
gaauuuuucuaguucguuca

SEQ ID NO: 494380 - RNA, 13 nt, Chlamydophila pneumoniae CWL029
gaauuuuuguuuu

SEQ ID NO: 494381 - RNA, 23 nt, Chlamydophila pneumoniae CWL029
gaauuguuuuguuuguuuucuau

SEQ ID NO: 494382 - RNA, 23 nt, Chlamydophila pneumoniae CWL029
gaauugcuugcgcaucagcagcu

SEQ ID NO: 494383 - RNA, 15 nt, Chlamydophila pneumoniae CWL029
gaauuggaagcuuuu

SEQ ID NO: 494384 - RNA, 18 nt, Chlamydophila pneumoniae CWL029
gaauuguaguucuuugaa

SEQ ID NO: 494385 - RNA, 15 nt, Chlamydophila pneumoniae CWL029
gaauugucaucucau

SEQ ID NO: 494386 - RNA, 18 nt, Chlamydophila pneumoniae CWL029
gaauuaaacuuucuucuc

SEQ ID NO: 494387 - RNA, 20 nt, Chlamydophila pneumoniae CWL029
gaauuaaacuuucuucucua

SEQ ID NO: 494388 - RNA, 16 nt, Chlamydophila pneumoniae CWL029
gacaauaaaaaagaga

SEQ ID NO: 494389 - RNA, 18 nt, Chlamydophila pneumoniae CWL029
gacaauaagaaaauccua

SEQ ID NO: 494390 - RNA, 21 nt, Chlamydophila pneumoniae CWL029
gacacaaaaagcuuuuuucuc

SEQ ID NO: 494391 - RNA, 23 nt, Chlamydophila pneumoniae CWL029
gacacaaaaagcuuuuuucucuu

SEQ ID NO: 494392 - RNA, 20 nt, Chlamydophila pneumoniae CWL029
gacaagguggguagccagga

SEQ ID NO: 494393 - RNA, 22 nt, Chlamydophila pneumoniae CWL029
gacaaggagucgugcaggagaa

SEQ ID NO: 494394 - RNA, 13 nt, Chlamydophila pneumoniae CWL029
gaauguucccaaa

SEQ ID NO: 494395 - RNA, 17 nt, Chlamydophila pneumoniae CWL029
gaaugccugccaaucca

SEQ ID NO: 494396 - RNA, 21 nt, Chlamydophila pneumoniae CWL029
gaaugagcuucacaucuuucu

SEQ ID NO: 494397 - RNA, 14 nt, Chlamydophila pneumoniae CWL029
gaauccuucucccu

SEQ ID NO: 494398 - RNA, 16 nt, Chlamydophila pneumoniae CWL029
gaauccuugaaagacu

SEQ ID NO: 494399 - RNA, 16 nt, Chlamydophila pneumoniae CWL029
gaaucgaagaacagag

SEQ ID NO: 494400 - RNA, 20 nt, Chlamydophila pneumoniae CWL029
gaaucugguuccuuaaagag

SEQ ID NO: 494401 - RNA, 23 nt, Chlamydophila pneumoniae CWL029
gaaucgccgcuugaggaggauug

SEQ ID NO: 494402 - RNA, 13 nt, Chlamydophila pneumoniae CWL029
gaaucuuuuucau

SEQ ID NO: 494403 - RNA, 14 nt, Chlamydophila pneumoniae CWL029
gaaucuuuauuucu

SEQ ID NO: 494404 - RNA, 19 nt, Chlamydophila pneumoniae CWL029
gaaucuuuucuagaaaacg

SEQ ID NO: 494405 - RNA, 19 nt, Chlamydophila pneumoniae CWL029
gaaugaaucgaagaacaga

SEQ ID NO: 494406 - RNA, 13 nt, Chlamydophila pneumoniae CWL029
aaagauucuaaau

SEQ ID NO: 494407 - RNA, 15 nt, Chlamydophila pneumoniae CWL029
aaagauucuaaauca

SEQ ID NO: 494408 - RNA, 17 nt, Chlamydophila pneumoniae CWL029
aaagauucuaaaucaac

SEQ ID NO: 494409 - RNA, 19 nt, Chlamydophila pneumoniae CWL029
aaagauucuaaaucaacua

SEQ ID NO: 494410 - RNA, 21 nt, Chlamydophila pneumoniae CWL029
gaauagaaagacauccuucuu

SEQ ID NO: 494411 - RNA, 12 nt, Chlamydophila pneumoniae CWL029
gaauagcaggaa

SEQ ID NO: 494412 - RNA, 11 nt, Chlamydophila pneumoniae CWL029
aaagauuaagg

SEQ ID NO: 494413 - RNA, 16 nt, Chlamydophila pneumoniae CWL029
gaauccaaaaaagagc

SEQ ID NO: 494414 - RNA, 14 nt, Chlamydophila pneumoniae CWL029
gaauccaaagacuu

SEQ ID NO: 494415 - RNA, 13 nt, Chlamydophila pneumoniae CWL029
gaaucccaaggga

SEQ ID NO: 494416 - RNA, 17 nt, Chlamydophila pneumoniae CWL029
gaauccccaauguuuuc

SEQ ID NO: 494417 - RNA, 16 nt, Chlamydophila pneumoniae CWL029
gaauccucuauccauc

SEQ ID NO: 494418 - RNA, 20 nt, Chlamydophila pneumoniae CWL029
gaauccucuauccaucaucg

SEQ ID NO: 494419 - RNA, 15 nt, Chlamydophila pneumoniae CWL029
gaauacauuccuagc

SEQ ID NO: 494420 - RNA, 15 nt, Chlamydophila pneumoniae CWL029
gaauaaucaaccaaa

SEQ ID NO: 494421 - RNA, 21 nt, Chlamydophila pneumoniae CWL029
gaauaaguuuugauuuugcag

SEQ ID NO: 494422 - RNA, 14 nt, Chlamydophila pneumoniae CWL029
gaauaagauuuuga

SEQ ID NO: 494423 - RNA, 20 nt, Chlamydophila pneumoniae CWL029
gaauaagauuuugaaaauug

SEQ ID NO: 494424 - RNA, 19 nt, Chlamydophila pneumoniae CWL029
gaauaagagcuacaauccc

SEQ ID NO: 494425 - RNA, 15 nt, Chlamydophila pneumoniae CWL029
gaauaaaacuuucuu

SEQ ID NO: 494426 - RNA, 13 nt, Chlamydophila pneumoniae CWL029
gaagucuucaggu

SEQ ID NO: 494427 - RNA, 20 nt, Chlamydophila pneumoniae CWL029
gaagucuucuugcugauccu

SEQ ID NO: 494428 - RNA, 19 nt, Chlamydophila pneumoniae CWL029
gaagucgcaguaaugccaa

SEQ ID NO: 494429 - RNA, 15 nt, Chlamydophila pneumoniae CWL029
gaagucgaaagauca

SEQ ID NO: 494430 - RNA, 22 nt, Chlamydophila pneumoniae CWL029
gaaguccuggauuuuaaagcaa

SEQ ID NO: 494431 - RNA, 13 nt, Chlamydophila pneumoniae CWL029
aaagaucacugag

SEQ ID NO: 494432 - RNA, 18 nt, Chlamydophila pneumoniae CWL029
aaagaucaucuucacuaa

SEQ ID NO: 494433 - RNA, 22 nt, Chlamydophila pneumoniae CWL029
aaagaucauggauucacaucuu

SEQ ID NO: 494434 - RNA, 12 nt, Chlamydophila pneumoniae CWL029
gaaguuuugcuc

SEQ ID NO: 494435 - RNA, 22 nt, Chlamydophila pneumoniae CWL029
gaaguuuuuuaagugcuuuuag

SEQ ID NO: 494436 - RNA, 20 nt, Chlamydophila pneumoniae CWL029
gaaguaaucgucacugcgca

SEQ ID NO: 494437 - RNA, 18 nt, Chlamydophila pneumoniae CWL029
gaaguaagcgauggcagu

SEQ ID NO: 494438 - RNA, 14 nt, Chlamydophila pneumoniae CWL029
gaaggggaagagga

SEQ ID NO: 494439 - RNA, 23 nt, Chlamydophila pneumoniae CWL029
gaaggggagauuccccagggaga

SEQ ID NO: 494440 - RNA, 21 nt, Chlamydophila pneumoniae CWL029
gaaggcggcuuuuugcaagcu

SEQ ID NO: 494441 - RNA, 20 nt, Chlamydophila pneumoniae CWL029
gaaggauaguuugagcagua

SEQ ID NO: 494442 - RNA, 18 nt, Chlamydophila pneumoniae CWL029
gaaggaaaaggcccccua

SEQ ID NO: 494443 - RNA, 12 nt, Chlamydophila pneumoniae CWL029
gaaggaagaucu

SEQ ID NO: 494444 - RNA, 20 nt, Chlamydophila pneumoniae CWL029
gaaggaagaucuugaacaga

SEQ ID NO: 494445 - RNA, 13 nt, Chlamydophila pneumoniae CWL029
gaaggaaaucaca

SEQ ID NO: 494446 - RNA, 14 nt, Chlamydophila pneumoniae CWL029
gaagcguuaacaac

SEQ ID NO: 494447 - RNA, 15 nt, Chlamydophila pneumoniae CWL029
gaagcuugcugauuu

SEQ ID NO: 494448 - RNA, 12 nt, Chlamydophila pneumoniae CWL029
gaaggaguucuu

SEQ ID NO: 494449 - RNA, 15 nt, Chlamydophila pneumoniae CWL029
gaaggacaacuagac

SEQ ID NO: 494450 - RNA, 15 nt, Chlamydophila pneumoniae CWL029
gaagcggagcaucuu

SEQ ID NO: 494451 - RNA, 21 nt, Chlamydophila pneumoniae CWL029
gaagcccgcaguuuaucucua

SEQ ID NO: 494452 - RNA, 18 nt, Chlamydophila pneumoniae CWL029
gaagagguguccauaaug

SEQ ID NO: 494453 - RNA, 23 nt, Chlamydophila pneumoniae CWL029
gaagccagucuucauaagaguag

SEQ ID NO: 494454 - RNA, 12 nt, Chlamydophila pneumoniae CWL029
gaagcagaaacu

SEQ ID NO: 494455 - RNA, 14 nt, Chlamydophila pneumoniae CWL029
aaagauaaagaagu

SEQ ID NO: 494456 - RNA, 16 nt, Chlamydophila pneumoniae CWL029
aaagauaaagaaguuu

SEQ ID NO: 494457 - RNA, 20 nt, Chlamydophila pneumoniae CWL029
aaagaguuuuuuagaggagc

SEQ ID NO: 494458 - RNA, 21 nt, Chlamydophila pneumoniae CWL029
aaagaguuuguucacauuuuc

SEQ ID NO: 494459 - RNA, 14 nt, Chlamydophila pneumoniae CWL029
aaagagugccaaga

SEQ ID NO: 494460 - RNA, 23 nt, Chlamydophila pneumoniae CWL029
aaagagucucuugcuuuuguaga

SEQ ID NO: 494461 - RNA, 17 nt, Chlamydophila pneumoniae CWL029
aaagagucucacucuuu

SEQ ID NO: 494462 - RNA, 24 nt, Chlamydophila pneumoniae CWL029
aaagagucucacucuuuucuagaa

SEQ ID NO: 494463 - RNA, 13 nt, Chlamydophila pneumoniae CWL029
aaagaggggagcu

SEQ ID NO: 494464 - RNA, 23 nt, Chlamydophila pneumoniae CWL029
gaagaaauuaaguaggccuccuu

SEQ ID NO: 494465 - RNA, 24 nt, Chlamydophila pneumoniae CWL029
gaagacguucgacaacaacauaaa

SEQ ID NO: 494466 - RNA, 14 nt, Chlamydophila pneumoniae CWL029
gaagacucucauca

SEQ ID NO: 494467 - RNA, 19 nt, Chlamydophila pneumoniae CWL029
gaagacucucaucagcaaa

SEQ ID NO: 494468 - RNA, 22 nt, Chlamydophila pneumoniae CWL029
gaagacucucaucagcaaaacu

SEQ ID NO: 494469 - RNA, 14 nt, Chlamydophila pneumoniae CWL029
gaagacuugcucug

SEQ ID NO: 494470 - RNA, 16 nt, Chlamydophila pneumoniae CWL029
gaagacuuguucuuca

SEQ ID NO: 494471 - RNA, 15 nt, Chlamydophila pneumoniae CWL029
gaagagaaaguagag

SEQ ID NO: 494472 - RNA, 21 nt, Chlamydophila pneumoniae CWL029
gaacuuucgucuuugcuuucu

SEQ ID NO: 494473 - RNA, 22 nt, Chlamydophila pneumoniae CWL029
gaacuuugaccagaugauuuuu

SEQ ID NO: 494474 - RNA, 22 nt, Chlamydophila pneumoniae CWL029
gaacuuuugggcccucucuuga

SEQ ID NO: 494475 - RNA, 14 nt, Chlamydophila pneumoniae CWL029
gaacuucagcaaga

SEQ ID NO: 494476 - RNA, 23 nt, Chlamydophila pneumoniae CWL029
gaacuucagcuuugcuuaaaaag

SEQ ID NO: 494477 - RNA, 18 nt, Chlamydophila pneumoniae CWL029
gaacuucagcaagaaaau

SEQ ID NO: 494478 - RNA, 19 nt, Chlamydophila pneumoniae CWL029
gaacuucagcaagaaaaua

SEQ ID NO: 494479 - RNA, 15 nt, Chlamydophila pneumoniae CWL029
gaacuuccugauucu

SEQ ID NO: 494480 - RNA, 22 nt, Chlamydophila pneumoniae CWL029
gaacuguaacuugcauuuuuug

SEQ ID NO: 494481 - RNA, 14 nt, Chlamydophila pneumoniae CWL029
gaacuuaaaauuca

SEQ ID NO: 494482 - RNA, 14 nt, Chlamydophila pneumoniae CWL029
gacuauuuuggaaa

SEQ ID NO: 494483 - RNA, 17 nt, Chlamydophila pneumoniae CWL029
gacuauguuuaaagcau

SEQ ID NO: 494484 - RNA, 18 nt, Chlamydophila pneumoniae CWL029
gacuauagaaaaggaugc

SEQ ID NO: 494485 - RNA, 15 nt, Chlamydophila pneumoniae CWL029
gacuauagaugccau

SEQ ID NO: 494486 - RNA, 21 nt, Chlamydophila pneumoniae CWL029
gacuauagaugccauaagucc

SEQ ID NO: 494487 - RNA, 18 nt, Chlamydophila pneumoniae CWL029
gacuaucgcaaauuucca

SEQ ID NO: 494488 - RNA, 13 nt, Chlamydophila pneumoniae CWL029
gacuacaagauag

SEQ ID NO: 494489 - RNA, 20 nt, Chlamydophila pneumoniae CWL029
gacuacaucuuguucugcac

SEQ ID NO: 494490 - RNA, 15 nt, Chlamydophila pneumoniae CWL029
gacuagcuuuucaug

SEQ ID NO: 494491 - RNA, 16 nt, Chlamydophila pneumoniae CWL029
gacuauagaaaaggau

SEQ ID NO: 494492 - RNA, 17 nt, Chlamydophila pneumoniae CWL029
gacuaaaugcgaggccc

SEQ ID NO: 494493 - RNA, 14 nt, Chlamydophila pneumoniae CWL029
gacguuccuuucuc

SEQ ID NO: 494494 - RNA, 16 nt, Chlamydophila pneumoniae CWL029
gacuaaaagaauaaua

SEQ ID NO: 494495 - RNA, 23 nt, Chlamydophila pneumoniae CWL029
gacuaaacaagaaaaagcaucua

SEQ ID NO: 494496 - RNA, 14 nt, Chlamydophila pneumoniae CWL029
gacgugguuuuugc

SEQ ID NO: 494497 - RNA, 18 nt, Chlamydophila pneumoniae CWL029
gacgugggagacauucca

SEQ ID NO: 494498 - RNA, 14 nt, Chlamydophila pneumoniae CWL029
gacggaaaaucaca

SEQ ID NO: 494499 - RNA, 17 nt, Chlamydophila pneumoniae CWL029
gacguacuaagauacgu

SEQ ID NO: 494500 - RNA, 16 nt, Chlamydophila pneumoniae CWL029
gacgaacgaagaaaac

SEQ ID NO: 494501 - RNA, 17 nt, Chlamydophila pneumoniae CWL029
gaccuuggacucuaggg

SEQ ID NO: 494502 - RNA, 16 nt, Chlamydophila pneumoniae CWL029
gaccugugaguaaaau

SEQ ID NO: 494503 - RNA, 23 nt, Chlamydophila pneumoniae CWL029
gaccuguaguaaaauaagaaauc

SEQ ID NO: 494504 - RNA, 19 nt, Chlamydophila pneumoniae CWL029
gaccugcaaacuccccagu

SEQ ID NO: 494505 - RNA, 23 nt, Chlamydophila pneumoniae CWL029
gacgagaacaugaccuuuaggaa

SEQ ID NO: 494506 - RNA, 14 nt, Chlamydophila pneumoniae CWL029
gaccauaaaaucaa

SEQ ID NO: 494507 - RNA, 13 nt, Chlamydophila pneumoniae CWL029
gaccgaaucucuc

SEQ ID NO: 494508 - RNA, 16 nt, Chlamydophila pneumoniae CWL029
gacauuuucaagcuuu

SEQ ID NO: 494509 - RNA, 21 nt, Chlamydophila pneumoniae CWL029
gacauuuucaagcuuucguuu

SEQ ID NO: 494510 - RNA, 19 nt, Chlamydophila pneumoniae CWL029
gaccaaaaauaaacauauu

SEQ ID NO: 494511 - RNA, 19 nt, Chlamydophila pneumoniae CWL029
gacaugagggcaugccuau

SEQ ID NO: 494512 - RNA, 21 nt, Chlamydophila pneumoniae CWL029
gacaugccuaaauagcucagu

SEQ ID NO: 494513 - RNA, 15 nt, Chlamydophila pneumoniae CWL029
gacaugcuuuccuuc

SEQ ID NO: 494514 - RNA, 20 nt, Chlamydophila pneumoniae CWL029
gacaugccuaaauagcucag

SEQ ID NO: 494515 - RNA, 13 nt, Chlamydophila pneumoniae CWL029
gacaguauucccu

SEQ ID NO: 494516 - RNA, 14 nt, Chlamydophila pneumoniae CWL029
gacagucucaugga

SEQ ID NO: 494517 - RNA, 20 nt, Chlamydophila pneumoniae CWL029
gacagucugugagaaauagg

SEQ ID NO: 494518 - RNA, 16 nt, Chlamydophila pneumoniae CWL029
gacagggaaagaacag

SEQ ID NO: 494519 - RNA, 12 nt, Chlamydophila pneumoniae CWL029
gaacucugaagu

SEQ ID NO: 494520 - RNA, 14 nt, Chlamydophila pneumoniae CWL029
gaacuauaggaagc

SEQ ID NO: 494521 - RNA, 20 nt, Chlamydophila pneumoniae CWL029
gaacuauccuguuucaacau

SEQ ID NO: 494522 - RNA, 21 nt, Chlamydophila pneumoniae CWL029
gaacuauccuguuucaacaua

SEQ ID NO: 494523 - RNA, 21 nt, Chlamydophila pneumoniae CWL029
gaacuacgggcaauauaucca

SEQ ID NO: 494524 - RNA, 17 nt, Chlamydophila pneumoniae CWL029
gaacuacuuaaauccua

SEQ ID NO: 494525 - RNA, 21 nt, Chlamydophila pneumoniae CWL029
gaacucacaaacaacagaaau

SEQ ID NO: 494526 - RNA, 14 nt, Chlamydophila pneumoniae CWL029
gaacucaucacaau

SEQ ID NO: 494527 - RNA, 16 nt, Chlamydophila pneumoniae CWL029
gaacuccauucagaug

SEQ ID NO: 494528 - RNA, 23 nt, Chlamydophila pneumoniae CWL029
gaacgucuaaagacgaagggagu

SEQ ID NO: 494529 - RNA, 16 nt, Chlamydophila pneumoniae CWL029
gaacguacuuagguaa

SEQ ID NO: 494530 - RNA, 14 nt, Chlamydophila pneumoniae CWL029
gaacuaaagagauc

SEQ ID NO: 494531 - RNA, 18 nt, Chlamydophila pneumoniae CWL029
gaacuaaaggaacugugc

SEQ ID NO: 494532 - RNA, 19 nt, Chlamydophila pneumoniae CWL029
gaacuaaaaguuuuuuauu

SEQ ID NO: 494533 - RNA, 19 nt, Chlamydophila pneumoniae CWL029
gaacgccaucuccacagcc

SEQ ID NO: 494534 - RNA, 20 nt, Chlamydophila pneumoniae CWL029
gaaccuccaccaggagcucc

SEQ ID NO: 494535 - RNA, 14 nt, Chlamydophila pneumoniae CWL029
gaaccuaggaggau

SEQ ID NO: 494536 - RNA, 21 nt, Chlamydophila pneumoniae CWL029
gaaccuaggaggauuuccuag

SEQ ID NO: 494537 - RNA, 13 nt, Chlamydophila pneumoniae CWL029
gaacccuggauga

SEQ ID NO: 494538 - RNA, 19 nt, Chlamydophila pneumoniae CWL029
gaaccaaaucuaucugcac

SEQ ID NO: 494539 - RNA, 16 nt, Chlamydophila pneumoniae CWL029
gaaccaaaaugaguuc

SEQ ID NO: 494540 - RNA, 22 nt, Chlamydophila pneumoniae CWL029
gaacagcacucucugcagggaa

SEQ ID NO: 494541 - RNA, 12 nt, Chlamydophila pneumoniae CWL029
gaacacucucua

SEQ ID NO: 494542 - RNA, 15 nt, Chlamydophila pneumoniae CWL029
gaacagcacucucug

SEQ ID NO: 494543 - RNA, 22 nt, Chlamydophila pneumoniae CWL029
gaacagcauggacuccaagaau

SEQ ID NO: 494544 - RNA, 23 nt, Chlamydophila pneumoniae CWL029
gaacagcauggacuccaagaaua

SEQ ID NO: 494545 - RNA, 20 nt, Chlamydophila pneumoniae CWL029
gaacaggagagagaaggcuc

SEQ ID NO: 494546 - RNA, 22 nt, Chlamydophila pneumoniae CWL029
gaacaguuugcucuggauguag

SEQ ID NO: 494547 - RNA, 12 nt, Chlamydophila pneumoniae CWL029
gaacaggagaga

SEQ ID NO: 494548 - RNA, 21 nt, Chlamydophila pneumoniae CWL029
gaacaggagguguauccguag

SEQ ID NO: 494549 - RNA, 21 nt, Chlamydophila pneumoniae CWL029
gaacaauguaaauugaguauc

SEQ ID NO: 494550 - RNA, 16 nt, Chlamydophila pneumoniae CWL029
gaacaccucuucucua

SEQ ID NO: 494551 - RNA, 15 nt, Chlamydophila pneumoniae CWL029
gaacaaagcucuccu

SEQ ID NO: 494552 - RNA, 21 nt, Chlamydophila pneumoniae CWL029
gaacaaaaaaucaaucuugau

SEQ ID NO: 494553 - RNA, 13 nt, Chlamydophila pneumoniae CWL029
gaacaaaaacugc

SEQ ID NO: 494554 - RNA, 14 nt, Chlamydophila pneumoniae CWL029
gaacaaucaacacc

SEQ ID NO: 494555 - RNA, 17 nt, Chlamydophila pneumoniae CWL029
gaacaauagaaagacca

SEQ ID NO: 494556 - RNA, 22 nt, Chlamydophila pneumoniae CWL029
gaaauugaauaucgaguucuuu

SEQ ID NO: 494557 - RNA, 21 nt, Chlamydophila pneumoniae CWL029
gaaauugaacucucaguuaaa

SEQ ID NO: 494558 - RNA, 18 nt, Chlamydophila pneumoniae CWL029
aaagagacuguagccuuu

SEQ ID NO: 494559 - RNA, 22 nt, Chlamydophila pneumoniae CWL029
gaaaugcaaaccaaaaaaguaa

SEQ ID NO: 494560 - RNA, 16 nt, Chlamydophila pneumoniae CWL029
gaaaucgcauuacaaa

SEQ ID NO: 494561 - RNA, 14 nt, Chlamydophila pneumoniae CWL029
gaaauccugggcaa

SEQ ID NO: 494562 - RNA, 22 nt, Chlamydophila pneumoniae CWL029
gaaauccugggcaaugaucaaa

SEQ ID NO: 494563 - RNA, 23 nt, Chlamydophila pneumoniae CWL029
gaaaucgacaggggaguuuucaa

SEQ ID NO: 494564 - RNA, 14 nt, Chlamydophila pneumoniae CWL029
gaaaguaucuucag

SEQ ID NO: 494565 - RNA, 15 nt, Chlamydophila pneumoniae CWL029
gaaaguauuccucuu

SEQ ID NO: 494566 - RNA, 19 nt, Chlamydophila pneumoniae CWL029
gaaaguaccuauugugcuu

SEQ ID NO: 494567 - RNA, 21 nt, Chlamydophila pneumoniae CWL029
gaaaguaccuauugugcuuuu

SEQ ID NO: 494568 - RNA, 23 nt, Chlamydophila pneumoniae CWL029
gaaaguauagacgggcuuauaaa

SEQ ID NO: 494569 - RNA, 18 nt, Chlamydophila pneumoniae CWL029
gaaagcuggaaggucgcu

SEQ ID NO: 494570 - RNA, 18 nt, Chlamydophila pneumoniae CWL029
gaaaguaaaauuucugua

SEQ ID NO: 494571 - RNA, 22 nt, Chlamydophila pneumoniae CWL029
gaaagcguuucgauaauuuuca

SEQ ID NO: 494572 - RNA, 23 nt, Chlamydophila pneumoniae CWL029
gaaagcguuucgauaauuuucac

SEQ ID NO: 494573 - RNA, 18 nt, Chlamydophila pneumoniae CWL029
gaaagcgcgaugaacagc

SEQ ID NO: 494574 - RNA, 20 nt, Chlamydophila pneumoniae CWL029
gaaauaauuuucagucuucc

SEQ ID NO: 494575 - RNA, 15 nt, Chlamydophila pneumoniae CWL029
gaaauacgcuuuucu

SEQ ID NO: 494576 - RNA, 22 nt, Chlamydophila pneumoniae CWL029
gaaauacguccagccugcacca

SEQ ID NO: 494577 - RNA, 12 nt, Chlamydophila pneumoniae CWL029
gaaauccuccua

SEQ ID NO: 494578 - RNA, 21 nt, Chlamydophila pneumoniae CWL029
gaaacuuaguuuugaaaagau

SEQ ID NO: 494579 - RNA, 17 nt, Chlamydophila pneumoniae CWL029
gaaacuucugacccugu

SEQ ID NO: 494580 - RNA, 13 nt, Chlamydophila pneumoniae CWL029
gaaagcacauaag

SEQ ID NO: 494581 - RNA, 18 nt, Chlamydophila pneumoniae CWL029
gaaagcagcgaagauuua

SEQ ID NO: 494582 - RNA, 14 nt, Chlamydophila pneumoniae CWL029
gaaaaucugcagca

SEQ ID NO: 494583 - RNA, 22 nt, Chlamydophila pneumoniae CWL029
gaaaaucuuuaagguugcuuuu

SEQ ID NO: 494584 - RNA, 15 nt, Chlamydophila pneumoniae CWL029
gaaaaucugcucucu

SEQ ID NO: 494585 - RNA, 20 nt, Chlamydophila pneumoniae CWL029
gaaaauccuaacaaaaggau

SEQ ID NO: 494586 - RNA, 17 nt, Chlamydophila pneumoniae CWL029
gaaaauccuuaggggcg

SEQ ID NO: 494587 - RNA, 24 nt, Chlamydophila pneumoniae CWL029
gaaaaucuacacgcuauagcaaca

SEQ ID NO: 494588 - RNA, 20 nt, Chlamydophila pneumoniae CWL029
gaaaaucucuaagaaucuau

SEQ ID NO: 494589 - RNA, 18 nt, Chlamydophila pneumoniae CWL029
gaaaauguaaaaaauuau

SEQ ID NO: 494590 - RNA, 16 nt, Chlamydophila pneumoniae CWL029
gaaaacgccaacugua

SEQ ID NO: 494591 - RNA, 13 nt, Chlamydophila pneumoniae CWL029
gaaaacauagaga

SEQ ID NO: 494592 - RNA, 14 nt, Chlamydophila pneumoniae CWL029
gaaaacaaggcaaa

SEQ ID NO: 494593 - RNA, 16 nt, Chlamydophila pneumoniae CWL029
gaaaauacagccagca

SEQ ID NO: 494594 - RNA, 18 nt, Chlamydophila pneumoniae CWL029
gaaaauacagccagcaga

SEQ ID NO: 494595 - RNA, 19 nt, Chlamydophila pneumoniae CWL029
gaaaauacagccagcagaa

SEQ ID NO: 494596 - RNA, 16 nt, Chlamydophila pneumoniae CWL029
gaaaauaagaagcagc

SEQ ID NO: 494597 - RNA, 22 nt, Chlamydophila pneumoniae CWL029
gaaaagauucuaaaucaacuac

SEQ ID NO: 494598 - RNA, 22 nt, Chlamydophila pneumoniae CWL029
gaaaagauuugcgaaucuaaga

SEQ ID NO: 494599 - RNA, 14 nt, Chlamydophila pneumoniae CWL029
gaaaagaaagaaua

SEQ ID NO: 494600 - RNA, 15 nt, Chlamydophila pneumoniae CWL029
gaaaagaacagggga

SEQ ID NO: 494601 - RNA, 13 nt, Chlamydophila pneumoniae CWL029
gaaaagaaugugc

SEQ ID NO: 494602 - RNA, 19 nt, Chlamydophila pneumoniae CWL029
gaaaaaguaguuuuaagaa

SEQ ID NO: 494603 - RNA, 18 nt, Chlamydophila pneumoniae CWL029
gaaaaagccuuucuuauu

SEQ ID NO: 494604 - RNA, 16 nt, Chlamydophila pneumoniae CWL029
gaaaaagcccauuccu

SEQ ID NO: 494605 - RNA, 17 nt, Chlamydophila pneumoniae CWL029
cuuuuguuugucuucca

SEQ ID NO: 494606 - RNA, 18 nt, Chlamydophila pneumoniae CWL029
cuuuuguuuuagcucuuu

SEQ ID NO: 494607 - RNA, 23 nt, Chlamydophila pneumoniae CWL029
cuuuuucuugaaaaauccugaga

SEQ ID NO: 494608 - RNA, 20 nt, Chlamydophila pneumoniae CWL029
cuuuuucuugauuagagaau

SEQ ID NO: 494609 - RNA, 14 nt, Chlamydophila pneumoniae CWL029
cuuuuacugaaauu

SEQ ID NO: 494610 - RNA, 20 nt, Chlamydophila pneumoniae CWL029
cuuuuagagccuuuucagau

SEQ ID NO: 494611 - RNA, 16 nt, Chlamydophila pneumoniae CWL029
cuuuuaucuguuaaaa

SEQ ID NO: 494612 - RNA, 22 nt, Chlamydophila pneumoniae CWL029
cuuuuagacgugcucucuucuu

SEQ ID NO: 494613 - RNA, 13 nt, Chlamydophila pneumoniae CWL029
cuuuuaugaugua

SEQ ID NO: 494614 - RNA, 18 nt, Chlamydophila pneumoniae CWL029
cuuuuaaaaacucuuuca

SEQ ID NO: 494615 - RNA, 23 nt, Chlamydophila pneumoniae CWL029
cuuuuacgaaugagaucagcucc

SEQ ID NO: 494616 - RNA, 23 nt, Chlamydophila pneumoniae CWL029
cuuuucagcaaacggagagcauu

SEQ ID NO: 494617 - RNA, 12 nt, Chlamydophila pneumoniae CWL029
cuuuucaaaaga

SEQ ID NO: 494618 - RNA, 20 nt, Chlamydophila pneumoniae CWL029
cuuuuccaaauuccuucaua

SEQ ID NO: 494619 - RNA, 15 nt, Chlamydophila pneumoniae CWL029
cuuuuccugcagcag

SEQ ID NO: 494620 - RNA, 18 nt, Chlamydophila pneumoniae CWL029
cuuuuccguuucagaagu

SEQ ID NO: 494621 - RNA, 13 nt, Chlamydophila pneumoniae CWL029
cuuuuccuaaauc

SEQ ID NO: 494622 - RNA, 19 nt, Chlamydophila pneumoniae CWL029
cuuuucuccuucuggaugc

SEQ ID NO: 494623 - RNA, 22 nt, Chlamydophila pneumoniae CWL029
cuuuucuaagcaauauuucugu

SEQ ID NO: 494624 - RNA, 15 nt, Chlamydophila pneumoniae CWL029
cuuuucuacaugcuc

SEQ ID NO: 494625 - RNA, 16 nt, Chlamydophila pneumoniae CWL029
cuuuucuacaugcuca

SEQ ID NO: 494626 - RNA, 13 nt, Chlamydophila pneumoniae CWL029
cuuuucuagaaaa

SEQ ID NO: 494627 - RNA, 15 nt, Chlamydophila pneumoniae CWL029
cuuuucgcagauacu

SEQ ID NO: 494628 - RNA, 17 nt, Chlamydophila pneumoniae CWL029
cuuuucugaagauuuuu

SEQ ID NO: 494629 - RNA, 14 nt, Chlamydophila pneumoniae CWL029
cuuuucugaagauu

SEQ ID NO: 494630 - RNA, 19 nt, Chlamydophila pneumoniae CWL029
cuuuucugaagauuuuuua

SEQ ID NO: 494631 - RNA, 21 nt, Chlamydophila pneumoniae CWL029
cuuuucugaaucuuuuguuuu

SEQ ID NO: 494632 - RNA, 15 nt, Chlamydophila pneumoniae CWL029
cuuuucugcuccuga

SEQ ID NO: 494633 - RNA, 12 nt, Chlamydophila pneumoniae CWL029
cuuuucuuauca

SEQ ID NO: 494634 - RNA, 14 nt, Chlamydophila pneumoniae CWL029
aaagacucucuucc

SEQ ID NO: 494635 - RNA, 14 nt, Chlamydophila pneumoniae CWL029
aaagacugaaaaga

SEQ ID NO: 494636 - RNA, 19 nt, Chlamydophila pneumoniae CWL029
aaagacucucuuccaaaag

SEQ ID NO: 494637 - RNA, 23 nt, Chlamydophila pneumoniae CWL029
aaagacuagcuuuuuuuaugauu

SEQ ID NO: 494638 - RNA, 18 nt, Chlamydophila pneumoniae CWL029
aaagacuucgaugucuuu

SEQ ID NO: 494639 - RNA, 19 nt, Chlamydophila pneumoniae CWL029
aaagacuucuuuauuauag

SEQ ID NO: 494640 - RNA, 18 nt, Chlamydophila pneumoniae CWL029
cuuuucuuccaaagacug

SEQ ID NO: 494641 - RNA, 14 nt, Chlamydophila pneumoniae CWL029
cuuuucuucuucgg

SEQ ID NO: 494642 - RNA, 21 nt, Chlamydophila pneumoniae CWL029
cuuuucuuuuuagaauccuga

SEQ ID NO: 494643 - RNA, 17 nt, Chlamydophila pneumoniae CWL029
cuuuucuuuuucuaggg

SEQ ID NO: 494644 - RNA, 13 nt, Chlamydophila pneumoniae CWL029
cuuuucuuuuucu

SEQ ID NO: 494645 - RNA, 13 nt, Chlamydophila pneumoniae CWL029
cuuuugcuacagc

SEQ ID NO: 494646 - RNA, 23 nt, Chlamydophila pneumoniae CWL029
cuuuugcuacagcuucuuuucca

SEQ ID NO: 494647 - RNA, 17 nt, Chlamydophila pneumoniae CWL029
cuuuugugaagauaaga

SEQ ID NO: 494648 - RNA, 21 nt, Chlamydophila pneumoniae CWL029
cuuugaccagaugauuuuuug

SEQ ID NO: 494649 - RNA, 21 nt, Chlamydophila pneumoniae CWL029
cuuugcaugaggagaccuuua

SEQ ID NO: 494650 - RNA, 16 nt, Chlamydophila pneumoniae CWL029
cuuugcaucccuaggg

SEQ ID NO: 494651 - RNA, 13 nt, Chlamydophila pneumoniae CWL029
cuuugcaugagga

SEQ ID NO: 494652 - RNA, 22 nt, Chlamydophila pneumoniae CWL029
cuuugcuuaaaaagucugaauc

SEQ ID NO: 494653 - RNA, 19 nt, Chlamydophila pneumoniae CWL029
cuuugugaguucuuccuuc

SEQ ID NO: 494654 - RNA, 18 nt, Chlamydophila pneumoniae CWL029
cuuuguggggauuuucag

SEQ ID NO: 494655 - RNA, 18 nt, Chlamydophila pneumoniae CWL029
cuuuguuaauagaagauc

SEQ ID NO: 494656 - RNA, 18 nt, Chlamydophila pneumoniae CWL029
cuuucuuuuagcuacuuc

SEQ ID NO: 494657 - RNA, 13 nt, Chlamydophila pneumoniae CWL029
cuuucuuggauug

SEQ ID NO: 494658 - RNA, 21 nt, Chlamydophila pneumoniae CWL029
cuuucuucuagagcuucaagu

SEQ ID NO: 494659 - RNA, 14 nt, Chlamydophila pneumoniae CWL029
cuuucuuuuugaga

SEQ ID NO: 494660 - RNA, 17 nt, Chlamydophila pneumoniae CWL029
cuuucuuuuugagauaa

SEQ ID NO: 494661 - RNA, 14 nt, Chlamydophila pneumoniae CWL029
cuuugaauuuccaa

SEQ ID NO: 494662 - RNA, 19 nt, Chlamydophila pneumoniae CWL029
cuuugaauuuccaaaggaa

SEQ ID NO: 494663 - RNA, 21 nt, Chlamydophila pneumoniae CWL029
cuuucucggucuuucuuuuuu

SEQ ID NO: 494664 - RNA, 19 nt, Chlamydophila pneumoniae CWL029
cuuucuccagcauuuuugg

SEQ ID NO: 494665 - RNA, 22 nt, Chlamydophila pneumoniae CWL029
cuuucuauuucgucgucauccc

SEQ ID NO: 494666 - RNA, 23 nt, Chlamydophila pneumoniae CWL029
cuuucuagaaugaugcaagcaga

SEQ ID NO: 494667 - RNA, 14 nt, Chlamydophila pneumoniae CWL029
cuuucuagcugcuc

SEQ ID NO: 494668 - RNA, 19 nt, Chlamydophila pneumoniae CWL029
cuuucauucccuuuuucca

SEQ ID NO: 494669 - RNA, 22 nt, Chlamydophila pneumoniae CWL029
cuuuagcaaucucuuucacaaa

SEQ ID NO: 494670 - RNA, 22 nt, Chlamydophila pneumoniae CWL029
cuuuagagacgcuuuuaucugu

SEQ ID NO: 494671 - RNA, 23 nt, Chlamydophila pneumoniae CWL029
cuuuagaaauuccaauuuuugca

SEQ ID NO: 494672 - RNA, 23 nt, Chlamydophila pneumoniae CWL029
cuuucacaaaggcgaucuucuuc

SEQ ID NO: 494673 - RNA, 15 nt, Chlamydophila pneumoniae CWL029
cuuucaauagcuucc

SEQ ID NO: 494674 - RNA, 16 nt, Chlamydophila pneumoniae CWL029
cuuuauugauagcuga

SEQ ID NO: 494675 - RNA, 23 nt, Chlamydophila pneumoniae CWL029
cuuucauaagauagagcgacuuc

SEQ ID NO: 494676 - RNA, 13 nt, Chlamydophila pneumoniae CWL029
cuuuaaucaagcc

SEQ ID NO: 494677 - RNA, 19 nt, Chlamydophila pneumoniae CWL029
cuuuaaguguuucuucaua

SEQ ID NO: 494678 - RNA, 12 nt, Chlamydophila pneumoniae CWL029
cuuuaaauuuuu

SEQ ID NO: 494679 - RNA, 23 nt, Chlamydophila pneumoniae CWL029
cuuuacgaugagguugagcaaga

SEQ ID NO: 494680 - RNA, 14 nt, Chlamydophila pneumoniae CWL029
gagcaacaguaauu

SEQ ID NO: 494681 - RNA, 23 nt, Chlamydophila pneumoniae CWL029
gagcaacuucuucguuagagaag

SEQ ID NO: 494682 - RNA, 19 nt, Chlamydophila pneumoniae CWL029
aaagcacuuaaaaaacuuc

SEQ ID NO: 494683 - RNA, 21 nt, Chlamydophila pneumoniae CWL029
gagcauuuaaccccacaauca

SEQ ID NO: 494684 - RNA, 23 nt, Chlamydophila pneumoniae CWL029
gagcauuuccaaacccauauucc

SEQ ID NO: 494685 - RNA, 22 nt, Chlamydophila pneumoniae CWL029
gagaggauuugaaccuccgccc

SEQ ID NO: 494686 - RNA, 21 nt, Chlamydophila pneumoniae CWL029
gagagcuuucgcuccuaagcu

SEQ ID NO: 494687 - RNA, 20 nt, Chlamydophila pneumoniae CWL029
gagagcuuuuagguagagaa

SEQ ID NO: 494688 - RNA, 22 nt, Chlamydophila pneumoniae CWL029
gagaggaaaucccgagauauga

SEQ ID NO: 494689 - RNA, 17 nt, Chlamydophila pneumoniae CWL029
gagaggagagaauccuu

SEQ ID NO: 494690 - RNA, 15 nt, Chlamydophila pneumoniae CWL029
gacuccaagaauagc

SEQ ID NO: 494691 - RNA, 19 nt, Chlamydophila pneumoniae CWL029
gacuccaagaauagcagga

SEQ ID NO: 494692 - RNA, 19 nt, Chlamydophila pneumoniae CWL029
gagagcuugguuuucuccu

SEQ ID NO: 494693 - RNA, 21 nt, Chlamydophila pneumoniae CWL029
gagaucuuugagaucuugaau

SEQ ID NO: 494694 - RNA, 19 nt, Chlamydophila pneumoniae CWL029
gagaucuuauagacaggua

SEQ ID NO: 494695 - RNA, 14 nt, Chlamydophila pneumoniae CWL029
gagauccuaagaga

SEQ ID NO: 494696 - RNA, 17 nt, Chlamydophila pneumoniae CWL029
gagauccuccuggaaga

SEQ ID NO: 494697 - RNA, 12 nt, Chlamydophila pneumoniae CWL029
gagauuuuccau

SEQ ID NO: 494698 - RNA, 21 nt, Chlamydophila pneumoniae CWL029
gagauuuuccauaggaacaaa

SEQ ID NO: 494699 - RNA, 12 nt, Chlamydophila pneumoniae CWL029
gagauuuuucua

SEQ ID NO: 494700 - RNA, 11 nt, Chlamydophila pneumoniae CWL029
gagcaaacauc

SEQ ID NO: 494701 - RNA, 12 nt, Chlamydophila pneumoniae CWL029
gagcggaauuuc

SEQ ID NO: 494702 - RNA, 16 nt, Chlamydophila pneumoniae CWL029
gagcgcuuucuuuuau

SEQ ID NO: 494703 - RNA, 20 nt, Chlamydophila pneumoniae CWL029
gagcucccucuagagcuuug

SEQ ID NO: 494704 - RNA, 18 nt, Chlamydophila pneumoniae CWL029
gagcuauuuuacuuacua

SEQ ID NO: 494705 - RNA, 13 nt, Chlamydophila pneumoniae CWL029
gagcucacaaccc

SEQ ID NO: 494706 - RNA, 12 nt, Chlamydophila pneumoniae CWL029
gagcuaccagaa

SEQ ID NO: 494707 - RNA, 18 nt, Chlamydophila pneumoniae CWL029
gagccuagagaguucuug

SEQ ID NO: 494708 - RNA, 20 nt, Chlamydophila pneumoniae CWL029
gagccacuuuuaauuucuua

SEQ ID NO: 494709 - RNA, 13 nt, Chlamydophila pneumoniae CWL029
gaguuucuaaugu

SEQ ID NO: 494710 - RNA, 17 nt, Chlamydophila pneumoniae CWL029
gaguucucucuucacuc

SEQ ID NO: 494711 - RNA, 15 nt, Chlamydophila pneumoniae CWL029
gaguucuuccuucuu

SEQ ID NO: 494712 - RNA, 19 nt, Chlamydophila pneumoniae CWL029
gaguucgcggaucuucuuc

SEQ ID NO: 494713 - RNA, 18 nt, Chlamydophila pneumoniae CWL029
gaguuucgaauucaauga

SEQ ID NO: 494714 - RNA, 19 nt, Chlamydophila pneumoniae CWL029
gaguuucuuauucacugga

SEQ ID NO: 494715 - RNA, 13 nt, Chlamydophila pneumoniae CWL029
gaguuuuacauca

SEQ ID NO: 494716 - RNA, 19 nt, Chlamydophila pneumoniae CWL029
gauaaaacgcuauuguuug

SEQ ID NO: 494717 - RNA, 13 nt, Chlamydophila pneumoniae CWL029
gauaaaacuauaa

SEQ ID NO: 494718 - RNA, 16 nt, Chlamydophila pneumoniae CWL029
gauaaaagguauuucu

SEQ ID NO: 494719 - RNA, 14 nt, Chlamydophila pneumoniae CWL029
gauaaaaucuucau

SEQ ID NO: 494720 - RNA, 19 nt, Chlamydophila pneumoniae CWL029
gauaaagacaucucuuuaa

SEQ ID NO: 494721 - RNA, 14 nt, Chlamydophila pneumoniae CWL029
gauaaacagcacag

SEQ ID NO: 494722 - RNA, 11 nt, Chlamydophila pneumoniae CWL029
gauaaacauac

SEQ ID NO: 494723 - RNA, 13 nt, Chlamydophila pneumoniae CWL029
gagugacucauca

SEQ ID NO: 494724 - RNA, 15 nt, Chlamydophila pneumoniae CWL029
gagugaccauagcau

SEQ ID NO: 494725 - RNA, 21 nt, Chlamydophila pneumoniae CWL029
gagugacaccaacaacaauaa

SEQ ID NO: 494726 - RNA, 15 nt, Chlamydophila pneumoniae CWL029
gaguguauuguaaag

SEQ ID NO: 494727 - RNA, 20 nt, Chlamydophila pneumoniae CWL029
gaguguuguuggagcagaaa

SEQ ID NO: 494728 - RNA, 20 nt, Chlamydophila pneumoniae CWL029
gaguuccgcaaauacagaca

SEQ ID NO: 494729 - RNA, 21 nt, Chlamydophila pneumoniae CWL029
gaguagacaagagagagcugg

SEQ ID NO: 494730 - RNA, 15 nt, Chlamydophila pneumoniae CWL029
gagucgauuucccag

SEQ ID NO: 494731 - RNA, 22 nt, Chlamydophila pneumoniae CWL029
gagucgaaacacucaugaaagu

SEQ ID NO: 494732 - RNA, 14 nt, Chlamydophila pneumoniae CWL029
gaguccuucuuuuc

SEQ ID NO: 494733 - RNA, 20 nt, Chlamydophila pneumoniae CWL029
gagucacuggcaucagugga

SEQ ID NO: 494734 - RNA, 19 nt, Chlamydophila pneumoniae CWL029
gagucacggcaaugauagg

SEQ ID NO: 494735 - RNA, 17 nt, Chlamydophila pneumoniae CWL029
gaguaaggaacaaugua

SEQ ID NO: 494736 - RNA, 14 nt, Chlamydophila pneumoniae CWL029
gagguaaccagaga

SEQ ID NO: 494737 - RNA, 15 nt, Chlamydophila pneumoniae CWL029
gaguaaaaucauagg

SEQ ID NO: 494738 - RNA, 17 nt, Chlamydophila pneumoniae CWL029
gagguaaccagagagcu

SEQ ID NO: 494739 - RNA, 18 nt, Chlamydophila pneumoniae CWL029
gaggggacggaaaaucac

SEQ ID NO: 494740 - RNA, 23 nt, Chlamydophila pneumoniae CWL029
gaggagacuugaucuacaaaaac

SEQ ID NO: 494741 - RNA, 20 nt, Chlamydophila pneumoniae CWL029
gaggagaauagcaagcacuu

SEQ ID NO: 494742 - RNA, 14 nt, Chlamydophila pneumoniae CWL029
gaggaguuuuccaa

SEQ ID NO: 494743 - RNA, 13 nt, Chlamydophila pneumoniae CWL029
gaggcccgaagca

SEQ ID NO: 494744 - RNA, 18 nt, Chlamydophila pneumoniae CWL029
gagcugauccagcuccau

SEQ ID NO: 494745 - RNA, 17 nt, Chlamydophila pneumoniae CWL029
gagcucuacucuacagu

SEQ ID NO: 494746 - RNA, 17 nt, Chlamydophila pneumoniae CWL029
gagcucgcaaaagcugu

SEQ ID NO: 494747 - RNA, 19 nt, Chlamydophila pneumoniae CWL029
gagcuccgcuagaggaucu

SEQ ID NO: 494748 - RNA, 12 nt, Chlamydophila pneumoniae CWL029
gagcuccuccuu

SEQ ID NO: 494749 - RNA, 20 nt, Chlamydophila pneumoniae CWL029
gaggaacguuacgucuuagg

SEQ ID NO: 494750 - RNA, 15 nt, Chlamydophila pneumoniae CWL029
gaggaacgcacgcca

SEQ ID NO: 494751 - RNA, 21 nt, Chlamydophila pneumoniae CWL029
gaggaacuucagcuuugcuua

SEQ ID NO: 494752 - RNA, 22 nt, Chlamydophila pneumoniae CWL029
gaggaagcacaccaaguacagu

SEQ ID NO: 494753 - RNA, 19 nt, Chlamydophila pneumoniae CWL029
gaucuggagagggaaggaa

SEQ ID NO: 494754 - RNA, 19 nt, Chlamydophila pneumoniae CWL029
gaucugcagcguuucuagg

SEQ ID NO: 494755 - RNA, 21 nt, Chlamydophila pneumoniae CWL029
gaucugcagcguuucuaggga

SEQ ID NO: 494756 - RNA, 14 nt, Chlamydophila pneumoniae CWL029
gaucugauagaaca

SEQ ID NO: 494757 - RNA, 19 nt, Chlamydophila pneumoniae CWL029
gaucucuuuuggaagaccu

SEQ ID NO: 494758 - RNA, 19 nt, Chlamydophila pneumoniae CWL029
gaucucgucuuggaaugcu

SEQ ID NO: 494759 - RNA, 18 nt, Chlamydophila pneumoniae CWL029
gaucucucuuccugcugc

SEQ ID NO: 494760 - RNA, 14 nt, Chlamydophila pneumoniae CWL029
gaucucucuuuccu

SEQ ID NO: 494761 - RNA, 19 nt, Chlamydophila pneumoniae CWL029
gaucucucuuuccuuagca

SEQ ID NO: 494762 - RNA, 21 nt, Chlamydophila pneumoniae CWL029
gaucucuucaugaaaaaagaa

SEQ ID NO: 494763 - RNA, 14 nt, Chlamydophila pneumoniae CWL029
gaucuacaaaaacu

SEQ ID NO: 494764 - RNA, 17 nt, Chlamydophila pneumoniae CWL029
gaucuacaaacagauuu

SEQ ID NO: 494765 - RNA, 23 nt, Chlamydophila pneumoniae CWL029
gaucuacagauaggguaagauug

SEQ ID NO: 494766 - RNA, 17 nt, Chlamydophila pneumoniae CWL029
gaucuagaaaaugaaga

SEQ ID NO: 494767 - RNA, 22 nt, Chlamydophila pneumoniae CWL029
gaucuagaaaaugaagagcuuc

SEQ ID NO: 494768 - RNA, 18 nt, Chlamydophila pneumoniae CWL029
gaucucaguaggagcagc

SEQ ID NO: 494769 - RNA, 23 nt, Chlamydophila pneumoniae CWL029
gaucuccgauagagauucuuucu

SEQ ID NO: 494770 - RNA, 14 nt, Chlamydophila pneumoniae CWL029
gaucucaucauaaa

SEQ ID NO: 494771 - RNA, 15 nt, Chlamydophila pneumoniae CWL029
gaucguuagagaccc

SEQ ID NO: 494772 - RNA, 21 nt, Chlamydophila pneumoniae CWL029
gauccuucaucagcuucccaa

SEQ ID NO: 494773 - RNA, 16 nt, Chlamydophila pneumoniae CWL029
gauccuuuccaagaag

SEQ ID NO: 494774 - RNA, 19 nt, Chlamydophila pneumoniae CWL029
gaucgaaucuuuauuucug

SEQ ID NO: 494775 - RNA, 23 nt, Chlamydophila pneumoniae CWL029
aaagcccucauccccucagaaag

SEQ ID NO: 494776 - RNA, 20 nt, Chlamydophila pneumoniae CWL029
aaagccauuccauauccaug

SEQ ID NO: 494777 - RNA, 14 nt, Chlamydophila pneumoniae CWL029
aaagcccauuccug

SEQ ID NO: 494778 - RNA, 15 nt, Chlamydophila pneumoniae CWL029
gauccuagaauagga

SEQ ID NO: 494779 - RNA, 23 nt, Chlamydophila pneumoniae CWL029
gaucccuguaguuucuaaaacag

SEQ ID NO: 494780 - RNA, 15 nt, Chlamydophila pneumoniae CWL029
gauccgaaaagaacc

SEQ ID NO: 494781 - RNA, 17 nt, Chlamydophila pneumoniae CWL029
gaucccgaagcaaucca

SEQ ID NO: 494782 - RNA, 18 nt, Chlamydophila pneumoniae CWL029
gaucccgggagucuucag

SEQ ID NO: 494783 - RNA, 18 nt, Chlamydophila pneumoniae CWL029
gaucccuaacgaugcagg

SEQ ID NO: 494784 - RNA, 19 nt, Chlamydophila pneumoniae CWL029
gauccaucggcauuucucc

SEQ ID NO: 494785 - RNA, 20 nt, Chlamydophila pneumoniae CWL029
gauccagcccccaggcugca

SEQ ID NO: 494786 - RNA, 18 nt, Chlamydophila pneumoniae CWL029
gauccagcccccaggcug

SEQ ID NO: 494787 - RNA, 14 nt, Chlamydophila pneumoniae CWL029
gauccauaaccuuu

SEQ ID NO: 494788 - RNA, 21 nt, Chlamydophila pneumoniae CWL029
gauccacagacugcaggaaau

SEQ ID NO: 494789 - RNA, 16 nt, Chlamydophila pneumoniae CWL029
gaucaucuucacuaaa

SEQ ID NO: 494790 - RNA, 23 nt, Chlamydophila pneumoniae CWL029
gaucauggauucacaucuuaaaa

SEQ ID NO: 494791 - RNA, 21 nt, Chlamydophila pneumoniae CWL029
gaucaucuacgauguuuucuu

SEQ ID NO: 494792 - RNA, 23 nt, Chlamydophila pneumoniae CWL029
gaucaggauucuaaaaagaaaag

SEQ ID NO: 494793 - RNA, 15 nt, Chlamydophila pneumoniae CWL029
gaucauaaacagcag

SEQ ID NO: 494794 - RNA, 17 nt, Chlamydophila pneumoniae CWL029
gaucagaaaaaaugcgu

SEQ ID NO: 494795 - RNA, 13 nt, Chlamydophila pneumoniae CWL029
gauauuacagauu

SEQ ID NO: 494796 - RNA, 15 nt, Chlamydophila pneumoniae CWL029
gauaugcugaauucc

SEQ ID NO: 494797 - RNA, 13 nt, Chlamydophila pneumoniae CWL029
gauaucuuguaca

SEQ ID NO: 494798 - RNA, 21 nt, Chlamydophila pneumoniae CWL029
gauaucugcucccuccuccuc

SEQ ID NO: 494799 - RNA, 15 nt, Chlamydophila pneumoniae CWL029
gauaugaagagacgu

SEQ ID NO: 494800 - RNA, 16 nt, Chlamydophila pneumoniae CWL029
gauauauagagcagac

SEQ ID NO: 494801 - RNA, 15 nt, Chlamydophila pneumoniae CWL029
gauauagagagaguc

SEQ ID NO: 494802 - RNA, 23 nt, Chlamydophila pneumoniae CWL029
gauaggugagguuugugcugcuu

SEQ ID NO: 494803 - RNA, 17 nt, Chlamydophila pneumoniae CWL029
gauaggcuggaacuguu

SEQ ID NO: 494804 - RNA, 13 nt, Chlamydophila pneumoniae CWL029
gauagggaauuuc

SEQ ID NO: 494805 - RNA, 17 nt, Chlamydophila pneumoniae CWL029
gauagcaaugauguuuu

SEQ ID NO: 494806 - RNA, 17 nt, Chlamydophila pneumoniae CWL029
gauacucucagcaaaga

SEQ ID NO: 494807 - RNA, 20 nt, Chlamydophila pneumoniae CWL029
gauacuguuuuuuaucuccu

SEQ ID NO: 494808 - RNA, 19 nt, Chlamydophila pneumoniae CWL029
gauacuuguaccguaaaga

SEQ ID NO: 494809 - RNA, 18 nt, Chlamydophila pneumoniae CWL029
gauagagcuucuuuaucu

SEQ ID NO: 494810 - RNA, 18 nt, Chlamydophila pneumoniae CWL029
gauaagaacuuuagggaa

SEQ ID NO: 494811 - RNA, 16 nt, Chlamydophila pneumoniae CWL029
gauaagaccagaaagg

SEQ ID NO: 494812 - RNA, 13 nt, Chlamydophila pneumoniae CWL029
gauaagauaaaga

SEQ ID NO: 494813 - RNA, 17 nt, Chlamydophila pneumoniae CWL029
gaugcugaggacgcaga

SEQ ID NO: 494814 - RNA, 19 nt, Chlamydophila pneumoniae CWL029
gaugcuaaagagucuuccu

SEQ ID NO: 494815 - RNA, 13 nt, Chlamydophila pneumoniae CWL029
gaugcuaauaaaa

SEQ ID NO: 494816 - RNA, 15 nt, Chlamydophila pneumoniae CWL029
gaugcuacuuuccac

SEQ ID NO: 494817 - RNA, 18 nt, Chlamydophila pneumoniae CWL029
gaugcaucucuuaaaaca

SEQ ID NO: 494818 - RNA, 20 nt, Chlamydophila pneumoniae CWL029
gaugccauugaucagaaucu

SEQ ID NO: 494819 - RNA, 18 nt, Chlamydophila pneumoniae CWL029
gaugccauuguagagauu

SEQ ID NO: 494820 - RNA, 15 nt, Chlamydophila pneumoniae CWL029
gaugccaagaaauau

SEQ ID NO: 494821 - RNA, 21 nt, Chlamydophila pneumoniae CWL029
gaugauuuuuuaugacaaacu

SEQ ID NO: 494822 - RNA, 20 nt, Chlamydophila pneumoniae CWL029
gaugcaaauuccagaaaaag

SEQ ID NO: 494823 - RNA, 17 nt, Chlamydophila pneumoniae CWL029
gaugcaccauaauauaa

SEQ ID NO: 494824 - RNA, 16 nt, Chlamydophila pneumoniae CWL029
gaugcaggccaggaga

SEQ ID NO: 494825 - RNA, 22 nt, Chlamydophila pneumoniae CWL029
gaugcagcauuuguaagaauca

SEQ ID NO: 494826 - RNA, 16 nt, Chlamydophila pneumoniae CWL029
aaagccuuugcucacu

SEQ ID NO: 494827 - RNA, 14 nt, Chlamydophila pneumoniae CWL029
aaagccuuucuuau

SEQ ID NO: 494828 - RNA, 18 nt, Chlamydophila pneumoniae CWL029
aaagcgaccugcaaauga

SEQ ID NO: 494829 - RNA, 16 nt, Chlamydophila pneumoniae CWL029
aaagccucgaaauuuu

SEQ ID NO: 494830 - RNA, 18 nt, Chlamydophila pneumoniae CWL029
aaagccucgaaauuuuca

SEQ ID NO: 494831 - RNA, 16 nt, Chlamydophila pneumoniae CWL029
gaugagguaucccacg

SEQ ID NO: 494832 - RNA, 17 nt, Chlamydophila pneumoniae CWL029
gaugacagggaaagaac

SEQ ID NO: 494833 - RNA, 15 nt, Chlamydophila pneumoniae CWL029
gaugaccucaucucg

SEQ ID NO: 494834 - RNA, 23 nt, Chlamydophila pneumoniae CWL029
gaugaauccaaaauaaauagaag

SEQ ID NO: 494835 - RNA, 17 nt, Chlamydophila pneumoniae CWL029
gaugaacagccucugug

SEQ ID NO: 494836 - RNA, 12 nt, Chlamydophila pneumoniae CWL029
gaugaacauaau

SEQ ID NO: 494837 - RNA, 17 nt, Chlamydophila pneumoniae CWL029
gaugaaacuuuaggauu

SEQ ID NO: 494838 - RNA, 23 nt, Chlamydophila pneumoniae CWL029
gaucuuuucuacuucaggaaaua

SEQ ID NO: 494839 - RNA, 20 nt, Chlamydophila pneumoniae CWL029
gaucuuuucuuucuaagaua

SEQ ID NO: 494840 - RNA, 20 nt, Chlamydophila pneumoniae CWL029
gaucuuuuugccaguucuug

SEQ ID NO: 494841 - RNA, 21 nt, Chlamydophila pneumoniae CWL029
gaucuuuuugccaguucuuga

SEQ ID NO: 494842 - RNA, 16 nt, Chlamydophila pneumoniae CWL029
gaucuuuguugagaag

SEQ ID NO: 494843 - RNA, 17 nt, Chlamydophila pneumoniae CWL029
gaucuucagagagaaca

SEQ ID NO: 494844 - RNA, 19 nt, Chlamydophila pneumoniae CWL029
gaucuuauauaaaacuuau

SEQ ID NO: 494845 - RNA, 15 nt, Chlamydophila pneumoniae CWL029
gaucuucuaaaacac

SEQ ID NO: 494846 - RNA, 18 nt, Chlamydophila pneumoniae CWL029
gaucuucuauuuuuuugg

SEQ ID NO: 494847 - RNA, 23 nt, Chlamydophila pneumoniae CWL029
gaucuugcucaggagauacaagc

SEQ ID NO: 494848 - RNA, 18 nt, Chlamydophila pneumoniae CWL029
gaucuugagaaaagaaca

SEQ ID NO: 494849 - RNA, 16 nt, Chlamydophila pneumoniae CWL029
gauuaaagagacugug

SEQ ID NO: 494850 - RNA, 17 nt, Chlamydophila pneumoniae CWL029
gauguuuaugaaaaucu

SEQ ID NO: 494851 - RNA, 14 nt, Chlamydophila pneumoniae CWL029
gaugucuagaaaag

SEQ ID NO: 494852 - RNA, 20 nt, Chlamydophila pneumoniae CWL029
gaugugccgugacuccagaa

SEQ ID NO: 494853 - RNA, 20 nt, Chlamydophila pneumoniae CWL029
gaugugauguucugcugcuu

SEQ ID NO: 494854 - RNA, 21 nt, Chlamydophila pneumoniae CWL029
gaugugcggcgagcucuagga

SEQ ID NO: 494855 - RNA, 15 nt, Chlamydophila pneumoniae CWL029
gauguuaaggcuucc

SEQ ID NO: 494856 - RNA, 22 nt, Chlamydophila pneumoniae CWL029
gauguuauaagugacuuuucuu

SEQ ID NO: 494857 - RNA, 19 nt, Chlamydophila pneumoniae CWL029
gauuaggaacaagucggca

SEQ ID NO: 494858 - RNA, 13 nt, Chlamydophila pneumoniae CWL029
gauuaguaaugau

SEQ ID NO: 494859 - RNA, 15 nt, Chlamydophila pneumoniae CWL029
gauuaguucucuaag

SEQ ID NO: 494860 - RNA, 20 nt, Chlamydophila pneumoniae CWL029
gauuaguucucuaagacugu

SEQ ID NO: 494861 - RNA, 15 nt, Chlamydophila pneumoniae CWL029
gauuaugaugccuca

SEQ ID NO: 494862 - RNA, 14 nt, Chlamydophila pneumoniae CWL029
gauuauucuagagu

SEQ ID NO: 494863 - RNA, 18 nt, Chlamydophila pneumoniae CWL029
gauuagaaaagauaaaac

SEQ ID NO: 494864 - RNA, 23 nt, Chlamydophila pneumoniae CWL029
gauguaacuaguaacuuaaucaa

SEQ ID NO: 494865 - RNA, 21 nt, Chlamydophila pneumoniae CWL029
gaugguugcuucuaagaaacu

SEQ ID NO: 494866 - RNA, 14 nt, Chlamydophila pneumoniae CWL029
gaugcuucuuucaa

SEQ ID NO: 494867 - RNA, 19 nt, Chlamydophila pneumoniae CWL029
gaugcuuagcaaaggcaac

SEQ ID NO: 494868 - RNA, 17 nt, Chlamydophila pneumoniae CWL029
gaugcuugugagaugaa

SEQ ID NO: 494869 - RNA, 21 nt, Chlamydophila pneumoniae CWL029
gauggaguuucuuauucacug

SEQ ID NO: 494870 - RNA, 18 nt, Chlamydophila pneumoniae CWL029
gauggcauagcgaaaguc

SEQ ID NO: 494871 - RNA, 14 nt, Chlamydophila pneumoniae CWL029
gauggcaaggaaaa

SEQ ID NO: 494872 - RNA, 20 nt, Chlamydophila pneumoniae CWL029
gauuuuacucccugaaguug

SEQ ID NO: 494873 - RNA, 13 nt, Chlamydophila pneumoniae CWL029
gauuuuaaaauga

SEQ ID NO: 494874 - RNA, 21 nt, Chlamydophila pneumoniae CWL029
gauuuucuagaaacaacugaa

SEQ ID NO: 494875 - RNA, 17 nt, Chlamydophila pneumoniae CWL029
gauuuucuagaaacaac

SEQ ID NO: 494876 - RNA, 19 nt, Chlamydophila pneumoniae CWL029
gauuuucgguuacuuuaau

SEQ ID NO: 494877 - RNA, 15 nt, Chlamydophila pneumoniae CWL029
gauuuccuuuuggga

SEQ ID NO: 494878 - RNA, 23 nt, Chlamydophila pneumoniae CWL029
gauuucguauagcuggcaaugau

SEQ ID NO: 494879 - RNA, 14 nt, Chlamydophila pneumoniae CWL029
gauuucuucuucag

SEQ ID NO: 494880 - RNA, 16 nt, Chlamydophila pneumoniae CWL029
gauuucuucuucagag

SEQ ID NO: 494881 - RNA, 16 nt, Chlamydophila pneumoniae CWL029
gauuucuccagcagcu

SEQ ID NO: 494882 - RNA, 14 nt, Chlamydophila pneumoniae CWL029
gauuucuuuuucag

SEQ ID NO: 494883 - RNA, 14 nt, Chlamydophila pneumoniae CWL029
gauuugcauuaccu

SEQ ID NO: 494884 - RNA, 18 nt, Chlamydophila pneumoniae CWL029
gauuuggaagauugaagg

SEQ ID NO: 494885 - RNA, 15 nt, Chlamydophila pneumoniae CWL029
gauugugcucaauac

SEQ ID NO: 494886 - RNA, 17 nt, Chlamydophila pneumoniae CWL029
gauuguuauugaguguu

SEQ ID NO: 494887 - RNA, 18 nt, Chlamydophila pneumoniae CWL029
gauuguucaaaaauagau

SEQ ID NO: 494888 - RNA, 19 nt, Chlamydophila pneumoniae CWL029
gauuguagagacauagccu

SEQ ID NO: 494889 - RNA, 14 nt, Chlamydophila pneumoniae CWL029
gauugguaaggaga

SEQ ID NO: 494890 - RNA, 15 nt, Chlamydophila pneumoniae CWL029
gauuguaaaaguagc

SEQ ID NO: 494891 - RNA, 22 nt, Chlamydophila pneumoniae CWL029
gauuuaaaagguuuugaagcuc

SEQ ID NO: 494892 - RNA, 15 nt, Chlamydophila pneumoniae CWL029
gauuuauguuuucuc

SEQ ID NO: 494893 - RNA, 20 nt, Chlamydophila pneumoniae CWL029
gauuuccccuucagaggcua

SEQ ID NO: 494894 - RNA, 17 nt, Chlamydophila pneumoniae CWL029
gauuuccuagguucuuu

SEQ ID NO: 494895 - RNA, 18 nt, Chlamydophila pneumoniae CWL029
gauuuccuuaagcuucug

SEQ ID NO: 494896 - RNA, 14 nt, Chlamydophila pneumoniae CWL029
gauuggaugagaau

SEQ ID NO: 494897 - RNA, 15 nt, Chlamydophila pneumoniae CWL029
gauuggaugagaauu

SEQ ID NO: 494898 - RNA, 13 nt, Chlamydophila pneumoniae CWL029
gauugcuaagcau

SEQ ID NO: 494899 - RNA, 13 nt, Chlamydophila pneumoniae CWL029
gauugccaggaga

SEQ ID NO: 494900 - RNA, 13 nt, Chlamydophila pneumoniae CWL029
gauucugcccaaa

SEQ ID NO: 494901 - RNA, 16 nt, Chlamydophila pneumoniae CWL029
gauucugcccaaagcu

SEQ ID NO: 494902 - RNA, 17 nt, Chlamydophila pneumoniae CWL029
gauucuccgucccccgg

SEQ ID NO: 494903 - RNA, 15 nt, Chlamydophila pneumoniae CWL029
gauucugaagagaga

SEQ ID NO: 494904 - RNA, 21 nt, Chlamydophila pneumoniae CWL029
gauucuccagcuucuuucuag

SEQ ID NO: 494905 - RNA, 16 nt, Chlamydophila pneumoniae CWL029
gauucucguguagaau

SEQ ID NO: 494906 - RNA, 18 nt, Chlamydophila pneumoniae CWL029
gauucucguguagaauuc

SEQ ID NO: 494907 - RNA, 15 nt, Chlamydophila pneumoniae CWL029
gauucuuuaaucuau

SEQ ID NO: 494908 - RNA, 23 nt, Chlamydophila pneumoniae CWL029
gauugaaacuuuuuuucuucucu

SEQ ID NO: 494909 - RNA, 19 nt, Chlamydophila pneumoniae CWL029
gauucaguuccucauccuc

SEQ ID NO: 494910 - RNA, 23 nt, Chlamydophila pneumoniae CWL029
gauuccaaugacgggagcucuuu

SEQ ID NO: 494911 - RNA, 17 nt, Chlamydophila pneumoniae CWL029
gauucaaugcagcuaac

SEQ ID NO: 494912 - RNA, 22 nt, Chlamydophila pneumoniae CWL029
gauucaaugcagcuaacgaagc

SEQ ID NO: 494913 - RNA, 11 nt, Chlamydophila pneumoniae CWL029
gauucaccaag

SEQ ID NO: 494914 - RNA, 14 nt, Chlamydophila pneumoniae CWL029
gauucuaaaucaac

SEQ ID NO: 494915 - RNA, 13 nt, Chlamydophila pneumoniae CWL029
gauucuacaaauu

SEQ ID NO: 494916 - RNA, 20 nt, Chlamydophila pneumoniae CWL029
gauucgcuacauaaaaugag

SEQ ID NO: 494917 - RNA, 16 nt, Chlamydophila pneumoniae CWL029
gauucccugcggacag

SEQ ID NO: 494918 - RNA, 14 nt, Chlamydophila pneumoniae CWL029
gauuccuagaaucu

SEQ ID NO: 494919 - RNA, 19 nt, Chlamydophila pneumoniae CWL029
gauuccugucauuccuaag

SEQ ID NO: 494920 - RNA, 14 nt, Chlamydophila pneumoniae CWL029
gauucgaaagaacu

SEQ ID NO: 494921 - RNA, 12 nt, Chlamydophila pneumoniae CWL029
gcaacaaccaaa

SEQ ID NO: 494922 - RNA, 20 nt, Chlamydophila pneumoniae CWL029
gcaacaaccaaaagaauucc

SEQ ID NO: 494923 - RNA, 16 nt, Chlamydophila pneumoniae CWL029
gcaacaaucuuucuuc

SEQ ID NO: 494924 - RNA, 18 nt, Chlamydophila pneumoniae CWL029
gcaacaaucuuucuucua

SEQ ID NO: 494925 - RNA, 17 nt, Chlamydophila pneumoniae CWL029
gcaacauccauucuuaa

SEQ ID NO: 494926 - RNA, 23 nt, Chlamydophila pneumoniae CWL029
gcaacauccauucuuaauauaaa

SEQ ID NO: 494927 - RNA, 11 nt, Chlamydophila pneumoniae CWL029
gcaaauauagu

SEQ ID NO: 494928 - RNA, 17 nt, Chlamydophila pneumoniae CWL029
gcaaaguuaaaccuuuu

SEQ ID NO: 494929 - RNA, 22 nt, Chlamydophila pneumoniae CWL029
gcaaaggaccacaauuccuaaa

SEQ ID NO: 494930 - RNA, 18 nt, Chlamydophila pneumoniae CWL029
gcaaaguacuacaauaac

SEQ ID NO: 494931 - RNA, 14 nt, Chlamydophila pneumoniae CWL029
gcaaagauaaagaa

SEQ ID NO: 494932 - RNA, 21 nt, Chlamydophila pneumoniae CWL029
gcaaaggaccacaauuccuaa

SEQ ID NO: 494933 - RNA, 18 nt, Chlamydophila pneumoniae CWL029
gcaaagcccccuccccca

SEQ ID NO: 494934 - RNA, 15 nt, Chlamydophila pneumoniae CWL029
gcaaagcccccuccc

SEQ ID NO: 494935 - RNA, 21 nt, Chlamydophila pneumoniae CWL029
gcaaacuccccaguuuuccau

SEQ ID NO: 494936 - RNA, 21 nt, Chlamydophila pneumoniae CWL029
gcaaacgcaaugauuucucua

SEQ ID NO: 494937 - RNA, 17 nt, Chlamydophila pneumoniae CWL029
gcaaacggagagcauuu

SEQ ID NO: 494938 - RNA, 14 nt, Chlamydophila pneumoniae CWL029
gcaaacagguauuu

SEQ ID NO: 494939 - RNA, 17 nt, Chlamydophila pneumoniae CWL029
gcaaacacaauuguaaa

SEQ ID NO: 494940 - RNA, 21 nt, Chlamydophila pneumoniae CWL029
gcaaaaugcgaggaaaaagga

SEQ ID NO: 494941 - RNA, 22 nt, Chlamydophila pneumoniae CWL029
gcaaaaugguuguuaggacgug

SEQ ID NO: 494942 - RNA, 17 nt, Chlamydophila pneumoniae CWL029
gcaaaagcaaggcugcc

SEQ ID NO: 494943 - RNA, 13 nt, Chlamydophila pneumoniae CWL029
gcaaaaagcuucu

SEQ ID NO: 494944 - RNA, 17 nt, Chlamydophila pneumoniae CWL029
gcaaaaaguuucaaucu

SEQ ID NO: 494945 - RNA, 21 nt, Chlamydophila pneumoniae CWL029
gauuuuugcuaagagcucuuu

SEQ ID NO: 494946 - RNA, 16 nt, Chlamydophila pneumoniae CWL029
gauuuuuagaauagaa

SEQ ID NO: 494947 - RNA, 18 nt, Chlamydophila pneumoniae CWL029
gauuuuuagaauagaaga

SEQ ID NO: 494948 - RNA, 21 nt, Chlamydophila pneumoniae CWL029
gauuuugcagugauaaaccaa

SEQ ID NO: 494949 - RNA, 22 nt, Chlamydophila pneumoniae CWL029
gcauagagagaaggaauuaaaa

SEQ ID NO: 494950 - RNA, 17 nt, Chlamydophila pneumoniae CWL029
gcauagcccgaaauuca

SEQ ID NO: 494951 - RNA, 22 nt, Chlamydophila pneumoniae CWL029
gcauagcccgaaauucauuaaa

SEQ ID NO: 494952 - RNA, 18 nt, Chlamydophila pneumoniae CWL029
gcauagcgagaacaccau

SEQ ID NO: 494953 - RNA, 21 nt, Chlamydophila pneumoniae CWL029
gcauagcgagaacaccauaaa

SEQ ID NO: 494954 - RNA, 21 nt, Chlamydophila pneumoniae CWL029
gcauaaggauucugagaaguu

SEQ ID NO: 494955 - RNA, 15 nt, Chlamydophila pneumoniae CWL029
gcauaaguuagccug

SEQ ID NO: 494956 - RNA, 17 nt, Chlamydophila pneumoniae CWL029
gcauaaucucaccagaa

SEQ ID NO: 494957 - RNA, 13 nt, Chlamydophila pneumoniae CWL029
gcauaauccugaa

SEQ ID NO: 494958 - RNA, 15 nt, Chlamydophila pneumoniae CWL029
gcauaauccugaaug

SEQ ID NO: 494959 - RNA, 15 nt, Chlamydophila pneumoniae CWL029
gcauaugcuccagaa

SEQ ID NO: 494960 - RNA, 18 nt, Chlamydophila pneumoniae CWL029
gcauauugccuucuucuu

SEQ ID NO: 494961 - RNA, 13 nt, Chlamydophila pneumoniae CWL029
gcaucucucucca

SEQ ID NO: 494962 - RNA, 14 nt, Chlamydophila pneumoniae CWL029
gcaucuagagucuc

SEQ ID NO: 494963 - RNA, 13 nt, Chlamydophila pneumoniae CWL029
gcaucuaagccag

SEQ ID NO: 494964 - RNA, 13 nt, Chlamydophila pneumoniae CWL029
gcaucuagagucu

SEQ ID NO: 494965 - RNA, 13 nt, Chlamydophila pneumoniae CWL029
gcaucauugaaac

SEQ ID NO: 494966 - RNA, 17 nt, Chlamydophila pneumoniae CWL029
gccaaagaacagcacuc

SEQ ID NO: 494967 - RNA, 12 nt, Chlamydophila pneumoniae CWL029
gcauuuucucug

SEQ ID NO: 494968 - RNA, 19 nt, Chlamydophila pneumoniae CWL029
gcauuuucucugagcagcu

SEQ ID NO: 494969 - RNA, 17 nt, Chlamydophila pneumoniae CWL029
gcauuuucuucuugcaa

SEQ ID NO: 494970 - RNA, 19 nt, Chlamydophila pneumoniae CWL029
gcauuuuacgaaucuuuuu

SEQ ID NO: 494971 - RNA, 19 nt, Chlamydophila pneumoniae CWL029
gcauuugccccuaacuggc

SEQ ID NO: 494972 - RNA, 21 nt, Chlamydophila pneumoniae CWL029
gcauuugccccuuccaauacu

SEQ ID NO: 494973 - RNA, 22 nt, Chlamydophila pneumoniae CWL029
gcauuccaggacguaaaaagaa

SEQ ID NO: 494974 - RNA, 18 nt, Chlamydophila pneumoniae CWL029
gcauuacgguuucuggga

SEQ ID NO: 494975 - RNA, 18 nt, Chlamydophila pneumoniae CWL029
gcauugccauaauaaagg

SEQ ID NO: 494976 - RNA, 13 nt, Chlamydophila pneumoniae CWL029
gcauugcaaauaa

SEQ ID NO: 494977 - RNA, 18 nt, Chlamydophila pneumoniae CWL029
gcauuggaaaucuuauaa

SEQ ID NO: 494978 - RNA, 22 nt, Chlamydophila pneumoniae CWL029
gcauuggacaacgcuucuuuuu

SEQ ID NO: 494979 - RNA, 16 nt, Chlamydophila pneumoniae CWL029
gcaugucguaggaagu

SEQ ID NO: 494980 - RNA, 16 nt, Chlamydophila pneumoniae CWL029
gcauggacuccaagaa

SEQ ID NO: 494981 - RNA, 22 nt, Chlamydophila pneumoniae CWL029
gcauggagaauaaucucuuuca

SEQ ID NO: 494982 - RNA, 16 nt, Chlamydophila pneumoniae CWL029
gcauggauccuucauc

SEQ ID NO: 494983 - RNA, 23 nt, Chlamydophila pneumoniae CWL029
gcauggauccuucaucagcuucc

SEQ ID NO: 494984 - RNA, 20 nt, Chlamydophila pneumoniae CWL029
gcaucuuauggaagagagca

SEQ ID NO: 494985 - RNA, 22 nt, Chlamydophila pneumoniae CWL029
gcaugcaucuuaucaagagcuc

SEQ ID NO: 494986 - RNA, 16 nt, Chlamydophila pneumoniae CWL029
gcaguuccgauaaaga

SEQ ID NO: 494987 - RNA, 19 nt, Chlamydophila pneumoniae CWL029
gcauaaccuuugacaacac

SEQ ID NO: 494988 - RNA, 18 nt, Chlamydophila pneumoniae CWL029
gcauaaacaaagcgucua

SEQ ID NO: 494989 - RNA, 16 nt, Chlamydophila pneumoniae CWL029
gcaguugcaauaccaa

SEQ ID NO: 494990 - RNA, 14 nt, Chlamydophila pneumoniae CWL029
gcaguuguacaauu

SEQ ID NO: 494991 - RNA, 21 nt, Chlamydophila pneumoniae CWL029
gcagugaaauuuugcaacaaa

SEQ ID NO: 494992 - RNA, 14 nt, Chlamydophila pneumoniae CWL029
gcagucucaggaaa

SEQ ID NO: 494993 - RNA, 23 nt, Chlamydophila pneumoniae CWL029
gcaguauagagaagauuucuaua

SEQ ID NO: 494994 - RNA, 22 nt, Chlamydophila pneumoniae CWL029
gcagguuugggugcuaaguugu

SEQ ID NO: 494995 - RNA, 18 nt, Chlamydophila pneumoniae CWL029
gcagcuucuggagaaaaa

SEQ ID NO: 494996 - RNA, 18 nt, Chlamydophila pneumoniae CWL029
gcagcuagaggcaaacag

SEQ ID NO: 494997 - RNA, 23 nt, Chlamydophila pneumoniae CWL029
gccaggagacuaaaagaauaaua

SEQ ID NO: 494998 - RNA, 23 nt, Chlamydophila pneumoniae CWL029
gccagcagcgaggaguuuuccaa

SEQ ID NO: 494999 - RNA, 17 nt, Chlamydophila pneumoniae CWL029
gccagagauucuucaca

SEQ ID NO: 495000 - RNA, 12 nt, Chlamydophila pneumoniae CWL029
gccagcagaagg

SEQ ID NO: 495001 - RNA, 20 nt, Chlamydophila pneumoniae CWL029
gccagcagaaguuccuucag

SEQ ID NO: 495002 - RNA, 15 nt, Chlamydophila pneumoniae CWL029
gccaaauaucucugg

SEQ ID NO: 495003 - RNA, 22 nt, Chlamydophila pneumoniae CWL029
aaagcucuccuucagaguugau

SEQ ID NO: 495004 - RNA, 18 nt, Chlamydophila pneumoniae CWL029
aaagcucuuucauaagau

SEQ ID NO: 495005 - RNA, 16 nt, Chlamydophila pneumoniae CWL029
aaagcugaauccaggu

SEQ ID NO: 495006 - RNA, 20 nt, Chlamydophila pneumoniae CWL029
gccgacucuacaucuucuug

SEQ ID NO: 495007 - RNA, 16 nt, Chlamydophila pneumoniae CWL029
gccgaaccaaaaugag

SEQ ID NO: 495008 - RNA, 19 nt, Chlamydophila pneumoniae CWL029
gcccugucacuaucuucua

SEQ ID NO: 495009 - RNA, 18 nt, Chlamydophila pneumoniae CWL029
gcccuugaaucauagaga

SEQ ID NO: 495010 - RNA, 17 nt, Chlamydophila pneumoniae CWL029
gcccauuaacuaagaua

SEQ ID NO: 495011 - RNA, 17 nt, Chlamydophila pneumoniae CWL029
gccccgaauuguauucg

SEQ ID NO: 495012 - RNA, 22 nt, Chlamydophila pneumoniae CWL029
gccccuuccaauacuaaaacua

SEQ ID NO: 495013 - RNA, 14 nt, Chlamydophila pneumoniae CWL029
gcccaaagcuaaaa

SEQ ID NO: 495014 - RNA, 18 nt, Chlamydophila pneumoniae CWL029
gccaucuucuucuaggau

SEQ ID NO: 495015 - RNA, 14 nt, Chlamydophila pneumoniae CWL029
gccaucaucaccag

SEQ ID NO: 495016 - RNA, 12 nt, Chlamydophila pneumoniae CWL029
gcgggcucaaag

SEQ ID NO: 495017 - RNA, 15 nt, Chlamydophila pneumoniae CWL029
gcgggcucaaagaaa

SEQ ID NO: 495018 - RNA, 14 nt, Chlamydophila pneumoniae CWL029
gcggcuuuuugcaa

SEQ ID NO: 495019 - RNA, 15 nt, Chlamydophila pneumoniae CWL029
gcgcugugaggaaaa

SEQ ID NO: 495020 - RNA, 16 nt, Chlamydophila pneumoniae CWL029
gcggaagcaccgccug

SEQ ID NO: 495021 - RNA, 20 nt, Chlamydophila pneumoniae CWL029
gcggaauacuucuccucgca

SEQ ID NO: 495022 - RNA, 22 nt, Chlamydophila pneumoniae CWL029
gcggcaacaagagcgcauuuua

SEQ ID NO: 495023 - RNA, 14 nt, Chlamydophila pneumoniae CWL029
gcgcccgagcuucc

SEQ ID NO: 495024 - RNA, 17 nt, Chlamydophila pneumoniae CWL029
gcgccgcauuacaggga

SEQ ID NO: 495025 - RNA, 18 nt, Chlamydophila pneumoniae CWL029
gcgccuccaccugcagcg

SEQ ID NO: 495026 - RNA, 12 nt, Chlamydophila pneumoniae CWL029
gcgccuccaccu

SEQ ID NO: 495027 - RNA, 12 nt, Chlamydophila pneumoniae CWL029
gcgcauuuuuuc

SEQ ID NO: 495028 - RNA, 21 nt, Chlamydophila pneumoniae CWL029
gcgcagcuucuggagaaaaaa

SEQ ID NO: 495029 - RNA, 18 nt, Chlamydophila pneumoniae CWL029
gcgcaccccaagcucaag

SEQ ID NO: 495030 - RNA, 16 nt, Chlamydophila pneumoniae CWL029
gcgauaucuauaaaug

SEQ ID NO: 495031 - RNA, 15 nt, Chlamydophila pneumoniae CWL029
gcgauaguaaacaga

SEQ ID NO: 495032 - RNA, 23 nt, Chlamydophila pneumoniae CWL029
gcgagccauagaggaaugauccc

SEQ ID NO: 495033 - RNA, 18 nt, Chlamydophila pneumoniae CWL029
gcgaagggaggagaacuu

SEQ ID NO: 495034 - RNA, 14 nt, Chlamydophila pneumoniae CWL029
gccuuuuucuugau

SEQ ID NO: 495035 - RNA, 22 nt, Chlamydophila pneumoniae CWL029
gccuuuuucuugauuagagaau

SEQ ID NO: 495036 - RNA, 17 nt, Chlamydophila pneumoniae CWL029
gccuuuuccuaaaucug

SEQ ID NO: 495037 - RNA, 20 nt, Chlamydophila pneumoniae CWL029
gccuuuuccuaaaucugcuu

SEQ ID NO: 495038 - RNA, 13 nt, Chlamydophila pneumoniae CWL029
gcgaaccaaaguc

SEQ ID NO: 495039 - RNA, 12 nt, Chlamydophila pneumoniae CWL029
gccuuuucagau

SEQ ID NO: 495040 - RNA, 19 nt, Chlamydophila pneumoniae CWL029
gccuucucauugcggcacc

SEQ ID NO: 495041 - RNA, 13 nt, Chlamydophila pneumoniae CWL029
gccuuaaauguau

SEQ ID NO: 495042 - RNA, 22 nt, Chlamydophila pneumoniae CWL029
gccugucuauaaaauaaauuuu

SEQ ID NO: 495043 - RNA, 15 nt, Chlamydophila pneumoniae CWL029
gccuggcuaaaggau

SEQ ID NO: 495044 - RNA, 23 nt, Chlamydophila pneumoniae CWL029
gccuggggaucuuaggaaauuug

SEQ ID NO: 495045 - RNA, 13 nt, Chlamydophila pneumoniae CWL029
gccucuccuugag

SEQ ID NO: 495046 - RNA, 19 nt, Chlamydophila pneumoniae CWL029
gccuggccaucaucaccag

SEQ ID NO: 495047 - RNA, 15 nt, Chlamydophila pneumoniae CWL029
gccucccgaagacaa

SEQ ID NO: 495048 - RNA, 18 nt, Chlamydophila pneumoniae CWL029
gccuauagaaauuagagu

SEQ ID NO: 495049 - RNA, 15 nt, Chlamydophila pneumoniae CWL029
gccuccaccugcagc

SEQ ID NO: 495050 - RNA, 20 nt, Chlamydophila pneumoniae CWL029
gccuccaccugcagcgcagc

SEQ ID NO: 495051 - RNA, 12 nt, Chlamydophila pneumoniae CWL029
gccuacaauacu

SEQ ID NO: 495052 - RNA, 14 nt, Chlamydophila pneumoniae CWL029
gccuagcuuucuug

SEQ ID NO: 495053 - RNA, 16 nt, Chlamydophila pneumoniae CWL029
gccgugcucuuauguu

SEQ ID NO: 495054 - RNA, 21 nt, Chlamydophila pneumoniae CWL029
gccguauagauuuuccgcaaa

SEQ ID NO: 495055 - RNA, 17 nt, Chlamydophila pneumoniae CWL029
ggucaggagguggugga

SEQ ID NO: 495056 - RNA, 22 nt, Chlamydophila pneumoniae CWL029
ggucacuauagaucucuugaag

SEQ ID NO: 495057 - RNA, 21 nt, Chlamydophila pneumoniae CWL029
ggucacuucaauuacaggagc

SEQ ID NO: 495058 - RNA, 15 nt, Chlamydophila pneumoniae CWL029
ggucacagcauuuuc

SEQ ID NO: 495059 - RNA, 14 nt, Chlamydophila pneumoniae CWL029
gguccaaacccugg

SEQ ID NO: 495060 - RNA, 18 nt, Chlamydophila pneumoniae CWL029
ggucgcaucaaugacugu

SEQ ID NO: 495061 - RNA, 18 nt, Chlamydophila pneumoniae CWL029
ggucgagaaccuccacca

SEQ ID NO: 495062 - RNA, 13 nt, Chlamydophila pneumoniae CWL029
gguaauuuuucag

SEQ ID NO: 495063 - RNA, 19 nt, Chlamydophila pneumoniae CWL029
gguagcagaguuuuucccu

SEQ ID NO: 495064 - RNA, 20 nt, Chlamydophila pneumoniae CWL029
gguagcagaguuuuucccuc

SEQ ID NO: 495065 - RNA, 15 nt, Chlamydophila pneumoniae CWL029
gguagagcuagaaug

SEQ ID NO: 495066 - RNA, 19 nt, Chlamydophila pneumoniae CWL029
gguagcuaaauuuagagaa

SEQ ID NO: 495067 - RNA, 22 nt, Chlamydophila pneumoniae CWL029
gguagcgucucuucuuccucua

SEQ ID NO: 495068 - RNA, 21 nt, Chlamydophila pneumoniae CWL029
gguagcccugcaccaauugca

SEQ ID NO: 495069 - RNA, 20 nt, Chlamydophila pneumoniae CWL029
gguaucuccuugauaaaacg

SEQ ID NO: 495070 - RNA, 22 nt, Chlamydophila pneumoniae CWL029
gguauuaggaaguaguggacua

SEQ ID NO: 495071 - RNA, 24 nt, Chlamydophila pneumoniae CWL029
gguaguuugccuucuuaucuucua

SEQ ID NO: 495072 - RNA, 14 nt, Chlamydophila pneumoniae CWL029
gguaaagagcuucu

SEQ ID NO: 495073 - RNA, 19 nt, Chlamydophila pneumoniae CWL029
gguaaagagcuucuucuaa

SEQ ID NO: 495074 - RNA, 14 nt, Chlamydophila pneumoniae CWL029
gguaaaacuacagg

SEQ ID NO: 495075 - RNA, 16 nt, Chlamydophila pneumoniae CWL029
ggguucaauuccuuuc

SEQ ID NO: 495076 - RNA, 15 nt, Chlamydophila pneumoniae CWL029
gggucuacaacaguu

SEQ ID NO: 495077 - RNA, 22 nt, Chlamydophila pneumoniae CWL029
gggguucccucuccuugaaaau

SEQ ID NO: 495078 - RNA, 18 nt, Chlamydophila pneumoniae CWL029
ggguaaguccacaagccu

SEQ ID NO: 495079 - RNA, 22 nt, Chlamydophila pneumoniae CWL029
ggggaucuuaggaaauuuggau

SEQ ID NO: 495080 - RNA, 15 nt, Chlamydophila pneumoniae CWL029
ggggauuaucccaaa

SEQ ID NO: 495081 - RNA, 15 nt, Chlamydophila pneumoniae CWL029
ggggauugauaacaa

SEQ ID NO: 495082 - RNA, 15 nt, Chlamydophila pneumoniae CWL029
ggggcaguuccuaaa

SEQ ID NO: 495083 - RNA, 13 nt, Chlamydophila pneumoniae CWL029
gggcuacaauacg

SEQ ID NO: 495084 - RNA, 22 nt, Chlamydophila pneumoniae CWL029
gggccagcgcauuaacgucauc

SEQ ID NO: 495085 - RNA, 18 nt, Chlamydophila pneumoniae CWL029
gggcaauauauccaggau

SEQ ID NO: 495086 - RNA, 14 nt, Chlamydophila pneumoniae CWL029
gggauggucaggaa

SEQ ID NO: 495087 - RNA, 16 nt, Chlamydophila pneumoniae CWL029
gggaucuucagagaga

SEQ ID NO: 495088 - RNA, 17 nt, Chlamydophila pneumoniae CWL029
gggaucuucagagagaa

SEQ ID NO: 495089 - RNA, 16 nt, Chlamydophila pneumoniae CWL029
gggauccugcaaagcc

SEQ ID NO: 495090 - RNA, 14 nt, Chlamydophila pneumoniae CWL029
gggaucacagucuu

SEQ ID NO: 495091 - RNA, 21 nt, Chlamydophila pneumoniae CWL029
gggauaaaacuauaaaagcca

SEQ ID NO: 495092 - RNA, 20 nt, Chlamydophila pneumoniae CWL029
gggauaaugcucacuucuuu

SEQ ID NO: 495093 - RNA, 15 nt, Chlamydophila pneumoniae CWL029
gggagcuagaaaguc

SEQ ID NO: 495094 - RNA, 16 nt, Chlamydophila pneumoniae CWL029
gggaggaauuccucuc

SEQ ID NO: 495095 - RNA, 14 nt, Chlamydophila pneumoniae CWL029
gggagagccauuuu

SEQ ID NO: 495096 - RNA, 22 nt, Chlamydophila pneumoniae CWL029
gggaauuaaacuuucuucucua

SEQ ID NO: 495097 - RNA, 23 nt, Chlamydophila pneumoniae CWL029
gggaauuaaacuuucuucucuag

SEQ ID NO: 495098 - RNA, 18 nt, Chlamydophila pneumoniae CWL029
gggaauaaaaaugguaau

SEQ ID NO: 495099 - RNA, 17 nt, Chlamydophila pneumoniae CWL029
gggaagacucucaucag

SEQ ID NO: 495100 - RNA, 19 nt, Chlamydophila pneumoniae CWL029
gggaagaaacuucucuagg

SEQ ID NO: 495101 - RNA, 20 nt, Chlamydophila pneumoniae CWL029
gggaagccuggaaaugaaua

SEQ ID NO: 495102 - RNA, 21 nt, Chlamydophila pneumoniae CWL029
gggaacaacugugguuuuaaa

SEQ ID NO: 495103 - RNA, 18 nt, Chlamydophila pneumoniae CWL029
gggaaauaccccaucuaa

SEQ ID NO: 495104 - RNA, 15 nt, Chlamydophila pneumoniae CWL029
gggaaaggucgggga

SEQ ID NO: 495105 - RNA, 11 nt, Chlamydophila pneumoniae CWL029
gggaaaaugcg

SEQ ID NO: 495106 - RNA, 18 nt, Chlamydophila pneumoniae CWL029
ggcuuuucuuuuucuagg

SEQ ID NO: 495107 - RNA, 15 nt, Chlamydophila pneumoniae CWL029
ggcuuuucuaaagcg

SEQ ID NO: 495108 - RNA, 20 nt, Chlamydophila pneumoniae CWL029
ggcuuugggcaucucucuuu

SEQ ID NO: 495109 - RNA, 20 nt, Chlamydophila pneumoniae CWL029
ggcuuugccuuuagagacgc

SEQ ID NO: 495110 - RNA, 20 nt, Chlamydophila pneumoniae CWL029
ggcuuuaaguguuucuucau

SEQ ID NO: 495111 - RNA, 22 nt, Chlamydophila pneumoniae CWL029
ggcuucagagauuuuaaagccu

SEQ ID NO: 495112 - RNA, 13 nt, Chlamydophila pneumoniae CWL029
ggcuuaagucuug

SEQ ID NO: 495113 - RNA, 21 nt, Chlamydophila pneumoniae CWL029
ggcuggaaagccaagcuucca

SEQ ID NO: 495114 - RNA, 16 nt, Chlamydophila pneumoniae CWL029
ggcugucuugaccaau

SEQ ID NO: 495115 - RNA, 15 nt, Chlamydophila pneumoniae CWL029
ggcucuuuuagagcc

SEQ ID NO: 495116 - RNA, 19 nt, Chlamydophila pneumoniae CWL029
ggcugagacauauugaaga

SEQ ID NO: 495117 - RNA, 14 nt, Chlamydophila pneumoniae CWL029
ggcugagagaagca

SEQ ID NO: 495118 - RNA, 23 nt, Chlamydophila pneumoniae CWL029
ggcucucgacacuauguguuucc

SEQ ID NO: 495119 - RNA, 12 nt, Chlamydophila pneumoniae CWL029
ggcuccagcaua

SEQ ID NO: 495120 - RNA, 14 nt, Chlamydophila pneumoniae CWL029
aaauacgcuuuucu

SEQ ID NO: 495121 - RNA, 18 nt, Chlamydophila pneumoniae CWL029
aaauagaaaggaaucccu

SEQ ID NO: 495122 - RNA, 14 nt, Chlamydophila pneumoniae CWL029
aaauagaaaacaua

SEQ ID NO: 495123 - RNA, 17 nt, Chlamydophila pneumoniae CWL029
aaauacagccagcagaa

SEQ ID NO: 495124 - RNA, 22 nt, Chlamydophila pneumoniae CWL029
aaauaauuuuauuaguuacuga

SEQ ID NO: 495125 - RNA, 20 nt, Chlamydophila pneumoniae CWL029
aaauaaguccuguuugaaaa

SEQ ID NO: 495126 - RNA, 18 nt, Chlamydophila pneumoniae CWL029
aaauaagccaguacuaaa

SEQ ID NO: 495127 - RNA, 18 nt, Chlamydophila pneumoniae CWL029
aaauaaucuucaaaagac

SEQ ID NO: 495128 - RNA, 18 nt, Chlamydophila pneumoniae CWL029
ggcccgauacaaauagcu

SEQ ID NO: 495129 - RNA, 14 nt, Chlamydophila pneumoniae CWL029
ggccccuggaauuu

SEQ ID NO: 495130 - RNA, 21 nt, Chlamydophila pneumoniae CWL029
aaaguccuccauguacaguuu

SEQ ID NO: 495131 - RNA, 14 nt, Chlamydophila pneumoniae CWL029
ggcauucaggagca

SEQ ID NO: 495132 - RNA, 15 nt, Chlamydophila pneumoniae CWL029
aaaguccaagaucaa

SEQ ID NO: 495133 - RNA, 20 nt, Chlamydophila pneumoniae CWL029
aaaguccaagaucaaacgaa

SEQ ID NO: 495134 - RNA, 22 nt, Chlamydophila pneumoniae CWL029
aaagucaaauacuucuccugaa

SEQ ID NO: 495135 - RNA, 14 nt, Chlamydophila pneumoniae CWL029
ggcaucuagagucu

SEQ ID NO: 495136 - RNA, 13 nt, Chlamydophila pneumoniae CWL029
ggcaucuaagcca

SEQ ID NO: 495137 - RNA, 18 nt, Chlamydophila pneumoniae CWL029
ggcagguagucccuuucu

SEQ ID NO: 495138 - RNA, 14 nt, Chlamydophila pneumoniae CWL029
aaaguagaauccuu

SEQ ID NO: 495139 - RNA, 19 nt, Chlamydophila pneumoniae CWL029
aaaguaggcacaucauuau

SEQ ID NO: 495140 - RNA, 17 nt, Chlamydophila pneumoniae CWL029
ggcaggaaugagcggca

SEQ ID NO: 495141 - RNA, 23 nt, Chlamydophila pneumoniae CWL029
ggcaggacucuuuaagcaagagc

SEQ ID NO: 495142 - RNA, 16 nt, Chlamydophila pneumoniae CWL029
ggcaaguguuuuucug

SEQ ID NO: 495143 - RNA, 13 nt, Chlamydophila pneumoniae CWL029
ggauguucaaagc

SEQ ID NO: 495144 - RNA, 18 nt, Chlamydophila pneumoniae CWL029
ggauuaucccaaacuucu

SEQ ID NO: 495145 - RNA, 17 nt, Chlamydophila pneumoniae CWL029
ggauuaucuuagggaau

SEQ ID NO: 495146 - RNA, 20 nt, Chlamydophila pneumoniae CWL029
ggauucaaauuugcucuccu

SEQ ID NO: 495147 - RNA, 15 nt, Chlamydophila pneumoniae CWL029
ggauucuaaaaagaa

SEQ ID NO: 495148 - RNA, 18 nt, Chlamydophila pneumoniae CWL029
ggauucuuuugcaaugcu

SEQ ID NO: 495149 - RNA, 18 nt, Chlamydophila pneumoniae CWL029
aaaguacaggcuccauca

SEQ ID NO: 495150 - RNA, 12 nt, Chlamydophila pneumoniae CWL029
aaaguacuacaa

SEQ ID NO: 495151 - RNA, 17 nt, Chlamydophila pneumoniae CWL029
aaaguaccuaggaucua

SEQ ID NO: 495152 - RNA, 11 nt, Chlamydophila pneumoniae CWL029
ggaugugaugu

SEQ ID NO: 495153 - RNA, 13 nt, Chlamydophila pneumoniae CWL029
ggaugcuaauaaa

SEQ ID NO: 495154 - RNA, 18 nt, Chlamydophila pneumoniae CWL029
ggauggacuacugaaaca

SEQ ID NO: 495155 - RNA, 17 nt, Chlamydophila pneumoniae CWL029
ggaucuuuucuuucuaa

SEQ ID NO: 495156 - RNA, 19 nt, Chlamydophila pneumoniae CWL029
ggaucuuuucuuucuaaga

SEQ ID NO: 495157 - RNA, 16 nt, Chlamydophila pneumoniae CWL029
ggaucuuaggauucuu

SEQ ID NO: 495158 - RNA, 16 nt, Chlamydophila pneumoniae CWL029
ggaucuugauaaaaga

SEQ ID NO: 495159 - RNA, 18 nt, Chlamydophila pneumoniae CWL029
ggaucuuauauaaaacuu

SEQ ID NO: 495160 - RNA, 20 nt, Chlamydophila pneumoniae CWL029
ggaucuucaucccuacccuc

SEQ ID NO: 495161 - RNA, 18 nt, Chlamydophila pneumoniae CWL029
ggaucucucuuuccuuag

SEQ ID NO: 495162 - RNA, 15 nt, Chlamydophila pneumoniae CWL029
ggaucuaaagcauca

SEQ ID NO: 495163 - RNA, 18 nt, Chlamydophila pneumoniae CWL029
ggaucccaaaaaaugccc

SEQ ID NO: 495164 - RNA, 18 nt, Chlamydophila pneumoniae CWL029
ggaucggucuuuucuaag

SEQ ID NO: 495165 - RNA, 15 nt, Chlamydophila pneumoniae CWL029
ggauaaguucuucca

SEQ ID NO: 495166 - RNA, 17 nt, Chlamydophila pneumoniae CWL029
ggauaccauaaggagau

SEQ ID NO: 495167 - RNA, 20 nt, Chlamydophila pneumoniae CWL029
ggauauugucaagaggcugu

SEQ ID NO: 495168 - RNA, 14 nt, Chlamydophila pneumoniae CWL029
ggauaaauggagga

SEQ ID NO: 495169 - RNA, 17 nt, Chlamydophila pneumoniae CWL029
ggauaaaaaguuuuugu

SEQ ID NO: 495170 - RNA, 22 nt, Chlamydophila pneumoniae CWL029
ggaguuucuuauucacuggaau

SEQ ID NO: 495171 - RNA, 23 nt, Chlamydophila pneumoniae CWL029
ggagcaucuuuucaaaagaaaag

SEQ ID NO: 495172 - RNA, 15 nt, Chlamydophila pneumoniae CWL029
ggagagcgaaauaga

SEQ ID NO: 495173 - RNA, 19 nt, Chlamydophila pneumoniae CWL029
ggagagcuucuucuguaaa

SEQ ID NO: 495174 - RNA, 17 nt, Chlamydophila pneumoniae CWL029
ggagagcuuucgcuccu

SEQ ID NO: 495175 - RNA, 13 nt, Chlamydophila pneumoniae CWL029
ggagagggaagga

SEQ ID NO: 495176 - RNA, 13 nt, Chlamydophila pneumoniae CWL029
ggagauuccuaaa

SEQ ID NO: 495177 - RNA, 17 nt, Chlamydophila pneumoniae CWL029
ggagagaacuuuugaau

SEQ ID NO: 495178 - RNA, 18 nt, Chlamydophila pneumoniae CWL029
ggagacucagagaaaauc

SEQ ID NO: 495179 - RNA, 19 nt, Chlamydophila pneumoniae CWL029
ggagaccuuuauagauaug

SEQ ID NO: 495180 - RNA, 16 nt, Chlamydophila pneumoniae CWL029
ggacuuguguauuugc

SEQ ID NO: 495181 - RNA, 15 nt, Chlamydophila pneumoniae CWL029
ggacuucucaaagac

SEQ ID NO: 495182 - RNA, 16 nt, Chlamydophila pneumoniae CWL029
ggacuucucaaagaca

SEQ ID NO: 495183 - RNA, 17 nt, Chlamydophila pneumoniae CWL029
aaaguaacgauaagaag

SEQ ID NO: 495184 - RNA, 17 nt, Chlamydophila pneumoniae CWL029
aaagguugauuggaucu

SEQ ID NO: 495185 - RNA, 22 nt, Chlamydophila pneumoniae CWL029
ggacugacuucuaugauaucac

SEQ ID NO: 495186 - RNA, 13 nt, Chlamydophila pneumoniae CWL029
ggacugcugacau

SEQ ID NO: 495187 - RNA, 23 nt, Chlamydophila pneumoniae CWL029
aaaggucagcccugccucacagc

SEQ ID NO: 495188 - RNA, 21 nt, Chlamydophila pneumoniae CWL029
aaagggucuuuaccagaaaug

SEQ ID NO: 495189 - RNA, 18 nt, Chlamydophila pneumoniae CWL029
aaaggguuucuuuccauc

SEQ ID NO: 495190 - RNA, 13 nt, Chlamydophila pneumoniae CWL029
aaagguaaaacua

SEQ ID NO: 495191 - RNA, 14 nt, Chlamydophila pneumoniae CWL029
aaagguauuucucu

SEQ ID NO: 495192 - RNA, 13 nt, Chlamydophila pneumoniae CWL029
aaaggcuuuucuu

SEQ ID NO: 495193 - RNA, 17 nt, Chlamydophila pneumoniae CWL029
aaagggaauuuucucau

SEQ ID NO: 495194 - RNA, 19 nt, Chlamydophila pneumoniae CWL029
ggaccuuggacucuagggu

SEQ ID NO: 495195 - RNA, 13 nt, Chlamydophila pneumoniae CWL029
ggaccuguuuucu

SEQ ID NO: 495196 - RNA, 17 nt, Chlamydophila pneumoniae CWL029
ggaccuguuuucuuuuc

SEQ ID NO: 495197 - RNA, 21 nt, Chlamydophila pneumoniae CWL029
ggaccuguuuucuuuucugaa

SEQ ID NO: 495198 - RNA, 18 nt, Chlamydophila pneumoniae CWL029
ggaccuaagggcucuccu

SEQ ID NO: 495199 - RNA, 12 nt, Chlamydophila pneumoniae CWL029
ggacagaaagau

SEQ ID NO: 495200 - RNA, 14 nt, Chlamydophila pneumoniae CWL029
ggacaauauagaga

SEQ ID NO: 495201 - RNA, 16 nt, Chlamydophila pneumoniae CWL029
ggacaaugcuaucucc

SEQ ID NO: 495202 - RNA, 18 nt, Chlamydophila pneumoniae CWL029
ggacaaugcuaucuccag

SEQ ID NO: 495203 - RNA, 14 nt, Chlamydophila pneumoniae CWL029
ggacacuagaauac

SEQ ID NO: 495204 - RNA, 9 nt, Chlamydophila pneumoniae CWL029
ggacaacua

SEQ ID NO: 495205 - RNA, 20 nt, Chlamydophila pneumoniae CWL029
ggacaacaacagcuuuaucu

SEQ ID NO: 495206 - RNA, 22 nt, Chlamydophila pneumoniae CWL029
ggaauuucccauauagcucguu

SEQ ID NO: 495207 - RNA, 22 nt, Chlamydophila pneumoniae CWL029
ggaauuagagaaauuuuuaauu

SEQ ID NO: 495208 - RNA, 18 nt, Chlamydophila pneumoniae CWL029
ggaauaauaggauaagaa

SEQ ID NO: 495209 - RNA, 14 nt, Chlamydophila pneumoniae CWL029
ggaagcucuucuac

SEQ ID NO: 495210 - RNA, 14 nt, Chlamydophila pneumoniae CWL029
ggaagguucucaaa

SEQ ID NO: 495211 - RNA, 15 nt, Chlamydophila pneumoniae CWL029
ggaagccagucuuca

SEQ ID NO: 495212 - RNA, 16 nt, Chlamydophila pneumoniae CWL029
ggaacaagucuucaau

SEQ ID NO: 495213 - RNA, 11 nt, Chlamydophila pneumoniae CWL029
ggaacaacugu

SEQ ID NO: 495214 - RNA, 15 nt, Chlamydophila pneumoniae CWL029
gcuuuaaauuuuuua

SEQ ID NO: 495215 - RNA, 18 nt, Chlamydophila pneumoniae CWL029
gcuuuacgaugagguuga

SEQ ID NO: 495216 - RNA, 14 nt, Chlamydophila pneumoniae CWL029
gcuuuagaagcccg

SEQ ID NO: 495217 - RNA, 12 nt, Chlamydophila pneumoniae CWL029
gcuuuaucucua

SEQ ID NO: 495218 - RNA, 19 nt, Chlamydophila pneumoniae CWL029
gcuuucagaaaagaaaagu

SEQ ID NO: 495219 - RNA, 13 nt, Chlamydophila pneumoniae CWL029
gcuugucuaggag

SEQ ID NO: 495220 - RNA, 21 nt, Chlamydophila pneumoniae CWL029
gcuuggggguggucuagagau

SEQ ID NO: 495221 - RNA, 18 nt, Chlamydophila pneumoniae CWL029
gcuugggcaaauaggaga

SEQ ID NO: 495222 - RNA, 17 nt, Chlamydophila pneumoniae CWL029
aaaggauucuaugagga

SEQ ID NO: 495223 - RNA, 15 nt, Chlamydophila pneumoniae CWL029
gcuugaccucaucag

SEQ ID NO: 495224 - RNA, 15 nt, Chlamydophila pneumoniae CWL029
gcuucuuucuuacua

SEQ ID NO: 495225 - RNA, 12 nt, Chlamydophila pneumoniae CWL029
gcuucuuuucca

SEQ ID NO: 495226 - RNA, 18 nt, Chlamydophila pneumoniae CWL029
gcuucuuguuuuugugga

SEQ ID NO: 495227 - RNA, 22 nt, Chlamydophila pneumoniae CWL029
gcuucuuuaucuagcucuucaa

SEQ ID NO: 495228 - RNA, 22 nt, Chlamydophila pneumoniae CWL029
gcuucuucuauagaauccacua

SEQ ID NO: 495229 - RNA, 15 nt, Chlamydophila pneumoniae CWL029
gcuucuccaaauaaa

SEQ ID NO: 495230 - RNA, 17 nt, Chlamydophila pneumoniae CWL029
gcuucuccaaauaaagc

SEQ ID NO: 495231 - RNA, 14 nt, Chlamydophila pneumoniae CWL029
gcuucucccauagc

SEQ ID NO: 495232 - RNA, 20 nt, Chlamydophila pneumoniae CWL029
gcuucuaagaucuuuuguaa

SEQ ID NO: 495233 - RNA, 17 nt, Chlamydophila pneumoniae CWL029
gcuucuaagaaacuucc

SEQ ID NO: 495234 - RNA, 20 nt, Chlamydophila pneumoniae CWL029
gcuucuggagaaaaaauauc

SEQ ID NO: 495235 - RNA, 12 nt, Chlamydophila pneumoniae CWL029
gcuucuguaaag

SEQ ID NO: 495236 - RNA, 19 nt, Chlamydophila pneumoniae CWL029
gcuuccugcuccucuucuu

SEQ ID NO: 495237 - RNA, 19 nt, Chlamydophila pneumoniae CWL029
gcuuccgugcgauuucccc

SEQ ID NO: 495238 - RNA, 22 nt, Chlamydophila pneumoniae CWL029
gcuuccauagcuuuagaagccc

SEQ ID NO: 495239 - RNA, 19 nt, Chlamydophila pneumoniae CWL029
gcuuccccuaauaggggac

SEQ ID NO: 495240 - RNA, 18 nt, Chlamydophila pneumoniae CWL029
gcuucauuaucuucguaa

SEQ ID NO: 495241 - RNA, 20 nt, Chlamydophila pneumoniae CWL029
gcuucauuccuacaucugug

SEQ ID NO: 495242 - RNA, 21 nt, Chlamydophila pneumoniae CWL029
gcuuccaacuuuugaagaucc

SEQ ID NO: 495243 - RNA, 15 nt, Chlamydophila pneumoniae CWL029
gcuucaucaaaacau

SEQ ID NO: 495244 - RNA, 16 nt, Chlamydophila pneumoniae CWL029
gcuucaucaaaacaua

SEQ ID NO: 495245 - RNA, 17 nt, Chlamydophila pneumoniae CWL029
gcuucaucaaaacauaa

SEQ ID NO: 495246 - RNA, 15 nt, Chlamydophila pneumoniae CWL029
gcuuacuuucuuuua

SEQ ID NO: 495247 - RNA, 14 nt, Chlamydophila pneumoniae CWL029
gcuuagccauggca

SEQ ID NO: 495248 - RNA, 20 nt, Chlamydophila pneumoniae CWL029
gcuuagccauggcaucuaag

SEQ ID NO: 495249 - RNA, 17 nt, Chlamydophila pneumoniae CWL029
gcuuauagagagaauga

SEQ ID NO: 495250 - RNA, 21 nt, Chlamydophila pneumoniae CWL029
gcuuauagagagaaugacuuu

SEQ ID NO: 495251 - RNA, 20 nt, Chlamydophila pneumoniae CWL029
gcuuauccaaguguucgagu

SEQ ID NO: 495252 - RNA, 13 nt, Chlamydophila pneumoniae CWL029
gcuuauccguggg

SEQ ID NO: 495253 - RNA, 21 nt, Chlamydophila pneumoniae CWL029
gcuucagaguggucauugccu

SEQ ID NO: 495254 - RNA, 15 nt, Chlamydophila pneumoniae CWL029
gcuucacaucuuucu

SEQ ID NO: 495255 - RNA, 18 nt, Chlamydophila pneumoniae CWL029
gcuucaccauuaagauau

SEQ ID NO: 495256 - RNA, 23 nt, Chlamydophila pneumoniae CWL029
gcuuauuucuguaguucuugcca

SEQ ID NO: 495257 - RNA, 16 nt, Chlamydophila pneumoniae CWL029
gcuucaaaaagcuccc

SEQ ID NO: 495258 - RNA, 14 nt, Chlamydophila pneumoniae CWL029
gcuuauuauugaau

SEQ ID NO: 495259 - RNA, 14 nt, Chlamydophila pneumoniae CWL029
gcuguguaaaaguu

SEQ ID NO: 495260 - RNA, 15 nt, Chlamydophila pneumoniae CWL029
gcuguuucuucugaa

SEQ ID NO: 495261 - RNA, 20 nt, Chlamydophila pneumoniae CWL029
aaaggaacuucguuucgcuu

SEQ ID NO: 495262 - RNA, 23 nt, Chlamydophila pneumoniae CWL029
aaaggaagggauguuuaauacaa

SEQ ID NO: 495263 - RNA, 18 nt, Chlamydophila pneumoniae CWL029
gcuguauuuucagcacug

SEQ ID NO: 495264 - RNA, 19 nt, Chlamydophila pneumoniae CWL029
aaaggaccacaauuccuaa

SEQ ID NO: 495265 - RNA, 17 nt, Chlamydophila pneumoniae CWL029
aaaggaaucucgggaga

SEQ ID NO: 495266 - RNA, 17 nt, Chlamydophila pneumoniae CWL029
aaaggaccauuaauuuc

SEQ ID NO: 495267 - RNA, 17 nt, Chlamydophila pneumoniae CWL029
aaaggaccuguuuucuu

SEQ ID NO: 495268 - RNA, 16 nt, Chlamydophila pneumoniae CWL029
aaaggagaaagaauug

SEQ ID NO: 495269 - RNA, 15 nt, Chlamydophila pneumoniae CWL029
gcuguacuugauauu

SEQ ID NO: 495270 - RNA, 21 nt, Chlamydophila pneumoniae CWL029
gcuguacuugauauuguucuu

SEQ ID NO: 495271 - RNA, 23 nt, Chlamydophila pneumoniae CWL029
aaaggauauugauaaaucccgaa

SEQ ID NO: 495272 - RNA, 15 nt, Chlamydophila pneumoniae CWL029
gcugcuagagcagcu

SEQ ID NO: 495273 - RNA, 14 nt, Chlamydophila pneumoniae CWL029
gcugcuagagcagc

SEQ ID NO: 495274 - RNA, 16 nt, Chlamydophila pneumoniae CWL029
gcugcugcuaaacagg

SEQ ID NO: 495275 - RNA, 15 nt, Chlamydophila pneumoniae CWL029
gcuggaagacuugcu

SEQ ID NO: 495276 - RNA, 14 nt, Chlamydophila pneumoniae CWL029
gcugauucucccaa

SEQ ID NO: 495277 - RNA, 21 nt, Chlamydophila pneumoniae CWL029
gcugauccucggcaucuuugg

SEQ ID NO: 495278 - RNA, 13 nt, Chlamydophila pneumoniae CWL029
gcugagagaagca

SEQ ID NO: 495279 - RNA, 14 nt, Chlamydophila pneumoniae CWL029
gcugauccaaaagc

SEQ ID NO: 495280 - RNA, 14 nt, Chlamydophila pneumoniae CWL029
gcugauuucuuuuu

SEQ ID NO: 495281 - RNA, 22 nt, Chlamydophila pneumoniae CWL029
gcugauuucuuuuucagcuucu

SEQ ID NO: 495282 - RNA, 19 nt, Chlamydophila pneumoniae CWL029
gcugcagcaaaacuaggaa

SEQ ID NO: 495283 - RNA, 22 nt, Chlamydophila pneumoniae CWL029
gcugcaaucucaaaaucaaaua

SEQ ID NO: 495284 - RNA, 17 nt, Chlamydophila pneumoniae CWL029
gcugacacucagcuccc

SEQ ID NO: 495285 - RNA, 20 nt, Chlamydophila pneumoniae CWL029
gcugagacauauugaagaua

SEQ ID NO: 495286 - RNA, 22 nt, Chlamydophila pneumoniae CWL029
gcugagacauauugaagauauu

SEQ ID NO: 495287 - RNA, 15 nt, Chlamydophila pneumoniae CWL029
gcucucuccaugagc

SEQ ID NO: 495288 - RNA, 12 nt, Chlamydophila pneumoniae CWL029
gcucuccuucag

SEQ ID NO: 495289 - RNA, 14 nt, Chlamydophila pneumoniae CWL029
gcucucgacacuau

SEQ ID NO: 495290 - RNA, 17 nt, Chlamydophila pneumoniae CWL029
gcugaagauuuuuucuu

SEQ ID NO: 495291 - RNA, 11 nt, Chlamydophila pneumoniae CWL029
gcugaagauuu

SEQ ID NO: 495292 - RNA, 16 nt, Chlamydophila pneumoniae CWL029
gcugaagauuuuuucu

SEQ ID NO: 495293 - RNA, 17 nt, Chlamydophila pneumoniae CWL029
gcucuagcuaacauaaa

SEQ ID NO: 495294 - RNA, 15 nt, Chlamydophila pneumoniae CWL029
gcucuagucuuucaa

SEQ ID NO: 495295 - RNA, 16 nt, Chlamydophila pneumoniae CWL029
gcucuccugcaaaaag

SEQ ID NO: 495296 - RNA, 18 nt, Chlamydophila pneumoniae CWL029
gcucuccugcaaaaaguu

SEQ ID NO: 495297 - RNA, 17 nt, Chlamydophila pneumoniae CWL029
gcucuaccaacugagcu

SEQ ID NO: 495298 - RNA, 22 nt, Chlamydophila pneumoniae CWL029
gcucuacaagcucgguacgucu

SEQ ID NO: 495299 - RNA, 18 nt, Chlamydophila pneumoniae CWL029
gcucgacguauuugccaa

SEQ ID NO: 495300 - RNA, 21 nt, Chlamydophila pneumoniae CWL029
gcuccuuggcuauggaaagag

SEQ ID NO: 495301 - RNA, 12 nt, Chlamydophila pneumoniae CWL029
gcuccugcaaaa

SEQ ID NO: 495302 - RNA, 17 nt, Chlamydophila pneumoniae CWL029
gcuccugcaaaaaacca

SEQ ID NO: 495303 - RNA, 13 nt, Chlamydophila pneumoniae CWL029
gcuccugaagcug

SEQ ID NO: 495304 - RNA, 23 nt, Chlamydophila pneumoniae CWL029
gcuccgacccgaccuaccugcua

SEQ ID NO: 495305 - RNA, 23 nt, Chlamydophila pneumoniae CWL029
gcucccaacaagggaaagaaacu

SEQ ID NO: 495306 - RNA, 19 nt, Chlamydophila pneumoniae CWL029
gcuccaaugggcagguuuc

SEQ ID NO: 495307 - RNA, 17 nt, Chlamydophila pneumoniae CWL029
gcuccaauuuucuucag

SEQ ID NO: 495308 - RNA, 21 nt, Chlamydophila pneumoniae CWL029
gcuccaaaaugggauccugca

SEQ ID NO: 495309 - RNA, 18 nt, Chlamydophila pneumoniae CWL029
gcucaucggaucuuuucu

SEQ ID NO: 495310 - RNA, 13 nt, Chlamydophila pneumoniae CWL029
gcucaucuagaaa

SEQ ID NO: 495311 - RNA, 14 nt, Chlamydophila pneumoniae CWL029
gcucauaacccaaa

SEQ ID NO: 495312 - RNA, 14 nt, Chlamydophila pneumoniae CWL029
gcucauaagaaauu

SEQ ID NO: 495313 - RNA, 19 nt, Chlamydophila pneumoniae CWL029
aaauccaaaaaaugcuccu

SEQ ID NO: 495314 - RNA, 15 nt, Chlamydophila pneumoniae CWL029
aaaucagaauccuga

SEQ ID NO: 495315 - RNA, 20 nt, Chlamydophila pneumoniae CWL029
aaaucauaggcuauaauuaa

SEQ ID NO: 495316 - RNA, 13 nt, Chlamydophila pneumoniae CWL029
guuuucacauggc

SEQ ID NO: 495317 - RNA, 18 nt, Chlamydophila pneumoniae CWL029
guuuucauaauccaagaa

SEQ ID NO: 495318 - RNA, 12 nt, Chlamydophila pneumoniae CWL029
guuuucuuuucu

SEQ ID NO: 495319 - RNA, 20 nt, Chlamydophila pneumoniae CWL029
guuuucuuuucugaagauuu

SEQ ID NO: 495320 - RNA, 15 nt, Chlamydophila pneumoniae CWL029
guuuugaaaucaaaa

SEQ ID NO: 495321 - RNA, 20 nt, Chlamydophila pneumoniae CWL029
guuuugauucccuccuuccu

SEQ ID NO: 495322 - RNA, 23 nt, Chlamydophila pneumoniae CWL029
guuuugauucccuccuuccuuaa

SEQ ID NO: 495323 - RNA, 22 nt, Chlamydophila pneumoniae CWL029
guuuugauuuugcagugauaaa

SEQ ID NO: 495324 - RNA, 22 nt, Chlamydophila pneumoniae CWL029
guuucuuccugaaucagcuuau

SEQ ID NO: 495325 - RNA, 20 nt, Chlamydophila pneumoniae CWL029
guuuguccuaggagagcuag

SEQ ID NO: 495326 - RNA, 23 nt, Chlamydophila pneumoniae CWL029
guuuguaguaaggagagacugug

SEQ ID NO: 495327 - RNA, 18 nt, Chlamydophila pneumoniae CWL029
guuuguaguguugaauaa

SEQ ID NO: 495328 - RNA, 24 nt, Chlamydophila pneumoniae CWL029
guuucuagaaaaucucuaagaauc

SEQ ID NO: 495329 - RNA, 16 nt, Chlamydophila pneumoniae CWL029
guuucucuggcaauga

SEQ ID NO: 495330 - RNA, 13 nt, Chlamydophila pneumoniae CWL029
guuucuaaauacu

SEQ ID NO: 495331 - RNA, 20 nt, Chlamydophila pneumoniae CWL029
aaaucaccagcauuaagaua

SEQ ID NO: 495332 - RNA, 21 nt, Chlamydophila pneumoniae CWL029
guuucuaaaacagaaauugcu

SEQ ID NO: 495333 - RNA, 16 nt, Chlamydophila pneumoniae CWL029
aaaucaaucuugaugg

SEQ ID NO: 495334 - RNA, 16 nt, Chlamydophila pneumoniae CWL029
aaaucaacucuccauc

SEQ ID NO: 495335 - RNA, 17 nt, Chlamydophila pneumoniae CWL029
guuucgauaucacggcu

SEQ ID NO: 495336 - RNA, 17 nt, Chlamydophila pneumoniae CWL029
aaauauucuuggaagau

SEQ ID NO: 495337 - RNA, 19 nt, Chlamydophila pneumoniae CWL029
aaauauucuuucaaaccac

SEQ ID NO: 495338 - RNA, 22 nt, Chlamydophila pneumoniae CWL029
guuucccaccauauucucagga

SEQ ID NO: 495339 - RNA, 16 nt, Chlamydophila pneumoniae CWL029
guuuccuuuucuccuu

SEQ ID NO: 495340 - RNA, 17 nt, Chlamydophila pneumoniae CWL029
guuuccuuuucuccuuc

SEQ ID NO: 495341 - RNA, 13 nt, Chlamydophila pneumoniae CWL029
guuuccuccucuu

SEQ ID NO: 495342 - RNA, 19 nt, Chlamydophila pneumoniae CWL029
guuuccgaucauuuuugcu

SEQ ID NO: 495343 - RNA, 15 nt, Chlamydophila pneumoniae CWL029
aaaucaaacauuacc

SEQ ID NO: 495344 - RNA, 22 nt, Chlamydophila pneumoniae CWL029
aaaucaaaguauauauuuuaca

SEQ ID NO: 495345 - RNA, 15 nt, Chlamydophila pneumoniae CWL029
aaaucaaaauuuuua

SEQ ID NO: 495346 - RNA, 16 nt, Chlamydophila pneumoniae CWL029
aaaucaacaucacaau

SEQ ID NO: 495347 - RNA, 21 nt, Chlamydophila pneumoniae CWL029
aaauaucuccguuaccaaaaa

SEQ ID NO: 495348 - RNA, 11 nt, Chlamydophila pneumoniae CWL029
aaauaugaauu

SEQ ID NO: 495349 - RNA, 21 nt, Chlamydophila pneumoniae CWL029
aaauaugagaucgaaucuuua

SEQ ID NO: 495350 - RNA, 15 nt, Chlamydophila pneumoniae CWL029
guuucaggucagcaa

SEQ ID NO: 495351 - RNA, 19 nt, Chlamydophila pneumoniae CWL029
guuucacaggcuacauagu

SEQ ID NO: 495352 - RNA, 23 nt, Chlamydophila pneumoniae CWL029
guuucacaggcuacauaguuuuu

SEQ ID NO: 495353 - RNA, 15 nt, Chlamydophila pneumoniae CWL029
guuucagaaggaucu

SEQ ID NO: 495354 - RNA, 23 nt, Chlamydophila pneumoniae CWL029
guuucagaagucacaaauuuuug

SEQ ID NO: 495355 - RNA, 15 nt, Chlamydophila pneumoniae CWL029
aaauauggggaaagc

SEQ ID NO: 495356 - RNA, 14 nt, Chlamydophila pneumoniae CWL029
guuucaguuuuauc

SEQ ID NO: 495357 - RNA, 23 nt, Chlamydophila pneumoniae CWL029
guuucauuuaaagaguccgaagc

SEQ ID NO: 495358 - RNA, 19 nt, Chlamydophila pneumoniae CWL029
guuuccaagacaacaccuc

SEQ ID NO: 495359 - RNA, 22 nt, Chlamydophila pneumoniae CWL029
guuuccaagacaacaccuccca

SEQ ID NO: 495360 - RNA, 14 nt, Chlamydophila pneumoniae CWL029
guuuaauacaaaaa

SEQ ID NO: 495361 - RNA, 12 nt, Chlamydophila pneumoniae CWL029
guuuagaaaaag

SEQ ID NO: 495362 - RNA, 21 nt, Chlamydophila pneumoniae CWL029
guuuagaaaaagaucuaaguc

SEQ ID NO: 495363 - RNA, 16 nt, Chlamydophila pneumoniae CWL029
guuucaaauaggaucu

SEQ ID NO: 495364 - RNA, 21 nt, Chlamydophila pneumoniae CWL029
guuucaaauaggaucucucuu

SEQ ID NO: 495365 - RNA, 12 nt, Chlamydophila pneumoniae CWL029
guuucaaucucu

SEQ ID NO: 495366 - RNA, 15 nt, Chlamydophila pneumoniae CWL029
guuucaaucucuccu

SEQ ID NO: 495367 - RNA, 17 nt, Chlamydophila pneumoniae CWL029
guuucaaucucuccuug

SEQ ID NO: 495368 - RNA, 19 nt, Chlamydophila pneumoniae CWL029
guugcuucuaagaaacuuc

SEQ ID NO: 495369 - RNA, 16 nt, Chlamydophila pneumoniae CWL029
guugcucauccuuuag

SEQ ID NO: 495370 - RNA, 22 nt, Chlamydophila pneumoniae CWL029
guugcuaagaucuuuagaauaa

SEQ ID NO: 495371 - RNA, 17 nt, Chlamydophila pneumoniae CWL029
guugcuaagcgaaccaa

SEQ ID NO: 495372 - RNA, 23 nt, Chlamydophila pneumoniae CWL029
guugcgaacagcuccuggauauu

SEQ ID NO: 495373 - RNA, 13 nt, Chlamydophila pneumoniae CWL029
guugcacuuuccg

SEQ ID NO: 495374 - RNA, 17 nt, Chlamydophila pneumoniae CWL029
guucuagcaaaucuaaa

SEQ ID NO: 495375 - RNA, 16 nt, Chlamydophila pneumoniae CWL029
guugaggaaaggaggg

SEQ ID NO: 495376 - RNA, 17 nt, Chlamydophila pneumoniae CWL029
guugaggaauuggcagg

SEQ ID NO: 495377 - RNA, 19 nt, Chlamydophila pneumoniae CWL029
guucucccgugaacaaaaa

SEQ ID NO: 495378 - RNA, 17 nt, Chlamydophila pneumoniae CWL029
guucucuaagacugugu

SEQ ID NO: 495379 - RNA, 14 nt, Chlamydophila pneumoniae CWL029
guucgaauccuucu

SEQ ID NO: 495380 - RNA, 14 nt, Chlamydophila pneumoniae CWL029
guucgcacuaauuu

SEQ ID NO: 495381 - RNA, 17 nt, Chlamydophila pneumoniae CWL029
guuccuuaucaggaaau

SEQ ID NO: 495382 - RNA, 20 nt, Chlamydophila pneumoniae CWL029
guuccuguaguuugcagaga

SEQ ID NO: 495383 - RNA, 21 nt, Chlamydophila pneumoniae CWL029
guuccuguaguuugcagagag

SEQ ID NO: 495384 - RNA, 22 nt, Chlamydophila pneumoniae CWL029
guuccuguaguuugcagagagu

SEQ ID NO: 495385 - RNA, 22 nt, Chlamydophila pneumoniae CWL029
guuccauagaguaucuaaaacu

SEQ ID NO: 495386 - RNA, 15 nt, Chlamydophila pneumoniae CWL029
guuccauaucaaaga

SEQ ID NO: 495387 - RNA, 23 nt, Chlamydophila pneumoniae CWL029
guucaccagaagcauugaggaca

SEQ ID NO: 495388 - RNA, 14 nt, Chlamydophila pneumoniae CWL029
guucacauuuucau

SEQ ID NO: 495389 - RNA, 15 nt, Chlamydophila pneumoniae CWL029
guuauuguuucuaug

SEQ ID NO: 495390 - RNA, 15 nt, Chlamydophila pneumoniae CWL029
guuccacuugcucuu

SEQ ID NO: 495391 - RNA, 18 nt, Chlamydophila pneumoniae CWL029
guuccaagacaauaaaaa

SEQ ID NO: 495392 - RNA, 24 nt, Chlamydophila pneumoniae CWL029
guuccacagagaccuucucuucag

SEQ ID NO: 495393 - RNA, 22 nt, Chlamydophila pneumoniae CWL029
guucaucuagaugauaacguuu

SEQ ID NO: 495394 - RNA, 14 nt, Chlamydophila pneumoniae CWL029
guuauauuuuucug

SEQ ID NO: 495395 - RNA, 15 nt, Chlamydophila pneumoniae CWL029
guuaggucuuaaagu

SEQ ID NO: 495396 - RNA, 14 nt, Chlamydophila pneumoniae CWL029
guuaugaagcuucu

SEQ ID NO: 495397 - RNA, 13 nt, Chlamydophila pneumoniae CWL029
guuauugaguguu

SEQ ID NO: 495398 - RNA, 15 nt, Chlamydophila pneumoniae CWL029
guuaggauauggugu

SEQ ID NO: 495399 - RNA, 15 nt, Chlamydophila pneumoniae CWL029
guuaagcaauaucug

SEQ ID NO: 495400 - RNA, 15 nt, Chlamydophila pneumoniae CWL029
guuaagcaccauaau

SEQ ID NO: 495401 - RNA, 21 nt, Chlamydophila pneumoniae CWL029
guuaacaaguaccaagaaaau

SEQ ID NO: 495402 - RNA, 17 nt, Chlamydophila pneumoniae CWL029
guuaaacaaaguaggau

SEQ ID NO: 495403 - RNA, 20 nt, Chlamydophila pneumoniae CWL029
guuaacaagauucucagcuu

SEQ ID NO: 495404 - RNA, 13 nt, Chlamydophila pneumoniae CWL029
guguugaauaaga

SEQ ID NO: 495405 - RNA, 19 nt, Chlamydophila pneumoniae CWL029
guguuuuuggcauaaagac

SEQ ID NO: 495406 - RNA, 16 nt, Chlamydophila pneumoniae CWL029
guguggguacaggggg

SEQ ID NO: 495407 - RNA, 18 nt, Chlamydophila pneumoniae CWL029
gugugguaaaaauauagg

SEQ ID NO: 495408 - RNA, 17 nt, Chlamydophila pneumoniae CWL029
guguucaauagcaaaga

SEQ ID NO: 495409 - RNA, 14 nt, Chlamydophila pneumoniae CWL029
aaauauaguuuuca

SEQ ID NO: 495410 - RNA, 17 nt, Chlamydophila pneumoniae CWL029
aaauauaucgcguguaa

SEQ ID NO: 495411 - RNA, 18 nt, Chlamydophila pneumoniae CWL029
aaauauaucuucagaauu

SEQ ID NO: 495412 - RNA, 21 nt, Chlamydophila pneumoniae CWL029
aaauaucaccuacaucagacu

SEQ ID NO: 495413 - RNA, 23 nt, Chlamydophila pneumoniae CWL029
aaauaucaccuacaucagacuga

SEQ ID NO: 495414 - RNA, 22 nt, Chlamydophila pneumoniae CWL029
gugguuagagcagcagaaucau

SEQ ID NO: 495415 - RNA, 15 nt, Chlamydophila pneumoniae CWL029
guguagccuuucuuu

SEQ ID NO: 495416 - RNA, 23 nt, Chlamydophila pneumoniae CWL029
gugucccauggcuggaaagccaa

SEQ ID NO: 495417 - RNA, 22 nt, Chlamydophila pneumoniae CWL029
gugucuuccuugggaggaggag

SEQ ID NO: 495418 - RNA, 13 nt, Chlamydophila pneumoniae CWL029
gugucuugcugau

SEQ ID NO: 495419 - RNA, 16 nt, Chlamydophila pneumoniae CWL029
guggaacuuucuggga

SEQ ID NO: 495420 - RNA, 20 nt, Chlamydophila pneumoniae CWL029
guggagcuugucuaggagcu

SEQ ID NO: 495421 - RNA, 23 nt, Chlamydophila pneumoniae CWL029
guggagcuugucuaggagcuucg

SEQ ID NO: 495422 - RNA, 13 nt, Chlamydophila pneumoniae CWL029
guggagguuagua

SEQ ID NO: 495423 - RNA, 15 nt, Chlamydophila pneumoniae CWL029
aaauauacugccagc

SEQ ID NO: 495424 - RNA, 13 nt, Chlamydophila pneumoniae CWL029
aaauauaacucuc

SEQ ID NO: 495425 - RNA, 15 nt, Chlamydophila pneumoniae CWL029
aaauauaaauuuaua

SEQ ID NO: 495426 - RNA, 21 nt, Chlamydophila pneumoniae CWL029
guggaaauugugaaaaaaaac

SEQ ID NO: 495427 - RNA, 18 nt, Chlamydophila pneumoniae CWL029
gugggauggucaggaaga

SEQ ID NO: 495428 - RNA, 23 nt, Chlamydophila pneumoniae CWL029
gugauugcugucagaacaagaag

SEQ ID NO: 495429 - RNA, 16 nt, Chlamydophila pneumoniae CWL029
gugauugcguauagau

SEQ ID NO: 495430 - RNA, 12 nt, Chlamydophila pneumoniae CWL029
gugauugcugcu

SEQ ID NO: 495431 - RNA, 20 nt, Chlamydophila pneumoniae CWL029
gugauuucuuuauucccuuu

SEQ ID NO: 495432 - RNA, 17 nt, Chlamydophila pneumoniae CWL029
gugcaaggccuaaucuu

SEQ ID NO: 495433 - RNA, 14 nt, Chlamydophila pneumoniae CWL029
gugacuuuucuucu

SEQ ID NO: 495434 - RNA, 12 nt, Chlamydophila pneumoniae CWL029
gugacuccuggu

SEQ ID NO: 495435 - RNA, 21 nt, Chlamydophila pneumoniae CWL029
gugaauauguacugaugugaa

SEQ ID NO: 495436 - RNA, 15 nt, Chlamydophila pneumoniae CWL029
gugaauuucuugacu

SEQ ID NO: 495437 - RNA, 19 nt, Chlamydophila pneumoniae CWL029
gugaagcugcuucuucaga

SEQ ID NO: 495438 - RNA, 21 nt, Chlamydophila pneumoniae CWL029
gugaacuuuuguacacagaga

SEQ ID NO: 495439 - RNA, 19 nt, Chlamydophila pneumoniae CWL029
gugaagccauuuucuaaga

SEQ ID NO: 495440 - RNA, 18 nt, Chlamydophila pneumoniae CWL029
gugaagaaauuaaguagg

SEQ ID NO: 495441 - RNA, 18 nt, Chlamydophila pneumoniae CWL029
aaauaggaucucucuuuc

SEQ ID NO: 495442 - RNA, 22 nt, Chlamydophila pneumoniae CWL029
aaauaggcucuacaggagaagc

SEQ ID NO: 495443 - RNA, 23 nt, Chlamydophila pneumoniae CWL029
aaauaggcucuacaggagaagcg

SEQ ID NO: 495444 - RNA, 20 nt, Chlamydophila pneumoniae CWL029
aaauaggagagcacuuuuaa

SEQ ID NO: 495445 - RNA, 12 nt, Chlamydophila pneumoniae CWL029
aaauaggaucuc

SEQ ID NO: 495446 - RNA, 19 nt, Chlamydophila pneumoniae CWL029
gugaaaguacaggaguucc

SEQ ID NO: 495447 - RNA, 16 nt, Chlamydophila pneumoniae CWL029
gugaaauauugaucuu

SEQ ID NO: 495448 - RNA, 15 nt, Chlamydophila pneumoniae CWL029
gugaacaaaaacugc

SEQ ID NO: 495449 - RNA, 21 nt, Chlamydophila pneumoniae CWL029
gucuuuaauuaaaaguucagc

SEQ ID NO: 495450 - RNA, 18 nt, Chlamydophila pneumoniae CWL029
gucuuugauuuucaggag

SEQ ID NO: 495451 - RNA, 23 nt, Chlamydophila pneumoniae CWL029
gucuuuucuaagcaauauuucug

SEQ ID NO: 495452 - RNA, 16 nt, Chlamydophila pneumoniae CWL029
gucuuagaauccucua

SEQ ID NO: 495453 - RNA, 19 nt, Chlamydophila pneumoniae CWL029
gucuuauugaagucuucuu

SEQ ID NO: 495454 - RNA, 19 nt, Chlamydophila pneumoniae CWL029
gucuucauaugcucucccg

SEQ ID NO: 495455 - RNA, 13 nt, Chlamydophila pneumoniae CWL029
gucugugagaaau

SEQ ID NO: 495456 - RNA, 17 nt, Chlamydophila pneumoniae CWL029
gucuguuaacucagaga

SEQ ID NO: 495457 - RNA, 21 nt, Chlamydophila pneumoniae CWL029
gucuguauuuucuucaacaua

SEQ ID NO: 495458 - RNA, 18 nt, Chlamydophila pneumoniae CWL029
gucuugcugauuuuugcu

SEQ ID NO: 495459 - RNA, 20 nt, Chlamydophila pneumoniae CWL029
gucuucuguaauuuuuuuca

SEQ ID NO: 495460 - RNA, 21 nt, Chlamydophila pneumoniae CWL029
gucuucuguaauuuuuuucaa

SEQ ID NO: 495461 - RNA, 19 nt, Chlamydophila pneumoniae CWL029
gucuugacguugcgaacag

SEQ ID NO: 495462 - RNA, 22 nt, Chlamydophila pneumoniae CWL029
gucuuccauaacaguuuguucu

SEQ ID NO: 495463 - RNA, 22 nt, Chlamydophila pneumoniae CWL029
gucuuccccccucacaauauaa

SEQ ID NO: 495464 - RNA, 23 nt, Chlamydophila pneumoniae CWL029
gucugcaaagagcaaaggagcgg

SEQ ID NO: 495465 - RNA, 11 nt, Chlamydophila pneumoniae CWL029
gucugaacauu

SEQ ID NO: 495466 - RNA, 13 nt, Chlamydophila pneumoniae CWL029
gucuguaaggaca

SEQ ID NO: 495467 - RNA, 14 nt, Chlamydophila pneumoniae CWL029
gucugcugaggaga

SEQ ID NO: 495468 - RNA, 16 nt, Chlamydophila pneumoniae CWL029
gucucaugaccuucag

SEQ ID NO: 495469 - RNA, 18 nt, Chlamydophila pneumoniae CWL029
gucuccagaagcaagaau

SEQ ID NO: 495470 - RNA, 15 nt, Chlamydophila pneumoniae CWL029
gucuccaaagauaca

SEQ ID NO: 495471 - RNA, 20 nt, Chlamydophila pneumoniae CWL029
gucuccaaauguucucucca

SEQ ID NO: 495472 - RNA, 14 nt, Chlamydophila pneumoniae CWL029
gucucuuucagcuc

SEQ ID NO: 495473 - RNA, 21 nt, Chlamydophila pneumoniae CWL029
gucucgaaacucuuugaggau

SEQ ID NO: 495474 - RNA, 21 nt, Chlamydophila pneumoniae CWL029
gucgcgaaaguaaaauuucug

SEQ ID NO: 495475 - RNA, 16 nt, Chlamydophila pneumoniae CWL029
gucgcgacugaaguca

SEQ ID NO: 495476 - RNA, 16 nt, Chlamydophila pneumoniae CWL029
gucgcgacaagacaau

SEQ ID NO: 495477 - RNA, 23 nt, Chlamydophila pneumoniae CWL029
gucgauacccaaagaggggagcu

SEQ ID NO: 495478 - RNA, 20 nt, Chlamydophila pneumoniae CWL029
guccuuuauaauggugucuu

SEQ ID NO: 495479 - RNA, 15 nt, Chlamydophila pneumoniae CWL029
guccuucuugcaaag

SEQ ID NO: 495480 - RNA, 20 nt, Chlamydophila pneumoniae CWL029
guccuccauggaaagaaaca

SEQ ID NO: 495481 - RNA, 15 nt, Chlamydophila pneumoniae CWL029
guccuaggagagcua

SEQ ID NO: 495482 - RNA, 14 nt, Chlamydophila pneumoniae CWL029
guccuaggcugaga

SEQ ID NO: 495483 - RNA, 14 nt, Chlamydophila pneumoniae CWL029
guccauaauuucuu

SEQ ID NO: 495484 - RNA, 18 nt, Chlamydophila pneumoniae CWL029
guccacagucauaaaaau

SEQ ID NO: 495485 - RNA, 17 nt, Chlamydophila pneumoniae CWL029
guccaagguucugggaa

SEQ ID NO: 495486 - RNA, 16 nt, Chlamydophila pneumoniae CWL029
guccagccugcaccag

SEQ ID NO: 495487 - RNA, 22 nt, Chlamydophila pneumoniae CWL029
gucaucccacgggucaggaggu

SEQ ID NO: 495488 - RNA, 19 nt, Chlamydophila pneumoniae CWL029
gucauguauccgaaaucug

SEQ ID NO: 495489 - RNA, 17 nt, Chlamydophila pneumoniae CWL029
gucaucucauaguuucu

SEQ ID NO: 495490 - RNA, 14 nt, Chlamydophila pneumoniae CWL029
gucacuacccugcc

SEQ ID NO: 495491 - RNA, 12 nt, Chlamydophila pneumoniae CWL029
gucacguucuua

SEQ ID NO: 495492 - RNA, 19 nt, Chlamydophila pneumoniae CWL029
gucacguucuuagaaagcg

SEQ ID NO: 495493 - RNA, 23 nt, Chlamydophila pneumoniae CWL029
gucagcccugccucacagcuaau

SEQ ID NO: 495494 - RNA, 15 nt, Chlamydophila pneumoniae CWL029
gucagguaaagagcu

SEQ ID NO: 495495 - RNA, 17 nt, Chlamydophila pneumoniae CWL029
ggugaagaauaauagca

SEQ ID NO: 495496 - RNA, 21 nt, Chlamydophila pneumoniae CWL029
gucaagcucugagaaagaaua

SEQ ID NO: 495497 - RNA, 18 nt, Chlamydophila pneumoniae CWL029
uacgagaucagauguaaa

SEQ ID NO: 495498 - RNA, 20 nt, Chlamydophila pneumoniae CWL029
uaccguuuacaucaauuuua

SEQ ID NO: 495499 - RNA, 15 nt, Chlamydophila pneumoniae CWL029
uaccguaaagaaaag

SEQ ID NO: 495500 - RNA, 21 nt, Chlamydophila pneumoniae CWL029
uaccguagcguacguuuucuc

SEQ ID NO: 495501 - RNA, 19 nt, Chlamydophila pneumoniae CWL029
uacgccgugccuauagaaa

SEQ ID NO: 495502 - RNA, 11 nt, Chlamydophila pneumoniae CWL029
uacuacaugag

SEQ ID NO: 495503 - RNA, 16 nt, Chlamydophila pneumoniae CWL029
uacuaagaagcucacu

SEQ ID NO: 495504 - RNA, 20 nt, Chlamydophila pneumoniae CWL029
uacuaaaggugaaaguacag

SEQ ID NO: 495505 - RNA, 22 nt, Chlamydophila pneumoniae CWL029
uacguccugaugccuuuuucuu

SEQ ID NO: 495506 - RNA, 14 nt, Chlamydophila pneumoniae CWL029
uacgugaucaaaau

SEQ ID NO: 495507 - RNA, 13 nt, Chlamydophila pneumoniae CWL029
uacuaaaaucuca

SEQ ID NO: 495508 - RNA, 17 nt, Chlamydophila pneumoniae CWL029
uacuaaaaucucauuuc

SEQ ID NO: 495509 - RNA, 16 nt, Chlamydophila pneumoniae CWL029
uacggcuaaauaaacc

SEQ ID NO: 495510 - RNA, 16 nt, Chlamydophila pneumoniae CWL029
uacguagcauaccuug

SEQ ID NO: 495511 - RNA, 19 nt, Chlamydophila pneumoniae CWL029
uacugagcuucuauuucua

SEQ ID NO: 495512 - RNA, 12 nt, Chlamydophila pneumoniae CWL029
uacucucugcuu

SEQ ID NO: 495513 - RNA, 16 nt, Chlamydophila pneumoniae CWL029
uacucuugcuugcuag

SEQ ID NO: 495514 - RNA, 14 nt, Chlamydophila pneumoniae CWL029
uacucuuuaaaaau

SEQ ID NO: 495515 - RNA, 16 nt, Chlamydophila pneumoniae CWL029
uacucuuuaaaaauag

SEQ ID NO: 495516 - RNA, 19 nt, Chlamydophila pneumoniae CWL029
uacucgucaaauucauuaa

SEQ ID NO: 495517 - RNA, 15 nt, Chlamydophila pneumoniae CWL029
uacuacucucaucaa

SEQ ID NO: 495518 - RNA, 18 nt, Chlamydophila pneumoniae CWL029
uacuacuuacaagaacaa

SEQ ID NO: 495519 - RNA, 14 nt, Chlamydophila pneumoniae CWL029
uacuagauaguuca

SEQ ID NO: 495520 - RNA, 23 nt, Chlamydophila pneumoniae CWL029
uacuuuaggaggggggauucugu

SEQ ID NO: 495521 - RNA, 12 nt, Chlamydophila pneumoniae CWL029
uacuucuccuga

SEQ ID NO: 495522 - RNA, 15 nt, Chlamydophila pneumoniae CWL029
uacuguuuuucuucc

SEQ ID NO: 495523 - RNA, 13 nt, Chlamydophila pneumoniae CWL029
uacuuauuguucu

SEQ ID NO: 495524 - RNA, 19 nt, Chlamydophila pneumoniae CWL029
uacuucaagaaaaaccccu

SEQ ID NO: 495525 - RNA, 21 nt, Chlamydophila pneumoniae CWL029
uacuggagagguaaccagaga

SEQ ID NO: 495526 - RNA, 23 nt, Chlamydophila pneumoniae CWL029
uacuggagagguaaccagagagc

SEQ ID NO: 495527 - RNA, 16 nt, Chlamydophila pneumoniae CWL029
uaccgaccgaaucucu

SEQ ID NO: 495528 - RNA, 19 nt, Chlamydophila pneumoniae CWL029
uaccgaccgaaucucucca

SEQ ID NO: 495529 - RNA, 14 nt, Chlamydophila pneumoniae CWL029
uaccgcuguuuuau

SEQ ID NO: 495530 - RNA, 16 nt, Chlamydophila pneumoniae CWL029
uacccucggagacuca

SEQ ID NO: 495531 - RNA, 16 nt, Chlamydophila pneumoniae CWL029
uacccucugcuuaucg

SEQ ID NO: 495532 - RNA, 22 nt, Chlamydophila pneumoniae CWL029
uacccucggagacucagagaaa

SEQ ID NO: 495533 - RNA, 19 nt, Chlamydophila pneumoniae CWL029
uacccuucagaauucucaa

SEQ ID NO: 495534 - RNA, 13 nt, Chlamydophila pneumoniae CWL029
uacccuucuucuu

SEQ ID NO: 495535 - RNA, 16 nt, Chlamydophila pneumoniae CWL029
uacccaaagaggggag

SEQ ID NO: 495536 - RNA, 17 nt, Chlamydophila pneumoniae CWL029
uacccaucuagaaacau

SEQ ID NO: 495537 - RNA, 21 nt, Chlamydophila pneumoniae CWL029
uaccauaaggagauuccuaaa

SEQ ID NO: 495538 - RNA, 18 nt, Chlamydophila pneumoniae CWL029
uaccauugagauccauag

SEQ ID NO: 495539 - RNA, 17 nt, Chlamydophila pneumoniae CWL029
uacaucuccaagccaug

SEQ ID NO: 495540 - RNA, 14 nt, Chlamydophila pneumoniae CWL029
uaccaacugagcua

SEQ ID NO: 495541 - RNA, 14 nt, Chlamydophila pneumoniae CWL029
uacaucagacugaa

SEQ ID NO: 495542 - RNA, 16 nt, Chlamydophila pneumoniae CWL029
uacaucagacugaaga

SEQ ID NO: 495543 - RNA, 20 nt, Chlamydophila pneumoniae CWL029
uacaucaaugauaucgccuu

SEQ ID NO: 495544 - RNA, 13 nt, Chlamydophila pneumoniae CWL029
uacauagaggaga

SEQ ID NO: 495545 - RNA, 14 nt, Chlamydophila pneumoniae CWL029
uacaucaaaaugcu

SEQ ID NO: 495546 - RNA, 18 nt, Chlamydophila pneumoniae CWL029
uacaguaguaaauaauaa

SEQ ID NO: 495547 - RNA, 17 nt, Chlamydophila pneumoniae CWL029
uacaguagcuugugcua

SEQ ID NO: 495548 - RNA, 14 nt, Chlamydophila pneumoniae CWL029
uacaauuuaaaucu

SEQ ID NO: 495549 - RNA, 16 nt, Chlamydophila pneumoniae CWL029
uacaaggucuuuuccu

SEQ ID NO: 495550 - RNA, 12 nt, Chlamydophila pneumoniae CWL029
uacaaguugaga

SEQ ID NO: 495551 - RNA, 22 nt, Chlamydophila pneumoniae CWL029
uacaagugucugaguuagcuuu

SEQ ID NO: 495552 - RNA, 22 nt, Chlamydophila pneumoniae CWL029
uaauaaugaagcagggaaaaug

SEQ ID NO: 495553 - RNA, 16 nt, Chlamydophila pneumoniae CWL029
uaauaagcaggaaaag

SEQ ID NO: 495554 - RNA, 18 nt, Chlamydophila pneumoniae CWL029
uaauaagcaggaaaagca

SEQ ID NO: 495555 - RNA, 21 nt, Chlamydophila pneumoniae CWL029
uaauaagcauauuuaaauaua

SEQ ID NO: 495556 - RNA, 15 nt, Chlamydophila pneumoniae CWL029
uaauaagaaccucua

SEQ ID NO: 495557 - RNA, 22 nt, Chlamydophila pneumoniae CWL029
uaauaaccugggggacuucaaa

SEQ ID NO: 495558 - RNA, 15 nt, Chlamydophila pneumoniae CWL029
uaauaggauaagaaa

SEQ ID NO: 495559 - RNA, 16 nt, Chlamydophila pneumoniae CWL029
uaauaggauaagaaau

SEQ ID NO: 495560 - RNA, 19 nt, Chlamydophila pneumoniae CWL029
uaauaggauaagaaauuaa

SEQ ID NO: 495561 - RNA, 16 nt, Chlamydophila pneumoniae CWL029
uaauagcuaaagugau

SEQ ID NO: 495562 - RNA, 14 nt, Chlamydophila pneumoniae CWL029
uaauagcaggaguu

SEQ ID NO: 495563 - RNA, 14 nt, Chlamydophila pneumoniae CWL029
uaauauaaaagaag

SEQ ID NO: 495564 - RNA, 14 nt, Chlamydophila pneumoniae CWL029
uaauaccuuucuaa

SEQ ID NO: 495565 - RNA, 23 nt, Chlamydophila pneumoniae CWL029
uaauacggacuucacaaagaacc

SEQ ID NO: 495566 - RNA, 13 nt, Chlamydophila pneumoniae CWL029
uaauacuuaaucc

SEQ ID NO: 495567 - RNA, 14 nt, Chlamydophila pneumoniae CWL029
uaauagaagaucau

SEQ ID NO: 495568 - RNA, 12 nt, Chlamydophila pneumoniae CWL029
uaauagagaaga

SEQ ID NO: 495569 - RNA, 13 nt, Chlamydophila pneumoniae CWL029
uaauagagaagaa

SEQ ID NO: 495570 - RNA, 16 nt, Chlamydophila pneumoniae CWL029
uaauauuugagaagau

SEQ ID NO: 495571 - RNA, 19 nt, Chlamydophila pneumoniae CWL029
uaaucaaagguuuuugauu

SEQ ID NO: 495572 - RNA, 13 nt, Chlamydophila pneumoniae CWL029
uaaucaaccaaaa

SEQ ID NO: 495573 - RNA, 17 nt, Chlamydophila pneumoniae CWL029
uaaucaaccaaaaugca

SEQ ID NO: 495574 - RNA, 19 nt, Chlamydophila pneumoniae CWL029
uaaucaagccuaaaucuau

SEQ ID NO: 495575 - RNA, 12 nt, Chlamydophila pneumoniae CWL029
uaaucaccuuag

SEQ ID NO: 495576 - RNA, 21 nt, Chlamydophila pneumoniae CWL029
uaaucagaagugaucuugaga

SEQ ID NO: 495577 - RNA, 14 nt, Chlamydophila pneumoniae CWL029
uaaucagaggagcc

SEQ ID NO: 495578 - RNA, 21 nt, Chlamydophila pneumoniae CWL029
uaaucagaggagccuccauaa

SEQ ID NO: 495579 - RNA, 14 nt, Chlamydophila pneumoniae CWL029
uaaucauaucugcg

SEQ ID NO: 495580 - RNA, 22 nt, Chlamydophila pneumoniae CWL029
uaauccagcaacaaccaaaaga

SEQ ID NO: 495581 - RNA, 20 nt, Chlamydophila pneumoniae CWL029
uacaagacaaaguuguuucu

SEQ ID NO: 495582 - RNA, 20 nt, Chlamydophila pneumoniae CWL029
uacaagacuacgacagaagu

SEQ ID NO: 495583 - RNA, 18 nt, Chlamydophila pneumoniae CWL029
uacaagcaauacuaagaa

SEQ ID NO: 495584 - RNA, 19 nt, Chlamydophila pneumoniae CWL029
uacaagcaauacuaagaag

SEQ ID NO: 495585 - RNA, 15 nt, Chlamydophila pneumoniae CWL029
uacaagcuuccuugg

SEQ ID NO: 495586 - RNA, 23 nt, Chlamydophila pneumoniae CWL029
uacaaauagcucugcgccaugca

SEQ ID NO: 495587 - RNA, 11 nt, Chlamydophila pneumoniae CWL029
uacaaacccau

SEQ ID NO: 495588 - RNA, 16 nt, Chlamydophila pneumoniae CWL029
uacaaacccauauuug

SEQ ID NO: 495589 - RNA, 18 nt, Chlamydophila pneumoniae CWL029
uacaaacccauauuugaa

SEQ ID NO: 495590 - RNA, 14 nt, Chlamydophila pneumoniae CWL029
uacaaacucuucca

SEQ ID NO: 495591 - RNA, 16 nt, Chlamydophila pneumoniae CWL029
uacaaacaagaagcgu

SEQ ID NO: 495592 - RNA, 18 nt, Chlamydophila pneumoniae CWL029
uacaaaaaauaaaaucaa

SEQ ID NO: 495593 - RNA, 14 nt, Chlamydophila pneumoniae CWL029
uacaaaacaaaagc

SEQ ID NO: 495594 - RNA, 20 nt, Chlamydophila pneumoniae CWL029
uaauuuuugcuaaacaaugc

SEQ ID NO: 495595 - RNA, 15 nt, Chlamydophila pneumoniae CWL029
uaauuuucuguuaau

SEQ ID NO: 495596 - RNA, 15 nt, Chlamydophila pneumoniae CWL029
uaauuucaaagaugc

SEQ ID NO: 495597 - RNA, 20 nt, Chlamydophila pneumoniae CWL029
uaaugauacgugcagugaau

SEQ ID NO: 495598 - RNA, 14 nt, Chlamydophila pneumoniae CWL029
uaaucgcacuucua

SEQ ID NO: 495599 - RNA, 18 nt, Chlamydophila pneumoniae CWL029
uaaucgagagaagaaauu

SEQ ID NO: 495600 - RNA, 20 nt, Chlamydophila pneumoniae CWL029
uaaucgagagaagaaauucu

SEQ ID NO: 495601 - RNA, 17 nt, Chlamydophila pneumoniae CWL029
uaaugcucacuucuuug

SEQ ID NO: 495602 - RNA, 23 nt, Chlamydophila pneumoniae CWL029
uaaugcagauagcuuacagagaa

SEQ ID NO: 495603 - RNA, 12 nt, Chlamydophila pneumoniae CWL029
uaauuaaaaacu

SEQ ID NO: 495604 - RNA, 15 nt, Chlamydophila pneumoniae CWL029
uaauuacagaucugc

SEQ ID NO: 495605 - RNA, 14 nt, Chlamydophila pneumoniae CWL029
uaauuacagaaucc

SEQ ID NO: 495606 - RNA, 23 nt, Chlamydophila pneumoniae CWL029
uaauguuuggccaacagcuaaua

SEQ ID NO: 495607 - RNA, 15 nt, Chlamydophila pneumoniae CWL029
uaauuauguagaucu

SEQ ID NO: 495608 - RNA, 20 nt, Chlamydophila pneumoniae CWL029
uaauuccaucuggaauggcc

SEQ ID NO: 495609 - RNA, 20 nt, Chlamydophila pneumoniae CWL029
uaauuccaaaauaaaaggag

SEQ ID NO: 495610 - RNA, 18 nt, Chlamydophila pneumoniae CWL029
uaacuuaauagauucguu

SEQ ID NO: 495611 - RNA, 20 nt, Chlamydophila pneumoniae CWL029
uaacuuaaagacuugcuucc

SEQ ID NO: 495612 - RNA, 20 nt, Chlamydophila pneumoniae CWL029
uaacuggcaaucuaaaauca

SEQ ID NO: 495613 - RNA, 15 nt, Chlamydophila pneumoniae CWL029
uaacuggcaaucuaa

SEQ ID NO: 495614 - RNA, 13 nt, Chlamydophila pneumoniae CWL029
aaauccgauaaga

SEQ ID NO: 495615 - RNA, 20 nt, Chlamydophila pneumoniae CWL029
aaaucccugaugcaguaauu

SEQ ID NO: 495616 - RNA, 18 nt, Chlamydophila pneumoniae CWL029
aaaucccuguucuagcaa

SEQ ID NO: 495617 - RNA, 20 nt, Chlamydophila pneumoniae CWL029
aaaucccgaacaaucaacac

SEQ ID NO: 495618 - RNA, 19 nt, Chlamydophila pneumoniae CWL029
uaacugagcaacuucuucg

SEQ ID NO: 495619 - RNA, 22 nt, Chlamydophila pneumoniae CWL029
uaacugaggcaaagauuuccaa

SEQ ID NO: 495620 - RNA, 21 nt, Chlamydophila pneumoniae CWL029
uaacucggaaaaaauagaucc

SEQ ID NO: 495621 - RNA, 17 nt, Chlamydophila pneumoniae CWL029
uaacucuagaucuucaa

SEQ ID NO: 495622 - RNA, 21 nt, Chlamydophila pneumoniae CWL029
uaacucuagaucuucaauccc

SEQ ID NO: 495623 - RNA, 19 nt, Chlamydophila pneumoniae CWL029
uaacuccaggggauaaaac

SEQ ID NO: 495624 - RNA, 19 nt, Chlamydophila pneumoniae CWL029
uaacuaucuacacaguagc

SEQ ID NO: 495625 - RNA, 23 nt, Chlamydophila pneumoniae CWL029
uaacuaucucuguuuuuugaaaa

SEQ ID NO: 495626 - RNA, 20 nt, Chlamydophila pneumoniae CWL029
uaacuauugggaaugcauuu

SEQ ID NO: 495627 - RNA, 14 nt, Chlamydophila pneumoniae CWL029
uaacguugauugga

SEQ ID NO: 495628 - RNA, 20 nt, Chlamydophila pneumoniae CWL029
uaacguuucuucgcaaauau

SEQ ID NO: 495629 - RNA, 19 nt, Chlamydophila pneumoniae CWL029
uaacguuucaggucagcaa

SEQ ID NO: 495630 - RNA, 16 nt, Chlamydophila pneumoniae CWL029
uaacguagucaaaaau

SEQ ID NO: 495631 - RNA, 23 nt, Chlamydophila pneumoniae CWL029
uaacguacgcaaguaaagaaauu

SEQ ID NO: 495632 - RNA, 16 nt, Chlamydophila pneumoniae CWL029
uaagaaugagaacguc

SEQ ID NO: 495633 - RNA, 15 nt, Chlamydophila pneumoniae CWL029
uaagaauaaaauagg

SEQ ID NO: 495634 - RNA, 13 nt, Chlamydophila pneumoniae CWL029
uaagaaaucccag

SEQ ID NO: 495635 - RNA, 14 nt, Chlamydophila pneumoniae CWL029
uaagaaacuuccaa

SEQ ID NO: 495636 - RNA, 16 nt, Chlamydophila pneumoniae CWL029
uaagaacaucuuccca

SEQ ID NO: 495637 - RNA, 15 nt, Chlamydophila pneumoniae CWL029
uaagaacguauacgu

SEQ ID NO: 495638 - RNA, 15 nt, Chlamydophila pneumoniae CWL029
uaagaacuagaaaaa

SEQ ID NO: 495639 - RNA, 15 nt, Chlamydophila pneumoniae CWL029
uaagaacuuuaggga

SEQ ID NO: 495640 - RNA, 13 nt, Chlamydophila pneumoniae CWL029
uaagaaaauccua

SEQ ID NO: 495641 - RNA, 23 nt, Chlamydophila pneumoniae CWL029
uaagaaacuaguucuucuuuacu

SEQ ID NO: 495642 - RNA, 22 nt, Chlamydophila pneumoniae CWL029
uaacuuggugagcagcuuuauc

SEQ ID NO: 495643 - RNA, 14 nt, Chlamydophila pneumoniae CWL029
uaagauuauuuguu

SEQ ID NO: 495644 - RNA, 17 nt, Chlamydophila pneumoniae CWL029
uaagaugcugaaccuuu

SEQ ID NO: 495645 - RNA, 14 nt, Chlamydophila pneumoniae CWL029
uaagaucuuuagaa

SEQ ID NO: 495646 - RNA, 16 nt, Chlamydophila pneumoniae CWL029
uaagauccucuauaga

SEQ ID NO: 495647 - RNA, 17 nt, Chlamydophila pneumoniae CWL029
uaagauauucaagagga

SEQ ID NO: 495648 - RNA, 23 nt, Chlamydophila pneumoniae CWL029
uaagauauguccgugagcaacaa

SEQ ID NO: 495649 - RNA, 20 nt, Chlamydophila pneumoniae CWL029
uaagauaucgaccuuaaaau

SEQ ID NO: 495650 - RNA, 14 nt, Chlamydophila pneumoniae CWL029
uaagauaucuccag

SEQ ID NO: 495651 - RNA, 20 nt, Chlamydophila pneumoniae CWL029
uaagauagacucucacugag

SEQ ID NO: 495652 - RNA, 21 nt, Chlamydophila pneumoniae CWL029
uaagauagacucucacugagu

SEQ ID NO: 495653 - RNA, 19 nt, Chlamydophila pneumoniae CWL029
uaagauagacucucacuga

SEQ ID NO: 495654 - RNA, 20 nt, Chlamydophila pneumoniae CWL029
uaagauaaacagcacaggca

SEQ ID NO: 495655 - RNA, 16 nt, Chlamydophila pneumoniae CWL029
uaagauaaacauuaag

SEQ ID NO: 495656 - RNA, 14 nt, Chlamydophila pneumoniae CWL029
uaagauaauagaga

SEQ ID NO: 495657 - RNA, 17 nt, Chlamydophila pneumoniae CWL029
uaagauaauagagaaga

SEQ ID NO: 495658 - RNA, 21 nt, Chlamydophila pneumoniae CWL029
uaagauaauagagaagaagca

SEQ ID NO: 495659 - RNA, 17 nt, Chlamydophila pneumoniae CWL029
uaagaggugauacauag

SEQ ID NO: 495660 - RNA, 16 nt, Chlamydophila pneumoniae CWL029
uaagagguucucuuaa

SEQ ID NO: 495661 - RNA, 17 nt, Chlamydophila pneumoniae CWL029
uaagagguucuugcuua

SEQ ID NO: 495662 - RNA, 17 nt, Chlamydophila pneumoniae CWL029
uaagaguuccaagacaa

SEQ ID NO: 495663 - RNA, 21 nt, Chlamydophila pneumoniae CWL029
uaagaguuuuacaucaaugau

SEQ ID NO: 495664 - RNA, 15 nt, Chlamydophila pneumoniae CWL029
uaagagaacuuuaac

SEQ ID NO: 495665 - RNA, 17 nt, Chlamydophila pneumoniae CWL029
uaagagacauuucuuga

SEQ ID NO: 495666 - RNA, 23 nt, Chlamydophila pneumoniae CWL029
uaagagauuuuccauaggaacaa

SEQ ID NO: 495667 - RNA, 17 nt, Chlamydophila pneumoniae CWL029
uaagagcaaacaucaaa

SEQ ID NO: 495668 - RNA, 12 nt, Chlamydophila pneumoniae CWL029
uaagagcuacaa

SEQ ID NO: 495669 - RNA, 16 nt, Chlamydophila pneumoniae CWL029
uaagacuguguuuuau

SEQ ID NO: 495670 - RNA, 16 nt, Chlamydophila pneumoniae CWL029
uaagacuaaaaaagag

SEQ ID NO: 495671 - RNA, 16 nt, Chlamydophila pneumoniae CWL029
uaagacgugcaucgcu

SEQ ID NO: 495672 - RNA, 19 nt, Chlamydophila pneumoniae CWL029
uaagucuugaguucuuuug

SEQ ID NO: 495673 - RNA, 23 nt, Chlamydophila pneumoniae CWL029
uaaguccuucuucccagccuuga

SEQ ID NO: 495674 - RNA, 19 nt, Chlamydophila pneumoniae CWL029
uaaguccuucuucccagcc

SEQ ID NO: 495675 - RNA, 16 nt, Chlamydophila pneumoniae CWL029
uaaguccuucuuccca

SEQ ID NO: 495676 - RNA, 15 nt, Chlamydophila pneumoniae CWL029
uaaguccaacaucag

SEQ ID NO: 495677 - RNA, 23 nt, Chlamydophila pneumoniae CWL029
uaaguaggccuccuucauucaca

SEQ ID NO: 495678 - RNA, 17 nt, Chlamydophila pneumoniae CWL029
uaaguaaccaauacagc

SEQ ID NO: 495679 - RNA, 17 nt, Chlamydophila pneumoniae CWL029
uaaggugcuauuuuaaa

SEQ ID NO: 495680 - RNA, 18 nt, Chlamydophila pneumoniae CWL029
uaagguuaucuuuuugga

SEQ ID NO: 495681 - RNA, 14 nt, Chlamydophila pneumoniae CWL029
uaagguuccaaaaa

SEQ ID NO: 495682 - RNA, 19 nt, Chlamydophila pneumoniae CWL029
uaagguuuccaugagaaua

SEQ ID NO: 495683 - RNA, 13 nt, Chlamydophila pneumoniae CWL029
uaaggguuuugaa

SEQ ID NO: 495684 - RNA, 17 nt, Chlamydophila pneumoniae CWL029
uaaggcuuccaaugcua

SEQ ID NO: 495685 - RNA, 20 nt, Chlamydophila pneumoniae CWL029
uaaggcuuccaaugcuauug

SEQ ID NO: 495686 - RNA, 16 nt, Chlamydophila pneumoniae CWL029
uaagggcucuccuaaa

SEQ ID NO: 495687 - RNA, 17 nt, Chlamydophila pneumoniae CWL029
uaaguugguccaucgag

SEQ ID NO: 495688 - RNA, 13 nt, Chlamydophila pneumoniae CWL029
uaaguucuuccaa

SEQ ID NO: 495689 - RNA, 17 nt, Chlamydophila pneumoniae CWL029
uaaguuagagacacaga

SEQ ID NO: 495690 - RNA, 12 nt, Chlamydophila pneumoniae CWL029
uaagugcuuuua

SEQ ID NO: 495691 - RNA, 17 nt, Chlamydophila pneumoniae CWL029
uaagugauaaggaagaa

SEQ ID NO: 495692 - RNA, 12 nt, Chlamydophila pneumoniae CWL029
uaauaaaucuau

SEQ ID NO: 495693 - RNA, 13 nt, Chlamydophila pneumoniae CWL029
uaauaaaauuuaa

SEQ ID NO: 495694 - RNA, 16 nt, Chlamydophila pneumoniae CWL029
uaauaaaauuuaaaaa

SEQ ID NO: 495695 - RNA, 22 nt, Chlamydophila pneumoniae CWL029
uaauaaaauuuaaaaaaaucuu

SEQ ID NO: 495696 - RNA, 14 nt, Chlamydophila pneumoniae CWL029
uaauaaaagaacau

SEQ ID NO: 495697 - RNA, 15 nt, Chlamydophila pneumoniae CWL029
uaauaaaagaacauu

SEQ ID NO: 495698 - RNA, 23 nt, Chlamydophila pneumoniae CWL029
uaaggaagaauuucgucuucaua

SEQ ID NO: 495699 - RNA, 23 nt, Chlamydophila pneumoniae CWL029
uaagcuuuucuuccaaagacuga

SEQ ID NO: 495700 - RNA, 17 nt, Chlamydophila pneumoniae CWL029
uaagcuuuccucuccaa

SEQ ID NO: 495701 - RNA, 20 nt, Chlamydophila pneumoniae CWL029
uaagcuaauaagauccaaaa

SEQ ID NO: 495702 - RNA, 12 nt, Chlamydophila pneumoniae CWL029
uaagcucaaaau

SEQ ID NO: 495703 - RNA, 15 nt, Chlamydophila pneumoniae CWL029
uaagcgcucuucaau

SEQ ID NO: 495704 - RNA, 20 nt, Chlamydophila pneumoniae CWL029
uaagcuggauucugucuaua

SEQ ID NO: 495705 - RNA, 19 nt, Chlamydophila pneumoniae CWL029
uaagcuggauucugucuau

SEQ ID NO: 495706 - RNA, 15 nt, Chlamydophila pneumoniae CWL029
uaagcuuauuucugu

SEQ ID NO: 495707 - RNA, 16 nt, Chlamydophila pneumoniae CWL029
uaagcuuuauguggag

SEQ ID NO: 495708 - RNA, 19 nt, Chlamydophila pneumoniae CWL029
uaagcucuuaauuucugcu

SEQ ID NO: 495709 - RNA, 21 nt, Chlamydophila pneumoniae CWL029
uaagcucaaaauuuccucgac

SEQ ID NO: 495710 - RNA, 15 nt, Chlamydophila pneumoniae CWL029
uaagcugcaaucuca

SEQ ID NO: 495711 - RNA, 18 nt, Chlamydophila pneumoniae CWL029
uaagauugccauguacau

SEQ ID NO: 495712 - RNA, 22 nt, Chlamydophila pneumoniae CWL029
uaagauugccauguacaugcag

SEQ ID NO: 495713 - RNA, 13 nt, Chlamydophila pneumoniae CWL029
uaagauuuccuua

SEQ ID NO: 495714 - RNA, 22 nt, Chlamydophila pneumoniae CWL029
uaagcaagcaacugauguuuua

SEQ ID NO: 495715 - RNA, 22 nt, Chlamydophila pneumoniae CWL029
uaagcaauauuucuguucugcu

SEQ ID NO: 495716 - RNA, 19 nt, Chlamydophila pneumoniae CWL029
uaagcagugugcugauuuu

SEQ ID NO: 495717 - RNA, 20 nt, Chlamydophila pneumoniae CWL029
uaagcauauuuaaauauaaa

SEQ ID NO: 495718 - RNA, 14 nt, Chlamydophila pneumoniae CWL029
uaagccaaauacca

SEQ ID NO: 495719 - RNA, 15 nt, Chlamydophila pneumoniae CWL029
uaagccaaauaccaa

SEQ ID NO: 495720 - RNA, 15 nt, Chlamydophila pneumoniae CWL029
uaagccaguacuaaa

SEQ ID NO: 495721 - RNA, 15 nt, Chlamydophila pneumoniae CWL029
uaagcgauggcaguu

SEQ ID NO: 495722 - RNA, 24 nt, Chlamydophila pneumoniae CWL029
uaacccgcuugcaucuuauggaag

SEQ ID NO: 495723 - RNA, 17 nt, Chlamydophila pneumoniae CWL029
uaaccccuccaaaauca

SEQ ID NO: 495724 - RNA, 12 nt, Chlamydophila pneumoniae CWL029
uaaccagagagc

SEQ ID NO: 495725 - RNA, 17 nt, Chlamydophila pneumoniae CWL029
uaacauccauagagaac

SEQ ID NO: 495726 - RNA, 17 nt, Chlamydophila pneumoniae CWL029
uaacacuuuguuuuuca

SEQ ID NO: 495727 - RNA, 14 nt, Chlamydophila pneumoniae CWL029
uaacagagcgccuc

SEQ ID NO: 495728 - RNA, 13 nt, Chlamydophila pneumoniae CWL029
uaacacuucuuuc

SEQ ID NO: 495729 - RNA, 15 nt, Chlamydophila pneumoniae CWL029
uaacacuucuuucuu

SEQ ID NO: 495730 - RNA, 13 nt, Chlamydophila pneumoniae CWL029
uaacgcugcuaau

SEQ ID NO: 495731 - RNA, 13 nt, Chlamydophila pneumoniae CWL029
uaacgcuuuucua

SEQ ID NO: 495732 - RNA, 19 nt, Chlamydophila pneumoniae CWL029
uaacgcuuuuucaaacugu

SEQ ID NO: 495733 - RNA, 21 nt, Chlamydophila pneumoniae CWL029
uaaccgucacuguuuuccaga

SEQ ID NO: 495734 - RNA, 17 nt, Chlamydophila pneumoniae CWL029
uaaccuaaggcauggca

SEQ ID NO: 495735 - RNA, 14 nt, Chlamydophila pneumoniae CWL029
uaacaccucuucaa

SEQ ID NO: 495736 - RNA, 15 nt, Chlamydophila pneumoniae CWL029
uaacaccaaaagaau

SEQ ID NO: 495737 - RNA, 18 nt, Chlamydophila pneumoniae CWL029
uaacaagggaagagaaaa

SEQ ID NO: 495738 - RNA, 22 nt, Chlamydophila pneumoniae CWL029
uaacaaguaccaagaaaauagu

SEQ ID NO: 495739 - RNA, 23 nt, Chlamydophila pneumoniae CWL029
uaacaaaaggauucuaugaggac

SEQ ID NO: 495740 - RNA, 22 nt, Chlamydophila pneumoniae CWL029
uaacaacuagguuauuaucaaa

SEQ ID NO: 495741 - RNA, 19 nt, Chlamydophila pneumoniae CWL029
uaacaacuucugacaauaa

SEQ ID NO: 495742 - RNA, 20 nt, Chlamydophila pneumoniae CWL029
uaaauuuuguuuuuccauuu

SEQ ID NO: 495743 - RNA, 14 nt, Chlamydophila pneumoniae CWL029
uaaauuuuuccuuc

SEQ ID NO: 495744 - RNA, 20 nt, Chlamydophila pneumoniae CWL029
uaaauuuuuccuucaacaca

SEQ ID NO: 495745 - RNA, 21 nt, Chlamydophila pneumoniae CWL029
uaaaucgcugggauucguaau

SEQ ID NO: 495746 - RNA, 18 nt, Chlamydophila pneumoniae CWL029
uaaaugccuuaaauguau

SEQ ID NO: 495747 - RNA, 19 nt, Chlamydophila pneumoniae CWL029
uaaauccaccaaugauaau

SEQ ID NO: 495748 - RNA, 20 nt, Chlamydophila pneumoniae CWL029
uaaauccccaccaacaaugc

SEQ ID NO: 495749 - RNA, 21 nt, Chlamydophila pneumoniae CWL029
uaaauguugggaugaucucgu

SEQ ID NO: 495750 - RNA, 19 nt, Chlamydophila pneumoniae CWL029
uaaauguuuucuaugaucc

SEQ ID NO: 495751 - RNA, 12 nt, Chlamydophila pneumoniae CWL029
uaaauucuggaa

SEQ ID NO: 495752 - RNA, 13 nt, Chlamydophila pneumoniae CWL029
uaaauucuggaau

SEQ ID NO: 495753 - RNA, 19 nt, Chlamydophila pneumoniae CWL029
uaaacagaucuuuaucauu

SEQ ID NO: 495754 - RNA, 15 nt, Chlamydophila pneumoniae CWL029
uaaacagcaaaguaa

SEQ ID NO: 495755 - RNA, 23 nt, Chlamydophila pneumoniae CWL029
uaaacagcacaggcauggucucc

SEQ ID NO: 495756 - RNA, 23 nt, Chlamydophila pneumoniae CWL029
uaaacagcgguugccuuucucuu

SEQ ID NO: 495757 - RNA, 20 nt, Chlamydophila pneumoniae CWL029
uaaacaaagcgucuaucuag

SEQ ID NO: 495758 - RNA, 15 nt, Chlamydophila pneumoniae CWL029
guuuuuaucccagau

SEQ ID NO: 495759 - RNA, 16 nt, Chlamydophila pneumoniae CWL029
guuuuuauuuuuaaau

SEQ ID NO: 495760 - RNA, 18 nt, Chlamydophila pneumoniae CWL029
guuuugcuguggaauuuu

SEQ ID NO: 495761 - RNA, 22 nt, Chlamydophila pneumoniae CWL029
guuuugcuuuuugaaugaucca

SEQ ID NO: 495762 - RNA, 15 nt, Chlamydophila pneumoniae CWL029
guuuuggauagaagc

SEQ ID NO: 495763 - RNA, 17 nt, Chlamydophila pneumoniae CWL029
uaaagacccuucuuucc

SEQ ID NO: 495764 - RNA, 18 nt, Chlamydophila pneumoniae CWL029
uaaagacccuucuuucca

SEQ ID NO: 495765 - RNA, 17 nt, Chlamydophila pneumoniae CWL029
uaaagauaaucuguaag

SEQ ID NO: 495766 - RNA, 20 nt, Chlamydophila pneumoniae CWL029
uaaagauacuuaucuuuaaa

SEQ ID NO: 495767 - RNA, 15 nt, Chlamydophila pneumoniae CWL029
uaaagaaucacucuc

SEQ ID NO: 495768 - RNA, 13 nt, Chlamydophila pneumoniae CWL029
uaaagaauucucc

SEQ ID NO: 495769 - RNA, 19 nt, Chlamydophila pneumoniae CWL029
uaaagaauuuguaacucuu

SEQ ID NO: 495770 - RNA, 19 nt, Chlamydophila pneumoniae CWL029
uaaacugacguuuuucccu

SEQ ID NO: 495771 - RNA, 22 nt, Chlamydophila pneumoniae CWL029
uaaacugggaagaccacgaaau

SEQ ID NO: 495772 - RNA, 19 nt, Chlamydophila pneumoniae CWL029
uaaacucuccaaaagcucu

SEQ ID NO: 495773 - RNA, 12 nt, Chlamydophila pneumoniae CWL029
uaaacucuccaa

SEQ ID NO: 495774 - RNA, 22 nt, Chlamydophila pneumoniae CWL029
uaaauaucuuaacgcuuagaga

SEQ ID NO: 495775 - RNA, 15 nt, Chlamydophila pneumoniae CWL029
uaaauauaaauuuau

SEQ ID NO: 495776 - RNA, 13 nt, Chlamydophila pneumoniae CWL029
uaaauauagaaaa

SEQ ID NO: 495777 - RNA, 17 nt, Chlamydophila pneumoniae CWL029
uaaauauagaaaaucau

SEQ ID NO: 495778 - RNA, 14 nt, Chlamydophila pneumoniae CWL029
uaaaguuuguaaaa

SEQ ID NO: 495779 - RNA, 13 nt, Chlamydophila pneumoniae CWL029
uaaauaaaaccac

SEQ ID NO: 495780 - RNA, 13 nt, Chlamydophila pneumoniae CWL029
uaaaguccaagau

SEQ ID NO: 495781 - RNA, 15 nt, Chlamydophila pneumoniae CWL029
uaaaggaacugugcc

SEQ ID NO: 495782 - RNA, 21 nt, Chlamydophila pneumoniae CWL029
uaaaguaauaucgguuucuuu

SEQ ID NO: 495783 - RNA, 21 nt, Chlamydophila pneumoniae CWL029
uaaaggaacugugccauaacg

SEQ ID NO: 495784 - RNA, 20 nt, Chlamydophila pneumoniae CWL029
uaaaguggcaaucuuuucuu

SEQ ID NO: 495785 - RNA, 18 nt, Chlamydophila pneumoniae CWL029
uaaagugucauacgcagc

SEQ ID NO: 495786 - RNA, 19 nt, Chlamydophila pneumoniae CWL029
uaaagcuauuguuuuucaa

SEQ ID NO: 495787 - RNA, 22 nt, Chlamydophila pneumoniae CWL029
uaaagccccacccacuccagaa

SEQ ID NO: 495788 - RNA, 15 nt, Chlamydophila pneumoniae CWL029
uaaagcuugagaaaa

SEQ ID NO: 495789 - RNA, 18 nt, Chlamydophila pneumoniae CWL029
uaaagcuccgagaaacaa

SEQ ID NO: 495790 - RNA, 14 nt, Chlamydophila pneumoniae CWL029
uaaagcugcuuuuu

SEQ ID NO: 495791 - RNA, 21 nt, Chlamydophila pneumoniae CWL029
uaaagauagcgacgucaucau

SEQ ID NO: 495792 - RNA, 22 nt, Chlamydophila pneumoniae CWL029
uaaagauagcgacgucaucaua

SEQ ID NO: 495793 - RNA, 20 nt, Chlamydophila pneumoniae CWL029
uaaagaucgugaucaaagaa

SEQ ID NO: 495794 - RNA, 23 nt, Chlamydophila pneumoniae CWL029
uaaagaucuuuuaugauguauaa

SEQ ID NO: 495795 - RNA, 16 nt, Chlamydophila pneumoniae CWL029
uaaagaucuucauaac

SEQ ID NO: 495796 - RNA, 19 nt, Chlamydophila pneumoniae CWL029
uaaagauguagaauaacgc

SEQ ID NO: 495797 - RNA, 15 nt, Chlamydophila pneumoniae CWL029
uaaagauuggaauau

SEQ ID NO: 495798 - RNA, 16 nt, Chlamydophila pneumoniae CWL029
ucacagcaaucugcag

SEQ ID NO: 495799 - RNA, 22 nt, Chlamydophila pneumoniae CWL029
ucacagcauuuucucugagcag

SEQ ID NO: 495800 - RNA, 16 nt, Chlamydophila pneumoniae CWL029
ucacagagucugggau

SEQ ID NO: 495801 - RNA, 22 nt, Chlamydophila pneumoniae CWL029
ucacagagucugggauguucaa

SEQ ID NO: 495802 - RNA, 19 nt, Chlamydophila pneumoniae CWL029
ucacagauaccaucaccuu

SEQ ID NO: 495803 - RNA, 20 nt, Chlamydophila pneumoniae CWL029
ucacagauaccaucaccuuc

SEQ ID NO: 495804 - RNA, 18 nt, Chlamydophila pneumoniae CWL029
ucacagcaugcacggcuu

SEQ ID NO: 495805 - RNA, 17 nt, Chlamydophila pneumoniae CWL029
ucacagcgcugugagga

SEQ ID NO: 495806 - RNA, 16 nt, Chlamydophila pneumoniae CWL029
ucacaaacaacagaaa

SEQ ID NO: 495807 - RNA, 11 nt, Chlamydophila pneumoniae CWL029
ucacaaagaau

SEQ ID NO: 495808 - RNA, 12 nt, Chlamydophila pneumoniae CWL029
ucacaaagaauu

SEQ ID NO: 495809 - RNA, 23 nt, Chlamydophila pneumoniae CWL029
ucacaguauuccaucacaguuaa

SEQ ID NO: 495810 - RNA, 19 nt, Chlamydophila pneumoniae CWL029
ucacaguuaagacgcagaa

SEQ ID NO: 495811 - RNA, 15 nt, Chlamydophila pneumoniae CWL029
aaaucgcauuacaaa

SEQ ID NO: 495812 - RNA, 20 nt, Chlamydophila pneumoniae CWL029
ucaccauauaauagauauac

SEQ ID NO: 495813 - RNA, 13 nt, Chlamydophila pneumoniae CWL029
ucacaucuuucuc

SEQ ID NO: 495814 - RNA, 15 nt, Chlamydophila pneumoniae CWL029
ucacaucuccuuuca

SEQ ID NO: 495815 - RNA, 14 nt, Chlamydophila pneumoniae CWL029
ucacaucaguucca

SEQ ID NO: 495816 - RNA, 16 nt, Chlamydophila pneumoniae CWL029
ucaaugagaucugcaa

SEQ ID NO: 495817 - RNA, 22 nt, Chlamydophila pneumoniae CWL029
ucaaugagcaucugagucauaa

SEQ ID NO: 495818 - RNA, 15 nt, Chlamydophila pneumoniae CWL029
ucaaugacuguaucu

SEQ ID NO: 495819 - RNA, 18 nt, Chlamydophila pneumoniae CWL029
ucaaugaagaaaaaucua

SEQ ID NO: 495820 - RNA, 13 nt, Chlamydophila pneumoniae CWL029
ucaauucuguuau

SEQ ID NO: 495821 - RNA, 12 nt, Chlamydophila pneumoniae CWL029
ucaauuccuuuc

SEQ ID NO: 495822 - RNA, 22 nt, Chlamydophila pneumoniae CWL029
ucaauuccuuucuccagcauuu

SEQ ID NO: 495823 - RNA, 23 nt, Chlamydophila pneumoniae CWL029
ucaauaaucggccgaguuucucc

SEQ ID NO: 495824 - RNA, 19 nt, Chlamydophila pneumoniae CWL029
ucaauaaccagaagacucc

SEQ ID NO: 495825 - RNA, 14 nt, Chlamydophila pneumoniae CWL029
ucaauaagaucucg

SEQ ID NO: 495826 - RNA, 21 nt, Chlamydophila pneumoniae CWL029
ucaauaagcuugccagcagaa

SEQ ID NO: 495827 - RNA, 13 nt, Chlamydophila pneumoniae CWL029
ucaauaaguagau

SEQ ID NO: 495828 - RNA, 15 nt, Chlamydophila pneumoniae CWL029
ucaagaaaaaccccu

SEQ ID NO: 495829 - RNA, 14 nt, Chlamydophila pneumoniae CWL029
ucaaguuucuuuug

SEQ ID NO: 495830 - RNA, 19 nt, Chlamydophila pneumoniae CWL029
ucaauaucuugaauucuca

SEQ ID NO: 495831 - RNA, 18 nt, Chlamydophila pneumoniae CWL029
ucaauagguaaggaaacg

SEQ ID NO: 495832 - RNA, 14 nt, Chlamydophila pneumoniae CWL029
ucaacuuuguuaau

SEQ ID NO: 495833 - RNA, 19 nt, Chlamydophila pneumoniae CWL029
ucaacuacaucuccaagcc

SEQ ID NO: 495834 - RNA, 15 nt, Chlamydophila pneumoniae CWL029
ucaacuacaucucca

SEQ ID NO: 495835 - RNA, 16 nt, Chlamydophila pneumoniae CWL029
ucaacuacaucuccaa

SEQ ID NO: 495836 - RNA, 13 nt, Chlamydophila pneumoniae CWL029
ucaacccagcugc

SEQ ID NO: 495837 - RNA, 19 nt, Chlamydophila pneumoniae CWL029
ucaacaccucaauacggac

SEQ ID NO: 495838 - RNA, 21 nt, Chlamydophila pneumoniae CWL029
ucaacacccggcuuuuccaga

SEQ ID NO: 495839 - RNA, 21 nt, Chlamydophila pneumoniae CWL029
ucaacauucuucugucuguau

SEQ ID NO: 495840 - RNA, 13 nt, Chlamydophila pneumoniae CWL029
ucaacauucuucu

SEQ ID NO: 495841 - RNA, 18 nt, Chlamydophila pneumoniae CWL029
ucaaaagaaaucaaacau

SEQ ID NO: 495842 - RNA, 12 nt, Chlamydophila pneumoniae CWL029
uauuuaauccaa

SEQ ID NO: 495843 - RNA, 12 nt, Chlamydophila pneumoniae CWL029
ucaaaauuuaaa

SEQ ID NO: 495844 - RNA, 14 nt, Chlamydophila pneumoniae CWL029
ucaaaauuuaaaua

SEQ ID NO: 495845 - RNA, 15 nt, Chlamydophila pneumoniae CWL029
ucaaaauuuaaauau

SEQ ID NO: 495846 - RNA, 18 nt, Chlamydophila pneumoniae CWL029
ucaaaauuuuuaguaauu

SEQ ID NO: 495847 - RNA, 24 nt, Chlamydophila pneumoniae CWL029
ucaaaauuuuuaguaauuacagcu

SEQ ID NO: 495848 - RNA, 11 nt, Chlamydophila pneumoniae CWL029
ucaaacauuac

SEQ ID NO: 495849 - RNA, 21 nt, Chlamydophila pneumoniae CWL029
ucaaaccacggauuuucucua

SEQ ID NO: 495850 - RNA, 17 nt, Chlamydophila pneumoniae CWL029
ucaaauuugcucuccug

SEQ ID NO: 495851 - RNA, 21 nt, Chlamydophila pneumoniae CWL029
ucaaauuggaauucgcauuuu

SEQ ID NO: 495852 - RNA, 12 nt, Chlamydophila pneumoniae CWL029
ucaaauucugaa

SEQ ID NO: 495853 - RNA, 15 nt, Chlamydophila pneumoniae CWL029
ucaaaucaucaaaaa

SEQ ID NO: 495854 - RNA, 15 nt, Chlamydophila pneumoniae CWL029
ucaaauuccuucuca

SEQ ID NO: 495855 - RNA, 19 nt, Chlamydophila pneumoniae CWL029
ucaaauuccuucucagaaa

SEQ ID NO: 495856 - RNA, 16 nt, Chlamydophila pneumoniae CWL029
ucaaacugauuaguuu

SEQ ID NO: 495857 - RNA, 21 nt, Chlamydophila pneumoniae CWL029
ucaaacugauuaguuuguuuu

SEQ ID NO: 495858 - RNA, 12 nt, Chlamydophila pneumoniae CWL029
ucaaagcaaaga

SEQ ID NO: 495859 - RNA, 16 nt, Chlamydophila pneumoniae CWL029
ucaaagcaaagagcaa

SEQ ID NO: 495860 - RNA, 23 nt, Chlamydophila pneumoniae CWL029
ucaaauaggaucucucuuuccuu

SEQ ID NO: 495861 - RNA, 13 nt, Chlamydophila pneumoniae CWL029
ucaaauaguucau

SEQ ID NO: 495862 - RNA, 17 nt, Chlamydophila pneumoniae CWL029
ucaaauaguucaucaua

SEQ ID NO: 495863 - RNA, 23 nt, Chlamydophila pneumoniae CWL029
ucaaauaguucaucauauuuuuc

SEQ ID NO: 495864 - RNA, 17 nt, Chlamydophila pneumoniae CWL029
ucaaaggauccauaacc

SEQ ID NO: 495865 - RNA, 18 nt, Chlamydophila pneumoniae CWL029
ucaaauacuucuccugaa

SEQ ID NO: 495866 - RNA, 18 nt, Chlamydophila pneumoniae CWL029
ucaaauagauuuuuacuu

SEQ ID NO: 495867 - RNA, 21 nt, Chlamydophila pneumoniae CWL029
ucaaaggcaacgcgauuuuca

SEQ ID NO: 495868 - RNA, 16 nt, Chlamydophila pneumoniae CWL029
ucagaaagccuuugcu

SEQ ID NO: 495869 - RNA, 21 nt, Chlamydophila pneumoniae CWL029
ucagaaauuccuaaaauuucc

SEQ ID NO: 495870 - RNA, 21 nt, Chlamydophila pneumoniae CWL029
ucagaacaacgcugcuucucu

SEQ ID NO: 495871 - RNA, 23 nt, Chlamydophila pneumoniae CWL029
ucagaacaacgcugcuucucuac

SEQ ID NO: 495872 - RNA, 13 nt, Chlamydophila pneumoniae CWL029
ucagaacaagaag

SEQ ID NO: 495873 - RNA, 19 nt, Chlamydophila pneumoniae CWL029
ucagaacaagaaguaggaa

SEQ ID NO: 495874 - RNA, 14 nt, Chlamydophila pneumoniae CWL029
ucacuucaauuaca

SEQ ID NO: 495875 - RNA, 16 nt, Chlamydophila pneumoniae CWL029
ucacuucaucgacagu

SEQ ID NO: 495876 - RNA, 16 nt, Chlamydophila pneumoniae CWL029
ucacuaucuucuaaaa

SEQ ID NO: 495877 - RNA, 17 nt, Chlamydophila pneumoniae CWL029
ucacuaucuucuaaaac

SEQ ID NO: 495878 - RNA, 17 nt, Chlamydophila pneumoniae CWL029
ucacuagagaaaaagcc

SEQ ID NO: 495879 - RNA, 16 nt, Chlamydophila pneumoniae CWL029
ucacguccacaagcuu

SEQ ID NO: 495880 - RNA, 23 nt, Chlamydophila pneumoniae CWL029
aaaucgguaaccugugaaaauuu

SEQ ID NO: 495881 - RNA, 20 nt, Chlamydophila pneumoniae CWL029
ucagcaaagacauccaagcc

SEQ ID NO: 495882 - RNA, 13 nt, Chlamydophila pneumoniae CWL029
ucagcaacauaaa

SEQ ID NO: 495883 - RNA, 21 nt, Chlamydophila pneumoniae CWL029
ucagcaacaucguuaauauaa

SEQ ID NO: 495884 - RNA, 21 nt, Chlamydophila pneumoniae CWL029
ucagauaaguuacuuucugau

SEQ ID NO: 495885 - RNA, 17 nt, Chlamydophila pneumoniae CWL029
ucagaugucuagaaaag

SEQ ID NO: 495886 - RNA, 19 nt, Chlamydophila pneumoniae CWL029
ucagaaugcccuuuaggga

SEQ ID NO: 495887 - RNA, 19 nt, Chlamydophila pneumoniae CWL029
ucagaauccauuuugccca

SEQ ID NO: 495888 - RNA, 20 nt, Chlamydophila pneumoniae CWL029
ucagaauccauuuugcccac

SEQ ID NO: 495889 - RNA, 20 nt, Chlamydophila pneumoniae CWL029
ucagaauuuuaucagaaacu

SEQ ID NO: 495890 - RNA, 13 nt, Chlamydophila pneumoniae CWL029
ucagaagcuauuc

SEQ ID NO: 495891 - RNA, 23 nt, Chlamydophila pneumoniae CWL029
ucagaaggaucugauagaacagg

SEQ ID NO: 495892 - RNA, 19 nt, Chlamydophila pneumoniae CWL029
ucagacgugcucucuacuu

SEQ ID NO: 495893 - RNA, 20 nt, Chlamydophila pneumoniae CWL029
ucagaggagccuccauaaug

SEQ ID NO: 495894 - RNA, 15 nt, Chlamydophila pneumoniae CWL029
ucagaggcuagaaaa

SEQ ID NO: 495895 - RNA, 19 nt, Chlamydophila pneumoniae CWL029
ucagaguugucaaguaagu

SEQ ID NO: 495896 - RNA, 18 nt, Chlamydophila pneumoniae CWL029
ucagagauugccaggaga

SEQ ID NO: 495897 - RNA, 16 nt, Chlamydophila pneumoniae CWL029
ucagagauugccagga

SEQ ID NO: 495898 - RNA, 17 nt, Chlamydophila pneumoniae CWL029
ucagagacaaguucauc

SEQ ID NO: 495899 - RNA, 20 nt, Chlamydophila pneumoniae CWL029
ucagagacaaguucaucaaa

SEQ ID NO: 495900 - RNA, 13 nt, Chlamydophila pneumoniae CWL029
ucagagagaacag

SEQ ID NO: 495901 - RNA, 18 nt, Chlamydophila pneumoniae CWL029
ucaggucugcugaggaga

SEQ ID NO: 495902 - RNA, 15 nt, Chlamydophila pneumoniae CWL029
ucaguggauucgugc

SEQ ID NO: 495903 - RNA, 19 nt, Chlamydophila pneumoniae CWL029
ucagugucuugaagagauu

SEQ ID NO: 495904 - RNA, 16 nt, Chlamydophila pneumoniae CWL029
ucaguaucaauaaucg

SEQ ID NO: 495905 - RNA, 15 nt, Chlamydophila pneumoniae CWL029
ucagucucucuaucu

SEQ ID NO: 495906 - RNA, 23 nt, Chlamydophila pneumoniae CWL029
aaaucuccguuugucccuuucag

SEQ ID NO: 495907 - RNA, 23 nt, Chlamydophila pneumoniae CWL029
aaaucucgagcuaccuagggucu

SEQ ID NO: 495908 - RNA, 20 nt, Chlamydophila pneumoniae CWL029
aaaucuaucugcacuuucuu

SEQ ID NO: 495909 - RNA, 14 nt, Chlamydophila pneumoniae CWL029
aaaucuauuccccu

SEQ ID NO: 495910 - RNA, 15 nt, Chlamydophila pneumoniae CWL029
aaaucucuaagaauc

SEQ ID NO: 495911 - RNA, 23 nt, Chlamydophila pneumoniae CWL029
aaaucucuaguuuuuacauguaa

SEQ ID NO: 495912 - RNA, 22 nt, Chlamydophila pneumoniae CWL029
aaaucuauacccaguuguaucc

SEQ ID NO: 495913 - RNA, 19 nt, Chlamydophila pneumoniae CWL029
aaaucuaccgugaagauuu

SEQ ID NO: 495914 - RNA, 21 nt, Chlamydophila pneumoniae CWL029
aaaucuacucuuuaaaaauag

SEQ ID NO: 495915 - RNA, 17 nt, Chlamydophila pneumoniae CWL029
ucaggagauacaagcaa

SEQ ID NO: 495916 - RNA, 15 nt, Chlamydophila pneumoniae CWL029
ucaggacaugccuua

SEQ ID NO: 495917 - RNA, 22 nt, Chlamydophila pneumoniae CWL029
ucaggaccuaagggcucuccua

SEQ ID NO: 495918 - RNA, 23 nt, Chlamydophila pneumoniae CWL029
ucagcucuaauucuucuacagaa

SEQ ID NO: 495919 - RNA, 15 nt, Chlamydophila pneumoniae CWL029
ucaggacaaugaaga

SEQ ID NO: 495920 - RNA, 15 nt, Chlamydophila pneumoniae CWL029
ucaggcauucuucau

SEQ ID NO: 495921 - RNA, 23 nt, Chlamydophila pneumoniae CWL029
ucaggcauucuucauuguagagg

SEQ ID NO: 495922 - RNA, 23 nt, Chlamydophila pneumoniae CWL029
ucaggauacucugaacaggaaua

SEQ ID NO: 495923 - RNA, 21 nt, Chlamydophila pneumoniae CWL029
ucagcucccaugugcugaaga

SEQ ID NO: 495924 - RNA, 20 nt, Chlamydophila pneumoniae CWL029
ucagcgcaucacgaaaagga

SEQ ID NO: 495925 - RNA, 21 nt, Chlamydophila pneumoniae CWL029
ucagcgcaucacgaaaaggag

SEQ ID NO: 495926 - RNA, 21 nt, Chlamydophila pneumoniae CWL029
ucagcccugccucacagcuaa

SEQ ID NO: 495927 - RNA, 12 nt, Chlamydophila pneumoniae CWL029
ucagcauuuuau

SEQ ID NO: 495928 - RNA, 18 nt, Chlamydophila pneumoniae CWL029
ucagcauagagagaagga

SEQ ID NO: 495929 - RNA, 17 nt, Chlamydophila pneumoniae CWL029
ucagcagcuucuauugc

SEQ ID NO: 495930 - RNA, 12 nt, Chlamydophila pneumoniae CWL029
ucagcagcuucu

SEQ ID NO: 495931 - RNA, 23 nt, Chlamydophila pneumoniae CWL029
ucagcacccaccauucuugaaga

SEQ ID NO: 495932 - RNA, 21 nt, Chlamydophila pneumoniae CWL029
ucagcaccuuguauaagagca

SEQ ID NO: 495933 - RNA, 14 nt, Chlamydophila pneumoniae CWL029
ucagcaagcccucc

SEQ ID NO: 495934 - RNA, 13 nt, Chlamydophila pneumoniae CWL029
ucagcaagaaaau

SEQ ID NO: 495935 - RNA, 18 nt, Chlamydophila pneumoniae CWL029
ucagcaagaaaauaggug

SEQ ID NO: 495936 - RNA, 18 nt, Chlamydophila pneumoniae CWL029
uauuaucuacagagagaa

SEQ ID NO: 495937 - RNA, 15 nt, Chlamydophila pneumoniae CWL029
uauuauaaauagaaa

SEQ ID NO: 495938 - RNA, 17 nt, Chlamydophila pneumoniae CWL029
uauuauaaauagaaauc

SEQ ID NO: 495939 - RNA, 19 nt, Chlamydophila pneumoniae CWL029
uauuaggcuuuuuucuauu

SEQ ID NO: 495940 - RNA, 17 nt, Chlamydophila pneumoniae CWL029
uauuaguuuugaaauca

SEQ ID NO: 495941 - RNA, 15 nt, Chlamydophila pneumoniae CWL029
uauuacagauuucuu

SEQ ID NO: 495942 - RNA, 20 nt, Chlamydophila pneumoniae CWL029
uauuaaagaugaaguuccca

SEQ ID NO: 495943 - RNA, 14 nt, Chlamydophila pneumoniae CWL029
uauuaacccaccag

SEQ ID NO: 495944 - RNA, 16 nt, Chlamydophila pneumoniae CWL029
uauuaacccaccagaa

SEQ ID NO: 495945 - RNA, 22 nt, Chlamydophila pneumoniae CWL029
uauuaagggaagaucuugguua

SEQ ID NO: 495946 - RNA, 18 nt, Chlamydophila pneumoniae CWL029
uauuaauaaauuuaucug

SEQ ID NO: 495947 - RNA, 14 nt, Chlamydophila pneumoniae CWL029
uauuaaucuuauug

SEQ ID NO: 495948 - RNA, 15 nt, Chlamydophila pneumoniae CWL029
uauguacuagauagu

SEQ ID NO: 495949 - RNA, 18 nt, Chlamydophila pneumoniae CWL029
uauguacugaugugaagc

SEQ ID NO: 495950 - RNA, 24 nt, Chlamydophila pneumoniae CWL029
uaugugaaagauuauucuagaguu

SEQ ID NO: 495951 - RNA, 18 nt, Chlamydophila pneumoniae CWL029
uaugugaugucgcgaaag

SEQ ID NO: 495952 - RNA, 15 nt, Chlamydophila pneumoniae CWL029
uauguccguauuuuu

SEQ ID NO: 495953 - RNA, 23 nt, Chlamydophila pneumoniae CWL029
aaauccugggcaaugaucaaaaa

SEQ ID NO: 495954 - RNA, 23 nt, Chlamydophila pneumoniae CWL029
aaauccugcucguaaaucuggaa

SEQ ID NO: 495955 - RNA, 13 nt, Chlamydophila pneumoniae CWL029
uauugcaaagcau

SEQ ID NO: 495956 - RNA, 18 nt, Chlamydophila pneumoniae CWL029
uauuuaagggaaauguca

SEQ ID NO: 495957 - RNA, 14 nt, Chlamydophila pneumoniae CWL029
uauuguuuuucaau

SEQ ID NO: 495958 - RNA, 23 nt, Chlamydophila pneumoniae CWL029
uauugggaagaaacuucucuagg

SEQ ID NO: 495959 - RNA, 19 nt, Chlamydophila pneumoniae CWL029
uauugggaaugcauuucau

SEQ ID NO: 495960 - RNA, 19 nt, Chlamydophila pneumoniae CWL029
uauuguguucccucuucuu

SEQ ID NO: 495961 - RNA, 15 nt, Chlamydophila pneumoniae CWL029
uauuccuauaacaac

SEQ ID NO: 495962 - RNA, 21 nt, Chlamydophila pneumoniae CWL029
uauuccuauaacaacauugca

SEQ ID NO: 495963 - RNA, 21 nt, Chlamydophila pneumoniae CWL029
uauucuaaggugcuauuuuaa

SEQ ID NO: 495964 - RNA, 23 nt, Chlamydophila pneumoniae CWL029
uauucuaaggugcuauuuuaaac

SEQ ID NO: 495965 - RNA, 15 nt, Chlamydophila pneumoniae CWL029
uauucuagaguugcu

SEQ ID NO: 495966 - RNA, 17 nt, Chlamydophila pneumoniae CWL029
uauucuguggaauauca

SEQ ID NO: 495967 - RNA, 15 nt, Chlamydophila pneumoniae CWL029
uauucuuuuguaauc

SEQ ID NO: 495968 - RNA, 15 nt, Chlamydophila pneumoniae CWL029
uaugguaguuugccu

SEQ ID NO: 495969 - RNA, 12 nt, Chlamydophila pneumoniae CWL029
uaugguccuagg

SEQ ID NO: 495970 - RNA, 13 nt, Chlamydophila pneumoniae CWL029
uaugggaggaauu

SEQ ID NO: 495971 - RNA, 22 nt, Chlamydophila pneumoniae CWL029
uauggaaggcggcuuuuugcaa

SEQ ID NO: 495972 - RNA, 21 nt, Chlamydophila pneumoniae CWL029
uauggaagagagcaagauaau

SEQ ID NO: 495973 - RNA, 18 nt, Chlamydophila pneumoniae CWL029
uaugcugaauuccucuga

SEQ ID NO: 495974 - RNA, 19 nt, Chlamydophila pneumoniae CWL029
uaugcuguugcuccaagag

SEQ ID NO: 495975 - RNA, 21 nt, Chlamydophila pneumoniae CWL029
uaugcuguugcuccaagaguu

SEQ ID NO: 495976 - RNA, 23 nt, Chlamydophila pneumoniae CWL029
uaugcuauagcuggaucuucuga

SEQ ID NO: 495977 - RNA, 20 nt, Chlamydophila pneumoniae CWL029
uaugcucauuaauaauaucu

SEQ ID NO: 495978 - RNA, 22 nt, Chlamydophila pneumoniae CWL029
uaugcucauuaauaauaucuaa

SEQ ID NO: 495979 - RNA, 19 nt, Chlamydophila pneumoniae CWL029
uaugacggauccuagaaua

SEQ ID NO: 495980 - RNA, 19 nt, Chlamydophila pneumoniae CWL029
uaugacacagcuaaucaau

SEQ ID NO: 495981 - RNA, 12 nt, Chlamydophila pneumoniae CWL029
uaugaaucacau

SEQ ID NO: 495982 - RNA, 16 nt, Chlamydophila pneumoniae CWL029
uaugaaugacugcaga

SEQ ID NO: 495983 - RNA, 17 nt, Chlamydophila pneumoniae CWL029
uaugaaugauuuccaua

SEQ ID NO: 495984 - RNA, 16 nt, Chlamydophila pneumoniae CWL029
uaugaaugauuuccau

SEQ ID NO: 495985 - RNA, 15 nt, Chlamydophila pneumoniae CWL029
uaugacuucuugucc

SEQ ID NO: 495986 - RNA, 20 nt, Chlamydophila pneumoniae CWL029
uaugacuucuuguccuguua

SEQ ID NO: 495987 - RNA, 18 nt, Chlamydophila pneumoniae CWL029
uaugagauaggaacucac

SEQ ID NO: 495988 - RNA, 16 nt, Chlamydophila pneumoniae CWL029
uaugagcuccaaaaua

SEQ ID NO: 495989 - RNA, 17 nt, Chlamydophila pneumoniae CWL029
uaugaggagauaaagau

SEQ ID NO: 495990 - RNA, 22 nt, Chlamydophila pneumoniae CWL029
uaugauccaauagccaaagacu

SEQ ID NO: 495991 - RNA, 17 nt, Chlamydophila pneumoniae CWL029
uaugauccgaaaacucu

SEQ ID NO: 495992 - RNA, 21 nt, Chlamydophila pneumoniae CWL029
uaugauccgaaaacucuuaga

SEQ ID NO: 495993 - RNA, 21 nt, Chlamydophila pneumoniae CWL029
uaugaucucuucaugaaaaaa

SEQ ID NO: 495994 - RNA, 21 nt, Chlamydophila pneumoniae CWL029
uaugaugccucauugccgugg

SEQ ID NO: 495995 - RNA, 21 nt, Chlamydophila pneumoniae CWL029
uaucuagaaguuuaaacgucu

SEQ ID NO: 495996 - RNA, 13 nt, Chlamydophila pneumoniae CWL029
uaucuacgagcau

SEQ ID NO: 495997 - RNA, 16 nt, Chlamydophila pneumoniae CWL029
uaucuauagaaggcau

SEQ ID NO: 495998 - RNA, 20 nt, Chlamydophila pneumoniae CWL029
uaucuauccuuaggugaaau

SEQ ID NO: 495999 - RNA, 22 nt, Chlamydophila pneumoniae CWL029
uaucuaaucaauucgcucagaa

SEQ ID NO: 496000 - RNA, 23 nt, Chlamydophila pneumoniae CWL029
uaucuacacaguagccuucuucu

SEQ ID NO: 496001 - RNA, 12 nt, Chlamydophila pneumoniae CWL029
uaucuacagaga

SEQ ID NO: 496002 - RNA, 12 nt, Chlamydophila pneumoniae CWL029
uaucgugacucu

SEQ ID NO: 496003 - RNA, 20 nt, Chlamydophila pneumoniae CWL029
uaucuccgccauaacacuuu

SEQ ID NO: 496004 - RNA, 18 nt, Chlamydophila pneumoniae CWL029
uaucucuaccgaacagag

SEQ ID NO: 496005 - RNA, 18 nt, Chlamydophila pneumoniae CWL029
uaucucuacgaugaacua

SEQ ID NO: 496006 - RNA, 14 nt, Chlamydophila pneumoniae CWL029
uaucucuguuuuuu

SEQ ID NO: 496007 - RNA, 16 nt, Chlamydophila pneumoniae CWL029
uaucugcguuucuuuc

SEQ ID NO: 496008 - RNA, 18 nt, Chlamydophila pneumoniae CWL029
uaucugcguuucuuucug

SEQ ID NO: 496009 - RNA, 15 nt, Chlamydophila pneumoniae CWL029
uaucugcucccuccu

SEQ ID NO: 496010 - RNA, 14 nt, Chlamydophila pneumoniae CWL029
uaucugcuucuacg

SEQ ID NO: 496011 - RNA, 16 nt, Chlamydophila pneumoniae CWL029
uaucugcacuuucuuu

SEQ ID NO: 496012 - RNA, 17 nt, Chlamydophila pneumoniae CWL029
uaucuucaaaaguaauc

SEQ ID NO: 496013 - RNA, 20 nt, Chlamydophila pneumoniae CWL029
uaucuguggcguaagcaaua

SEQ ID NO: 496014 - RNA, 16 nt, Chlamydophila pneumoniae CWL029
uaucuugaaaguacag

SEQ ID NO: 496015 - RNA, 16 nt, Chlamydophila pneumoniae CWL029
uaucuucguaauaacu

SEQ ID NO: 496016 - RNA, 16 nt, Chlamydophila pneumoniae CWL029
uaucuuuauuuaaaua

SEQ ID NO: 496017 - RNA, 15 nt, Chlamydophila pneumoniae CWL029
uauccuuaucuugcu

SEQ ID NO: 496018 - RNA, 14 nt, Chlamydophila pneumoniae CWL029
uauccuuccuuauu

SEQ ID NO: 496019 - RNA, 14 nt, Chlamydophila pneumoniae CWL029
uauccugcuccaaa

SEQ ID NO: 496020 - RNA, 14 nt, Chlamydophila pneumoniae CWL029
uaucgaguucuuuu

SEQ ID NO: 496021 - RNA, 23 nt, Chlamydophila pneumoniae CWL029
uaucgccuuccuuaacaacauca

SEQ ID NO: 496022 - RNA, 19 nt, Chlamydophila pneumoniae CWL029
uaucgggggugccaaaaaa

SEQ ID NO: 496023 - RNA, 19 nt, Chlamydophila pneumoniae CWL029
uauccccagaucucuuuag

SEQ ID NO: 496024 - RNA, 17 nt, Chlamydophila pneumoniae CWL029
uaucccagauaaagaca

SEQ ID NO: 496025 - RNA, 18 nt, Chlamydophila pneumoniae CWL029
uauccaggguagcgcuuu

SEQ ID NO: 496026 - RNA, 18 nt, Chlamydophila pneumoniae CWL029
uauccagaaauacgucca

SEQ ID NO: 496027 - RNA, 22 nt, Chlamydophila pneumoniae CWL029
uauccagaaauacguccagccu

SEQ ID NO: 496028 - RNA, 21 nt, Chlamydophila pneumoniae CWL029
uaucaucaaaagauaugucuu

SEQ ID NO: 496029 - RNA, 15 nt, Chlamydophila pneumoniae CWL029
uaucauaucuucaaa

SEQ ID NO: 496030 - RNA, 14 nt, Chlamydophila pneumoniae CWL029
uauaguagaagaaa

SEQ ID NO: 496031 - RNA, 12 nt, Chlamydophila pneumoniae CWL029
uauaggaaacug

SEQ ID NO: 496032 - RNA, 19 nt, Chlamydophila pneumoniae CWL029
uauacagacaagcaaggaa

SEQ ID NO: 496033 - RNA, 20 nt, Chlamydophila pneumoniae CWL029
uauacagacaagcaaggaaa

SEQ ID NO: 496034 - RNA, 17 nt, Chlamydophila pneumoniae CWL029
uauacagaaaagaaugu

SEQ ID NO: 496035 - RNA, 14 nt, Chlamydophila pneumoniae CWL029
uauauaaaacauag

SEQ ID NO: 496036 - RNA, 11 nt, Chlamydophila pneumoniae CWL029
uauauaaaggu

SEQ ID NO: 496037 - RNA, 18 nt, Chlamydophila pneumoniae CWL029
uauauaaagguuacaagc

SEQ ID NO: 496038 - RNA, 14 nt, Chlamydophila pneumoniae CWL029
uauauccugaguga

SEQ ID NO: 496039 - RNA, 19 nt, Chlamydophila pneumoniae CWL029
uauaucgcguguaaaagcu

SEQ ID NO: 496040 - RNA, 21 nt, Chlamydophila pneumoniae CWL029
uauaugcuacaaacucuucca

SEQ ID NO: 496041 - RNA, 17 nt, Chlamydophila pneumoniae CWL029
uauaaggauaucaugca

SEQ ID NO: 496042 - RNA, 16 nt, Chlamydophila pneumoniae CWL029
uauaagagcaagguaa

SEQ ID NO: 496043 - RNA, 15 nt, Chlamydophila pneumoniae CWL029
uauaagagguucucu

SEQ ID NO: 496044 - RNA, 19 nt, Chlamydophila pneumoniae CWL029
uauaaaugcuguagauugu

SEQ ID NO: 496045 - RNA, 15 nt, Chlamydophila pneumoniae CWL029
uauaacaucuaaaaa

SEQ ID NO: 496046 - RNA, 17 nt, Chlamydophila pneumoniae CWL029
uauaaaguuuccaagug

SEQ ID NO: 496047 - RNA, 15 nt, Chlamydophila pneumoniae CWL029
uaguucuucuuuacu

SEQ ID NO: 496048 - RNA, 21 nt, Chlamydophila pneumoniae CWL029
uagugaaugagcuucacaucu

SEQ ID NO: 496049 - RNA, 17 nt, Chlamydophila pneumoniae CWL029
uagugaacacucucuac

SEQ ID NO: 496050 - RNA, 22 nt, Chlamydophila pneumoniae CWL029
uagugaacacucucuaccauca

SEQ ID NO: 496051 - RNA, 19 nt, Chlamydophila pneumoniae CWL029
uagugaagcugcuucuuca

SEQ ID NO: 496052 - RNA, 13 nt, Chlamydophila pneumoniae CWL029
uagucuucuuaga

SEQ ID NO: 496053 - RNA, 16 nt, Chlamydophila pneumoniae CWL029
uagucuucuuagaaag

SEQ ID NO: 496054 - RNA, 21 nt, Chlamydophila pneumoniae CWL029
uagucuucuuagaaagacuag

SEQ ID NO: 496055 - RNA, 14 nt, Chlamydophila pneumoniae CWL029
uagucuucuuagaa

SEQ ID NO: 496056 - RNA, 16 nt, Chlamydophila pneumoniae CWL029
uagucuuucuaagaag

SEQ ID NO: 496057 - RNA, 19 nt, Chlamydophila pneumoniae CWL029
uagucgucuuuuaaagagc

SEQ ID NO: 496058 - RNA, 17 nt, Chlamydophila pneumoniae CWL029
uaguggucaucucguug

SEQ ID NO: 496059 - RNA, 14 nt, Chlamydophila pneumoniae CWL029
uagugagauagucu

SEQ ID NO: 496060 - RNA, 23 nt, Chlamydophila pneumoniae CWL029
uagugaggccuccauuucuagga

SEQ ID NO: 496061 - RNA, 15 nt, Chlamydophila pneumoniae CWL029
uaguccuuauuucaa

SEQ ID NO: 496062 - RNA, 19 nt, Chlamydophila pneumoniae CWL029
uaguccuuauuucaaagaa

SEQ ID NO: 496063 - RNA, 12 nt, Chlamydophila pneumoniae CWL029
uagguucuuuuc

SEQ ID NO: 496064 - RNA, 22 nt, Chlamydophila pneumoniae CWL029
uagguucuuuucggaucagaau

SEQ ID NO: 496065 - RNA, 18 nt, Chlamydophila pneumoniae CWL029
uagguuguuguugaggaa

SEQ ID NO: 496066 - RNA, 15 nt, Chlamydophila pneumoniae CWL029
uaguaaggagagacu

SEQ ID NO: 496067 - RNA, 15 nt, Chlamydophila pneumoniae CWL029
uccguuuuuucagau

SEQ ID NO: 496068 - RNA, 17 nt, Chlamydophila pneumoniae CWL029
uccguugaauuaauaaa

SEQ ID NO: 496069 - RNA, 23 nt, Chlamydophila pneumoniae CWL029
uccgugagauacuuuaaagacuu

SEQ ID NO: 496070 - RNA, 18 nt, Chlamydophila pneumoniae CWL029
uccguuaccaaaaacugg

SEQ ID NO: 496071 - RNA, 19 nt, Chlamydophila pneumoniae CWL029
uccguagguguuaaguuca

SEQ ID NO: 496072 - RNA, 14 nt, Chlamydophila pneumoniae CWL029
uccguauuuuuuac

SEQ ID NO: 496073 - RNA, 16 nt, Chlamydophila pneumoniae CWL029
uccgucaagaacaaga

SEQ ID NO: 496074 - RNA, 16 nt, Chlamydophila pneumoniae CWL029
uccgucauauuuaaaa

SEQ ID NO: 496075 - RNA, 20 nt, Chlamydophila pneumoniae CWL029
uccuaagucguuaacaucaa

SEQ ID NO: 496076 - RNA, 19 nt, Chlamydophila pneumoniae CWL029
uccuaagucguuaacauca

SEQ ID NO: 496077 - RNA, 14 nt, Chlamydophila pneumoniae CWL029
uccuaaaucugcuu

SEQ ID NO: 496078 - RNA, 19 nt, Chlamydophila pneumoniae CWL029
uccuaacuucugaaggaaa

SEQ ID NO: 496079 - RNA, 18 nt, Chlamydophila pneumoniae CWL029
uccuaagagauuuuccau

SEQ ID NO: 496080 - RNA, 19 nt, Chlamydophila pneumoniae CWL029
uccuaagagauuuuccaua

SEQ ID NO: 496081 - RNA, 21 nt, Chlamydophila pneumoniae CWL029
uccuagagucgaguuucuagu

SEQ ID NO: 496082 - RNA, 22 nt, Chlamydophila pneumoniae CWL029
uccuagacagccuugacucuaa

SEQ ID NO: 496083 - RNA, 16 nt, Chlamydophila pneumoniae CWL029
uccuacuccuaaagua

SEQ ID NO: 496084 - RNA, 16 nt, Chlamydophila pneumoniae CWL029
uccuacuucugcagga

SEQ ID NO: 496085 - RNA, 18 nt, Chlamydophila pneumoniae CWL029
uccuacgagcgcuuucuu

SEQ ID NO: 496086 - RNA, 13 nt, Chlamydophila pneumoniae CWL029
uccuacggcaaga

SEQ ID NO: 496087 - RNA, 22 nt, Chlamydophila pneumoniae CWL029
uccuauugguguaucucuuaaa

SEQ ID NO: 496088 - RNA, 19 nt, Chlamydophila pneumoniae CWL029
uccuauaaaaaccuuaucg

SEQ ID NO: 496089 - RNA, 19 nt, Chlamydophila pneumoniae CWL029
uccuaucaaagcaaaaguc

SEQ ID NO: 496090 - RNA, 17 nt, Chlamydophila pneumoniae CWL029
uccuaggcugagacaua

SEQ ID NO: 496091 - RNA, 18 nt, Chlamydophila pneumoniae CWL029
uccuagggagugaggaau

SEQ ID NO: 496092 - RNA, 15 nt, Chlamydophila pneumoniae CWL029
uccuagcagagaaau

SEQ ID NO: 496093 - RNA, 19 nt, Chlamydophila pneumoniae CWL029
uccuauuuuagcauaaucu

SEQ ID NO: 496094 - RNA, 14 nt, Chlamydophila pneumoniae CWL029
uccuauuuuuuaag

SEQ ID NO: 496095 - RNA, 23 nt, Chlamydophila pneumoniae CWL029
uccucaaagccgaggauucgcua

SEQ ID NO: 496096 - RNA, 17 nt, Chlamydophila pneumoniae CWL029
uccucaagaauaugaac

SEQ ID NO: 496097 - RNA, 19 nt, Chlamydophila pneumoniae CWL029
uccucaagauaaaucccac

SEQ ID NO: 496098 - RNA, 20 nt, Chlamydophila pneumoniae CWL029
uccucaagauaaaucccacu

SEQ ID NO: 496099 - RNA, 13 nt, Chlamydophila pneumoniae CWL029
uccucaauuuguu

SEQ ID NO: 496100 - RNA, 13 nt, Chlamydophila pneumoniae CWL029
uccucacuauuaa

SEQ ID NO: 496101 - RNA, 17 nt, Chlamydophila pneumoniae CWL029
uccggaaggaguucuuu

SEQ ID NO: 496102 - RNA, 20 nt, Chlamydophila pneumoniae CWL029
uccggauucuuuauccccag

SEQ ID NO: 496103 - RNA, 15 nt, Chlamydophila pneumoniae CWL029
uccuguuccauauca

SEQ ID NO: 496104 - RNA, 15 nt, Chlamydophila pneumoniae CWL029
uccuguagagcaaga

SEQ ID NO: 496105 - RNA, 13 nt, Chlamydophila pneumoniae CWL029
uccuguagccacu

SEQ ID NO: 496106 - RNA, 16 nt, Chlamydophila pneumoniae CWL029
uccuguauauucugaa

SEQ ID NO: 496107 - RNA, 16 nt, Chlamydophila pneumoniae CWL029
uccuguaguuuuacuu

SEQ ID NO: 496108 - RNA, 15 nt, Chlamydophila pneumoniae CWL029
uccuggucuccagaa

SEQ ID NO: 496109 - RNA, 22 nt, Chlamydophila pneumoniae CWL029
uccuggggugcguaucaguuuu

SEQ ID NO: 496110 - RNA, 16 nt, Chlamydophila pneumoniae CWL029
uccugggguucucuaa

SEQ ID NO: 496111 - RNA, 17 nt, Chlamydophila pneumoniae CWL029
uccuuauccgucagccu

SEQ ID NO: 496112 - RNA, 18 nt, Chlamydophila pneumoniae CWL029
uccuuacggauacguugg

SEQ ID NO: 496113 - RNA, 14 nt, Chlamydophila pneumoniae CWL029
uccuuacucccaug

SEQ ID NO: 496114 - RNA, 22 nt, Chlamydophila pneumoniae CWL029
uccuuaccaauaugcucugcca

SEQ ID NO: 496115 - RNA, 22 nt, Chlamydophila pneumoniae CWL029
uccuuaaugguagcuuaagaau

SEQ ID NO: 496116 - RNA, 15 nt, Chlamydophila pneumoniae CWL029
uccuuaaccuccuca

SEQ ID NO: 496117 - RNA, 15 nt, Chlamydophila pneumoniae CWL029
uccuuaucuugcugc

SEQ ID NO: 496118 - RNA, 14 nt, Chlamydophila pneumoniae CWL029
uccuucaaagauau

SEQ ID NO: 496119 - RNA, 20 nt, Chlamydophila pneumoniae CWL029
uccuucaggauuuuccauua

SEQ ID NO: 496120 - RNA, 13 nt, Chlamydophila pneumoniae CWL029
uccuucaggauuu

SEQ ID NO: 496121 - RNA, 18 nt, Chlamydophila pneumoniae CWL029
uccuucauucacagcagu

SEQ ID NO: 496122 - RNA, 15 nt, Chlamydophila pneumoniae CWL029
uccugcuccaaaaug

SEQ ID NO: 496123 - RNA, 23 nt, Chlamydophila pneumoniae CWL029
uccugcggaucgucgccuuuucc

SEQ ID NO: 496124 - RNA, 17 nt, Chlamydophila pneumoniae CWL029
uccugcaguauuauaaa

SEQ ID NO: 496125 - RNA, 22 nt, Chlamydophila pneumoniae CWL029
uccugcagcagccuuggcucua

SEQ ID NO: 496126 - RNA, 13 nt, Chlamydophila pneumoniae CWL029
uccugaagcagcu

SEQ ID NO: 496127 - RNA, 22 nt, Chlamydophila pneumoniae CWL029
uccugaagccaugacaaagggu

SEQ ID NO: 496128 - RNA, 18 nt, Chlamydophila pneumoniae CWL029
uccugaacggcucuuucu

SEQ ID NO: 496129 - RNA, 19 nt, Chlamydophila pneumoniae CWL029
uccugaacggcucuuucua

SEQ ID NO: 496130 - RNA, 17 nt, Chlamydophila pneumoniae CWL029
uccucuuucuuaggaaa

SEQ ID NO: 496131 - RNA, 20 nt, Chlamydophila pneumoniae CWL029
uccucuucuucaucuucuaa

SEQ ID NO: 496132 - RNA, 14 nt, Chlamydophila pneumoniae CWL029
uccucuuccuuuuu

SEQ ID NO: 496133 - RNA, 14 nt, Chlamydophila pneumoniae CWL029
uccucugaaggauu

SEQ ID NO: 496134 - RNA, 15 nt, Chlamydophila pneumoniae CWL029
uccucugauuccagu

SEQ ID NO: 496135 - RNA, 22 nt, Chlamydophila pneumoniae CWL029
uccucuccaaaacaaucuaaag

SEQ ID NO: 496136 - RNA, 14 nt, Chlamydophila pneumoniae CWL029
uccucucaugaaau

SEQ ID NO: 496137 - RNA, 16 nt, Chlamydophila pneumoniae CWL029
uccucucaugaaauuu

SEQ ID NO: 496138 - RNA, 14 nt, Chlamydophila pneumoniae CWL029
uccucuauccauca

SEQ ID NO: 496139 - RNA, 22 nt, Chlamydophila pneumoniae CWL029
uccucuauccaucaucgaagaa

SEQ ID NO: 496140 - RNA, 19 nt, Chlamydophila pneumoniae CWL029
uccugagguugggcagaag

SEQ ID NO: 496141 - RNA, 21 nt, Chlamydophila pneumoniae CWL029
uccugagguugggcagaagcu

SEQ ID NO: 496142 - RNA, 14 nt, Chlamydophila pneumoniae CWL029
uccugaguaaaauc

SEQ ID NO: 496143 - RNA, 19 nt, Chlamydophila pneumoniae CWL029
uccugaggcuauagaauac

SEQ ID NO: 496144 - RNA, 17 nt, Chlamydophila pneumoniae CWL029
uccugacuauaaaaugc

SEQ ID NO: 496145 - RNA, 15 nt, Chlamydophila pneumoniae CWL029
uccugacucuuuuaa

SEQ ID NO: 496146 - RNA, 11 nt, Chlamydophila pneumoniae CWL029
uccugagacca

SEQ ID NO: 496147 - RNA, 11 nt, Chlamydophila pneumoniae CWL029
uccugagagcg

SEQ ID NO: 496148 - RNA, 23 nt, Chlamydophila pneumoniae CWL029
uccugacgcauagcacuaugaau

SEQ ID NO: 496149 - RNA, 12 nt, Chlamydophila pneumoniae CWL029
uccugaccagug

SEQ ID NO: 496150 - RNA, 16 nt, Chlamydophila pneumoniae CWL029
uccugacacaacucuu

SEQ ID NO: 496151 - RNA, 19 nt, Chlamydophila pneumoniae CWL029
uccugaauaugcuuuucaa

SEQ ID NO: 496152 - RNA, 17 nt, Chlamydophila pneumoniae CWL029
uccugaugccuuuuucu

SEQ ID NO: 496153 - RNA, 23 nt, Chlamydophila pneumoniae CWL029
uccugaucccuuagaaauucuaa

SEQ ID NO: 496154 - RNA, 20 nt, Chlamydophila pneumoniae CWL029
uccuccucgucuaaagaaga

SEQ ID NO: 496155 - RNA, 18 nt, Chlamydophila pneumoniae CWL029
uccuccuagguucuuuuu

SEQ ID NO: 496156 - RNA, 22 nt, Chlamydophila pneumoniae CWL029
uccuccauggaaagaaacaaau

SEQ ID NO: 496157 - RNA, 16 nt, Chlamydophila pneumoniae CWL029
uccuccauguacaguu

SEQ ID NO: 496158 - RNA, 20 nt, Chlamydophila pneumoniae CWL029
uccuccaaugagcucuauuu

SEQ ID NO: 496159 - RNA, 12 nt, Chlamydophila pneumoniae CWL029
uccuccaaaauu

SEQ ID NO: 496160 - RNA, 14 nt, Chlamydophila pneumoniae CWL029
uccucaucaucaga

SEQ ID NO: 496161 - RNA, 16 nt, Chlamydophila pneumoniae CWL029
uccucagaauccauuu

SEQ ID NO: 496162 - RNA, 23 nt, Chlamydophila pneumoniae CWL029
uccuccuucugcaaucagugcug

SEQ ID NO: 496163 - RNA, 14 nt, Chlamydophila pneumoniae CWL029
uccucgauacuguu

SEQ ID NO: 496164 - RNA, 23 nt, Chlamydophila pneumoniae CWL029
uccucgauacuguugauccuucu

SEQ ID NO: 496165 - RNA, 23 nt, Chlamydophila pneumoniae CWL029
uccucuaaggacaaaucucccaa

SEQ ID NO: 496166 - RNA, 17 nt, Chlamydophila pneumoniae CWL029
uccucgucuaaagaaga

SEQ ID NO: 496167 - RNA, 16 nt, Chlamydophila pneumoniae CWL029
uccucggcaacuacug

SEQ ID NO: 496168 - RNA, 20 nt, Chlamydophila pneumoniae CWL029
ucgcacuacagcuucauuau

SEQ ID NO: 496169 - RNA, 17 nt, Chlamydophila pneumoniae CWL029
ucgcaguccaaagacuu

SEQ ID NO: 496170 - RNA, 16 nt, Chlamydophila pneumoniae CWL029
ucgcaauccaggaaua

SEQ ID NO: 496171 - RNA, 23 nt, Chlamydophila pneumoniae CWL029
ucgcaacuuaagauacuucucca

SEQ ID NO: 496172 - RNA, 22 nt, Chlamydophila pneumoniae CWL029
ucgaucucugugguuccuggau

SEQ ID NO: 496173 - RNA, 23 nt, Chlamydophila pneumoniae CWL029
ucgaucccggcuuugggcaucuc

SEQ ID NO: 496174 - RNA, 15 nt, Chlamydophila pneumoniae CWL029
ucgaugagggaaaug

SEQ ID NO: 496175 - RNA, 13 nt, Chlamydophila pneumoniae CWL029
ucgaugcuauuuu

SEQ ID NO: 496176 - RNA, 16 nt, Chlamydophila pneumoniae CWL029
ucgaugcuauuuuucc

SEQ ID NO: 496177 - RNA, 17 nt, Chlamydophila pneumoniae CWL029
ucgaugcuauuuuucca

SEQ ID NO: 496178 - RNA, 22 nt, Chlamydophila pneumoniae CWL029
ucgauuguaacuucguuagaaa

SEQ ID NO: 496179 - RNA, 15 nt, Chlamydophila pneumoniae CWL029
ucgauuggaagcaaa

SEQ ID NO: 496180 - RNA, 18 nt, Chlamydophila pneumoniae CWL029
ucgauugagauugaggau

SEQ ID NO: 496181 - RNA, 16 nt, Chlamydophila pneumoniae CWL029
ucgauacgguuuuuau

SEQ ID NO: 496182 - RNA, 17 nt, Chlamydophila pneumoniae CWL029
ucgauaggaagccaguc

SEQ ID NO: 496183 - RNA, 22 nt, Chlamydophila pneumoniae CWL029
ucgauaucucuaccgaacagag

SEQ ID NO: 496184 - RNA, 20 nt, Chlamydophila pneumoniae CWL029
ucgaguaccgaccgaaucuc

SEQ ID NO: 496185 - RNA, 21 nt, Chlamydophila pneumoniae CWL029
ucgaguauggcaaauaaaaca

SEQ ID NO: 496186 - RNA, 18 nt, Chlamydophila pneumoniae CWL029
ucgauaagaacuuuaggg

SEQ ID NO: 496187 - RNA, 13 nt, Chlamydophila pneumoniae CWL029
ucgauaauuuuca

SEQ ID NO: 496188 - RNA, 17 nt, Chlamydophila pneumoniae CWL029
ucgauaacacuucuuuc

SEQ ID NO: 496189 - RNA, 12 nt, Chlamydophila pneumoniae CWL029
ucgauaagaacu

SEQ ID NO: 496190 - RNA, 16 nt, Chlamydophila pneumoniae CWL029
ucgaguucuuuuugca

SEQ ID NO: 496191 - RNA, 19 nt, Chlamydophila pneumoniae CWL029
ucgagcagaaacuccaaaa

SEQ ID NO: 496192 - RNA, 21 nt, Chlamydophila pneumoniae CWL029
ucgagcagaaacuccaaaaua

SEQ ID NO: 496193 - RNA, 15 nt, Chlamydophila pneumoniae CWL029
ucgagcagaaaugau

SEQ ID NO: 496194 - RNA, 15 nt, Chlamydophila pneumoniae CWL029
ucgacuuccuucaau

SEQ ID NO: 496195 - RNA, 21 nt, Chlamydophila pneumoniae CWL029
ucgacuuccuucaaucguaau

SEQ ID NO: 496196 - RNA, 12 nt, Chlamydophila pneumoniae CWL029
ucgacucuucca

SEQ ID NO: 496197 - RNA, 21 nt, Chlamydophila pneumoniae CWL029
ucgacuauaagagguucucuu

SEQ ID NO: 496198 - RNA, 17 nt, Chlamydophila pneumoniae CWL029
ucgagaucuuuuugcca

SEQ ID NO: 496199 - RNA, 19 nt, Chlamydophila pneumoniae CWL029
ucgagagaagaaauucuga

SEQ ID NO: 496200 - RNA, 21 nt, Chlamydophila pneumoniae CWL029
ucgacuuuuuuaagagugucu

SEQ ID NO: 496201 - RNA, 18 nt, Chlamydophila pneumoniae CWL029
ucgagaacguagcagagg

SEQ ID NO: 496202 - RNA, 20 nt, Chlamydophila pneumoniae CWL029
ucgagaacguagcagaggca

SEQ ID NO: 496203 - RNA, 17 nt, Chlamydophila pneumoniae CWL029
ucgagagaagaaauucu

SEQ ID NO: 496204 - RNA, 20 nt, Chlamydophila pneumoniae CWL029
ucgaaugguuccugaagcag

SEQ ID NO: 496205 - RNA, 12 nt, Chlamydophila pneumoniae CWL029
ucgaauuccucc

SEQ ID NO: 496206 - RNA, 19 nt, Chlamydophila pneumoniae CWL029
ucgaaucuaaaaacuuccc

SEQ ID NO: 496207 - RNA, 14 nt, Chlamydophila pneumoniae CWL029
ucgaaucuuuauuu

SEQ ID NO: 496208 - RNA, 23 nt, Chlamydophila pneumoniae CWL029
ucgaauuuuuguuuuaacucuag

SEQ ID NO: 496209 - RNA, 15 nt, Chlamydophila pneumoniae CWL029
ucgaacucugaagua

SEQ ID NO: 496210 - RNA, 19 nt, Chlamydophila pneumoniae CWL029
ucgaagaacuuagcaauga

SEQ ID NO: 496211 - RNA, 19 nt, Chlamydophila pneumoniae CWL029
ucgaagagcccucuucacu

SEQ ID NO: 496212 - RNA, 16 nt, Chlamydophila pneumoniae CWL029
ucgaagcuugcugauu

SEQ ID NO: 496213 - RNA, 16 nt, Chlamydophila pneumoniae CWL029
ucgaagauucaaagaa

SEQ ID NO: 496214 - RNA, 23 nt, Chlamydophila pneumoniae CWL029
ucgaagaaaauaaagaucuucau

SEQ ID NO: 496215 - RNA, 22 nt, Chlamydophila pneumoniae CWL029
ucgacagcagcauuuucuaaag

SEQ ID NO: 496216 - RNA, 19 nt, Chlamydophila pneumoniae CWL029
ucgacaggggaguuuucaa

SEQ ID NO: 496217 - RNA, 14 nt, Chlamydophila pneumoniae CWL029
ucgaccuauuugca

SEQ ID NO: 496218 - RNA, 16 nt, Chlamydophila pneumoniae CWL029
ucgaccuauuugcaac

SEQ ID NO: 496219 - RNA, 14 nt, Chlamydophila pneumoniae CWL029
ucgaaaaacgguaa

SEQ ID NO: 496220 - RNA, 21 nt, Chlamydophila pneumoniae CWL029
uccuuuuuaggacgcuauccu

SEQ ID NO: 496221 - RNA, 12 nt, Chlamydophila pneumoniae CWL029
uccuuuuaaaau

SEQ ID NO: 496222 - RNA, 13 nt, Chlamydophila pneumoniae CWL029
uccuuuuaaaauu

SEQ ID NO: 496223 - RNA, 22 nt, Chlamydophila pneumoniae CWL029
uccuuugcuaagaacuagcaug

SEQ ID NO: 496224 - RNA, 22 nt, Chlamydophila pneumoniae CWL029
uccuuucuuuugcuuuucccac

SEQ ID NO: 496225 - RNA, 22 nt, Chlamydophila pneumoniae CWL029
ucgaaacacucaugaaagugcu

SEQ ID NO: 496226 - RNA, 19 nt, Chlamydophila pneumoniae CWL029
ucgaaacucuuugaggaua

SEQ ID NO: 496227 - RNA, 15 nt, Chlamydophila pneumoniae CWL029
ucgaaauccuaaaaa

SEQ ID NO: 496228 - RNA, 21 nt, Chlamydophila pneumoniae CWL029
ucgaacagagaugcaaauccu

SEQ ID NO: 496229 - RNA, 12 nt, Chlamydophila pneumoniae CWL029
ucgaaauuuuca

SEQ ID NO: 496230 - RNA, 15 nt, Chlamydophila pneumoniae CWL029
uccuugggucuuuuu

SEQ ID NO: 496231 - RNA, 17 nt, Chlamydophila pneumoniae CWL029
uccuuggauuucuucuu

SEQ ID NO: 496232 - RNA, 17 nt, Chlamydophila pneumoniae CWL029
uccuugcagcccugcau

SEQ ID NO: 496233 - RNA, 20 nt, Chlamydophila pneumoniae CWL029
uccuuguagaacuucucaag

SEQ ID NO: 496234 - RNA, 17 nt, Chlamydophila pneumoniae CWL029
uccuuguagaacuucuc

SEQ ID NO: 496235 - RNA, 16 nt, Chlamydophila pneumoniae CWL029
uccuuuaaauaaaauc

SEQ ID NO: 496236 - RNA, 12 nt, Chlamydophila pneumoniae CWL029
uccuucucccuc

SEQ ID NO: 496237 - RNA, 15 nt, Chlamydophila pneumoniae CWL029
uccuucuguuuucac

SEQ ID NO: 496238 - RNA, 14 nt, Chlamydophila pneumoniae CWL029
uccuucugcaauca

SEQ ID NO: 496239 - RNA, 12 nt, Chlamydophila pneumoniae CWL029
uccuucuccugu

SEQ ID NO: 496240 - RNA, 22 nt, Chlamydophila pneumoniae CWL029
uccuucuacaaugauauaaaag

SEQ ID NO: 496241 - RNA, 17 nt, Chlamydophila pneumoniae CWL029
uccuucgaagcggagca

SEQ ID NO: 496242 - RNA, 11 nt, Chlamydophila pneumoniae CWL029
uccuuccuuaa

SEQ ID NO: 496243 - RNA, 14 nt, Chlamydophila pneumoniae CWL029
uccuucgaccuauu

SEQ ID NO: 496244 - RNA, 18 nt, Chlamydophila pneumoniae CWL029
uccuugaaauugcucuug

SEQ ID NO: 496245 - RNA, 15 nt, Chlamydophila pneumoniae CWL029
uccuugacaaauaag

SEQ ID NO: 496246 - RNA, 18 nt, Chlamydophila pneumoniae CWL029
uccuugauaaaacgcuau

SEQ ID NO: 496247 - RNA, 14 nt, Chlamydophila pneumoniae CWL029
uccuugauuuggga

SEQ ID NO: 496248 - RNA, 21 nt, Chlamydophila pneumoniae CWL029
uccuucuuucugcucuucuau

SEQ ID NO: 496249 - RNA, 13 nt, Chlamydophila pneumoniae CWL029
uccuugaaaauca

SEQ ID NO: 496250 - RNA, 20 nt, Chlamydophila pneumoniae CWL029
uccgcuagaggaucuucaag

SEQ ID NO: 496251 - RNA, 17 nt, Chlamydophila pneumoniae CWL029
uccgcaggucgcaucaa

SEQ ID NO: 496252 - RNA, 12 nt, Chlamydophila pneumoniae CWL029
uccgauauacuu

SEQ ID NO: 496253 - RNA, 17 nt, Chlamydophila pneumoniae CWL029
uccgauuaacuuuauac

SEQ ID NO: 496254 - RNA, 15 nt, Chlamydophila pneumoniae CWL029
uccgauuaguaauga

SEQ ID NO: 496255 - RNA, 19 nt, Chlamydophila pneumoniae CWL029
uccgauuaguaaugaugua

SEQ ID NO: 496256 - RNA, 21 nt, Chlamydophila pneumoniae CWL029
uccgaucauaauuagagagaa

SEQ ID NO: 496257 - RNA, 16 nt, Chlamydophila pneumoniae CWL029
uccgaauggagaagga

SEQ ID NO: 496258 - RNA, 13 nt, Chlamydophila pneumoniae CWL029
ucccuuuuuaagu

SEQ ID NO: 496259 - RNA, 19 nt, Chlamydophila pneumoniae CWL029
uccgaaaucugacagaccu

SEQ ID NO: 496260 - RNA, 21 nt, Chlamydophila pneumoniae CWL029
aaaucugcaagauuaucuuua

SEQ ID NO: 496261 - RNA, 16 nt, Chlamydophila pneumoniae CWL029
aaaucugcuauaacca

SEQ ID NO: 496262 - RNA, 14 nt, Chlamydophila pneumoniae CWL029
aaaucugcuuuuau

SEQ ID NO: 496263 - RNA, 20 nt, Chlamydophila pneumoniae CWL029
aaaucugcuuuuaucucaau

SEQ ID NO: 496264 - RNA, 17 nt, Chlamydophila pneumoniae CWL029
uccgagaaacaaccauc

SEQ ID NO: 496265 - RNA, 15 nt, Chlamydophila pneumoniae CWL029
ucccucuucuuccaa

SEQ ID NO: 496266 - RNA, 16 nt, Chlamydophila pneumoniae CWL029
ucccucuucuuccaau

SEQ ID NO: 496267 - RNA, 14 nt, Chlamydophila pneumoniae CWL029
ucccugacacagag

SEQ ID NO: 496268 - RNA, 21 nt, Chlamydophila pneumoniae CWL029
ucccuacccucaucauccuca

SEQ ID NO: 496269 - RNA, 20 nt, Chlamydophila pneumoniae CWL029
ucccuaagaguuccaagaca

SEQ ID NO: 496270 - RNA, 22 nt, Chlamydophila pneumoniae CWL029
ucccuaaaguaacgauaagaag

SEQ ID NO: 496271 - RNA, 22 nt, Chlamydophila pneumoniae CWL029
ucccuauaaagcaaaugccugu

SEQ ID NO: 496272 - RNA, 21 nt, Chlamydophila pneumoniae CWL029
ucccuagguuuuaucuuuaga

SEQ ID NO: 496273 - RNA, 14 nt, Chlamydophila pneumoniae CWL029
ucccucacaagaag

SEQ ID NO: 496274 - RNA, 20 nt, Chlamydophila pneumoniae CWL029
ucccugauguugcccuacaa

SEQ ID NO: 496275 - RNA, 18 nt, Chlamydophila pneumoniae CWL029
ucccugauuccauccugu

SEQ ID NO: 496276 - RNA, 19 nt, Chlamydophila pneumoniae CWL029
ucccugauuccauccuguc

SEQ ID NO: 496277 - RNA, 12 nt, Chlamydophila pneumoniae CWL029
ucccuucuucuu

SEQ ID NO: 496278 - RNA, 17 nt, Chlamydophila pneumoniae CWL029
ucccuucuucuuuuaga

SEQ ID NO: 496279 - RNA, 19 nt, Chlamydophila pneumoniae CWL029
ucccuuagaaauucuaaga

SEQ ID NO: 496280 - RNA, 18 nt, Chlamydophila pneumoniae CWL029
ucccgugagcaugcucac

SEQ ID NO: 496281 - RNA, 21 nt, Chlamydophila pneumoniae CWL029
ucccgguaugaucaagaggag

SEQ ID NO: 496282 - RNA, 13 nt, Chlamydophila pneumoniae CWL029
ucccgacaagcuu

SEQ ID NO: 496283 - RNA, 17 nt, Chlamydophila pneumoniae CWL029
ucccgacauuuaacauc

SEQ ID NO: 496284 - RNA, 17 nt, Chlamydophila pneumoniae CWL029
ucccgagauaugaagag

SEQ ID NO: 496285 - RNA, 21 nt, Chlamydophila pneumoniae CWL029
ucccgagggaugaugcccuga

SEQ ID NO: 496286 - RNA, 22 nt, Chlamydophila pneumoniae CWL029
ucccgcaaaguuaaaccuuuuu

SEQ ID NO: 496287 - RNA, 14 nt, Chlamydophila pneumoniae CWL029
uccccugcaucucu

SEQ ID NO: 496288 - RNA, 16 nt, Chlamydophila pneumoniae CWL029
uccccugcaucucugc

SEQ ID NO: 496289 - RNA, 19 nt, Chlamydophila pneumoniae CWL029
uccccucugauuauuucua

SEQ ID NO: 496290 - RNA, 21 nt, Chlamydophila pneumoniae CWL029
uccccucugauuauuucuaaa

SEQ ID NO: 496291 - RNA, 15 nt, Chlamydophila pneumoniae CWL029
uccccuucauucuuu

SEQ ID NO: 496292 - RNA, 18 nt, Chlamydophila pneumoniae CWL029
ucccagaagaaauuagag

SEQ ID NO: 496293 - RNA, 22 nt, Chlamydophila pneumoniae CWL029
ucccacuggacuucguuuugau

SEQ ID NO: 496294 - RNA, 20 nt, Chlamydophila pneumoniae CWL029
ucccacggugccuaggcuaa

SEQ ID NO: 496295 - RNA, 16 nt, Chlamydophila pneumoniae CWL029
ucccagauuacaagag

SEQ ID NO: 496296 - RNA, 20 nt, Chlamydophila pneumoniae CWL029
ucccagauuuuuuugguugc

SEQ ID NO: 496297 - RNA, 18 nt, Chlamydophila pneumoniae CWL029
ucccagauuuuuuugguu

SEQ ID NO: 496298 - RNA, 15 nt, Chlamydophila pneumoniae CWL029
ucccaucacauaaau

SEQ ID NO: 496299 - RNA, 22 nt, Chlamydophila pneumoniae CWL029
ucccaucaucgagcugaucuuc

SEQ ID NO: 496300 - RNA, 21 nt, Chlamydophila pneumoniae CWL029
ucccauaaauguauaggcauu

SEQ ID NO: 496301 - RNA, 16 nt, Chlamydophila pneumoniae CWL029
ucccagucgugagaag

SEQ ID NO: 496302 - RNA, 18 nt, Chlamydophila pneumoniae CWL029
uccccauucacaaaucuu

SEQ ID NO: 496303 - RNA, 12 nt, Chlamydophila pneumoniae CWL029
ucccccuaaggg

SEQ ID NO: 496304 - RNA, 23 nt, Chlamydophila pneumoniae CWL029
ucccccugaaugcaacagaguca

SEQ ID NO: 496305 - RNA, 17 nt, Chlamydophila pneumoniae CWL029
ucccccagaccuaaaaa

SEQ ID NO: 496306 - RNA, 12 nt, Chlamydophila pneumoniae CWL029
ucccaugggaua

SEQ ID NO: 496307 - RNA, 16 nt, Chlamydophila pneumoniae CWL029
ucccauguaguaaauu

SEQ ID NO: 496308 - RNA, 16 nt, Chlamydophila pneumoniae CWL029
ucccauuucuggagaa

SEQ ID NO: 496309 - RNA, 20 nt, Chlamydophila pneumoniae CWL029
ucccaccauauucucaggaa

SEQ ID NO: 496310 - RNA, 16 nt, Chlamydophila pneumoniae CWL029
ucccaagcugaaagaa

SEQ ID NO: 496311 - RNA, 16 nt, Chlamydophila pneumoniae CWL029
ucccaauauccagaaa

SEQ ID NO: 496312 - RNA, 19 nt, Chlamydophila pneumoniae CWL029
ucccaaucaagauaaaggc

SEQ ID NO: 496313 - RNA, 14 nt, Chlamydophila pneumoniae CWL029
ucccaaaaaaugcc

SEQ ID NO: 496314 - RNA, 16 nt, Chlamydophila pneumoniae CWL029
uccauuucuaggaauu

SEQ ID NO: 496315 - RNA, 14 nt, Chlamydophila pneumoniae CWL029
uccauuuagaauga

SEQ ID NO: 496316 - RNA, 12 nt, Chlamydophila pneumoniae CWL029
uccauucuuaau

SEQ ID NO: 496317 - RNA, 20 nt, Chlamydophila pneumoniae CWL029
uccauucuuaauauaaaaga

SEQ ID NO: 496318 - RNA, 16 nt, Chlamydophila pneumoniae CWL029
uccauguacaguuugu

SEQ ID NO: 496319 - RNA, 14 nt, Chlamydophila pneumoniae CWL029
uccauguacagaaa

SEQ ID NO: 496320 - RNA, 21 nt, Chlamydophila pneumoniae CWL029
uccauuagggcauucuguaau

SEQ ID NO: 496321 - RNA, 21 nt, Chlamydophila pneumoniae CWL029
uccauagaguaucuaaaacuu

SEQ ID NO: 496322 - RNA, 21 nt, Chlamydophila pneumoniae CWL029
uccauagccaaggagcuauag

SEQ ID NO: 496323 - RNA, 22 nt, Chlamydophila pneumoniae CWL029
uccauagcgauagcuaaaccuu

SEQ ID NO: 496324 - RNA, 18 nt, Chlamydophila pneumoniae CWL029
uccauagcuuuagaagcc

SEQ ID NO: 496325 - RNA, 13 nt, Chlamydophila pneumoniae CWL029
uccauaggaacaa

SEQ ID NO: 496326 - RNA, 16 nt, Chlamydophila pneumoniae CWL029
uccauaggaacaaagc

SEQ ID NO: 496327 - RNA, 16 nt, Chlamydophila pneumoniae CWL029
uccauaggaucugcau

SEQ ID NO: 496328 - RNA, 21 nt, Chlamydophila pneumoniae CWL029
uccagguagcagaguuuuucc

SEQ ID NO: 496329 - RNA, 17 nt, Chlamydophila pneumoniae CWL029
uccaggacguaaaaaga

SEQ ID NO: 496330 - RNA, 13 nt, Chlamydophila pneumoniae CWL029
uccagaagcaaga

SEQ ID NO: 496331 - RNA, 19 nt, Chlamydophila pneumoniae CWL029
uccacuuuuuucccuccac

SEQ ID NO: 496332 - RNA, 12 nt, Chlamydophila pneumoniae CWL029
uccagaaaguau

SEQ ID NO: 496333 - RNA, 19 nt, Chlamydophila pneumoniae CWL029
uccagaaauacguccagcc

SEQ ID NO: 496334 - RNA, 18 nt, Chlamydophila pneumoniae CWL029
uccagaaauuacuguggu

SEQ ID NO: 496335 - RNA, 15 nt, Chlamydophila pneumoniae CWL029
uccacuacugucaau

SEQ ID NO: 496336 - RNA, 19 nt, Chlamydophila pneumoniae CWL029
uccacuguucuucuucagu

SEQ ID NO: 496337 - RNA, 15 nt, Chlamydophila pneumoniae CWL029
uccacuguucuucuu

SEQ ID NO: 496338 - RNA, 16 nt, Chlamydophila pneumoniae CWL029
uccacagacugcagga

SEQ ID NO: 496339 - RNA, 23 nt, Chlamydophila pneumoniae CWL029
uccaccaggagcuccuccuugaa

SEQ ID NO: 496340 - RNA, 14 nt, Chlamydophila pneumoniae CWL029
uccacgaauucuuu

SEQ ID NO: 496341 - RNA, 16 nt, Chlamydophila pneumoniae CWL029
uccaacuuuugaagau

SEQ ID NO: 496342 - RNA, 21 nt, Chlamydophila pneumoniae CWL029
uccaagaagucaucgcgagag

SEQ ID NO: 496343 - RNA, 13 nt, Chlamydophila pneumoniae CWL029
uccaacuucaacu

SEQ ID NO: 496344 - RNA, 20 nt, Chlamydophila pneumoniae CWL029
uccaagacaacaccucccac

SEQ ID NO: 496345 - RNA, 22 nt, Chlamydophila pneumoniae CWL029
uccaagacaacaccucccacca

SEQ ID NO: 496346 - RNA, 20 nt, Chlamydophila pneumoniae CWL029
uccaagacaauaaaaaagag

SEQ ID NO: 496347 - RNA, 21 nt, Chlamydophila pneumoniae CWL029
uccaagacaauaaaaaagaga

SEQ ID NO: 496348 - RNA, 13 nt, Chlamydophila pneumoniae CWL029
uccaagacaauaa

SEQ ID NO: 496349 - RNA, 14 nt, Chlamydophila pneumoniae CWL029
uccaagaguucucu

SEQ ID NO: 496350 - RNA, 22 nt, Chlamydophila pneumoniae CWL029
uccaacagucugcuuuuuugau

SEQ ID NO: 496351 - RNA, 13 nt, Chlamydophila pneumoniae CWL029
uccaacaucagcu

SEQ ID NO: 496352 - RNA, 16 nt, Chlamydophila pneumoniae CWL029
uccaacggacauuuuc

SEQ ID NO: 496353 - RNA, 23 nt, Chlamydophila pneumoniae CWL029
uccaagugaucagaaaugaagcc

SEQ ID NO: 496354 - RNA, 15 nt, Chlamydophila pneumoniae CWL029
uccaauacuaaaacu

SEQ ID NO: 496355 - RNA, 16 nt, Chlamydophila pneumoniae CWL029
uccaaucugcugaagg

SEQ ID NO: 496356 - RNA, 18 nt, Chlamydophila pneumoniae CWL029
uccaaucugcugaaggga

SEQ ID NO: 496357 - RNA, 16 nt, Chlamydophila pneumoniae CWL029
uccaaugcaugaaucu

SEQ ID NO: 496358 - RNA, 20 nt, Chlamydophila pneumoniae CWL029
uccaauagccaaagacucuu

SEQ ID NO: 496359 - RNA, 17 nt, Chlamydophila pneumoniae CWL029
uccaauaggccagaaug

SEQ ID NO: 496360 - RNA, 19 nt, Chlamydophila pneumoniae CWL029
uccaauccauucugagaaa

SEQ ID NO: 496361 - RNA, 17 nt, Chlamydophila pneumoniae CWL029
ucauguccuucaaaaug

SEQ ID NO: 496362 - RNA, 12 nt, Chlamydophila pneumoniae CWL029
ucauuaaaaauu

SEQ ID NO: 496363 - RNA, 15 nt, Chlamydophila pneumoniae CWL029
ucauuaaaaauuuaa

SEQ ID NO: 496364 - RNA, 15 nt, Chlamydophila pneumoniae CWL029
ucauuccagcaucuu

SEQ ID NO: 496365 - RNA, 16 nt, Chlamydophila pneumoniae CWL029
ucauuagcaagagcuc

SEQ ID NO: 496366 - RNA, 22 nt, Chlamydophila pneumoniae CWL029
ucauuagcaucaucuccugaag

SEQ ID NO: 496367 - RNA, 20 nt, Chlamydophila pneumoniae CWL029
ucauuagcccuacgaaucca

SEQ ID NO: 496368 - RNA, 15 nt, Chlamydophila pneumoniae CWL029
ucauuaucaagaaau

SEQ ID NO: 496369 - RNA, 18 nt, Chlamydophila pneumoniae CWL029
ucauuaucaagaaauucu

SEQ ID NO: 496370 - RNA, 15 nt, Chlamydophila pneumoniae CWL029
ucauucaccuugauu

SEQ ID NO: 496371 - RNA, 14 nt, Chlamydophila pneumoniae CWL029
ucauuuucauagca

SEQ ID NO: 496372 - RNA, 23 nt, Chlamydophila pneumoniae CWL029
uccaacaaacaauuccguacgcu

SEQ ID NO: 496373 - RNA, 21 nt, Chlamydophila pneumoniae CWL029
uccaaacgguuaaugaacuca

SEQ ID NO: 496374 - RNA, 12 nt, Chlamydophila pneumoniae CWL029
uccaaagacuga

SEQ ID NO: 496375 - RNA, 17 nt, Chlamydophila pneumoniae CWL029
uccaaagaucaucuuca

SEQ ID NO: 496376 - RNA, 18 nt, Chlamydophila pneumoniae CWL029
uccaaacauuuuuaagga

SEQ ID NO: 496377 - RNA, 16 nt, Chlamydophila pneumoniae CWL029
uccaaacccugggcuc

SEQ ID NO: 496378 - RNA, 13 nt, Chlamydophila pneumoniae CWL029
ugaaaaucuuuaa

SEQ ID NO: 496379 - RNA, 14 nt, Chlamydophila pneumoniae CWL029
ugaaagcuucuucu

SEQ ID NO: 496380 - RNA, 12 nt, Chlamydophila pneumoniae CWL029
ugaaaucaugga

SEQ ID NO: 496381 - RNA, 19 nt, Chlamydophila pneumoniae CWL029
ugaaaaaagaauaaaaaua

SEQ ID NO: 496382 - RNA, 20 nt, Chlamydophila pneumoniae CWL029
ugaaaagauuugcgaaucua

SEQ ID NO: 496383 - RNA, 13 nt, Chlamydophila pneumoniae CWL029
ugaaaacuucaaa

SEQ ID NO: 496384 - RNA, 18 nt, Chlamydophila pneumoniae CWL029
ugaaguccagacuuuccu

SEQ ID NO: 496385 - RNA, 23 nt, Chlamydophila pneumoniae CWL029
ugaagucguuuagauuuuucuuu

SEQ ID NO: 496386 - RNA, 15 nt, Chlamydophila pneumoniae CWL029
ugaagucuucuugcu

SEQ ID NO: 496387 - RNA, 23 nt, Chlamydophila pneumoniae CWL029
ugaaguuuugguuuuagaaaugu

SEQ ID NO: 496388 - RNA, 22 nt, Chlamydophila pneumoniae CWL029
ugaagcugcuucuucagaguug

SEQ ID NO: 496389 - RNA, 13 nt, Chlamydophila pneumoniae CWL029
ugaaggaucauac

SEQ ID NO: 496390 - RNA, 15 nt, Chlamydophila pneumoniae CWL029
ugaagauuuuuucuu

SEQ ID NO: 496391 - RNA, 17 nt, Chlamydophila pneumoniae CWL029
ugaagcagaaacuuuaa

SEQ ID NO: 496392 - RNA, 16 nt, Chlamydophila pneumoniae CWL029
ugaagcagggaaaaug

SEQ ID NO: 496393 - RNA, 15 nt, Chlamydophila pneumoniae CWL029
ugaagccaugacaaa

SEQ ID NO: 496394 - RNA, 19 nt, Chlamydophila pneumoniae CWL029
ugaagaaguacaagugaag

SEQ ID NO: 496395 - RNA, 16 nt, Chlamydophila pneumoniae CWL029
ugaagacaaguaaaca

SEQ ID NO: 496396 - RNA, 22 nt, Chlamydophila pneumoniae CWL029
ugaacggcucuuucuaaaacau

SEQ ID NO: 496397 - RNA, 21 nt, Chlamydophila pneumoniae CWL029
ugaacguagcuacaaaauuau

SEQ ID NO: 496398 - RNA, 13 nt, Chlamydophila pneumoniae CWL029
ugaacauaauucg

SEQ ID NO: 496399 - RNA, 20 nt, Chlamydophila pneumoniae CWL029
ugaaccuccgcccccuugca

SEQ ID NO: 496400 - RNA, 16 nt, Chlamydophila pneumoniae CWL029
ucuuuggguucuucca

SEQ ID NO: 496401 - RNA, 16 nt, Chlamydophila pneumoniae CWL029
ucuuuggcacaauccu

SEQ ID NO: 496402 - RNA, 20 nt, Chlamydophila pneumoniae CWL029
ucuuuggcacaauccucacu

SEQ ID NO: 496403 - RNA, 22 nt, Chlamydophila pneumoniae CWL029
ucuuugauuuucaggagaccag

SEQ ID NO: 496404 - RNA, 18 nt, Chlamydophila pneumoniae CWL029
ucuuugagaucuugaaug

SEQ ID NO: 496405 - RNA, 20 nt, Chlamydophila pneumoniae CWL029
ucuuugaggauacgaauaag

SEQ ID NO: 496406 - RNA, 15 nt, Chlamydophila pneumoniae CWL029
ucuuucuucuagagc

SEQ ID NO: 496407 - RNA, 17 nt, Chlamydophila pneumoniae CWL029
ucuuucugauuuaaaag

SEQ ID NO: 496408 - RNA, 14 nt, Chlamydophila pneumoniae CWL029
ucuuucuuaggaaa

SEQ ID NO: 496409 - RNA, 22 nt, Chlamydophila pneumoniae CWL029
ucuuucucgaggggacggaaaa

SEQ ID NO: 496410 - RNA, 11 nt, Chlamydophila pneumoniae CWL029
ucuuucuagaa

SEQ ID NO: 496411 - RNA, 19 nt, Chlamydophila pneumoniae CWL029
ucuuucuagaaugaugcaa

SEQ ID NO: 496412 - RNA, 16 nt, Chlamydophila pneumoniae CWL029
ucuuucuaggccggga

SEQ ID NO: 496413 - RNA, 15 nt, Chlamydophila pneumoniae CWL029
ucuuucuauagcucc

SEQ ID NO: 496414 - RNA, 16 nt, Chlamydophila pneumoniae CWL029
ucuuucuauagcuccu

SEQ ID NO: 496415 - RNA, 15 nt, Chlamydophila pneumoniae CWL029
ucuuucucuaaaaua

SEQ ID NO: 496416 - RNA, 12 nt, Chlamydophila pneumoniae CWL029
ucuuucucuaaa

SEQ ID NO: 496417 - RNA, 15 nt, Chlamydophila pneumoniae CWL029
ucuuucuaagauauc

SEQ ID NO: 496418 - RNA, 20 nt, Chlamydophila pneumoniae CWL029
ucuuucuaaaacaucagcaa

SEQ ID NO: 496419 - RNA, 21 nt, Chlamydophila pneumoniae CWL029
ucuuucgaugcuauuuuucca

SEQ ID NO: 496420 - RNA, 14 nt, Chlamydophila pneumoniae CWL029
ucuuucagaaagaa

SEQ ID NO: 496421 - RNA, 14 nt, Chlamydophila pneumoniae CWL029
ucuuucauacuaaa

SEQ ID NO: 496422 - RNA, 16 nt, Chlamydophila pneumoniae CWL029
ucuuucauacuaaaau

SEQ ID NO: 496423 - RNA, 14 nt, Chlamydophila pneumoniae CWL029
ucuuucauucccuu

SEQ ID NO: 496424 - RNA, 15 nt, Chlamydophila pneumoniae CWL029
ucuuucauucccuuu

SEQ ID NO: 496425 - RNA, 19 nt, Chlamydophila pneumoniae CWL029
ucuuuuuauugauaaugau

SEQ ID NO: 496426 - RNA, 21 nt, Chlamydophila pneumoniae CWL029
ucuuuuucuagggaucccaaa

SEQ ID NO: 496427 - RNA, 12 nt, Chlamydophila pneumoniae CWL029
ucuuuucuaagc

SEQ ID NO: 496428 - RNA, 19 nt, Chlamydophila pneumoniae CWL029
ucuuuucuaagcaauauuu

SEQ ID NO: 496429 - RNA, 17 nt, Chlamydophila pneumoniae CWL029
ucuuuucuacaugcuca

SEQ ID NO: 496430 - RNA, 14 nt, Chlamydophila pneumoniae CWL029
ucuuuucugaagau

SEQ ID NO: 496431 - RNA, 15 nt, Chlamydophila pneumoniae CWL029
ucuuuguucgcuccu

SEQ ID NO: 496432 - RNA, 23 nt, Chlamydophila pneumoniae CWL029
ucuuuuauauaccacuacugagc

SEQ ID NO: 496433 - RNA, 18 nt, Chlamydophila pneumoniae CWL029
ucuuuuaugauguauaaa

SEQ ID NO: 496434 - RNA, 21 nt, Chlamydophila pneumoniae CWL029
ucuuuuaugauguauaaaguu

SEQ ID NO: 496435 - RNA, 16 nt, Chlamydophila pneumoniae CWL029
ucuuucaauaacagag

SEQ ID NO: 496436 - RNA, 23 nt, Chlamydophila pneumoniae CWL029
ucuuucacauacauucuauucua

SEQ ID NO: 496437 - RNA, 13 nt, Chlamydophila pneumoniae CWL029
ucuuucacaucuu

SEQ ID NO: 496438 - RNA, 18 nt, Chlamydophila pneumoniae CWL029
ucuuucacaucuuuagaa

SEQ ID NO: 496439 - RNA, 21 nt, Chlamydophila pneumoniae CWL029
ucuuucacaucuuuagaauca

SEQ ID NO: 496440 - RNA, 22 nt, Chlamydophila pneumoniae CWL029
ucuuucaccaacuccucuaagg

SEQ ID NO: 496441 - RNA, 15 nt, Chlamydophila pneumoniae CWL029
ucuuuauuuuuaaaa

SEQ ID NO: 496442 - RNA, 12 nt, Chlamydophila pneumoniae CWL029
ucuuuauuuaaa

SEQ ID NO: 496443 - RNA, 15 nt, Chlamydophila pneumoniae CWL029
ucuuuauuuaaauaa

SEQ ID NO: 496444 - RNA, 18 nt, Chlamydophila pneumoniae CWL029
ucuuuauuuuuaaaaaua

SEQ ID NO: 496445 - RNA, 14 nt, Chlamydophila pneumoniae CWL029
ucuuuaugagagag

SEQ ID NO: 496446 - RNA, 14 nt, Chlamydophila pneumoniae CWL029
ucuuuagcaaacau

SEQ ID NO: 496447 - RNA, 18 nt, Chlamydophila pneumoniae CWL029
ucuuuaggguaaagaaau

SEQ ID NO: 496448 - RNA, 21 nt, Chlamydophila pneumoniae CWL029
ucuuuauaaauacaggagaau

SEQ ID NO: 496449 - RNA, 16 nt, Chlamydophila pneumoniae CWL029
ucuuuacuaacaaaau

SEQ ID NO: 496450 - RNA, 21 nt, Chlamydophila pneumoniae CWL029
ucuuuaauccaguuuuuuaaa

SEQ ID NO: 496451 - RNA, 22 nt, Chlamydophila pneumoniae CWL029
ucuuuaauccaguuuuuuaaau

SEQ ID NO: 496452 - RNA, 19 nt, Chlamydophila pneumoniae CWL029
ucuuuaauugugcucucua

SEQ ID NO: 496453 - RNA, 19 nt, Chlamydophila pneumoniae CWL029
ucuuuaagguugcuuuucu

SEQ ID NO: 496454 - RNA, 16 nt, Chlamydophila pneumoniae CWL029
ucuuuaagauuuccuu

SEQ ID NO: 496455 - RNA, 15 nt, Chlamydophila pneumoniae CWL029
ucuuuaaaaaauucu

SEQ ID NO: 496456 - RNA, 20 nt, Chlamydophila pneumoniae CWL029
ucuuuaaaaacccaacuccc

SEQ ID NO: 496457 - RNA, 15 nt, Chlamydophila pneumoniae CWL029
ucuuguucuaaaaug

SEQ ID NO: 496458 - RNA, 14 nt, Chlamydophila pneumoniae CWL029
ucuugguguauagu

SEQ ID NO: 496459 - RNA, 15 nt, Chlamydophila pneumoniae CWL029
ucuugguguauagua

SEQ ID NO: 496460 - RNA, 16 nt, Chlamydophila pneumoniae CWL029
ucuugguguauaguau

SEQ ID NO: 496461 - RNA, 14 nt, Chlamydophila pneumoniae CWL029
ucuugcuuuuccgu

SEQ ID NO: 496462 - RNA, 15 nt, Chlamydophila pneumoniae CWL029
ucuugcugauuuuug

SEQ ID NO: 496463 - RNA, 23 nt, Chlamydophila pneumoniae CWL029
ucuugcugcccaaauugagaaau

SEQ ID NO: 496464 - RNA, 14 nt, Chlamydophila pneumoniae CWL029
ucuugauuagagaa

SEQ ID NO: 496465 - RNA, 15 nt, Chlamydophila pneumoniae CWL029
ucuugauuagagaau

SEQ ID NO: 496466 - RNA, 13 nt, Chlamydophila pneumoniae CWL029
ucuugauaaaaga

SEQ ID NO: 496467 - RNA, 18 nt, Chlamydophila pneumoniae CWL029
ucuugauagcuaagagca

SEQ ID NO: 496468 - RNA, 17 nt, Chlamydophila pneumoniae CWL029
ucuugauguacaguaaa

SEQ ID NO: 496469 - RNA, 13 nt, Chlamydophila pneumoniae CWL029
ucuugccaaugug

SEQ ID NO: 496470 - RNA, 15 nt, Chlamydophila pneumoniae CWL029
ucuucuuuggaugcu

SEQ ID NO: 496471 - RNA, 13 nt, Chlamydophila pneumoniae CWL029
ucuucuuuucguu

SEQ ID NO: 496472 - RNA, 14 nt, Chlamydophila pneumoniae CWL029
ucuucuuugccaau

SEQ ID NO: 496473 - RNA, 15 nt, Chlamydophila pneumoniae CWL029
ucuugaaaaaauucu

SEQ ID NO: 496474 - RNA, 11 nt, Chlamydophila pneumoniae CWL029
ucuugaaaaaa

SEQ ID NO: 496475 - RNA, 19 nt, Chlamydophila pneumoniae CWL029
ucuugaaguucuucaagau

SEQ ID NO: 496476 - RNA, 22 nt, Chlamydophila pneumoniae CWL029
ucuugaaguucuucaagaugau

SEQ ID NO: 496477 - RNA, 18 nt, Chlamydophila pneumoniae CWL029
ucuugacaacgguguuca

SEQ ID NO: 496478 - RNA, 16 nt, Chlamydophila pneumoniae CWL029
ucuugagcauccaaaa

SEQ ID NO: 496479 - RNA, 17 nt, Chlamydophila pneumoniae CWL029
ucuugagcauccaaaau

SEQ ID NO: 496480 - RNA, 21 nt, Chlamydophila pneumoniae CWL029
ucuugagcgacgacaaggaca

SEQ ID NO: 496481 - RNA, 14 nt, Chlamydophila pneumoniae CWL029
ucuugacggcagga

SEQ ID NO: 496482 - RNA, 19 nt, Chlamydophila pneumoniae CWL029
ucuugacggcaggacucuu

SEQ ID NO: 496483 - RNA, 23 nt, Chlamydophila pneumoniae CWL029
ucuucuagcucauuaucaagaaa

SEQ ID NO: 496484 - RNA, 18 nt, Chlamydophila pneumoniae CWL029
ucuucuagagcuucaagu

SEQ ID NO: 496485 - RNA, 15 nt, Chlamydophila pneumoniae CWL029
ucuucuacagaauag

SEQ ID NO: 496486 - RNA, 19 nt, Chlamydophila pneumoniae CWL029
ucuucuacuuuaagaagca

SEQ ID NO: 496487 - RNA, 17 nt, Chlamydophila pneumoniae CWL029
ucuucgauuguaacuuc

SEQ ID NO: 496488 - RNA, 18 nt, Chlamydophila pneumoniae CWL029
ucuucgauuguaacuucg

SEQ ID NO: 496489 - RNA, 14 nt, Chlamydophila pneumoniae CWL029
ucuucgauuucuag

SEQ ID NO: 496490 - RNA, 22 nt, Chlamydophila pneumoniae CWL029
ucuucgauuucuaguuguccuu

SEQ ID NO: 496491 - RNA, 22 nt, Chlamydophila pneumoniae CWL029
ucuucgcaaauauaguuuucau

SEQ ID NO: 496492 - RNA, 17 nt, Chlamydophila pneumoniae CWL029
ucuucucgguuuaaggc

SEQ ID NO: 496493 - RNA, 17 nt, Chlamydophila pneumoniae CWL029
ucuucucuaugaacgau

SEQ ID NO: 496494 - RNA, 16 nt, Chlamydophila pneumoniae CWL029
ucuucugaaaucaaaa

SEQ ID NO: 496495 - RNA, 22 nt, Chlamydophila pneumoniae CWL029
ucuucuggauacguuuuucccu

SEQ ID NO: 496496 - RNA, 17 nt, Chlamydophila pneumoniae CWL029
ucuucuggcugagagaa

SEQ ID NO: 496497 - RNA, 19 nt, Chlamydophila pneumoniae CWL029
ucuucuggguucuccacau

SEQ ID NO: 496498 - RNA, 23 nt, Chlamydophila pneumoniae CWL029
ucuucuggauacguuuuucccuu

SEQ ID NO: 496499 - RNA, 16 nt, Chlamydophila pneumoniae CWL029
ucuucuguaggaacaa

SEQ ID NO: 496500 - RNA, 14 nt, Chlamydophila pneumoniae CWL029
ucuucuugauuaag

SEQ ID NO: 496501 - RNA, 15 nt, Chlamydophila pneumoniae CWL029
ucuucuugcaaucuu

SEQ ID NO: 496502 - RNA, 22 nt, Chlamydophila pneumoniae CWL029
ucuucuugcaaucuuugaagcu

SEQ ID NO: 496503 - RNA, 22 nt, Chlamydophila pneumoniae CWL029
ucuucuucgguguagaucuuuu

SEQ ID NO: 496504 - RNA, 17 nt, Chlamydophila pneumoniae CWL029
ucuucuucccuuucaaa

SEQ ID NO: 496505 - RNA, 15 nt, Chlamydophila pneumoniae CWL029
ucuucuucaaaguca

SEQ ID NO: 496506 - RNA, 19 nt, Chlamydophila pneumoniae CWL029
ucuucuuccaaaaucucua

SEQ ID NO: 496507 - RNA, 16 nt, Chlamydophila pneumoniae CWL029
ucuucuuagaaacaca

SEQ ID NO: 496508 - RNA, 16 nt, Chlamydophila pneumoniae CWL029
ucuucuuagaagagaa

SEQ ID NO: 496509 - RNA, 18 nt, Chlamydophila pneumoniae CWL029
ucuucuuagaagagaaag

SEQ ID NO: 496510 - RNA, 15 nt, Chlamydophila pneumoniae CWL029
ucuucuguuuucucu

SEQ ID NO: 496511 - RNA, 16 nt, Chlamydophila pneumoniae CWL029
ucuuaugggagaagcu

SEQ ID NO: 496512 - RNA, 17 nt, Chlamydophila pneumoniae CWL029
ucuuauggucagaagcu

SEQ ID NO: 496513 - RNA, 16 nt, Chlamydophila pneumoniae CWL029
ucuuauucacuggaau

SEQ ID NO: 496514 - RNA, 20 nt, Chlamydophila pneumoniae CWL029
ucuuagcguauccgcugccc

SEQ ID NO: 496515 - RNA, 16 nt, Chlamydophila pneumoniae CWL029
ucuuagccaaaauuuc

SEQ ID NO: 496516 - RNA, 18 nt, Chlamydophila pneumoniae CWL029
ucuuauguuaaaaauacc

SEQ ID NO: 496517 - RNA, 14 nt, Chlamydophila pneumoniae CWL029
ucuuagaauccaaa

SEQ ID NO: 496518 - RNA, 14 nt, Chlamydophila pneumoniae CWL029
ucuuaauuaaaaac

SEQ ID NO: 496519 - RNA, 18 nt, Chlamydophila pneumoniae CWL029
ucuuaauauaaaagaaga

SEQ ID NO: 496520 - RNA, 22 nt, Chlamydophila pneumoniae CWL029
ucuuaaaauauuaaauucaaaa

SEQ ID NO: 496521 - RNA, 18 nt, Chlamydophila pneumoniae CWL029
ucuuaacaauauaugcua

SEQ ID NO: 496522 - RNA, 17 nt, Chlamydophila pneumoniae CWL029
ucuuaacgcuuagagaa

SEQ ID NO: 496523 - RNA, 18 nt, Chlamydophila pneumoniae CWL029
ucuuaacuggcaaucuaa

SEQ ID NO: 496524 - RNA, 21 nt, Chlamydophila pneumoniae CWL029
ucuuaacuggcaaucuaaaau

SEQ ID NO: 496525 - RNA, 14 nt, Chlamydophila pneumoniae CWL029
ucuuaagaauaaaa

SEQ ID NO: 496526 - RNA, 17 nt, Chlamydophila pneumoniae CWL029
ucuuaagaauaaaauag

SEQ ID NO: 496527 - RNA, 12 nt, Chlamydophila pneumoniae CWL029
ucuuaaaacaug

SEQ ID NO: 496528 - RNA, 12 nt, Chlamydophila pneumoniae CWL029
ucuuaaaacugc

SEQ ID NO: 496529 - RNA, 14 nt, Chlamydophila pneumoniae CWL029
ucuguuuuggaaag

SEQ ID NO: 496530 - RNA, 16 nt, Chlamydophila pneumoniae CWL029
ucugguauagaaacac

SEQ ID NO: 496531 - RNA, 17 nt, Chlamydophila pneumoniae CWL029
ucuucagaaugcccuuu

SEQ ID NO: 496532 - RNA, 13 nt, Chlamydophila pneumoniae CWL029
ucuucaaagaacu

SEQ ID NO: 496533 - RNA, 23 nt, Chlamydophila pneumoniae CWL029
ucuucaaagcuacuaaucaccuu

SEQ ID NO: 496534 - RNA, 14 nt, Chlamydophila pneumoniae CWL029
ucuucaaaagaccg

SEQ ID NO: 496535 - RNA, 22 nt, Chlamydophila pneumoniae CWL029
ucuucaaaagaccgccuucuaa

SEQ ID NO: 496536 - RNA, 18 nt, Chlamydophila pneumoniae CWL029
ucuucauaugcucucccg

SEQ ID NO: 496537 - RNA, 23 nt, Chlamydophila pneumoniae CWL029
ucuucagucauucuauggucucc

SEQ ID NO: 496538 - RNA, 15 nt, Chlamydophila pneumoniae CWL029
ucuucaggugaagga

SEQ ID NO: 496539 - RNA, 15 nt, Chlamydophila pneumoniae CWL029
ucuucaggaacagca

SEQ ID NO: 496540 - RNA, 19 nt, Chlamydophila pneumoniae CWL029
ucuucagaguugucaagua

SEQ ID NO: 496541 - RNA, 21 nt, Chlamydophila pneumoniae CWL029
ucuucccauuucuucuuagaa

SEQ ID NO: 496542 - RNA, 14 nt, Chlamydophila pneumoniae CWL029
ucuucccccagacc

SEQ ID NO: 496543 - RNA, 20 nt, Chlamydophila pneumoniae CWL029
ucuucauugcaaaaaugaaa

SEQ ID NO: 496544 - RNA, 16 nt, Chlamydophila pneumoniae CWL029
ucuucauuccaggauu

SEQ ID NO: 496545 - RNA, 20 nt, Chlamydophila pneumoniae CWL029
ucuucauuuucuuuuaagag

SEQ ID NO: 496546 - RNA, 15 nt, Chlamydophila pneumoniae CWL029
ucuucaucaauacga

SEQ ID NO: 496547 - RNA, 13 nt, Chlamydophila pneumoniae CWL029
ucuucauccgaag

SEQ ID NO: 496548 - RNA, 16 nt, Chlamydophila pneumoniae CWL029
ucuucauccgaagacu

SEQ ID NO: 496549 - RNA, 15 nt, Chlamydophila pneumoniae CWL029
ucuucaugaaaaaag

SEQ ID NO: 496550 - RNA, 18 nt, Chlamydophila pneumoniae CWL029
ucuucauuauuaaacgaa

SEQ ID NO: 496551 - RNA, 21 nt, Chlamydophila pneumoniae CWL029
ucugggugcgucguaaucuuu

SEQ ID NO: 496552 - RNA, 22 nt, Chlamydophila pneumoniae CWL029
ucugcuccugaauaugcuuuuc

SEQ ID NO: 496553 - RNA, 15 nt, Chlamydophila pneumoniae CWL029
ucugcucuauauauc

SEQ ID NO: 496554 - RNA, 13 nt, Chlamydophila pneumoniae CWL029
ucugcugaggaga

SEQ ID NO: 496555 - RNA, 15 nt, Chlamydophila pneumoniae CWL029
ucugcguuucuuucu

SEQ ID NO: 496556 - RNA, 24 nt, Chlamydophila pneumoniae CWL029
ucugcgugucguugguucaaaucc

SEQ ID NO: 496557 - RNA, 22 nt, Chlamydophila pneumoniae CWL029
ucugcgucuuuaauuaaaaguu

SEQ ID NO: 496558 - RNA, 20 nt, Chlamydophila pneumoniae CWL029
ucugcgauaggaucuucuau

SEQ ID NO: 496559 - RNA, 22 nt, Chlamydophila pneumoniae CWL029
ucugcgcagcguauaauuggcg

SEQ ID NO: 496560 - RNA, 17 nt, Chlamydophila pneumoniae CWL029
ucugccuuaugcucauu

SEQ ID NO: 496561 - RNA, 16 nt, Chlamydophila pneumoniae CWL029
ucugcccgucuuagaa

SEQ ID NO: 496562 - RNA, 16 nt, Chlamydophila pneumoniae CWL029
ucugcccuuucugcaa

SEQ ID NO: 496563 - RNA, 19 nt, Chlamydophila pneumoniae CWL029
ucugccauaggauccagga

SEQ ID NO: 496564 - RNA, 18 nt, Chlamydophila pneumoniae CWL029
ucugauugagaauaaaac

SEQ ID NO: 496565 - RNA, 19 nt, Chlamydophila pneumoniae CWL029
ucugauuaguucucuaaga

SEQ ID NO: 496566 - RNA, 16 nt, Chlamydophila pneumoniae CWL029
ucugauuauuucuaaa

SEQ ID NO: 496567 - RNA, 20 nt, Chlamydophila pneumoniae CWL029
ucugauuauuucuaaaaaau

SEQ ID NO: 496568 - RNA, 13 nt, Chlamydophila pneumoniae CWL029
ucugagaaguuaa

SEQ ID NO: 496569 - RNA, 21 nt, Chlamydophila pneumoniae CWL029
ucugagcauaacuugaagaag

SEQ ID NO: 496570 - RNA, 18 nt, Chlamydophila pneumoniae CWL029
ucugaugacguuaauaaa

SEQ ID NO: 496571 - RNA, 15 nt, Chlamydophila pneumoniae CWL029
ucugaucccucaaaa

SEQ ID NO: 496572 - RNA, 19 nt, Chlamydophila pneumoniae CWL029
ucugaaucucauaaguaua

SEQ ID NO: 496573 - RNA, 23 nt, Chlamydophila pneumoniae CWL029
ucugaaucucauaaguauagaga

SEQ ID NO: 496574 - RNA, 15 nt, Chlamydophila pneumoniae CWL029
ucugacaaguguguu

SEQ ID NO: 496575 - RNA, 15 nt, Chlamydophila pneumoniae CWL029
ucucuuuuggaagac

SEQ ID NO: 496576 - RNA, 24 nt, Chlamydophila pneumoniae CWL029
ucucuuuuggaagaccuuuggauu

SEQ ID NO: 496577 - RNA, 15 nt, Chlamydophila pneumoniae CWL029
ucucuuugacaucua

SEQ ID NO: 496578 - RNA, 22 nt, Chlamydophila pneumoniae CWL029
aaaugcuccugcaaaaaaccag

SEQ ID NO: 496579 - RNA, 16 nt, Chlamydophila pneumoniae CWL029
ucugaagcuaaaaaau

SEQ ID NO: 496580 - RNA, 12 nt, Chlamydophila pneumoniae CWL029
ucugaagcugca

SEQ ID NO: 496581 - RNA, 20 nt, Chlamydophila pneumoniae CWL029
ucugaagaccccucuugcuu

SEQ ID NO: 496582 - RNA, 22 nt, Chlamydophila pneumoniae CWL029
ucucuucccuuguuaugaaaau

SEQ ID NO: 496583 - RNA, 22 nt, Chlamydophila pneumoniae CWL029
ucucuuccuucuccuguaaagc

SEQ ID NO: 496584 - RNA, 12 nt, Chlamydophila pneumoniae CWL029
ucucuuccuucu

SEQ ID NO: 496585 - RNA, 22 nt, Chlamydophila pneumoniae CWL029
ucucuucgcuggcauguuuaau

SEQ ID NO: 496586 - RNA, 13 nt, Chlamydophila pneumoniae CWL029
ucucuuccaaaag

SEQ ID NO: 496587 - RNA, 21 nt, Chlamydophila pneumoniae CWL029
ucucuuaacuggcaaucuaaa

SEQ ID NO: 496588 - RNA, 15 nt, Chlamydophila pneumoniae CWL029
ucucuaguucuagaa

SEQ ID NO: 496589 - RNA, 22 nt, Chlamydophila pneumoniae CWL029
ucucuaguucuagaaaggcauu

SEQ ID NO: 496590 - RNA, 16 nt, Chlamydophila pneumoniae CWL029
ucucuaguuuuuacau

SEQ ID NO: 496591 - RNA, 14 nt, Chlamydophila pneumoniae CWL029
ucucuauaaaaaaa

SEQ ID NO: 496592 - RNA, 18 nt, Chlamydophila pneumoniae CWL029
ucucuguauaguuuucaa

SEQ ID NO: 496593 - RNA, 21 nt, Chlamydophila pneumoniae CWL029
ucucuagccaauauagaagcu

SEQ ID NO: 496594 - RNA, 22 nt, Chlamydophila pneumoniae CWL029
ucucuagccaauauagaagcug

SEQ ID NO: 496595 - RNA, 15 nt, Chlamydophila pneumoniae CWL029
ucucuaggaacucuu

SEQ ID NO: 496596 - RNA, 22 nt, Chlamydophila pneumoniae CWL029
ucucuaccgaacagagcgucua

SEQ ID NO: 496597 - RNA, 18 nt, Chlamydophila pneumoniae CWL029
ucucuaagaaauuuucuc

SEQ ID NO: 496598 - RNA, 17 nt, Chlamydophila pneumoniae CWL029
ucucguacguggaaagu

SEQ ID NO: 496599 - RNA, 19 nt, Chlamydophila pneumoniae CWL029
ucucgucauuaccugcuaa

SEQ ID NO: 496600 - RNA, 16 nt, Chlamydophila pneumoniae CWL029
ucucuaagcagccucu

SEQ ID NO: 496601 - RNA, 17 nt, Chlamydophila pneumoniae CWL029
ucucgggagaacaugcc

SEQ ID NO: 496602 - RNA, 11 nt, Chlamydophila pneumoniae CWL029
ucgccaaacca

SEQ ID NO: 496603 - RNA, 13 nt, Chlamydophila pneumoniae CWL029
ucgccaaaccaug

SEQ ID NO: 496604 - RNA, 21 nt, Chlamydophila pneumoniae CWL029
ucgccaaaccaugaggcugcu

SEQ ID NO: 496605 - RNA, 21 nt, Chlamydophila pneumoniae CWL029
ugagaggaucgugaaguacau

SEQ ID NO: 496606 - RNA, 18 nt, Chlamydophila pneumoniae CWL029
ugagaaaucuuuugauua

SEQ ID NO: 496607 - RNA, 19 nt, Chlamydophila pneumoniae CWL029
ugagaacucagcgcaucac

SEQ ID NO: 496608 - RNA, 15 nt, Chlamydophila pneumoniae CWL029
ugagaccauaaaauc

SEQ ID NO: 496609 - RNA, 17 nt, Chlamydophila pneumoniae CWL029
ugacuucuuguccuguu

SEQ ID NO: 496610 - RNA, 16 nt, Chlamydophila pneumoniae CWL029
ugacucuaauucagaa

SEQ ID NO: 496611 - RNA, 12 nt, Chlamydophila pneumoniae CWL029
ugacucuagagu

SEQ ID NO: 496612 - RNA, 14 nt, Chlamydophila pneumoniae CWL029
ugacucuagccacc

SEQ ID NO: 496613 - RNA, 18 nt, Chlamydophila pneumoniae CWL029
ugacucuagccaccaaca

SEQ ID NO: 496614 - RNA, 11 nt, Chlamydophila pneumoniae CWL029
ugacugaaacu

SEQ ID NO: 496615 - RNA, 12 nt, Chlamydophila pneumoniae CWL029
ugacugaaacuc

SEQ ID NO: 496616 - RNA, 14 nt, Chlamydophila pneumoniae CWL029
ugacuauuuucauu

SEQ ID NO: 496617 - RNA, 23 nt, Chlamydophila pneumoniae CWL029
ugacuaugguaagcauuucuguu

SEQ ID NO: 496618 - RNA, 21 nt, Chlamydophila pneumoniae CWL029
ugacuauagggagacucuuga

SEQ ID NO: 496619 - RNA, 22 nt, Chlamydophila pneumoniae CWL029
ugacuaauaccuuucuaagaau

SEQ ID NO: 496620 - RNA, 22 nt, Chlamydophila pneumoniae CWL029
ugacguuaauaaagaggcuccc

SEQ ID NO: 496621 - RNA, 20 nt, Chlamydophila pneumoniae CWL029
ugacguuaauaaagaggcuc

SEQ ID NO: 496622 - RNA, 21 nt, Chlamydophila pneumoniae CWL029
ugacggcaggacucuuuaagc

SEQ ID NO: 496623 - RNA, 17 nt, Chlamydophila pneumoniae CWL029
ugacgcuuuuccaaagc

SEQ ID NO: 496624 - RNA, 16 nt, Chlamydophila pneumoniae CWL029
ugaccucaucucgcag

SEQ ID NO: 496625 - RNA, 20 nt, Chlamydophila pneumoniae CWL029
ugaccucaucucgcagucca

SEQ ID NO: 496626 - RNA, 23 nt, Chlamydophila pneumoniae CWL029
ugaccaaacuuggucauuauagu

SEQ ID NO: 496627 - RNA, 11 nt, Chlamydophila pneumoniae CWL029
ugaccaagaac

SEQ ID NO: 496628 - RNA, 13 nt, Chlamydophila pneumoniae CWL029
ugacaucuccaag

SEQ ID NO: 496629 - RNA, 21 nt, Chlamydophila pneumoniae CWL029
ugacaucuccaagauaauuau

SEQ ID NO: 496630 - RNA, 22 nt, Chlamydophila pneumoniae CWL029
ugacccagagaauguucccaaa

SEQ ID NO: 496631 - RNA, 17 nt, Chlamydophila pneumoniae CWL029
ugaucuucuagaugugu

SEQ ID NO: 496632 - RNA, 23 nt, Chlamydophila pneumoniae CWL029
ugaucugaaauagcaaagacauc

SEQ ID NO: 496633 - RNA, 16 nt, Chlamydophila pneumoniae CWL029
ugauccuugcaaaaca

SEQ ID NO: 496634 - RNA, 20 nt, Chlamydophila pneumoniae CWL029
ugauccgaaaacucuuagag

SEQ ID NO: 496635 - RNA, 22 nt, Chlamydophila pneumoniae CWL029
ugauacuuguaccguaaagaaa

SEQ ID NO: 496636 - RNA, 12 nt, Chlamydophila pneumoniae CWL029
ugauacuuuaga

SEQ ID NO: 496637 - RNA, 13 nt, Chlamydophila pneumoniae CWL029
ugauaaggaagaa

SEQ ID NO: 496638 - RNA, 19 nt, Chlamydophila pneumoniae CWL029
ugauaccaccuaaaaugca

SEQ ID NO: 496639 - RNA, 21 nt, Chlamydophila pneumoniae CWL029
ugauaccaccuaaaaugcagg

SEQ ID NO: 496640 - RNA, 18 nt, Chlamydophila pneumoniae CWL029
ugaguggguucacuccug

SEQ ID NO: 496641 - RNA, 20 nt, Chlamydophila pneumoniae CWL029
ugaguuagcuuuugugauac

SEQ ID NO: 496642 - RNA, 14 nt, Chlamydophila pneumoniae CWL029
ugauaaaagauagu

SEQ ID NO: 496643 - RNA, 14 nt, Chlamydophila pneumoniae CWL029
ugauaaaaauuuuc

SEQ ID NO: 496644 - RNA, 19 nt, Chlamydophila pneumoniae CWL029
ugauaaaagguauuucucu

SEQ ID NO: 496645 - RNA, 12 nt, Chlamydophila pneumoniae CWL029
ugauaaagccug

SEQ ID NO: 496646 - RNA, 17 nt, Chlamydophila pneumoniae CWL029
ugagggucggauuuaga

SEQ ID NO: 496647 - RNA, 12 nt, Chlamydophila pneumoniae CWL029
ugagcuacaaga

SEQ ID NO: 496648 - RNA, 14 nt, Chlamydophila pneumoniae CWL029
ugagcuaagucucc

SEQ ID NO: 496649 - RNA, 13 nt, Chlamydophila pneumoniae CWL029
ugagcucucuagc

SEQ ID NO: 496650 - RNA, 22 nt, Chlamydophila pneumoniae CWL029
ugaggaacgcacgccaagagag

SEQ ID NO: 496651 - RNA, 18 nt, Chlamydophila pneumoniae CWL029
ugaggaaucauaaccaaa

SEQ ID NO: 496652 - RNA, 22 nt, Chlamydophila pneumoniae CWL029
ugaggaaucauaaccaaaagaa

SEQ ID NO: 496653 - RNA, 19 nt, Chlamydophila pneumoniae CWL029
ugaggacgcagagaugcua

SEQ ID NO: 496654 - RNA, 20 nt, Chlamydophila pneumoniae CWL029
ugaggagcucccucuagagc

SEQ ID NO: 496655 - RNA, 18 nt, Chlamydophila pneumoniae CWL029
ugaggauaaguucuucca

SEQ ID NO: 496656 - RNA, 16 nt, Chlamydophila pneumoniae CWL029
ugagcaacaagcugcu

SEQ ID NO: 496657 - RNA, 22 nt, Chlamydophila pneumoniae CWL029
ugagcaacaagcugcugagcag

SEQ ID NO: 496658 - RNA, 23 nt, Chlamydophila pneumoniae CWL029
ugagaucaucucccaaauagcua

SEQ ID NO: 496659 - RNA, 22 nt, Chlamydophila pneumoniae CWL029
ugagauaaucgcacuucuauuu

SEQ ID NO: 496660 - RNA, 17 nt, Chlamydophila pneumoniae CWL029
ugagauacggaggauua

SEQ ID NO: 496661 - RNA, 16 nt, Chlamydophila pneumoniae CWL029
ugccaaucuuccuuaa

SEQ ID NO: 496662 - RNA, 15 nt, Chlamydophila pneumoniae CWL029
ugccaaugugcaaua

SEQ ID NO: 496663 - RNA, 20 nt, Chlamydophila pneumoniae CWL029
ugccaauguggugauuucuu

SEQ ID NO: 496664 - RNA, 21 nt, Chlamydophila pneumoniae CWL029
ugccaauguggugauuucuuu

SEQ ID NO: 496665 - RNA, 19 nt, Chlamydophila pneumoniae CWL029
ugcauuucaugaauuguca

SEQ ID NO: 496666 - RNA, 12 nt, Chlamydophila pneumoniae CWL029
ugcaucuuauca

SEQ ID NO: 496667 - RNA, 19 nt, Chlamydophila pneumoniae CWL029
ugcaucuuaucaagagcuc

SEQ ID NO: 496668 - RNA, 17 nt, Chlamydophila pneumoniae CWL029
ugcaucuuauggaagag

SEQ ID NO: 496669 - RNA, 22 nt, Chlamydophila pneumoniae CWL029
ugcauuaucuaagaauauggac

SEQ ID NO: 496670 - RNA, 16 nt, Chlamydophila pneumoniae CWL029
ugcaucucuuaaaaca

SEQ ID NO: 496671 - RNA, 20 nt, Chlamydophila pneumoniae CWL029
ugcauacuggcccagauucu

SEQ ID NO: 496672 - RNA, 13 nt, Chlamydophila pneumoniae CWL029
ugcauaaucucac

SEQ ID NO: 496673 - RNA, 22 nt, Chlamydophila pneumoniae CWL029
ugcauacguuaacaaggauuau

SEQ ID NO: 496674 - RNA, 19 nt, Chlamydophila pneumoniae CWL029
ugcaguuccgauaaagaua

SEQ ID NO: 496675 - RNA, 16 nt, Chlamydophila pneumoniae CWL029
ugcaguugaugagaaa

SEQ ID NO: 496676 - RNA, 18 nt, Chlamydophila pneumoniae CWL029
ugcaguugaugagaaaaa

SEQ ID NO: 496677 - RNA, 19 nt, Chlamydophila pneumoniae CWL029
ugcagcguuucuagggacg

SEQ ID NO: 496678 - RNA, 22 nt, Chlamydophila pneumoniae CWL029
ugcagcagauaccaaaauacca

SEQ ID NO: 496679 - RNA, 13 nt, Chlamydophila pneumoniae CWL029
ugcagaucuuuua

SEQ ID NO: 496680 - RNA, 21 nt, Chlamydophila pneumoniae CWL029
ugcagauacuaaacuccauug

SEQ ID NO: 496681 - RNA, 23 nt, Chlamydophila pneumoniae CWL029
ugcacuugcgguuuuggauagaa

SEQ ID NO: 496682 - RNA, 15 nt, Chlamydophila pneumoniae CWL029
ugcacacauccugga

SEQ ID NO: 496683 - RNA, 17 nt, Chlamydophila pneumoniae CWL029
ugcaauuccauagguua

SEQ ID NO: 496684 - RNA, 17 nt, Chlamydophila pneumoniae CWL029
ugcaauuccgaagaaga

SEQ ID NO: 496685 - RNA, 20 nt, Chlamydophila pneumoniae CWL029
ugcaauucuucaugcugcuu

SEQ ID NO: 496686 - RNA, 17 nt, Chlamydophila pneumoniae CWL029
ugcaauugccauaucau

SEQ ID NO: 496687 - RNA, 13 nt, Chlamydophila pneumoniae CWL029
ugcaaucagugcu

SEQ ID NO: 496688 - RNA, 16 nt, Chlamydophila pneumoniae CWL029
ugcaaucagugcugcc

SEQ ID NO: 496689 - RNA, 14 nt, Chlamydophila pneumoniae CWL029
ugcaaucucaaaau

SEQ ID NO: 496690 - RNA, 17 nt, Chlamydophila pneumoniae CWL029
ugcaaggccuaaucuug

SEQ ID NO: 496691 - RNA, 16 nt, Chlamydophila pneumoniae CWL029
ugcaagugcuuucagg

SEQ ID NO: 496692 - RNA, 19 nt, Chlamydophila pneumoniae CWL029
ugcaaguuugaaugcagca

SEQ ID NO: 496693 - RNA, 13 nt, Chlamydophila pneumoniae CWL029
ugcaauacuuuuc

SEQ ID NO: 496694 - RNA, 20 nt, Chlamydophila pneumoniae CWL029
ugcaagagcccuugugcauc

SEQ ID NO: 496695 - RNA, 19 nt, Chlamydophila pneumoniae CWL029
ugcaagcagauagagcuuc

SEQ ID NO: 496696 - RNA, 14 nt, Chlamydophila pneumoniae CWL029
ugcaaggcaaugau

SEQ ID NO: 496697 - RNA, 21 nt, Chlamydophila pneumoniae CWL029
ugcaaggcaagaugugcucga

SEQ ID NO: 496698 - RNA, 18 nt, Chlamydophila pneumoniae CWL029
ugcaagcuucaucaggag

SEQ ID NO: 496699 - RNA, 19 nt, Chlamydophila pneumoniae CWL029
ugcaacggagaaauuugug

SEQ ID NO: 496700 - RNA, 18 nt, Chlamydophila pneumoniae CWL029
ugcaaccuguaaagacca

SEQ ID NO: 496701 - RNA, 19 nt, Chlamydophila pneumoniae CWL029
ugcaaccacacaggauugu

SEQ ID NO: 496702 - RNA, 14 nt, Chlamydophila pneumoniae CWL029
ugcaaauuccagaa

SEQ ID NO: 496703 - RNA, 12 nt, Chlamydophila pneumoniae CWL029
ugcaaauuucau

SEQ ID NO: 496704 - RNA, 22 nt, Chlamydophila pneumoniae CWL029
ugcaaaugaagggaugggaucg

SEQ ID NO: 496705 - RNA, 18 nt, Chlamydophila pneumoniae CWL029
ugcaaauccuguagaaac

SEQ ID NO: 496706 - RNA, 16 nt, Chlamydophila pneumoniae CWL029
ugcaaaaaugaaagaa

SEQ ID NO: 496707 - RNA, 18 nt, Chlamydophila pneumoniae CWL029
ugcaaaaaguuucaaucu

SEQ ID NO: 496708 - RNA, 14 nt, Chlamydophila pneumoniae CWL029
ugcaaaaaaccagc

SEQ ID NO: 496709 - RNA, 23 nt, Chlamydophila pneumoniae CWL029
ugcaaaaaaccagccaauaacau

SEQ ID NO: 496710 - RNA, 21 nt, Chlamydophila pneumoniae CWL029
ugauuuuugcuaagagcucuu

SEQ ID NO: 496711 - RNA, 18 nt, Chlamydophila pneumoniae CWL029
ugauuuuugcuaagagcu

SEQ ID NO: 496712 - RNA, 13 nt, Chlamydophila pneumoniae CWL029
ugauuuuucaaau

SEQ ID NO: 496713 - RNA, 19 nt, Chlamydophila pneumoniae CWL029
ugauuuuucaaucaauaaa

SEQ ID NO: 496714 - RNA, 17 nt, Chlamydophila pneumoniae CWL029
ugcaaacugaucugaaa

SEQ ID NO: 496715 - RNA, 17 nt, Chlamydophila pneumoniae CWL029
ugcaaaaaugaaagaaa

SEQ ID NO: 496716 - RNA, 14 nt, Chlamydophila pneumoniae CWL029
ugcaaaggaaggga

SEQ ID NO: 496717 - RNA, 16 nt, Chlamydophila pneumoniae CWL029
ugcaaagcaucuugua

SEQ ID NO: 496718 - RNA, 14 nt, Chlamydophila pneumoniae CWL029
ugcaaagcccauac

SEQ ID NO: 496719 - RNA, 21 nt, Chlamydophila pneumoniae CWL029
ugauucccggaggcaaagauc

SEQ ID NO: 496720 - RNA, 14 nt, Chlamydophila pneumoniae CWL029
ugauuccuuaaguc

SEQ ID NO: 496721 - RNA, 19 nt, Chlamydophila pneumoniae CWL029
ugaugauuuuuuaugacaa

SEQ ID NO: 496722 - RNA, 14 nt, Chlamydophila pneumoniae CWL029
ugaugacauugcaa

SEQ ID NO: 496723 - RNA, 16 nt, Chlamydophila pneumoniae CWL029
ugauugaaguucagac

SEQ ID NO: 496724 - RNA, 17 nt, Chlamydophila pneumoniae CWL029
ugauugaacagucuugc

SEQ ID NO: 496725 - RNA, 18 nt, Chlamydophila pneumoniae CWL029
ugauugagaauaaaacuu

SEQ ID NO: 496726 - RNA, 17 nt, Chlamydophila pneumoniae CWL029
ugccugaaaauucgaau

SEQ ID NO: 496727 - RNA, 20 nt, Chlamydophila pneumoniae CWL029
ugccuuacgaacuauagcaa

SEQ ID NO: 496728 - RNA, 19 nt, Chlamydophila pneumoniae CWL029
ugccuucuuaucuucuaaa

SEQ ID NO: 496729 - RNA, 13 nt, Chlamydophila pneumoniae CWL029
ugccuuaugcuca

SEQ ID NO: 496730 - RNA, 16 nt, Chlamydophila pneumoniae CWL029
ugccagagauucuuca

SEQ ID NO: 496731 - RNA, 18 nt, Chlamydophila pneumoniae CWL029
ugccagagauucuucaca

SEQ ID NO: 496732 - RNA, 15 nt, Chlamydophila pneumoniae CWL029
ugcgacaaaaaugcc

SEQ ID NO: 496733 - RNA, 19 nt, Chlamydophila pneumoniae CWL029
ugcgaaugucguuaaaaac

SEQ ID NO: 496734 - RNA, 20 nt, Chlamydophila pneumoniae CWL029
ugcgaauccugaggaugcua

SEQ ID NO: 496735 - RNA, 14 nt, Chlamydophila pneumoniae CWL029
ugccuuuuuuucua

SEQ ID NO: 496736 - RNA, 16 nt, Chlamydophila pneumoniae CWL029
ugcgaacaguuccuau

SEQ ID NO: 496737 - RNA, 16 nt, Chlamydophila pneumoniae CWL029
ugccuuuagggaaaaa

SEQ ID NO: 496738 - RNA, 17 nt, Chlamydophila pneumoniae CWL029
ugcgcacggauucuaaa

SEQ ID NO: 496739 - RNA, 22 nt, Chlamydophila pneumoniae CWL029
ugcuccaauuuucuucagcacu

SEQ ID NO: 496740 - RNA, 14 nt, Chlamydophila pneumoniae CWL029
ugcuccugaagcug

SEQ ID NO: 496741 - RNA, 11 nt, Chlamydophila pneumoniae CWL029
ugcuccugaag

SEQ ID NO: 496742 - RNA, 23 nt, Chlamydophila pneumoniae CWL029
ugcuccuaagugauaaggaagaa

SEQ ID NO: 496743 - RNA, 21 nt, Chlamydophila pneumoniae CWL029
ugcucccuccuccucgucuaa

SEQ ID NO: 496744 - RNA, 20 nt, Chlamydophila pneumoniae CWL029
ugcucaauacagauaucaaa

SEQ ID NO: 496745 - RNA, 20 nt, Chlamydophila pneumoniae CWL029
ugcucaggagauacaagcaa

SEQ ID NO: 496746 - RNA, 22 nt, Chlamydophila pneumoniae CWL029
ugcucaggagauacaagcaauu

SEQ ID NO: 496747 - RNA, 20 nt, Chlamydophila pneumoniae CWL029
ugcuacuuuaaaguggcaau

SEQ ID NO: 496748 - RNA, 22 nt, Chlamydophila pneumoniae CWL029
ugcuaauccagcaacaaccaaa

SEQ ID NO: 496749 - RNA, 12 nt, Chlamydophila pneumoniae CWL029
ugcuaauaauuc

SEQ ID NO: 496750 - RNA, 13 nt, Chlamydophila pneumoniae CWL029
ugcuacaaacucu

SEQ ID NO: 496751 - RNA, 17 nt, Chlamydophila pneumoniae CWL029
ugcuacaaacucuucca

SEQ ID NO: 496752 - RNA, 16 nt, Chlamydophila pneumoniae CWL029
ugcuaaaacuaaaguu

SEQ ID NO: 496753 - RNA, 13 nt, Chlamydophila pneumoniae CWL029
ugcuaaacaaugc

SEQ ID NO: 496754 - RNA, 23 nt, Chlamydophila pneumoniae CWL029
ugcuaaacuuuuuuucaaaucau

SEQ ID NO: 496755 - RNA, 20 nt, Chlamydophila pneumoniae CWL029
ugcuaaacuuuuuuucaaau

SEQ ID NO: 496756 - RNA, 13 nt, Chlamydophila pneumoniae CWL029
ugcuaacaacucc

SEQ ID NO: 496757 - RNA, 19 nt, Chlamydophila pneumoniae CWL029
ugcuaagaucuuuagaaua

SEQ ID NO: 496758 - RNA, 20 nt, Chlamydophila pneumoniae CWL029
ugcuaagcgaaccaaaguca

SEQ ID NO: 496759 - RNA, 21 nt, Chlamydophila pneumoniae CWL029
ugcuauagcuggaucuucuga

SEQ ID NO: 496760 - RNA, 21 nt, Chlamydophila pneumoniae CWL029
ugcuaucaaagacucaugaaa

SEQ ID NO: 496761 - RNA, 21 nt, Chlamydophila pneumoniae CWL029
ugcuaucauaacguauuucac

SEQ ID NO: 496762 - RNA, 12 nt, Chlamydophila pneumoniae CWL029
ugcuaucuccag

SEQ ID NO: 496763 - RNA, 12 nt, Chlamydophila pneumoniae CWL029
ugcuauacagaa

SEQ ID NO: 496764 - RNA, 18 nt, Chlamydophila pneumoniae CWL029
ugcuagagcuuucagaaa

SEQ ID NO: 496765 - RNA, 14 nt, Chlamydophila pneumoniae CWL029
ugcuaggaagauga

SEQ ID NO: 496766 - RNA, 14 nt, Chlamydophila pneumoniae CWL029
ugcuauuuacugaa

SEQ ID NO: 496767 - RNA, 18 nt, Chlamydophila pneumoniae CWL029
ugcgucuuuaauuaaaag

SEQ ID NO: 496768 - RNA, 12 nt, Chlamydophila pneumoniae CWL029
ugcguuuccaug

SEQ ID NO: 496769 - RNA, 18 nt, Chlamydophila pneumoniae CWL029
ugcguuugagcuaagucu

SEQ ID NO: 496770 - RNA, 15 nt, Chlamydophila pneumoniae CWL029
ugcggcuaauuucaa

SEQ ID NO: 496771 - RNA, 15 nt, Chlamydophila pneumoniae CWL029
ugcggccacauuaag

SEQ ID NO: 496772 - RNA, 18 nt, Chlamydophila pneumoniae CWL029
uggacaacgcuucuuuuu

SEQ ID NO: 496773 - RNA, 23 nt, Chlamydophila pneumoniae CWL029
uggacagcggccacaugaagucc

SEQ ID NO: 496774 - RNA, 22 nt, Chlamydophila pneumoniae CWL029
uggaccagaugcuaaagagucu

SEQ ID NO: 496775 - RNA, 16 nt, Chlamydophila pneumoniae CWL029
uggaaguaaucuggaa

SEQ ID NO: 496776 - RNA, 19 nt, Chlamydophila pneumoniae CWL029
uggaaguaaucuggaagca

SEQ ID NO: 496777 - RNA, 20 nt, Chlamydophila pneumoniae CWL029
uggaauaucaggacaaugaa

SEQ ID NO: 496778 - RNA, 18 nt, Chlamydophila pneumoniae CWL029
uggaaucagggacucuuu

SEQ ID NO: 496779 - RNA, 23 nt, Chlamydophila pneumoniae CWL029
uggaauggcuuuuguuuuguauu

SEQ ID NO: 496780 - RNA, 22 nt, Chlamydophila pneumoniae CWL029
uggaauucaaacuccuuuuaaa

SEQ ID NO: 496781 - RNA, 19 nt, Chlamydophila pneumoniae CWL029
uggaauucaaacuccuuuu

SEQ ID NO: 496782 - RNA, 14 nt, Chlamydophila pneumoniae CWL029
uggaaugacuaaau

SEQ ID NO: 496783 - RNA, 18 nt, Chlamydophila pneumoniae CWL029
uggaaugacuaaaugcga

SEQ ID NO: 496784 - RNA, 13 nt, Chlamydophila pneumoniae CWL029
uggaaugccaaau

SEQ ID NO: 496785 - RNA, 19 nt, Chlamydophila pneumoniae CWL029
uggaaugccaaauccuccg

SEQ ID NO: 496786 - RNA, 18 nt, Chlamydophila pneumoniae CWL029
uggaagauaaacauacau

SEQ ID NO: 496787 - RNA, 16 nt, Chlamydophila pneumoniae CWL029
uggaagauugaaggca

SEQ ID NO: 496788 - RNA, 21 nt, Chlamydophila pneumoniae CWL029
uggaagcuuuuacgagcuuuu

SEQ ID NO: 496789 - RNA, 19 nt, Chlamydophila pneumoniae CWL029
uggaacgcauaagagacau

SEQ ID NO: 496790 - RNA, 22 nt, Chlamydophila pneumoniae CWL029
uggaacaguauaaucagaagug

SEQ ID NO: 496791 - RNA, 16 nt, Chlamydophila pneumoniae CWL029
uggaaauugugaaaaa

SEQ ID NO: 496792 - RNA, 20 nt, Chlamydophila pneumoniae CWL029
uggaaauagagaaacuuuug

SEQ ID NO: 496793 - RNA, 23 nt, Chlamydophila pneumoniae CWL029
uggaaaucaccagcauuaagaua

SEQ ID NO: 496794 - RNA, 14 nt, Chlamydophila pneumoniae CWL029
uggaaacuuuucca

SEQ ID NO: 496795 - RNA, 18 nt, Chlamydophila pneumoniae CWL029
uggaaacuuuuccaaauu

SEQ ID NO: 496796 - RNA, 18 nt, Chlamydophila pneumoniae CWL029
uggaaagagucccugauu

SEQ ID NO: 496797 - RNA, 21 nt, Chlamydophila pneumoniae CWL029
uggaaaagccucgaaauuuuc

SEQ ID NO: 496798 - RNA, 23 nt, Chlamydophila pneumoniae CWL029
ugcuuuuagaucccgaagcaauc

SEQ ID NO: 496799 - RNA, 13 nt, Chlamydophila pneumoniae CWL029
ugcuuuucauuuu

SEQ ID NO: 496800 - RNA, 13 nt, Chlamydophila pneumoniae CWL029
ugcuuuuccuucu

SEQ ID NO: 496801 - RNA, 15 nt, Chlamydophila pneumoniae CWL029
ugcuuuucucuucaa

SEQ ID NO: 496802 - RNA, 19 nt, Chlamydophila pneumoniae CWL029
ugcuuuuguuguuuuugcu

SEQ ID NO: 496803 - RNA, 23 nt, Chlamydophila pneumoniae CWL029
ugcuuucuagcugcucuuuuaga

SEQ ID NO: 496804 - RNA, 19 nt, Chlamydophila pneumoniae CWL029
ugcuuugugaguucuuccu

SEQ ID NO: 496805 - RNA, 22 nt, Chlamydophila pneumoniae CWL029
ugcuuugugaguucuuccuucu

SEQ ID NO: 496806 - RNA, 19 nt, Chlamydophila pneumoniae CWL029
ugcuuugccgccucagcac

SEQ ID NO: 496807 - RNA, 14 nt, Chlamydophila pneumoniae CWL029
ugcuuuaacagaag

SEQ ID NO: 496808 - RNA, 14 nt, Chlamydophila pneumoniae CWL029
ugcuuguugguuaa

SEQ ID NO: 496809 - RNA, 15 nt, Chlamydophila pneumoniae CWL029
ugcuugucuacagag

SEQ ID NO: 496810 - RNA, 22 nt, Chlamydophila pneumoniae CWL029
ugcuuguauaaaugcuguagau

SEQ ID NO: 496811 - RNA, 15 nt, Chlamydophila pneumoniae CWL029
ugcuuagcaaaggca

SEQ ID NO: 496812 - RNA, 18 nt, Chlamydophila pneumoniae CWL029
ugcuuagcgaucucucuu

SEQ ID NO: 496813 - RNA, 19 nt, Chlamydophila pneumoniae CWL029
ugcuuaagaguuuuacauc

SEQ ID NO: 496814 - RNA, 12 nt, Chlamydophila pneumoniae CWL029
ugcuuauuuccc

SEQ ID NO: 496815 - RNA, 22 nt, Chlamydophila pneumoniae CWL029
ugcuuauuuccccgaacaaauu

SEQ ID NO: 496816 - RNA, 18 nt, Chlamydophila pneumoniae CWL029
ugcuucgggaucuaaaag

SEQ ID NO: 496817 - RNA, 18 nt, Chlamydophila pneumoniae CWL029
ugcuucuaagaaacuucc

SEQ ID NO: 496818 - RNA, 18 nt, Chlamydophila pneumoniae CWL029
ugcuucuguaaagauucu

SEQ ID NO: 496819 - RNA, 11 nt, Chlamydophila pneumoniae CWL029
ugcuucuucag

SEQ ID NO: 496820 - RNA, 12 nt, Chlamydophila pneumoniae CWL029
ugcuucuccaaa

SEQ ID NO: 496821 - RNA, 17 nt, Chlamydophila pneumoniae CWL029
ugcuucuauuuuagaau

SEQ ID NO: 496822 - RNA, 21 nt, Chlamydophila pneumoniae CWL029
ugcuugaccucaucagaagug

SEQ ID NO: 496823 - RNA, 16 nt, Chlamydophila pneumoniae CWL029
ugcuuaaaauucugua

SEQ ID NO: 496824 - RNA, 13 nt, Chlamydophila pneumoniae CWL029
ugcuguuucuucu

SEQ ID NO: 496825 - RNA, 16 nt, Chlamydophila pneumoniae CWL029
ugcuguuucuauuagc

SEQ ID NO: 496826 - RNA, 17 nt, Chlamydophila pneumoniae CWL029
ugcuguuguaauaaaag

SEQ ID NO: 496827 - RNA, 14 nt, Chlamydophila pneumoniae CWL029
ugcugucagaacaa

SEQ ID NO: 496828 - RNA, 12 nt, Chlamydophila pneumoniae CWL029
ugcugucagaac

SEQ ID NO: 496829 - RNA, 18 nt, Chlamydophila pneumoniae CWL029
ugcugggggagcuagaaa

SEQ ID NO: 496830 - RNA, 13 nt, Chlamydophila pneumoniae CWL029
ugcugcucuccaa

SEQ ID NO: 496831 - RNA, 21 nt, Chlamydophila pneumoniae CWL029
ugcugcuuccccuaauagggg

SEQ ID NO: 496832 - RNA, 16 nt, Chlamydophila pneumoniae CWL029
ugcuggaguagcucaa

SEQ ID NO: 496833 - RNA, 17 nt, Chlamydophila pneumoniae CWL029
aaauguauaggcauuaa

SEQ ID NO: 496834 - RNA, 13 nt, Chlamydophila pneumoniae CWL029
aaauguaaaaaau

SEQ ID NO: 496835 - RNA, 15 nt, Chlamydophila pneumoniae CWL029
aaauguaagaaggca

SEQ ID NO: 496836 - RNA, 21 nt, Chlamydophila pneumoniae CWL029
ugcugagggaucuucucuaug

SEQ ID NO: 496837 - RNA, 22 nt, Chlamydophila pneumoniae CWL029
ugcugaauauaguuuaaauguc

SEQ ID NO: 496838 - RNA, 14 nt, Chlamydophila pneumoniae CWL029
ugcugaagggacag

SEQ ID NO: 496839 - RNA, 17 nt, Chlamydophila pneumoniae CWL029
ugcugaagauuuuuucu

SEQ ID NO: 496840 - RNA, 21 nt, Chlamydophila pneumoniae CWL029
ugcugaagauuuuuucuuggu

SEQ ID NO: 496841 - RNA, 15 nt, Chlamydophila pneumoniae CWL029
ugcugauuucuuuuu

SEQ ID NO: 496842 - RNA, 10 nt, Chlamydophila pneumoniae CWL029
ugcugcccaa

SEQ ID NO: 496843 - RNA, 20 nt, Chlamydophila pneumoniae CWL029
ugcugccaugacauaggcaa

SEQ ID NO: 496844 - RNA, 16 nt, Chlamydophila pneumoniae CWL029
ugcucucuucuucuca

SEQ ID NO: 496845 - RNA, 17 nt, Chlamydophila pneumoniae CWL029
ugcucuaaguugauacu

SEQ ID NO: 496846 - RNA, 16 nt, Chlamydophila pneumoniae CWL029
ugcucgugcgacugcu

SEQ ID NO: 496847 - RNA, 14 nt, Chlamydophila pneumoniae CWL029
ugcucuuucauuuc

SEQ ID NO: 496848 - RNA, 14 nt, Chlamydophila pneumoniae CWL029
ugcucugacaagug

SEQ ID NO: 496849 - RNA, 15 nt, Chlamydophila pneumoniae CWL029
ugcucugacaagugu

SEQ ID NO: 496850 - RNA, 15 nt, Chlamydophila pneumoniae CWL029
ugcucucuaaagcuu

SEQ ID NO: 496851 - RNA, 16 nt, Chlamydophila pneumoniae CWL029
ugcucuguauuggaaa

SEQ ID NO: 496852 - RNA, 23 nt, Chlamydophila pneumoniae CWL029
ugcucguauuagaguuucuuuug

SEQ ID NO: 496853 - RNA, 16 nt, Chlamydophila pneumoniae CWL029
ugucugaguuagcuuu

SEQ ID NO: 496854 - RNA, 17 nt, Chlamydophila pneumoniae CWL029
ugucugcaaagagcaaa

SEQ ID NO: 496855 - RNA, 23 nt, Chlamydophila pneumoniae CWL029
ugucuugcuuugugaguucuucc

SEQ ID NO: 496856 - RNA, 12 nt, Chlamydophila pneumoniae CWL029
ugucuuuccagg

SEQ ID NO: 496857 - RNA, 21 nt, Chlamydophila pneumoniae CWL029
ugugcacccaaucgguaugau

SEQ ID NO: 496858 - RNA, 22 nt, Chlamydophila pneumoniae CWL029
ugugcacccaaucgguaugaua

SEQ ID NO: 496859 - RNA, 14 nt, Chlamydophila pneumoniae CWL029
ugucuccaaagaua

SEQ ID NO: 496860 - RNA, 15 nt, Chlamydophila pneumoniae CWL029
ugucuccauacagcg

SEQ ID NO: 496861 - RNA, 13 nt, Chlamydophila pneumoniae CWL029
ugucguuaaaaac

SEQ ID NO: 496862 - RNA, 17 nt, Chlamydophila pneumoniae CWL029
ugucgcuuucauuugua

SEQ ID NO: 496863 - RNA, 13 nt, Chlamydophila pneumoniae CWL029
uguccuugcagcc

SEQ ID NO: 496864 - RNA, 14 nt, Chlamydophila pneumoniae CWL029
uguagcagagccuc

SEQ ID NO: 496865 - RNA, 19 nt, Chlamydophila pneumoniae CWL029
uguagcauuucuuucucuu

SEQ ID NO: 496866 - RNA, 18 nt, Chlamydophila pneumoniae CWL029
uguauucagugucuugaa

SEQ ID NO: 496867 - RNA, 13 nt, Chlamydophila pneumoniae CWL029
uguauuuccuucu

SEQ ID NO: 496868 - RNA, 15 nt, Chlamydophila pneumoniae CWL029
uguauuguacuuuuu

SEQ ID NO: 496869 - RNA, 18 nt, Chlamydophila pneumoniae CWL029
uguauuguguucccucuu

SEQ ID NO: 496870 - RNA, 16 nt, Chlamydophila pneumoniae CWL029
uguauucugaagcugc

SEQ ID NO: 496871 - RNA, 18 nt, Chlamydophila pneumoniae CWL029
ugucacaauaccaucucu

SEQ ID NO: 496872 - RNA, 19 nt, Chlamydophila pneumoniae CWL029
ugucacacugcgagagaaa

SEQ ID NO: 496873 - RNA, 13 nt, Chlamydophila pneumoniae CWL029
uguccguauuuuu

SEQ ID NO: 496874 - RNA, 17 nt, Chlamydophila pneumoniae CWL029
uguccgugagcaacaag

SEQ ID NO: 496875 - RNA, 13 nt, Chlamydophila pneumoniae CWL029
ugguuccuggauu

SEQ ID NO: 496876 - RNA, 23 nt, Chlamydophila pneumoniae CWL029
uguaaagugaaauugaacucuca

SEQ ID NO: 496877 - RNA, 16 nt, Chlamydophila pneumoniae CWL029
uguaaauacaaaacaa

SEQ ID NO: 496878 - RNA, 20 nt, Chlamydophila pneumoniae CWL029
uguaaauaguauacaagcga

SEQ ID NO: 496879 - RNA, 15 nt, Chlamydophila pneumoniae CWL029
ugguuuucuccuucu

SEQ ID NO: 496880 - RNA, 21 nt, Chlamydophila pneumoniae CWL029
uguacuagauaguucacaagu

SEQ ID NO: 496881 - RNA, 22 nt, Chlamydophila pneumoniae CWL029
uguaauuuccuuagaagggaaa

SEQ ID NO: 496882 - RNA, 13 nt, Chlamydophila pneumoniae CWL029
uguaauaaaagaa

SEQ ID NO: 496883 - RNA, 16 nt, Chlamydophila pneumoniae CWL029
uguaagcgugcaaguu

SEQ ID NO: 496884 - RNA, 17 nt, Chlamydophila pneumoniae CWL029
uguaaaugucgguuugu

SEQ ID NO: 496885 - RNA, 17 nt, Chlamydophila pneumoniae CWL029
uguaagacuaaaaaaga

SEQ ID NO: 496886 - RNA, 18 nt, Chlamydophila pneumoniae CWL029
ugguuaggguaaggcuua

SEQ ID NO: 496887 - RNA, 22 nt, Chlamydophila pneumoniae CWL029
ugguguucuucagcccacuguu

SEQ ID NO: 496888 - RNA, 23 nt, Chlamydophila pneumoniae CWL029
ugguuaaaacccauguuucuucc

SEQ ID NO: 496889 - RNA, 13 nt, Chlamydophila pneumoniae CWL029
ugguuaaaauaga

SEQ ID NO: 496890 - RNA, 19 nt, Chlamydophila pneumoniae CWL029
uggucucuauuuagaccaa

SEQ ID NO: 496891 - RNA, 17 nt, Chlamydophila pneumoniae CWL029
uggugacucuagccacc

SEQ ID NO: 496892 - RNA, 21 nt, Chlamydophila pneumoniae CWL029
uggugacucuagccaccaaca

SEQ ID NO: 496893 - RNA, 16 nt, Chlamydophila pneumoniae CWL029
uggucuagagauuuuu

SEQ ID NO: 496894 - RNA, 19 nt, Chlamydophila pneumoniae CWL029
uggucuagagauuuuucua

SEQ ID NO: 496895 - RNA, 15 nt, Chlamydophila pneumoniae CWL029
uggugagaucaucuc

SEQ ID NO: 496896 - RNA, 15 nt, Chlamydophila pneumoniae CWL029
uggggaaauuaaauu

SEQ ID NO: 496897 - RNA, 16 nt, Chlamydophila pneumoniae CWL029
uggcugucuugaccaa

SEQ ID NO: 496898 - RNA, 21 nt, Chlamydophila pneumoniae CWL029
ugggaagccuggaaaugaaua

SEQ ID NO: 496899 - RNA, 12 nt, Chlamydophila pneumoniae CWL029
ugggaagacucu

SEQ ID NO: 496900 - RNA, 19 nt, Chlamydophila pneumoniae CWL029
ugggaagacucucaucagc

SEQ ID NO: 496901 - RNA, 18 nt, Chlamydophila pneumoniae CWL029
ugggaaggucuuuucgca

SEQ ID NO: 496902 - RNA, 22 nt, Chlamydophila pneumoniae CWL029
ugggaaugcgcaggcaauuuuu

SEQ ID NO: 496903 - RNA, 22 nt, Chlamydophila pneumoniae CWL029
ugggaauucuuuuccugcagca

SEQ ID NO: 496904 - RNA, 22 nt, Chlamydophila pneumoniae CWL029
ugggaauuugauuuuucaaauu

SEQ ID NO: 496905 - RNA, 15 nt, Chlamydophila pneumoniae CWL029
uggcugagagaagca

SEQ ID NO: 496906 - RNA, 16 nt, Chlamydophila pneumoniae CWL029
uggcugagagauaggg

SEQ ID NO: 496907 - RNA, 17 nt, Chlamydophila pneumoniae CWL029
uggcucuagaaauauac

SEQ ID NO: 496908 - RNA, 16 nt, Chlamydophila pneumoniae CWL029
uggcuccuaaacucaa

SEQ ID NO: 496909 - RNA, 13 nt, Chlamydophila pneumoniae CWL029
uggcguaauaauu

SEQ ID NO: 496910 - RNA, 20 nt, Chlamydophila pneumoniae CWL029
uggcuauagauacuuugcaa

SEQ ID NO: 496911 - RNA, 17 nt, Chlamydophila pneumoniae CWL029
uggcauucuuuuucuau

SEQ ID NO: 496912 - RNA, 18 nt, Chlamydophila pneumoniae CWL029
uggcauucuuuuucuauu

SEQ ID NO: 496913 - RNA, 18 nt, Chlamydophila pneumoniae CWL029
uggcauugccauaauaaa

SEQ ID NO: 496914 - RNA, 14 nt, Chlamydophila pneumoniae CWL029
uggcaucuaagcca

SEQ ID NO: 496915 - RNA, 14 nt, Chlamydophila pneumoniae CWL029
uggcauagagccua

SEQ ID NO: 496916 - RNA, 14 nt, Chlamydophila pneumoniae CWL029
uggcauagcgagaa

SEQ ID NO: 496917 - RNA, 13 nt, Chlamydophila pneumoniae CWL029
uggcaaggaaaau

SEQ ID NO: 496918 - RNA, 17 nt, Chlamydophila pneumoniae CWL029
uggauguagaggaucua

SEQ ID NO: 496919 - RNA, 17 nt, Chlamydophila pneumoniae CWL029
uggauaccggcaaauaa

SEQ ID NO: 496920 - RNA, 18 nt, Chlamydophila pneumoniae CWL029
uggauacguuuuucccuu

SEQ ID NO: 496921 - RNA, 16 nt, Chlamydophila pneumoniae CWL029
uggauagaagcaugaa

SEQ ID NO: 496922 - RNA, 21 nt, Chlamydophila pneumoniae CWL029
uggauaacacgaguuucgaua

SEQ ID NO: 496923 - RNA, 16 nt, Chlamydophila pneumoniae CWL029
uggagugacaccaaca

SEQ ID NO: 496924 - RNA, 14 nt, Chlamydophila pneumoniae CWL029
uggaucaaggagua

SEQ ID NO: 496925 - RNA, 21 nt, Chlamydophila pneumoniae CWL029
uggauccaucggcauuucucc

SEQ ID NO: 496926 - RNA, 22 nt, Chlamydophila pneumoniae CWL029
uggauccaucggcauuucucca

SEQ ID NO: 496927 - RNA, 15 nt, Chlamydophila pneumoniae CWL029
uggauccuucaucag

SEQ ID NO: 496928 - RNA, 16 nt, Chlamydophila pneumoniae CWL029
uggaugcuaauaaaau

SEQ ID NO: 496929 - RNA, 17 nt, Chlamydophila pneumoniae CWL029
uggagagggaaggaaua

SEQ ID NO: 496930 - RNA, 16 nt, Chlamydophila pneumoniae CWL029
uggagcagaaacucca

SEQ ID NO: 496931 - RNA, 17 nt, Chlamydophila pneumoniae CWL029
uggagcaucauuccagc

SEQ ID NO: 496932 - RNA, 15 nt, Chlamydophila pneumoniae CWL029
uggaggccaaagaac

SEQ ID NO: 496933 - RNA, 15 nt, Chlamydophila pneumoniae CWL029
uggaggauaaaugag

SEQ ID NO: 496934 - RNA, 19 nt, Chlamydophila pneumoniae CWL029
uggaggccaaagaacagca

SEQ ID NO: 496935 - RNA, 17 nt, Chlamydophila pneumoniae CWL029
uggacuacugaaacacu

SEQ ID NO: 496936 - RNA, 18 nt, Chlamydophila pneumoniae CWL029
uggacgugguaagguuau

SEQ ID NO: 496937 - RNA, 17 nt, Chlamydophila pneumoniae CWL029
uggacguacuaagauac

SEQ ID NO: 496938 - RNA, 20 nt, Chlamydophila pneumoniae CWL029
uggagaauaaucucuuucau

SEQ ID NO: 496939 - RNA, 21 nt, Chlamydophila pneumoniae CWL029
uggacuucugguuuuucgauu

SEQ ID NO: 496940 - RNA, 14 nt, Chlamydophila pneumoniae CWL029
uggacuccaagaau

SEQ ID NO: 496941 - RNA, 18 nt, Chlamydophila pneumoniae CWL029
uucguaagagaauuauua

SEQ ID NO: 496942 - RNA, 20 nt, Chlamydophila pneumoniae CWL029
uucguaacgcuuuucuaaua

SEQ ID NO: 496943 - RNA, 12 nt, Chlamydophila pneumoniae CWL029
uucuaagauucc

SEQ ID NO: 496944 - RNA, 17 nt, Chlamydophila pneumoniae CWL029
uucuaaauagaaaacau

SEQ ID NO: 496945 - RNA, 21 nt, Chlamydophila pneumoniae CWL029
uucuaaaucccgccuuucuac

SEQ ID NO: 496946 - RNA, 22 nt, Chlamydophila pneumoniae CWL029
uucgugugcacccaaucgguau

SEQ ID NO: 496947 - RNA, 17 nt, Chlamydophila pneumoniae CWL029
uucguauagcuggcaau

SEQ ID NO: 496948 - RNA, 18 nt, Chlamydophila pneumoniae CWL029
uucguggaacuuucuggg

SEQ ID NO: 496949 - RNA, 19 nt, Chlamydophila pneumoniae CWL029
uucgccuuggguuugucuc

SEQ ID NO: 496950 - RNA, 17 nt, Chlamydophila pneumoniae CWL029
uucgcuacauaaaauga

SEQ ID NO: 496951 - RNA, 20 nt, Chlamydophila pneumoniae CWL029
uucgcacgcaacaucucaca

SEQ ID NO: 496952 - RNA, 20 nt, Chlamydophila pneumoniae CWL029
uucgcacuaauuuccuucag

SEQ ID NO: 496953 - RNA, 22 nt, Chlamydophila pneumoniae CWL029
uuccuuggcguacucuauuaag

SEQ ID NO: 496954 - RNA, 17 nt, Chlamydophila pneumoniae CWL029
uuccuuggauuucuucu

SEQ ID NO: 496955 - RNA, 22 nt, Chlamydophila pneumoniae CWL029
uuccuuggauuucuucuucuaa

SEQ ID NO: 496956 - RNA, 22 nt, Chlamydophila pneumoniae CWL029
uuccuuuuucugcuucuccaaa

SEQ ID NO: 496957 - RNA, 14 nt, Chlamydophila pneumoniae CWL029
uuccuuuugauaaa

SEQ ID NO: 496958 - RNA, 17 nt, Chlamydophila pneumoniae CWL029
uuccuuuuucugcuucu

SEQ ID NO: 496959 - RNA, 22 nt, Chlamydophila pneumoniae CWL029
uucucuguaucgauaacgauuu

SEQ ID NO: 496960 - RNA, 18 nt, Chlamydophila pneumoniae CWL029
uucucuguugggagcuuc

SEQ ID NO: 496961 - RNA, 18 nt, Chlamydophila pneumoniae CWL029
uucucugauucucauaaa

SEQ ID NO: 496962 - RNA, 21 nt, Chlamydophila pneumoniae CWL029
uucucugagcagcuucgcaau

SEQ ID NO: 496963 - RNA, 20 nt, Chlamydophila pneumoniae CWL029
uucugcaaucagugcugcca

SEQ ID NO: 496964 - RNA, 15 nt, Chlamydophila pneumoniae CWL029
uucugcaaucugaau

SEQ ID NO: 496965 - RNA, 21 nt, Chlamydophila pneumoniae CWL029
uucugcaggauuuguagcucc

SEQ ID NO: 496966 - RNA, 19 nt, Chlamydophila pneumoniae CWL029
uucugauccgaaaagaacc

SEQ ID NO: 496967 - RNA, 22 nt, Chlamydophila pneumoniae CWL029
uucugaugacguuaauaaagag

SEQ ID NO: 496968 - RNA, 15 nt, Chlamydophila pneumoniae CWL029
uucugauugagaaua

SEQ ID NO: 496969 - RNA, 19 nt, Chlamydophila pneumoniae CWL029
uucucuaggaacucuuuaa

SEQ ID NO: 496970 - RNA, 13 nt, Chlamydophila pneumoniae CWL029
uucucgguuuaag

SEQ ID NO: 496971 - RNA, 14 nt, Chlamydophila pneumoniae CWL029
uucucauagcuucc

SEQ ID NO: 496972 - RNA, 17 nt, Chlamydophila pneumoniae CWL029
uucucauagcuuccugu

SEQ ID NO: 496973 - RNA, 19 nt, Chlamydophila pneumoniae CWL029
uucucauagcuuccuguag

SEQ ID NO: 496974 - RNA, 22 nt, Chlamydophila pneumoniae CWL029
uucucgaacaggagagagaagg

SEQ ID NO: 496975 - RNA, 21 nt, Chlamydophila pneumoniae CWL029
uucucauccagacaagacacu

SEQ ID NO: 496976 - RNA, 15 nt, Chlamydophila pneumoniae CWL029
uucuacaaacaggua

SEQ ID NO: 496977 - RNA, 20 nt, Chlamydophila pneumoniae CWL029
uucuacauuugcuauuuucc

SEQ ID NO: 496978 - RNA, 21 nt, Chlamydophila pneumoniae CWL029
uucuacauuugcuauuuuccc

SEQ ID NO: 496979 - RNA, 18 nt, Chlamydophila pneumoniae CWL029
uucuacauagauccccuu

SEQ ID NO: 496980 - RNA, 13 nt, Chlamydophila pneumoniae CWL029
uucuaccaauucu

SEQ ID NO: 496981 - RNA, 24 nt, Chlamydophila pneumoniae CWL029
uucuaagcuuauuucuguaguucu

SEQ ID NO: 496982 - RNA, 16 nt, Chlamydophila pneumoniae CWL029
uucuagcuaauaauga

SEQ ID NO: 496983 - RNA, 21 nt, Chlamydophila pneumoniae CWL029
uucuagcucauuaucaagaaa

SEQ ID NO: 496984 - RNA, 20 nt, Chlamydophila pneumoniae CWL029
uucuagggaucccaaaaaau

SEQ ID NO: 496985 - RNA, 15 nt, Chlamydophila pneumoniae CWL029
uucuagguauuuguu

SEQ ID NO: 496986 - RNA, 16 nt, Chlamydophila pneumoniae CWL029
uucuagguauuuguuu

SEQ ID NO: 496987 - RNA, 19 nt, Chlamydophila pneumoniae CWL029
uucuaccuguagcuacaga

SEQ ID NO: 496988 - RNA, 20 nt, Chlamydophila pneumoniae CWL029
uucuaugccauaaauacagg

SEQ ID NO: 496989 - RNA, 21 nt, Chlamydophila pneumoniae CWL029
uucuauacgcuuaacaugaaa

SEQ ID NO: 496990 - RNA, 12 nt, Chlamydophila pneumoniae CWL029
uucuauuaaaaa

SEQ ID NO: 496991 - RNA, 15 nt, Chlamydophila pneumoniae CWL029
uucuauuaaaaauag

SEQ ID NO: 496992 - RNA, 13 nt, Chlamydophila pneumoniae CWL029
uucuauuucauau

SEQ ID NO: 496993 - RNA, 20 nt, Chlamydophila pneumoniae CWL029
uucuauuucgucgucauccc

SEQ ID NO: 496994 - RNA, 14 nt, Chlamydophila pneumoniae CWL029
uucuauuucugcug

SEQ ID NO: 496995 - RNA, 23 nt, Chlamydophila pneumoniae CWL029
uuccuguuguacuaucacagcca

SEQ ID NO: 496996 - RNA, 15 nt, Chlamydophila pneumoniae CWL029
uuccuuaaagaguuu

SEQ ID NO: 496997 - RNA, 23 nt, Chlamydophila pneumoniae CWL029
uuccuuaagggaagaucugaaau

SEQ ID NO: 496998 - RNA, 15 nt, Chlamydophila pneumoniae CWL029
uuccuuaagucgucc

SEQ ID NO: 496999 - RNA, 18 nt, Chlamydophila pneumoniae CWL029
uuccuccuuucgucccuc

SEQ ID NO: 497000 - RNA, 17 nt, Chlamydophila pneumoniae CWL029
uuccucucaugaaauuu

SEQ ID NO: 497001 - RNA, 13 nt, Chlamydophila pneumoniae CWL029
uuccucuccaaaa

SEQ ID NO: 497002 - RNA, 17 nt, Chlamydophila pneumoniae CWL029
uuccucgagcuaccaga

SEQ ID NO: 497003 - RNA, 22 nt, Chlamydophila pneumoniae CWL029
uuccucgaguauggcaaauaaa

SEQ ID NO: 497004 - RNA, 20 nt, Chlamydophila pneumoniae CWL029
uuccuacaucugugauuaau

SEQ ID NO: 497005 - RNA, 21 nt, Chlamydophila pneumoniae CWL029
uuccuacaucugugauuaauc

SEQ ID NO: 497006 - RNA, 12 nt, Chlamydophila pneumoniae CWL029
uuccuaccuaua

SEQ ID NO: 497007 - RNA, 18 nt, Chlamydophila pneumoniae CWL029
uuccuacgacaugccuaa

SEQ ID NO: 497008 - RNA, 15 nt, Chlamydophila pneumoniae CWL029
uuccgcggccaucau

SEQ ID NO: 497009 - RNA, 21 nt, Chlamydophila pneumoniae CWL029
uuccuauaugaaugauuucca

SEQ ID NO: 497010 - RNA, 16 nt, Chlamydophila pneumoniae CWL029
uuccuacuucugcagg

SEQ ID NO: 497011 - RNA, 12 nt, Chlamydophila pneumoniae CWL029
uuccuagagucg

SEQ ID NO: 497012 - RNA, 22 nt, Chlamydophila pneumoniae CWL029
uuccuauaugaaugauuuccau

SEQ ID NO: 497013 - RNA, 21 nt, Chlamydophila pneumoniae CWL029
uuccuccgaggagggaaacac

SEQ ID NO: 497014 - RNA, 18 nt, Chlamydophila pneumoniae CWL029
uucccaucuuguucuaaa

SEQ ID NO: 497015 - RNA, 17 nt, Chlamydophila pneumoniae CWL029
uucccacuaagaaugag

SEQ ID NO: 497016 - RNA, 23 nt, Chlamydophila pneumoniae CWL029
uucccaagcugaaagaaugccau

SEQ ID NO: 497017 - RNA, 16 nt, Chlamydophila pneumoniae CWL029
uuccauuuuuccuccu

SEQ ID NO: 497018 - RNA, 18 nt, Chlamydophila pneumoniae CWL029
uucccgacucaaucaaau

SEQ ID NO: 497019 - RNA, 15 nt, Chlamydophila pneumoniae CWL029
uuccccuuuaaagcc

SEQ ID NO: 497020 - RNA, 23 nt, Chlamydophila pneumoniae CWL029
uucccuuuaaaaguacgaccaac

SEQ ID NO: 497021 - RNA, 20 nt, Chlamydophila pneumoniae CWL029
uuccgacccagucaaaauau

SEQ ID NO: 497022 - RNA, 21 nt, Chlamydophila pneumoniae CWL029
uuccgauuaguaaugauguag

SEQ ID NO: 497023 - RNA, 13 nt, Chlamydophila pneumoniae CWL029
uuccauguagaag

SEQ ID NO: 497024 - RNA, 23 nt, Chlamydophila pneumoniae CWL029
uuccauggcuauuuuuaaaauga

SEQ ID NO: 497025 - RNA, 17 nt, Chlamydophila pneumoniae CWL029
uuccauuauacuuuuuu

SEQ ID NO: 497026 - RNA, 19 nt, Chlamydophila pneumoniae CWL029
uuccauggauauggaaugg

SEQ ID NO: 497027 - RNA, 21 nt, Chlamydophila pneumoniae CWL029
uuccauuagggcauucuguaa

SEQ ID NO: 497028 - RNA, 22 nt, Chlamydophila pneumoniae CWL029
uuccauagaguaucuaaaacuu

SEQ ID NO: 497029 - RNA, 20 nt, Chlamydophila pneumoniae CWL029
uuccauagccaaggagcuau

SEQ ID NO: 497030 - RNA, 19 nt, Chlamydophila pneumoniae CWL029
uuccauagguuagaaauga

SEQ ID NO: 497031 - RNA, 21 nt, Chlamydophila pneumoniae CWL029
uuccauagguuagaaaugaaa

SEQ ID NO: 497032 - RNA, 13 nt, Chlamydophila pneumoniae CWL029
uuccagaaaucug

SEQ ID NO: 497033 - RNA, 18 nt, Chlamydophila pneumoniae CWL029
uuccacagagaccuucuc

SEQ ID NO: 497034 - RNA, 19 nt, Chlamydophila pneumoniae CWL029
uuccaaugcaugaaucucu

SEQ ID NO: 497035 - RNA, 23 nt, Chlamydophila pneumoniae CWL029
uugcucuaccaacugagcuauuu

SEQ ID NO: 497036 - RNA, 20 nt, Chlamydophila pneumoniae CWL029
uugcucuggauguagaggau

SEQ ID NO: 497037 - RNA, 15 nt, Chlamydophila pneumoniae CWL029
uugcugaaaaugauu

SEQ ID NO: 497038 - RNA, 12 nt, Chlamydophila pneumoniae CWL029
uugcugaagauu

SEQ ID NO: 497039 - RNA, 15 nt, Chlamydophila pneumoniae CWL029
uugcugaagauuuuu

SEQ ID NO: 497040 - RNA, 20 nt, Chlamydophila pneumoniae CWL029
uugcugaagauuuuuucuug

SEQ ID NO: 497041 - RNA, 23 nt, Chlamydophila pneumoniae CWL029
uugcuccuccaaaagaccaaaaa

SEQ ID NO: 497042 - RNA, 14 nt, Chlamydophila pneumoniae CWL029
uugccuucuuaucu

SEQ ID NO: 497043 - RNA, 12 nt, Chlamydophila pneumoniae CWL029
uugccuucuucu

SEQ ID NO: 497044 - RNA, 19 nt, Chlamydophila pneumoniae CWL029
uugccuggggaucuuagga

SEQ ID NO: 497045 - RNA, 22 nt, Chlamydophila pneumoniae CWL029
uugccaaucuuccuuaaccucc

SEQ ID NO: 497046 - RNA, 22 nt, Chlamydophila pneumoniae CWL029
uugccaauguggugauuucuuu

SEQ ID NO: 497047 - RNA, 19 nt, Chlamydophila pneumoniae CWL029
uugcccauugaccugcuuu

SEQ ID NO: 497048 - RNA, 18 nt, Chlamydophila pneumoniae CWL029
uugcaccccaugcaagug

SEQ ID NO: 497049 - RNA, 15 nt, Chlamydophila pneumoniae CWL029
uugcaauuuucuaaa

SEQ ID NO: 497050 - RNA, 21 nt, Chlamydophila pneumoniae CWL029
uugcaauucuucaugcugcuu

SEQ ID NO: 497051 - RNA, 14 nt, Chlamydophila pneumoniae CWL029
uugcaauugccaua

SEQ ID NO: 497052 - RNA, 21 nt, Chlamydophila pneumoniae CWL029
uugcaauaccaauugggcuag

SEQ ID NO: 497053 - RNA, 18 nt, Chlamydophila pneumoniae CWL029
uugcaacaaucuuucuuc

SEQ ID NO: 497054 - RNA, 22 nt, Chlamydophila pneumoniae CWL029
uugcaacaaaaggcccaacucu

SEQ ID NO: 497055 - RNA, 21 nt, Chlamydophila pneumoniae CWL029
uugcaagagccggaacuucag

SEQ ID NO: 497056 - RNA, 15 nt, Chlamydophila pneumoniae CWL029
uugauugaaacuuuu

SEQ ID NO: 497057 - RNA, 16 nt, Chlamydophila pneumoniae CWL029
uugauugaacagucuu

SEQ ID NO: 497058 - RNA, 21 nt, Chlamydophila pneumoniae CWL029
uugauuggaucuugauaaaag

SEQ ID NO: 497059 - RNA, 21 nt, Chlamydophila pneumoniae CWL029
uugauuuugcagugauaaacc

SEQ ID NO: 497060 - RNA, 12 nt, Chlamydophila pneumoniae CWL029
uugauucauaaa

SEQ ID NO: 497061 - RNA, 14 nt, Chlamydophila pneumoniae CWL029
uugagaaagaccac

SEQ ID NO: 497062 - RNA, 16 nt, Chlamydophila pneumoniae CWL029
uugagaaagaccaccu

SEQ ID NO: 497063 - RNA, 19 nt, Chlamydophila pneumoniae CWL029
uugagaaauauaacucucu

SEQ ID NO: 497064 - RNA, 22 nt, Chlamydophila pneumoniae CWL029
uugacuuucauaugaaugacug

SEQ ID NO: 497065 - RNA, 14 nt, Chlamydophila pneumoniae CWL029
uugagcacauuguu

SEQ ID NO: 497066 - RNA, 15 nt, Chlamydophila pneumoniae CWL029
uugaguugguuuugu

SEQ ID NO: 497067 - RNA, 16 nt, Chlamydophila pneumoniae CWL029
uugaguugguuuugua

SEQ ID NO: 497068 - RNA, 13 nt, Chlamydophila pneumoniae CWL029
uugauaaaacgcu

SEQ ID NO: 497069 - RNA, 19 nt, Chlamydophila pneumoniae CWL029
uugauaaauucaucggcau

SEQ ID NO: 497070 - RNA, 15 nt, Chlamydophila pneumoniae CWL029
uugauaacaguagcg

SEQ ID NO: 497071 - RNA, 17 nt, Chlamydophila pneumoniae CWL029
uugauauuaucuuguaa

SEQ ID NO: 497072 - RNA, 13 nt, Chlamydophila pneumoniae CWL029
uugaugagaaaaa

SEQ ID NO: 497073 - RNA, 19 nt, Chlamydophila pneumoniae CWL029
uugaugagaaaaagaaucu

SEQ ID NO: 497074 - RNA, 21 nt, Chlamydophila pneumoniae CWL029
uugaugagaaaaagaaucucu

SEQ ID NO: 497075 - RNA, 14 nt, Chlamydophila pneumoniae CWL029
uugauccagccccc

SEQ ID NO: 497076 - RNA, 15 nt, Chlamydophila pneumoniae CWL029
uugacuauugggagg

SEQ ID NO: 497077 - RNA, 12 nt, Chlamydophila pneumoniae CWL029
uugacugaaacu

SEQ ID NO: 497078 - RNA, 23 nt, Chlamydophila pneumoniae CWL029
uugacuaaauccaccaaugauaa

SEQ ID NO: 497079 - RNA, 16 nt, Chlamydophila pneumoniae CWL029
uugacuagcucucuug

SEQ ID NO: 497080 - RNA, 14 nt, Chlamydophila pneumoniae CWL029
uugaccuuuuucau

SEQ ID NO: 497081 - RNA, 22 nt, Chlamydophila pneumoniae CWL029
uugacaacgguguucauaauca

SEQ ID NO: 497082 - RNA, 14 nt, Chlamydophila pneumoniae CWL029
uugacaauaagaaa

SEQ ID NO: 497083 - RNA, 15 nt, Chlamydophila pneumoniae CWL029
uugaagaacaaaaaa

SEQ ID NO: 497084 - RNA, 20 nt, Chlamydophila pneumoniae CWL029
uugaagaacaaaaaaucaau

SEQ ID NO: 497085 - RNA, 18 nt, Chlamydophila pneumoniae CWL029
uugaagaaguacaaguga

SEQ ID NO: 497086 - RNA, 16 nt, Chlamydophila pneumoniae CWL029
uugaauaaugcauccc

SEQ ID NO: 497087 - RNA, 19 nt, Chlamydophila pneumoniae CWL029
uugaauaagauuuugaaaa

SEQ ID NO: 497088 - RNA, 21 nt, Chlamydophila pneumoniae CWL029
uugaaguuuugguuuuagaaa

SEQ ID NO: 497089 - RNA, 14 nt, Chlamydophila pneumoniae CWL029
uugaaguucucaaa

SEQ ID NO: 497090 - RNA, 16 nt, Chlamydophila pneumoniae CWL029
uugaaucccaucaaag

SEQ ID NO: 497091 - RNA, 24 nt, Chlamydophila pneumoniae CWL029
uugaaucauagagauaucaucaaa

SEQ ID NO: 497092 - RNA, 19 nt, Chlamydophila pneumoniae CWL029
uugaauccuucuauagcaa

SEQ ID NO: 497093 - RNA, 17 nt, Chlamydophila pneumoniae CWL029
uugaaucuauagucugu

SEQ ID NO: 497094 - RNA, 23 nt, Chlamydophila pneumoniae CWL029
uugaaugcagcacggaacaaguc

SEQ ID NO: 497095 - RNA, 19 nt, Chlamydophila pneumoniae CWL029
uugaauuaaaaguuccaaa

SEQ ID NO: 497096 - RNA, 14 nt, Chlamydophila pneumoniae CWL029
uucuuuuccugcag

SEQ ID NO: 497097 - RNA, 12 nt, Chlamydophila pneumoniae CWL029
uucuuuucuaua

SEQ ID NO: 497098 - RNA, 21 nt, Chlamydophila pneumoniae CWL029
uugaaaccguaacugaggcaa

SEQ ID NO: 497099 - RNA, 20 nt, Chlamydophila pneumoniae CWL029
uugaaacgcccuucaggaca

SEQ ID NO: 497100 - RNA, 20 nt, Chlamydophila pneumoniae CWL029
uugaaacuuuuuuucuucuc

SEQ ID NO: 497101 - RNA, 20 nt, Chlamydophila pneumoniae CWL029
uugaacaacuccuuaaacuu

SEQ ID NO: 497102 - RNA, 13 nt, Chlamydophila pneumoniae CWL029
uugaaaucuaccg

SEQ ID NO: 497103 - RNA, 14 nt, Chlamydophila pneumoniae CWL029
uugaaauugcucuu

SEQ ID NO: 497104 - RNA, 23 nt, Chlamydophila pneumoniae CWL029
uucuuucuaggaucucuaguaag

SEQ ID NO: 497105 - RNA, 12 nt, Chlamydophila pneumoniae CWL029
uucuuucugcuu

SEQ ID NO: 497106 - RNA, 12 nt, Chlamydophila pneumoniae CWL029
uucuuucuuacu

SEQ ID NO: 497107 - RNA, 20 nt, Chlamydophila pneumoniae CWL029
uucuuugaagaacaaaaaau

SEQ ID NO: 497108 - RNA, 19 nt, Chlamydophila pneumoniae CWL029
uucuuuauccccagaucuc

SEQ ID NO: 497109 - RNA, 19 nt, Chlamydophila pneumoniae CWL029
uucuuuaucuagcucuuca

SEQ ID NO: 497110 - RNA, 18 nt, Chlamydophila pneumoniae CWL029
uucuuuaggguaaagaaa

SEQ ID NO: 497111 - RNA, 20 nt, Chlamydophila pneumoniae CWL029
uucuugauccaucugcucuu

SEQ ID NO: 497112 - RNA, 22 nt, Chlamydophila pneumoniae CWL029
uucuugcucugacaaguguguu

SEQ ID NO: 497113 - RNA, 14 nt, Chlamydophila pneumoniae CWL029
uucuugacggcagg

SEQ ID NO: 497114 - RNA, 22 nt, Chlamydophila pneumoniae CWL029
uucuugacuuguuucuccuauu

SEQ ID NO: 497115 - RNA, 16 nt, Chlamydophila pneumoniae CWL029
uucugccuuaugcuca

SEQ ID NO: 497116 - RNA, 14 nt, Chlamydophila pneumoniae CWL029
uucuugaagaucuc

SEQ ID NO: 497117 - RNA, 19 nt, Chlamydophila pneumoniae CWL029
uucuugaagaucuccgaag

SEQ ID NO: 497118 - RNA, 17 nt, Chlamydophila pneumoniae CWL029
uucaggacaugccuuag

SEQ ID NO: 497119 - RNA, 23 nt, Chlamydophila pneumoniae CWL029
uucaggagaccagggaucuucau

SEQ ID NO: 497120 - RNA, 19 nt, Chlamydophila pneumoniae CWL029
uucacuauuaggcuuuuuu

SEQ ID NO: 497121 - RNA, 23 nt, Chlamydophila pneumoniae CWL029
uucagcaagucgguaauaccuuu

SEQ ID NO: 497122 - RNA, 23 nt, Chlamydophila pneumoniae CWL029
uucagagagaacaggagguguau

SEQ ID NO: 497123 - RNA, 13 nt, Chlamydophila pneumoniae CWL029
uucagcacugacu

SEQ ID NO: 497124 - RNA, 12 nt, Chlamydophila pneumoniae CWL029
uucagcacuuuu

SEQ ID NO: 497125 - RNA, 16 nt, Chlamydophila pneumoniae CWL029
uucaccuugaaguuuu

SEQ ID NO: 497126 - RNA, 15 nt, Chlamydophila pneumoniae CWL029
uucacgacauacauc

SEQ ID NO: 497127 - RNA, 23 nt, Chlamydophila pneumoniae CWL029
uucacgacauacaucaaaaugcu

SEQ ID NO: 497128 - RNA, 17 nt, Chlamydophila pneumoniae CWL029
uucacguauagguugaa

SEQ ID NO: 497129 - RNA, 17 nt, Chlamydophila pneumoniae CWL029
uucacauaguuuaauaa

SEQ ID NO: 497130 - RNA, 21 nt, Chlamydophila pneumoniae CWL029
uucaauacgcuagcucuuaaa

SEQ ID NO: 497131 - RNA, 22 nt, Chlamydophila pneumoniae CWL029
uucaauacgcuagcucuuaaau

SEQ ID NO: 497132 - RNA, 20 nt, Chlamydophila pneumoniae CWL029
uucaauagguaaggaaacga

SEQ ID NO: 497133 - RNA, 16 nt, Chlamydophila pneumoniae CWL029
uucaauaucuugaauu

SEQ ID NO: 497134 - RNA, 15 nt, Chlamydophila pneumoniae CWL029
uucaaaaagagagcc

SEQ ID NO: 497135 - RNA, 18 nt, Chlamydophila pneumoniae CWL029
uuauuuguuucuuccaua

SEQ ID NO: 497136 - RNA, 13 nt, Chlamydophila pneumoniae CWL029
uuauuuuaaaguc

SEQ ID NO: 497137 - RNA, 15 nt, Chlamydophila pneumoniae CWL029
uuauuuaaaauuucu

SEQ ID NO: 497138 - RNA, 19 nt, Chlamydophila pneumoniae CWL029
uuauugaauaagcuuuccu

SEQ ID NO: 497139 - RNA, 12 nt, Chlamydophila pneumoniae CWL029
uuauucuuaaug

SEQ ID NO: 497140 - RNA, 15 nt, Chlamydophila pneumoniae CWL029
uucaaaauagaagcc

SEQ ID NO: 497141 - RNA, 16 nt, Chlamydophila pneumoniae CWL029
uucaaaagaccgccuu

SEQ ID NO: 497142 - RNA, 13 nt, Chlamydophila pneumoniae CWL029
uucaaaagaaaag

SEQ ID NO: 497143 - RNA, 14 nt, Chlamydophila pneumoniae CWL029
uucaaaagaaaaga

SEQ ID NO: 497144 - RNA, 15 nt, Chlamydophila pneumoniae CWL029
uucaaaagaaaucaa

SEQ ID NO: 497145 - RNA, 22 nt, Chlamydophila pneumoniae CWL029
uucaaaagaaaucaaacauuac

SEQ ID NO: 497146 - RNA, 23 nt, Chlamydophila pneumoniae CWL029
uucaauaauaucgguuccuauau

SEQ ID NO: 497147 - RNA, 21 nt, Chlamydophila pneumoniae CWL029
uucaauaauuucaaagaugca

SEQ ID NO: 497148 - RNA, 12 nt, Chlamydophila pneumoniae CWL029
uucaaguuucuu

SEQ ID NO: 497149 - RNA, 11 nt, Chlamydophila pneumoniae CWL029
uucaagaaaaa

SEQ ID NO: 497150 - RNA, 20 nt, Chlamydophila pneumoniae CWL029
uuaucaaaagguuuuauaaa

SEQ ID NO: 497151 - RNA, 11 nt, Chlamydophila pneumoniae CWL029
uuauauuaaga

SEQ ID NO: 497152 - RNA, 20 nt, Chlamydophila pneumoniae CWL029
uuauaguagcgaauccagaa

SEQ ID NO: 497153 - RNA, 15 nt, Chlamydophila pneumoniae CWL029
uuauagauaugccuc

SEQ ID NO: 497154 - RNA, 20 nt, Chlamydophila pneumoniae CWL029
uuauaggaauaacaccaaaa

SEQ ID NO: 497155 - RNA, 20 nt, Chlamydophila pneumoniae CWL029
uuauauagacaaugcaaccu

SEQ ID NO: 497156 - RNA, 13 nt, Chlamydophila pneumoniae CWL029
uuauauaaaacuu

SEQ ID NO: 497157 - RNA, 15 nt, Chlamydophila pneumoniae CWL029
uuauauaaaacuuau

SEQ ID NO: 497158 - RNA, 16 nt, Chlamydophila pneumoniae CWL029
uuauauaaagaucuuu

SEQ ID NO: 497159 - RNA, 18 nt, Chlamydophila pneumoniae CWL029
uuaucaugagaauuuuca

SEQ ID NO: 497160 - RNA, 19 nt, Chlamydophila pneumoniae CWL029
uuauccugaacaucuccag

SEQ ID NO: 497161 - RNA, 15 nt, Chlamydophila pneumoniae CWL029
uuaucccaaacuucu

SEQ ID NO: 497162 - RNA, 17 nt, Chlamydophila pneumoniae CWL029
uuaugacaaacucuauu

SEQ ID NO: 497163 - RNA, 21 nt, Chlamydophila pneumoniae CWL029
uuaugacaaacucuauuuuca

SEQ ID NO: 497164 - RNA, 13 nt, Chlamydophila pneumoniae CWL029
uuaugaccaagaa

SEQ ID NO: 497165 - RNA, 15 nt, Chlamydophila pneumoniae CWL029
uuaucuccaaagauc

SEQ ID NO: 497166 - RNA, 19 nt, Chlamydophila pneumoniae CWL029
uuaucuccccauucacaaa

SEQ ID NO: 497167 - RNA, 15 nt, Chlamydophila pneumoniae CWL029
uuaucuagcucuuca

SEQ ID NO: 497168 - RNA, 19 nt, Chlamydophila pneumoniae CWL029
uuaucuagcucuucaaggu

SEQ ID NO: 497169 - RNA, 21 nt, Chlamydophila pneumoniae CWL029
uuaucuaggucgauaucccac

SEQ ID NO: 497170 - RNA, 20 nt, Chlamydophila pneumoniae CWL029
uuaucgggggugccaaaaaa

SEQ ID NO: 497171 - RNA, 19 nt, Chlamydophila pneumoniae CWL029
uuaucgugacucuuaucug

SEQ ID NO: 497172 - RNA, 13 nt, Chlamydophila pneumoniae CWL029
uuaucuaaagaaa

SEQ ID NO: 497173 - RNA, 23 nt, Chlamydophila pneumoniae CWL029
uuaucgauaauaaaagcacccuc

SEQ ID NO: 497174 - RNA, 22 nt, Chlamydophila pneumoniae CWL029
uuauguuaaaaauaccaagaug

SEQ ID NO: 497175 - RNA, 22 nt, Chlamydophila pneumoniae CWL029
uuauguuuucucgaagaaaaua

SEQ ID NO: 497176 - RNA, 16 nt, Chlamydophila pneumoniae CWL029
uuauguuuucucgaag

SEQ ID NO: 497177 - RNA, 22 nt, Chlamydophila pneumoniae CWL029
uuauguagaucauaaacagcag

SEQ ID NO: 497178 - RNA, 21 nt, Chlamydophila pneumoniae CWL029
uuauguagauugauccagccc

SEQ ID NO: 497179 - RNA, 12 nt, Chlamydophila pneumoniae CWL029
uuacugaggaaa

SEQ ID NO: 497180 - RNA, 18 nt, Chlamydophila pneumoniae CWL029
uuacuuuaaucaagccua

SEQ ID NO: 497181 - RNA, 22 nt, Chlamydophila pneumoniae CWL029
uuacuuuaaucaagccuaaauc

SEQ ID NO: 497182 - RNA, 21 nt, Chlamydophila pneumoniae CWL029
uuacuaacucuguaauauuca

SEQ ID NO: 497183 - RNA, 13 nt, Chlamydophila pneumoniae CWL029
uuaccgaagagcc

SEQ ID NO: 497184 - RNA, 19 nt, Chlamydophila pneumoniae CWL029
uuacccuaauuugaauagu

SEQ ID NO: 497185 - RNA, 14 nt, Chlamydophila pneumoniae CWL029
uuagcuucuuuuuu

SEQ ID NO: 497186 - RNA, 16 nt, Chlamydophila pneumoniae CWL029
uuagccaaaauuuccu

SEQ ID NO: 497187 - RNA, 13 nt, Chlamydophila pneumoniae CWL029
uuagcauuucucu

SEQ ID NO: 497188 - RNA, 17 nt, Chlamydophila pneumoniae CWL029
uuagcaucaucuccuga

SEQ ID NO: 497189 - RNA, 20 nt, Chlamydophila pneumoniae CWL029
uuagccauggcaucuaagcc

SEQ ID NO: 497190 - RNA, 22 nt, Chlamydophila pneumoniae CWL029
uuagcauaaggggagucuugga

SEQ ID NO: 497191 - RNA, 14 nt, Chlamydophila pneumoniae CWL029
uuagcauagagcuc

SEQ ID NO: 497192 - RNA, 20 nt, Chlamydophila pneumoniae CWL029
uuagcauagagcucuaaaaa

SEQ ID NO: 497193 - RNA, 13 nt, Chlamydophila pneumoniae CWL029
uuagagugacuca

SEQ ID NO: 497194 - RNA, 13 nt, Chlamydophila pneumoniae CWL029
uuagagucugcag

SEQ ID NO: 497195 - RNA, 23 nt, Chlamydophila pneumoniae CWL029
uuagaaguaauccuaauuccuuc

SEQ ID NO: 497196 - RNA, 17 nt, Chlamydophila pneumoniae CWL029
uuagaauaagagcuaca

SEQ ID NO: 497197 - RNA, 13 nt, Chlamydophila pneumoniae CWL029
uuagaacuucaau

SEQ ID NO: 497198 - RNA, 12 nt, Chlamydophila pneumoniae CWL029
uuagaagagaaa

SEQ ID NO: 497199 - RNA, 14 nt, Chlamydophila pneumoniae CWL029
uuagaacuauagga

SEQ ID NO: 497200 - RNA, 17 nt, Chlamydophila pneumoniae CWL029
uuagagaaauuuuuaau

SEQ ID NO: 497201 - RNA, 23 nt, Chlamydophila pneumoniae CWL029
uuagagaagagguguccauaaug

SEQ ID NO: 497202 - RNA, 16 nt, Chlamydophila pneumoniae CWL029
uuagagagaaacaucg

SEQ ID NO: 497203 - RNA, 21 nt, Chlamydophila pneumoniae CWL029
uuagagaucguaauguauccu

SEQ ID NO: 497204 - RNA, 20 nt, Chlamydophila pneumoniae CWL029
uuagaauagaagauccucaa

SEQ ID NO: 497205 - RNA, 18 nt, Chlamydophila pneumoniae CWL029
uuagacgugcucucuucu

SEQ ID NO: 497206 - RNA, 18 nt, Chlamydophila pneumoniae CWL029
uuauacuuuuuuuauaua

SEQ ID NO: 497207 - RNA, 14 nt, Chlamydophila pneumoniae CWL029
uuauaaacuucaau

SEQ ID NO: 497208 - RNA, 18 nt, Chlamydophila pneumoniae CWL029
uuauaaacuucuagacaa

SEQ ID NO: 497209 - RNA, 19 nt, Chlamydophila pneumoniae CWL029
uuauaaacuucuagacaac

SEQ ID NO: 497210 - RNA, 22 nt, Chlamydophila pneumoniae CWL029
uuauaaagaucgggucuacaac

SEQ ID NO: 497211 - RNA, 18 nt, Chlamydophila pneumoniae CWL029
uuaguuuaccugaaaaaa

SEQ ID NO: 497212 - RNA, 18 nt, Chlamydophila pneumoniae CWL029
uuaguuaacuccuucaau

SEQ ID NO: 497213 - RNA, 21 nt, Chlamydophila pneumoniae CWL029
uuaguggaaauugugaaaaaa

SEQ ID NO: 497214 - RNA, 23 nt, Chlamydophila pneumoniae CWL029
uuagguagauagaaauucuguag

SEQ ID NO: 497215 - RNA, 12 nt, Chlamydophila pneumoniae CWL029
uuaggucuuaaa

SEQ ID NO: 497216 - RNA, 12 nt, Chlamydophila pneumoniae CWL029
uuaguaaagaau

SEQ ID NO: 497217 - RNA, 23 nt, Chlamydophila pneumoniae CWL029
uuaguaaaugccucuuucauacu

SEQ ID NO: 497218 - RNA, 12 nt, Chlamydophila pneumoniae CWL029
uuaauucucuga

SEQ ID NO: 497219 - RNA, 13 nt, Chlamydophila pneumoniae CWL029
uuaauuccuugga

SEQ ID NO: 497220 - RNA, 24 nt, Chlamydophila pneumoniae CWL029
uuaauuccaacuacauaauaagca

SEQ ID NO: 497221 - RNA, 13 nt, Chlamydophila pneumoniae CWL029
uuaauguuuggcc

SEQ ID NO: 497222 - RNA, 21 nt, Chlamydophila pneumoniae CWL029
uuaaugcaagcaacucuucag

SEQ ID NO: 497223 - RNA, 14 nt, Chlamydophila pneumoniae CWL029
uuacagaucugcau

SEQ ID NO: 497224 - RNA, 20 nt, Chlamydophila pneumoniae CWL029
uuacagaugcaugauccuau

SEQ ID NO: 497225 - RNA, 19 nt, Chlamydophila pneumoniae CWL029
uuacaauuuuagauacgcu

SEQ ID NO: 497226 - RNA, 13 nt, Chlamydophila pneumoniae CWL029
uuacaggaaacuc

SEQ ID NO: 497227 - RNA, 22 nt, Chlamydophila pneumoniae CWL029
uuacaaugaagucuucuuuccc

SEQ ID NO: 497228 - RNA, 14 nt, Chlamydophila pneumoniae CWL029
uuacaauugaaaau

SEQ ID NO: 497229 - RNA, 18 nt, Chlamydophila pneumoniae CWL029
uuacaauuuaaaucugca

SEQ ID NO: 497230 - RNA, 15 nt, Chlamydophila pneumoniae CWL029
uuacauguaaacaaa

SEQ ID NO: 497231 - RNA, 13 nt, Chlamydophila pneumoniae CWL029
uuaauccuugagg

SEQ ID NO: 497232 - RNA, 14 nt, Chlamydophila pneumoniae CWL029
uuaauauaaaagaa

SEQ ID NO: 497233 - RNA, 22 nt, Chlamydophila pneumoniae CWL029
uuaauaagcauauuuaaauaua

SEQ ID NO: 497234 - RNA, 20 nt, Chlamydophila pneumoniae CWL029
uuaauaagaaccucuaauuu

SEQ ID NO: 497235 - RNA, 16 nt, Chlamydophila pneumoniae CWL029
uuaaggaucccaucau

SEQ ID NO: 497236 - RNA, 14 nt, Chlamydophila pneumoniae CWL029
uuaaggaaacagug

SEQ ID NO: 497237 - RNA, 23 nt, Chlamydophila pneumoniae CWL029
uuaaggaaacagugguaugcuuu

SEQ ID NO: 497238 - RNA, 20 nt, Chlamydophila pneumoniae CWL029
uuaagugauggggauuaucc

SEQ ID NO: 497239 - RNA, 17 nt, Chlamydophila pneumoniae CWL029
uuaagugcuuuuagauc

SEQ ID NO: 497240 - RNA, 17 nt, Chlamydophila pneumoniae CWL029
uuaaguguuucuucaua

SEQ ID NO: 497241 - RNA, 19 nt, Chlamydophila pneumoniae CWL029
uuaagaagauucuuuaauc

SEQ ID NO: 497242 - RNA, 19 nt, Chlamydophila pneumoniae CWL029
uuaagaccaaacuuucuuu

SEQ ID NO: 497243 - RNA, 21 nt, Chlamydophila pneumoniae CWL029
uuaagacucaauacuucagga

SEQ ID NO: 497244 - RNA, 14 nt, Chlamydophila pneumoniae CWL029
uuaagaggaaagca

SEQ ID NO: 497245 - RNA, 18 nt, Chlamydophila pneumoniae CWL029
uuaagauaaacagcacag

SEQ ID NO: 497246 - RNA, 15 nt, Chlamydophila pneumoniae CWL029
uuaagauaaacauua

SEQ ID NO: 497247 - RNA, 18 nt, Chlamydophila pneumoniae CWL029
uuaagauagacucucacu

SEQ ID NO: 497248 - RNA, 18 nt, Chlamydophila pneumoniae CWL029
uuaacccgcuugcaucuu

SEQ ID NO: 497249 - RNA, 14 nt, Chlamydophila pneumoniae CWL029
uuaacccaccagaa

SEQ ID NO: 497250 - RNA, 15 nt, Chlamydophila pneumoniae CWL029
uuaacccaccagaag

SEQ ID NO: 497251 - RNA, 13 nt, Chlamydophila pneumoniae CWL029
uuuccagcaaagc

SEQ ID NO: 497252 - RNA, 14 nt, Chlamydophila pneumoniae CWL029
uuuccaagaaguca

SEQ ID NO: 497253 - RNA, 13 nt, Chlamydophila pneumoniae CWL029
uuuccaacuucaa

SEQ ID NO: 497254 - RNA, 22 nt, Chlamydophila pneumoniae CWL029
uuuccaagacaacaccucccac

SEQ ID NO: 497255 - RNA, 14 nt, Chlamydophila pneumoniae CWL029
uuucagauguacaa

SEQ ID NO: 497256 - RNA, 12 nt, Chlamydophila pneumoniae CWL029
uuucagauuuuu

SEQ ID NO: 497257 - RNA, 14 nt, Chlamydophila pneumoniae CWL029
uuucagauuuuuua

SEQ ID NO: 497258 - RNA, 22 nt, Chlamydophila pneumoniae CWL029
uuucagagccgcuagccauagu

SEQ ID NO: 497259 - RNA, 14 nt, Chlamydophila pneumoniae CWL029
uuucagaaaagaaa

SEQ ID NO: 497260 - RNA, 21 nt, Chlamydophila pneumoniae CWL029
uuucauauaaaguuuccaagu

SEQ ID NO: 497261 - RNA, 16 nt, Chlamydophila pneumoniae CWL029
uuucauacuuauccuu

SEQ ID NO: 497262 - RNA, 22 nt, Chlamydophila pneumoniae CWL029
uuucaguuguuucuagaaaauc

SEQ ID NO: 497263 - RNA, 21 nt, Chlamydophila pneumoniae CWL029
uuucaguuuuaucggcaauug

SEQ ID NO: 497264 - RNA, 13 nt, Chlamydophila pneumoniae CWL029
uuucauaagagaa

SEQ ID NO: 497265 - RNA, 18 nt, Chlamydophila pneumoniae CWL029
uuuauagcggaguguuuu

SEQ ID NO: 497266 - RNA, 14 nt, Chlamydophila pneumoniae CWL029
uuucaaauucugaa

SEQ ID NO: 497267 - RNA, 9 nt, Chlamydophila pneumoniae CWL029
uuucaaagg

SEQ ID NO: 497268 - RNA, 17 nt, Chlamydophila pneumoniae CWL029
uuucaaaggagaaagaa

SEQ ID NO: 497269 - RNA, 22 nt, Chlamydophila pneumoniae CWL029
uuucaaaggcaacgcgauuuuc

SEQ ID NO: 497270 - RNA, 22 nt, Chlamydophila pneumoniae CWL029
uuuauuuuaggaagcuuaucaa

SEQ ID NO: 497271 - RNA, 19 nt, Chlamydophila pneumoniae CWL029
uuuauuuugaugcuucuuu

SEQ ID NO: 497272 - RNA, 21 nt, Chlamydophila pneumoniae CWL029
uuucaauaaccagaagacucc

SEQ ID NO: 497273 - RNA, 19 nt, Chlamydophila pneumoniae CWL029
uuucaagauugugcucaau

SEQ ID NO: 497274 - RNA, 20 nt, Chlamydophila pneumoniae CWL029
uuucaagcuuucguuuucua

SEQ ID NO: 497275 - RNA, 16 nt, Chlamydophila pneumoniae CWL029
uuucaaucucuccuug

SEQ ID NO: 497276 - RNA, 19 nt, Chlamydophila pneumoniae CWL029
uuucacgagcucacaaccc

SEQ ID NO: 497277 - RNA, 21 nt, Chlamydophila pneumoniae CWL029
uuucaccaacuccucuaagga

SEQ ID NO: 497278 - RNA, 19 nt, Chlamydophila pneumoniae CWL029
uuucacauaguuuaauaaa

SEQ ID NO: 497279 - RNA, 16 nt, Chlamydophila pneumoniae CWL029
uuuaccuuguuuuccu

SEQ ID NO: 497280 - RNA, 13 nt, Chlamydophila pneumoniae CWL029
uuuacgaaaacau

SEQ ID NO: 497281 - RNA, 22 nt, Chlamydophila pneumoniae CWL029
uuuacgaaaacaucuguauauu

SEQ ID NO: 497282 - RNA, 17 nt, Chlamydophila pneumoniae CWL029
uuuacgaaucuuuuuca

SEQ ID NO: 497283 - RNA, 16 nt, Chlamydophila pneumoniae CWL029
uuuacaaucucugcga

SEQ ID NO: 497284 - RNA, 13 nt, Chlamydophila pneumoniae CWL029
uuuaauuuuucua

SEQ ID NO: 497285 - RNA, 18 nt, Chlamydophila pneumoniae CWL029
uuuaauuuuucuaagaaa

SEQ ID NO: 497286 - RNA, 21 nt, Chlamydophila pneumoniae CWL029
uuuaacucuagaucuucaauc

SEQ ID NO: 497287 - RNA, 15 nt, Chlamydophila pneumoniae CWL029
uuuaauucaaaaaga

SEQ ID NO: 497288 - RNA, 15 nt, Chlamydophila pneumoniae CWL029
uuuacgaugagguug

SEQ ID NO: 497289 - RNA, 16 nt, Chlamydophila pneumoniae CWL029
uuuagcgcuacaguga

SEQ ID NO: 497290 - RNA, 17 nt, Chlamydophila pneumoniae CWL029
uuuagcuauuugaaaua

SEQ ID NO: 497291 - RNA, 19 nt, Chlamydophila pneumoniae CWL029
uuuaguggaaauugugaaa

SEQ ID NO: 497292 - RNA, 15 nt, Chlamydophila pneumoniae CWL029
uuuaguucaccacua

SEQ ID NO: 497293 - RNA, 15 nt, Chlamydophila pneumoniae CWL029
uuuaguuucccacua

SEQ ID NO: 497294 - RNA, 13 nt, Chlamydophila pneumoniae CWL029
uuuauaaacuucu

SEQ ID NO: 497295 - RNA, 21 nt, Chlamydophila pneumoniae CWL029
uuuauaaagaucgggucuaca

SEQ ID NO: 497296 - RNA, 23 nt, Chlamydophila pneumoniae CWL029
uuuaaaagauuccuuaccuauau

SEQ ID NO: 497297 - RNA, 13 nt, Chlamydophila pneumoniae CWL029
uuguuucuagaaa

SEQ ID NO: 497298 - RNA, 15 nt, Chlamydophila pneumoniae CWL029
uuguuuagaaaaaga

SEQ ID NO: 497299 - RNA, 14 nt, Chlamydophila pneumoniae CWL029
uuguuguuuuugcu

SEQ ID NO: 497300 - RNA, 19 nt, Chlamydophila pneumoniae CWL029
uuguugucagcuuugcuua

SEQ ID NO: 497301 - RNA, 22 nt, Chlamydophila pneumoniae CWL029
uuguuggcauagcgagaacacc

SEQ ID NO: 497302 - RNA, 13 nt, Chlamydophila pneumoniae CWL029
uugcugauuucuu

SEQ ID NO: 497303 - RNA, 17 nt, Chlamydophila pneumoniae CWL029
uuuaaaguguguaaaug

SEQ ID NO: 497304 - RNA, 21 nt, Chlamydophila pneumoniae CWL029
uuuaaauaaaaccacuucucu

SEQ ID NO: 497305 - RNA, 21 nt, Chlamydophila pneumoniae CWL029
uuuaaaaguacgaccaacucc

SEQ ID NO: 497306 - RNA, 14 nt, Chlamydophila pneumoniae CWL029
uuuaaauagcaucc

SEQ ID NO: 497307 - RNA, 18 nt, Chlamydophila pneumoniae CWL029
uuuaaaugagcaauguuu

SEQ ID NO: 497308 - RNA, 14 nt, Chlamydophila pneumoniae CWL029
uuuaaaugccuuaa

SEQ ID NO: 497309 - RNA, 17 nt, Chlamydophila pneumoniae CWL029
uuuaaaugccuuaaaug

SEQ ID NO: 497310 - RNA, 22 nt, Chlamydophila pneumoniae CWL029
uuuaaauucgccaaacgaauuu

SEQ ID NO: 497311 - RNA, 19 nt, Chlamydophila pneumoniae CWL029
uuuaacaugccaaaaguuu

SEQ ID NO: 497312 - RNA, 20 nt, Chlamydophila pneumoniae CWL029
uuugcaguuccgauaaagau

SEQ ID NO: 497313 - RNA, 13 nt, Chlamydophila pneumoniae CWL029
uuugccugaaauc

SEQ ID NO: 497314 - RNA, 14 nt, Chlamydophila pneumoniae CWL029
uuugccauuucuau

SEQ ID NO: 497315 - RNA, 16 nt, Chlamydophila pneumoniae CWL029
uuugcuaaacaaugca

SEQ ID NO: 497316 - RNA, 21 nt, Chlamydophila pneumoniae CWL029
uuugcuacagcuucuuuucca

SEQ ID NO: 497317 - RNA, 16 nt, Chlamydophila pneumoniae CWL029
uuugcuccuccaaaag

SEQ ID NO: 497318 - RNA, 15 nt, Chlamydophila pneumoniae CWL029
uuugcucucuagauu

SEQ ID NO: 497319 - RNA, 12 nt, Chlamydophila pneumoniae CWL029
uuugcugaagau

SEQ ID NO: 497320 - RNA, 17 nt, Chlamydophila pneumoniae CWL029
uuugaugcuucuuucaa

SEQ ID NO: 497321 - RNA, 18 nt, Chlamydophila pneumoniae CWL029
uuugaugcuucuuucaaa

SEQ ID NO: 497322 - RNA, 18 nt, Chlamydophila pneumoniae CWL029
uuugaugaucgaucccuu

SEQ ID NO: 497323 - RNA, 14 nt, Chlamydophila pneumoniae CWL029
uuugaucgcuugug

SEQ ID NO: 497324 - RNA, 16 nt, Chlamydophila pneumoniae CWL029
uuugauucauaaagag

SEQ ID NO: 497325 - RNA, 13 nt, Chlamydophila pneumoniae CWL029
uuugauuuuucaa

SEQ ID NO: 497326 - RNA, 13 nt, Chlamydophila pneumoniae CWL029
uuugcaaaugaaa

SEQ ID NO: 497327 - RNA, 18 nt, Chlamydophila pneumoniae CWL029
uuugcaaaugaaaagaga

SEQ ID NO: 497328 - RNA, 18 nt, Chlamydophila pneumoniae CWL029
uuugcaacaaucuuucuu

SEQ ID NO: 497329 - RNA, 15 nt, Chlamydophila pneumoniae CWL029
uuucuuauaaaaaag

SEQ ID NO: 497330 - RNA, 15 nt, Chlamydophila pneumoniae CWL029
uuucuuaauuuccuu

SEQ ID NO: 497331 - RNA, 17 nt, Chlamydophila pneumoniae CWL029
uuucuguugcacuuucc

SEQ ID NO: 497332 - RNA, 13 nt, Chlamydophila pneumoniae CWL029
uuucuguuccuga

SEQ ID NO: 497333 - RNA, 20 nt, Chlamydophila pneumoniae CWL029
uuucuguucugcuucuguaa

SEQ ID NO: 497334 - RNA, 12 nt, Chlamydophila pneumoniae CWL029
uuucuucuguuu

SEQ ID NO: 497335 - RNA, 14 nt, Chlamydophila pneumoniae CWL029
uuucuucuucuaaa

SEQ ID NO: 497336 - RNA, 17 nt, Chlamydophila pneumoniae CWL029
uuucuugauauuugucu

SEQ ID NO: 497337 - RNA, 20 nt, Chlamydophila pneumoniae CWL029
uuucuucucuaggaagauuu

SEQ ID NO: 497338 - RNA, 13 nt, Chlamydophila pneumoniae CWL029
uuucuugauuaga

SEQ ID NO: 497339 - RNA, 22 nt, Chlamydophila pneumoniae CWL029
uuucuugugguuuuucuccucu

SEQ ID NO: 497340 - RNA, 13 nt, Chlamydophila pneumoniae CWL029
uuucuuucuaaga

SEQ ID NO: 497341 - RNA, 14 nt, Chlamydophila pneumoniae CWL029
uuucuuuaaagaau

SEQ ID NO: 497342 - RNA, 22 nt, Chlamydophila pneumoniae CWL029
uuucuuuaaagaauagcaugaa

SEQ ID NO: 497343 - RNA, 16 nt, Chlamydophila pneumoniae CWL029
uuucuuucacaucuuu

SEQ ID NO: 497344 - RNA, 14 nt, Chlamydophila pneumoniae CWL029
uuucuuuauucccu

SEQ ID NO: 497345 - RNA, 23 nt, Chlamydophila pneumoniae CWL029
uuugagcaguaauguuaacgaau

SEQ ID NO: 497346 - RNA, 18 nt, Chlamydophila pneumoniae CWL029
uuugacuuucauaugaau

SEQ ID NO: 497347 - RNA, 14 nt, Chlamydophila pneumoniae CWL029
uuugacaaauuuau

SEQ ID NO: 497348 - RNA, 13 nt, Chlamydophila pneumoniae CWL029
uuugacaacacca

SEQ ID NO: 497349 - RNA, 20 nt, Chlamydophila pneumoniae CWL029
uuugacaucuaauuuuaaau

SEQ ID NO: 497350 - RNA, 23 nt, Chlamydophila pneumoniae CWL029
uuugaccagaugauuuuuugaau

SEQ ID NO: 497351 - RNA, 14 nt, Chlamydophila pneumoniae CWL029
uuugaaaauauccu

SEQ ID NO: 497352 - RNA, 13 nt, Chlamydophila pneumoniae CWL029
uuucuuuugcaaa

SEQ ID NO: 497353 - RNA, 21 nt, Chlamydophila pneumoniae CWL029
uuugaauauauugugcauuac

SEQ ID NO: 497354 - RNA, 17 nt, Chlamydophila pneumoniae CWL029
uuugaacaacuccuuaa

SEQ ID NO: 497355 - RNA, 13 nt, Chlamydophila pneumoniae CWL029
uuucucuccacag

SEQ ID NO: 497356 - RNA, 15 nt, Chlamydophila pneumoniae CWL029
uuucucuaaaauaug

SEQ ID NO: 497357 - RNA, 20 nt, Chlamydophila pneumoniae CWL029
uuucucucuuuaucuuuaag

SEQ ID NO: 497358 - RNA, 12 nt, Chlamydophila pneumoniae CWL029
uuucuauuuuca

SEQ ID NO: 497359 - RNA, 22 nt, Chlamydophila pneumoniae CWL029
uuucucaccacggaagauaugu

SEQ ID NO: 497360 - RNA, 23 nt, Chlamydophila pneumoniae CWL029
uuucugauugagaauaaaacuuu

SEQ ID NO: 497361 - RNA, 13 nt, Chlamydophila pneumoniae CWL029
uuucugaagauuu

SEQ ID NO: 497362 - RNA, 22 nt, Chlamydophila pneumoniae CWL029
uuucucuuucgaugcuauuuuu

SEQ ID NO: 497363 - RNA, 13 nt, Chlamydophila pneumoniae CWL029
uuucugcucuucu

SEQ ID NO: 497364 - RNA, 20 nt, Chlamydophila pneumoniae CWL029
uuucuguacaacaaaauuug

SEQ ID NO: 497365 - RNA, 14 nt, Chlamydophila pneumoniae CWL029
uuucguuuuuucuu

SEQ ID NO: 497366 - RNA, 14 nt, Chlamydophila pneumoniae CWL029
uuucuaaauacuua

SEQ ID NO: 497367 - RNA, 14 nt, Chlamydophila pneumoniae CWL029
uuucgucuaaaaua

SEQ ID NO: 497368 - RNA, 15 nt, Chlamydophila pneumoniae CWL029
uuucgugaacaaaau

SEQ ID NO: 497369 - RNA, 15 nt, Chlamydophila pneumoniae CWL029
uuucguaaccacagu

SEQ ID NO: 497370 - RNA, 19 nt, Chlamydophila pneumoniae CWL029
uuucuacuucaggaaauaa

SEQ ID NO: 497371 - RNA, 22 nt, Chlamydophila pneumoniae CWL029
uuucuagaaaacgccaacugua

SEQ ID NO: 497372 - RNA, 21 nt, Chlamydophila pneumoniae CWL029
uuucuagaaacugcuccugaa

SEQ ID NO: 497373 - RNA, 17 nt, Chlamydophila pneumoniae CWL029
uuucuacugaaaccuuc

SEQ ID NO: 497374 - RNA, 21 nt, Chlamydophila pneumoniae CWL029
uuucuacauuugcuauuuucc

SEQ ID NO: 497375 - RNA, 14 nt, Chlamydophila pneumoniae CWL029
uuucuaauguaggg

SEQ ID NO: 497376 - RNA, 22 nt, Chlamydophila pneumoniae CWL029
uuucuaagauuccuaacuucug

SEQ ID NO: 497377 - RNA, 22 nt, Chlamydophila pneumoniae CWL029
uuucuagcugcucuuuuagaau

SEQ ID NO: 497378 - RNA, 16 nt, Chlamydophila pneumoniae CWL029
uuucuaggaauugcug

SEQ ID NO: 497379 - RNA, 22 nt, Chlamydophila pneumoniae CWL029
uuucuaggacagcacauagagu

SEQ ID NO: 497380 - RNA, 22 nt, Chlamydophila pneumoniae CWL029
uuucuaggccgggauuuuaauu

SEQ ID NO: 497381 - RNA, 23 nt, Chlamydophila pneumoniae CWL029
uuucuaguucguucaucugucau

SEQ ID NO: 497382 - RNA, 21 nt, Chlamydophila pneumoniae CWL029
uuucuaucuaaucaauucgcu

SEQ ID NO: 497383 - RNA, 14 nt, Chlamydophila pneumoniae CWL029
uuuccuaguccucu

SEQ ID NO: 497384 - RNA, 12 nt, Chlamydophila pneumoniae CWL029
uuuccuaaaaua

SEQ ID NO: 497385 - RNA, 16 nt, Chlamydophila pneumoniae CWL029
uuuccucucaugaaau

SEQ ID NO: 497386 - RNA, 20 nt, Chlamydophila pneumoniae CWL029
uuuccugacuauaaaaugcc

SEQ ID NO: 497387 - RNA, 21 nt, Chlamydophila pneumoniae CWL029
uuuccuucaggauuuuccauu

SEQ ID NO: 497388 - RNA, 23 nt, Chlamydophila pneumoniae CWL029
uuuccuucuuuuaaaaacucuuu

SEQ ID NO: 497389 - RNA, 18 nt, Chlamydophila pneumoniae CWL029
uuuccuggucuccagaag

SEQ ID NO: 497390 - RNA, 14 nt, Chlamydophila pneumoniae CWL029
uuucgaagcgcucu

SEQ ID NO: 497391 - RNA, 22 nt, Chlamydophila pneumoniae CWL029
uuucgaagcgcucuacaaaugc

SEQ ID NO: 497392 - RNA, 17 nt, Chlamydophila pneumoniae CWL029
uuuccuuuucuccuucu

SEQ ID NO: 497393 - RNA, 18 nt, Chlamydophila pneumoniae CWL029
uuuccuuuucuccuucug

SEQ ID NO: 497394 - RNA, 19 nt, Chlamydophila pneumoniae CWL029
uuuccuuuucuccuucugg

SEQ ID NO: 497395 - RNA, 20 nt, Chlamydophila pneumoniae CWL029
uuucgaugcuauuuuuccau

SEQ ID NO: 497396 - RNA, 19 nt, Chlamydophila pneumoniae CWL029
uuuccggggagaacuucaa

SEQ ID NO: 497397 - RNA, 16 nt, Chlamydophila pneumoniae CWL029
uuucccucguugcuua

SEQ ID NO: 497398 - RNA, 21 nt, Chlamydophila pneumoniae CWL029
uuucccuaagcaaaaacuuuc

SEQ ID NO: 497399 - RNA, 20 nt, Chlamydophila pneumoniae CWL029
uuuccauacccaaauuucuu

SEQ ID NO: 497400 - RNA, 22 nt, Chlamydophila pneumoniae CWL029
uuuccauacccaaauuucuucu

SEQ ID NO: 497401 - RNA, 23 nt, Chlamydophila pneumoniae CWL029
uuuccauacccaaauuucuucug

SEQ ID NO: 497402 - RNA, 11 nt, Chlamydophila pneumoniae CWL029
uuuccauccac

SEQ ID NO: 497403 - RNA, 14 nt, Chlamydophila pneumoniae CWL029
uuuccauaggaucu

SEQ ID NO: 497404 - RNA, 20 nt, Chlamydophila pneumoniae CWL029
uuucccaccauauucucagg

SEQ ID NO: 497405 - RNA, 17 nt, Chlamydophila pneumoniae CWL029
aaauuaagucacacuuu

SEQ ID NO: 497406 - RNA, 12 nt, Chlamydophila pneumoniae CWL029
aaauuaaauauc

SEQ ID NO: 497407 - RNA, 20 nt, Chlamydophila pneumoniae CWL029
aaauguuuugcgauaucuau

SEQ ID NO: 497408 - RNA, 21 nt, Chlamydophila pneumoniae CWL029
aaauguuuugcgauaucuaua

SEQ ID NO: 497409 - RNA, 21 nt, Chlamydophila pneumoniae CWL029
aaauguugauagguagaggca

SEQ ID NO: 497410 - RNA, 11 nt, Chlamydophila pneumoniae CWL029
uuuuuuaauuc

SEQ ID NO: 497411 - RNA, 23 nt, Chlamydophila pneumoniae CWL029
aaaugugaaaucguaucuuuuug

SEQ ID NO: 497412 - RNA, 20 nt, Chlamydophila pneumoniae CWL029
uuuuugaauaugauuuccac

SEQ ID NO: 497413 - RNA, 12 nt, Chlamydophila pneumoniae CWL029
uuuuugaaaacu

SEQ ID NO: 497414 - RNA, 20 nt, Chlamydophila pneumoniae CWL029
uuuuucuugaaaaauccuga

SEQ ID NO: 497415 - RNA, 22 nt, Chlamydophila pneumoniae CWL029
uuuuucuguuccugaguacuuu

SEQ ID NO: 497416 - RNA, 13 nt, Chlamydophila pneumoniae CWL029
uuuuucuuaguau

SEQ ID NO: 497417 - RNA, 14 nt, Chlamydophila pneumoniae CWL029
uuuuugaaaacuuc

SEQ ID NO: 497418 - RNA, 13 nt, Chlamydophila pneumoniae CWL029
uuuuugaaaauuu

SEQ ID NO: 497419 - RNA, 22 nt, Chlamydophila pneumoniae CWL029
uuuuucugcuucuccaaauaaa

SEQ ID NO: 497420 - RNA, 10 nt, Chlamydophila pneumoniae CWL029
uuuuucucuu

SEQ ID NO: 497421 - RNA, 12 nt, Chlamydophila pneumoniae CWL029
uuuuucuaguuc

SEQ ID NO: 497422 - RNA, 18 nt, Chlamydophila pneumoniae CWL029
uuuuuguucauccagaag

SEQ ID NO: 497423 - RNA, 19 nt, Chlamydophila pneumoniae CWL029
uuuuuuaaagcuauuguuu

SEQ ID NO: 497424 - RNA, 12 nt, Chlamydophila pneumoniae CWL029
uuuuuuaaagug

SEQ ID NO: 497425 - RNA, 17 nt, Chlamydophila pneumoniae CWL029
uuuuugcugaagauuuu

SEQ ID NO: 497426 - RNA, 23 nt, Chlamydophila pneumoniae CWL029
uuuuugcuaagagcucuuucccu

SEQ ID NO: 497427 - RNA, 16 nt, Chlamydophila pneumoniae CWL029
aaauuaucuccaaaga

SEQ ID NO: 497428 - RNA, 12 nt, Chlamydophila pneumoniae CWL029
uuuuuucuaaau

SEQ ID NO: 497429 - RNA, 11 nt, Chlamydophila pneumoniae CWL029
uuuuuucuauu

SEQ ID NO: 497430 - RNA, 13 nt, Chlamydophila pneumoniae CWL029
aaauuacuguggu

SEQ ID NO: 497431 - RNA, 22 nt, Chlamydophila pneumoniae CWL029
aaauuccuucucagaaagauau

SEQ ID NO: 497432 - RNA, 14 nt, Chlamydophila pneumoniae CWL029
aaauuccuucucag

SEQ ID NO: 497433 - RNA, 12 nt, Chlamydophila pneumoniae CWL029
aaauuccucuug

SEQ ID NO: 497434 - RNA, 13 nt, Chlamydophila pneumoniae CWL029
aaauucuaagcgc

SEQ ID NO: 497435 - RNA, 21 nt, Chlamydophila pneumoniae CWL029
aaauucuagguuucaggaaau

SEQ ID NO: 497436 - RNA, 12 nt, Chlamydophila pneumoniae CWL029
aaauucuguaaa

SEQ ID NO: 497437 - RNA, 14 nt, Chlamydophila pneumoniae CWL029
aaauucauuaaaau

SEQ ID NO: 497438 - RNA, 22 nt, Chlamydophila pneumoniae CWL029
aaauucaugccuuuggcaauca

SEQ ID NO: 497439 - RNA, 16 nt, Chlamydophila pneumoniae CWL029
aaauucauuaagaaca

SEQ ID NO: 497440 - RNA, 11 nt, Chlamydophila pneumoniae CWL029
aaauucccaua

SEQ ID NO: 497441 - RNA, 18 nt, Chlamydophila pneumoniae CWL029
aaauucaaaauagaagcc

SEQ ID NO: 497442 - RNA, 22 nt, Chlamydophila pneumoniae CWL029
aaauucaaaaucaaaguauaua

SEQ ID NO: 497443 - RNA, 12 nt, Chlamydophila pneumoniae CWL029
uuuugcucucua

SEQ ID NO: 497444 - RNA, 16 nt, Chlamydophila pneumoniae CWL029
uuuugcugaagauuuu

SEQ ID NO: 497445 - RNA, 18 nt, Chlamydophila pneumoniae CWL029
uuuugcugaagauuuuuu

SEQ ID NO: 497446 - RNA, 17 nt, Chlamydophila pneumoniae CWL029
uuuugcugaagauuuuu

SEQ ID NO: 497447 - RNA, 16 nt, Chlamydophila pneumoniae CWL029
uuuugcuaaacaaugc

SEQ ID NO: 497448 - RNA, 18 nt, Chlamydophila pneumoniae CWL029
uuuugccgugcucuuaug

SEQ ID NO: 497449 - RNA, 14 nt, Chlamydophila pneumoniae CWL029
uuuugcgauuucag

SEQ ID NO: 497450 - RNA, 20 nt, Chlamydophila pneumoniae CWL029
uuuugcaaaucuucgaauuu

SEQ ID NO: 497451 - RNA, 15 nt, Chlamydophila pneumoniae CWL029
uuuugauuuugcagu

SEQ ID NO: 497452 - RNA, 20 nt, Chlamydophila pneumoniae CWL029
uuuugaauuaaaaguuccaa

SEQ ID NO: 497453 - RNA, 14 nt, Chlamydophila pneumoniae CWL029
uuuugagauucaaa

SEQ ID NO: 497454 - RNA, 13 nt, Chlamydophila pneumoniae CWL029
uuuugauaccucu

SEQ ID NO: 497455 - RNA, 14 nt, Chlamydophila pneumoniae CWL029
uuuugaagugcuuu

SEQ ID NO: 497456 - RNA, 13 nt, Chlamydophila pneumoniae CWL029
uuuugaaaauuuu

SEQ ID NO: 497457 - RNA, 22 nt, Chlamydophila pneumoniae CWL029
uuuucuuuucugaagauuuuuu

SEQ ID NO: 497458 - RNA, 13 nt, Chlamydophila pneumoniae CWL029
uuuucuucucuaa

SEQ ID NO: 497459 - RNA, 21 nt, Chlamydophila pneumoniae CWL029
uuuucuucugacauuccuuaa

SEQ ID NO: 497460 - RNA, 12 nt, Chlamydophila pneumoniae CWL029
uuuucuuccaaa

SEQ ID NO: 497461 - RNA, 16 nt, Chlamydophila pneumoniae CWL029
uuuucuuccaaagacu

SEQ ID NO: 497462 - RNA, 17 nt, Chlamydophila pneumoniae CWL029
uuuucuugauuagagaa

SEQ ID NO: 497463 - RNA, 22 nt, Chlamydophila pneumoniae CWL029
uuuucuuguaagacuaaaaaag

SEQ ID NO: 497464 - RNA, 20 nt, Chlamydophila pneumoniae CWL029
uuuucuucuucggaucugua

SEQ ID NO: 497465 - RNA, 22 nt, Chlamydophila pneumoniae CWL029
uuuucuucuuuaagauuuccuu

SEQ ID NO: 497466 - RNA, 13 nt, Chlamydophila pneumoniae CWL029
uuuucuucuuuag

SEQ ID NO: 497467 - RNA, 22 nt, Chlamydophila pneumoniae CWL029
uuuucuuauagggaauuuuuuc

SEQ ID NO: 497468 - RNA, 16 nt, Chlamydophila pneumoniae CWL029
uuuucuuaucaugaaa

SEQ ID NO: 497469 - RNA, 16 nt, Chlamydophila pneumoniae CWL029
uuuucuucaacauaca

SEQ ID NO: 497470 - RNA, 21 nt, Chlamydophila pneumoniae CWL029
uuuucuucaggaacagcauua

SEQ ID NO: 497471 - RNA, 11 nt, Chlamydophila pneumoniae CWL029
uuuucuagaaa

SEQ ID NO: 497472 - RNA, 18 nt, Chlamydophila pneumoniae CWL029
uuuucuagaaaagauucu

SEQ ID NO: 497473 - RNA, 14 nt, Chlamydophila pneumoniae CWL029
uuuucuaagagauc

SEQ ID NO: 497474 - RNA, 15 nt, Chlamydophila pneumoniae CWL029
uuuucuaagagaucu

SEQ ID NO: 497475 - RNA, 22 nt, Chlamydophila pneumoniae CWL029
uuuucuaagauuccuaacuucu

SEQ ID NO: 497476 - RNA, 12 nt, Chlamydophila pneumoniae CWL029
uuuucuaaaaug

SEQ ID NO: 497477 - RNA, 22 nt, Chlamydophila pneumoniae CWL029
uuuucuagaaaagauucuaaau

SEQ ID NO: 497478 - RNA, 22 nt, Chlamydophila pneumoniae CWL029
uuuucuagcauaguguuccaaa

SEQ ID NO: 497479 - RNA, 22 nt, Chlamydophila pneumoniae CWL029
uuuucuagucgugccaaugugc

SEQ ID NO: 497480 - RNA, 17 nt, Chlamydophila pneumoniae CWL029
uuuuguucccuacuucc

SEQ ID NO: 497481 - RNA, 15 nt, Chlamydophila pneumoniae CWL029
uuuugugaauuuuau

SEQ ID NO: 497482 - RNA, 20 nt, Chlamydophila pneumoniae CWL029
uuuugguuuuagaaauguuu

SEQ ID NO: 497483 - RNA, 19 nt, Chlamydophila pneumoniae CWL029
uuuuguaaucuaagaaucu

SEQ ID NO: 497484 - RNA, 20 nt, Chlamydophila pneumoniae CWL029
uuuuguaaucuaagaaucua

SEQ ID NO: 497485 - RNA, 13 nt, Chlamydophila pneumoniae CWL029
uuuuguacacaga

SEQ ID NO: 497486 - RNA, 14 nt, Chlamydophila pneumoniae CWL029
uuuuguaggaacau

SEQ ID NO: 497487 - RNA, 12 nt, Chlamydophila pneumoniae CWL029
uuuuuacaugua

SEQ ID NO: 497488 - RNA, 12 nt, Chlamydophila pneumoniae CWL029
uuuuuaaauaca

SEQ ID NO: 497489 - RNA, 23 nt, Chlamydophila pneumoniae CWL029
uuuuucaaucaauaaaaugucca

SEQ ID NO: 497490 - RNA, 16 nt, Chlamydophila pneumoniae CWL029
uuuuucaauccuuccu

SEQ ID NO: 497491 - RNA, 19 nt, Chlamydophila pneumoniae CWL029
uuuuucccuuuaaaaguac

SEQ ID NO: 497492 - RNA, 15 nt, Chlamydophila pneumoniae CWL029
uuuuuccaacuucaa

SEQ ID NO: 497493 - RNA, 13 nt, Chlamydophila pneumoniae CWL029
uuuucaguucgug

SEQ ID NO: 497494 - RNA, 22 nt, Chlamydophila pneumoniae CWL029
uuuucagaaagcgaagagcuca

SEQ ID NO: 497495 - RNA, 12 nt, Chlamydophila pneumoniae CWL029
uuuucagcacug

SEQ ID NO: 497496 - RNA, 22 nt, Chlamydophila pneumoniae CWL029
uuuucagccugucuauaaaaua

SEQ ID NO: 497497 - RNA, 21 nt, Chlamydophila pneumoniae CWL029
uuuucaauagcaguaucuaga

SEQ ID NO: 497498 - RNA, 15 nt, Chlamydophila pneumoniae CWL029
uuuucaauccuuccu

SEQ ID NO: 497499 - RNA, 18 nt, Chlamydophila pneumoniae CWL029
uuuucaagucuguaagga

SEQ ID NO: 497500 - RNA, 13 nt, Chlamydophila pneumoniae CWL029
uuuucaauaacca

SEQ ID NO: 497501 - RNA, 20 nt, Chlamydophila pneumoniae CWL029
uuuucgcuaacuuauccuca

SEQ ID NO: 497502 - RNA, 16 nt, Chlamydophila pneumoniae CWL029
uuuucguaaccacagu

SEQ ID NO: 497503 - RNA, 15 nt, Chlamydophila pneumoniae CWL029
uuuucgacgcuguug

SEQ ID NO: 497504 - RNA, 21 nt, Chlamydophila pneumoniae CWL029
uuuuccugugugguuggaucc

SEQ ID NO: 497505 - RNA, 13 nt, Chlamydophila pneumoniae CWL029
uuuuccucuauau

SEQ ID NO: 497506 - RNA, 23 nt, Chlamydophila pneumoniae CWL029
uuuuccgcaaaggaaaagauaug

SEQ ID NO: 497507 - RNA, 15 nt, Chlamydophila pneumoniae CWL029
uuuuccaaauuccuu

SEQ ID NO: 497508 - RNA, 20 nt, Chlamydophila pneumoniae CWL029
uuuuccaggaccaaacuucg

SEQ ID NO: 497509 - RNA, 13 nt, Chlamydophila pneumoniae CWL029
uuuuauuuaaaau

SEQ ID NO: 497510 - RNA, 20 nt, Chlamydophila pneumoniae CWL029
uuuuauuuauuaucuuguuu

SEQ ID NO: 497511 - RNA, 16 nt, Chlamydophila pneumoniae CWL029
uuuuaugacaaacucu

SEQ ID NO: 497512 - RNA, 17 nt, Chlamydophila pneumoniae CWL029
uuuuaugauuacaucua

SEQ ID NO: 497513 - RNA, 18 nt, Chlamydophila pneumoniae CWL029
uuuuaugaucucuucaug

SEQ ID NO: 497514 - RNA, 20 nt, Chlamydophila pneumoniae CWL029
uuuuaggacgcuauccuauu

SEQ ID NO: 497515 - RNA, 23 nt, Chlamydophila pneumoniae CWL029
uuuuaggaucuuuguugagaagg

SEQ ID NO: 497516 - RNA, 15 nt, Chlamydophila pneumoniae CWL029
uuuuauagcaucgua

SEQ ID NO: 497517 - RNA, 16 nt, Chlamydophila pneumoniae CWL029
uuuuauaggaauaaca

SEQ ID NO: 497518 - RNA, 13 nt, Chlamydophila pneumoniae CWL029
uuuuacuaucucc

SEQ ID NO: 497519 - RNA, 12 nt, Chlamydophila pneumoniae CWL029
uuuuacucccug

SEQ ID NO: 497520 - RNA, 16 nt, Chlamydophila pneumoniae CWL029
uuuuacugaaauuaag

SEQ ID NO: 497521 - RNA, 20 nt, Chlamydophila pneumoniae CWL029
uuuuagaaauguuuuuaaac

SEQ ID NO: 497522 - RNA, 14 nt, Chlamydophila pneumoniae CWL029
uuuuagaacuucaa

SEQ ID NO: 497523 - RNA, 15 nt, Chlamydophila pneumoniae CWL029
uuuuagagccuuuuc

SEQ ID NO: 497524 - RNA, 19 nt, Chlamydophila pneumoniae CWL029
uuuuaaagauaaggaccag

SEQ ID NO: 497525 - RNA, 18 nt, Chlamydophila pneumoniae CWL029
uuuuaaagcaaaaauucu

SEQ ID NO: 497526 - RNA, 22 nt, Chlamydophila pneumoniae CWL029
uuuuaaagccuccucaagauaa

SEQ ID NO: 497527 - RNA, 14 nt, Chlamydophila pneumoniae CWL029
uuuuaaaaugauag

SEQ ID NO: 497528 - RNA, 16 nt, Chlamydophila pneumoniae CWL029
uuuuaaaaugugucuu

SEQ ID NO: 497529 - RNA, 19 nt, Chlamydophila pneumoniae CWL029
uuuuaaaaauauggggaaa

SEQ ID NO: 497530 - RNA, 18 nt, Chlamydophila pneumoniae CWL029
uuuguuaauagaagauca

SEQ ID NO: 497531 - RNA, 18 nt, Chlamydophila pneumoniae CWL029
uuuuaagugcuuuuagau

SEQ ID NO: 497532 - RNA, 14 nt, Chlamydophila pneumoniae CWL029
uuuuaauaaaauuu

SEQ ID NO: 497533 - RNA, 15 nt, Chlamydophila pneumoniae CWL029
uuuuaccauugagau

SEQ ID NO: 497534 - RNA, 13 nt, Chlamydophila pneumoniae CWL029
uuuuaauucaaaa

SEQ ID NO: 497535 - RNA, 17 nt, Chlamydophila pneumoniae CWL029
uuuuaauucaaaaagag

SEQ ID NO: 497536 - RNA, 19 nt, Chlamydophila pneumoniae CWL029
uuugguaucugauugcuaa

SEQ ID NO: 497537 - RNA, 23 nt, Chlamydophila pneumoniae CWL029
uuugggauaaaaaguuuuuguuc

SEQ ID NO: 497538 - RNA, 17 nt, Chlamydophila pneumoniae CWL029
uuuggcaguucacugag

SEQ ID NO: 497539 - RNA, 14 nt, Chlamydophila pneumoniae CWL029
uuugcugcucucca

SEQ ID NO: 497540 - RNA, 16 nt, Chlamydophila pneumoniae CWL029
uuugcugcgaaugucg

SEQ ID NO: 497541 - RNA, 18 nt, Chlamydophila pneumoniae CWL029
uuugcugcagcaaaacua

SEQ ID NO: 497542 - RNA, 18 nt, Chlamydophila pneumoniae CWL029
uuuggaaagcucuuucau

SEQ ID NO: 497543 - RNA, 14 nt, Chlamydophila pneumoniae CWL029
uuuggaaaugagag

SEQ ID NO: 497544 - RNA, 14 nt, Chlamydophila pneumoniae CWL029
uuuggagaagcuca

SEQ ID NO: 497545 - RNA, 15 nt, Chlamydophila pneumoniae CWL029
uuuguccuuugcuaa

SEQ ID NO: 497546 - RNA, 18 nt, Chlamydophila pneumoniae CWL029
uuugucguaauugcugaa

SEQ ID NO: 497547 - RNA, 16 nt, Chlamydophila pneumoniae CWL029
uuugucaucacaucag

SEQ ID NO: 497548 - RNA, 13 nt, Chlamydophila pneumoniae CWL029
uuugugaauuuua

SEQ ID NO: 497549 - RNA, 18 nt, Chlamydophila pneumoniae CWL029
uuugugaagauaagacca

SEQ ID NO: 497550 - RNA, 22 nt, Chlamydophila pneumoniae CWL029
uuugugauauucuuggaauaua

SEQ ID NO: 497551 - RNA, 22 nt, Chlamydophila pneumoniae CWL029
uuugugccccuccgauugcuaa

SEQ ID NO: 497552 - RNA, 19 nt, Chlamydophila pneumoniae CWL029
uuuguuaaacccaauucuu

SEQ ID NO: 497553 - RNA, 20 nt, Chlamydophila pneumoniae CWL029
uuuguaaaugucgguuuguu

SEQ ID NO: 497554 - RNA, 17 nt, Chlamydophila pneumoniae CWL029
uuuguaaucguuucaua

SEQ ID NO: 497555 - RNA, 13 nt, Chlamydophila pneumoniae CWL029
uuuguagauuagg

SEQ ID NO: 497556 - RNA, 14 nt, Chlamydophila pneumoniae CWL029
uuuguagcauuucu

SEQ ID NO: 497557 - RNA, 14 nt, Chlamydophila pneumoniae CWL029
uuuguaguguugaa

SEQ ID NO: 497558 - RNA, 21 nt, Chlamydophila pneumoniae CWL029
aagauauauuuuuaaagagag

SEQ ID NO: 497559 - RNA, 17 nt, Chlamydophila pneumoniae CWL029
aagauaucccaaagcua

SEQ ID NO: 497560 - RNA, 12 nt, Chlamydophila pneumoniae CWL029
aagauaucugcu

SEQ ID NO: 497561 - RNA, 18 nt, Chlamydophila pneumoniae CWL029
aagauagcgacgucauca

SEQ ID NO: 497562 - RNA, 19 nt, Chlamydophila pneumoniae CWL029
aagauagacucucacugag

SEQ ID NO: 497563 - RNA, 17 nt, Chlamydophila pneumoniae CWL029
aagauaaugucuccauc

SEQ ID NO: 497564 - RNA, 20 nt, Chlamydophila pneumoniae CWL029
aagauaaucuguaagaaaau

SEQ ID NO: 497565 - RNA, 20 nt, Chlamydophila pneumoniae CWL029
aagauaaucauuaagacuca

SEQ ID NO: 497566 - RNA, 19 nt, Chlamydophila pneumoniae CWL029
aagaucaauauagagaacu

SEQ ID NO: 497567 - RNA, 17 nt, Chlamydophila pneumoniae CWL029
aagaucuucauaaccaa

SEQ ID NO: 497568 - RNA, 19 nt, Chlamydophila pneumoniae CWL029
aagaucuccgccuacaaua

SEQ ID NO: 497569 - RNA, 23 nt, Chlamydophila pneumoniae CWL029
aagaucgucggaagacuuuuuaa

SEQ ID NO: 497570 - RNA, 18 nt, Chlamydophila pneumoniae CWL029
aagaucuugguuaugcua

SEQ ID NO: 497571 - RNA, 16 nt, Chlamydophila pneumoniae CWL029
aagaugaauaccagaa

SEQ ID NO: 497572 - RNA, 22 nt, Chlamydophila pneumoniae CWL029
aagaugaauaccagaagcaaag

SEQ ID NO: 497573 - RNA, 15 nt, Chlamydophila pneumoniae CWL029
aagaugagaaaaucu

SEQ ID NO: 497574 - RNA, 17 nt, Chlamydophila pneumoniae CWL029
aagaugcagauacuaaa

SEQ ID NO: 497575 - RNA, 18 nt, Chlamydophila pneumoniae CWL029
aagauggcaaggaaaauu

SEQ ID NO: 497576 - RNA, 21 nt, Chlamydophila pneumoniae CWL029
aagauguauaaggauaucuuc

SEQ ID NO: 497577 - RNA, 15 nt, Chlamydophila pneumoniae CWL029
aagauuuuuagaaua

SEQ ID NO: 497578 - RNA, 23 nt, Chlamydophila pneumoniae CWL029
aagauuuuaggggguuuuucuau

SEQ ID NO: 497579 - RNA, 15 nt, Chlamydophila pneumoniae CWL029
aagauuuccccaaga

SEQ ID NO: 497580 - RNA, 19 nt, Chlamydophila pneumoniae CWL029
aagauuuauuuugucuuuu

SEQ ID NO: 497581 - RNA, 18 nt, Chlamydophila pneumoniae CWL029
aagauugugcucaauaca

SEQ ID NO: 497582 - RNA, 19 nt, Chlamydophila pneumoniae CWL029
aagauuauuuguuucuucc

SEQ ID NO: 497583 - RNA, 24 nt, Chlamydophila pneumoniae CWL029
aagauuauuuguuucuuccauaca

SEQ ID NO: 497584 - RNA, 14 nt, Chlamydophila pneumoniae CWL029
aagauucaaagaag

SEQ ID NO: 497585 - RNA, 22 nt, Chlamydophila pneumoniae CWL029
aagauuccuaacuucugaagga

SEQ ID NO: 497586 - RNA, 22 nt, Chlamydophila pneumoniae CWL029
aagauucucagcuucaucagaa

SEQ ID NO: 497587 - RNA, 19 nt, Chlamydophila pneumoniae CWL029
aagauuccuuaccuauaua

SEQ ID NO: 497588 - RNA, 14 nt, Chlamydophila pneumoniae CWL029
aagauugaaggcac

SEQ ID NO: 497589 - RNA, 24 nt, Chlamydophila pneumoniae CWL029
aagauugcagguagauccuauagu

SEQ ID NO: 497590 - RNA, 13 nt, Chlamydophila pneumoniae CWL029
aagcagcgaagau

SEQ ID NO: 497591 - RNA, 14 nt, Chlamydophila pneumoniae CWL029
aagcagauagagcu

SEQ ID NO: 497592 - RNA, 12 nt, Chlamydophila pneumoniae CWL029
aagcagggaaaa

SEQ ID NO: 497593 - RNA, 21 nt, Chlamydophila pneumoniae CWL029
aagcaggugugugguaaaaau

SEQ ID NO: 497594 - RNA, 22 nt, Chlamydophila pneumoniae CWL029
aagcaggugugugguaaaaaua

SEQ ID NO: 497595 - RNA, 20 nt, Chlamydophila pneumoniae CWL029
aagcaguaacugcaaagaga

SEQ ID NO: 497596 - RNA, 18 nt, Chlamydophila pneumoniae CWL029
aagcauucugcuagagcu

SEQ ID NO: 497597 - RNA, 15 nt, Chlamydophila pneumoniae CWL029
aagcauugcaaauaa

SEQ ID NO: 497598 - RNA, 20 nt, Chlamydophila pneumoniae CWL029
aagcauugcaaauaagccag

SEQ ID NO: 497599 - RNA, 21 nt, Chlamydophila pneumoniae CWL029
aagcauuuuugggaaaagaaa

SEQ ID NO: 497600 - RNA, 15 nt, Chlamydophila pneumoniae CWL029
aagccaaaaggcaca

SEQ ID NO: 497601 - RNA, 21 nt, Chlamydophila pneumoniae CWL029
aagcauguuauauagacaaug

SEQ ID NO: 497602 - RNA, 14 nt, Chlamydophila pneumoniae CWL029
aagcaugaagcaga

SEQ ID NO: 497603 - RNA, 16 nt, Chlamydophila pneumoniae CWL029
aagcauagucgucuuu

SEQ ID NO: 497604 - RNA, 20 nt, Chlamydophila pneumoniae CWL029
aagcauagucgucuuuuaaa

SEQ ID NO: 497605 - RNA, 21 nt, Chlamydophila pneumoniae CWL029
aagcauagcccgaaauucauu

SEQ ID NO: 497606 - RNA, 18 nt, Chlamydophila pneumoniae CWL029
aagcaucuuucaucaaug

SEQ ID NO: 497607 - RNA, 17 nt, Chlamydophila pneumoniae CWL029
aagcauauuuaaauaua

SEQ ID NO: 497608 - RNA, 15 nt, Chlamydophila pneumoniae CWL029
aagcaucauugaaac

SEQ ID NO: 497609 - RNA, 19 nt, Chlamydophila pneumoniae CWL029
aagcacuuguuuuuucuuc

SEQ ID NO: 497610 - RNA, 20 nt, Chlamydophila pneumoniae CWL029
aagcacuuguuuuuucuucu

SEQ ID NO: 497611 - RNA, 22 nt, Chlamydophila pneumoniae CWL029
aagcacucuuaauuaaaaacug

SEQ ID NO: 497612 - RNA, 21 nt, Chlamydophila pneumoniae CWL029
aagcacuaaaagggaagcuuc

SEQ ID NO: 497613 - RNA, 14 nt, Chlamydophila pneumoniae CWL029
aagcacccucuuca

SEQ ID NO: 497614 - RNA, 22 nt, Chlamydophila pneumoniae CWL029
aagcaaucccccagcauucacu

SEQ ID NO: 497615 - RNA, 17 nt, Chlamydophila pneumoniae CWL029
aagcaccacgaccuaua

SEQ ID NO: 497616 - RNA, 18 nt, Chlamydophila pneumoniae CWL029
aagcacccucuucauccg

SEQ ID NO: 497617 - RNA, 13 nt, Chlamydophila pneumoniae CWL029
aagcaaaagauca

SEQ ID NO: 497618 - RNA, 13 nt, Chlamydophila pneumoniae CWL029
aagcaaaagcaag

SEQ ID NO: 497619 - RNA, 20 nt, Chlamydophila pneumoniae CWL029
aagcaaagauaaagaaguuu

SEQ ID NO: 497620 - RNA, 21 nt, Chlamydophila pneumoniae CWL029
aagcaaucccccagcauucac

SEQ ID NO: 497621 - RNA, 13 nt, Chlamydophila pneumoniae CWL029
aagcaauccagua

SEQ ID NO: 497622 - RNA, 17 nt, Chlamydophila pneumoniae CWL029
aagcaacuaaacucucc

SEQ ID NO: 497623 - RNA, 20 nt, Chlamydophila pneumoniae CWL029
aagauaaggaccagguguag

SEQ ID NO: 497624 - RNA, 14 nt, Chlamydophila pneumoniae CWL029
aagauaagaccaga

SEQ ID NO: 497625 - RNA, 19 nt, Chlamydophila pneumoniae CWL029
aagauaaacauuaagugau

SEQ ID NO: 497626 - RNA, 12 nt, Chlamydophila pneumoniae CWL029
aagauaaagaag

SEQ ID NO: 497627 - RNA, 13 nt, Chlamydophila pneumoniae CWL029
aagauaaagaagu

SEQ ID NO: 497628 - RNA, 16 nt, Chlamydophila pneumoniae CWL029
aagaguuuuuuagagg

SEQ ID NO: 497629 - RNA, 15 nt, Chlamydophila pneumoniae CWL029
aagauaaacagcaca

SEQ ID NO: 497630 - RNA, 15 nt, Chlamydophila pneumoniae CWL029
aagagugucuaagau

SEQ ID NO: 497631 - RNA, 13 nt, Chlamydophila pneumoniae CWL029
aagagugccaaga

SEQ ID NO: 497632 - RNA, 22 nt, Chlamydophila pneumoniae CWL029
aagagucuuugaugcuaaacga

SEQ ID NO: 497633 - RNA, 18 nt, Chlamydophila pneumoniae CWL029
aagaguagccccagcaac

SEQ ID NO: 497634 - RNA, 16 nt, Chlamydophila pneumoniae CWL029
aagagucccugauucc

SEQ ID NO: 497635 - RNA, 18 nt, Chlamydophila pneumoniae CWL029
aagaguccgaagccuuca

SEQ ID NO: 497636 - RNA, 20 nt, Chlamydophila pneumoniae CWL029
aagaggagugaaagcuucuu

SEQ ID NO: 497637 - RNA, 14 nt, Chlamydophila pneumoniae CWL029
aagaggaagaugau

SEQ ID NO: 497638 - RNA, 21 nt, Chlamydophila pneumoniae CWL029
aagagcuugucuuccacgaag

SEQ ID NO: 497639 - RNA, 22 nt, Chlamydophila pneumoniae CWL029
aagagcuuguucuguaacacuu

SEQ ID NO: 497640 - RNA, 16 nt, Chlamydophila pneumoniae CWL029
aagagcucuugagaaa

SEQ ID NO: 497641 - RNA, 22 nt, Chlamydophila pneumoniae CWL029
aagagcuuccauuggaauccuu

SEQ ID NO: 497642 - RNA, 22 nt, Chlamydophila pneumoniae CWL029
aagagcaagguaacauccauag

SEQ ID NO: 497643 - RNA, 17 nt, Chlamydophila pneumoniae CWL029
aagagcccccauaggaa

SEQ ID NO: 497644 - RNA, 15 nt, Chlamydophila pneumoniae CWL029
aagagcccuugaauc

SEQ ID NO: 497645 - RNA, 17 nt, Chlamydophila pneumoniae CWL029
aagagcuaaagaaacuu

SEQ ID NO: 497646 - RNA, 22 nt, Chlamydophila pneumoniae CWL029
aagagcucaucggaucuuuucu

SEQ ID NO: 497647 - RNA, 17 nt, Chlamydophila pneumoniae CWL029
aagagcucguaauccuu

SEQ ID NO: 497648 - RNA, 16 nt, Chlamydophila pneumoniae CWL029
aagagaauuauuauua

SEQ ID NO: 497649 - RNA, 15 nt, Chlamydophila pneumoniae CWL029
aagagacaagaaaau

SEQ ID NO: 497650 - RNA, 16 nt, Chlamydophila pneumoniae CWL029
aagagacaagaaaaua

SEQ ID NO: 497651 - RNA, 15 nt, Chlamydophila pneumoniae CWL029
aagagaaucuccuca

SEQ ID NO: 497652 - RNA, 23 nt, Chlamydophila pneumoniae CWL029
aagacuuuuuaaauagcaucccu

SEQ ID NO: 497653 - RNA, 21 nt, Chlamydophila pneumoniae CWL029
aagacuucgaugucuuuccag

SEQ ID NO: 497654 - RNA, 13 nt, Chlamydophila pneumoniae CWL029
aagacuugcucug

SEQ ID NO: 497655 - RNA, 19 nt, Chlamydophila pneumoniae CWL029
aagacuuguucuucauuau

SEQ ID NO: 497656 - RNA, 22 nt, Chlamydophila pneumoniae CWL029
aagagagcuugucacacugcga

SEQ ID NO: 497657 - RNA, 16 nt, Chlamydophila pneumoniae CWL029
aagagcaaacaucaaa

SEQ ID NO: 497658 - RNA, 21 nt, Chlamydophila pneumoniae CWL029
aagagcaaacaucaaagagag

SEQ ID NO: 497659 - RNA, 23 nt, Chlamydophila pneumoniae CWL029
aagagauugauuucuugcuuuua

SEQ ID NO: 497660 - RNA, 15 nt, Chlamydophila pneumoniae CWL029
aagagauauagguau

SEQ ID NO: 497661 - RNA, 22 nt, Chlamydophila pneumoniae CWL029
aagagauauagguaucagcaag

SEQ ID NO: 497662 - RNA, 16 nt, Chlamydophila pneumoniae CWL029
aagacugaaaagaucg

SEQ ID NO: 497663 - RNA, 19 nt, Chlamydophila pneumoniae CWL029
aagacucucaucagcaaaa

SEQ ID NO: 497664 - RNA, 20 nt, Chlamydophila pneumoniae CWL029
aagacuagcuuuuuuuauga

SEQ ID NO: 497665 - RNA, 15 nt, Chlamydophila pneumoniae CWL029
aagacucaaagaacu

SEQ ID NO: 497666 - RNA, 19 nt, Chlamydophila pneumoniae CWL029
aagacucaugaaauagugu

SEQ ID NO: 497667 - RNA, 15 nt, Chlamydophila pneumoniae CWL029
aagacuguguuuuau

SEQ ID NO: 497668 - RNA, 14 nt, Chlamydophila pneumoniae CWL029
aagacugucuauga

SEQ ID NO: 497669 - RNA, 16 nt, Chlamydophila pneumoniae CWL029
aagacgagaacaugac

SEQ ID NO: 497670 - RNA, 15 nt, Chlamydophila pneumoniae CWL029
aagaccuaacgcaac

SEQ ID NO: 497671 - RNA, 17 nt, Chlamydophila pneumoniae CWL029
aagacauucauuuuuua

SEQ ID NO: 497672 - RNA, 20 nt, Chlamydophila pneumoniae CWL029
aagacauucauuuuuuaaua

SEQ ID NO: 497673 - RNA, 16 nt, Chlamydophila pneumoniae CWL029
aagaccaccuucccca

SEQ ID NO: 497674 - RNA, 22 nt, Chlamydophila pneumoniae CWL029
aagacauccuucuuuaccuaug

SEQ ID NO: 497675 - RNA, 16 nt, Chlamydophila pneumoniae CWL029
aagacauuauagaggu

SEQ ID NO: 497676 - RNA, 22 nt, Chlamydophila pneumoniae CWL029
aagaauucuuugccaaggaccu

SEQ ID NO: 497677 - RNA, 15 nt, Chlamydophila pneumoniae CWL029
aagaauucagagaaa

SEQ ID NO: 497678 - RNA, 17 nt, Chlamydophila pneumoniae CWL029
aagaauuucauaagaga

SEQ ID NO: 497679 - RNA, 17 nt, Chlamydophila pneumoniae CWL029
aagacaccgaaagaaau

SEQ ID NO: 497680 - RNA, 13 nt, Chlamydophila pneumoniae CWL029
aagacaagagaag

SEQ ID NO: 497681 - RNA, 18 nt, Chlamydophila pneumoniae CWL029
aagacaauaaaaaagaga

SEQ ID NO: 497682 - RNA, 17 nt, Chlamydophila pneumoniae CWL029
aagacaauaaaaaagag

SEQ ID NO: 497683 - RNA, 15 nt, Chlamydophila pneumoniae CWL029
aagaauagcaggaag

SEQ ID NO: 497684 - RNA, 22 nt, Chlamydophila pneumoniae CWL029
aagaauaauagcaaguagcucu

SEQ ID NO: 497685 - RNA, 15 nt, Chlamydophila pneumoniae CWL029
aaauugaaaucuuua

SEQ ID NO: 497686 - RNA, 22 nt, Chlamydophila pneumoniae CWL029
aagaaucgccgcuugaggagga

SEQ ID NO: 497687 - RNA, 19 nt, Chlamydophila pneumoniae CWL029
aagaauaucuuuugaaucu

SEQ ID NO: 497688 - RNA, 18 nt, Chlamydophila pneumoniae CWL029
aagaauagcguagaggac

SEQ ID NO: 497689 - RNA, 14 nt, Chlamydophila pneumoniae CWL029
aagaaugacacaga

SEQ ID NO: 497690 - RNA, 21 nt, Chlamydophila pneumoniae CWL029
aagaauguagcuguuccaaga

SEQ ID NO: 497691 - RNA, 17 nt, Chlamydophila pneumoniae CWL029
aagucaccuuacaucca

SEQ ID NO: 497692 - RNA, 23 nt, Chlamydophila pneumoniae CWL029
aaguaucuucaguagaguuagaa

SEQ ID NO: 497693 - RNA, 22 nt, Chlamydophila pneumoniae CWL029
aaguaucuugauguuugucaca

SEQ ID NO: 497694 - RNA, 17 nt, Chlamydophila pneumoniae CWL029
aaguaagguuccaaaaa

SEQ ID NO: 497695 - RNA, 16 nt, Chlamydophila pneumoniae CWL029
aaguaacuaucuacac

SEQ ID NO: 497696 - RNA, 20 nt, Chlamydophila pneumoniae CWL029
aaguaacuaucuacacagua

SEQ ID NO: 497697 - RNA, 14 nt, Chlamydophila pneumoniae CWL029
aaguccacaagccu

SEQ ID NO: 497698 - RNA, 20 nt, Chlamydophila pneumoniae CWL029
aaguccgauagcaaugaugu

SEQ ID NO: 497699 - RNA, 19 nt, Chlamydophila pneumoniae CWL029
aagucagccaagacaaaaa

SEQ ID NO: 497700 - RNA, 16 nt, Chlamydophila pneumoniae CWL029
aaguccaacaucagcu

SEQ ID NO: 497701 - RNA, 13 nt, Chlamydophila pneumoniae CWL029
aagucuccauaau

SEQ ID NO: 497702 - RNA, 19 nt, Chlamydophila pneumoniae CWL029
aaguccuccauguacaguu

SEQ ID NO: 497703 - RNA, 20 nt, Chlamydophila pneumoniae CWL029
aagugcuuucaggaguucuu

SEQ ID NO: 497704 - RNA, 20 nt, Chlamydophila pneumoniae CWL029
aauaaacugacguuuuuccc

SEQ ID NO: 497705 - RNA, 12 nt, Chlamydophila pneumoniae CWL029
aauaaaauuuaa

SEQ ID NO: 497706 - RNA, 15 nt, Chlamydophila pneumoniae CWL029
aauaaaauuuaaaaa

SEQ ID NO: 497707 - RNA, 18 nt, Chlamydophila pneumoniae CWL029
aauaaaauuuaaaaaaau

SEQ ID NO: 497708 - RNA, 14 nt, Chlamydophila pneumoniae CWL029
aauaaaauguccaa

SEQ ID NO: 497709 - RNA, 12 nt, Chlamydophila pneumoniae CWL029
aauaaaaugauu

SEQ ID NO: 497710 - RNA, 13 nt, Chlamydophila pneumoniae CWL029
aauaaaagcaccc

SEQ ID NO: 497711 - RNA, 16 nt, Chlamydophila pneumoniae CWL029
aauaaaacuuucuuuu

SEQ ID NO: 497712 - RNA, 12 nt, Chlamydophila pneumoniae CWL029
aauaaaagaaag

SEQ ID NO: 497713 - RNA, 21 nt, Chlamydophila pneumoniae CWL029
aaguuuuuuaagugcuuuuag

SEQ ID NO: 497714 - RNA, 20 nt, Chlamydophila pneumoniae CWL029
aaguuuuuucucucuuuauc

SEQ ID NO: 497715 - RNA, 14 nt, Chlamydophila pneumoniae CWL029
aauaaaaaagagag

SEQ ID NO: 497716 - RNA, 17 nt, Chlamydophila pneumoniae CWL029
aaguuguagugaaugag

SEQ ID NO: 497717 - RNA, 19 nt, Chlamydophila pneumoniae CWL029
aaguuguuuauuuagcauu

SEQ ID NO: 497718 - RNA, 17 nt, Chlamydophila pneumoniae CWL029
aaguucuuggaaaaaag

SEQ ID NO: 497719 - RNA, 19 nt, Chlamydophila pneumoniae CWL029
aaguucuuggaaaaaagga

SEQ ID NO: 497720 - RNA, 12 nt, Chlamydophila pneumoniae CWL029
aaguuccuucag

SEQ ID NO: 497721 - RNA, 19 nt, Chlamydophila pneumoniae CWL029
aaguucggcgccuucaaaa

SEQ ID NO: 497722 - RNA, 14 nt, Chlamydophila pneumoniae CWL029
aaguuacuuucuga

SEQ ID NO: 497723 - RNA, 19 nt, Chlamydophila pneumoniae CWL029
aaguuugauaagcuaacac

SEQ ID NO: 497724 - RNA, 19 nt, Chlamydophila pneumoniae CWL029
aaguuuguauuuucuacau

SEQ ID NO: 497725 - RNA, 20 nt, Chlamydophila pneumoniae CWL029
aaguuuguauuuucuacauu

SEQ ID NO: 497726 - RNA, 17 nt, Chlamydophila pneumoniae CWL029
aaguuuucgauacacaa

SEQ ID NO: 497727 - RNA, 22 nt, Chlamydophila pneumoniae CWL029
aaguuuugguuuuagaaauguu

SEQ ID NO: 497728 - RNA, 12 nt, Chlamydophila pneumoniae CWL029
aaguuuugcucu

SEQ ID NO: 497729 - RNA, 17 nt, Chlamydophila pneumoniae CWL029
aagguuuccaugagaau

SEQ ID NO: 497730 - RNA, 14 nt, Chlamydophila pneumoniae CWL029
aagguuuuaaauuu

SEQ ID NO: 497731 - RNA, 22 nt, Chlamydophila pneumoniae CWL029
aagguugcuaagaucuuuagaa

SEQ ID NO: 497732 - RNA, 22 nt, Chlamydophila pneumoniae CWL029
aagguugagacguaaccacagg

SEQ ID NO: 497733 - RNA, 17 nt, Chlamydophila pneumoniae CWL029
aagguaaauuuuuaaaa

SEQ ID NO: 497734 - RNA, 21 nt, Chlamydophila pneumoniae CWL029
aagguaacauccauagagaac

SEQ ID NO: 497735 - RNA, 15 nt, Chlamydophila pneumoniae CWL029
aagguagaguccaca

SEQ ID NO: 497736 - RNA, 16 nt, Chlamydophila pneumoniae CWL029
aaggucugcgucuuua

SEQ ID NO: 497737 - RNA, 16 nt, Chlamydophila pneumoniae CWL029
aagguauuaggaagua

SEQ ID NO: 497738 - RNA, 19 nt, Chlamydophila pneumoniae CWL029
aaggcugcugauccaaaag

SEQ ID NO: 497739 - RNA, 14 nt, Chlamydophila pneumoniae CWL029
aaggcuugaggauu

SEQ ID NO: 497740 - RNA, 20 nt, Chlamydophila pneumoniae CWL029
aagguaaaacuacaggaaaa

SEQ ID NO: 497741 - RNA, 17 nt, Chlamydophila pneumoniae CWL029
aaggcugauugaaaguc

SEQ ID NO: 497742 - RNA, 18 nt, Chlamydophila pneumoniae CWL029
aaggcugcuugagacuug

SEQ ID NO: 497743 - RNA, 18 nt, Chlamydophila pneumoniae CWL029
aaggccuaaucuuguagc

SEQ ID NO: 497744 - RNA, 19 nt, Chlamydophila pneumoniae CWL029
aaggcacuccaaaacucaa

SEQ ID NO: 497745 - RNA, 22 nt, Chlamydophila pneumoniae CWL029
aaggauuugcucuguaguaaag

SEQ ID NO: 497746 - RNA, 12 nt, Chlamydophila pneumoniae CWL029
aaggcaagaugu

SEQ ID NO: 497747 - RNA, 19 nt, Chlamydophila pneumoniae CWL029
aaggcacaacaaugacauu

SEQ ID NO: 497748 - RNA, 15 nt, Chlamydophila pneumoniae CWL029
aaggcaccaacacuu

SEQ ID NO: 497749 - RNA, 21 nt, Chlamydophila pneumoniae CWL029
aaggauaucaugcaauacuuu

SEQ ID NO: 497750 - RNA, 16 nt, Chlamydophila pneumoniae CWL029
aaggauuggaugagaa

SEQ ID NO: 497751 - RNA, 14 nt, Chlamydophila pneumoniae CWL029
aaggagauuccuaa

SEQ ID NO: 497752 - RNA, 16 nt, Chlamydophila pneumoniae CWL029
aaggacaaaucuccca

SEQ ID NO: 497753 - RNA, 20 nt, Chlamydophila pneumoniae CWL029
aaggaagaucuugaacagag

SEQ ID NO: 497754 - RNA, 21 nt, Chlamydophila pneumoniae CWL029
aaggaagggauguuuaauaca

SEQ ID NO: 497755 - RNA, 22 nt, Chlamydophila pneumoniae CWL029
aaggaagggauguuuaauacaa

SEQ ID NO: 497756 - RNA, 15 nt, Chlamydophila pneumoniae CWL029
aaggaagguucucaa

SEQ ID NO: 497757 - RNA, 21 nt, Chlamydophila pneumoniae CWL029
aaggaauaugcucuccuugua

SEQ ID NO: 497758 - RNA, 22 nt, Chlamydophila pneumoniae CWL029
aagcuuguuccacuugcucuuu

SEQ ID NO: 497759 - RNA, 12 nt, Chlamydophila pneumoniae CWL029
aagcugugcauu

SEQ ID NO: 497760 - RNA, 19 nt, Chlamydophila pneumoniae CWL029
aagcugugcauuuucuucu

SEQ ID NO: 497761 - RNA, 19 nt, Chlamydophila pneumoniae CWL029
aagcuguggcgauuuuacu

SEQ ID NO: 497762 - RNA, 18 nt, Chlamydophila pneumoniae CWL029
aagcugugguaucgaugu

SEQ ID NO: 497763 - RNA, 17 nt, Chlamydophila pneumoniae CWL029
aagcugucgcaaaugca

SEQ ID NO: 497764 - RNA, 18 nt, Chlamydophila pneumoniae CWL029
aagcugcuucuucagagu

SEQ ID NO: 497765 - RNA, 15 nt, Chlamydophila pneumoniae CWL029
aagcugcaaacugau

SEQ ID NO: 497766 - RNA, 23 nt, Chlamydophila pneumoniae CWL029
aagcuauagauuuuggagacaca

SEQ ID NO: 497767 - RNA, 21 nt, Chlamydophila pneumoniae CWL029
aagcuacggaugggcacucuu

SEQ ID NO: 497768 - RNA, 20 nt, Chlamydophila pneumoniae CWL029
aagcuaauaagauccaaaaa

SEQ ID NO: 497769 - RNA, 16 nt, Chlamydophila pneumoniae CWL029
aagcucuucuacuuua

SEQ ID NO: 497770 - RNA, 14 nt, Chlamydophila pneumoniae CWL029
aagcucuuaauuuc

SEQ ID NO: 497771 - RNA, 15 nt, Chlamydophila pneumoniae CWL029
aagcucuacaagcuc

SEQ ID NO: 497772 - RNA, 11 nt, Chlamydophila pneumoniae CWL029
aagcucucucc

SEQ ID NO: 497773 - RNA, 16 nt, Chlamydophila pneumoniae CWL029
aagcucguacuguucc

SEQ ID NO: 497774 - RNA, 16 nt, Chlamydophila pneumoniae CWL029
aagcucgaccucuagc

SEQ ID NO: 497775 - RNA, 14 nt, Chlamydophila pneumoniae CWL029
aagccaaauaccaa

SEQ ID NO: 497776 - RNA, 15 nt, Chlamydophila pneumoniae CWL029
aagccaagaagaugu

SEQ ID NO: 497777 - RNA, 14 nt, Chlamydophila pneumoniae CWL029
aagccacagagaau

SEQ ID NO: 497778 - RNA, 18 nt, Chlamydophila pneumoniae CWL029
aagccacauucuucugau

SEQ ID NO: 497779 - RNA, 14 nt, Chlamydophila pneumoniae CWL029
aagcggagcaucuu

SEQ ID NO: 497780 - RNA, 18 nt, Chlamydophila pneumoniae CWL029
aagcggaguccuucuugc

SEQ ID NO: 497781 - RNA, 20 nt, Chlamydophila pneumoniae CWL029
aauguuuaucgacucuucca

SEQ ID NO: 497782 - RNA, 22 nt, Chlamydophila pneumoniae CWL029
aauguuuagaauuuguccuuug

SEQ ID NO: 497783 - RNA, 19 nt, Chlamydophila pneumoniae CWL029
aauguuuggccaacagcua

SEQ ID NO: 497784 - RNA, 22 nt, Chlamydophila pneumoniae CWL029
aauguugcuaagcgaaccaaag

SEQ ID NO: 497785 - RNA, 23 nt, Chlamydophila pneumoniae CWL029
aauguuuuccucgaguauggcaa

SEQ ID NO: 497786 - RNA, 12 nt, Chlamydophila pneumoniae CWL029
aauuaaaaguuc

SEQ ID NO: 497787 - RNA, 22 nt, Chlamydophila pneumoniae CWL029
aauguuaacgaauugcuuuccc

SEQ ID NO: 497788 - RNA, 18 nt, Chlamydophila pneumoniae CWL029
aaugugcucggacagaaa

SEQ ID NO: 497789 - RNA, 14 nt, Chlamydophila pneumoniae CWL029
aauuaaacuuucuu

SEQ ID NO: 497790 - RNA, 13 nt, Chlamydophila pneumoniae CWL029
aauuaagaaacua

SEQ ID NO: 497791 - RNA, 15 nt, Chlamydophila pneumoniae CWL029
aauuaccauuuugca

SEQ ID NO: 497792 - RNA, 21 nt, Chlamydophila pneumoniae CWL029
aauuaccuugagacaaagaau

SEQ ID NO: 497793 - RNA, 18 nt, Chlamydophila pneumoniae CWL029
aauuaccuugagacaaag

SEQ ID NO: 497794 - RNA, 14 nt, Chlamydophila pneumoniae CWL029
aauuacuuggauaa

SEQ ID NO: 497795 - RNA, 23 nt, Chlamydophila pneumoniae CWL029
aauuacuuggauaacacgaguuu

SEQ ID NO: 497796 - RNA, 15 nt, Chlamydophila pneumoniae CWL029
aauuagaaucagagg

SEQ ID NO: 497797 - RNA, 17 nt, Chlamydophila pneumoniae CWL029
aauuagagaaauuuuua

SEQ ID NO: 497798 - RNA, 15 nt, Chlamydophila pneumoniae CWL029
aauguauugcaaaua

SEQ ID NO: 497799 - RNA, 19 nt, Chlamydophila pneumoniae CWL029
aaugugacgcaagagacaa

SEQ ID NO: 497800 - RNA, 22 nt, Chlamydophila pneumoniae CWL029
aaugucgguuuguuaaacccaa

SEQ ID NO: 497801 - RNA, 14 nt, Chlamydophila pneumoniae CWL029
aaugucgucucaga

SEQ ID NO: 497802 - RNA, 24 nt, Chlamydophila pneumoniae CWL029
aauguauaggcauuaauaacuuua

SEQ ID NO: 497803 - RNA, 21 nt, Chlamydophila pneumoniae CWL029
aauguaucggggauugcaaaa

SEQ ID NO: 497804 - RNA, 20 nt, Chlamydophila pneumoniae CWL029
aaugcuacgguuuucugccu

SEQ ID NO: 497805 - RNA, 14 nt, Chlamydophila pneumoniae CWL029
aaugcucacuucuu

SEQ ID NO: 497806 - RNA, 22 nt, Chlamydophila pneumoniae CWL029
aaugcuccuugggucuuuuuau

SEQ ID NO: 497807 - RNA, 19 nt, Chlamydophila pneumoniae CWL029
aaugccauucuuaucugcu

SEQ ID NO: 497808 - RNA, 19 nt, Chlamydophila pneumoniae CWL029
aaugcagauagcuuacaga

SEQ ID NO: 497809 - RNA, 13 nt, Chlamydophila pneumoniae CWL029
aaugccagcagcg

SEQ ID NO: 497810 - RNA, 18 nt, Chlamydophila pneumoniae CWL029
aaugcuguagauuguuag

SEQ ID NO: 497811 - RNA, 23 nt, Chlamydophila pneumoniae CWL029
aauggauuccauaggggaugauu

SEQ ID NO: 497812 - RNA, 20 nt, Chlamydophila pneumoniae CWL029
aauggcagcuuggaugggaa

SEQ ID NO: 497813 - RNA, 21 nt, Chlamydophila pneumoniae CWL029
aauggcagcuuggaugggaau

SEQ ID NO: 497814 - RNA, 18 nt, Chlamydophila pneumoniae CWL029
aaucgcacuucuauuucu

SEQ ID NO: 497815 - RNA, 22 nt, Chlamydophila pneumoniae CWL029
aaucguucccaucacauaaauc

SEQ ID NO: 497816 - RNA, 21 nt, Chlamydophila pneumoniae CWL029
aaucguucuuagcgcauguau

SEQ ID NO: 497817 - RNA, 15 nt, Chlamydophila pneumoniae CWL029
aauccuuuggaagcu

SEQ ID NO: 497818 - RNA, 16 nt, Chlamydophila pneumoniae CWL029
aauccuuuauguauaa

SEQ ID NO: 497819 - RNA, 18 nt, Chlamydophila pneumoniae CWL029
aauccuuuggaagcuauc

SEQ ID NO: 497820 - RNA, 17 nt, Chlamydophila pneumoniae CWL029
aaucgauaacguugccu

SEQ ID NO: 497821 - RNA, 19 nt, Chlamydophila pneumoniae CWL029
aaucgagagaagaaauucu

SEQ ID NO: 497822 - RNA, 23 nt, Chlamydophila pneumoniae CWL029
aaucgagagaagaaauucugacu

SEQ ID NO: 497823 - RNA, 13 nt, Chlamydophila pneumoniae CWL029
aaucuaagaacua

SEQ ID NO: 497824 - RNA, 21 nt, Chlamydophila pneumoniae CWL029
aaucuaaguaaaacugcgcua

SEQ ID NO: 497825 - RNA, 20 nt, Chlamydophila pneumoniae CWL029
aaucguuucuauagacucua

SEQ ID NO: 497826 - RNA, 23 nt, Chlamydophila pneumoniae CWL029
aaucguuucucuggcaaugacuu

SEQ ID NO: 497827 - RNA, 14 nt, Chlamydophila pneumoniae CWL029
aaucuaaaaccuga

SEQ ID NO: 497828 - RNA, 14 nt, Chlamydophila pneumoniae CWL029
aaucuaaaaucaca

SEQ ID NO: 497829 - RNA, 19 nt, Chlamydophila pneumoniae CWL029
aaucucaaaaucaaauaga

SEQ ID NO: 497830 - RNA, 22 nt, Chlamydophila pneumoniae CWL029
aaucucagugaacucuucaaga

SEQ ID NO: 497831 - RNA, 19 nt, Chlamydophila pneumoniae CWL029
aaucucagugaacucuuca

SEQ ID NO: 497832 - RNA, 18 nt, Chlamydophila pneumoniae CWL029
aaucucaucuggaaaagc

SEQ ID NO: 497833 - RNA, 22 nt, Chlamydophila pneumoniae CWL029
aaucucauuccagcaucuucuc

SEQ ID NO: 497834 - RNA, 21 nt, Chlamydophila pneumoniae CWL029
aaucucuuuaaaaauuaaagu

SEQ ID NO: 497835 - RNA, 20 nt, Chlamydophila pneumoniae CWL029
aaucucuucuguaggaacaa

SEQ ID NO: 497836 - RNA, 13 nt, Chlamydophila pneumoniae CWL029
aaucugaaucuca

SEQ ID NO: 497837 - RNA, 21 nt, Chlamydophila pneumoniae CWL029
aaucugaaugccugccaaucc

SEQ ID NO: 497838 - RNA, 16 nt, Chlamydophila pneumoniae CWL029
aaucugaaucucauaa

SEQ ID NO: 497839 - RNA, 22 nt, Chlamydophila pneumoniae CWL029
aaucugacgugcauugaauccu

SEQ ID NO: 497840 - RNA, 22 nt, Chlamydophila pneumoniae CWL029
aaucugagcacauuuuucuaua

SEQ ID NO: 497841 - RNA, 11 nt, Chlamydophila pneumoniae CWL029
aaucugauuca

SEQ ID NO: 497842 - RNA, 13 nt, Chlamydophila pneumoniae CWL029
aaucucuaagaau

SEQ ID NO: 497843 - RNA, 23 nt, Chlamydophila pneumoniae CWL029
aaucucuagggauaauuaaacuc

SEQ ID NO: 497844 - RNA, 17 nt, Chlamydophila pneumoniae CWL029
aaucucuaugcgcucua

SEQ ID NO: 497845 - RNA, 23 nt, Chlamydophila pneumoniae CWL029
aaucucgcuauuccauaaaaaug

SEQ ID NO: 497846 - RNA, 15 nt, Chlamydophila pneumoniae CWL029
aaucucgcuauucca

SEQ ID NO: 497847 - RNA, 16 nt, Chlamydophila pneumoniae CWL029
aaucuccucaucagag

SEQ ID NO: 497848 - RNA, 14 nt, Chlamydophila pneumoniae CWL029
aaucuccucucuca

SEQ ID NO: 497849 - RNA, 14 nt, Chlamydophila pneumoniae CWL029
aaucugcaagauua

SEQ ID NO: 497850 - RNA, 12 nt, Chlamydophila pneumoniae CWL029
aaucuggaagca

SEQ ID NO: 497851 - RNA, 20 nt, Chlamydophila pneumoniae CWL029
aaucuuccuuaaccuccuca

SEQ ID NO: 497852 - RNA, 19 nt, Chlamydophila pneumoniae CWL029
aaucuucuuagccaaaauu

SEQ ID NO: 497853 - RNA, 13 nt, Chlamydophila pneumoniae CWL029
aaugacacagaga

SEQ ID NO: 497854 - RNA, 14 nt, Chlamydophila pneumoniae CWL029
aaugacacagagaa

SEQ ID NO: 497855 - RNA, 16 nt, Chlamydophila pneumoniae CWL029
aaugacagcugagaaa

SEQ ID NO: 497856 - RNA, 18 nt, Chlamydophila pneumoniae CWL029
aaugaagucuucuuuccc

SEQ ID NO: 497857 - RNA, 20 nt, Chlamydophila pneumoniae CWL029
aaugaagucuucuuucccca

SEQ ID NO: 497858 - RNA, 21 nt, Chlamydophila pneumoniae CWL029
aaucuuguagcaauuaccugc

SEQ ID NO: 497859 - RNA, 14 nt, Chlamydophila pneumoniae CWL029
aaucuuguaaguua

SEQ ID NO: 497860 - RNA, 18 nt, Chlamydophila pneumoniae CWL029
aaucuuuaagguugcuuu

SEQ ID NO: 497861 - RNA, 14 nt, Chlamydophila pneumoniae CWL029
aaucuuugaagcuc

SEQ ID NO: 497862 - RNA, 12 nt, Chlamydophila pneumoniae CWL029
aaugauaagaaa

SEQ ID NO: 497863 - RNA, 22 nt, Chlamydophila pneumoniae CWL029
aaugaggguggaacuauccugu

SEQ ID NO: 497864 - RNA, 17 nt, Chlamydophila pneumoniae CWL029
aaugacuuuagaaauuc

SEQ ID NO: 497865 - RNA, 17 nt, Chlamydophila pneumoniae CWL029
aaugauauaaaagcuga

SEQ ID NO: 497866 - RNA, 14 nt, Chlamydophila pneumoniae CWL029
aaugauauuacaga

SEQ ID NO: 497867 - RNA, 17 nt, Chlamydophila pneumoniae CWL029
aaugaucaaaaaugaua

SEQ ID NO: 497868 - RNA, 16 nt, Chlamydophila pneumoniae CWL029
aaugcaagcaacucuu

SEQ ID NO: 497869 - RNA, 13 nt, Chlamydophila pneumoniae CWL029
aauacuucuccug

SEQ ID NO: 497870 - RNA, 15 nt, Chlamydophila pneumoniae CWL029
aauacuucuccugaa

SEQ ID NO: 497871 - RNA, 21 nt, Chlamydophila pneumoniae CWL029
aauagaacgaauuucaacagc

SEQ ID NO: 497872 - RNA, 19 nt, Chlamydophila pneumoniae CWL029
aauacuguucgauaagaac

SEQ ID NO: 497873 - RNA, 19 nt, Chlamydophila pneumoniae CWL029
aauacuuaggaauuuuucu

SEQ ID NO: 497874 - RNA, 21 nt, Chlamydophila pneumoniae CWL029
aauacuuaggaauuuuucuag

SEQ ID NO: 497875 - RNA, 18 nt, Chlamydophila pneumoniae CWL029
aauacuuaggaauuuuuc

SEQ ID NO: 497876 - RNA, 17 nt, Chlamydophila pneumoniae CWL029
aauacguuuuuaggguu

SEQ ID NO: 497877 - RNA, 12 nt, Chlamydophila pneumoniae CWL029
aauacuaagaag

SEQ ID NO: 497878 - RNA, 14 nt, Chlamydophila pneumoniae CWL029
aauacuccacuuuu

SEQ ID NO: 497879 - RNA, 16 nt, Chlamydophila pneumoniae CWL029
aauacgaucugcuuug

SEQ ID NO: 497880 - RNA, 15 nt, Chlamydophila pneumoniae CWL029
aauacguccagccug

SEQ ID NO: 497881 - RNA, 23 nt, Chlamydophila pneumoniae CWL029
aauacguccagccugcaccagac

SEQ ID NO: 497882 - RNA, 13 nt, Chlamydophila pneumoniae CWL029
aauaccagaagca

SEQ ID NO: 497883 - RNA, 14 nt, Chlamydophila pneumoniae CWL029
aauaccagaagcaa

SEQ ID NO: 497884 - RNA, 18 nt, Chlamydophila pneumoniae CWL029
aauaccagauaaagcaaa

SEQ ID NO: 497885 - RNA, 22 nt, Chlamydophila pneumoniae CWL029
aauaccagauaaagcaaagaua

SEQ ID NO: 497886 - RNA, 15 nt, Chlamydophila pneumoniae CWL029
aauaccaucucuuuc

SEQ ID NO: 497887 - RNA, 21 nt, Chlamydophila pneumoniae CWL029
aauaccaucucuuucuauuuc

SEQ ID NO: 497888 - RNA, 22 nt, Chlamydophila pneumoniae CWL029
aauacauagguaaaaccagcau

SEQ ID NO: 497889 - RNA, 13 nt, Chlamydophila pneumoniae CWL029
aauacaggagaau

SEQ ID NO: 497890 - RNA, 15 nt, Chlamydophila pneumoniae CWL029
aauacagccagcaga

SEQ ID NO: 497891 - RNA, 17 nt, Chlamydophila pneumoniae CWL029
aauacagccagcagaag

SEQ ID NO: 497892 - RNA, 17 nt, Chlamydophila pneumoniae CWL029
aauacagacagaugcuu

SEQ ID NO: 497893 - RNA, 14 nt, Chlamydophila pneumoniae CWL029
aauaaaguccucca

SEQ ID NO: 497894 - RNA, 21 nt, Chlamydophila pneumoniae CWL029
aauagcucugcgccaugcaca

SEQ ID NO: 497895 - RNA, 15 nt, Chlamydophila pneumoniae CWL029
aauagcucuggagau

SEQ ID NO: 497896 - RNA, 14 nt, Chlamydophila pneumoniae CWL029
aauagcucuuuuca

SEQ ID NO: 497897 - RNA, 15 nt, Chlamydophila pneumoniae CWL029
aauagcucuuuucau

SEQ ID NO: 497898 - RNA, 18 nt, Chlamydophila pneumoniae CWL029
aauagcucuuuucaugau

SEQ ID NO: 497899 - RNA, 20 nt, Chlamydophila pneumoniae CWL029
aauagaggaccgaaaaaccu

SEQ ID NO: 497900 - RNA, 15 nt, Chlamydophila pneumoniae CWL029
aauagcuaaagugau

SEQ ID NO: 497901 - RNA, 15 nt, Chlamydophila pneumoniae CWL029
aauagacacuugcuu

SEQ ID NO: 497902 - RNA, 13 nt, Chlamydophila pneumoniae CWL029
aauagagaaacuu

SEQ ID NO: 497903 - RNA, 16 nt, Chlamydophila pneumoniae CWL029
aauagagaaagagugc

SEQ ID NO: 497904 - RNA, 21 nt, Chlamydophila pneumoniae CWL029
aauagagaagaagcaaaagau

SEQ ID NO: 497905 - RNA, 15 nt, Chlamydophila pneumoniae CWL029
aauaggauaagaaau

SEQ ID NO: 497906 - RNA, 16 nt, Chlamydophila pneumoniae CWL029
aauaggauaagaaauu

SEQ ID NO: 497907 - RNA, 19 nt, Chlamydophila pneumoniae CWL029
aauagcuuacuuucuuuua

SEQ ID NO: 497908 - RNA, 13 nt, Chlamydophila pneumoniae CWL029
aauauaaauuuau

SEQ ID NO: 497909 - RNA, 23 nt, Chlamydophila pneumoniae CWL029
aauauaacugcauacaaggcaca

SEQ ID NO: 497910 - RNA, 13 nt, Chlamydophila pneumoniae CWL029
aauaucacauucc

SEQ ID NO: 497911 - RNA, 20 nt, Chlamydophila pneumoniae CWL029
aauaucaccuacaucagacu

SEQ ID NO: 497912 - RNA, 22 nt, Chlamydophila pneumoniae CWL029
aauaucgaguucuuuuugcaga

SEQ ID NO: 497913 - RNA, 14 nt, Chlamydophila pneumoniae CWL029
aauauucaacaugu

SEQ ID NO: 497914 - RNA, 20 nt, Chlamydophila pneumoniae CWL029
aauauuaacccaccagaagg

SEQ ID NO: 497915 - RNA, 18 nt, Chlamydophila pneumoniae CWL029
aauauuugagaagauaug

SEQ ID NO: 497916 - RNA, 14 nt, Chlamydophila pneumoniae CWL029
aaucaacaucacaa

SEQ ID NO: 497917 - RNA, 20 nt, Chlamydophila pneumoniae CWL029
aaucaagccacagagaauug

SEQ ID NO: 497918 - RNA, 13 nt, Chlamydophila pneumoniae CWL029
aaucaauaaaaug

SEQ ID NO: 497919 - RNA, 14 nt, Chlamydophila pneumoniae CWL029
aaucaauccaagaa

SEQ ID NO: 497920 - RNA, 15 nt, Chlamydophila pneumoniae CWL029
aaucacauaaaauaa

SEQ ID NO: 497921 - RNA, 19 nt, Chlamydophila pneumoniae CWL029
aaucacaucaguuccauuu

SEQ ID NO: 497922 - RNA, 15 nt, Chlamydophila pneumoniae CWL029
aaucaccaauuuuuu

SEQ ID NO: 497923 - RNA, 16 nt, Chlamydophila pneumoniae CWL029
aaucaccaauuuuuuc

SEQ ID NO: 497924 - RNA, 18 nt, Chlamydophila pneumoniae CWL029
aaucacgacgucaucacc

SEQ ID NO: 497925 - RNA, 14 nt, Chlamydophila pneumoniae CWL029
aaucagaagugauc

SEQ ID NO: 497926 - RNA, 14 nt, Chlamydophila pneumoniae CWL029
aaucacucuaugau

SEQ ID NO: 497927 - RNA, 19 nt, Chlamydophila pneumoniae CWL029
aaucacuuaauaauguuuu

SEQ ID NO: 497928 - RNA, 13 nt, Chlamydophila pneumoniae CWL029
aaucagaggagcc

SEQ ID NO: 497929 - RNA, 15 nt, Chlamydophila pneumoniae CWL029
aaucauaaaaaaagc

SEQ ID NO: 497930 - RNA, 12 nt, Chlamydophila pneumoniae CWL029
aaucauaaccaa

SEQ ID NO: 497931 - RNA, 18 nt, Chlamydophila pneumoniae CWL029
aaucauaaccaaaagaau

SEQ ID NO: 497932 - RNA, 15 nt, Chlamydophila pneumoniae CWL029
aaucaucaaaaagau

SEQ ID NO: 497933 - RNA, 18 nt, Chlamydophila pneumoniae CWL029
accgcgagugugacugca

SEQ ID NO: 497934 - RNA, 18 nt, Chlamydophila pneumoniae CWL029
accgcuaguauuaagaua

SEQ ID NO: 497935 - RNA, 17 nt, Chlamydophila pneumoniae CWL029
acccucaaauuggaauu

SEQ ID NO: 497936 - RNA, 16 nt, Chlamydophila pneumoniae CWL029
acccucaucauccuca

SEQ ID NO: 497937 - RNA, 13 nt, Chlamydophila pneumoniae CWL029
accgagacuauuu

SEQ ID NO: 497938 - RNA, 17 nt, Chlamydophila pneumoniae CWL029
accgagaugaacauaau

SEQ ID NO: 497939 - RNA, 12 nt, Chlamydophila pneumoniae CWL029
accgacaagcau

SEQ ID NO: 497940 - RNA, 14 nt, Chlamydophila pneumoniae CWL029
accgaaucucucca

SEQ ID NO: 497941 - RNA, 16 nt, Chlamydophila pneumoniae CWL029
accgaaucucuccagc

SEQ ID NO: 497942 - RNA, 13 nt, Chlamydophila pneumoniae CWL029
accgaaagucccg

SEQ ID NO: 497943 - RNA, 20 nt, Chlamydophila pneumoniae CWL029
acccuuuauacuguuuuucu

SEQ ID NO: 497944 - RNA, 21 nt, Chlamydophila pneumoniae CWL029
acccuuuauacuguuuuucuu

SEQ ID NO: 497945 - RNA, 15 nt, Chlamydophila pneumoniae CWL029
accgaaacuucucag

SEQ ID NO: 497946 - RNA, 19 nt, Chlamydophila pneumoniae CWL029
accgaaaaaccuucuccaa

SEQ ID NO: 497947 - RNA, 22 nt, Chlamydophila pneumoniae CWL029
acccauguuucuuccugaauca

SEQ ID NO: 497948 - RNA, 14 nt, Chlamydophila pneumoniae CWL029
acccauaaucccua

SEQ ID NO: 497949 - RNA, 13 nt, Chlamydophila pneumoniae CWL029
acccacuccagaa

SEQ ID NO: 497950 - RNA, 11 nt, Chlamydophila pneumoniae CWL029
acccagcugcg

SEQ ID NO: 497951 - RNA, 20 nt, Chlamydophila pneumoniae CWL029
acccacgcaugccucuuggu

SEQ ID NO: 497952 - RNA, 22 nt, Chlamydophila pneumoniae CWL029
acccaccauucuugaagaucuc

SEQ ID NO: 497953 - RNA, 14 nt, Chlamydophila pneumoniae CWL029
accauuaaauugua

SEQ ID NO: 497954 - RNA, 23 nt, Chlamydophila pneumoniae CWL029
accauuuaccccaggaaucacug

SEQ ID NO: 497955 - RNA, 19 nt, Chlamydophila pneumoniae CWL029
acccaaacugaugccaaga

SEQ ID NO: 497956 - RNA, 16 nt, Chlamydophila pneumoniae CWL029
accaucuguugaucuu

SEQ ID NO: 497957 - RNA, 18 nt, Chlamydophila pneumoniae CWL029
accauccgacuuuccuca

SEQ ID NO: 497958 - RNA, 22 nt, Chlamydophila pneumoniae CWL029
accauccgacuuuccucaaagc

SEQ ID NO: 497959 - RNA, 14 nt, Chlamydophila pneumoniae CWL029
accaucaagguauu

SEQ ID NO: 497960 - RNA, 18 nt, Chlamydophila pneumoniae CWL029
accaucaagguauuggaa

SEQ ID NO: 497961 - RNA, 23 nt, Chlamydophila pneumoniae CWL029
accagcucgagaucuuuuugcca

SEQ ID NO: 497962 - RNA, 20 nt, Chlamydophila pneumoniae CWL029
accacuuuagaauuuucuuu

SEQ ID NO: 497963 - RNA, 20 nt, Chlamydophila pneumoniae CWL029
accacuaccgaauuuucaau

SEQ ID NO: 497964 - RNA, 21 nt, Chlamydophila pneumoniae CWL029
accacuacugagcuucuauuu

SEQ ID NO: 497965 - RNA, 17 nt, Chlamydophila pneumoniae CWL029
accacuucauauaaaac

SEQ ID NO: 497966 - RNA, 18 nt, Chlamydophila pneumoniae CWL029
accacgcaucuuaagaga

SEQ ID NO: 497967 - RNA, 19 nt, Chlamydophila pneumoniae CWL029
accaagaugucuccaaaga

SEQ ID NO: 497968 - RNA, 23 nt, Chlamydophila pneumoniae CWL029
accaagaugucuccaaagauaca

SEQ ID NO: 497969 - RNA, 16 nt, Chlamydophila pneumoniae CWL029
accaagaaaucucagu

SEQ ID NO: 497970 - RNA, 21 nt, Chlamydophila pneumoniae CWL029
accaauaaccgaaacuucuca

SEQ ID NO: 497971 - RNA, 23 nt, Chlamydophila pneumoniae CWL029
accaauaaccgaaacuucucaga

SEQ ID NO: 497972 - RNA, 14 nt, Chlamydophila pneumoniae CWL029
accaauacagcaua

SEQ ID NO: 497973 - RNA, 23 nt, Chlamydophila pneumoniae CWL029
accaaucuugagcauccaaaaug

SEQ ID NO: 497974 - RNA, 18 nt, Chlamydophila pneumoniae CWL029
accacagugauuuagaaa

SEQ ID NO: 497975 - RNA, 19 nt, Chlamydophila pneumoniae CWL029
accacagcuguacagaaca

SEQ ID NO: 497976 - RNA, 20 nt, Chlamydophila pneumoniae CWL029
accacagaggucgauuugaa

SEQ ID NO: 497977 - RNA, 18 nt, Chlamydophila pneumoniae CWL029
accacaauuccuaaaaca

SEQ ID NO: 497978 - RNA, 22 nt, Chlamydophila pneumoniae CWL029
accacaauuccuaaaacaagaa

SEQ ID NO: 497979 - RNA, 20 nt, Chlamydophila pneumoniae CWL029
accaaugauaauuucauuau

SEQ ID NO: 497980 - RNA, 19 nt, Chlamydophila pneumoniae CWL029
accaaugaucguagcuaaa

SEQ ID NO: 497981 - RNA, 22 nt, Chlamydophila pneumoniae CWL029
acauuucucaccacggaagaua

SEQ ID NO: 497982 - RNA, 15 nt, Chlamydophila pneumoniae CWL029
acauuucguuuuuuc

SEQ ID NO: 497983 - RNA, 14 nt, Chlamydophila pneumoniae CWL029
acauuguuuaaguc

SEQ ID NO: 497984 - RNA, 23 nt, Chlamydophila pneumoniae CWL029
acauuguuuaaguccuucuuccc

SEQ ID NO: 497985 - RNA, 16 nt, Chlamydophila pneumoniae CWL029
acauuuccccaugaaa

SEQ ID NO: 497986 - RNA, 22 nt, Chlamydophila pneumoniae CWL029
acauuuccccaugaaaauacaa

SEQ ID NO: 497987 - RNA, 14 nt, Chlamydophila pneumoniae CWL029
accaaauccuccug

SEQ ID NO: 497988 - RNA, 22 nt, Chlamydophila pneumoniae CWL029
accaaaucaucgcaaucaaaga

SEQ ID NO: 497989 - RNA, 13 nt, Chlamydophila pneumoniae CWL029
accaaaucuaucu

SEQ ID NO: 497990 - RNA, 20 nt, Chlamydophila pneumoniae CWL029
acauuuugccuuuagggaaa

SEQ ID NO: 497991 - RNA, 19 nt, Chlamydophila pneumoniae CWL029
acauuuuucaauaaccaga

SEQ ID NO: 497992 - RNA, 19 nt, Chlamydophila pneumoniae CWL029
accaaaagaauuccuaaaa

SEQ ID NO: 497993 - RNA, 19 nt, Chlamydophila pneumoniae CWL029
acaucuuguucugcacgug

SEQ ID NO: 497994 - RNA, 23 nt, Chlamydophila pneumoniae CWL029
acaucuuuguggggcaguaggua

SEQ ID NO: 497995 - RNA, 18 nt, Chlamydophila pneumoniae CWL029
acaucuugagcuucaaaa

SEQ ID NO: 497996 - RNA, 15 nt, Chlamydophila pneumoniae CWL029
acaucuugagcuuca

SEQ ID NO: 497997 - RNA, 18 nt, Chlamydophila pneumoniae CWL029
acauccuuguagaacuuc

SEQ ID NO: 497998 - RNA, 23 nt, Chlamydophila pneumoniae CWL029
acauccuuguagaacuucucaag

SEQ ID NO: 497999 - RNA, 23 nt, Chlamydophila pneumoniae CWL029
acaugcgcagaauaaaauggccu

SEQ ID NO: 498000 - RNA, 15 nt, Chlamydophila pneumoniae CWL029
acaugcucaagaaga

SEQ ID NO: 498001 - RNA, 17 nt, Chlamydophila pneumoniae CWL029
acauguugguagaggcu

SEQ ID NO: 498002 - RNA, 18 nt, Chlamydophila pneumoniae CWL029
acauuccuuaauuacucg

SEQ ID NO: 498003 - RNA, 19 nt, Chlamydophila pneumoniae CWL029
acauucacccucauuaaga

SEQ ID NO: 498004 - RNA, 19 nt, Chlamydophila pneumoniae CWL029
acauucaggauacucugaa

SEQ ID NO: 498005 - RNA, 23 nt, Chlamydophila pneumoniae CWL029
acauucauuuuuuaauaaaauuu

SEQ ID NO: 498006 - RNA, 22 nt, Chlamydophila pneumoniae CWL029
acauucuccgccagaguuuaaa

SEQ ID NO: 498007 - RNA, 17 nt, Chlamydophila pneumoniae CWL029
acauucuuaauaucuac

SEQ ID NO: 498008 - RNA, 13 nt, Chlamydophila pneumoniae CWL029
acauucuucugau

SEQ ID NO: 498009 - RNA, 18 nt, Chlamydophila pneumoniae CWL029
acauugaccuaaaggaau

SEQ ID NO: 498010 - RNA, 23 nt, Chlamydophila pneumoniae CWL029
acauugcgggcucaaagaaaguc

SEQ ID NO: 498011 - RNA, 18 nt, Chlamydophila pneumoniae CWL029
acauugcgggcucaaaga

SEQ ID NO: 498012 - RNA, 23 nt, Chlamydophila pneumoniae CWL029
acauugcugccaggcuuaaauau

SEQ ID NO: 498013 - RNA, 21 nt, Chlamydophila pneumoniae CWL029
acauugcugccaggcuuaaau

SEQ ID NO: 498014 - RNA, 22 nt, Chlamydophila pneumoniae CWL029
acauaucuccuuuaaauaaaau

SEQ ID NO: 498015 - RNA, 13 nt, Chlamydophila pneumoniae CWL029
acaucaauuuuac

SEQ ID NO: 498016 - RNA, 12 nt, Chlamydophila pneumoniae CWL029
acaucaagaauu

SEQ ID NO: 498017 - RNA, 17 nt, Chlamydophila pneumoniae CWL029
acaucaugaaauacccg

SEQ ID NO: 498018 - RNA, 19 nt, Chlamydophila pneumoniae CWL029
acaucaugauauugcguuu

SEQ ID NO: 498019 - RNA, 21 nt, Chlamydophila pneumoniae CWL029
acaucccccgggaagcugucg

SEQ ID NO: 498020 - RNA, 16 nt, Chlamydophila pneumoniae CWL029
acauccauucuuaaua

SEQ ID NO: 498021 - RNA, 12 nt, Chlamydophila pneumoniae CWL029
acauccucacua

SEQ ID NO: 498022 - RNA, 19 nt, Chlamydophila pneumoniae CWL029
acauacucgucaaauucau

SEQ ID NO: 498023 - RNA, 22 nt, Chlamydophila pneumoniae CWL029
acauagaaaacauaucccauag

SEQ ID NO: 498024 - RNA, 24 nt, Chlamydophila pneumoniae CWL029
acauagagauucuacaaauuaccu

SEQ ID NO: 498025 - RNA, 18 nt, Chlamydophila pneumoniae CWL029
acauaguuuaauaaaucu

SEQ ID NO: 498026 - RNA, 15 nt, Chlamydophila pneumoniae CWL029
acaguuugagaaaga

SEQ ID NO: 498027 - RNA, 18 nt, Chlamydophila pneumoniae CWL029
acaguuugagaaagacca

SEQ ID NO: 498028 - RNA, 16 nt, Chlamydophila pneumoniae CWL029
acaguuuguaaaaagc

SEQ ID NO: 498029 - RNA, 22 nt, Chlamydophila pneumoniae CWL029
acauaagcacucuuaauuaaaa

SEQ ID NO: 498030 - RNA, 21 nt, Chlamydophila pneumoniae CWL029
acauaaccucggucucgcugu

SEQ ID NO: 498031 - RNA, 18 nt, Chlamydophila pneumoniae CWL029
acagcaaaguaaugugcg

SEQ ID NO: 498032 - RNA, 13 nt, Chlamydophila pneumoniae CWL029
acagauuuuucaa

SEQ ID NO: 498033 - RNA, 16 nt, Chlamydophila pneumoniae CWL029
acagcauaaaaauucu

SEQ ID NO: 498034 - RNA, 13 nt, Chlamydophila pneumoniae CWL029
acagcaucggcaa

SEQ ID NO: 498035 - RNA, 19 nt, Chlamydophila pneumoniae CWL029
acagcaucggcaaccaguu

SEQ ID NO: 498036 - RNA, 19 nt, Chlamydophila pneumoniae CWL029
acagaccguccuccccaua

SEQ ID NO: 498037 - RNA, 21 nt, Chlamydophila pneumoniae CWL029
acagaagucuuggacguuccu

SEQ ID NO: 498038 - RNA, 21 nt, Chlamydophila pneumoniae CWL029
acagauaugcugaauuccucu

SEQ ID NO: 498039 - RNA, 17 nt, Chlamydophila pneumoniae CWL029
acagauaagacaauaaa

SEQ ID NO: 498040 - RNA, 23 nt, Chlamydophila pneumoniae CWL029
acagaguucgcgaccugugauuu

SEQ ID NO: 498041 - RNA, 22 nt, Chlamydophila pneumoniae CWL029
acacucaaauucaaaauagaag

SEQ ID NO: 498042 - RNA, 19 nt, Chlamydophila pneumoniae CWL029
acagaaaagaaugugcuuu

SEQ ID NO: 498043 - RNA, 15 nt, Chlamydophila pneumoniae CWL029
acagaaagauugugc

SEQ ID NO: 498044 - RNA, 16 nt, Chlamydophila pneumoniae CWL029
acacgcuauagcaaca

SEQ ID NO: 498045 - RNA, 16 nt, Chlamydophila pneumoniae CWL029
acacggacacuauuau

SEQ ID NO: 498046 - RNA, 16 nt, Chlamydophila pneumoniae CWL029
acaccaacaacaauaa

SEQ ID NO: 498047 - RNA, 16 nt, Chlamydophila pneumoniae CWL029
acaccaaaagaauacu

SEQ ID NO: 498048 - RNA, 16 nt, Chlamydophila pneumoniae CWL029
acacauugucucuuuu

SEQ ID NO: 498049 - RNA, 22 nt, Chlamydophila pneumoniae CWL029
acaccaggaaguccgauagcaa

SEQ ID NO: 498050 - RNA, 14 nt, Chlamydophila pneumoniae CWL029
acaccauagaacug

SEQ ID NO: 498051 - RNA, 15 nt, Chlamydophila pneumoniae CWL029
acaccauagaacugc

SEQ ID NO: 498052 - RNA, 17 nt, Chlamydophila pneumoniae CWL029
acaccagcucgagaucu

SEQ ID NO: 498053 - RNA, 13 nt, Chlamydophila pneumoniae CWL029
acaccucuucucu

SEQ ID NO: 498054 - RNA, 21 nt, Chlamydophila pneumoniae CWL029
acaccugcccauuuuuggaaa

SEQ ID NO: 498055 - RNA, 20 nt, Chlamydophila pneumoniae CWL029
acacgaucuaaggcuuugcc

SEQ ID NO: 498056 - RNA, 13 nt, Chlamydophila pneumoniae CWL029
acacgaauaauua

SEQ ID NO: 498057 - RNA, 16 nt, Chlamydophila pneumoniae CWL029
acacgaauaauuaaau

SEQ ID NO: 498058 - RNA, 21 nt, Chlamydophila pneumoniae CWL029
acacccucggauaggcuggaa

SEQ ID NO: 498059 - RNA, 20 nt, Chlamydophila pneumoniae CWL029
acacccugacagguagugcu

SEQ ID NO: 498060 - RNA, 17 nt, Chlamydophila pneumoniae CWL029
acaauaccaucucuuuc

SEQ ID NO: 498061 - RNA, 13 nt, Chlamydophila pneumoniae CWL029
acaauaagaaaau

SEQ ID NO: 498062 - RNA, 18 nt, Chlamydophila pneumoniae CWL029
acaauaaacgagacugca

SEQ ID NO: 498063 - RNA, 13 nt, Chlamydophila pneumoniae CWL029
acaauaaaaaaga

SEQ ID NO: 498064 - RNA, 15 nt, Chlamydophila pneumoniae CWL029
acaaguucuaccuau

SEQ ID NO: 498065 - RNA, 16 nt, Chlamydophila pneumoniae CWL029
acaagggaaagaaacu

SEQ ID NO: 498066 - RNA, 17 nt, Chlamydophila pneumoniae CWL029
acaagggauucuuguug

SEQ ID NO: 498067 - RNA, 15 nt, Chlamydophila pneumoniae CWL029
acaagggaaagaaac

SEQ ID NO: 498068 - RNA, 15 nt, Chlamydophila pneumoniae CWL029
acaagcuucaucaaa

SEQ ID NO: 498069 - RNA, 20 nt, Chlamydophila pneumoniae CWL029
acaagcuuccuuggucuuau

SEQ ID NO: 498070 - RNA, 23 nt, Chlamydophila pneumoniae CWL029
acaagcuucguccugacacaacu

SEQ ID NO: 498071 - RNA, 21 nt, Chlamydophila pneumoniae CWL029
acaagugcauuaucuaagaau

SEQ ID NO: 498072 - RNA, 12 nt, Chlamydophila pneumoniae CWL029
acaagucccccu

SEQ ID NO: 498073 - RNA, 21 nt, Chlamydophila pneumoniae CWL029
acaauaggcacccaaacugau

SEQ ID NO: 498074 - RNA, 14 nt, Chlamydophila pneumoniae CWL029
acaauauaaaugcu

SEQ ID NO: 498075 - RNA, 21 nt, Chlamydophila pneumoniae CWL029
acaauauaagcaccacgaccu

SEQ ID NO: 498076 - RNA, 16 nt, Chlamydophila pneumoniae CWL029
acaaucguagccccau

SEQ ID NO: 498077 - RNA, 22 nt, Chlamydophila pneumoniae CWL029
acaaucucuagggauaauuaaa

SEQ ID NO: 498078 - RNA, 17 nt, Chlamydophila pneumoniae CWL029
acacaaaaagcuuuuuu

SEQ ID NO: 498079 - RNA, 12 nt, Chlamydophila pneumoniae CWL029
acaauuuuaaaa

SEQ ID NO: 498080 - RNA, 15 nt, Chlamydophila pneumoniae CWL029
acaauuuaaaucugc

SEQ ID NO: 498081 - RNA, 19 nt, Chlamydophila pneumoniae CWL029
acaauuuaaaucugcaaga

SEQ ID NO: 498082 - RNA, 13 nt, Chlamydophila pneumoniae CWL029
acaauuccuaaaa

SEQ ID NO: 498083 - RNA, 15 nt, Chlamydophila pneumoniae CWL029
acaaugcuaucucca

SEQ ID NO: 498084 - RNA, 21 nt, Chlamydophila pneumoniae CWL029
acaauggaaauagagaaacuu

SEQ ID NO: 498085 - RNA, 10 nt, Chlamydophila pneumoniae CWL029
acaauguuua

SEQ ID NO: 498086 - RNA, 12 nt, Chlamydophila pneumoniae CWL029
acaauguuuaga

SEQ ID NO: 498087 - RNA, 17 nt, Chlamydophila pneumoniae CWL029
acaauguuuagaauuug

SEQ ID NO: 498088 - RNA, 23 nt, Chlamydophila pneumoniae CWL029
acaauuagagauucauaaaacug

SEQ ID NO: 498089 - RNA, 12 nt, Chlamydophila pneumoniae CWL029
acacaaauagca

SEQ ID NO: 498090 - RNA, 19 nt, Chlamydophila pneumoniae CWL029
acacaaauagcaagagcua

SEQ ID NO: 498091 - RNA, 17 nt, Chlamydophila pneumoniae CWL029
acacacaugacaaauaa

SEQ ID NO: 498092 - RNA, 23 nt, Chlamydophila pneumoniae CWL029
acacagacuugaggaaucugaau

SEQ ID NO: 498093 - RNA, 17 nt, Chlamydophila pneumoniae CWL029
acacagagaacaauaaa

SEQ ID NO: 498094 - RNA, 20 nt, Chlamydophila pneumoniae CWL029
acacacuuucuuuaaagaau

SEQ ID NO: 498095 - RNA, 21 nt, Chlamydophila pneumoniae CWL029
acacacuuucuuuaaagaaua

SEQ ID NO: 498096 - RNA, 17 nt, Chlamydophila pneumoniae CWL029
acacaguagccuucuuc

SEQ ID NO: 498097 - RNA, 21 nt, Chlamydophila pneumoniae CWL029
acacaggggaacgcucucuag

SEQ ID NO: 498098 - RNA, 17 nt, Chlamydophila pneumoniae CWL029
acaacaucaugaaauac

SEQ ID NO: 498099 - RNA, 22 nt, Chlamydophila pneumoniae CWL029
acaacaguugcggagaugccau

SEQ ID NO: 498100 - RNA, 14 nt, Chlamydophila pneumoniae CWL029
acaacaucaugaaa

SEQ ID NO: 498101 - RNA, 16 nt, Chlamydophila pneumoniae CWL029
acaacaucaugaaaua

SEQ ID NO: 498102 - RNA, 13 nt, Chlamydophila pneumoniae CWL029
acaacagagacaa

SEQ ID NO: 498103 - RNA, 17 nt, Chlamydophila pneumoniae CWL029
acaacauaaagaagguu

SEQ ID NO: 498104 - RNA, 18 nt, Chlamydophila pneumoniae CWL029
acaacauugaguugguuu

SEQ ID NO: 498105 - RNA, 23 nt, Chlamydophila pneumoniae CWL029
acaacgcugcuucucuacuaaaa

SEQ ID NO: 498106 - RNA, 22 nt, Chlamydophila pneumoniae CWL029
acaacgguguucauaaucagaa

SEQ ID NO: 498107 - RNA, 19 nt, Chlamydophila pneumoniae CWL029
acaacugugguuuuaaaaa

SEQ ID NO: 498108 - RNA, 22 nt, Chlamydophila pneumoniae CWL029
acaacuucuaucuuacugaaga

SEQ ID NO: 498109 - RNA, 17 nt, Chlamydophila pneumoniae CWL029
acaacuucugacaauaa

SEQ ID NO: 498110 - RNA, 21 nt, Chlamydophila pneumoniae CWL029
acaagaagaucaaagauuccu

SEQ ID NO: 498111 - RNA, 20 nt, Chlamydophila pneumoniae CWL029
acaagaaccuguuuuucuaa

SEQ ID NO: 498112 - RNA, 15 nt, Chlamydophila pneumoniae CWL029
acaagaacugaagag

SEQ ID NO: 498113 - RNA, 15 nt, Chlamydophila pneumoniae CWL029
acaacuuugaggcaa

SEQ ID NO: 498114 - RNA, 14 nt, Chlamydophila pneumoniae CWL029
acaagagagagcug

SEQ ID NO: 498115 - RNA, 19 nt, Chlamydophila pneumoniae CWL029
acaagagcgcauuuuacag

SEQ ID NO: 498116 - RNA, 22 nt, Chlamydophila pneumoniae CWL029
acaagagagagcuggacuucug

SEQ ID NO: 498117 - RNA, 13 nt, Chlamydophila pneumoniae CWL029
acaagauaguggu

SEQ ID NO: 498118 - RNA, 23 nt, Chlamydophila pneumoniae CWL029
acaagauucucagcuucaucaga

SEQ ID NO: 498119 - RNA, 19 nt, Chlamydophila pneumoniae CWL029
acaagccucccuaugugaa

SEQ ID NO: 498120 - RNA, 21 nt, Chlamydophila pneumoniae CWL029
acaagcaguaacugcaaagag

SEQ ID NO: 498121 - RNA, 16 nt, Chlamydophila pneumoniae CWL029
acaagcauaaacuccu

SEQ ID NO: 498122 - RNA, 17 nt, Chlamydophila pneumoniae CWL029
acaaaguaggauugaua

SEQ ID NO: 498123 - RNA, 20 nt, Chlamydophila pneumoniae CWL029
acaaaguaggauugauaaau

SEQ ID NO: 498124 - RNA, 15 nt, Chlamydophila pneumoniae CWL029
acaaaggcauaagau

SEQ ID NO: 498125 - RNA, 15 nt, Chlamydophila pneumoniae CWL029
acaaagaucacugag

SEQ ID NO: 498126 - RNA, 13 nt, Chlamydophila pneumoniae CWL029
acaaagccacagc

SEQ ID NO: 498127 - RNA, 16 nt, Chlamydophila pneumoniae CWL029
acaaagcgucuaucua

SEQ ID NO: 498128 - RNA, 13 nt, Chlamydophila pneumoniae CWL029
acaaacagauuuu

SEQ ID NO: 498129 - RNA, 12 nt, Chlamydophila pneumoniae CWL029
acaaacaucgaa

SEQ ID NO: 498130 - RNA, 19 nt, Chlamydophila pneumoniae CWL029
acaaacaucgaaaccacag

SEQ ID NO: 498131 - RNA, 22 nt, Chlamydophila pneumoniae CWL029
acaaacaucgaaaccacagcaa

SEQ ID NO: 498132 - RNA, 15 nt, Chlamydophila pneumoniae CWL029
acaaagaaccauaga

SEQ ID NO: 498133 - RNA, 21 nt, Chlamydophila pneumoniae CWL029
acaaacuaacauagauaaggu

SEQ ID NO: 498134 - RNA, 21 nt, Chlamydophila pneumoniae CWL029
acaaacucuauuuucauauca

SEQ ID NO: 498135 - RNA, 13 nt, Chlamydophila pneumoniae CWL029
acaaacucuucca

SEQ ID NO: 498136 - RNA, 19 nt, Chlamydophila pneumoniae CWL029
acaacaccucccaccaagg

SEQ ID NO: 498137 - RNA, 19 nt, Chlamydophila pneumoniae CWL029
acaacaacagcuuuaucuu

SEQ ID NO: 498138 - RNA, 15 nt, Chlamydophila pneumoniae CWL029
acaacaacauaaaga

SEQ ID NO: 498139 - RNA, 13 nt, Chlamydophila pneumoniae CWL029
acaacaaauugau

SEQ ID NO: 498140 - RNA, 21 nt, Chlamydophila pneumoniae CWL029
acaaaugugacgcaagagaca

SEQ ID NO: 498141 - RNA, 22 nt, Chlamydophila pneumoniae CWL029
acaaaugugacgcaagagacaa

SEQ ID NO: 498142 - RNA, 15 nt, Chlamydophila pneumoniae CWL029
acaaauagcucugcg

SEQ ID NO: 498143 - RNA, 13 nt, Chlamydophila pneumoniae CWL029
acaaauaaaauga

SEQ ID NO: 498144 - RNA, 22 nt, Chlamydophila pneumoniae CWL029
acaaaucauuuaaagcugaaau

SEQ ID NO: 498145 - RNA, 23 nt, Chlamydophila pneumoniae CWL029
acaaaucacgacgucaucaccau

SEQ ID NO: 498146 - RNA, 17 nt, Chlamydophila pneumoniae CWL029
acaaacaacagaaaugu

SEQ ID NO: 498147 - RNA, 17 nt, Chlamydophila pneumoniae CWL029
acaaaauuucuuauaaa

SEQ ID NO: 498148 - RNA, 22 nt, Chlamydophila pneumoniae CWL029
acaaaauuucuuauaaaaaagg

SEQ ID NO: 498149 - RNA, 23 nt, Chlamydophila pneumoniae CWL029
acaaaagguauugcaaauuucau

SEQ ID NO: 498150 - RNA, 18 nt, Chlamydophila pneumoniae CWL029
acaaaagucucuagggaa

SEQ ID NO: 498151 - RNA, 23 nt, Chlamydophila pneumoniae CWL029
acaaaagucucuagggaaaggag

SEQ ID NO: 498152 - RNA, 12 nt, Chlamydophila pneumoniae CWL029
acaaaaaugccu

SEQ ID NO: 498153 - RNA, 16 nt, Chlamydophila pneumoniae CWL029
acaaaacaaaagccau

SEQ ID NO: 498154 - RNA, 19 nt, Chlamydophila pneumoniae CWL029
acaaaaaagggaucuccuu

SEQ ID NO: 498155 - RNA, 13 nt, Chlamydophila pneumoniae CWL029
acaaaaaaucaau

SEQ ID NO: 498156 - RNA, 15 nt, Chlamydophila pneumoniae CWL029
acaaaaacugcgcua

SEQ ID NO: 498157 - RNA, 17 nt, Chlamydophila pneumoniae CWL029
aauuuuuuucaaaggag

SEQ ID NO: 498158 - RNA, 20 nt, Chlamydophila pneumoniae CWL029
aauuuuugcuaaacaaugca

SEQ ID NO: 498159 - RNA, 15 nt, Chlamydophila pneumoniae CWL029
aauuuuucuaagaaa

SEQ ID NO: 498160 - RNA, 15 nt, Chlamydophila pneumoniae CWL029
aauuuucccauuaca

SEQ ID NO: 498161 - RNA, 22 nt, Chlamydophila pneumoniae CWL029
aauuuucagccugucuauaaaa

SEQ ID NO: 498162 - RNA, 18 nt, Chlamydophila pneumoniae CWL029
aauuuucagucuuccuuu

SEQ ID NO: 498163 - RNA, 22 nt, Chlamydophila pneumoniae CWL029
aauuucuugacuuguuucuccu

SEQ ID NO: 498164 - RNA, 13 nt, Chlamydophila pneumoniae CWL029
aauuucuucauca

SEQ ID NO: 498165 - RNA, 13 nt, Chlamydophila pneumoniae CWL029
aauuucuuauaaa

SEQ ID NO: 498166 - RNA, 17 nt, Chlamydophila pneumoniae CWL029
aauuucuuauaaaaaag

SEQ ID NO: 498167 - RNA, 20 nt, Chlamydophila pneumoniae CWL029
aauuucuccaguaucuucuc

SEQ ID NO: 498168 - RNA, 22 nt, Chlamydophila pneumoniae CWL029
aauuucuccaguaucuucucuu

SEQ ID NO: 498169 - RNA, 17 nt, Chlamydophila pneumoniae CWL029
aauuucugaaacaaugc

SEQ ID NO: 498170 - RNA, 18 nt, Chlamydophila pneumoniae CWL029
aauuucugaaacaaugca

SEQ ID NO: 498171 - RNA, 15 nt, Chlamydophila pneumoniae CWL029
aauuucuaggacagc

SEQ ID NO: 498172 - RNA, 20 nt, Chlamydophila pneumoniae CWL029
aauuucggacgauauuuaga

SEQ ID NO: 498173 - RNA, 14 nt, Chlamydophila pneumoniae CWL029
aauuuccuuagaag

SEQ ID NO: 498174 - RNA, 21 nt, Chlamydophila pneumoniae CWL029
aauuuccuuagaagggaaagu

SEQ ID NO: 498175 - RNA, 16 nt, Chlamydophila pneumoniae CWL029
aauuuccugcauggcu

SEQ ID NO: 498176 - RNA, 11 nt, Chlamydophila pneumoniae CWL029
aauuuccaaag

SEQ ID NO: 498177 - RNA, 14 nt, Chlamydophila pneumoniae CWL029
aauuuccaaaggaa

SEQ ID NO: 498178 - RNA, 16 nt, Chlamydophila pneumoniae CWL029
aauuuccaaaggaaaa

SEQ ID NO: 498179 - RNA, 19 nt, Chlamydophila pneumoniae CWL029
aauuuccaaucacacuaca

SEQ ID NO: 498180 - RNA, 12 nt, Chlamydophila pneumoniae CWL029
aauuaguaaaug

SEQ ID NO: 498181 - RNA, 17 nt, Chlamydophila pneumoniae CWL029
aauuagagggauuugua

SEQ ID NO: 498182 - RNA, 15 nt, Chlamydophila pneumoniae CWL029
aauuagaguaugagg

SEQ ID NO: 498183 - RNA, 18 nt, Chlamydophila pneumoniae CWL029
aauuuuauuaguuacuga

SEQ ID NO: 498184 - RNA, 16 nt, Chlamydophila pneumoniae CWL029
aauuuuagcuucuuuu

SEQ ID NO: 498185 - RNA, 21 nt, Chlamydophila pneumoniae CWL029
aauuugcaagagccggaacuu

SEQ ID NO: 498186 - RNA, 17 nt, Chlamydophila pneumoniae CWL029
aauuuggauuuauguuu

SEQ ID NO: 498187 - RNA, 23 nt, Chlamydophila pneumoniae CWL029
aauuugcguugcauguccauuaa

SEQ ID NO: 498188 - RNA, 18 nt, Chlamydophila pneumoniae CWL029
aauuugccugaaauccug

SEQ ID NO: 498189 - RNA, 14 nt, Chlamydophila pneumoniae CWL029
aauuugauuuuuca

SEQ ID NO: 498190 - RNA, 17 nt, Chlamydophila pneumoniae CWL029
aauuugccugaaauccu

SEQ ID NO: 498191 - RNA, 16 nt, Chlamydophila pneumoniae CWL029
acucuuccacaauguu

SEQ ID NO: 498192 - RNA, 22 nt, Chlamydophila pneumoniae CWL029
acucuuccacaauguuuagaau

SEQ ID NO: 498193 - RNA, 23 nt, Chlamydophila pneumoniae CWL029
acucuuccacaauguuuagaauu

SEQ ID NO: 498194 - RNA, 22 nt, Chlamydophila pneumoniae CWL029
acucuucaucgauaggaugaca

SEQ ID NO: 498195 - RNA, 22 nt, Chlamydophila pneumoniae CWL029
acucuuccaauuguaaaucauu

SEQ ID NO: 498196 - RNA, 18 nt, Chlamydophila pneumoniae CWL029
acucuccauccucagucu

SEQ ID NO: 498197 - RNA, 20 nt, Chlamydophila pneumoniae CWL029
acucuccauccucagucucu

SEQ ID NO: 498198 - RNA, 23 nt, Chlamydophila pneumoniae CWL029
acucucccauguaguaaauuccu

SEQ ID NO: 498199 - RNA, 16 nt, Chlamydophila pneumoniae CWL029
acucuuccuucuacag

SEQ ID NO: 498200 - RNA, 21 nt, Chlamydophila pneumoniae CWL029
acucuuccuucuacagauuga

SEQ ID NO: 498201 - RNA, 14 nt, Chlamydophila pneumoniae CWL029
acucuuuaaaaaua

SEQ ID NO: 498202 - RNA, 17 nt, Chlamydophila pneumoniae CWL029
acucuuuaaaaauagaa

SEQ ID NO: 498203 - RNA, 14 nt, Chlamydophila pneumoniae CWL029
acucuucuuuuuau

SEQ ID NO: 498204 - RNA, 21 nt, Chlamydophila pneumoniae CWL029
acugaauaguagaguugacaa

SEQ ID NO: 498205 - RNA, 14 nt, Chlamydophila pneumoniae CWL029
acugaagagcaauu

SEQ ID NO: 498206 - RNA, 24 nt, Chlamydophila pneumoniae CWL029
acugaagagcaauuaagaaacuag

SEQ ID NO: 498207 - RNA, 17 nt, Chlamydophila pneumoniae CWL029
acucgccgaaaguaucu

SEQ ID NO: 498208 - RNA, 20 nt, Chlamydophila pneumoniae CWL029
acucgccauaauagucucug

SEQ ID NO: 498209 - RNA, 14 nt, Chlamydophila pneumoniae CWL029
acucccguuuuguu

SEQ ID NO: 498210 - RNA, 19 nt, Chlamydophila pneumoniae CWL029
acucguguggaucacguaa

SEQ ID NO: 498211 - RNA, 17 nt, Chlamydophila pneumoniae CWL029
acucuccaaaagcucua

SEQ ID NO: 498212 - RNA, 16 nt, Chlamydophila pneumoniae CWL029
acucucaucagcaaaa

SEQ ID NO: 498213 - RNA, 15 nt, Chlamydophila pneumoniae CWL029
acucucacugagugu

SEQ ID NO: 498214 - RNA, 24 nt, Chlamydophila pneumoniae CWL029
acucaggcuuuaaguguuucuuca

SEQ ID NO: 498215 - RNA, 21 nt, Chlamydophila pneumoniae CWL029
acucaggauauauagagcaga

SEQ ID NO: 498216 - RNA, 22 nt, Chlamydophila pneumoniae CWL029
acucagcguucgcucucuuuaa

SEQ ID NO: 498217 - RNA, 23 nt, Chlamydophila pneumoniae CWL029
acucagcguucgcucucuuuaaa

SEQ ID NO: 498218 - RNA, 22 nt, Chlamydophila pneumoniae CWL029
acucagcgcaucacgaaaagga

SEQ ID NO: 498219 - RNA, 15 nt, Chlamydophila pneumoniae CWL029
acucagagaaaauca

SEQ ID NO: 498220 - RNA, 18 nt, Chlamydophila pneumoniae CWL029
acucacaaacaacagaaa

SEQ ID NO: 498221 - RNA, 11 nt, Chlamydophila pneumoniae CWL029
acuaucuacac

SEQ ID NO: 498222 - RNA, 15 nt, Chlamydophila pneumoniae CWL029
acuaucuacacagua

SEQ ID NO: 498223 - RNA, 17 nt, Chlamydophila pneumoniae CWL029
acuaucuacacaguagc

SEQ ID NO: 498224 - RNA, 13 nt, Chlamydophila pneumoniae CWL029
acucacagaguuc

SEQ ID NO: 498225 - RNA, 18 nt, Chlamydophila pneumoniae CWL029
acucacauuugcuuuaac

SEQ ID NO: 498226 - RNA, 24 nt, Chlamydophila pneumoniae CWL029
acucacauuugcuuuaacagaagc

SEQ ID NO: 498227 - RNA, 14 nt, Chlamydophila pneumoniae CWL029
acucaucaguaaaa

SEQ ID NO: 498228 - RNA, 15 nt, Chlamydophila pneumoniae CWL029
acucaugaaagugcu

SEQ ID NO: 498229 - RNA, 16 nt, Chlamydophila pneumoniae CWL029
acuccauucagauggu

SEQ ID NO: 498230 - RNA, 15 nt, Chlamydophila pneumoniae CWL029
acucccaaggaaauu

SEQ ID NO: 498231 - RNA, 16 nt, Chlamydophila pneumoniae CWL029
acuccaggggauaaaa

SEQ ID NO: 498232 - RNA, 14 nt, Chlamydophila pneumoniae CWL029
acuccaggguguuu

SEQ ID NO: 498233 - RNA, 17 nt, Chlamydophila pneumoniae CWL029
acuccaagucagccaag

SEQ ID NO: 498234 - RNA, 21 nt, Chlamydophila pneumoniae CWL029
acuccaagucagccaagacaa

SEQ ID NO: 498235 - RNA, 13 nt, Chlamydophila pneumoniae CWL029
acuccacuuuuuu

SEQ ID NO: 498236 - RNA, 14 nt, Chlamydophila pneumoniae CWL029
acuccacuuuuuuc

SEQ ID NO: 498237 - RNA, 14 nt, Chlamydophila pneumoniae CWL029
acuccagaaaguau

SEQ ID NO: 498238 - RNA, 17 nt, Chlamydophila pneumoniae CWL029
acuccagagcccuuggu

SEQ ID NO: 498239 - RNA, 13 nt, Chlamydophila pneumoniae CWL029
acuagauuucuac

SEQ ID NO: 498240 - RNA, 20 nt, Chlamydophila pneumoniae CWL029
acuagauuucuacaaacagg

SEQ ID NO: 498241 - RNA, 14 nt, Chlamydophila pneumoniae CWL029
acuaggaaaagcau

SEQ ID NO: 498242 - RNA, 22 nt, Chlamydophila pneumoniae CWL029
acuaggaaaagcauagucgucu

SEQ ID NO: 498243 - RNA, 14 nt, Chlamydophila pneumoniae CWL029
acuagcuuuucaug

SEQ ID NO: 498244 - RNA, 15 nt, Chlamydophila pneumoniae CWL029
acuauagaaaaggau

SEQ ID NO: 498245 - RNA, 17 nt, Chlamydophila pneumoniae CWL029
acuauagggagacucuu

SEQ ID NO: 498246 - RNA, 22 nt, Chlamydophila pneumoniae CWL029
acuagagauucgaaagaacuac

SEQ ID NO: 498247 - RNA, 21 nt, Chlamydophila pneumoniae CWL029
acuacugagcuucuauuucua

SEQ ID NO: 498248 - RNA, 15 nt, Chlamydophila pneumoniae CWL029
acuacaauaaccagg

SEQ ID NO: 498249 - RNA, 17 nt, Chlamydophila pneumoniae CWL029
acuacacgcacuugcuu

SEQ ID NO: 498250 - RNA, 19 nt, Chlamydophila pneumoniae CWL029
acuaaguuuaggcaggaag

SEQ ID NO: 498251 - RNA, 19 nt, Chlamydophila pneumoniae CWL029
acuaauaccuuucuaagaa

SEQ ID NO: 498252 - RNA, 21 nt, Chlamydophila pneumoniae CWL029
acuaagaagcucacucuuuaa

SEQ ID NO: 498253 - RNA, 22 nt, Chlamydophila pneumoniae CWL029
acuaacucuguaauauucaaca

SEQ ID NO: 498254 - RNA, 18 nt, Chlamydophila pneumoniae CWL029
acuaacaaaauuucuuau

SEQ ID NO: 498255 - RNA, 22 nt, Chlamydophila pneumoniae CWL029
acuaaaugacgaguugaaguuu

SEQ ID NO: 498256 - RNA, 21 nt, Chlamydophila pneumoniae CWL029
acguucgacaacaacauaaag

SEQ ID NO: 498257 - RNA, 13 nt, Chlamydophila pneumoniae CWL029
acguucugcaaca

SEQ ID NO: 498258 - RNA, 23 nt, Chlamydophila pneumoniae CWL029
acguuaauaaagaggcucccauc

SEQ ID NO: 498259 - RNA, 14 nt, Chlamydophila pneumoniae CWL029
acgugaucaaaauu

SEQ ID NO: 498260 - RNA, 13 nt, Chlamydophila pneumoniae CWL029
acgucuuaugaaa

SEQ ID NO: 498261 - RNA, 16 nt, Chlamydophila pneumoniae CWL029
acgucuuucaccaacu

SEQ ID NO: 498262 - RNA, 17 nt, Chlamydophila pneumoniae CWL029
acgucuuucaccaacuc

SEQ ID NO: 498263 - RNA, 22 nt, Chlamydophila pneumoniae CWL029
acgucacuggggcauaagaacu

SEQ ID NO: 498264 - RNA, 23 nt, Chlamydophila pneumoniae CWL029
acgucacuggggcauaagaacuc

SEQ ID NO: 498265 - RNA, 23 nt, Chlamydophila pneumoniae CWL029
acguauccuugauuuuaaaauga

SEQ ID NO: 498266 - RNA, 13 nt, Chlamydophila pneumoniae CWL029
acgucaucaccau

SEQ ID NO: 498267 - RNA, 14 nt, Chlamydophila pneumoniae CWL029
acgucagcuguccu

SEQ ID NO: 498268 - RNA, 15 nt, Chlamydophila pneumoniae CWL029
acgucagcuguccuc

SEQ ID NO: 498269 - RNA, 22 nt, Chlamydophila pneumoniae CWL029
acguauagguugaauaaauuuu

SEQ ID NO: 498270 - RNA, 14 nt, Chlamydophila pneumoniae CWL029
acguagcagaggca

SEQ ID NO: 498271 - RNA, 22 nt, Chlamydophila pneumoniae CWL029
acguagcauaccuuggaaaggu

SEQ ID NO: 498272 - RNA, 17 nt, Chlamydophila pneumoniae CWL029
acguagcuacaaaauua

SEQ ID NO: 498273 - RNA, 20 nt, Chlamydophila pneumoniae CWL029
acgggcaauauauccaggau

SEQ ID NO: 498274 - RNA, 14 nt, Chlamydophila pneumoniae CWL029
acggagagagauuc

SEQ ID NO: 498275 - RNA, 23 nt, Chlamydophila pneumoniae CWL029
acgcuuuuaucuguuaaaaacaa

SEQ ID NO: 498276 - RNA, 21 nt, Chlamydophila pneumoniae CWL029
acggauaggaucauugaguuc

SEQ ID NO: 498277 - RNA, 22 nt, Chlamydophila pneumoniae CWL029
acgcuugugguuagaggaagca

SEQ ID NO: 498278 - RNA, 19 nt, Chlamydophila pneumoniae CWL029
acgcuacgguacuuuacaa

SEQ ID NO: 498279 - RNA, 18 nt, Chlamydophila pneumoniae CWL029
acgcuacgguacuuuaca

SEQ ID NO: 498280 - RNA, 20 nt, Chlamydophila pneumoniae CWL029
acgcuaagcucuuaauuucu

SEQ ID NO: 498281 - RNA, 13 nt, Chlamydophila pneumoniae CWL029
acgcuaagcucuu

SEQ ID NO: 498282 - RNA, 13 nt, Chlamydophila pneumoniae CWL029
acgcuauucuuaa

SEQ ID NO: 498283 - RNA, 10 nt, Chlamydophila pneumoniae CWL029
acgcuauucu

SEQ ID NO: 498284 - RNA, 17 nt, Chlamydophila pneumoniae CWL029
acgcucccuaugccagu

SEQ ID NO: 498285 - RNA, 16 nt, Chlamydophila pneumoniae CWL029
acgcucuaaacucucu

SEQ ID NO: 498286 - RNA, 13 nt, Chlamydophila pneumoniae CWL029
acgccuucaaguc

SEQ ID NO: 498287 - RNA, 16 nt, Chlamydophila pneumoniae CWL029
acgccauacugauaua

SEQ ID NO: 498288 - RNA, 22 nt, Chlamydophila pneumoniae CWL029
acgcaguaucguaacuuccuuu

SEQ ID NO: 498289 - RNA, 14 nt, Chlamydophila pneumoniae CWL029
acgcaggaagaaca

SEQ ID NO: 498290 - RNA, 18 nt, Chlamydophila pneumoniae CWL029
acuguugcauuagauacg

SEQ ID NO: 498291 - RNA, 19 nt, Chlamydophila pneumoniae CWL029
acuguuuguuuauuaucua

SEQ ID NO: 498292 - RNA, 21 nt, Chlamydophila pneumoniae CWL029
acuguuuguuuauuaucuaca

SEQ ID NO: 498293 - RNA, 17 nt, Chlamydophila pneumoniae CWL029
acugugccauaacgcau

SEQ ID NO: 498294 - RNA, 23 nt, Chlamydophila pneumoniae CWL029
acuguugauccuucuuaugguca

SEQ ID NO: 498295 - RNA, 19 nt, Chlamydophila pneumoniae CWL029
acuguccauccaaauagag

SEQ ID NO: 498296 - RNA, 22 nt, Chlamydophila pneumoniae CWL029
acuguacaaaugcaucucuagc

SEQ ID NO: 498297 - RNA, 13 nt, Chlamydophila pneumoniae CWL029
acuguacaaaugc

SEQ ID NO: 498298 - RNA, 13 nt, Chlamydophila pneumoniae CWL029
acugaccugauac

SEQ ID NO: 498299 - RNA, 20 nt, Chlamydophila pneumoniae CWL029
acuuagaucuuuucuacuuc

SEQ ID NO: 498300 - RNA, 22 nt, Chlamydophila pneumoniae CWL029
acuuauguacugagguagcaua

SEQ ID NO: 498301 - RNA, 22 nt, Chlamydophila pneumoniae CWL029
acuuauguucuaugagauagga

SEQ ID NO: 498302 - RNA, 14 nt, Chlamydophila pneumoniae CWL029
acuuacgaaucuua

SEQ ID NO: 498303 - RNA, 21 nt, Chlamydophila pneumoniae CWL029
acuuccaaaacgauccuguuc

SEQ ID NO: 498304 - RNA, 17 nt, Chlamydophila pneumoniae CWL029
acuucaacuucuccaac

SEQ ID NO: 498305 - RNA, 23 nt, Chlamydophila pneumoniae CWL029
acuuauuguucuugguguauagu

SEQ ID NO: 498306 - RNA, 16 nt, Chlamydophila pneumoniae CWL029
acuucaaaugaaauuc

SEQ ID NO: 498307 - RNA, 18 nt, Chlamydophila pneumoniae CWL029
acuucaacuucuccaacu

SEQ ID NO: 498308 - RNA, 18 nt, Chlamydophila pneumoniae CWL029
acuucaagccaaaaccaa

SEQ ID NO: 498309 - RNA, 17 nt, Chlamydophila pneumoniae CWL029
acuucaguuguugcuuu

SEQ ID NO: 498310 - RNA, 16 nt, Chlamydophila pneumoniae CWL029
acuugcucugaagcuc

SEQ ID NO: 498311 - RNA, 17 nt, Chlamydophila pneumoniae CWL029
acuugcucuuuaauaag

SEQ ID NO: 498312 - RNA, 16 nt, Chlamydophila pneumoniae CWL029
acuuggucauuauagu

SEQ ID NO: 498313 - RNA, 14 nt, Chlamydophila pneumoniae CWL029
acuugggagaugcu

SEQ ID NO: 498314 - RNA, 13 nt, Chlamydophila pneumoniae CWL029
acuugggaugcua

SEQ ID NO: 498315 - RNA, 12 nt, Chlamydophila pneumoniae CWL029
acuucuuuuucu

SEQ ID NO: 498316 - RNA, 19 nt, Chlamydophila pneumoniae CWL029
acuugcauggauccuucau

SEQ ID NO: 498317 - RNA, 17 nt, Chlamydophila pneumoniae CWL029
acuugcauuuuuuggaa

SEQ ID NO: 498318 - RNA, 17 nt, Chlamydophila pneumoniae CWL029
acuucugcuaguccugu

SEQ ID NO: 498319 - RNA, 20 nt, Chlamydophila pneumoniae CWL029
acuucugguccaaacccugg

SEQ ID NO: 498320 - RNA, 11 nt, Chlamydophila pneumoniae CWL029
acuucugguuu

SEQ ID NO: 498321 - RNA, 16 nt, Chlamydophila pneumoniae CWL029
acuucuuccacgagau

SEQ ID NO: 498322 - RNA, 19 nt, Chlamydophila pneumoniae CWL029
acuucuucguuagagaaga

SEQ ID NO: 498323 - RNA, 17 nt, Chlamydophila pneumoniae CWL029
acuucuucucgguuuaa

SEQ ID NO: 498324 - RNA, 23 nt, Chlamydophila pneumoniae CWL029
acuucuucucgguuuaaggcaau

SEQ ID NO: 498325 - RNA, 13 nt, Chlamydophila pneumoniae CWL029
acuucuucuuuuc

SEQ ID NO: 498326 - RNA, 18 nt, Chlamydophila pneumoniae CWL029
acuucuugugauccuugc

SEQ ID NO: 498327 - RNA, 13 nt, Chlamydophila pneumoniae CWL029
acuucuuucuugc

SEQ ID NO: 498328 - RNA, 15 nt, Chlamydophila pneumoniae CWL029
acuucuuucuugcuc

SEQ ID NO: 498329 - RNA, 22 nt, Chlamydophila pneumoniae CWL029
acuucuuugccguauagauuuu

SEQ ID NO: 498330 - RNA, 18 nt, Chlamydophila pneumoniae CWL029
acuucuaugauaucacca

SEQ ID NO: 498331 - RNA, 12 nt, Chlamydophila pneumoniae CWL029
acuucucagaua

SEQ ID NO: 498332 - RNA, 15 nt, Chlamydophila pneumoniae CWL029
acuucucagauaaaa

SEQ ID NO: 498333 - RNA, 21 nt, Chlamydophila pneumoniae CWL029
acuucucagcaucucgaacaa

SEQ ID NO: 498334 - RNA, 15 nt, Chlamydophila pneumoniae CWL029
acuuuuacugaaauu

SEQ ID NO: 498335 - RNA, 18 nt, Chlamydophila pneumoniae CWL029
acuuuggucuucuguaau

SEQ ID NO: 498336 - RNA, 16 nt, Chlamydophila pneumoniae CWL029
acuuugaccagaugau

SEQ ID NO: 498337 - RNA, 21 nt, Chlamydophila pneumoniae CWL029
acuuugaccagaugauuuuuu

SEQ ID NO: 498338 - RNA, 22 nt, Chlamydophila pneumoniae CWL029
acuuugaggcaagucucaaagg

SEQ ID NO: 498339 - RNA, 17 nt, Chlamydophila pneumoniae CWL029
acuuugcaauacaccaa

SEQ ID NO: 498340 - RNA, 16 nt, Chlamydophila pneumoniae CWL029
acuuugccaacagcug

SEQ ID NO: 498341 - RNA, 13 nt, Chlamydophila pneumoniae CWL029
acuuucuuuaaag

SEQ ID NO: 498342 - RNA, 17 nt, Chlamydophila pneumoniae CWL029
acuuucuuuuugagaua

SEQ ID NO: 498343 - RNA, 18 nt, Chlamydophila pneumoniae CWL029
acuuucugauugagaaua

SEQ ID NO: 498344 - RNA, 20 nt, Chlamydophila pneumoniae CWL029
acuuucugauugagaauaaa

SEQ ID NO: 498345 - RNA, 12 nt, Chlamydophila pneumoniae CWL029
acuuucuucucu

SEQ ID NO: 498346 - RNA, 14 nt, Chlamydophila pneumoniae CWL029
acuuucuucucuag

SEQ ID NO: 498347 - RNA, 22 nt, Chlamydophila pneumoniae CWL029
acuuucuucucuaggaagauuu

SEQ ID NO: 498348 - RNA, 18 nt, Chlamydophila pneumoniae CWL029
acuuucccuucuaaggaa

SEQ ID NO: 498349 - RNA, 14 nt, Chlamydophila pneumoniae CWL029
acuuuccucaaagc

SEQ ID NO: 498350 - RNA, 12 nt, Chlamydophila pneumoniae CWL029
acuuuccucucu

SEQ ID NO: 498351 - RNA, 15 nt, Chlamydophila pneumoniae CWL029
acuuuccucucuuua

SEQ ID NO: 498352 - RNA, 17 nt, Chlamydophila pneumoniae CWL029
acuuuccucucuuuaua

SEQ ID NO: 498353 - RNA, 17 nt, Chlamydophila pneumoniae CWL029
acuuucguguacagacc

SEQ ID NO: 498354 - RNA, 16 nt, Chlamydophila pneumoniae CWL029
acuuucaagauugugc

SEQ ID NO: 498355 - RNA, 12 nt, Chlamydophila pneumoniae CWL029
acuuuauucucu

SEQ ID NO: 498356 - RNA, 23 nt, Chlamydophila pneumoniae CWL029
acuuuagggaagaaauuaacaac

SEQ ID NO: 498357 - RNA, 23 nt, Chlamydophila pneumoniae CWL029
acuuuacuucggaugagauccaa

SEQ ID NO: 498358 - RNA, 22 nt, Chlamydophila pneumoniae CWL029
acuuuaagaagcacuucuuuag

SEQ ID NO: 498359 - RNA, 21 nt, Chlamydophila pneumoniae CWL029
acuuuaaucaagccuaaaucu

SEQ ID NO: 498360 - RNA, 22 nt, Chlamydophila pneumoniae CWL029
acuuuaaucaagccuaaaucua

SEQ ID NO: 498361 - RNA, 18 nt, Chlamydophila pneumoniae CWL029
acuuguucuucauuauua

SEQ ID NO: 498362 - RNA, 11 nt, Chlamydophila pneumoniae CWL029
agaaagaagcc

SEQ ID NO: 498363 - RNA, 13 nt, Chlamydophila pneumoniae CWL029
agaaacuuuaaaa

SEQ ID NO: 498364 - RNA, 14 nt, Chlamydophila pneumoniae CWL029
agaaacuucugacc

SEQ ID NO: 498365 - RNA, 20 nt, Chlamydophila pneumoniae CWL029
agaaagaaguccuagggagu

SEQ ID NO: 498366 - RNA, 20 nt, Chlamydophila pneumoniae CWL029
agaaagaaugacacagagaa

SEQ ID NO: 498367 - RNA, 22 nt, Chlamydophila pneumoniae CWL029
agaaagaaugacacagagaaca

SEQ ID NO: 498368 - RNA, 15 nt, Chlamydophila pneumoniae CWL029
agaaagacaaaaaau

SEQ ID NO: 498369 - RNA, 18 nt, Chlamydophila pneumoniae CWL029
agaaagacaaaaaaucug

SEQ ID NO: 498370 - RNA, 14 nt, Chlamydophila pneumoniae CWL029
agaaagaccaccuu

SEQ ID NO: 498371 - RNA, 22 nt, Chlamydophila pneumoniae CWL029
agaaauauacucuugcuugcua

SEQ ID NO: 498372 - RNA, 16 nt, Chlamydophila pneumoniae CWL029
agaaauauacugccag

SEQ ID NO: 498373 - RNA, 18 nt, Chlamydophila pneumoniae CWL029
agaaauacgcuuuucuuc

SEQ ID NO: 498374 - RNA, 14 nt, Chlamydophila pneumoniae CWL029
agaaaucacacuua

SEQ ID NO: 498375 - RNA, 15 nt, Chlamydophila pneumoniae CWL029
agaaaucaguccuaa

SEQ ID NO: 498376 - RNA, 16 nt, Chlamydophila pneumoniae CWL029
agaaaucgacagggga

SEQ ID NO: 498377 - RNA, 20 nt, Chlamydophila pneumoniae CWL029
agaaaucuuuugauuaggcu

SEQ ID NO: 498378 - RNA, 14 nt, Chlamydophila pneumoniae CWL029
agaaaacauagaga

SEQ ID NO: 498379 - RNA, 21 nt, Chlamydophila pneumoniae CWL029
agaaaacauagagauucuaca

SEQ ID NO: 498380 - RNA, 13 nt, Chlamydophila pneumoniae CWL029
agaaaacauagag

SEQ ID NO: 498381 - RNA, 19 nt, Chlamydophila pneumoniae CWL029
agaaaaaccccuagaacuu

SEQ ID NO: 498382 - RNA, 13 nt, Chlamydophila pneumoniae CWL029
agaaaaagaacau

SEQ ID NO: 498383 - RNA, 22 nt, Chlamydophila pneumoniae CWL029
acuuuuuuucuucucuaagaaa

SEQ ID NO: 498384 - RNA, 13 nt, Chlamydophila pneumoniae CWL029
agaaaagauaaaa

SEQ ID NO: 498385 - RNA, 16 nt, Chlamydophila pneumoniae CWL029
agaaaagaacagggga

SEQ ID NO: 498386 - RNA, 14 nt, Chlamydophila pneumoniae CWL029
agaaaagaaaagug

SEQ ID NO: 498387 - RNA, 17 nt, Chlamydophila pneumoniae CWL029
agaaaagaaaaguguga

SEQ ID NO: 498388 - RNA, 18 nt, Chlamydophila pneumoniae CWL029
agaaaagaaaagugugag

SEQ ID NO: 498389 - RNA, 15 nt, Chlamydophila pneumoniae CWL029
agaaaauaaagaucu

SEQ ID NO: 498390 - RNA, 19 nt, Chlamydophila pneumoniae CWL029
agaaaauaaagaucuucau

SEQ ID NO: 498391 - RNA, 13 nt, Chlamydophila pneumoniae CWL029
agaaaauaagaag

SEQ ID NO: 498392 - RNA, 14 nt, Chlamydophila pneumoniae CWL029
agaaacaacugaaa

SEQ ID NO: 498393 - RNA, 20 nt, Chlamydophila pneumoniae CWL029
agaaaauaguacgcuuuuua

SEQ ID NO: 498394 - RNA, 14 nt, Chlamydophila pneumoniae CWL029
agaaaauaucacau

SEQ ID NO: 498395 - RNA, 13 nt, Chlamydophila pneumoniae CWL029
agauaaaucccac

SEQ ID NO: 498396 - RNA, 23 nt, Chlamydophila pneumoniae CWL029
agauaaauccccaccaacaaugc

SEQ ID NO: 498397 - RNA, 13 nt, Chlamydophila pneumoniae CWL029
agauaaacauaca

SEQ ID NO: 498398 - RNA, 13 nt, Chlamydophila pneumoniae CWL029
agauaaagaauuc

SEQ ID NO: 498399 - RNA, 19 nt, Chlamydophila pneumoniae CWL029
agauaaagacaucucuuua

SEQ ID NO: 498400 - RNA, 21 nt, Chlamydophila pneumoniae CWL029
agaguucgcacuaauuuccuu

SEQ ID NO: 498401 - RNA, 23 nt, Chlamydophila pneumoniae CWL029
agaguucgcacuaauuuccuuca

SEQ ID NO: 498402 - RNA, 18 nt, Chlamydophila pneumoniae CWL029
agauaaacagcacaggca

SEQ ID NO: 498403 - RNA, 14 nt, Chlamydophila pneumoniae CWL029
agaguuagauguaa

SEQ ID NO: 498404 - RNA, 17 nt, Chlamydophila pneumoniae CWL029
agaguuccgcaaauaca

SEQ ID NO: 498405 - RNA, 20 nt, Chlamydophila pneumoniae CWL029
agaguggucauugccuugcu

SEQ ID NO: 498406 - RNA, 15 nt, Chlamydophila pneumoniae CWL029
agagugucuaagaua

SEQ ID NO: 498407 - RNA, 12 nt, Chlamydophila pneumoniae CWL029
agaguagcccca

SEQ ID NO: 498408 - RNA, 20 nt, Chlamydophila pneumoniae CWL029
agagggaucauguagcagag

SEQ ID NO: 498409 - RNA, 21 nt, Chlamydophila pneumoniae CWL029
agagggaucauguagcagagc

SEQ ID NO: 498410 - RNA, 16 nt, Chlamydophila pneumoniae CWL029
agagggauuuguagga

SEQ ID NO: 498411 - RNA, 22 nt, Chlamydophila pneumoniae CWL029
agagguucuugcuuauugucuu

SEQ ID NO: 498412 - RNA, 13 nt, Chlamydophila pneumoniae CWL029
agaguaaagagua

SEQ ID NO: 498413 - RNA, 15 nt, Chlamydophila pneumoniae CWL029
agagccgucuacuuu

SEQ ID NO: 498414 - RNA, 18 nt, Chlamydophila pneumoniae CWL029
agagcuaacagcacguaa

SEQ ID NO: 498415 - RNA, 12 nt, Chlamydophila pneumoniae CWL029
agagcuagaaug

SEQ ID NO: 498416 - RNA, 13 nt, Chlamydophila pneumoniae CWL029
agagcuaugauga

SEQ ID NO: 498417 - RNA, 22 nt, Chlamydophila pneumoniae CWL029
agaggagacucuaguuuuucuu

SEQ ID NO: 498418 - RNA, 15 nt, Chlamydophila pneumoniae CWL029
agaggagagaauccu

SEQ ID NO: 498419 - RNA, 18 nt, Chlamydophila pneumoniae CWL029
agaggaagcacaccaagu

SEQ ID NO: 498420 - RNA, 21 nt, Chlamydophila pneumoniae CWL029
agaggaccgagaugaacauaa

SEQ ID NO: 498421 - RNA, 13 nt, Chlamydophila pneumoniae CWL029
agaggccaccaaa

SEQ ID NO: 498422 - RNA, 13 nt, Chlamydophila pneumoniae CWL029
agaggcaauugag

SEQ ID NO: 498423 - RNA, 18 nt, Chlamydophila pneumoniae CWL029
agaggccuuuuagaguau

SEQ ID NO: 498424 - RNA, 17 nt, Chlamydophila pneumoniae CWL029
agagcaugcuugaggaa

SEQ ID NO: 498425 - RNA, 19 nt, Chlamydophila pneumoniae CWL029
agagcccuugugcaucuau

SEQ ID NO: 498426 - RNA, 22 nt, Chlamydophila pneumoniae CWL029
agagcacuuuuaauauuugaga

SEQ ID NO: 498427 - RNA, 20 nt, Chlamydophila pneumoniae CWL029
agagacaucguauauaagau

SEQ ID NO: 498428 - RNA, 12 nt, Chlamydophila pneumoniae CWL029
agagaccuucuc

SEQ ID NO: 498429 - RNA, 18 nt, Chlamydophila pneumoniae CWL029
agagaccuucucuucaga

SEQ ID NO: 498430 - RNA, 23 nt, Chlamydophila pneumoniae CWL029
agagaauacauugcugccaggcu

SEQ ID NO: 498431 - RNA, 22 nt, Chlamydophila pneumoniae CWL029
agagaauacucuagguuuucuc

SEQ ID NO: 498432 - RNA, 21 nt, Chlamydophila pneumoniae CWL029
agagaauccuuuuuaggaaag

SEQ ID NO: 498433 - RNA, 22 nt, Chlamydophila pneumoniae CWL029
agagaauccuuuuuaggaaagg

SEQ ID NO: 498434 - RNA, 18 nt, Chlamydophila pneumoniae CWL029
agagaaucgagaacaguu

SEQ ID NO: 498435 - RNA, 19 nt, Chlamydophila pneumoniae CWL029
agagaaucuccucaucaga

SEQ ID NO: 498436 - RNA, 15 nt, Chlamydophila pneumoniae CWL029
agagaauguucccaa

SEQ ID NO: 498437 - RNA, 22 nt, Chlamydophila pneumoniae CWL029
agagaauuauuauuaguuaauu

SEQ ID NO: 498438 - RNA, 14 nt, Chlamydophila pneumoniae CWL029
agagacaaagccac

SEQ ID NO: 498439 - RNA, 17 nt, Chlamydophila pneumoniae CWL029
agagacaaagccacagc

SEQ ID NO: 498440 - RNA, 13 nt, Chlamydophila pneumoniae CWL029
agagacaagaaaa

SEQ ID NO: 498441 - RNA, 14 nt, Chlamydophila pneumoniae CWL029
agagacacagaagg

SEQ ID NO: 498442 - RNA, 15 nt, Chlamydophila pneumoniae CWL029
agagacacagaagga

SEQ ID NO: 498443 - RNA, 14 nt, Chlamydophila pneumoniae CWL029
agagaagacaggag

SEQ ID NO: 498444 - RNA, 17 nt, Chlamydophila pneumoniae CWL029
agagaacuuucgucuuu

SEQ ID NO: 498445 - RNA, 21 nt, Chlamydophila pneumoniae CWL029
agagaagagguguccauaaug

SEQ ID NO: 498446 - RNA, 22 nt, Chlamydophila pneumoniae CWL029
agagaacucuuaaagguaaagc

SEQ ID NO: 498447 - RNA, 20 nt, Chlamydophila pneumoniae CWL029
agagaacuuuaacgaagaag

SEQ ID NO: 498448 - RNA, 20 nt, Chlamydophila pneumoniae CWL029
agagaaaggcgcucuuaccu

SEQ ID NO: 498449 - RNA, 11 nt, Chlamydophila pneumoniae CWL029
agagaaaauca

SEQ ID NO: 498450 - RNA, 18 nt, Chlamydophila pneumoniae CWL029
agacuuguauucuugaga

SEQ ID NO: 498451 - RNA, 13 nt, Chlamydophila pneumoniae CWL029
agacuuuccucuc

SEQ ID NO: 498452 - RNA, 17 nt, Chlamydophila pneumoniae CWL029
agacuuuccucucuuua

SEQ ID NO: 498453 - RNA, 20 nt, Chlamydophila pneumoniae CWL029
agacuucgaugucuuuccag

SEQ ID NO: 498454 - RNA, 16 nt, Chlamydophila pneumoniae CWL029
agacucucuuccaaaa

SEQ ID NO: 498455 - RNA, 18 nt, Chlamydophila pneumoniae CWL029
agacugcaaaggaaggga

SEQ ID NO: 498456 - RNA, 19 nt, Chlamydophila pneumoniae CWL029
agacucuaguuuuucuuua

SEQ ID NO: 498457 - RNA, 13 nt, Chlamydophila pneumoniae CWL029
agacucucaucag

SEQ ID NO: 498458 - RNA, 15 nt, Chlamydophila pneumoniae CWL029
agacucucaucagca

SEQ ID NO: 498459 - RNA, 22 nt, Chlamydophila pneumoniae CWL029
agacuguguuuuauccaccaag

SEQ ID NO: 498460 - RNA, 23 nt, Chlamydophila pneumoniae CWL029
agacgcuagguugcaugcuugaa

SEQ ID NO: 498461 - RNA, 22 nt, Chlamydophila pneumoniae CWL029
agacucccaaggaaauuaugga

SEQ ID NO: 498462 - RNA, 21 nt, Chlamydophila pneumoniae CWL029
agacucaucuuugaacaacuc

SEQ ID NO: 498463 - RNA, 13 nt, Chlamydophila pneumoniae CWL029
agacucagagaaa

SEQ ID NO: 498464 - RNA, 14 nt, Chlamydophila pneumoniae CWL029
agacucagagaaaa

SEQ ID NO: 498465 - RNA, 18 nt, Chlamydophila pneumoniae CWL029
agacucagagaaaaucaa

SEQ ID NO: 498466 - RNA, 22 nt, Chlamydophila pneumoniae CWL029
agacgcuuuuaucuguuaaaaa

SEQ ID NO: 498467 - RNA, 21 nt, Chlamydophila pneumoniae CWL029
agacucacauuugcuuuaaca

SEQ ID NO: 498468 - RNA, 19 nt, Chlamydophila pneumoniae CWL029
agacccuucuuuccauaaa

SEQ ID NO: 498469 - RNA, 21 nt, Chlamydophila pneumoniae CWL029
agacccuccguggcggauaau

SEQ ID NO: 498470 - RNA, 20 nt, Chlamydophila pneumoniae CWL029
agaccaauaaauccaaaaaa

SEQ ID NO: 498471 - RNA, 23 nt, Chlamydophila pneumoniae CWL029
agacauucccuaaagcugccagu

SEQ ID NO: 498472 - RNA, 16 nt, Chlamydophila pneumoniae CWL029
agaccaaacuuucuuu

SEQ ID NO: 498473 - RNA, 17 nt, Chlamydophila pneumoniae CWL029
agacauucauuuuuuaa

SEQ ID NO: 498474 - RNA, 12 nt, Chlamydophila pneumoniae CWL029
agacauuccaca

SEQ ID NO: 498475 - RNA, 17 nt, Chlamydophila pneumoniae CWL029
agaccguccuccccaua

SEQ ID NO: 498476 - RNA, 22 nt, Chlamydophila pneumoniae CWL029
agacaaagaauccccccuucua

SEQ ID NO: 498477 - RNA, 16 nt, Chlamydophila pneumoniae CWL029
agacaaagccacagcc

SEQ ID NO: 498478 - RNA, 13 nt, Chlamydophila pneumoniae CWL029
agacaaaguuguu

SEQ ID NO: 498479 - RNA, 14 nt, Chlamydophila pneumoniae CWL029
agaauuuucugcga

SEQ ID NO: 498480 - RNA, 20 nt, Chlamydophila pneumoniae CWL029
agaauuaagaagaagcugac

SEQ ID NO: 498481 - RNA, 14 nt, Chlamydophila pneumoniae CWL029
agaauuuucaugau

SEQ ID NO: 498482 - RNA, 22 nt, Chlamydophila pneumoniae CWL029
agacaucucugcuuuccacacg

SEQ ID NO: 498483 - RNA, 17 nt, Chlamydophila pneumoniae CWL029
agacaaugacuguagga

SEQ ID NO: 498484 - RNA, 22 nt, Chlamydophila pneumoniae CWL029
agacaaugcaaccuguaaagac

SEQ ID NO: 498485 - RNA, 19 nt, Chlamydophila pneumoniae CWL029
agacacaaaaagcuuuuuu

SEQ ID NO: 498486 - RNA, 16 nt, Chlamydophila pneumoniae CWL029
agacacacuuucuuua

SEQ ID NO: 498487 - RNA, 16 nt, Chlamydophila pneumoniae CWL029
agaaggccaguuacug

SEQ ID NO: 498488 - RNA, 18 nt, Chlamydophila pneumoniae CWL029
agaaggcuuguuucuguu

SEQ ID NO: 498489 - RNA, 19 nt, Chlamydophila pneumoniae CWL029
agaaggcucucaaggucac

SEQ ID NO: 498490 - RNA, 16 nt, Chlamydophila pneumoniae CWL029
agaagcggaagcaccg

SEQ ID NO: 498491 - RNA, 16 nt, Chlamydophila pneumoniae CWL029
agaaggaggaguccuu

SEQ ID NO: 498492 - RNA, 16 nt, Chlamydophila pneumoniae CWL029
agaaauuaacagagcg

SEQ ID NO: 498493 - RNA, 16 nt, Chlamydophila pneumoniae CWL029
agaaauguugauaggu

SEQ ID NO: 498494 - RNA, 20 nt, Chlamydophila pneumoniae CWL029
agaaauuccaauuuuugcau

SEQ ID NO: 498495 - RNA, 13 nt, Chlamydophila pneumoniae CWL029
agaaaugcucuuc

SEQ ID NO: 498496 - RNA, 21 nt, Chlamydophila pneumoniae CWL029
agaaaugcaaaccaaaaaagu

SEQ ID NO: 498497 - RNA, 14 nt, Chlamydophila pneumoniae CWL029
agaaauucuaagag

SEQ ID NO: 498498 - RNA, 10 nt, Chlamydophila pneumoniae CWL029
agaagacgcu

SEQ ID NO: 498499 - RNA, 14 nt, Chlamydophila pneumoniae CWL029
agaagagaaaagau

SEQ ID NO: 498500 - RNA, 21 nt, Chlamydophila pneumoniae CWL029
agaagacgcucuuagccuagg

SEQ ID NO: 498501 - RNA, 19 nt, Chlamydophila pneumoniae CWL029
agaagacucccaaggaaau

SEQ ID NO: 498502 - RNA, 15 nt, Chlamydophila pneumoniae CWL029
agaagagaaaagaua

SEQ ID NO: 498503 - RNA, 19 nt, Chlamydophila pneumoniae CWL029
agaagaugauuggacaagu

SEQ ID NO: 498504 - RNA, 15 nt, Chlamydophila pneumoniae CWL029
agaagauucaagcaa

SEQ ID NO: 498505 - RNA, 14 nt, Chlamydophila pneumoniae CWL029
agaagauucuuuaa

SEQ ID NO: 498506 - RNA, 17 nt, Chlamydophila pneumoniae CWL029
agaagagguaauaauag

SEQ ID NO: 498507 - RNA, 14 nt, Chlamydophila pneumoniae CWL029
agaagaucaaagau

SEQ ID NO: 498508 - RNA, 12 nt, Chlamydophila pneumoniae CWL029
agaauaaaacuu

SEQ ID NO: 498509 - RNA, 17 nt, Chlamydophila pneumoniae CWL029
agaauaaaacuuucuuu

SEQ ID NO: 498510 - RNA, 21 nt, Chlamydophila pneumoniae CWL029
agaauaaaacuuucuuuuuga

SEQ ID NO: 498511 - RNA, 12 nt, Chlamydophila pneumoniae CWL029
agaauaaagauu

SEQ ID NO: 498512 - RNA, 14 nt, Chlamydophila pneumoniae CWL029
agaauaucaucuuc

SEQ ID NO: 498513 - RNA, 18 nt, Chlamydophila pneumoniae CWL029
agaaucauugagaugaaa

SEQ ID NO: 498514 - RNA, 15 nt, Chlamydophila pneumoniae CWL029
agaauccauuuugcc

SEQ ID NO: 498515 - RNA, 16 nt, Chlamydophila pneumoniae CWL029
agaauccauuuugccc

SEQ ID NO: 498516 - RNA, 23 nt, Chlamydophila pneumoniae CWL029
agaauccauuuugcccacuucua

SEQ ID NO: 498517 - RNA, 15 nt, Chlamydophila pneumoniae CWL029
agaauaugaacugcc

SEQ ID NO: 498518 - RNA, 22 nt, Chlamydophila pneumoniae CWL029
agaaucauaacaagucuaucga

SEQ ID NO: 498519 - RNA, 11 nt, Chlamydophila pneumoniae CWL029
agaaugaugca

SEQ ID NO: 498520 - RNA, 14 nt, Chlamydophila pneumoniae CWL029
agaaugaugcaagc

SEQ ID NO: 498521 - RNA, 16 nt, Chlamydophila pneumoniae CWL029
agaaugcaucuugagg

SEQ ID NO: 498522 - RNA, 15 nt, Chlamydophila pneumoniae CWL029
agaaugauaagaaag

SEQ ID NO: 498523 - RNA, 16 nt, Chlamydophila pneumoniae CWL029
agaaugauaagaaagc

SEQ ID NO: 498524 - RNA, 19 nt, Chlamydophila pneumoniae CWL029
agcaacaguaauuauuuuc

SEQ ID NO: 498525 - RNA, 18 nt, Chlamydophila pneumoniae CWL029
agcaacaucguuaauaua

SEQ ID NO: 498526 - RNA, 19 nt, Chlamydophila pneumoniae CWL029
agcaacaucguuaauauaa

SEQ ID NO: 498527 - RNA, 22 nt, Chlamydophila pneumoniae CWL029
agcaacaucguuaauauaauug

SEQ ID NO: 498528 - RNA, 14 nt, Chlamydophila pneumoniae CWL029
agcaacaaccaaaa

SEQ ID NO: 498529 - RNA, 14 nt, Chlamydophila pneumoniae CWL029
agcaaccuuuccua

SEQ ID NO: 498530 - RNA, 19 nt, Chlamydophila pneumoniae CWL029
agcaaccuuuccuaaaaua

SEQ ID NO: 498531 - RNA, 22 nt, Chlamydophila pneumoniae CWL029
agcaacgcaugacgcuuuucca

SEQ ID NO: 498532 - RNA, 14 nt, Chlamydophila pneumoniae CWL029
agcaacuaaagcau

SEQ ID NO: 498533 - RNA, 12 nt, Chlamydophila pneumoniae CWL029
agcaacucuuca

SEQ ID NO: 498534 - RNA, 17 nt, Chlamydophila pneumoniae CWL029
agcaagaauuucuucua

SEQ ID NO: 498535 - RNA, 20 nt, Chlamydophila pneumoniae CWL029
agcaauaucuauagaaggca

SEQ ID NO: 498536 - RNA, 21 nt, Chlamydophila pneumoniae CWL029
agcaaucccccagcauucacu

SEQ ID NO: 498537 - RNA, 19 nt, Chlamydophila pneumoniae CWL029
agcaaucccccagcauuca

SEQ ID NO: 498538 - RNA, 18 nt, Chlamydophila pneumoniae CWL029
agcaaucguguuuuccug

SEQ ID NO: 498539 - RNA, 21 nt, Chlamydophila pneumoniae CWL029
agcaaucuguauccgacucug

SEQ ID NO: 498540 - RNA, 20 nt, Chlamydophila pneumoniae CWL029
agcaaugccucuaauacguu

SEQ ID NO: 498541 - RNA, 16 nt, Chlamydophila pneumoniae CWL029
agcaaugauguuuuuu

SEQ ID NO: 498542 - RNA, 13 nt, Chlamydophila pneumoniae CWL029
agcaaggaaaaaa

SEQ ID NO: 498543 - RNA, 14 nt, Chlamydophila pneumoniae CWL029
agcaaggaaaaaaa

SEQ ID NO: 498544 - RNA, 21 nt, Chlamydophila pneumoniae CWL029
agcaaggaaaaaaaaucugcu

SEQ ID NO: 498545 - RNA, 17 nt, Chlamydophila pneumoniae CWL029
agcaagauuuuguagga

SEQ ID NO: 498546 - RNA, 12 nt, Chlamydophila pneumoniae CWL029
agcaagauggca

SEQ ID NO: 498547 - RNA, 13 nt, Chlamydophila pneumoniae CWL029
agcaagagcucuu

SEQ ID NO: 498548 - RNA, 19 nt, Chlamydophila pneumoniae CWL029
agcaagagcucuugagaaa

SEQ ID NO: 498549 - RNA, 23 nt, Chlamydophila pneumoniae CWL029
agcaagguaacauccauagagaa

SEQ ID NO: 498550 - RNA, 19 nt, Chlamydophila pneumoniae CWL029
agcaaagaaaauucucaga

SEQ ID NO: 498551 - RNA, 21 nt, Chlamydophila pneumoniae CWL029
agcaaagaacacccccgcagc

SEQ ID NO: 498552 - RNA, 14 nt, Chlamydophila pneumoniae CWL029
agcaaagcggcucu

SEQ ID NO: 498553 - RNA, 16 nt, Chlamydophila pneumoniae CWL029
agcaaagagcaaggaa

SEQ ID NO: 498554 - RNA, 15 nt, Chlamydophila pneumoniae CWL029
agcaaagauaaagaa

SEQ ID NO: 498555 - RNA, 17 nt, Chlamydophila pneumoniae CWL029
agcaaagauaaagaagu

SEQ ID NO: 498556 - RNA, 19 nt, Chlamydophila pneumoniae CWL029
agcaaaucuaaaaccugac

SEQ ID NO: 498557 - RNA, 22 nt, Chlamydophila pneumoniae CWL029
agcaaaguuaaugcaagcaacu

SEQ ID NO: 498558 - RNA, 13 nt, Chlamydophila pneumoniae CWL029
agauuuuucuuuu

SEQ ID NO: 498559 - RNA, 14 nt, Chlamydophila pneumoniae CWL029
agauuuuuagaaua

SEQ ID NO: 498560 - RNA, 19 nt, Chlamydophila pneumoniae CWL029
agauuuugagaaugaacaa

SEQ ID NO: 498561 - RNA, 23 nt, Chlamydophila pneumoniae CWL029
agauuuuguaggaacaugccaaa

SEQ ID NO: 498562 - RNA, 13 nt, Chlamydophila pneumoniae CWL029
agcaaaacuagga

SEQ ID NO: 498563 - RNA, 23 nt, Chlamydophila pneumoniae CWL029
agcaaaacuguguucaauagcaa

SEQ ID NO: 498564 - RNA, 15 nt, Chlamydophila pneumoniae CWL029
agcaaaaauucuagg

SEQ ID NO: 498565 - RNA, 20 nt, Chlamydophila pneumoniae CWL029
agcaaaaugcgaggaaaaag

SEQ ID NO: 498566 - RNA, 22 nt, Chlamydophila pneumoniae CWL029
agauuuuaggggguuuuucuau

SEQ ID NO: 498567 - RNA, 14 nt, Chlamydophila pneumoniae CWL029
agauuuuaaagccu

SEQ ID NO: 498568 - RNA, 22 nt, Chlamydophila pneumoniae CWL029
agauuuuaaagccuccucaaga

SEQ ID NO: 498569 - RNA, 17 nt, Chlamydophila pneumoniae CWL029
agauuucuaauccucca

SEQ ID NO: 498570 - RNA, 20 nt, Chlamydophila pneumoniae CWL029
agauuucuauagagcaucau

SEQ ID NO: 498571 - RNA, 12 nt, Chlamydophila pneumoniae CWL029
agauuuccuccg

SEQ ID NO: 498572 - RNA, 17 nt, Chlamydophila pneumoniae CWL029
agauuuccuuaagcuuc

SEQ ID NO: 498573 - RNA, 20 nt, Chlamydophila pneumoniae CWL029
agauuuccuuaagcuucuga

SEQ ID NO: 498574 - RNA, 16 nt, Chlamydophila pneumoniae CWL029
agauuuaguucaccac

SEQ ID NO: 498575 - RNA, 14 nt, Chlamydophila pneumoniae CWL029
agauaauagagaag

SEQ ID NO: 498576 - RNA, 19 nt, Chlamydophila pneumoniae CWL029
agauaauagagaagaagca

SEQ ID NO: 498577 - RNA, 17 nt, Chlamydophila pneumoniae CWL029
agauaauagagaagaag

SEQ ID NO: 498578 - RNA, 19 nt, Chlamydophila pneumoniae CWL029
agauugugcucaauacaga

SEQ ID NO: 498579 - RNA, 18 nt, Chlamydophila pneumoniae CWL029
agauuguuucaggccugg

SEQ ID NO: 498580 - RNA, 18 nt, Chlamydophila pneumoniae CWL029
agauuguucaaaaauaga

SEQ ID NO: 498581 - RNA, 16 nt, Chlamydophila pneumoniae CWL029
agauuguaauuuccuu

SEQ ID NO: 498582 - RNA, 13 nt, Chlamydophila pneumoniae CWL029
agauaauuaugua

SEQ ID NO: 498583 - RNA, 17 nt, Chlamydophila pneumoniae CWL029
agcagaguuuuucccuc

SEQ ID NO: 498584 - RNA, 13 nt, Chlamydophila pneumoniae CWL029
agcagcaaaaauu

SEQ ID NO: 498585 - RNA, 13 nt, Chlamydophila pneumoniae CWL029
agcagcagaauca

SEQ ID NO: 498586 - RNA, 18 nt, Chlamydophila pneumoniae CWL029
agcagcaaauacuccagg

SEQ ID NO: 498587 - RNA, 15 nt, Chlamydophila pneumoniae CWL029
agcagaaacuccaaa

SEQ ID NO: 498588 - RNA, 15 nt, Chlamydophila pneumoniae CWL029
agcacuucuuuagga

SEQ ID NO: 498589 - RNA, 16 nt, Chlamydophila pneumoniae CWL029
agcagacgaauaacua

SEQ ID NO: 498590 - RNA, 20 nt, Chlamydophila pneumoniae CWL029
agcagaaguccuaucaaagc

SEQ ID NO: 498591 - RNA, 18 nt, Chlamydophila pneumoniae CWL029
agcagaaucauaaucugc

SEQ ID NO: 498592 - RNA, 13 nt, Chlamydophila pneumoniae CWL029
agcacuuaaaaaa

SEQ ID NO: 498593 - RNA, 22 nt, Chlamydophila pneumoniae CWL029
agcacuuaaaaaacuuccuaac

SEQ ID NO: 498594 - RNA, 19 nt, Chlamydophila pneumoniae CWL029
agcacucacgcucucgcua

SEQ ID NO: 498595 - RNA, 20 nt, Chlamydophila pneumoniae CWL029
agcacucacgcucucgcuaa

SEQ ID NO: 498596 - RNA, 19 nt, Chlamydophila pneumoniae CWL029
agcacucuuaauuaaaaac

SEQ ID NO: 498597 - RNA, 12 nt, Chlamydophila pneumoniae CWL029
agcacugaugaa

SEQ ID NO: 498598 - RNA, 23 nt, Chlamydophila pneumoniae CWL029
agcacuaaaagggaagcuuccau

SEQ ID NO: 498599 - RNA, 14 nt, Chlamydophila pneumoniae CWL029
agcacgcacuaauc

SEQ ID NO: 498600 - RNA, 19 nt, Chlamydophila pneumoniae CWL029
agcacgagcgggagaauca

SEQ ID NO: 498601 - RNA, 15 nt, Chlamydophila pneumoniae CWL029
agcacauuuuucuau

SEQ ID NO: 498602 - RNA, 18 nt, Chlamydophila pneumoniae CWL029
agcacauuuuucuauaau

SEQ ID NO: 498603 - RNA, 14 nt, Chlamydophila pneumoniae CWL029
agcaccauaaugga

SEQ ID NO: 498604 - RNA, 18 nt, Chlamydophila pneumoniae CWL029
agcaccuaauaaagaagg

SEQ ID NO: 498605 - RNA, 13 nt, Chlamydophila pneumoniae CWL029
agcauagagagaa

SEQ ID NO: 498606 - RNA, 21 nt, Chlamydophila pneumoniae CWL029
agcauagagcucuaaaaaaga

SEQ ID NO: 498607 - RNA, 22 nt, Chlamydophila pneumoniae CWL029
agcauaguguauaucagcaaaa

SEQ ID NO: 498608 - RNA, 12 nt, Chlamydophila pneumoniae CWL029
agcauaaaaauu

SEQ ID NO: 498609 - RNA, 14 nt, Chlamydophila pneumoniae CWL029
agcauaaacaaagc

SEQ ID NO: 498610 - RNA, 19 nt, Chlamydophila pneumoniae CWL029
agcauaaggauucugagaa

SEQ ID NO: 498611 - RNA, 20 nt, Chlamydophila pneumoniae CWL029
agcauaaguuagccuggcua

SEQ ID NO: 498612 - RNA, 18 nt, Chlamydophila pneumoniae CWL029
agcauaaggggagucuug

SEQ ID NO: 498613 - RNA, 17 nt, Chlamydophila pneumoniae CWL029
agcaguugcaauaccaa

SEQ ID NO: 498614 - RNA, 12 nt, Chlamydophila pneumoniae CWL029
agcagugugcca

SEQ ID NO: 498615 - RNA, 13 nt, Chlamydophila pneumoniae CWL029
agcagugugccaa

SEQ ID NO: 498616 - RNA, 21 nt, Chlamydophila pneumoniae CWL029
agcaucugagucauaagcucu

SEQ ID NO: 498617 - RNA, 22 nt, Chlamydophila pneumoniae CWL029
agcaucugagucauaagcucua

SEQ ID NO: 498618 - RNA, 17 nt, Chlamydophila pneumoniae CWL029
agcaucuuucaucaaug

SEQ ID NO: 498619 - RNA, 17 nt, Chlamydophila pneumoniae CWL029
agcauccuguagagcaa

SEQ ID NO: 498620 - RNA, 18 nt, Chlamydophila pneumoniae CWL029
agcaucauuaauuccauc

SEQ ID NO: 498621 - RNA, 22 nt, Chlamydophila pneumoniae CWL029
agcauccaaaaugucuuuuuca

SEQ ID NO: 498622 - RNA, 23 nt, Chlamydophila pneumoniae CWL029
agcaucacggaguguuugaagau

SEQ ID NO: 498623 - RNA, 22 nt, Chlamydophila pneumoniae CWL029
agcauauuuaaauauaaauuua

SEQ ID NO: 498624 - RNA, 23 nt, Chlamydophila pneumoniae CWL029
agcagggaaaaugcgaucuucac

SEQ ID NO: 498625 - RNA, 21 nt, Chlamydophila pneumoniae CWL029
agcaggaaggaauagagaaag

SEQ ID NO: 498626 - RNA, 22 nt, Chlamydophila pneumoniae CWL029
agcaggaauaaucaaccaaaau

SEQ ID NO: 498627 - RNA, 18 nt, Chlamydophila pneumoniae CWL029
agcaggaaaagcaaaaug

SEQ ID NO: 498628 - RNA, 22 nt, Chlamydophila pneumoniae CWL029
agcaggauaaccaucaaucacu

SEQ ID NO: 498629 - RNA, 22 nt, Chlamydophila pneumoniae CWL029
agcagcugucaauccaacaaag

SEQ ID NO: 498630 - RNA, 17 nt, Chlamydophila pneumoniae CWL029
agcagcuucgcaaucuu

SEQ ID NO: 498631 - RNA, 14 nt, Chlamydophila pneumoniae CWL029
agcagccucuucuc

SEQ ID NO: 498632 - RNA, 18 nt, Chlamydophila pneumoniae CWL029
agccaucgcgaagcuuuc

SEQ ID NO: 498633 - RNA, 23 nt, Chlamydophila pneumoniae CWL029
agccaucgguucggucucuucuc

SEQ ID NO: 498634 - RNA, 21 nt, Chlamydophila pneumoniae CWL029
agccauaauuagaacagcaug

SEQ ID NO: 498635 - RNA, 20 nt, Chlamydophila pneumoniae CWL029
agccauaauuagaacagcau

SEQ ID NO: 498636 - RNA, 16 nt, Chlamydophila pneumoniae CWL029
agccauagaggaauga

SEQ ID NO: 498637 - RNA, 23 nt, Chlamydophila pneumoniae CWL029
agccaguacuaaauuaguaaaug

SEQ ID NO: 498638 - RNA, 22 nt, Chlamydophila pneumoniae CWL029
agccagacuggucuaacuuaga

SEQ ID NO: 498639 - RNA, 17 nt, Chlamydophila pneumoniae CWL029
agccagcagaaggcugc

SEQ ID NO: 498640 - RNA, 21 nt, Chlamydophila pneumoniae CWL029
agccaagaagauguagagucg

SEQ ID NO: 498641 - RNA, 17 nt, Chlamydophila pneumoniae CWL029
agccacagagaauugca

SEQ ID NO: 498642 - RNA, 15 nt, Chlamydophila pneumoniae CWL029
agccaccaucuguug

SEQ ID NO: 498643 - RNA, 17 nt, Chlamydophila pneumoniae CWL029
agccacccccacuucuu

SEQ ID NO: 498644 - RNA, 20 nt, Chlamydophila pneumoniae CWL029
agccacccccacuucuuuuu

SEQ ID NO: 498645 - RNA, 23 nt, Chlamydophila pneumoniae CWL029
agcauuuuacgaaucuuuuucau

SEQ ID NO: 498646 - RNA, 21 nt, Chlamydophila pneumoniae CWL029
agcauuuucucugagcagcuu

SEQ ID NO: 498647 - RNA, 17 nt, Chlamydophila pneumoniae CWL029
agccaaagucacucaaa

SEQ ID NO: 498648 - RNA, 22 nt, Chlamydophila pneumoniae CWL029
agcauguuauauagacaaugca

SEQ ID NO: 498649 - RNA, 14 nt, Chlamydophila pneumoniae CWL029
agcaugugcagaag

SEQ ID NO: 498650 - RNA, 15 nt, Chlamydophila pneumoniae CWL029
agcaugugcagaagg

SEQ ID NO: 498651 - RNA, 18 nt, Chlamydophila pneumoniae CWL029
agcauguucgauuuucuc

SEQ ID NO: 498652 - RNA, 13 nt, Chlamydophila pneumoniae CWL029
agcauuaggaaag

SEQ ID NO: 498653 - RNA, 16 nt, Chlamydophila pneumoniae CWL029
agcauucugcuagagc

SEQ ID NO: 498654 - RNA, 17 nt, Chlamydophila pneumoniae CWL029
agcauucugcuagagcu

SEQ ID NO: 498655 - RNA, 16 nt, Chlamydophila pneumoniae CWL029
agcauuguuuguccua

SEQ ID NO: 498656 - RNA, 22 nt, Chlamydophila pneumoniae CWL029
agcauuguuuguccuaggagag

SEQ ID NO: 498657 - RNA, 15 nt, Chlamydophila pneumoniae CWL029
agcauggacuccaag

SEQ ID NO: 498658 - RNA, 17 nt, Chlamydophila pneumoniae CWL029
agcauggacuccaagaa

SEQ ID NO: 498659 - RNA, 19 nt, Chlamydophila pneumoniae CWL029
agcauggacuccaagaaua

SEQ ID NO: 498660 - RNA, 15 nt, Chlamydophila pneumoniae CWL029
agcauggagaauaau

SEQ ID NO: 498661 - RNA, 13 nt, Chlamydophila pneumoniae CWL029
agcaugaagcaga

SEQ ID NO: 498662 - RNA, 15 nt, Chlamydophila pneumoniae CWL029
agcaugaugccauug

SEQ ID NO: 498663 - RNA, 20 nt, Chlamydophila pneumoniae CWL029
agcugagcuaucuucaaguu

SEQ ID NO: 498664 - RNA, 14 nt, Chlamydophila pneumoniae CWL029
agcugagagauuuu

SEQ ID NO: 498665 - RNA, 19 nt, Chlamydophila pneumoniae CWL029
agcugagagauuuuuucau

SEQ ID NO: 498666 - RNA, 18 nt, Chlamydophila pneumoniae CWL029
agcugcugagcagcaaaa

SEQ ID NO: 498667 - RNA, 19 nt, Chlamydophila pneumoniae CWL029
agcugcucuuuuagaaugu

SEQ ID NO: 498668 - RNA, 15 nt, Chlamydophila pneumoniae CWL029
agcugcaaucucaaa

SEQ ID NO: 498669 - RNA, 15 nt, Chlamydophila pneumoniae CWL029
agcugcaaacacaau

SEQ ID NO: 498670 - RNA, 17 nt, Chlamydophila pneumoniae CWL029
agcucguaauccuucuu

SEQ ID NO: 498671 - RNA, 22 nt, Chlamydophila pneumoniae CWL029
agcucuucagcaagucgguaau

SEQ ID NO: 498672 - RNA, 15 nt, Chlamydophila pneumoniae CWL029
agcucuuucauaaga

SEQ ID NO: 498673 - RNA, 14 nt, Chlamydophila pneumoniae CWL029
agcucuuucuugga

SEQ ID NO: 498674 - RNA, 15 nt, Chlamydophila pneumoniae CWL029
agcugacuccuugua

SEQ ID NO: 498675 - RNA, 15 nt, Chlamydophila pneumoniae CWL029
agcucgaccucuagc

SEQ ID NO: 498676 - RNA, 16 nt, Chlamydophila pneumoniae CWL029
agcucgagaucuuuuu

SEQ ID NO: 498677 - RNA, 20 nt, Chlamydophila pneumoniae CWL029
agcuccucacaucuccuuuc

SEQ ID NO: 498678 - RNA, 14 nt, Chlamydophila pneumoniae CWL029
agcuauagaaagag

SEQ ID NO: 498679 - RNA, 13 nt, Chlamydophila pneumoniae CWL029
agcucccucuaga

SEQ ID NO: 498680 - RNA, 14 nt, Chlamydophila pneumoniae CWL029
agcucccucuagag

SEQ ID NO: 498681 - RNA, 17 nt, Chlamydophila pneumoniae CWL029
agcuccauaagcuuuuc

SEQ ID NO: 498682 - RNA, 18 nt, Chlamydophila pneumoniae CWL029
agcuccauuuaaauggau

SEQ ID NO: 498683 - RNA, 15 nt, Chlamydophila pneumoniae CWL029
agcuccguaauggag

SEQ ID NO: 498684 - RNA, 20 nt, Chlamydophila pneumoniae CWL029
agcuccguaauggagagcuu

SEQ ID NO: 498685 - RNA, 18 nt, Chlamydophila pneumoniae CWL029
agcuccgaggcuucugag

SEQ ID NO: 498686 - RNA, 17 nt, Chlamydophila pneumoniae CWL029
agcuagucuucuuagaa

SEQ ID NO: 498687 - RNA, 17 nt, Chlamydophila pneumoniae CWL029
agcuagucuuucuaaga

SEQ ID NO: 498688 - RNA, 19 nt, Chlamydophila pneumoniae CWL029
agcuaggcgauaguaaaca

SEQ ID NO: 498689 - RNA, 13 nt, Chlamydophila pneumoniae CWL029
agcuagaagagcg

SEQ ID NO: 498690 - RNA, 15 nt, Chlamydophila pneumoniae CWL029
agcuagagcauuccg

SEQ ID NO: 498691 - RNA, 19 nt, Chlamydophila pneumoniae CWL029
agcuagagauccaaugaca

SEQ ID NO: 498692 - RNA, 17 nt, Chlamydophila pneumoniae CWL029
agcuacuaaucaccuua

SEQ ID NO: 498693 - RNA, 12 nt, Chlamydophila pneumoniae CWL029
agcuacuucuuc

SEQ ID NO: 498694 - RNA, 13 nt, Chlamydophila pneumoniae CWL029
agcuagaaagucc

SEQ ID NO: 498695 - RNA, 14 nt, Chlamydophila pneumoniae CWL029
agcuaaagaaacuu

SEQ ID NO: 498696 - RNA, 12 nt, Chlamydophila pneumoniae CWL029
agcuaaaucaaa

SEQ ID NO: 498697 - RNA, 13 nt, Chlamydophila pneumoniae CWL029
agcuaaaucaaaa

SEQ ID NO: 498698 - RNA, 19 nt, Chlamydophila pneumoniae CWL029
agcuacagaaagagcuaaa

SEQ ID NO: 498699 - RNA, 17 nt, Chlamydophila pneumoniae CWL029
agcuacagaaagagcua

SEQ ID NO: 498700 - RNA, 23 nt, Chlamydophila pneumoniae CWL029
agcgucaauguuaaucuaauuuu

SEQ ID NO: 498701 - RNA, 16 nt, Chlamydophila pneumoniae CWL029
agcgcuuuuuuaaagu

SEQ ID NO: 498702 - RNA, 15 nt, Chlamydophila pneumoniae CWL029
agcggcaacauaauc

SEQ ID NO: 498703 - RNA, 23 nt, Chlamydophila pneumoniae CWL029
agcgcuagugcaagguucugcga

SEQ ID NO: 498704 - RNA, 15 nt, Chlamydophila pneumoniae CWL029
agcgcguuucaaaua

SEQ ID NO: 498705 - RNA, 14 nt, Chlamydophila pneumoniae CWL029
agcgcccgaaucuu

SEQ ID NO: 498706 - RNA, 22 nt, Chlamydophila pneumoniae CWL029
agcgccuccaccugcagcgcag

SEQ ID NO: 498707 - RNA, 20 nt, Chlamydophila pneumoniae CWL029
agcgcaucacgaaaaggaga

SEQ ID NO: 498708 - RNA, 18 nt, Chlamydophila pneumoniae CWL029
agcgauuucgacagcagc

SEQ ID NO: 498709 - RNA, 13 nt, Chlamydophila pneumoniae CWL029
agcgauagcuaaa

SEQ ID NO: 498710 - RNA, 16 nt, Chlamydophila pneumoniae CWL029
agcgauagcuaaaccu

SEQ ID NO: 498711 - RNA, 21 nt, Chlamydophila pneumoniae CWL029
agcgaucgcaaucagcaacau

SEQ ID NO: 498712 - RNA, 17 nt, Chlamydophila pneumoniae CWL029
agcgaucucucuuccug

SEQ ID NO: 498713 - RNA, 22 nt, Chlamydophila pneumoniae CWL029
agcgagaacaccauaaaacaau

SEQ ID NO: 498714 - RNA, 15 nt, Chlamydophila pneumoniae CWL029
agcgaaccaaaguca

SEQ ID NO: 498715 - RNA, 15 nt, Chlamydophila pneumoniae CWL029
agccuucuucucgaa

SEQ ID NO: 498716 - RNA, 21 nt, Chlamydophila pneumoniae CWL029
agccuugauugaacagucuug

SEQ ID NO: 498717 - RNA, 20 nt, Chlamydophila pneumoniae CWL029
agccuugcagcauccugaac

SEQ ID NO: 498718 - RNA, 15 nt, Chlamydophila pneumoniae CWL029
agccuuggcucuaga

SEQ ID NO: 498719 - RNA, 22 nt, Chlamydophila pneumoniae CWL029
agccuuggcucuagaaauauac

SEQ ID NO: 498720 - RNA, 17 nt, Chlamydophila pneumoniae CWL029
agcgaaagcagcgaaga

SEQ ID NO: 498721 - RNA, 14 nt, Chlamydophila pneumoniae CWL029
agccuggaaaugaa

SEQ ID NO: 498722 - RNA, 12 nt, Chlamydophila pneumoniae CWL029
agccugucuaua

SEQ ID NO: 498723 - RNA, 19 nt, Chlamydophila pneumoniae CWL029
agccugucuuaucuaaaga

SEQ ID NO: 498724 - RNA, 21 nt, Chlamydophila pneumoniae CWL029
agccugucuuaucuaaagaaa

SEQ ID NO: 498725 - RNA, 20 nt, Chlamydophila pneumoniae CWL029
agccuuagcagcacccauaa

SEQ ID NO: 498726 - RNA, 18 nt, Chlamydophila pneumoniae CWL029
agccucugugguuuuuau

SEQ ID NO: 498727 - RNA, 21 nt, Chlamydophila pneumoniae CWL029
agccucgauuugaucuugcuc

SEQ ID NO: 498728 - RNA, 14 nt, Chlamydophila pneumoniae CWL029
agccucuucucuac

SEQ ID NO: 498729 - RNA, 17 nt, Chlamydophila pneumoniae CWL029
agccugcaccagacccu

SEQ ID NO: 498730 - RNA, 22 nt, Chlamydophila pneumoniae CWL029
agccuagcaaaacuguguucaa

SEQ ID NO: 498731 - RNA, 16 nt, Chlamydophila pneumoniae CWL029
agccuccuccuucugc

SEQ ID NO: 498732 - RNA, 22 nt, Chlamydophila pneumoniae CWL029
agccuccucaagauaaauccca

SEQ ID NO: 498733 - RNA, 20 nt, Chlamydophila pneumoniae CWL029
agccuaugggaggaauuccu

SEQ ID NO: 498734 - RNA, 16 nt, Chlamydophila pneumoniae CWL029
agccuaugauaaagcc

SEQ ID NO: 498735 - RNA, 20 nt, Chlamydophila pneumoniae CWL029
agccguaggguauccugcuc

SEQ ID NO: 498736 - RNA, 16 nt, Chlamydophila pneumoniae CWL029
agcccucgguuauuuu

SEQ ID NO: 498737 - RNA, 19 nt, Chlamydophila pneumoniae CWL029
agcccucgguuauuuuucc

SEQ ID NO: 498738 - RNA, 14 nt, Chlamydophila pneumoniae CWL029
agcccuagauagca

SEQ ID NO: 498739 - RNA, 13 nt, Chlamydophila pneumoniae CWL029
agcccuauagaaa

SEQ ID NO: 498740 - RNA, 23 nt, Chlamydophila pneumoniae CWL029
agcccuagaguaaagaguagccc

SEQ ID NO: 498741 - RNA, 17 nt, Chlamydophila pneumoniae CWL029
agcccuagauagcaaau

SEQ ID NO: 498742 - RNA, 13 nt, Chlamydophila pneumoniae CWL029
agccccagcaacc

SEQ ID NO: 498743 - RNA, 13 nt, Chlamydophila pneumoniae CWL029
agcccauuccugc

SEQ ID NO: 498744 - RNA, 14 nt, Chlamydophila pneumoniae CWL029
agccauuuuccagg

SEQ ID NO: 498745 - RNA, 15 nt, Chlamydophila pneumoniae CWL029
agccauuuuccagga

SEQ ID NO: 498746 - RNA, 12 nt, Chlamydophila pneumoniae CWL029
agccauuuucua

SEQ ID NO: 498747 - RNA, 20 nt, Chlamydophila pneumoniae CWL029
agccauuuucuaagagaucu

SEQ ID NO: 498748 - RNA, 21 nt, Chlamydophila pneumoniae CWL029
agcccuugguuuccuccuuuc

SEQ ID NO: 498749 - RNA, 22 nt, Chlamydophila pneumoniae CWL029
agccgaggcgauuuucauggac

SEQ ID NO: 498750 - RNA, 13 nt, Chlamydophila pneumoniae CWL029
agccggagcuucu

SEQ ID NO: 498751 - RNA, 21 nt, Chlamydophila pneumoniae CWL029
auaaaaucaagccacagagaa

SEQ ID NO: 498752 - RNA, 13 nt, Chlamydophila pneumoniae CWL029
auaaaauuggcuu

SEQ ID NO: 498753 - RNA, 14 nt, Chlamydophila pneumoniae CWL029
auaaaauuggcuuu

SEQ ID NO: 498754 - RNA, 17 nt, Chlamydophila pneumoniae CWL029
auaaaauuuaaaaaaau

SEQ ID NO: 498755 - RNA, 13 nt, Chlamydophila pneumoniae CWL029
auaaaauggccuc

SEQ ID NO: 498756 - RNA, 16 nt, Chlamydophila pneumoniae CWL029
auaaaaugagcucacg

SEQ ID NO: 498757 - RNA, 17 nt, Chlamydophila pneumoniae CWL029
auaaaaggguagcgaau

SEQ ID NO: 498758 - RNA, 19 nt, Chlamydophila pneumoniae CWL029
auaaaagaacgauaaaauu

SEQ ID NO: 498759 - RNA, 22 nt, Chlamydophila pneumoniae CWL029
auaaaagaacgauaaaauugaa

SEQ ID NO: 498760 - RNA, 13 nt, Chlamydophila pneumoniae CWL029
auaaaagaaagaa

SEQ ID NO: 498761 - RNA, 14 nt, Chlamydophila pneumoniae CWL029
auaaaagaaagaau

SEQ ID NO: 498762 - RNA, 22 nt, Chlamydophila pneumoniae CWL029
auaaaacgcuauuguuuguccu

SEQ ID NO: 498763 - RNA, 15 nt, Chlamydophila pneumoniae CWL029
auaaaaauguaauuu

SEQ ID NO: 498764 - RNA, 16 nt, Chlamydophila pneumoniae CWL029
auaaaaauucucauaa

SEQ ID NO: 498765 - RNA, 14 nt, Chlamydophila pneumoniae CWL029
auaaaacauaggcu

SEQ ID NO: 498766 - RNA, 15 nt, Chlamydophila pneumoniae CWL029
auaaauccaaaaaau

SEQ ID NO: 498767 - RNA, 17 nt, Chlamydophila pneumoniae CWL029
auaaaucccgaacaauc

SEQ ID NO: 498768 - RNA, 21 nt, Chlamydophila pneumoniae CWL029
auaaaugcuauuuuccucuau

SEQ ID NO: 498769 - RNA, 14 nt, Chlamydophila pneumoniae CWL029
auaaauguagggau

SEQ ID NO: 498770 - RNA, 19 nt, Chlamydophila pneumoniae CWL029
auaaauucaggacccuuuu

SEQ ID NO: 498771 - RNA, 18 nt, Chlamydophila pneumoniae CWL029
auaaaguuuguaaaaacu

SEQ ID NO: 498772 - RNA, 16 nt, Chlamydophila pneumoniae CWL029
auaaagacaucucuuu

SEQ ID NO: 498773 - RNA, 16 nt, Chlamydophila pneumoniae CWL029
auaaagaagguugaga

SEQ ID NO: 498774 - RNA, 16 nt, Chlamydophila pneumoniae CWL029
auaaauacaggagaau

SEQ ID NO: 498775 - RNA, 13 nt, Chlamydophila pneumoniae CWL029
auaaauacaggag

SEQ ID NO: 498776 - RNA, 17 nt, Chlamydophila pneumoniae CWL029
auaacaaacgccgcucu

SEQ ID NO: 498777 - RNA, 15 nt, Chlamydophila pneumoniae CWL029
auaaauuuaucugcu

SEQ ID NO: 498778 - RNA, 16 nt, Chlamydophila pneumoniae CWL029
auaaauuuaucugcuu

SEQ ID NO: 498779 - RNA, 15 nt, Chlamydophila pneumoniae CWL029
auaaccagaagacuc

SEQ ID NO: 498780 - RNA, 19 nt, Chlamydophila pneumoniae CWL029
auaaccaggggcuuuccuu

SEQ ID NO: 498781 - RNA, 19 nt, Chlamydophila pneumoniae CWL029
auaaccacuauacccucug

SEQ ID NO: 498782 - RNA, 14 nt, Chlamydophila pneumoniae CWL029
auaacaucaagaau

SEQ ID NO: 498783 - RNA, 21 nt, Chlamydophila pneumoniae CWL029
auaacaugcgcagaauaaaau

SEQ ID NO: 498784 - RNA, 16 nt, Chlamydophila pneumoniae CWL029
auaacaugcgcagaau

SEQ ID NO: 498785 - RNA, 21 nt, Chlamydophila pneumoniae CWL029
auaaccuuugacaacaccaca

SEQ ID NO: 498786 - RNA, 13 nt, Chlamydophila pneumoniae CWL029
auaaccugggcaa

SEQ ID NO: 498787 - RNA, 22 nt, Chlamydophila pneumoniae CWL029
aguuuuuuaagugcuuuuagau

SEQ ID NO: 498788 - RNA, 16 nt, Chlamydophila pneumoniae CWL029
aguuuuuucaauccuu

SEQ ID NO: 498789 - RNA, 20 nt, Chlamydophila pneumoniae CWL029
aguuuuuucaauccuuccuu

SEQ ID NO: 498790 - RNA, 13 nt, Chlamydophila pneumoniae CWL029
auaaaaaagagag

SEQ ID NO: 498791 - RNA, 13 nt, Chlamydophila pneumoniae CWL029
aguuuucaaaaau

SEQ ID NO: 498792 - RNA, 16 nt, Chlamydophila pneumoniae CWL029
aguuuucaagucugua

SEQ ID NO: 498793 - RNA, 17 nt, Chlamydophila pneumoniae CWL029
aguuuguagcagcaaga

SEQ ID NO: 498794 - RNA, 21 nt, Chlamydophila pneumoniae CWL029
aguuuguagcauuucuuucuc

SEQ ID NO: 498795 - RNA, 20 nt, Chlamydophila pneumoniae CWL029
aguuuccaagugaucagaaa

SEQ ID NO: 498796 - RNA, 17 nt, Chlamydophila pneumoniae CWL029
aguuucaaucucuccuu

SEQ ID NO: 498797 - RNA, 18 nt, Chlamydophila pneumoniae CWL029
aguuucacauaguuuaau

SEQ ID NO: 498798 - RNA, 16 nt, Chlamydophila pneumoniae CWL029
aguugaccuuuuucau

SEQ ID NO: 498799 - RNA, 20 nt, Chlamydophila pneumoniae CWL029
aguugagaaccuucacaaga

SEQ ID NO: 498800 - RNA, 22 nt, Chlamydophila pneumoniae CWL029
aguugagaaccuucacaagaaa

SEQ ID NO: 498801 - RNA, 13 nt, Chlamydophila pneumoniae CWL029
aguugaggaaagg

SEQ ID NO: 498802 - RNA, 19 nt, Chlamydophila pneumoniae CWL029
aguugcgcgcccucuucua

SEQ ID NO: 498803 - RNA, 19 nt, Chlamydophila pneumoniae CWL029
aguugccuaaagagauaua

SEQ ID NO: 498804 - RNA, 21 nt, Chlamydophila pneumoniae CWL029
aguugcgcaguggacggggag

SEQ ID NO: 498805 - RNA, 17 nt, Chlamydophila pneumoniae CWL029
aguuggcguuuucuaga

SEQ ID NO: 498806 - RNA, 14 nt, Chlamydophila pneumoniae CWL029
aguuguaauuucuu

SEQ ID NO: 498807 - RNA, 18 nt, Chlamydophila pneumoniae CWL029
aguuuaugacacagcuaa

SEQ ID NO: 498808 - RNA, 17 nt, Chlamydophila pneumoniae CWL029
aguucgcggaucuucuu

SEQ ID NO: 498809 - RNA, 19 nt, Chlamydophila pneumoniae CWL029
aguucgcgaccugugauuu

SEQ ID NO: 498810 - RNA, 23 nt, Chlamydophila pneumoniae CWL029
aguucuuguuaaaguaaaaaaua

SEQ ID NO: 498811 - RNA, 17 nt, Chlamydophila pneumoniae CWL029
aguucuuuuguuugucu

SEQ ID NO: 498812 - RNA, 18 nt, Chlamydophila pneumoniae CWL029
aguucuugauucucuucc

SEQ ID NO: 498813 - RNA, 18 nt, Chlamydophila pneumoniae CWL029
aguucuugccaauguggu

SEQ ID NO: 498814 - RNA, 16 nt, Chlamydophila pneumoniae CWL029
aguucuuggaaaaaag

SEQ ID NO: 498815 - RNA, 19 nt, Chlamydophila pneumoniae CWL029
aguucuuguaauaaaagaa

SEQ ID NO: 498816 - RNA, 22 nt, Chlamydophila pneumoniae CWL029
aguucuuguaauaaaagaacau

SEQ ID NO: 498817 - RNA, 15 nt, Chlamydophila pneumoniae CWL029
aguucuuguuaaagu

SEQ ID NO: 498818 - RNA, 20 nt, Chlamydophila pneumoniae CWL029
aguucucccgugaacaaaaa

SEQ ID NO: 498819 - RNA, 15 nt, Chlamydophila pneumoniae CWL029
aguucucucuucacu

SEQ ID NO: 498820 - RNA, 17 nt, Chlamydophila pneumoniae CWL029
aguucuuccuucuucuu

SEQ ID NO: 498821 - RNA, 14 nt, Chlamydophila pneumoniae CWL029
aguucuucuuuacu

SEQ ID NO: 498822 - RNA, 14 nt, Chlamydophila pneumoniae CWL029
aguuccgauaaaga

SEQ ID NO: 498823 - RNA, 15 nt, Chlamydophila pneumoniae CWL029
aguuccgaauaggca

SEQ ID NO: 498824 - RNA, 20 nt, Chlamydophila pneumoniae CWL029
aguuccgcggccaucauuaa

SEQ ID NO: 498825 - RNA, 22 nt, Chlamydophila pneumoniae CWL029
aguucauguugcucauccuuua

SEQ ID NO: 498826 - RNA, 16 nt, Chlamydophila pneumoniae CWL029
aguucauuagcuaaau

SEQ ID NO: 498827 - RNA, 19 nt, Chlamydophila pneumoniae CWL029
aguucauuagcuaaaucaa

SEQ ID NO: 498828 - RNA, 17 nt, Chlamydophila pneumoniae CWL029
aguucagcaaagaaguu

SEQ ID NO: 498829 - RNA, 14 nt, Chlamydophila pneumoniae CWL029
aguuauuaauaaau

SEQ ID NO: 498830 - RNA, 19 nt, Chlamydophila pneumoniae CWL029
aguuaacuguguaugaauc

SEQ ID NO: 498831 - RNA, 20 nt, Chlamydophila pneumoniae CWL029
aguggaaauugugaaaaaaa

SEQ ID NO: 498832 - RNA, 15 nt, Chlamydophila pneumoniae CWL029
agugcuuucaggagu

SEQ ID NO: 498833 - RNA, 13 nt, Chlamydophila pneumoniae CWL029
agugcugccauga

SEQ ID NO: 498834 - RNA, 23 nt, Chlamydophila pneumoniae CWL029
agucucgguuuccugaagaugag

SEQ ID NO: 498835 - RNA, 19 nt, Chlamydophila pneumoniae CWL029
agucgugagaagcaucuuc

SEQ ID NO: 498836 - RNA, 14 nt, Chlamydophila pneumoniae CWL029
agucgugcaggaga

SEQ ID NO: 498837 - RNA, 13 nt, Chlamydophila pneumoniae CWL029
agucuauuugaaa

SEQ ID NO: 498838 - RNA, 22 nt, Chlamydophila pneumoniae CWL029
agucuauuugaaaagaaagaau

SEQ ID NO: 498839 - RNA, 20 nt, Chlamydophila pneumoniae CWL029
agucucacucuuuucuagaa

SEQ ID NO: 498840 - RNA, 12 nt, Chlamydophila pneumoniae CWL029
agucucauggau

SEQ ID NO: 498841 - RNA, 19 nt, Chlamydophila pneumoniae CWL029
agucuccauaauucugcac

SEQ ID NO: 498842 - RNA, 19 nt, Chlamydophila pneumoniae CWL029
agugaucuugagaaaagaa

SEQ ID NO: 498843 - RNA, 22 nt, Chlamydophila pneumoniae CWL029
agugaaugagcuucacaucuuu

SEQ ID NO: 498844 - RNA, 20 nt, Chlamydophila pneumoniae CWL029
agugaacucuucaagagcuu

SEQ ID NO: 498845 - RNA, 16 nt, Chlamydophila pneumoniae CWL029
agugaagacaaguaaa

SEQ ID NO: 498846 - RNA, 20 nt, Chlamydophila pneumoniae CWL029
agugaagcugcuucuucaga

SEQ ID NO: 498847 - RNA, 22 nt, Chlamydophila pneumoniae CWL029
agugaaauuuugcaacaaaagg

SEQ ID NO: 498848 - RNA, 17 nt, Chlamydophila pneumoniae CWL029
agugaacacucucuacc

SEQ ID NO: 498849 - RNA, 13 nt, Chlamydophila pneumoniae CWL029
agucgagaaacaa

SEQ ID NO: 498850 - RNA, 21 nt, Chlamydophila pneumoniae CWL029
agucgagaaacaaaaucuuuu

SEQ ID NO: 498851 - RNA, 22 nt, Chlamydophila pneumoniae CWL029
agucgauacccaaagaggggag

SEQ ID NO: 498852 - RNA, 15 nt, Chlamydophila pneumoniae CWL029
agucgcuagaucaca

SEQ ID NO: 498853 - RNA, 23 nt, Chlamydophila pneumoniae CWL029
aguccgcaugaacgugcaucucu

SEQ ID NO: 498854 - RNA, 17 nt, Chlamydophila pneumoniae CWL029
aguccgauagcaaugau

SEQ ID NO: 498855 - RNA, 19 nt, Chlamydophila pneumoniae CWL029
agucccuugcgggagaagu

SEQ ID NO: 498856 - RNA, 18 nt, Chlamydophila pneumoniae CWL029
agucccuugucaacaaaa

SEQ ID NO: 498857 - RNA, 23 nt, Chlamydophila pneumoniae CWL029
agucccccuaagggcucuagaua

SEQ ID NO: 498858 - RNA, 15 nt, Chlamydophila pneumoniae CWL029
aguccucuaugguuu

SEQ ID NO: 498859 - RNA, 13 nt, Chlamydophila pneumoniae CWL029
aguccaagaucaa

SEQ ID NO: 498860 - RNA, 14 nt, Chlamydophila pneumoniae CWL029
aguccaagaucaaa

SEQ ID NO: 498861 - RNA, 16 nt, Chlamydophila pneumoniae CWL029
aguccaagaucaaacg

SEQ ID NO: 498862 - RNA, 15 nt, Chlamydophila pneumoniae CWL029
aguccagacuuuccu

SEQ ID NO: 498863 - RNA, 23 nt, Chlamydophila pneumoniae CWL029
aguccaucggggcggacuauguu

SEQ ID NO: 498864 - RNA, 22 nt, Chlamydophila pneumoniae CWL029
agucaugauuuuucaaucaaua

SEQ ID NO: 498865 - RNA, 16 nt, Chlamydophila pneumoniae CWL029
agucauuagcaagagc

SEQ ID NO: 498866 - RNA, 16 nt, Chlamydophila pneumoniae CWL029
agucauuaucacagau

SEQ ID NO: 498867 - RNA, 18 nt, Chlamydophila pneumoniae CWL029
agucagccaagacaaaaa

SEQ ID NO: 498868 - RNA, 16 nt, Chlamydophila pneumoniae CWL029
agucagccaagacaaa

SEQ ID NO: 498869 - RNA, 24 nt, Chlamydophila pneumoniae CWL029
agucacggcgaaagcuacagcuaa

SEQ ID NO: 498870 - RNA, 22 nt, Chlamydophila pneumoniae CWL029
agucacuaaagauacuuaucuu

SEQ ID NO: 498871 - RNA, 19 nt, Chlamydophila pneumoniae CWL029
agucacuuucagccuguaa

SEQ ID NO: 498872 - RNA, 16 nt, Chlamydophila pneumoniae CWL029
agucauaagcucuauu

SEQ ID NO: 498873 - RNA, 13 nt, Chlamydophila pneumoniae CWL029
agucacacuuucc

SEQ ID NO: 498874 - RNA, 15 nt, Chlamydophila pneumoniae CWL029
agucacacuuuccgu

SEQ ID NO: 498875 - RNA, 13 nt, Chlamydophila pneumoniae CWL029
agucaaaaauucu

SEQ ID NO: 498876 - RNA, 12 nt, Chlamydophila pneumoniae CWL029
agucaaacauca

SEQ ID NO: 498877 - RNA, 20 nt, Chlamydophila pneumoniae CWL029
agucaaauacuucuccugaa

SEQ ID NO: 498878 - RNA, 12 nt, Chlamydophila pneumoniae CWL029
aguaucuagcuu

SEQ ID NO: 498879 - RNA, 17 nt, Chlamydophila pneumoniae CWL029
aguaucuagcuuugucu

SEQ ID NO: 498880 - RNA, 17 nt, Chlamydophila pneumoniae CWL029
aguaugaggagauaaag

SEQ ID NO: 498881 - RNA, 19 nt, Chlamydophila pneumoniae CWL029
aguaugaggagauaaagau

SEQ ID NO: 498882 - RNA, 16 nt, Chlamydophila pneumoniae CWL029
aguauggcaaauaaaa

SEQ ID NO: 498883 - RNA, 23 nt, Chlamydophila pneumoniae CWL029
aguaucgggauuuugucgagaac

SEQ ID NO: 498884 - RNA, 22 nt, Chlamydophila pneumoniae CWL029
aguauucuguggaauaucagga

SEQ ID NO: 498885 - RNA, 15 nt, Chlamydophila pneumoniae CWL029
aguauuaaucuuauu

SEQ ID NO: 498886 - RNA, 15 nt, Chlamydophila pneumoniae CWL029
aguauucccuccgca

SEQ ID NO: 498887 - RNA, 20 nt, Chlamydophila pneumoniae CWL029
aguauucccuccgcaguugu

SEQ ID NO: 498888 - RNA, 14 nt, Chlamydophila pneumoniae CWL029
aguauggcauucuu

SEQ ID NO: 498889 - RNA, 21 nt, Chlamydophila pneumoniae CWL029
aguauuaaagaugaaguuccc

SEQ ID NO: 498890 - RNA, 17 nt, Chlamydophila pneumoniae CWL029
aguagcauccuguagag

SEQ ID NO: 498891 - RNA, 22 nt, Chlamydophila pneumoniae CWL029
aguagcgaauccagaauuuucu

SEQ ID NO: 498892 - RNA, 13 nt, Chlamydophila pneumoniae CWL029
aguaggagcagcg

SEQ ID NO: 498893 - RNA, 15 nt, Chlamydophila pneumoniae CWL029
aguagcuugugcuaa

SEQ ID NO: 498894 - RNA, 20 nt, Chlamydophila pneumoniae CWL029
aguagcucucuccuggagag

SEQ ID NO: 498895 - RNA, 14 nt, Chlamydophila pneumoniae CWL029
aguagguaagaagc

SEQ ID NO: 498896 - RNA, 18 nt, Chlamydophila pneumoniae CWL029
aguaggguguauucugaa

SEQ ID NO: 498897 - RNA, 20 nt, Chlamydophila pneumoniae CWL029
aguaggcgaugcaaauucca

SEQ ID NO: 498898 - RNA, 22 nt, Chlamydophila pneumoniae CWL029
aguauaauagugagcucccuga

SEQ ID NO: 498899 - RNA, 13 nt, Chlamydophila pneumoniae CWL029
aguauaaucagaa

SEQ ID NO: 498900 - RNA, 15 nt, Chlamydophila pneumoniae CWL029
aguauacaagcgaaa

SEQ ID NO: 498901 - RNA, 20 nt, Chlamydophila pneumoniae CWL029
aguauagcuuuuaguuuccc

SEQ ID NO: 498902 - RNA, 14 nt, Chlamydophila pneumoniae CWL029
aguauagucugguu

SEQ ID NO: 498903 - RNA, 12 nt, Chlamydophila pneumoniae CWL029
aguagagaaugu

SEQ ID NO: 498904 - RNA, 16 nt, Chlamydophila pneumoniae CWL029
aguagaacugcgaagg

SEQ ID NO: 498905 - RNA, 18 nt, Chlamydophila pneumoniae CWL029
aguagaggaauucuggaa

SEQ ID NO: 498906 - RNA, 15 nt, Chlamydophila pneumoniae CWL029
aguagaucuucugaa

SEQ ID NO: 498907 - RNA, 22 nt, Chlamydophila pneumoniae CWL029
aguagaucuucugaaaucaaaa

SEQ ID NO: 498908 - RNA, 21 nt, Chlamydophila pneumoniae CWL029
aguacuucuuacccuaauuug

SEQ ID NO: 498909 - RNA, 19 nt, Chlamydophila pneumoniae CWL029
aguacuuauccugaacauc

SEQ ID NO: 498910 - RNA, 15 nt, Chlamydophila pneumoniae CWL029
aguacuacaauaacc

SEQ ID NO: 498911 - RNA, 17 nt, Chlamydophila pneumoniae CWL029
aguacgugaucucacga

SEQ ID NO: 498912 - RNA, 18 nt, Chlamydophila pneumoniae CWL029
aguacgaccaacuccuca

SEQ ID NO: 498913 - RNA, 16 nt, Chlamydophila pneumoniae CWL029
aguacgauccaucuca

SEQ ID NO: 498914 - RNA, 14 nt, Chlamydophila pneumoniae CWL029
aguacgcaaaguac

SEQ ID NO: 498915 - RNA, 18 nt, Chlamydophila pneumoniae CWL029
aguaccuaggaucuacau

SEQ ID NO: 498916 - RNA, 22 nt, Chlamydophila pneumoniae CWL029
aguaccuucucgucauucugca

SEQ ID NO: 498917 - RNA, 23 nt, Chlamydophila pneumoniae CWL029
aguaccuucucgucauucugcaa

SEQ ID NO: 498918 - RNA, 16 nt, Chlamydophila pneumoniae CWL029
aucaacuacaucucca

SEQ ID NO: 498919 - RNA, 18 nt, Chlamydophila pneumoniae CWL029
aucaacuacaucuccaag

SEQ ID NO: 498920 - RNA, 20 nt, Chlamydophila pneumoniae CWL029
aucaagaagagaaaagauag

SEQ ID NO: 498921 - RNA, 17 nt, Chlamydophila pneumoniae CWL029
aucaagaagagaaaaga

SEQ ID NO: 498922 - RNA, 21 nt, Chlamydophila pneumoniae CWL029
aucaagagcucguaauccuuc

SEQ ID NO: 498923 - RNA, 16 nt, Chlamydophila pneumoniae CWL029
aucaagaggagugaaa

SEQ ID NO: 498924 - RNA, 21 nt, Chlamydophila pneumoniae CWL029
aucaagaguuucgaauucaau

SEQ ID NO: 498925 - RNA, 15 nt, Chlamydophila pneumoniae CWL029
aucaaagaaagugaa

SEQ ID NO: 498926 - RNA, 16 nt, Chlamydophila pneumoniae CWL029
aucaaagaucugaauu

SEQ ID NO: 498927 - RNA, 17 nt, Chlamydophila pneumoniae CWL029
aucaaagcaaaagucau

SEQ ID NO: 498928 - RNA, 17 nt, Chlamydophila pneumoniae CWL029
aucaaagcaaagagcaa

SEQ ID NO: 498929 - RNA, 16 nt, Chlamydophila pneumoniae CWL029
aucaaagauuccuaag

SEQ ID NO: 498930 - RNA, 21 nt, Chlamydophila pneumoniae CWL029
aucaaaggcaauagcagcagc

SEQ ID NO: 498931 - RNA, 17 nt, Chlamydophila pneumoniae CWL029
aucaaagaacaauaaaa

SEQ ID NO: 498932 - RNA, 17 nt, Chlamydophila pneumoniae CWL029
aucaaagggucuuuacc

SEQ ID NO: 498933 - RNA, 21 nt, Chlamydophila pneumoniae CWL029
aucaaaggcugcuugagacuu

SEQ ID NO: 498934 - RNA, 17 nt, Chlamydophila pneumoniae CWL029
aucaaaguauauauuuu

SEQ ID NO: 498935 - RNA, 21 nt, Chlamydophila pneumoniae CWL029
aucaaaguauauauuuuacaa

SEQ ID NO: 498936 - RNA, 18 nt, Chlamydophila pneumoniae CWL029
aucaaauaaggcugcuau

SEQ ID NO: 498937 - RNA, 16 nt, Chlamydophila pneumoniae CWL029
aucaaauagauuuuua

SEQ ID NO: 498938 - RNA, 12 nt, Chlamydophila pneumoniae CWL029
auauugcucuug

SEQ ID NO: 498939 - RNA, 18 nt, Chlamydophila pneumoniae CWL029
auauuuagagagaaacau

SEQ ID NO: 498940 - RNA, 18 nt, Chlamydophila pneumoniae CWL029
auauuccuauaacaacau

SEQ ID NO: 498941 - RNA, 19 nt, Chlamydophila pneumoniae CWL029
auauuacagauuucuucuu

SEQ ID NO: 498942 - RNA, 12 nt, Chlamydophila pneumoniae CWL029
auauuaaauuca

SEQ ID NO: 498943 - RNA, 17 nt, Chlamydophila pneumoniae CWL029
auauuaacccaccagaa

SEQ ID NO: 498944 - RNA, 14 nt, Chlamydophila pneumoniae CWL029
auaugucuugcuuu

SEQ ID NO: 498945 - RNA, 22 nt, Chlamydophila pneumoniae CWL029
auauggguguaaauuuuuccuu

SEQ ID NO: 498946 - RNA, 22 nt, Chlamydophila pneumoniae CWL029
auaugggacuucaagccaaaac

SEQ ID NO: 498947 - RNA, 17 nt, Chlamydophila pneumoniae CWL029
auaucucuggcauaauc

SEQ ID NO: 498948 - RNA, 20 nt, Chlamydophila pneumoniae CWL029
auaucucuggcauaauccug

SEQ ID NO: 498949 - RNA, 22 nt, Chlamydophila pneumoniae CWL029
auaucucuggcauaauccugaa

SEQ ID NO: 498950 - RNA, 20 nt, Chlamydophila pneumoniae CWL029
auaucgguuucuuuuuuuug

SEQ ID NO: 498951 - RNA, 19 nt, Chlamydophila pneumoniae CWL029
auaucuccuuuaaauaaaa

SEQ ID NO: 498952 - RNA, 21 nt, Chlamydophila pneumoniae CWL029
auaucuccuuuaaauaaaauc

SEQ ID NO: 498953 - RNA, 22 nt, Chlamydophila pneumoniae CWL029
auaugaaugacugcagauugca

SEQ ID NO: 498954 - RNA, 17 nt, Chlamydophila pneumoniae CWL029
auaugaaugacugcaga

SEQ ID NO: 498955 - RNA, 15 nt, Chlamydophila pneumoniae CWL029
auaugauuuccacuu

SEQ ID NO: 498956 - RNA, 18 nt, Chlamydophila pneumoniae CWL029
auaugcucugccauuucu

SEQ ID NO: 498957 - RNA, 21 nt, Chlamydophila pneumoniae CWL029
auauggaaggcggcuuuuugc

SEQ ID NO: 498958 - RNA, 18 nt, Chlamydophila pneumoniae CWL029
auaucguagacaacaagu

SEQ ID NO: 498959 - RNA, 20 nt, Chlamydophila pneumoniae CWL029
auauccguauggauuucucc

SEQ ID NO: 498960 - RNA, 13 nt, Chlamydophila pneumoniae CWL029
auauauccugagu

SEQ ID NO: 498961 - RNA, 23 nt, Chlamydophila pneumoniae CWL029
auauaugaguuuacuaacucugu

SEQ ID NO: 498962 - RNA, 13 nt, Chlamydophila pneumoniae CWL029
auaucccaaagcu

SEQ ID NO: 498963 - RNA, 16 nt, Chlamydophila pneumoniae CWL029
auaucauuaagaagau

SEQ ID NO: 498964 - RNA, 14 nt, Chlamydophila pneumoniae CWL029
auaucaucaaaaga

SEQ ID NO: 498965 - RNA, 14 nt, Chlamydophila pneumoniae CWL029
auaucaucacuaag

SEQ ID NO: 498966 - RNA, 14 nt, Chlamydophila pneumoniae CWL029
auaucaucuuccuc

SEQ ID NO: 498967 - RNA, 22 nt, Chlamydophila pneumoniae CWL029
auaucaugcaauacuuuucucc

SEQ ID NO: 498968 - RNA, 21 nt, Chlamydophila pneumoniae CWL029
auauaauaguggcuauacccu

SEQ ID NO: 498969 - RNA, 15 nt, Chlamydophila pneumoniae CWL029
auauaaucguuuuuu

SEQ ID NO: 498970 - RNA, 23 nt, Chlamydophila pneumoniae CWL029
auauaagcaccacgaccuauacc

SEQ ID NO: 498971 - RNA, 19 nt, Chlamydophila pneumoniae CWL029
auauaaaugcuauuuuccu

SEQ ID NO: 498972 - RNA, 20 nt, Chlamydophila pneumoniae CWL029
auauagagagcgcagagucu

SEQ ID NO: 498973 - RNA, 13 nt, Chlamydophila pneumoniae CWL029
auauauaagaucu

SEQ ID NO: 498974 - RNA, 22 nt, Chlamydophila pneumoniae CWL029
auauauaagaucuuucauuuua

SEQ ID NO: 498975 - RNA, 13 nt, Chlamydophila pneumoniae CWL029
auaguauuuuuaa

SEQ ID NO: 498976 - RNA, 14 nt, Chlamydophila pneumoniae CWL029
auaguauuuuuaaa

SEQ ID NO: 498977 - RNA, 15 nt, Chlamydophila pneumoniae CWL029
auaguauuuuuaaau

SEQ ID NO: 498978 - RNA, 18 nt, Chlamydophila pneumoniae CWL029
auaguaucguaagccggc

SEQ ID NO: 498979 - RNA, 21 nt, Chlamydophila pneumoniae CWL029
auagccucgagcagaaacucc

SEQ ID NO: 498980 - RNA, 19 nt, Chlamydophila pneumoniae CWL029
auagccucuucuacaccau

SEQ ID NO: 498981 - RNA, 20 nt, Chlamydophila pneumoniae CWL029
auagccucuucuacaccaua

SEQ ID NO: 498982 - RNA, 23 nt, Chlamydophila pneumoniae CWL029
auagccuuccauaucuagaaguu

SEQ ID NO: 498983 - RNA, 19 nt, Chlamydophila pneumoniae CWL029
auagcgaaagucaaagggc

SEQ ID NO: 498984 - RNA, 19 nt, Chlamydophila pneumoniae CWL029
auagcgacaugagaaaucu

SEQ ID NO: 498985 - RNA, 13 nt, Chlamydophila pneumoniae CWL029
auagcgagaacac

SEQ ID NO: 498986 - RNA, 18 nt, Chlamydophila pneumoniae CWL029
auaguccuagcagagaaa

SEQ ID NO: 498987 - RNA, 19 nt, Chlamydophila pneumoniae CWL029
auagucuucuacuaggcgc

SEQ ID NO: 498988 - RNA, 19 nt, Chlamydophila pneumoniae CWL029
auaguuaaauuuccaaaga

SEQ ID NO: 498989 - RNA, 17 nt, Chlamydophila pneumoniae CWL029
auauaaagacucucuuc

SEQ ID NO: 498990 - RNA, 19 nt, Chlamydophila pneumoniae CWL029
auaguuauuaauaaauuua

SEQ ID NO: 498991 - RNA, 12 nt, Chlamydophila pneumoniae CWL029
auagacaaccua

SEQ ID NO: 498992 - RNA, 22 nt, Chlamydophila pneumoniae CWL029
auagaaggcaucccgaacgcua

SEQ ID NO: 498993 - RNA, 18 nt, Chlamydophila pneumoniae CWL029
auagaacucuccucgagg

SEQ ID NO: 498994 - RNA, 15 nt, Chlamydophila pneumoniae CWL029
auagaagaucauuaa

SEQ ID NO: 498995 - RNA, 14 nt, Chlamydophila pneumoniae CWL029
auagaaaugagaga

SEQ ID NO: 498996 - RNA, 14 nt, Chlamydophila pneumoniae CWL029
auagaaauucugua

SEQ ID NO: 498997 - RNA, 16 nt, Chlamydophila pneumoniae CWL029
auagaaauucuguaga

SEQ ID NO: 498998 - RNA, 22 nt, Chlamydophila pneumoniae CWL029
auagaaauucuguagauacuau

SEQ ID NO: 498999 - RNA, 19 nt, Chlamydophila pneumoniae CWL029
auagaaaagguauuaggaa

SEQ ID NO: 499000 - RNA, 16 nt, Chlamydophila pneumoniae CWL029
auagaaaacauauccc

SEQ ID NO: 499001 - RNA, 12 nt, Chlamydophila pneumoniae CWL029
auagaaaaggau

SEQ ID NO: 499002 - RNA, 20 nt, Chlamydophila pneumoniae CWL029
auacuacuuacaagaacaag

SEQ ID NO: 499003 - RNA, 18 nt, Chlamydophila pneumoniae CWL029
auacuuaggaauuuuucu

SEQ ID NO: 499004 - RNA, 20 nt, Chlamydophila pneumoniae CWL029
auagccgacaugcuuuccuu

SEQ ID NO: 499005 - RNA, 12 nt, Chlamydophila pneumoniae CWL029
auagccaaagac

SEQ ID NO: 499006 - RNA, 18 nt, Chlamydophila pneumoniae CWL029
auagcaucccuucuucuu

SEQ ID NO: 499007 - RNA, 20 nt, Chlamydophila pneumoniae CWL029
auagcauguucgauuuucuc

SEQ ID NO: 499008 - RNA, 17 nt, Chlamydophila pneumoniae CWL029
auagccuccauuuagac

SEQ ID NO: 499009 - RNA, 13 nt, Chlamydophila pneumoniae CWL029
auagcaaaucaau

SEQ ID NO: 499010 - RNA, 18 nt, Chlamydophila pneumoniae CWL029
auagauccaagaaugaau

SEQ ID NO: 499011 - RNA, 15 nt, Chlamydophila pneumoniae CWL029
auagcauacgacagu

SEQ ID NO: 499012 - RNA, 17 nt, Chlamydophila pneumoniae CWL029
auagcaguauagagaag

SEQ ID NO: 499013 - RNA, 13 nt, Chlamydophila pneumoniae CWL029
auagcagucuugc

SEQ ID NO: 499014 - RNA, 22 nt, Chlamydophila pneumoniae CWL029
auagauagggccgugaagcaga

SEQ ID NO: 499015 - RNA, 23 nt, Chlamydophila pneumoniae CWL029
auagauauacgcccaugucuuca

SEQ ID NO: 499016 - RNA, 14 nt, Chlamydophila pneumoniae CWL029
auagauaugccuca

SEQ ID NO: 499017 - RNA, 17 nt, Chlamydophila pneumoniae CWL029
auagaucacaucaagau

SEQ ID NO: 499018 - RNA, 20 nt, Chlamydophila pneumoniae CWL029
auagacauucccuaaagcug

SEQ ID NO: 499019 - RNA, 23 nt, Chlamydophila pneumoniae CWL029
auagacauucccuaaagcugcca

SEQ ID NO: 499020 - RNA, 14 nt, Chlamydophila pneumoniae CWL029
auagacauucccua

SEQ ID NO: 499021 - RNA, 15 nt, Chlamydophila pneumoniae CWL029
auagacacuugcuua

SEQ ID NO: 499022 - RNA, 20 nt, Chlamydophila pneumoniae CWL029
auagacacuugcuuaaggaa

SEQ ID NO: 499023 - RNA, 23 nt, Chlamydophila pneumoniae CWL029
auagaccggaucccguaaaagaa

SEQ ID NO: 499024 - RNA, 16 nt, Chlamydophila pneumoniae CWL029
auacguuuuuuuccuu

SEQ ID NO: 499025 - RNA, 19 nt, Chlamydophila pneumoniae CWL029
auacuaagaagcucacucu

SEQ ID NO: 499026 - RNA, 13 nt, Chlamydophila pneumoniae CWL029
auacgcuuuucuu

SEQ ID NO: 499027 - RNA, 16 nt, Chlamydophila pneumoniae CWL029
auacgcuuacaaauaa

SEQ ID NO: 499028 - RNA, 14 nt, Chlamydophila pneumoniae CWL029
auacgaaggaucau

SEQ ID NO: 499029 - RNA, 23 nt, Chlamydophila pneumoniae CWL029
auaccuuucuaagaauucuuugc

SEQ ID NO: 499030 - RNA, 11 nt, Chlamydophila pneumoniae CWL029
auaccacagcu

SEQ ID NO: 499031 - RNA, 17 nt, Chlamydophila pneumoniae CWL029
auaccagaagcaaaggu

SEQ ID NO: 499032 - RNA, 14 nt, Chlamydophila pneumoniae CWL029
auaccagaagcaaa

SEQ ID NO: 499033 - RNA, 21 nt, Chlamydophila pneumoniae CWL029
auaccagauaaagcaaagaua

SEQ ID NO: 499034 - RNA, 13 nt, Chlamydophila pneumoniae CWL029
auaccaaaauuau

SEQ ID NO: 499035 - RNA, 16 nt, Chlamydophila pneumoniae CWL029
auaccaagaugaagaa

SEQ ID NO: 499036 - RNA, 15 nt, Chlamydophila pneumoniae CWL029
auaccaaaauaccau

SEQ ID NO: 499037 - RNA, 22 nt, Chlamydophila pneumoniae CWL029
auacccucggagacucagagaa

SEQ ID NO: 499038 - RNA, 13 nt, Chlamydophila pneumoniae CWL029
auacccuucuucu

SEQ ID NO: 499039 - RNA, 16 nt, Chlamydophila pneumoniae CWL029
auacccaucuagaaac

SEQ ID NO: 499040 - RNA, 16 nt, Chlamydophila pneumoniae CWL029
auacccacaaagauca

SEQ ID NO: 499041 - RNA, 15 nt, Chlamydophila pneumoniae CWL029
auacccaucuagaaa

SEQ ID NO: 499042 - RNA, 19 nt, Chlamydophila pneumoniae CWL029
auacagauaucaaagcauu

SEQ ID NO: 499043 - RNA, 20 nt, Chlamydophila pneumoniae CWL029
auacagauguuuucguaaau

SEQ ID NO: 499044 - RNA, 14 nt, Chlamydophila pneumoniae CWL029
auacagccagcaga

SEQ ID NO: 499045 - RNA, 16 nt, Chlamydophila pneumoniae CWL029
auacagccagcagaag

SEQ ID NO: 499046 - RNA, 22 nt, Chlamydophila pneumoniae CWL029
auacagcgcgaucacuuuccug

SEQ ID NO: 499047 - RNA, 15 nt, Chlamydophila pneumoniae CWL029
auacagcauaaaaau

SEQ ID NO: 499048 - RNA, 21 nt, Chlamydophila pneumoniae CWL029
auacaggccugaugucuccau

SEQ ID NO: 499049 - RNA, 22 nt, Chlamydophila pneumoniae CWL029
auacaggcuccucugcuaagca

SEQ ID NO: 499050 - RNA, 16 nt, Chlamydophila pneumoniae CWL029
auacaguacgcaaagu

SEQ ID NO: 499051 - RNA, 14 nt, Chlamydophila pneumoniae CWL029
auacaguagaaaca

SEQ ID NO: 499052 - RNA, 15 nt, Chlamydophila pneumoniae CWL029
auacaguagaaacau

SEQ ID NO: 499053 - RNA, 19 nt, Chlamydophila pneumoniae CWL029
auacaguuggcguuuucua

SEQ ID NO: 499054 - RNA, 22 nt, Chlamydophila pneumoniae CWL029
auacaguuggcguuuucuagaa

SEQ ID NO: 499055 - RNA, 19 nt, Chlamydophila pneumoniae CWL029
auacaucccauucaauaau

SEQ ID NO: 499056 - RNA, 15 nt, Chlamydophila pneumoniae CWL029
auacauagguaaaac

SEQ ID NO: 499057 - RNA, 19 nt, Chlamydophila pneumoniae CWL029
auacaucaccacugcucca

SEQ ID NO: 499058 - RNA, 12 nt, Chlamydophila pneumoniae CWL029
auacauuccuag

SEQ ID NO: 499059 - RNA, 23 nt, Chlamydophila pneumoniae CWL029
auacauugcugccaggcuuaaau

SEQ ID NO: 499060 - RNA, 19 nt, Chlamydophila pneumoniae CWL029
auacagacaagcaaggaaa

SEQ ID NO: 499061 - RNA, 20 nt, Chlamydophila pneumoniae CWL029
auacagacaagcaaggaaaa

SEQ ID NO: 499062 - RNA, 17 nt, Chlamydophila pneumoniae CWL029
auacaauccagaaucuc

SEQ ID NO: 499063 - RNA, 19 nt, Chlamydophila pneumoniae CWL029
auacaauccagaaucucca

SEQ ID NO: 499064 - RNA, 12 nt, Chlamydophila pneumoniae CWL029
auacaagcaauu

SEQ ID NO: 499065 - RNA, 13 nt, Chlamydophila pneumoniae CWL029
auaauuuucaguc

SEQ ID NO: 499066 - RNA, 21 nt, Chlamydophila pneumoniae CWL029
auacaaaacaaaagccauucc

SEQ ID NO: 499067 - RNA, 14 nt, Chlamydophila pneumoniae CWL029
auacaaaaaauaaa

SEQ ID NO: 499068 - RNA, 16 nt, Chlamydophila pneumoniae CWL029
auacaaacaucgaaac

SEQ ID NO: 499069 - RNA, 16 nt, Chlamydophila pneumoniae CWL029
auaauuuguuuagaaa

SEQ ID NO: 499070 - RNA, 18 nt, Chlamydophila pneumoniae CWL029
auaauuucaaagaugcag

SEQ ID NO: 499071 - RNA, 14 nt, Chlamydophila pneumoniae CWL029
auaauucgugucau

SEQ ID NO: 499072 - RNA, 23 nt, Chlamydophila pneumoniae CWL029
auaaucauuaagacucaauacuu

SEQ ID NO: 499073 - RNA, 15 nt, Chlamydophila pneumoniae CWL029
auaaucucaccagaa

SEQ ID NO: 499074 - RNA, 15 nt, Chlamydophila pneumoniae CWL029
auaaucuguaagaaa

SEQ ID NO: 499075 - RNA, 20 nt, Chlamydophila pneumoniae CWL029
auaaucuguaagaaaaugag

SEQ ID NO: 499076 - RNA, 19 nt, Chlamydophila pneumoniae CWL029
auaaugauuccuagaaucu

SEQ ID NO: 499077 - RNA, 16 nt, Chlamydophila pneumoniae CWL029
auaaugacucuagagu

SEQ ID NO: 499078 - RNA, 22 nt, Chlamydophila pneumoniae CWL029
aucgacucuuccaauuguaaau

SEQ ID NO: 499079 - RNA, 17 nt, Chlamydophila pneumoniae CWL029
aucgacucuucgcccau

SEQ ID NO: 499080 - RNA, 23 nt, Chlamydophila pneumoniae CWL029
aucgaucucugugguuccuggau

SEQ ID NO: 499081 - RNA, 20 nt, Chlamydophila pneumoniae CWL029
aucgccgcuugaggaggauu

SEQ ID NO: 499082 - RNA, 15 nt, Chlamydophila pneumoniae CWL029
aucgcccaauuuuua

SEQ ID NO: 499083 - RNA, 22 nt, Chlamydophila pneumoniae CWL029
aucgaaucuugauauugaaaga

SEQ ID NO: 499084 - RNA, 20 nt, Chlamydophila pneumoniae CWL029
aucgaagagcccucuucacu

SEQ ID NO: 499085 - RNA, 15 nt, Chlamydophila pneumoniae CWL029
auccuuucacaaaga

SEQ ID NO: 499086 - RNA, 21 nt, Chlamydophila pneumoniae CWL029
aucgacaggggaguuuucaaa

SEQ ID NO: 499087 - RNA, 19 nt, Chlamydophila pneumoniae CWL029
aucgaccauccuguagcuu

SEQ ID NO: 499088 - RNA, 15 nt, Chlamydophila pneumoniae CWL029
auccuugcaaaacag

SEQ ID NO: 499089 - RNA, 19 nt, Chlamydophila pneumoniae CWL029
auccuugauuuuaaaauga

SEQ ID NO: 499090 - RNA, 15 nt, Chlamydophila pneumoniae CWL029
auccuuuccaagaag

SEQ ID NO: 499091 - RNA, 12 nt, Chlamydophila pneumoniae CWL029
auccugucuauu

SEQ ID NO: 499092 - RNA, 21 nt, Chlamydophila pneumoniae CWL029
auccuuaucuugcugcccaaa

SEQ ID NO: 499093 - RNA, 21 nt, Chlamydophila pneumoniae CWL029
auccuucacucguugccaauc

SEQ ID NO: 499094 - RNA, 20 nt, Chlamydophila pneumoniae CWL029
auccuuccaagugcucagua

SEQ ID NO: 499095 - RNA, 11 nt, Chlamydophila pneumoniae CWL029
auccuuccuua

SEQ ID NO: 499096 - RNA, 20 nt, Chlamydophila pneumoniae CWL029
aucuaaaagcacuuaaaaaa

SEQ ID NO: 499097 - RNA, 18 nt, Chlamydophila pneumoniae CWL029
aucuaaaaacuucccauc

SEQ ID NO: 499098 - RNA, 19 nt, Chlamydophila pneumoniae CWL029
aucuaaccaaccuuguuga

SEQ ID NO: 499099 - RNA, 18 nt, Chlamydophila pneumoniae CWL029
aucguaauagcgacauga

SEQ ID NO: 499100 - RNA, 15 nt, Chlamydophila pneumoniae CWL029
aucguacaggacugu

SEQ ID NO: 499101 - RNA, 15 nt, Chlamydophila pneumoniae CWL029
aucguaucuuuuugc

SEQ ID NO: 499102 - RNA, 16 nt, Chlamydophila pneumoniae CWL029
aucggcagcagcauaa

SEQ ID NO: 499103 - RNA, 18 nt, Chlamydophila pneumoniae CWL029
aucgcuaucagcugggua

SEQ ID NO: 499104 - RNA, 14 nt, Chlamydophila pneumoniae CWL029
aucgcgaagcuuuc

SEQ ID NO: 499105 - RNA, 15 nt, Chlamydophila pneumoniae CWL029
auccuguagagcaag

SEQ ID NO: 499106 - RNA, 22 nt, Chlamydophila pneumoniae CWL029
auccuguagagcaagauucuuc

SEQ ID NO: 499107 - RNA, 21 nt, Chlamydophila pneumoniae CWL029
auccuguaacacccucccuca

SEQ ID NO: 499108 - RNA, 23 nt, Chlamydophila pneumoniae CWL029
auccuguaacacccucccucaua

SEQ ID NO: 499109 - RNA, 15 nt, Chlamydophila pneumoniae CWL029
auccuggagcaugag

SEQ ID NO: 499110 - RNA, 16 nt, Chlamydophila pneumoniae CWL029
auccugcuccaaaaug

SEQ ID NO: 499111 - RNA, 24 nt, Chlamydophila pneumoniae CWL029
auccugcucguaaaucuggaauga

SEQ ID NO: 499112 - RNA, 15 nt, Chlamydophila pneumoniae CWL029
auccuccgccuguca

SEQ ID NO: 499113 - RNA, 22 nt, Chlamydophila pneumoniae CWL029
auccuccuagguucuuuuuuug

SEQ ID NO: 499114 - RNA, 23 nt, Chlamydophila pneumoniae CWL029
auccugcaaagcccccuccccca

SEQ ID NO: 499115 - RNA, 18 nt, Chlamydophila pneumoniae CWL029
auccugcaauccacgcuc

SEQ ID NO: 499116 - RNA, 22 nt, Chlamydophila pneumoniae CWL029
auccugagaccauacacaaauc

SEQ ID NO: 499117 - RNA, 15 nt, Chlamydophila pneumoniae CWL029
auccugaaaguacag

SEQ ID NO: 499118 - RNA, 17 nt, Chlamydophila pneumoniae CWL029
auccugaaaguacagaa

SEQ ID NO: 499119 - RNA, 16 nt, Chlamydophila pneumoniae CWL029
auccucagucucucua

SEQ ID NO: 499120 - RNA, 14 nt, Chlamydophila pneumoniae CWL029
auccucagucucuc

SEQ ID NO: 499121 - RNA, 16 nt, Chlamydophila pneumoniae CWL029
auccuauuuuagcaua

SEQ ID NO: 499122 - RNA, 15 nt, Chlamydophila pneumoniae CWL029
auccucacuagagau

SEQ ID NO: 499123 - RNA, 18 nt, Chlamydophila pneumoniae CWL029
auccuaagagauuuucca

SEQ ID NO: 499124 - RNA, 21 nt, Chlamydophila pneumoniae CWL029
auccgucagccuuagcagcac

SEQ ID NO: 499125 - RNA, 24 nt, Chlamydophila pneumoniae CWL029
auccgucagccuuagcagcaccca

SEQ ID NO: 499126 - RNA, 14 nt, Chlamydophila pneumoniae CWL029
aucccuucuucuuu

SEQ ID NO: 499127 - RNA, 18 nt, Chlamydophila pneumoniae CWL029
aucccuguaguuucuaaa

SEQ ID NO: 499128 - RNA, 16 nt, Chlamydophila pneumoniae CWL029
auccgacuuuccucaa

SEQ ID NO: 499129 - RNA, 22 nt, Chlamydophila pneumoniae CWL029
auccgacuuuccucaaagccga

SEQ ID NO: 499130 - RNA, 18 nt, Chlamydophila pneumoniae CWL029
auccgcacuuacauuggc

SEQ ID NO: 499131 - RNA, 17 nt, Chlamydophila pneumoniae CWL029
auccccaccaacaaugc

SEQ ID NO: 499132 - RNA, 14 nt, Chlamydophila pneumoniae CWL029
aucccgaagcaauc

SEQ ID NO: 499133 - RNA, 15 nt, Chlamydophila pneumoniae CWL029
aucccgaacaaucaa

SEQ ID NO: 499134 - RNA, 16 nt, Chlamydophila pneumoniae CWL029
aucccucaaaaucaca

SEQ ID NO: 499135 - RNA, 19 nt, Chlamydophila pneumoniae CWL029
aucccuaagguuuccauga

SEQ ID NO: 499136 - RNA, 23 nt, Chlamydophila pneumoniae CWL029
aucccagauaaagacaucucuuu

SEQ ID NO: 499137 - RNA, 16 nt, Chlamydophila pneumoniae CWL029
aucccaccgacaagau

SEQ ID NO: 499138 - RNA, 19 nt, Chlamydophila pneumoniae CWL029
aucccacgggucaggaggu

SEQ ID NO: 499139 - RNA, 15 nt, Chlamydophila pneumoniae CWL029
aucccaaacuucuuc

SEQ ID NO: 499140 - RNA, 17 nt, Chlamydophila pneumoniae CWL029
auccaugcuagaagaca

SEQ ID NO: 499141 - RNA, 15 nt, Chlamydophila pneumoniae CWL029
auccaugaacagcau

SEQ ID NO: 499142 - RNA, 17 nt, Chlamydophila pneumoniae CWL029
auccaucggcauuucuc

SEQ ID NO: 499143 - RNA, 17 nt, Chlamydophila pneumoniae CWL029
auccagcaacaaccaaa

SEQ ID NO: 499144 - RNA, 20 nt, Chlamydophila pneumoniae CWL029
auccagcaacaaccaaaaga

SEQ ID NO: 499145 - RNA, 13 nt, Chlamydophila pneumoniae CWL029
auccagcucaagg

SEQ ID NO: 499146 - RNA, 14 nt, Chlamydophila pneumoniae CWL029
auccaaugacaauc

SEQ ID NO: 499147 - RNA, 14 nt, Chlamydophila pneumoniae CWL029
auccaauagccaaa

SEQ ID NO: 499148 - RNA, 18 nt, Chlamydophila pneumoniae CWL029
auccaauagccaaagacu

SEQ ID NO: 499149 - RNA, 20 nt, Chlamydophila pneumoniae CWL029
auccacagaucguaaucugu

SEQ ID NO: 499150 - RNA, 14 nt, Chlamydophila pneumoniae CWL029
auccacauccuugu

SEQ ID NO: 499151 - RNA, 15 nt, Chlamydophila pneumoniae CWL029
auccaccaagacuga

SEQ ID NO: 499152 - RNA, 15 nt, Chlamydophila pneumoniae CWL029
auccagacaagacac

SEQ ID NO: 499153 - RNA, 16 nt, Chlamydophila pneumoniae CWL029
auccacugcuuuaggc

SEQ ID NO: 499154 - RNA, 15 nt, Chlamydophila pneumoniae CWL029
auccagauuagaaaa

SEQ ID NO: 499155 - RNA, 20 nt, Chlamydophila pneumoniae CWL029
auccagauuguucaaaaaua

SEQ ID NO: 499156 - RNA, 21 nt, Chlamydophila pneumoniae CWL029
auccagauuagaaaagauaaa

SEQ ID NO: 499157 - RNA, 14 nt, Chlamydophila pneumoniae CWL029
auccaagauaccau

SEQ ID NO: 499158 - RNA, 17 nt, Chlamydophila pneumoniae CWL029
auccaagaauagccaua

SEQ ID NO: 499159 - RNA, 14 nt, Chlamydophila pneumoniae CWL029
auccaagaauagcc

SEQ ID NO: 499160 - RNA, 22 nt, Chlamydophila pneumoniae CWL029
auccaaauugcaauuuucuaaa

SEQ ID NO: 499161 - RNA, 15 nt, Chlamydophila pneumoniae CWL029
auccaacaaagauga

SEQ ID NO: 499162 - RNA, 18 nt, Chlamydophila pneumoniae CWL029
auccaaaaugucuuuuuc

SEQ ID NO: 499163 - RNA, 18 nt, Chlamydophila pneumoniae CWL029
auccaaacgguuaaugaa

SEQ ID NO: 499164 - RNA, 12 nt, Chlamydophila pneumoniae CWL029
auccaaagacuu

SEQ ID NO: 499165 - RNA, 21 nt, Chlamydophila pneumoniae CWL029
auccaaaaaaugcuccugcaa

SEQ ID NO: 499166 - RNA, 12 nt, Chlamydophila pneumoniae CWL029
aucauuguugcu

SEQ ID NO: 499167 - RNA, 17 nt, Chlamydophila pneumoniae CWL029
aucauauuuuucuugaa

SEQ ID NO: 499168 - RNA, 15 nt, Chlamydophila pneumoniae CWL029
aucaucgaagaacuu

SEQ ID NO: 499169 - RNA, 21 nt, Chlamydophila pneumoniae CWL029
aucaucuacgauguuuucuua

SEQ ID NO: 499170 - RNA, 19 nt, Chlamydophila pneumoniae CWL029
aucaucucccaaauagcua

SEQ ID NO: 499171 - RNA, 21 nt, Chlamydophila pneumoniae CWL029
aucaucucccaaauagcuaca

SEQ ID NO: 499172 - RNA, 20 nt, Chlamydophila pneumoniae CWL029
aucaugauaaaaauuuucag

SEQ ID NO: 499173 - RNA, 17 nt, Chlamydophila pneumoniae CWL029
aucaugagaauuuucau

SEQ ID NO: 499174 - RNA, 14 nt, Chlamydophila pneumoniae CWL029
aucaugauaaaaau

SEQ ID NO: 499175 - RNA, 21 nt, Chlamydophila pneumoniae CWL029
aucaugcaauacuuuucuccc

SEQ ID NO: 499176 - RNA, 21 nt, Chlamydophila pneumoniae CWL029
aucauggucccuauagaacau

SEQ ID NO: 499177 - RNA, 18 nt, Chlamydophila pneumoniae CWL029
aucauuagcaucaucucc

SEQ ID NO: 499178 - RNA, 19 nt, Chlamydophila pneumoniae CWL029
aucauuaagaagauucuuu

SEQ ID NO: 499179 - RNA, 14 nt, Chlamydophila pneumoniae CWL029
aucauguagcagag

SEQ ID NO: 499180 - RNA, 21 nt, Chlamydophila pneumoniae CWL029
aucauguagugcuucuucuau

SEQ ID NO: 499181 - RNA, 14 nt, Chlamydophila pneumoniae CWL029
aucagggacucuuu

SEQ ID NO: 499182 - RNA, 18 nt, Chlamydophila pneumoniae CWL029
aucaggauggucauacca

SEQ ID NO: 499183 - RNA, 19 nt, Chlamydophila pneumoniae CWL029
aucaggauucuaaaaagaa

SEQ ID NO: 499184 - RNA, 13 nt, Chlamydophila pneumoniae CWL029
aucaggaaaugaa

SEQ ID NO: 499185 - RNA, 18 nt, Chlamydophila pneumoniae CWL029
aucaggagucucuggaag

SEQ ID NO: 499186 - RNA, 17 nt, Chlamydophila pneumoniae CWL029
aucauaaccaaaagaau

SEQ ID NO: 499187 - RNA, 16 nt, Chlamydophila pneumoniae CWL029
aucagugcugccauga

SEQ ID NO: 499188 - RNA, 17 nt, Chlamydophila pneumoniae CWL029
aucaguucauuuuggca

SEQ ID NO: 499189 - RNA, 19 nt, Chlamydophila pneumoniae CWL029
aucaguuccauuuucaggc

SEQ ID NO: 499190 - RNA, 13 nt, Chlamydophila pneumoniae CWL029
augcucuagaaaa

SEQ ID NO: 499191 - RNA, 21 nt, Chlamydophila pneumoniae CWL029
augcuccuugggucuuuuuau

SEQ ID NO: 499192 - RNA, 18 nt, Chlamydophila pneumoniae CWL029
augcucauuaauaauauc

SEQ ID NO: 499193 - RNA, 22 nt, Chlamydophila pneumoniae CWL029
augcucauuaauaauaucuaac

SEQ ID NO: 499194 - RNA, 23 nt, Chlamydophila pneumoniae CWL029
augcuaaauuugucaucacauca

SEQ ID NO: 499195 - RNA, 12 nt, Chlamydophila pneumoniae CWL029
augcuaucccac

SEQ ID NO: 499196 - RNA, 15 nt, Chlamydophila pneumoniae CWL029
augcuauuuuuccau

SEQ ID NO: 499197 - RNA, 21 nt, Chlamydophila pneumoniae CWL029
augcuaaagagucuuccuaga

SEQ ID NO: 499198 - RNA, 18 nt, Chlamydophila pneumoniae CWL029
augcaucucuuaaaacau

SEQ ID NO: 499199 - RNA, 12 nt, Chlamydophila pneumoniae CWL029
augcaucucuua

SEQ ID NO: 499200 - RNA, 22 nt, Chlamydophila pneumoniae CWL029
augcauucugauccgaaaagaa

SEQ ID NO: 499201 - RNA, 17 nt, Chlamydophila pneumoniae CWL029
augcauuuguuuggaaa

SEQ ID NO: 499202 - RNA, 23 nt, Chlamydophila pneumoniae CWL029
auggaugucaccacgaacuucag

SEQ ID NO: 499203 - RNA, 18 nt, Chlamydophila pneumoniae CWL029
auggagaaggacacuaga

SEQ ID NO: 499204 - RNA, 14 nt, Chlamydophila pneumoniae CWL029
auggacaagcaaaa

SEQ ID NO: 499205 - RNA, 23 nt, Chlamydophila pneumoniae CWL029
auggacagcguauaggaaacugu

SEQ ID NO: 499206 - RNA, 13 nt, Chlamydophila pneumoniae CWL029
auggaaugccaaa

SEQ ID NO: 499207 - RNA, 17 nt, Chlamydophila pneumoniae CWL029
auggaauggcuuuuguu

SEQ ID NO: 499208 - RNA, 22 nt, Chlamydophila pneumoniae CWL029
auggaaagagucccugauucca

SEQ ID NO: 499209 - RNA, 15 nt, Chlamydophila pneumoniae CWL029
auggaaacauagaau

SEQ ID NO: 499210 - RNA, 14 nt, Chlamydophila pneumoniae CWL029
auggaaagaaacaa

SEQ ID NO: 499211 - RNA, 17 nt, Chlamydophila pneumoniae CWL029
augcuuagcaaaggcaa

SEQ ID NO: 499212 - RNA, 20 nt, Chlamydophila pneumoniae CWL029
augcuucaaggcaucuucuu

SEQ ID NO: 499213 - RNA, 14 nt, Chlamydophila pneumoniae CWL029
augcuucuuucaaa

SEQ ID NO: 499214 - RNA, 19 nt, Chlamydophila pneumoniae CWL029
augcuugaaguucucaaag

SEQ ID NO: 499215 - RNA, 16 nt, Chlamydophila pneumoniae CWL029
auguacagaaaauaag

SEQ ID NO: 499216 - RNA, 18 nt, Chlamydophila pneumoniae CWL029
auguacagaaaauaagaa

SEQ ID NO: 499217 - RNA, 18 nt, Chlamydophila pneumoniae CWL029
auguacaagcuucaucaa

SEQ ID NO: 499218 - RNA, 14 nt, Chlamydophila pneumoniae CWL029
auguagaucuacaa

SEQ ID NO: 499219 - RNA, 22 nt, Chlamydophila pneumoniae CWL029
auguacccagcgaugucuuuga

SEQ ID NO: 499220 - RNA, 17 nt, Chlamydophila pneumoniae CWL029
augucgcuaccauaucu

SEQ ID NO: 499221 - RNA, 20 nt, Chlamydophila pneumoniae CWL029
augucacucuagaaaauauu

SEQ ID NO: 499222 - RNA, 15 nt, Chlamydophila pneumoniae CWL029
augucaguaucaaua

SEQ ID NO: 499223 - RNA, 19 nt, Chlamydophila pneumoniae CWL029
augucuccaaagauacauu

SEQ ID NO: 499224 - RNA, 14 nt, Chlamydophila pneumoniae CWL029
augucuaaaggagu

SEQ ID NO: 499225 - RNA, 24 nt, Chlamydophila pneumoniae CWL029
augugguucccccuaagguagcua

SEQ ID NO: 499226 - RNA, 19 nt, Chlamydophila pneumoniae CWL029
augugcgcacaagggauuc

SEQ ID NO: 499227 - RNA, 16 nt, Chlamydophila pneumoniae CWL029
augugucuugcugauu

SEQ ID NO: 499228 - RNA, 23 nt, Chlamydophila pneumoniae CWL029
augugucuugcugauuuuugcua

SEQ ID NO: 499229 - RNA, 16 nt, Chlamydophila pneumoniae CWL029
auguucccaaauagaa

SEQ ID NO: 499230 - RNA, 12 nt, Chlamydophila pneumoniae CWL029
auguuauggacu

SEQ ID NO: 499231 - RNA, 15 nt, Chlamydophila pneumoniae CWL029
auguuaugaguuuuu

SEQ ID NO: 499232 - RNA, 18 nt, Chlamydophila pneumoniae CWL029
auguuaugaguuuuuaau

SEQ ID NO: 499233 - RNA, 21 nt, Chlamydophila pneumoniae CWL029
auguucuaugagauaggaacu

SEQ ID NO: 499234 - RNA, 17 nt, Chlamydophila pneumoniae CWL029
auguucucgcaaugcuu

SEQ ID NO: 499235 - RNA, 14 nt, Chlamydophila pneumoniae CWL029
auguucgauuuucu

SEQ ID NO: 499236 - RNA, 12 nt, Chlamydophila pneumoniae CWL029
augguugcuucu

SEQ ID NO: 499237 - RNA, 22 nt, Chlamydophila pneumoniae CWL029
augggugagauuauaaagauaa

SEQ ID NO: 499238 - RNA, 19 nt, Chlamydophila pneumoniae CWL029
auggucaggaagaaaggau

SEQ ID NO: 499239 - RNA, 16 nt, Chlamydophila pneumoniae CWL029
augggguccauucuga

SEQ ID NO: 499240 - RNA, 15 nt, Chlamydophila pneumoniae CWL029
auggcccgauacaaa

SEQ ID NO: 499241 - RNA, 20 nt, Chlamydophila pneumoniae CWL029
auggauuucuccagcagcuu

SEQ ID NO: 499242 - RNA, 17 nt, Chlamydophila pneumoniae CWL029
auggcgauaaaugcuga

SEQ ID NO: 499243 - RNA, 16 nt, Chlamydophila pneumoniae CWL029
auggcuggaaagccaa

SEQ ID NO: 499244 - RNA, 18 nt, Chlamydophila pneumoniae CWL029
augcauagaauaaagauu

SEQ ID NO: 499245 - RNA, 15 nt, Chlamydophila pneumoniae CWL029
augcaucaaugaagu

SEQ ID NO: 499246 - RNA, 20 nt, Chlamydophila pneumoniae CWL029
augcagauacuaaacuccau

SEQ ID NO: 499247 - RNA, 21 nt, Chlamydophila pneumoniae CWL029
augcacgcuuucgucuaaaau

SEQ ID NO: 499248 - RNA, 22 nt, Chlamydophila pneumoniae CWL029
augcacgcuuucgucuaaaaua

SEQ ID NO: 499249 - RNA, 12 nt, Chlamydophila pneumoniae CWL029
augauucauaac

SEQ ID NO: 499250 - RNA, 23 nt, Chlamydophila pneumoniae CWL029
augcaaaacaacaucacuaucau

SEQ ID NO: 499251 - RNA, 14 nt, Chlamydophila pneumoniae CWL029
augauuuuuugaau

SEQ ID NO: 499252 - RNA, 17 nt, Chlamydophila pneumoniae CWL029
augcaccauaauauaau

SEQ ID NO: 499253 - RNA, 19 nt, Chlamydophila pneumoniae CWL029
augauauuuuuauuuaaaa

SEQ ID NO: 499254 - RNA, 21 nt, Chlamydophila pneumoniae CWL029
augauauuuuuauuuaaaauu

SEQ ID NO: 499255 - RNA, 16 nt, Chlamydophila pneumoniae CWL029
augauccgaaaacucu

SEQ ID NO: 499256 - RNA, 16 nt, Chlamydophila pneumoniae CWL029
augaucuacagauagg

SEQ ID NO: 499257 - RNA, 17 nt, Chlamydophila pneumoniae CWL029
augaucgggguuucaga

SEQ ID NO: 499258 - RNA, 21 nt, Chlamydophila pneumoniae CWL029
augaucgggguuucagaagga

SEQ ID NO: 499259 - RNA, 17 nt, Chlamydophila pneumoniae CWL029
augaugcauauugccuu

SEQ ID NO: 499260 - RNA, 15 nt, Chlamydophila pneumoniae CWL029
augauguuuuuuaac

SEQ ID NO: 499261 - RNA, 17 nt, Chlamydophila pneumoniae CWL029
augaggcacauguagga

SEQ ID NO: 499262 - RNA, 18 nt, Chlamydophila pneumoniae CWL029
augaggauacacuucuaa

SEQ ID NO: 499263 - RNA, 13 nt, Chlamydophila pneumoniae CWL029
augauaauuucau

SEQ ID NO: 499264 - RNA, 20 nt, Chlamydophila pneumoniae CWL029
augauaccaagaugaagaaa

SEQ ID NO: 499265 - RNA, 13 nt, Chlamydophila pneumoniae CWL029
augauaucaccag

SEQ ID NO: 499266 - RNA, 20 nt, Chlamydophila pneumoniae CWL029
augagcgagguauucucugg

SEQ ID NO: 499267 - RNA, 18 nt, Chlamydophila pneumoniae CWL029
augagcucaggcaacaac

SEQ ID NO: 499268 - RNA, 17 nt, Chlamydophila pneumoniae CWL029
augagcacauucaagau

SEQ ID NO: 499269 - RNA, 13 nt, Chlamydophila pneumoniae CWL029
augacuauuuuca

SEQ ID NO: 499270 - RNA, 22 nt, Chlamydophila pneumoniae CWL029
augacuauuuucauuccaagau

SEQ ID NO: 499271 - RNA, 18 nt, Chlamydophila pneumoniae CWL029
augacagggaaagaacag

SEQ ID NO: 499272 - RNA, 17 nt, Chlamydophila pneumoniae CWL029
augacggauccuagaau

SEQ ID NO: 499273 - RNA, 22 nt, Chlamydophila pneumoniae CWL029
augacggauccuagaauaggaa

SEQ ID NO: 499274 - RNA, 14 nt, Chlamydophila pneumoniae CWL029
augacaacagagac

SEQ ID NO: 499275 - RNA, 18 nt, Chlamydophila pneumoniae CWL029
augacaaguaucuacaca

SEQ ID NO: 499276 - RNA, 19 nt, Chlamydophila pneumoniae CWL029
augacacagagaacaauaa

SEQ ID NO: 499277 - RNA, 19 nt, Chlamydophila pneumoniae CWL029
augaacucaggcuuuaagu

SEQ ID NO: 499278 - RNA, 12 nt, Chlamydophila pneumoniae CWL029
augaacgugcau

SEQ ID NO: 499279 - RNA, 22 nt, Chlamydophila pneumoniae CWL029
augaacagccucugugguuuuu

SEQ ID NO: 499280 - RNA, 16 nt, Chlamydophila pneumoniae CWL029
aucuuuuugccaguuc

SEQ ID NO: 499281 - RNA, 13 nt, Chlamydophila pneumoniae CWL029
aucuuuuuuaaag

SEQ ID NO: 499282 - RNA, 14 nt, Chlamydophila pneumoniae CWL029
aucuuuuuuaaagc

SEQ ID NO: 499283 - RNA, 14 nt, Chlamydophila pneumoniae CWL029
augaaaaaagaaua

SEQ ID NO: 499284 - RNA, 17 nt, Chlamydophila pneumoniae CWL029
augaaaaggauugcacu

SEQ ID NO: 499285 - RNA, 18 nt, Chlamydophila pneumoniae CWL029
augaaauuucauucucac

SEQ ID NO: 499286 - RNA, 23 nt, Chlamydophila pneumoniae CWL029
augaaauuucauucucacagcau

SEQ ID NO: 499287 - RNA, 20 nt, Chlamydophila pneumoniae CWL029
augaaauuuucuaagagguu

SEQ ID NO: 499288 - RNA, 21 nt, Chlamydophila pneumoniae CWL029
aucuuugagaucuugaaugau

SEQ ID NO: 499289 - RNA, 20 nt, Chlamydophila pneumoniae CWL029
aucuuugagaucuugaauga

SEQ ID NO: 499290 - RNA, 15 nt, Chlamydophila pneumoniae CWL029
aucuuugaacaaaaa

SEQ ID NO: 499291 - RNA, 18 nt, Chlamydophila pneumoniae CWL029
aucuuuggcacaauccuc

SEQ ID NO: 499292 - RNA, 15 nt, Chlamydophila pneumoniae CWL029
aucuuuguugagaag

SEQ ID NO: 499293 - RNA, 22 nt, Chlamydophila pneumoniae CWL029
aucuuuuucauggcccgauaca

SEQ ID NO: 499294 - RNA, 23 nt, Chlamydophila pneumoniae CWL029
aucuuguucuaaaaugaaauacu

SEQ ID NO: 499295 - RNA, 19 nt, Chlamydophila pneumoniae CWL029
aucuuuaguuuaccugaaa

SEQ ID NO: 499296 - RNA, 22 nt, Chlamydophila pneumoniae CWL029
aucuuuaguuuaccugaaaaaa

SEQ ID NO: 499297 - RNA, 15 nt, Chlamydophila pneumoniae CWL029
aucuuucaaaagaaa

SEQ ID NO: 499298 - RNA, 18 nt, Chlamydophila pneumoniae CWL029
aucuuuauuuaaauaaaa

SEQ ID NO: 499299 - RNA, 19 nt, Chlamydophila pneumoniae CWL029
aucuuuauuuuuaaaaaua

SEQ ID NO: 499300 - RNA, 13 nt, Chlamydophila pneumoniae CWL029
aucuuuauuuaaa

SEQ ID NO: 499301 - RNA, 15 nt, Chlamydophila pneumoniae CWL029
aucuuguucuaaaau

SEQ ID NO: 499302 - RNA, 19 nt, Chlamydophila pneumoniae CWL029
aucuuguaaguuacggaac

SEQ ID NO: 499303 - RNA, 23 nt, Chlamydophila pneumoniae CWL029
aucuugcugcccaaauugagaaa

SEQ ID NO: 499304 - RNA, 21 nt, Chlamydophila pneumoniae CWL029
aucuucucauccagacaagac

SEQ ID NO: 499305 - RNA, 19 nt, Chlamydophila pneumoniae CWL029
aucuucuaaaaccacagaa

SEQ ID NO: 499306 - RNA, 13 nt, Chlamydophila pneumoniae CWL029
aucuucccauuuc

SEQ ID NO: 499307 - RNA, 13 nt, Chlamydophila pneumoniae CWL029
aucuucauaacca

SEQ ID NO: 499308 - RNA, 16 nt, Chlamydophila pneumoniae CWL029
aucuucagaauuuuau

SEQ ID NO: 499309 - RNA, 22 nt, Chlamydophila pneumoniae CWL029
aucuucagagagaacaggaggu

SEQ ID NO: 499310 - RNA, 16 nt, Chlamydophila pneumoniae CWL029
aucuucagggucuaag

SEQ ID NO: 499311 - RNA, 17 nt, Chlamydophila pneumoniae CWL029
aucuucacgacauacau

SEQ ID NO: 499312 - RNA, 21 nt, Chlamydophila pneumoniae CWL029
aucuucacgacauacaucaaa

SEQ ID NO: 499313 - RNA, 23 nt, Chlamydophila pneumoniae CWL029
aucuucaccacaaaccucuaaaa

SEQ ID NO: 499314 - RNA, 12 nt, Chlamydophila pneumoniae CWL029
aucuucaaaaga

SEQ ID NO: 499315 - RNA, 20 nt, Chlamydophila pneumoniae CWL029
aucuuauugacuagcucucu

SEQ ID NO: 499316 - RNA, 15 nt, Chlamydophila pneumoniae CWL029
aucuuaugggagaag

SEQ ID NO: 499317 - RNA, 12 nt, Chlamydophila pneumoniae CWL029
aucuuacauaaa

SEQ ID NO: 499318 - RNA, 17 nt, Chlamydophila pneumoniae CWL029
aucuuaguccaugaauc

SEQ ID NO: 499319 - RNA, 16 nt, Chlamydophila pneumoniae CWL029
aucuuauagacaggua

SEQ ID NO: 499320 - RNA, 13 nt, Chlamydophila pneumoniae CWL029
aucuuauauaaaa

SEQ ID NO: 499321 - RNA, 16 nt, Chlamydophila pneumoniae CWL029
aucuuauauaaaacuu

SEQ ID NO: 499322 - RNA, 15 nt, Chlamydophila pneumoniae CWL029
aucuuaucaagagcu

SEQ ID NO: 499323 - RNA, 23 nt, Chlamydophila pneumoniae CWL029
aucuguaauagcaggaguuuuca

SEQ ID NO: 499324 - RNA, 17 nt, Chlamydophila pneumoniae CWL029
aucuguaagaaaaugag

SEQ ID NO: 499325 - RNA, 14 nt, Chlamydophila pneumoniae CWL029
aucuguuaaaaaca

SEQ ID NO: 499326 - RNA, 15 nt, Chlamydophila pneumoniae CWL029
aucugucauuaaaaa

SEQ ID NO: 499327 - RNA, 17 nt, Chlamydophila pneumoniae CWL029
aucugucauuaaaaauu

SEQ ID NO: 499328 - RNA, 23 nt, Chlamydophila pneumoniae CWL029
aucugucauuaaaaauuuaaaag

SEQ ID NO: 499329 - RNA, 17 nt, Chlamydophila pneumoniae CWL029
aucuguaguaggcacuu

SEQ ID NO: 499330 - RNA, 17 nt, Chlamydophila pneumoniae CWL029
aucuguauccuuccuua

SEQ ID NO: 499331 - RNA, 18 nt, Chlamydophila pneumoniae CWL029
aucuaagaugguuauuau

SEQ ID NO: 499332 - RNA, 23 nt, Chlamydophila pneumoniae CWL029
aucuaagccagaggcccgaagca

SEQ ID NO: 499333 - RNA, 15 nt, Chlamydophila pneumoniae CWL029
aucuaagaauaugga

SEQ ID NO: 499334 - RNA, 13 nt, Chlamydophila pneumoniae CWL029
aucuaaucaauuc

SEQ ID NO: 499335 - RNA, 17 nt, Chlamydophila pneumoniae CWL029
aucuacaaaaacuagaa

SEQ ID NO: 499336 - RNA, 19 nt, Chlamydophila pneumoniae CWL029
aucuacaaaaacuagaaua

SEQ ID NO: 499337 - RNA, 21 nt, Chlamydophila pneumoniae CWL029
aucuacaaaaacuagaauaug

SEQ ID NO: 499338 - RNA, 20 nt, Chlamydophila pneumoniae CWL029
aucuacaaacagauuuuuca

SEQ ID NO: 499339 - RNA, 17 nt, Chlamydophila pneumoniae CWL029
aucugcuucuacgguaa

SEQ ID NO: 499340 - RNA, 12 nt, Chlamydophila pneumoniae CWL029
aucuggagaugc

SEQ ID NO: 499341 - RNA, 21 nt, Chlamydophila pneumoniae CWL029
auucgaaaaacgguaaauauc

SEQ ID NO: 499342 - RNA, 13 nt, Chlamydophila pneumoniae CWL029
auuccugagguug

SEQ ID NO: 499343 - RNA, 17 nt, Chlamydophila pneumoniae CWL029
auuccuuaaugguagcu

SEQ ID NO: 499344 - RNA, 14 nt, Chlamydophila pneumoniae CWL029
auucgcuacauaaa

SEQ ID NO: 499345 - RNA, 14 nt, Chlamydophila pneumoniae CWL029
auucgcauuuuugg

SEQ ID NO: 499346 - RNA, 20 nt, Chlamydophila pneumoniae CWL029
auucgccaaacgaauuucuu

SEQ ID NO: 499347 - RNA, 15 nt, Chlamydophila pneumoniae CWL029
auucggaccaaugau

SEQ ID NO: 499348 - RNA, 20 nt, Chlamydophila pneumoniae CWL029
auucccuuuuuccauaccca

SEQ ID NO: 499349 - RNA, 20 nt, Chlamydophila pneumoniae CWL029
auuccguacgcuauaaauaa

SEQ ID NO: 499350 - RNA, 14 nt, Chlamydophila pneumoniae CWL029
auuccccaaacuua

SEQ ID NO: 499351 - RNA, 14 nt, Chlamydophila pneumoniae CWL029
auuccccguguuug

SEQ ID NO: 499352 - RNA, 18 nt, Chlamydophila pneumoniae CWL029
auuccccagggagaucua

SEQ ID NO: 499353 - RNA, 18 nt, Chlamydophila pneumoniae CWL029
auucccggaggcaaagau

SEQ ID NO: 499354 - RNA, 20 nt, Chlamydophila pneumoniae CWL029
auucccggaggcaaagauca

SEQ ID NO: 499355 - RNA, 20 nt, Chlamydophila pneumoniae CWL029
auucccugacacagagcuuc

SEQ ID NO: 499356 - RNA, 13 nt, Chlamydophila pneumoniae CWL029
auucccuccgcag

SEQ ID NO: 499357 - RNA, 20 nt, Chlamydophila pneumoniae CWL029
auucccaagaacuugagcac

SEQ ID NO: 499358 - RNA, 21 nt, Chlamydophila pneumoniae CWL029
auuccauccugucuauuucuu

SEQ ID NO: 499359 - RNA, 19 nt, Chlamydophila pneumoniae CWL029
auuccauagguuagaaaug

SEQ ID NO: 499360 - RNA, 22 nt, Chlamydophila pneumoniae CWL029
auuccauagguuagaaaugaaa

SEQ ID NO: 499361 - RNA, 17 nt, Chlamydophila pneumoniae CWL029
auuccagaaaaagaaca

SEQ ID NO: 499362 - RNA, 21 nt, Chlamydophila pneumoniae CWL029
auuccagaaaaagaacauaag

SEQ ID NO: 499363 - RNA, 19 nt, Chlamydophila pneumoniae CWL029
auuccagcaucuucucgaa

SEQ ID NO: 499364 - RNA, 23 nt, Chlamydophila pneumoniae CWL029
auuccagcugagcuaucuucaag

SEQ ID NO: 499365 - RNA, 21 nt, Chlamydophila pneumoniae CWL029
auuccaggacguaaaaagaaa

SEQ ID NO: 499366 - RNA, 23 nt, Chlamydophila pneumoniae CWL029
auuccaggauucuauaacuacaa

SEQ ID NO: 499367 - RNA, 17 nt, Chlamydophila pneumoniae CWL029
auuccaaaauaaaagga

SEQ ID NO: 499368 - RNA, 14 nt, Chlamydophila pneumoniae CWL029
auuccaauuuuugc

SEQ ID NO: 499369 - RNA, 23 nt, Chlamydophila pneumoniae CWL029
auuccaagaucuccgccuacaau

SEQ ID NO: 499370 - RNA, 16 nt, Chlamydophila pneumoniae CWL029
auucagugucuugaag

SEQ ID NO: 499371 - RNA, 17 nt, Chlamydophila pneumoniae CWL029
auucauaaagaggaaug

SEQ ID NO: 499372 - RNA, 19 nt, Chlamydophila pneumoniae CWL029
auucauauuuacgaaaaca

SEQ ID NO: 499373 - RNA, 23 nt, Chlamydophila pneumoniae CWL029
auucaucuaggggagcuauuacu

SEQ ID NO: 499374 - RNA, 18 nt, Chlamydophila pneumoniae CWL029
auucaugccgcauuucuu

SEQ ID NO: 499375 - RNA, 15 nt, Chlamydophila pneumoniae CWL029
auucauuaagaacau

SEQ ID NO: 499376 - RNA, 14 nt, Chlamydophila pneumoniae CWL029
auuggcauagagcc

SEQ ID NO: 499377 - RNA, 13 nt, Chlamydophila pneumoniae CWL029
auuggaagcaaag

SEQ ID NO: 499378 - RNA, 20 nt, Chlamydophila pneumoniae CWL029
auugcugccaggcuuaaaua

SEQ ID NO: 499379 - RNA, 18 nt, Chlamydophila pneumoniae CWL029
auugcgggcucaaagaaa

SEQ ID NO: 499380 - RNA, 16 nt, Chlamydophila pneumoniae CWL029
auugcugaaaaugauu

SEQ ID NO: 499381 - RNA, 20 nt, Chlamydophila pneumoniae CWL029
auugcauuaagauaaacauu

SEQ ID NO: 499382 - RNA, 15 nt, Chlamydophila pneumoniae CWL029
auugcauuuaaacua

SEQ ID NO: 499383 - RNA, 16 nt, Chlamydophila pneumoniae CWL029
auugaugcuuaagagu

SEQ ID NO: 499384 - RNA, 19 nt, Chlamydophila pneumoniae CWL029
auugacaacacgaucuaag

SEQ ID NO: 499385 - RNA, 14 nt, Chlamydophila pneumoniae CWL029
auugaagauauuau

SEQ ID NO: 499386 - RNA, 14 nt, Chlamydophila pneumoniae CWL029
auugaucuuuccuc

SEQ ID NO: 499387 - RNA, 16 nt, Chlamydophila pneumoniae CWL029
auucuaaaagagcaag

SEQ ID NO: 499388 - RNA, 22 nt, Chlamydophila pneumoniae CWL029
auucuaaggugcuauuuuaaac

SEQ ID NO: 499389 - RNA, 13 nt, Chlamydophila pneumoniae CWL029
auucguuauccuc

SEQ ID NO: 499390 - RNA, 19 nt, Chlamydophila pneumoniae CWL029
auucucccaauauccagaa

SEQ ID NO: 499391 - RNA, 13 nt, Chlamydophila pneumoniae CWL029
auucucugacacu

SEQ ID NO: 499392 - RNA, 23 nt, Chlamydophila pneumoniae CWL029
auucucugacacuccucagaauc

SEQ ID NO: 499393 - RNA, 14 nt, Chlamydophila pneumoniae CWL029
auucucuucauuuu

SEQ ID NO: 499394 - RNA, 15 nt, Chlamydophila pneumoniae CWL029
auucugaagagagaa

SEQ ID NO: 499395 - RNA, 23 nt, Chlamydophila pneumoniae CWL029
auucugaagauauauuuuuaaag

SEQ ID NO: 499396 - RNA, 12 nt, Chlamydophila pneumoniae CWL029
auucugaagcug

SEQ ID NO: 499397 - RNA, 16 nt, Chlamydophila pneumoniae CWL029
auucucaauucuguau

SEQ ID NO: 499398 - RNA, 17 nt, Chlamydophila pneumoniae CWL029
auucucaaggaucuuau

SEQ ID NO: 499399 - RNA, 14 nt, Chlamydophila pneumoniae CWL029
auucucacucuaug

SEQ ID NO: 499400 - RNA, 13 nt, Chlamydophila pneumoniae CWL029
auucucagcuuca

SEQ ID NO: 499401 - RNA, 20 nt, Chlamydophila pneumoniae CWL029
auucuagaguugcuuuaugg

SEQ ID NO: 499402 - RNA, 20 nt, Chlamydophila pneumoniae CWL029
auucugcccaaagcuaaaau

SEQ ID NO: 499403 - RNA, 21 nt, Chlamydophila pneumoniae CWL029
auucugcccaaagcuaaaaug

SEQ ID NO: 499404 - RNA, 18 nt, Chlamydophila pneumoniae CWL029
auucugagaaagaagucc

SEQ ID NO: 499405 - RNA, 15 nt, Chlamydophila pneumoniae CWL029
auucugagaaagaag

SEQ ID NO: 499406 - RNA, 20 nt, Chlamydophila pneumoniae CWL029
auucugauaaucagaggagc

SEQ ID NO: 499407 - RNA, 19 nt, Chlamydophila pneumoniae CWL029
auucugaugaccucaucuc

SEQ ID NO: 499408 - RNA, 21 nt, Chlamydophila pneumoniae CWL029
auucuugagaguccugggguu

SEQ ID NO: 499409 - RNA, 22 nt, Chlamydophila pneumoniae CWL029
auucuucauuguagaggucacu

SEQ ID NO: 499410 - RNA, 13 nt, Chlamydophila pneumoniae CWL029
auucuuuuccugc

SEQ ID NO: 499411 - RNA, 23 nt, Chlamydophila pneumoniae CWL029
auucuuuuguaaucuaagaaucu

SEQ ID NO: 499412 - RNA, 20 nt, Chlamydophila pneumoniae CWL029
auugaacguagcuacaaaau

SEQ ID NO: 499413 - RNA, 13 nt, Chlamydophila pneumoniae CWL029
auucuuugccaag

SEQ ID NO: 499414 - RNA, 14 nt, Chlamydophila pneumoniae CWL029
auucuuuauaaaua

SEQ ID NO: 499415 - RNA, 21 nt, Chlamydophila pneumoniae CWL029
auucuuuauccccagaucucu

SEQ ID NO: 499416 - RNA, 23 nt, Chlamydophila pneumoniae CWL029
auucuugagaguccugggguucu

SEQ ID NO: 499417 - RNA, 14 nt, Chlamydophila pneumoniae CWL029
auuucuuauaaaaa

SEQ ID NO: 499418 - RNA, 16 nt, Chlamydophila pneumoniae CWL029
auuucuuauaaaaaag

SEQ ID NO: 499419 - RNA, 21 nt, Chlamydophila pneumoniae CWL029
auuucuuaauuuccuucucca

SEQ ID NO: 499420 - RNA, 16 nt, Chlamydophila pneumoniae CWL029
auuucuuucacaucuu

SEQ ID NO: 499421 - RNA, 22 nt, Chlamydophila pneumoniae CWL029
auuucuuucacaucuuuagaau

SEQ ID NO: 499422 - RNA, 17 nt, Chlamydophila pneumoniae CWL029
auuucuguaguucuugc

SEQ ID NO: 499423 - RNA, 16 nt, Chlamydophila pneumoniae CWL029
auuucuuacaagacaa

SEQ ID NO: 499424 - RNA, 17 nt, Chlamydophila pneumoniae CWL029
auuucucuaucaucaau

SEQ ID NO: 499425 - RNA, 16 nt, Chlamydophila pneumoniae CWL029
auuucucuaucaucaa

SEQ ID NO: 499426 - RNA, 23 nt, Chlamydophila pneumoniae CWL029
auuucucuaagcagccucuucuc

SEQ ID NO: 499427 - RNA, 22 nt, Chlamydophila pneumoniae CWL029
auuucguauagcuggcaaugau

SEQ ID NO: 499428 - RNA, 15 nt, Chlamydophila pneumoniae CWL029
auuucgugaacaaaa

SEQ ID NO: 499429 - RNA, 14 nt, Chlamydophila pneumoniae CWL029
auuuguuuagcaua

SEQ ID NO: 499430 - RNA, 20 nt, Chlamydophila pneumoniae CWL029
auuuguugucagcuuugcuu

SEQ ID NO: 499431 - RNA, 21 nt, Chlamydophila pneumoniae CWL029
auuuguagcucccauaaguuc

SEQ ID NO: 499432 - RNA, 19 nt, Chlamydophila pneumoniae CWL029
auuuguaagaaucauaaca

SEQ ID NO: 499433 - RNA, 15 nt, Chlamydophila pneumoniae CWL029
auuugcugcauccca

SEQ ID NO: 499434 - RNA, 23 nt, Chlamydophila pneumoniae CWL029
auuugcuuccaacggacauuuuc

SEQ ID NO: 499435 - RNA, 15 nt, Chlamydophila pneumoniae CWL029
auuugauuuuucaaa

SEQ ID NO: 499436 - RNA, 22 nt, Chlamydophila pneumoniae CWL029
auuugcaacaaucuuucuucua

SEQ ID NO: 499437 - RNA, 16 nt, Chlamydophila pneumoniae CWL029
auuuuuagaauagaag

SEQ ID NO: 499438 - RNA, 18 nt, Chlamydophila pneumoniae CWL029
auuuuuaggaucuuuguu

SEQ ID NO: 499439 - RNA, 20 nt, Chlamydophila pneumoniae CWL029
auuuuuaauuuuucuaagaa

SEQ ID NO: 499440 - RNA, 22 nt, Chlamydophila pneumoniae CWL029
auuuuggugagaucaucuccca

SEQ ID NO: 499441 - RNA, 15 nt, Chlamydophila pneumoniae CWL029
auuuucucaauagug

SEQ ID NO: 499442 - RNA, 15 nt, Chlamydophila pneumoniae CWL029
auuuucucauagcuu

SEQ ID NO: 499443 - RNA, 21 nt, Chlamydophila pneumoniae CWL029
auuuucuauucgcugucuaga

SEQ ID NO: 499444 - RNA, 16 nt, Chlamydophila pneumoniae CWL029
auuuugacguaaugca

SEQ ID NO: 499445 - RNA, 18 nt, Chlamydophila pneumoniae CWL029
auuuugacguaaugcaga

SEQ ID NO: 499446 - RNA, 20 nt, Chlamydophila pneumoniae CWL029
auuuugacguaaugcagaua

SEQ ID NO: 499447 - RNA, 17 nt, Chlamydophila pneumoniae CWL029
auuuuccgcaaaggaaa

SEQ ID NO: 499448 - RNA, 17 nt, Chlamydophila pneumoniae CWL029
auuuucccuuugucuau

SEQ ID NO: 499449 - RNA, 16 nt, Chlamydophila pneumoniae CWL029
auuuuccaggaccaaa

SEQ ID NO: 499450 - RNA, 17 nt, Chlamydophila pneumoniae CWL029
auuuucccaauauccuc

SEQ ID NO: 499451 - RNA, 17 nt, Chlamydophila pneumoniae CWL029
auuuucccauuacagcc

SEQ ID NO: 499452 - RNA, 18 nt, Chlamydophila pneumoniae CWL029
auuuuagcuucuuuuuuu

SEQ ID NO: 499453 - RNA, 22 nt, Chlamydophila pneumoniae CWL029
auuuuaggaagcuuaucaagaa

SEQ ID NO: 499454 - RNA, 21 nt, Chlamydophila pneumoniae CWL029
auuuuagggaugguuuccucu

SEQ ID NO: 499455 - RNA, 15 nt, Chlamydophila pneumoniae CWL029
auuuuacgaauuuca

SEQ ID NO: 499456 - RNA, 19 nt, Chlamydophila pneumoniae CWL029
auuuccuagguucuuuucg

SEQ ID NO: 499457 - RNA, 19 nt, Chlamydophila pneumoniae CWL029
auuuccuaccuauauuuuu

SEQ ID NO: 499458 - RNA, 16 nt, Chlamydophila pneumoniae CWL029
auuuccuuaagcuucu

SEQ ID NO: 499459 - RNA, 20 nt, Chlamydophila pneumoniae CWL029
auuuccuucaggauuuucca

SEQ ID NO: 499460 - RNA, 19 nt, Chlamydophila pneumoniae CWL029
auuuccuucaggauuuucc

SEQ ID NO: 499461 - RNA, 14 nt, Chlamydophila pneumoniae CWL029
auuuccuucuuuua

SEQ ID NO: 499462 - RNA, 16 nt, Chlamydophila pneumoniae CWL029
auuuccuucuccagag

SEQ ID NO: 499463 - RNA, 14 nt, Chlamydophila pneumoniae CWL029
auuuccaguauucu

SEQ ID NO: 499464 - RNA, 17 nt, Chlamydophila pneumoniae CWL029
auuuccaguauucugug

SEQ ID NO: 499465 - RNA, 19 nt, Chlamydophila pneumoniae CWL029
auuuccccaugaaaauaca

SEQ ID NO: 499466 - RNA, 20 nt, Chlamydophila pneumoniae CWL029
auuuauguuuucucgaagaa

SEQ ID NO: 499467 - RNA, 19 nt, Chlamydophila pneumoniae CWL029
auuuccaauccauucugag

SEQ ID NO: 499468 - RNA, 13 nt, Chlamydophila pneumoniae CWL029
auuucauuugaaa

SEQ ID NO: 499469 - RNA, 11 nt, Chlamydophila pneumoniae CWL029
auuguuuuguu

SEQ ID NO: 499470 - RNA, 14 nt, Chlamydophila pneumoniae CWL029
auuguuuuugcaaa

SEQ ID NO: 499471 - RNA, 21 nt, Chlamydophila pneumoniae CWL029
auuuaaaagguuuugaagcuc

SEQ ID NO: 499472 - RNA, 17 nt, Chlamydophila pneumoniae CWL029
auuuaagggaaauguca

SEQ ID NO: 499473 - RNA, 16 nt, Chlamydophila pneumoniae CWL029
auuuagggaagaguuc

SEQ ID NO: 499474 - RNA, 14 nt, Chlamydophila pneumoniae CWL029
caaagaguuuuuua

SEQ ID NO: 499475 - RNA, 23 nt, Chlamydophila pneumoniae CWL029
caaagaguuuuuuagaggagcuu

SEQ ID NO: 499476 - RNA, 16 nt, Chlamydophila pneumoniae CWL029
caaagauaaagaaguu

SEQ ID NO: 499477 - RNA, 13 nt, Chlamydophila pneumoniae CWL029
caaagauauaagg

SEQ ID NO: 499478 - RNA, 11 nt, Chlamydophila pneumoniae CWL029
caaagaucagu

SEQ ID NO: 499479 - RNA, 15 nt, Chlamydophila pneumoniae CWL029
caaagaucacugaga

SEQ ID NO: 499480 - RNA, 22 nt, Chlamydophila pneumoniae CWL029
caaagcuuguuccacuugcucu

SEQ ID NO: 499481 - RNA, 22 nt, Chlamydophila pneumoniae CWL029
caaagcuaggcgauaguaaaca

SEQ ID NO: 499482 - RNA, 14 nt, Chlamydophila pneumoniae CWL029
caaacuucuucucg

SEQ ID NO: 499483 - RNA, 17 nt, Chlamydophila pneumoniae CWL029
caaagacaucuccugca

SEQ ID NO: 499484 - RNA, 20 nt, Chlamydophila pneumoniae CWL029
caaagacguaggugccugaa

SEQ ID NO: 499485 - RNA, 14 nt, Chlamydophila pneumoniae CWL029
caaagacucaugaa

SEQ ID NO: 499486 - RNA, 16 nt, Chlamydophila pneumoniae CWL029
caaagacugagcuucu

SEQ ID NO: 499487 - RNA, 13 nt, Chlamydophila pneumoniae CWL029
caaagacuuuugc

SEQ ID NO: 499488 - RNA, 15 nt, Chlamydophila pneumoniae CWL029
caaagagcaaaggag

SEQ ID NO: 499489 - RNA, 22 nt, Chlamydophila pneumoniae CWL029
caaauauaugaguuuacuaacu

SEQ ID NO: 499490 - RNA, 14 nt, Chlamydophila pneumoniae CWL029
caaaucccugaugc

SEQ ID NO: 499491 - RNA, 20 nt, Chlamydophila pneumoniae CWL029
caaauaagccaguacuaaau

SEQ ID NO: 499492 - RNA, 19 nt, Chlamydophila pneumoniae CWL029
caaauaaguccuguuugaa

SEQ ID NO: 499493 - RNA, 17 nt, Chlamydophila pneumoniae CWL029
caaaggguuucuuucca

SEQ ID NO: 499494 - RNA, 15 nt, Chlamydophila pneumoniae CWL029
caaaggcaaccucug

SEQ ID NO: 499495 - RNA, 12 nt, Chlamydophila pneumoniae CWL029
caaaggcaacaa

SEQ ID NO: 499496 - RNA, 22 nt, Chlamydophila pneumoniae CWL029
caaaggaagggauguuuaauac

SEQ ID NO: 499497 - RNA, 14 nt, Chlamydophila pneumoniae CWL029
caaaggagaaagaa

SEQ ID NO: 499498 - RNA, 19 nt, Chlamydophila pneumoniae CWL029
caaaggagaaagaauugua

SEQ ID NO: 499499 - RNA, 19 nt, Chlamydophila pneumoniae CWL029
caaaggagcgggauaggca

SEQ ID NO: 499500 - RNA, 13 nt, Chlamydophila pneumoniae CWL029
caacauaacauga

SEQ ID NO: 499501 - RNA, 22 nt, Chlamydophila pneumoniae CWL029
caacauaaucauuauccauauc

SEQ ID NO: 499502 - RNA, 13 nt, Chlamydophila pneumoniae CWL029
caacauaaagaag

SEQ ID NO: 499503 - RNA, 13 nt, Chlamydophila pneumoniae CWL029
caacaguaauuau

SEQ ID NO: 499504 - RNA, 22 nt, Chlamydophila pneumoniae CWL029
caacaguguagccuuucuuuuu

SEQ ID NO: 499505 - RNA, 15 nt, Chlamydophila pneumoniae CWL029
caacaagggaaagaa

SEQ ID NO: 499506 - RNA, 22 nt, Chlamydophila pneumoniae CWL029
caacaaaugugacgcaagagac

SEQ ID NO: 499507 - RNA, 17 nt, Chlamydophila pneumoniae CWL029
caacaacgcucccuaug

SEQ ID NO: 499508 - RNA, 19 nt, Chlamydophila pneumoniae CWL029
caaaucuuacauaaaccuu

SEQ ID NO: 499509 - RNA, 21 nt, Chlamydophila pneumoniae CWL029
caaauccugcauacccuucuu

SEQ ID NO: 499510 - RNA, 23 nt, Chlamydophila pneumoniae CWL029
caaaucuucgaauuuuuguuuua

SEQ ID NO: 499511 - RNA, 18 nt, Chlamydophila pneumoniae CWL029
caaauucaaaauagaagc

SEQ ID NO: 499512 - RNA, 15 nt, Chlamydophila pneumoniae CWL029
caaauguucucucca

SEQ ID NO: 499513 - RNA, 18 nt, Chlamydophila pneumoniae CWL029
caaauuccuucucagaaa

SEQ ID NO: 499514 - RNA, 22 nt, Chlamydophila pneumoniae CWL029
caaauuccuucucagaaagaua

SEQ ID NO: 499515 - RNA, 14 nt, Chlamydophila pneumoniae CWL029
caaauuccuucuca

SEQ ID NO: 499516 - RNA, 18 nt, Chlamydophila pneumoniae CWL029
caaauucaccaaccaguu

SEQ ID NO: 499517 - RNA, 21 nt, Chlamydophila pneumoniae CWL029
caaauucaccaaccaguuucu

SEQ ID NO: 499518 - RNA, 13 nt, Chlamydophila pneumoniae CWL029
caaauucauuaag

SEQ ID NO: 499519 - RNA, 16 nt, Chlamydophila pneumoniae CWL029
caaauuuuucgagaau

SEQ ID NO: 499520 - RNA, 14 nt, Chlamydophila pneumoniae CWL029
caacaaaagggcau

SEQ ID NO: 499521 - RNA, 13 nt, Chlamydophila pneumoniae CWL029
caaaccuccuaga

SEQ ID NO: 499522 - RNA, 14 nt, Chlamydophila pneumoniae CWL029
caaaccucuaaaaa

SEQ ID NO: 499523 - RNA, 15 nt, Chlamydophila pneumoniae CWL029
caaaccucuaaaaac

SEQ ID NO: 499524 - RNA, 20 nt, Chlamydophila pneumoniae CWL029
caaacgcaaugauuucucua

SEQ ID NO: 499525 - RNA, 19 nt, Chlamydophila pneumoniae CWL029
caaacuaacauagauaagg

SEQ ID NO: 499526 - RNA, 16 nt, Chlamydophila pneumoniae CWL029
caaacuccuuuuaaaa

SEQ ID NO: 499527 - RNA, 16 nt, Chlamydophila pneumoniae CWL029
caaacucuauuuucau

SEQ ID NO: 499528 - RNA, 20 nt, Chlamydophila pneumoniae CWL029
caaacugaugccaagaaaua

SEQ ID NO: 499529 - RNA, 21 nt, Chlamydophila pneumoniae CWL029
caaacugauuaguuuguuuua

SEQ ID NO: 499530 - RNA, 16 nt, Chlamydophila pneumoniae CWL029
caaacagauuuuucaa

SEQ ID NO: 499531 - RNA, 20 nt, Chlamydophila pneumoniae CWL029
caaacccugggcucacucua

SEQ ID NO: 499532 - RNA, 16 nt, Chlamydophila pneumoniae CWL029
caaacccucuccagaa

SEQ ID NO: 499533 - RNA, 23 nt, Chlamydophila pneumoniae CWL029
caaaccagguagagugucuuccu

SEQ ID NO: 499534 - RNA, 15 nt, Chlamydophila pneumoniae CWL029
caaaccacggauuuu

SEQ ID NO: 499535 - RNA, 18 nt, Chlamydophila pneumoniae CWL029
caaacaucauuguugcug

SEQ ID NO: 499536 - RNA, 17 nt, Chlamydophila pneumoniae CWL029
caaacaucacucaggau

SEQ ID NO: 499537 - RNA, 19 nt, Chlamydophila pneumoniae CWL029
caaacauuaccguucccua

SEQ ID NO: 499538 - RNA, 12 nt, Chlamydophila pneumoniae CWL029
caaacauuuuua

SEQ ID NO: 499539 - RNA, 14 nt, Chlamydophila pneumoniae CWL029
caaacauuuuuaag

SEQ ID NO: 499540 - RNA, 16 nt, Chlamydophila pneumoniae CWL029
caaacauuuuuaagga

SEQ ID NO: 499541 - RNA, 12 nt, Chlamydophila pneumoniae CWL029
caaaccaaaaaa

SEQ ID NO: 499542 - RNA, 20 nt, Chlamydophila pneumoniae CWL029
caaaccacggauuuucucua

SEQ ID NO: 499543 - RNA, 22 nt, Chlamydophila pneumoniae CWL029
caaaauuauguauaaacuccac

SEQ ID NO: 499544 - RNA, 18 nt, Chlamydophila pneumoniae CWL029
caaaauuauguauaaacu

SEQ ID NO: 499545 - RNA, 19 nt, Chlamydophila pneumoniae CWL029
caaaauucaugcaaaacaa

SEQ ID NO: 499546 - RNA, 17 nt, Chlamydophila pneumoniae CWL029
caaaaugcgaggaaaaa

SEQ ID NO: 499547 - RNA, 18 nt, Chlamydophila pneumoniae CWL029
caaaaugcgaggaaaaag

SEQ ID NO: 499548 - RNA, 16 nt, Chlamydophila pneumoniae CWL029
caaaaugggauccugc

SEQ ID NO: 499549 - RNA, 22 nt, Chlamydophila pneumoniae CWL029
caaaaugucuuuuucaauugcu

SEQ ID NO: 499550 - RNA, 18 nt, Chlamydophila pneumoniae CWL029
caaaaugggauccugcaa

SEQ ID NO: 499551 - RNA, 14 nt, Chlamydophila pneumoniae CWL029
caaaauguuuaucg

SEQ ID NO: 499552 - RNA, 17 nt, Chlamydophila pneumoniae CWL029
caaaaucaaaguauaua

SEQ ID NO: 499553 - RNA, 15 nt, Chlamydophila pneumoniae CWL029
caaaauauucuuuca

SEQ ID NO: 499554 - RNA, 15 nt, Chlamydophila pneumoniae CWL029
caaaagguuuuauaa

SEQ ID NO: 499555 - RNA, 21 nt, Chlamydophila pneumoniae CWL029
caaaagguuuuauaaagaucg

SEQ ID NO: 499556 - RNA, 18 nt, Chlamydophila pneumoniae CWL029
auuuuucaauaaccagaa

SEQ ID NO: 499557 - RNA, 16 nt, Chlamydophila pneumoniae CWL029
caaaagucaugaggac

SEQ ID NO: 499558 - RNA, 18 nt, Chlamydophila pneumoniae CWL029
caaaagucaugaggacug

SEQ ID NO: 499559 - RNA, 12 nt, Chlamydophila pneumoniae CWL029
caaaauaaaaaa

SEQ ID NO: 499560 - RNA, 13 nt, Chlamydophila pneumoniae CWL029
caaaauaaaagga

SEQ ID NO: 499561 - RNA, 15 nt, Chlamydophila pneumoniae CWL029
caaaauaaaaggagc

SEQ ID NO: 499562 - RNA, 14 nt, Chlamydophila pneumoniae CWL029
auuuuuauuuaaaa

SEQ ID NO: 499563 - RNA, 18 nt, Chlamydophila pneumoniae CWL029
caaguaaucaugauaaaa

SEQ ID NO: 499564 - RNA, 15 nt, Chlamydophila pneumoniae CWL029
caagggaaagaaacu

SEQ ID NO: 499565 - RNA, 19 nt, Chlamydophila pneumoniae CWL029
caaggcugcugauccaaaa

SEQ ID NO: 499566 - RNA, 21 nt, Chlamydophila pneumoniae CWL029
caagucugcuugggacauuuc

SEQ ID NO: 499567 - RNA, 18 nt, Chlamydophila pneumoniae CWL029
caagucgagaaacaaaau

SEQ ID NO: 499568 - RNA, 12 nt, Chlamydophila pneumoniae CWL029
caagucuguaag

SEQ ID NO: 499569 - RNA, 15 nt, Chlamydophila pneumoniae CWL029
caaguguguauugua

SEQ ID NO: 499570 - RNA, 22 nt, Chlamydophila pneumoniae CWL029
caagugcucaguaaauauuuua

SEQ ID NO: 499571 - RNA, 21 nt, Chlamydophila pneumoniae CWL029
caaggcaaaaaguugaggaaa

SEQ ID NO: 499572 - RNA, 15 nt, Chlamydophila pneumoniae CWL029
caaggauuaugaauc

SEQ ID NO: 499573 - RNA, 17 nt, Chlamydophila pneumoniae CWL029
caaggauuaugaauccu

SEQ ID NO: 499574 - RNA, 14 nt, Chlamydophila pneumoniae CWL029
caagcuucaucaaa

SEQ ID NO: 499575 - RNA, 12 nt, Chlamydophila pneumoniae CWL029
caagcucgcgua

SEQ ID NO: 499576 - RNA, 23 nt, Chlamydophila pneumoniae CWL029
caagcaauacuaagaagcucacu

SEQ ID NO: 499577 - RNA, 13 nt, Chlamydophila pneumoniae CWL029
caagcaacucuuc

SEQ ID NO: 499578 - RNA, 16 nt, Chlamydophila pneumoniae CWL029
caagcaacucuucagc

SEQ ID NO: 499579 - RNA, 13 nt, Chlamydophila pneumoniae CWL029
caagauuuuguag

SEQ ID NO: 499580 - RNA, 23 nt, Chlamydophila pneumoniae CWL029
caagaugucuccaaagauacauu

SEQ ID NO: 499581 - RNA, 20 nt, Chlamydophila pneumoniae CWL029
caagauucccugcggacaga

SEQ ID NO: 499582 - RNA, 15 nt, Chlamydophila pneumoniae CWL029
caagauucucagcuu

SEQ ID NO: 499583 - RNA, 21 nt, Chlamydophila pneumoniae CWL029
caagcgcgcuaaaaaaaggcu

SEQ ID NO: 499584 - RNA, 19 nt, Chlamydophila pneumoniae CWL029
caauagcaaagauuucugc

SEQ ID NO: 499585 - RNA, 16 nt, Chlamydophila pneumoniae CWL029
caauagcaaagauuuc

SEQ ID NO: 499586 - RNA, 13 nt, Chlamydophila pneumoniae CWL029
caauagcagcagc

SEQ ID NO: 499587 - RNA, 22 nt, Chlamydophila pneumoniae CWL029
caauaccuguacgguaaaucca

SEQ ID NO: 499588 - RNA, 14 nt, Chlamydophila pneumoniae CWL029
caauauagaaaucg

SEQ ID NO: 499589 - RNA, 16 nt, Chlamydophila pneumoniae CWL029
caauauagaagcugcu

SEQ ID NO: 499590 - RNA, 14 nt, Chlamydophila pneumoniae CWL029
caauauaagcacca

SEQ ID NO: 499591 - RNA, 15 nt, Chlamydophila pneumoniae CWL029
caaucacauaaagau

SEQ ID NO: 499592 - RNA, 22 nt, Chlamydophila pneumoniae CWL029
caauauuaaaccguaggauucu

SEQ ID NO: 499593 - RNA, 19 nt, Chlamydophila pneumoniae CWL029
caauaaccgaaacuucuca

SEQ ID NO: 499594 - RNA, 17 nt, Chlamydophila pneumoniae CWL029
caauaagaaaauccuaa

SEQ ID NO: 499595 - RNA, 14 nt, Chlamydophila pneumoniae CWL029
caaguugagagaga

SEQ ID NO: 499596 - RNA, 13 nt, Chlamydophila pneumoniae CWL029
caaguucaucaaa

SEQ ID NO: 499597 - RNA, 20 nt, Chlamydophila pneumoniae CWL029
caaguucaucaaauaaggcu

SEQ ID NO: 499598 - RNA, 17 nt, Chlamydophila pneumoniae CWL029
caauacagauguaaaug

SEQ ID NO: 499599 - RNA, 23 nt, Chlamydophila pneumoniae CWL029
caauacagauguaaaugcuccuu

SEQ ID NO: 499600 - RNA, 17 nt, Chlamydophila pneumoniae CWL029
caauacagcauaaaaau

SEQ ID NO: 499601 - RNA, 18 nt, Chlamydophila pneumoniae CWL029
caauacagcauaaaaauu

SEQ ID NO: 499602 - RNA, 14 nt, Chlamydophila pneumoniae CWL029
caauaccagauaaa

SEQ ID NO: 499603 - RNA, 22 nt, Chlamydophila pneumoniae CWL029
caagaggcuguccuugcagccc

SEQ ID NO: 499604 - RNA, 23 nt, Chlamydophila pneumoniae CWL029
caagagcucguaauccuucuuuc

SEQ ID NO: 499605 - RNA, 22 nt, Chlamydophila pneumoniae CWL029
caagaggucgaagauucaaaga

SEQ ID NO: 499606 - RNA, 16 nt, Chlamydophila pneumoniae CWL029
caagaguucucuuuga

SEQ ID NO: 499607 - RNA, 20 nt, Chlamydophila pneumoniae CWL029
caagacaaaaaagggaucuc

SEQ ID NO: 499608 - RNA, 21 nt, Chlamydophila pneumoniae CWL029
caagaccacuuaggguucuca

SEQ ID NO: 499609 - RNA, 18 nt, Chlamydophila pneumoniae CWL029
caagagacaagaaaauau

SEQ ID NO: 499610 - RNA, 21 nt, Chlamydophila pneumoniae CWL029
caagagacaagaaaauaucac

SEQ ID NO: 499611 - RNA, 16 nt, Chlamydophila pneumoniae CWL029
caagagacaagaaaau

SEQ ID NO: 499612 - RNA, 20 nt, Chlamydophila pneumoniae CWL029
caagagcaucacaaacuaaa

SEQ ID NO: 499613 - RNA, 15 nt, Chlamydophila pneumoniae CWL029
caagagcccuugugc

SEQ ID NO: 499614 - RNA, 15 nt, Chlamydophila pneumoniae CWL029
caagacgaaagcaca

SEQ ID NO: 499615 - RNA, 16 nt, Chlamydophila pneumoniae CWL029
caagacgaaagcacau

SEQ ID NO: 499616 - RNA, 18 nt, Chlamydophila pneumoniae CWL029
caagacuacgacagaagu

SEQ ID NO: 499617 - RNA, 12 nt, Chlamydophila pneumoniae CWL029
caagagacaaga

SEQ ID NO: 499618 - RNA, 23 nt, Chlamydophila pneumoniae CWL029
caacuuuguuaauagaagaucau

SEQ ID NO: 499619 - RNA, 21 nt, Chlamydophila pneumoniae CWL029
caacuuuuuuacuaucuccua

SEQ ID NO: 499620 - RNA, 14 nt, Chlamydophila pneumoniae CWL029
caagaaaaaccccu

SEQ ID NO: 499621 - RNA, 16 nt, Chlamydophila pneumoniae CWL029
caagaaaacaaaguca

SEQ ID NO: 499622 - RNA, 19 nt, Chlamydophila pneumoniae CWL029
caacuuuguuaauagaaga

SEQ ID NO: 499623 - RNA, 21 nt, Chlamydophila pneumoniae CWL029
caacucucccauguaguaaau

SEQ ID NO: 499624 - RNA, 20 nt, Chlamydophila pneumoniae CWL029
caacucuacaagugucugag

SEQ ID NO: 499625 - RNA, 21 nt, Chlamydophila pneumoniae CWL029
caagaauagcaggaaggaaua

SEQ ID NO: 499626 - RNA, 21 nt, Chlamydophila pneumoniae CWL029
caagaauagccauaauuagaa

SEQ ID NO: 499627 - RNA, 19 nt, Chlamydophila pneumoniae CWL029
caagaauccgaucauaauu

SEQ ID NO: 499628 - RNA, 17 nt, Chlamydophila pneumoniae CWL029
caagaagcguacuuuac

SEQ ID NO: 499629 - RNA, 16 nt, Chlamydophila pneumoniae CWL029
caagaagaucaaagau

SEQ ID NO: 499630 - RNA, 18 nt, Chlamydophila pneumoniae CWL029
caagaacuugagcacaaa

SEQ ID NO: 499631 - RNA, 17 nt, Chlamydophila pneumoniae CWL029
caagaagagaaaagaua

SEQ ID NO: 499632 - RNA, 18 nt, Chlamydophila pneumoniae CWL029
caagaagagaaaagauag

SEQ ID NO: 499633 - RNA, 11 nt, Chlamydophila pneumoniae CWL029
caagaagaugu

SEQ ID NO: 499634 - RNA, 23 nt, Chlamydophila pneumoniae CWL029
caagaaaauaggugacuucuuug

SEQ ID NO: 499635 - RNA, 23 nt, Chlamydophila pneumoniae CWL029
caagaaaaauucuucgagagcau

SEQ ID NO: 499636 - RNA, 18 nt, Chlamydophila pneumoniae CWL029
caagaaauauacugccag

SEQ ID NO: 499637 - RNA, 14 nt, Chlamydophila pneumoniae CWL029
caagaaaugcccug

SEQ ID NO: 499638 - RNA, 14 nt, Chlamydophila pneumoniae CWL029
caagaacaauaagu

SEQ ID NO: 499639 - RNA, 15 nt, Chlamydophila pneumoniae CWL029
caagaacugaagagu

SEQ ID NO: 499640 - RNA, 17 nt, Chlamydophila pneumoniae CWL029
caagaaccuguuuuucu

SEQ ID NO: 499641 - RNA, 20 nt, Chlamydophila pneumoniae CWL029
caagaaccuguuuuucuaaa

SEQ ID NO: 499642 - RNA, 23 nt, Chlamydophila pneumoniae CWL029
caagaaccuguuuuucuaaaaug

SEQ ID NO: 499643 - RNA, 20 nt, Chlamydophila pneumoniae CWL029
caacuaaaccuucaaugauu

SEQ ID NO: 499644 - RNA, 12 nt, Chlamydophila pneumoniae CWL029
caacuaaacucu

SEQ ID NO: 499645 - RNA, 16 nt, Chlamydophila pneumoniae CWL029
caacuaaacucuccaa

SEQ ID NO: 499646 - RNA, 14 nt, Chlamydophila pneumoniae CWL029
caacuaaacuggga

SEQ ID NO: 499647 - RNA, 21 nt, Chlamydophila pneumoniae CWL029
caacucauccuaaauuaaaua

SEQ ID NO: 499648 - RNA, 22 nt, Chlamydophila pneumoniae CWL029
caacgguguucauaaucagaac

SEQ ID NO: 499649 - RNA, 16 nt, Chlamydophila pneumoniae CWL029
caacgaucgucaguaa

SEQ ID NO: 499650 - RNA, 14 nt, Chlamydophila pneumoniae CWL029
caacaucaaagaau

SEQ ID NO: 499651 - RNA, 18 nt, Chlamydophila pneumoniae CWL029
caaccuuuccuaaaauaa

SEQ ID NO: 499652 - RNA, 15 nt, Chlamydophila pneumoniae CWL029
cacugaacgccaucu

SEQ ID NO: 499653 - RNA, 13 nt, Chlamydophila pneumoniae CWL029
cacucuuucugua

SEQ ID NO: 499654 - RNA, 21 nt, Chlamydophila pneumoniae CWL029
cacucucugcagggaauccug

SEQ ID NO: 499655 - RNA, 19 nt, Chlamydophila pneumoniae CWL029
cacucuagaaaauauuccu

SEQ ID NO: 499656 - RNA, 23 nt, Chlamydophila pneumoniae CWL029
cacucuagaaaauauuccuggaa

SEQ ID NO: 499657 - RNA, 20 nt, Chlamydophila pneumoniae CWL029
cacucuaucauaucuucaaa

SEQ ID NO: 499658 - RNA, 18 nt, Chlamydophila pneumoniae CWL029
cacuauacccucugcuua

SEQ ID NO: 499659 - RNA, 13 nt, Chlamydophila pneumoniae CWL029
cacuaucuguaau

SEQ ID NO: 499660 - RNA, 13 nt, Chlamydophila pneumoniae CWL029
cacuauuaucugc

SEQ ID NO: 499661 - RNA, 18 nt, Chlamydophila pneumoniae CWL029
cacuauguguuuccuuuu

SEQ ID NO: 499662 - RNA, 21 nt, Chlamydophila pneumoniae CWL029
cacuauguguuuccuuuucuc

SEQ ID NO: 499663 - RNA, 15 nt, Chlamydophila pneumoniae CWL029
cacuacuuaaagcuu

SEQ ID NO: 499664 - RNA, 13 nt, Chlamydophila pneumoniae CWL029
cacuacuguucua

SEQ ID NO: 499665 - RNA, 21 nt, Chlamydophila pneumoniae CWL029
cacuaggcaugguaggagccg

SEQ ID NO: 499666 - RNA, 12 nt, Chlamydophila pneumoniae CWL029
cacucaaaagaa

SEQ ID NO: 499667 - RNA, 14 nt, Chlamydophila pneumoniae CWL029
cacucaaacccucu

SEQ ID NO: 499668 - RNA, 19 nt, Chlamydophila pneumoniae CWL029
cacucaaacccucuccaga

SEQ ID NO: 499669 - RNA, 17 nt, Chlamydophila pneumoniae CWL029
cacucaaacccucucca

SEQ ID NO: 499670 - RNA, 17 nt, Chlamydophila pneumoniae CWL029
cacuaacggcaguaugc

SEQ ID NO: 499671 - RNA, 20 nt, Chlamydophila pneumoniae CWL029
cacuaaacgaucaaauuccu

SEQ ID NO: 499672 - RNA, 17 nt, Chlamydophila pneumoniae CWL029
cacuaaaagggaagcuu

SEQ ID NO: 499673 - RNA, 16 nt, Chlamydophila pneumoniae CWL029
cacguuugacaaauuu

SEQ ID NO: 499674 - RNA, 23 nt, Chlamydophila pneumoniae CWL029
cacuaaucucaggcauucuucau

SEQ ID NO: 499675 - RNA, 18 nt, Chlamydophila pneumoniae CWL029
cacuaaguuuaggcagga

SEQ ID NO: 499676 - RNA, 15 nt, Chlamydophila pneumoniae CWL029
cacguucugcaacaa

SEQ ID NO: 499677 - RNA, 23 nt, Chlamydophila pneumoniae CWL029
cacgcucacgagucccuucuuuc

SEQ ID NO: 499678 - RNA, 12 nt, Chlamydophila pneumoniae CWL029
cacgccuauaga

SEQ ID NO: 499679 - RNA, 17 nt, Chlamydophila pneumoniae CWL029
cacgccuccuucaaaga

SEQ ID NO: 499680 - RNA, 17 nt, Chlamydophila pneumoniae CWL029
cacggacacuauuaucu

SEQ ID NO: 499681 - RNA, 13 nt, Chlamydophila pneumoniae CWL029
cacggaaauauuc

SEQ ID NO: 499682 - RNA, 17 nt, Chlamydophila pneumoniae CWL029
cacggacuccgucuccu

SEQ ID NO: 499683 - RNA, 13 nt, Chlamydophila pneumoniae CWL029
cacggauucuaaa

SEQ ID NO: 499684 - RNA, 17 nt, Chlamydophila pneumoniae CWL029
cacggauuuucucuaca

SEQ ID NO: 499685 - RNA, 23 nt, Chlamydophila pneumoniae CWL029
cacggcggagaauaucaucuucc

SEQ ID NO: 499686 - RNA, 14 nt, Chlamydophila pneumoniae CWL029
cacgcaacaucuca

SEQ ID NO: 499687 - RNA, 17 nt, Chlamydophila pneumoniae CWL029
cacgaucuucggaauac

SEQ ID NO: 499688 - RNA, 17 nt, Chlamydophila pneumoniae CWL029
cacgaucuagaagauga

SEQ ID NO: 499689 - RNA, 18 nt, Chlamydophila pneumoniae CWL029
cacgccacaaguuauccu

SEQ ID NO: 499690 - RNA, 23 nt, Chlamydophila pneumoniae CWL029
cacgaguucgcggaucuucuucu

SEQ ID NO: 499691 - RNA, 15 nt, Chlamydophila pneumoniae CWL029
cacgagauucugcuu

SEQ ID NO: 499692 - RNA, 20 nt, Chlamydophila pneumoniae CWL029
cacgaccucgaauuccuccc

SEQ ID NO: 499693 - RNA, 17 nt, Chlamydophila pneumoniae CWL029
cacgaauuucuaacuua

SEQ ID NO: 499694 - RNA, 18 nt, Chlamydophila pneumoniae CWL029
cacgaacuucagcaagaa

SEQ ID NO: 499695 - RNA, 13 nt, Chlamydophila pneumoniae CWL029
cacgaaaaggaga

SEQ ID NO: 499696 - RNA, 20 nt, Chlamydophila pneumoniae CWL029
caccuuaauggcuccuacuc

SEQ ID NO: 499697 - RNA, 14 nt, Chlamydophila pneumoniae CWL029
caccuuacauccaa

SEQ ID NO: 499698 - RNA, 15 nt, Chlamydophila pneumoniae CWL029
caccuuacauccaau

SEQ ID NO: 499699 - RNA, 17 nt, Chlamydophila pneumoniae CWL029
caccuucggaucuuccc

SEQ ID NO: 499700 - RNA, 22 nt, Chlamydophila pneumoniae CWL029
caccuuccccaagcucucucca

SEQ ID NO: 499701 - RNA, 20 nt, Chlamydophila pneumoniae CWL029
caccuuagagugacucauca

SEQ ID NO: 499702 - RNA, 21 nt, Chlamydophila pneumoniae CWL029
caccuugaaguuuuuucucuc

SEQ ID NO: 499703 - RNA, 11 nt, Chlamydophila pneumoniae CWL029
caccugaagag

SEQ ID NO: 499704 - RNA, 15 nt, Chlamydophila pneumoniae CWL029
caccucuucaaagac

SEQ ID NO: 499705 - RNA, 12 nt, Chlamydophila pneumoniae CWL029
caccugcccauu

SEQ ID NO: 499706 - RNA, 23 nt, Chlamydophila pneumoniae CWL029
caccucaauaaaucuauuccccu

SEQ ID NO: 499707 - RNA, 16 nt, Chlamydophila pneumoniae CWL029
caccuaaaguuugagc

SEQ ID NO: 499708 - RNA, 15 nt, Chlamydophila pneumoniae CWL029
caccuaaaaugcagg

SEQ ID NO: 499709 - RNA, 12 nt, Chlamydophila pneumoniae CWL029
cacccucccuca

SEQ ID NO: 499710 - RNA, 14 nt, Chlamydophila pneumoniae CWL029
cacccacuccagaa

SEQ ID NO: 499711 - RNA, 17 nt, Chlamydophila pneumoniae CWL029
caccauuuuugaauaug

SEQ ID NO: 499712 - RNA, 14 nt, Chlamydophila pneumoniae CWL029
cacccccacuucuu

SEQ ID NO: 499713 - RNA, 21 nt, Chlamydophila pneumoniae CWL029
caccaggaguuggagaauuga

SEQ ID NO: 499714 - RNA, 17 nt, Chlamydophila pneumoniae CWL029
caccaggagcuccuccu

SEQ ID NO: 499715 - RNA, 18 nt, Chlamydophila pneumoniae CWL029
caccaggagcuccuccuu

SEQ ID NO: 499716 - RNA, 16 nt, Chlamydophila pneumoniae CWL029
caccagguccuucugg

SEQ ID NO: 499717 - RNA, 16 nt, Chlamydophila pneumoniae CWL029
caccagggguuucuaa

SEQ ID NO: 499718 - RNA, 13 nt, Chlamydophila pneumoniae CWL029
caccauaauauaa

SEQ ID NO: 499719 - RNA, 13 nt, Chlamydophila pneumoniae CWL029
caccauauucuca

SEQ ID NO: 499720 - RNA, 19 nt, Chlamydophila pneumoniae CWL029
caccacgaacuucagcaag

SEQ ID NO: 499721 - RNA, 23 nt, Chlamydophila pneumoniae CWL029
caccacgaacuucagcaagaaaa

SEQ ID NO: 499722 - RNA, 22 nt, Chlamydophila pneumoniae CWL029
caccagacccucgaguaccgac

SEQ ID NO: 499723 - RNA, 14 nt, Chlamydophila pneumoniae CWL029
caccagaagcaacu

SEQ ID NO: 499724 - RNA, 18 nt, Chlamydophila pneumoniae CWL029
caccagaagcauugagga

SEQ ID NO: 499725 - RNA, 14 nt, Chlamydophila pneumoniae CWL029
caccagaaggaagg

SEQ ID NO: 499726 - RNA, 21 nt, Chlamydophila pneumoniae CWL029
caccagaaggaagguucucaa

SEQ ID NO: 499727 - RNA, 13 nt, Chlamydophila pneumoniae CWL029
caccaauuuuuuc

SEQ ID NO: 499728 - RNA, 21 nt, Chlamydophila pneumoniae CWL029
caccaaggggcguucuugaaa

SEQ ID NO: 499729 - RNA, 12 nt, Chlamydophila pneumoniae CWL029
caccaagacuga

SEQ ID NO: 499730 - RNA, 15 nt, Chlamydophila pneumoniae CWL029
caccaacaacaauaa

SEQ ID NO: 499731 - RNA, 18 nt, Chlamydophila pneumoniae CWL029
cacauugcgggcucaaag

SEQ ID NO: 499732 - RNA, 17 nt, Chlamydophila pneumoniae CWL029
cacauucaagauucccu

SEQ ID NO: 499733 - RNA, 19 nt, Chlamydophila pneumoniae CWL029
cacauuuagaaguaauccu

SEQ ID NO: 499734 - RNA, 21 nt, Chlamydophila pneumoniae CWL029
cacauuuagaaguaauccuaa

SEQ ID NO: 499735 - RNA, 18 nt, Chlamydophila pneumoniae CWL029
cacauuugcuuuaacaga

SEQ ID NO: 499736 - RNA, 17 nt, Chlamydophila pneumoniae CWL029
cacauuguuuaaguccu

SEQ ID NO: 499737 - RNA, 23 nt, Chlamydophila pneumoniae CWL029
cacauuuugguaucugauugcua

SEQ ID NO: 499738 - RNA, 12 nt, Chlamydophila pneumoniae CWL029
caccaaaagaau

SEQ ID NO: 499739 - RNA, 17 nt, Chlamydophila pneumoniae CWL029
cacauuaagcaaucccc

SEQ ID NO: 499740 - RNA, 16 nt, Chlamydophila pneumoniae CWL029
cacaugcccaaacauc

SEQ ID NO: 499741 - RNA, 14 nt, Chlamydophila pneumoniae CWL029
cacaucuuucucua

SEQ ID NO: 499742 - RNA, 23 nt, Chlamydophila pneumoniae CWL029
cacaucuuucucuaaaauaugcu

SEQ ID NO: 499743 - RNA, 14 nt, Chlamydophila pneumoniae CWL029
cacaucaaagcaau

SEQ ID NO: 499744 - RNA, 21 nt, Chlamydophila pneumoniae CWL029
cacaggaaugaaaccuucaga

SEQ ID NO: 499745 - RNA, 17 nt, Chlamydophila pneumoniae CWL029
cacaggcauggucuccc

SEQ ID NO: 499746 - RNA, 13 nt, Chlamydophila pneumoniae CWL029
cacauaguuuaau

SEQ ID NO: 499747 - RNA, 14 nt, Chlamydophila pneumoniae CWL029
cacauagaaacagu

SEQ ID NO: 499748 - RNA, 23 nt, Chlamydophila pneumoniae CWL029
cacaguuaagacgcagaaacacu

SEQ ID NO: 499749 - RNA, 13 nt, Chlamydophila pneumoniae CWL029
cacaguuugagaa

SEQ ID NO: 499750 - RNA, 15 nt, Chlamydophila pneumoniae CWL029
cacagugauuuagaa

SEQ ID NO: 499751 - RNA, 13 nt, Chlamydophila pneumoniae CWL029
cacagcauuuucu

SEQ ID NO: 499752 - RNA, 13 nt, Chlamydophila pneumoniae CWL029
cacagcaugcacg

SEQ ID NO: 499753 - RNA, 17 nt, Chlamydophila pneumoniae CWL029
cacagcuaaucaaucca

SEQ ID NO: 499754 - RNA, 18 nt, Chlamydophila pneumoniae CWL029
cacagcuaaucaauccaa

SEQ ID NO: 499755 - RNA, 17 nt, Chlamydophila pneumoniae CWL029
cacagcuaugauugaaa

SEQ ID NO: 499756 - RNA, 15 nt, Chlamydophila pneumoniae CWL029
cacagacuugaggaa

SEQ ID NO: 499757 - RNA, 21 nt, Chlamydophila pneumoniae CWL029
cacagacuugaggaaucugaa

SEQ ID NO: 499758 - RNA, 17 nt, Chlamydophila pneumoniae CWL029
cacagacugcaggaaau

SEQ ID NO: 499759 - RNA, 16 nt, Chlamydophila pneumoniae CWL029
cacagaaugauaagaa

SEQ ID NO: 499760 - RNA, 23 nt, Chlamydophila pneumoniae CWL029
cacagagcuucuaaaaacucuuc

SEQ ID NO: 499761 - RNA, 13 nt, Chlamydophila pneumoniae CWL029
cacacuuucuuua

SEQ ID NO: 499762 - RNA, 14 nt, Chlamydophila pneumoniae CWL029
cacacuuucuuuaa

SEQ ID NO: 499763 - RNA, 23 nt, Chlamydophila pneumoniae CWL029
cacacuuucuuuaaagaauagca

SEQ ID NO: 499764 - RNA, 19 nt, Chlamydophila pneumoniae CWL029
cacacuuaaagguaaaacu

SEQ ID NO: 499765 - RNA, 19 nt, Chlamydophila pneumoniae CWL029
cacacgaucuucggaauac

SEQ ID NO: 499766 - RNA, 15 nt, Chlamydophila pneumoniae CWL029
cacacgaucuucgga

SEQ ID NO: 499767 - RNA, 22 nt, Chlamydophila pneumoniae CWL029
cacaaucgugauugcugucaga

SEQ ID NO: 499768 - RNA, 13 nt, Chlamydophila pneumoniae CWL029
cacaaucgcauca

SEQ ID NO: 499769 - RNA, 23 nt, Chlamydophila pneumoniae CWL029
cacaauauaaaugcuauuuuccu

SEQ ID NO: 499770 - RNA, 15 nt, Chlamydophila pneumoniae CWL029
cacaauauaaaugcu

SEQ ID NO: 499771 - RNA, 15 nt, Chlamydophila pneumoniae CWL029
cacaagugcauuauc

SEQ ID NO: 499772 - RNA, 13 nt, Chlamydophila pneumoniae CWL029
caauuugcguugc

SEQ ID NO: 499773 - RNA, 17 nt, Chlamydophila pneumoniae CWL029
caauuuccugcauggcu

SEQ ID NO: 499774 - RNA, 17 nt, Chlamydophila pneumoniae CWL029
caauuuuuguagacaau

SEQ ID NO: 499775 - RNA, 13 nt, Chlamydophila pneumoniae CWL029
cacaaaaccugga

SEQ ID NO: 499776 - RNA, 18 nt, Chlamydophila pneumoniae CWL029
caauuuucuucagcacuu

SEQ ID NO: 499777 - RNA, 23 nt, Chlamydophila pneumoniae CWL029
caauuuguauauccacgaucuag

SEQ ID NO: 499778 - RNA, 14 nt, Chlamydophila pneumoniae CWL029
caauuuuaaaaucu

SEQ ID NO: 499779 - RNA, 18 nt, Chlamydophila pneumoniae CWL029
caauuuuaccacuuccag

SEQ ID NO: 499780 - RNA, 15 nt, Chlamydophila pneumoniae CWL029
cacaaaauaaaaccc

SEQ ID NO: 499781 - RNA, 12 nt, Chlamydophila pneumoniae CWL029
cacaaaauuugu

SEQ ID NO: 499782 - RNA, 15 nt, Chlamydophila pneumoniae CWL029
cacaaacaacagaaa

SEQ ID NO: 499783 - RNA, 17 nt, Chlamydophila pneumoniae CWL029
cacaaaccucuaaaaac

SEQ ID NO: 499784 - RNA, 20 nt, Chlamydophila pneumoniae CWL029
cacaaaucauuuaaagcuga

SEQ ID NO: 499785 - RNA, 14 nt, Chlamydophila pneumoniae CWL029
cacaacucuuuaau

SEQ ID NO: 499786 - RNA, 15 nt, Chlamydophila pneumoniae CWL029
caauuguaaauacaa

SEQ ID NO: 499787 - RNA, 18 nt, Chlamydophila pneumoniae CWL029
caauuguaaauacaaaac

SEQ ID NO: 499788 - RNA, 20 nt, Chlamydophila pneumoniae CWL029
caauugccaugcccacagac

SEQ ID NO: 499789 - RNA, 12 nt, Chlamydophila pneumoniae CWL029
caauugagcucu

SEQ ID NO: 499790 - RNA, 13 nt, Chlamydophila pneumoniae CWL029
caauugaaaauuc

SEQ ID NO: 499791 - RNA, 20 nt, Chlamydophila pneumoniae CWL029
caauugaaucagauuagagu

SEQ ID NO: 499792 - RNA, 16 nt, Chlamydophila pneumoniae CWL029
caauugagcucucuag

SEQ ID NO: 499793 - RNA, 15 nt, Chlamydophila pneumoniae CWL029
caauucuucaugcug

SEQ ID NO: 499794 - RNA, 17 nt, Chlamydophila pneumoniae CWL029
caauucuuaaaaagcua

SEQ ID NO: 499795 - RNA, 21 nt, Chlamydophila pneumoniae CWL029
caauucuuaaaaagcuaaaca

SEQ ID NO: 499796 - RNA, 15 nt, Chlamydophila pneumoniae CWL029
caauucucucucugc

SEQ ID NO: 499797 - RNA, 17 nt, Chlamydophila pneumoniae CWL029
caauuccuaaaacaaga

SEQ ID NO: 499798 - RNA, 17 nt, Chlamydophila pneumoniae CWL029
caauucgagauauggaa

SEQ ID NO: 499799 - RNA, 17 nt, Chlamydophila pneumoniae CWL029
caauucgcucagaaaau

SEQ ID NO: 499800 - RNA, 16 nt, Chlamydophila pneumoniae CWL029
caauucgguagagcua

SEQ ID NO: 499801 - RNA, 15 nt, Chlamydophila pneumoniae CWL029
caauucgguagagcu

SEQ ID NO: 499802 - RNA, 20 nt, Chlamydophila pneumoniae CWL029
caauuccuaaaacaagaaga

SEQ ID NO: 499803 - RNA, 15 nt, Chlamydophila pneumoniae CWL029
caauuccgaagaaga

SEQ ID NO: 499804 - RNA, 18 nt, Chlamydophila pneumoniae CWL029
caauuccgaagaagaaag

SEQ ID NO: 499805 - RNA, 17 nt, Chlamydophila pneumoniae CWL029
caauuccccuuuaaagc

SEQ ID NO: 499806 - RNA, 19 nt, Chlamydophila pneumoniae CWL029
caauuaugcccaaggaaaa

SEQ ID NO: 499807 - RNA, 23 nt, Chlamydophila pneumoniae CWL029
caauuaugcccaaggaaaaacaa

SEQ ID NO: 499808 - RNA, 14 nt, Chlamydophila pneumoniae CWL029
caauuacaggaaac

SEQ ID NO: 499809 - RNA, 14 nt, Chlamydophila pneumoniae CWL029
caaucaguucaucu

SEQ ID NO: 499810 - RNA, 18 nt, Chlamydophila pneumoniae CWL029
cauagagagccuuuccua

SEQ ID NO: 499811 - RNA, 15 nt, Chlamydophila pneumoniae CWL029
cauagagauucuaca

SEQ ID NO: 499812 - RNA, 16 nt, Chlamydophila pneumoniae CWL029
cauagaguaucuaaaa

SEQ ID NO: 499813 - RNA, 20 nt, Chlamydophila pneumoniae CWL029
cauagaguucgcacuaauuu

SEQ ID NO: 499814 - RNA, 18 nt, Chlamydophila pneumoniae CWL029
cauagccaucauagcaaa

SEQ ID NO: 499815 - RNA, 23 nt, Chlamydophila pneumoniae CWL029
cauagccaucauagcaaacggaa

SEQ ID NO: 499816 - RNA, 20 nt, Chlamydophila pneumoniae CWL029
cauagcaacuacagagggcu

SEQ ID NO: 499817 - RNA, 14 nt, Chlamydophila pneumoniae CWL029
cauagcgaaaguca

SEQ ID NO: 499818 - RNA, 14 nt, Chlamydophila pneumoniae CWL029
cauagcgagaacac

SEQ ID NO: 499819 - RNA, 13 nt, Chlamydophila pneumoniae CWL029
cauaauucugcac

SEQ ID NO: 499820 - RNA, 11 nt, Chlamydophila pneumoniae CWL029
cauagaauaaa

SEQ ID NO: 499821 - RNA, 18 nt, Chlamydophila pneumoniae CWL029
cauagggaugacccaaaa

SEQ ID NO: 499822 - RNA, 20 nt, Chlamydophila pneumoniae CWL029
cauagguaaaaccagcauaa

SEQ ID NO: 499823 - RNA, 19 nt, Chlamydophila pneumoniae CWL029
cauagguaauacgagagga

SEQ ID NO: 499824 - RNA, 16 nt, Chlamydophila pneumoniae CWL029
cauagguuagaaauga

SEQ ID NO: 499825 - RNA, 20 nt, Chlamydophila pneumoniae CWL029
cauaguauggcauucuuuuu

SEQ ID NO: 499826 - RNA, 21 nt, Chlamydophila pneumoniae CWL029
cauaggaaugccaaaccucuu

SEQ ID NO: 499827 - RNA, 17 nt, Chlamydophila pneumoniae CWL029
cauaggauccaggaguu

SEQ ID NO: 499828 - RNA, 17 nt, Chlamydophila pneumoniae CWL029
cauagcguauuccccac

SEQ ID NO: 499829 - RNA, 18 nt, Chlamydophila pneumoniae CWL029
cauaguuuuuauuuuuaa

SEQ ID NO: 499830 - RNA, 20 nt, Chlamydophila pneumoniae CWL029
cauaguuuuuauuuuuaaau

SEQ ID NO: 499831 - RNA, 22 nt, Chlamydophila pneumoniae CWL029
cauaguuuuuauuuuuaaauaa

SEQ ID NO: 499832 - RNA, 18 nt, Chlamydophila pneumoniae CWL029
cauauacuguuaacaagu

SEQ ID NO: 499833 - RNA, 20 nt, Chlamydophila pneumoniae CWL029
cauauacguggcuuccauaa

SEQ ID NO: 499834 - RNA, 21 nt, Chlamydophila pneumoniae CWL029
cauauacguggcuuccauaac

SEQ ID NO: 499835 - RNA, 14 nt, Chlamydophila pneumoniae CWL029
caucagaagcuccu

SEQ ID NO: 499836 - RNA, 18 nt, Chlamydophila pneumoniae CWL029
caucagaaaucaaagggu

SEQ ID NO: 499837 - RNA, 14 nt, Chlamydophila pneumoniae CWL029
caucagaaguggcc

SEQ ID NO: 499838 - RNA, 18 nt, Chlamydophila pneumoniae CWL029
caucagaggccaccaaaa

SEQ ID NO: 499839 - RNA, 19 nt, Chlamydophila pneumoniae CWL029
caucagcaaaacucccgac

SEQ ID NO: 499840 - RNA, 20 nt, Chlamydophila pneumoniae CWL029
caucaaugguuaaaacccau

SEQ ID NO: 499841 - RNA, 19 nt, Chlamydophila pneumoniae CWL029
caucacaaacuaaaucaac

SEQ ID NO: 499842 - RNA, 19 nt, Chlamydophila pneumoniae CWL029
caucacaauuacaggaaac

SEQ ID NO: 499843 - RNA, 22 nt, Chlamydophila pneumoniae CWL029
caucaccauccaaagcuauuuc

SEQ ID NO: 499844 - RNA, 23 nt, Chlamydophila pneumoniae CWL029
caucacuaagauacgaaguccca

SEQ ID NO: 499845 - RNA, 21 nt, Chlamydophila pneumoniae CWL029
cauauccaaugagagagagac

SEQ ID NO: 499846 - RNA, 17 nt, Chlamydophila pneumoniae CWL029
cauauccauggaauggc

SEQ ID NO: 499847 - RNA, 13 nt, Chlamydophila pneumoniae CWL029
cauauucuccuua

SEQ ID NO: 499848 - RNA, 12 nt, Chlamydophila pneumoniae CWL029
cauauugcaaag

SEQ ID NO: 499849 - RNA, 15 nt, Chlamydophila pneumoniae CWL029
cauauugcaaagcau

SEQ ID NO: 499850 - RNA, 14 nt, Chlamydophila pneumoniae CWL029
cauauugccuucuu

SEQ ID NO: 499851 - RNA, 17 nt, Chlamydophila pneumoniae CWL029
cauauuuauuuaaacca

SEQ ID NO: 499852 - RNA, 23 nt, Chlamydophila pneumoniae CWL029
caucaaugauaucgccuuccuua

SEQ ID NO: 499853 - RNA, 21 nt, Chlamydophila pneumoniae CWL029
caucaaugcgauuacuucacg

SEQ ID NO: 499854 - RNA, 22 nt, Chlamydophila pneumoniae CWL029
caucaaugagaucugcaaacgc

SEQ ID NO: 499855 - RNA, 15 nt, Chlamydophila pneumoniae CWL029
caucaaucacucuau

SEQ ID NO: 499856 - RNA, 16 nt, Chlamydophila pneumoniae CWL029
cauauuugaauaaagg

SEQ ID NO: 499857 - RNA, 14 nt, Chlamydophila pneumoniae CWL029
cauauuugaauaaa

SEQ ID NO: 499858 - RNA, 14 nt, Chlamydophila pneumoniae CWL029
caucaaagaauuau

SEQ ID NO: 499859 - RNA, 23 nt, Chlamydophila pneumoniae CWL029
caucaaagaauuauugauauuau

SEQ ID NO: 499860 - RNA, 19 nt, Chlamydophila pneumoniae CWL029
caucaaauaaggcugcuau

SEQ ID NO: 499861 - RNA, 20 nt, Chlamydophila pneumoniae CWL029
caucaaauaguucaucauau

SEQ ID NO: 499862 - RNA, 17 nt, Chlamydophila pneumoniae CWL029
caucucacaagcauccu

SEQ ID NO: 499863 - RNA, 13 nt, Chlamydophila pneumoniae CWL029
caucucacagaua

SEQ ID NO: 499864 - RNA, 21 nt, Chlamydophila pneumoniae CWL029
caucuccaagauaauuaugua

SEQ ID NO: 499865 - RNA, 14 nt, Chlamydophila pneumoniae CWL029
caucguuaauauaa

SEQ ID NO: 499866 - RNA, 21 nt, Chlamydophila pneumoniae CWL029
caucggcauaacuuuaucaua

SEQ ID NO: 499867 - RNA, 19 nt, Chlamydophila pneumoniae CWL029
caucgcaguuccauagcua

SEQ ID NO: 499868 - RNA, 22 nt, Chlamydophila pneumoniae CWL029
cauccuguagagcaagauucuu

SEQ ID NO: 499869 - RNA, 18 nt, Chlamydophila pneumoniae CWL029
caucggagaacuuccuga

SEQ ID NO: 499870 - RNA, 15 nt, Chlamydophila pneumoniae CWL029
cauccgaagacucaa

SEQ ID NO: 499871 - RNA, 19 nt, Chlamydophila pneumoniae CWL029
caucccuggauuucuucug

SEQ ID NO: 499872 - RNA, 22 nt, Chlamydophila pneumoniae CWL029
cauccauucuuaauauaaaaga

SEQ ID NO: 499873 - RNA, 14 nt, Chlamydophila pneumoniae CWL029
caucaggauucucu

SEQ ID NO: 499874 - RNA, 16 nt, Chlamydophila pneumoniae CWL029
caucaggauucucucu

SEQ ID NO: 499875 - RNA, 16 nt, Chlamydophila pneumoniae CWL029
cauuuccccaugaaaa

SEQ ID NO: 499876 - RNA, 16 nt, Chlamydophila pneumoniae CWL029
cauuucauguaagaau

SEQ ID NO: 499877 - RNA, 12 nt, Chlamydophila pneumoniae CWL029
cauuucaugaau

SEQ ID NO: 499878 - RNA, 16 nt, Chlamydophila pneumoniae CWL029
cauuuagauaaagaaa

SEQ ID NO: 499879 - RNA, 19 nt, Chlamydophila pneumoniae CWL029
cauuggcuccuaaggaaac

SEQ ID NO: 499880 - RNA, 16 nt, Chlamydophila pneumoniae CWL029
cauugcuauugaaaaa

SEQ ID NO: 499881 - RNA, 18 nt, Chlamydophila pneumoniae CWL029
cauugccauaauaaaggu

SEQ ID NO: 499882 - RNA, 17 nt, Chlamydophila pneumoniae CWL029
cauucuugaagaucucc

SEQ ID NO: 499883 - RNA, 17 nt, Chlamydophila pneumoniae CWL029
cauuccagcaucuucuc

SEQ ID NO: 499884 - RNA, 20 nt, Chlamydophila pneumoniae CWL029
cauuccaggacguaaaaaga

SEQ ID NO: 499885 - RNA, 14 nt, Chlamydophila pneumoniae CWL029
cauuccaggauucu

SEQ ID NO: 499886 - RNA, 13 nt, Chlamydophila pneumoniae CWL029
cauucauuuuuua

SEQ ID NO: 499887 - RNA, 19 nt, Chlamydophila pneumoniae CWL029
cauucauuuuuuaauaaaa

SEQ ID NO: 499888 - RNA, 12 nt, Chlamydophila pneumoniae CWL029
cauucauuuuuu

SEQ ID NO: 499889 - RNA, 17 nt, Chlamydophila pneumoniae CWL029
cauuccgagcugcaaac

SEQ ID NO: 499890 - RNA, 14 nt, Chlamydophila pneumoniae CWL029
cauuccgagcugca

SEQ ID NO: 499891 - RNA, 15 nt, Chlamydophila pneumoniae CWL029
cauucccuaaagcug

SEQ ID NO: 499892 - RNA, 19 nt, Chlamydophila pneumoniae CWL029
cauucccuaaagcugccag

SEQ ID NO: 499893 - RNA, 15 nt, Chlamydophila pneumoniae CWL029
cauuaccguucccua

SEQ ID NO: 499894 - RNA, 23 nt, Chlamydophila pneumoniae CWL029
cauguuaauaagcauauuuaaau

SEQ ID NO: 499895 - RNA, 18 nt, Chlamydophila pneumoniae CWL029
cauguuaagcguauagaa

SEQ ID NO: 499896 - RNA, 20 nt, Chlamydophila pneumoniae CWL029
cauguuaagcguauagaaua

SEQ ID NO: 499897 - RNA, 17 nt, Chlamydophila pneumoniae CWL029
cauuagggcauucugua

SEQ ID NO: 499898 - RNA, 19 nt, Chlamydophila pneumoniae CWL029
cauuauacuuuuuuuauau

SEQ ID NO: 499899 - RNA, 17 nt, Chlamydophila pneumoniae CWL029
cauuauuaaacgaauac

SEQ ID NO: 499900 - RNA, 16 nt, Chlamydophila pneumoniae CWL029
cauguaguaaauuccu

SEQ ID NO: 499901 - RNA, 15 nt, Chlamydophila pneumoniae CWL029
cauguaacugaaagu

SEQ ID NO: 499902 - RNA, 16 nt, Chlamydophila pneumoniae CWL029
cauguaacugaaagua

SEQ ID NO: 499903 - RNA, 18 nt, Chlamydophila pneumoniae CWL029
cauguacaguuuguaaaa

SEQ ID NO: 499904 - RNA, 19 nt, Chlamydophila pneumoniae CWL029
cauguacaguuuguaaaaa

SEQ ID NO: 499905 - RNA, 15 nt, Chlamydophila pneumoniae CWL029
cauggcguaaugcuc

SEQ ID NO: 499906 - RNA, 12 nt, Chlamydophila pneumoniae CWL029
cauguaaacaaa

SEQ ID NO: 499907 - RNA, 21 nt, Chlamydophila pneumoniae CWL029
cauggcuauuuuuaaaaugau

SEQ ID NO: 499908 - RNA, 23 nt, Chlamydophila pneumoniae CWL029
caugcuaauccagcaacaaccaa

SEQ ID NO: 499909 - RNA, 12 nt, Chlamydophila pneumoniae CWL029
caugcucaagaa

SEQ ID NO: 499910 - RNA, 17 nt, Chlamydophila pneumoniae CWL029
caugcucaagaagauga

SEQ ID NO: 499911 - RNA, 20 nt, Chlamydophila pneumoniae CWL029
caugccaaauaucucuggca

SEQ ID NO: 499912 - RNA, 19 nt, Chlamydophila pneumoniae CWL029
caugccgcauuucuucaau

SEQ ID NO: 499913 - RNA, 17 nt, Chlamydophila pneumoniae CWL029
cauggcccgauacaaau

SEQ ID NO: 499914 - RNA, 14 nt, Chlamydophila pneumoniae CWL029
cauggcgaggggcc

SEQ ID NO: 499915 - RNA, 16 nt, Chlamydophila pneumoniae CWL029
caugcauagaauaaag

SEQ ID NO: 499916 - RNA, 17 nt, Chlamydophila pneumoniae CWL029
caugcauagaauaaaga

SEQ ID NO: 499917 - RNA, 13 nt, Chlamydophila pneumoniae CWL029
caugcauagcuga

SEQ ID NO: 499918 - RNA, 14 nt, Chlamydophila pneumoniae CWL029
caugaguuuuucag

SEQ ID NO: 499919 - RNA, 15 nt, Chlamydophila pneumoniae CWL029
caugaucuuuaggaa

SEQ ID NO: 499920 - RNA, 23 nt, Chlamydophila pneumoniae CWL029
caugagagucgaaacacucauga

SEQ ID NO: 499921 - RNA, 23 nt, Chlamydophila pneumoniae CWL029
caugaggcugcuacgugaucaaa

SEQ ID NO: 499922 - RNA, 17 nt, Chlamydophila pneumoniae CWL029
caugaggagaccuuuau

SEQ ID NO: 499923 - RNA, 17 nt, Chlamydophila pneumoniae CWL029
caugagcucaggcaaca

SEQ ID NO: 499924 - RNA, 15 nt, Chlamydophila pneumoniae CWL029
caugacauaggcaaa

SEQ ID NO: 499925 - RNA, 19 nt, Chlamydophila pneumoniae CWL029
caugacauaggcaaauccu

SEQ ID NO: 499926 - RNA, 20 nt, Chlamydophila pneumoniae CWL029
caugaccuuuagcugcugaa

SEQ ID NO: 499927 - RNA, 19 nt, Chlamydophila pneumoniae CWL029
caugacgcuuuuccaaagc

SEQ ID NO: 499928 - RNA, 15 nt, Chlamydophila pneumoniae CWL029
caugacuauuuucau

SEQ ID NO: 499929 - RNA, 15 nt, Chlamydophila pneumoniae CWL029
caugaaucugguucc

SEQ ID NO: 499930 - RNA, 17 nt, Chlamydophila pneumoniae CWL029
caugaagcagaaacuuu

SEQ ID NO: 499931 - RNA, 18 nt, Chlamydophila pneumoniae CWL029
caugaagcagaaacuuua

SEQ ID NO: 499932 - RNA, 14 nt, Chlamydophila pneumoniae CWL029
caucucucuccaaa

SEQ ID NO: 499933 - RNA, 23 nt, Chlamydophila pneumoniae CWL029
caucucuggaauacauuccuagc

SEQ ID NO: 499934 - RNA, 12 nt, Chlamydophila pneumoniae CWL029
caucucuggaau

SEQ ID NO: 499935 - RNA, 21 nt, Chlamydophila pneumoniae CWL029
caugaacgugcaucucuucag

SEQ ID NO: 499936 - RNA, 16 nt, Chlamydophila pneumoniae CWL029
caugaaauuucauucu

SEQ ID NO: 499937 - RNA, 19 nt, Chlamydophila pneumoniae CWL029
caguucgugagagucagga

SEQ ID NO: 499938 - RNA, 23 nt, Chlamydophila pneumoniae CWL029
caguuugagaaagaccaccuucc

SEQ ID NO: 499939 - RNA, 19 nt, Chlamydophila pneumoniae CWL029
cauaagaucaauauagaga

SEQ ID NO: 499940 - RNA, 17 nt, Chlamydophila pneumoniae CWL029
cauaagaacucuauuug

SEQ ID NO: 499941 - RNA, 14 nt, Chlamydophila pneumoniae CWL029
cauaagagaacuuu

SEQ ID NO: 499942 - RNA, 15 nt, Chlamydophila pneumoniae CWL029
cauaacuugaagaag

SEQ ID NO: 499943 - RNA, 22 nt, Chlamydophila pneumoniae CWL029
cauaacuugaagaaguacaagu

SEQ ID NO: 499944 - RNA, 11 nt, Chlamydophila pneumoniae CWL029
cauaacugugc

SEQ ID NO: 499945 - RNA, 15 nt, Chlamydophila pneumoniae CWL029
cauaaaggcucuuuu

SEQ ID NO: 499946 - RNA, 20 nt, Chlamydophila pneumoniae CWL029
cauaaaguauauugacaaca

SEQ ID NO: 499947 - RNA, 22 nt, Chlamydophila pneumoniae CWL029
cauaaaguucggcgccuucaaa

SEQ ID NO: 499948 - RNA, 20 nt, Chlamydophila pneumoniae CWL029
cauaagaucaauauagagaa

SEQ ID NO: 499949 - RNA, 16 nt, Chlamydophila pneumoniae CWL029
cauaagauuuccccaa

SEQ ID NO: 499950 - RNA, 14 nt, Chlamydophila pneumoniae CWL029
cauaagcuuuucuu

SEQ ID NO: 499951 - RNA, 13 nt, Chlamydophila pneumoniae CWL029
cauaauagucucu

SEQ ID NO: 499952 - RNA, 15 nt, Chlamydophila pneumoniae CWL029
cauaaguauagagag

SEQ ID NO: 499953 - RNA, 15 nt, Chlamydophila pneumoniae CWL029
cauaaguuagccugg

SEQ ID NO: 499954 - RNA, 13 nt, Chlamydophila pneumoniae CWL029
cauaauccaagau

SEQ ID NO: 499955 - RNA, 21 nt, Chlamydophila pneumoniae CWL029
cauaaucacacucguagccuu

SEQ ID NO: 499956 - RNA, 15 nt, Chlamydophila pneumoniae CWL029
caguuccuauuuuuu

SEQ ID NO: 499957 - RNA, 15 nt, Chlamydophila pneumoniae CWL029
caguucgacaaccaa

SEQ ID NO: 499958 - RNA, 21 nt, Chlamydophila pneumoniae CWL029
caguucauguugcucauccuu

SEQ ID NO: 499959 - RNA, 18 nt, Chlamydophila pneumoniae CWL029
caguggcuuauagagaga

SEQ ID NO: 499960 - RNA, 21 nt, Chlamydophila pneumoniae CWL029
cagugauuccugucauuccua

SEQ ID NO: 499961 - RNA, 14 nt, Chlamydophila pneumoniae CWL029
caguaauuccaaaa

SEQ ID NO: 499962 - RNA, 20 nt, Chlamydophila pneumoniae CWL029
cagguuguccuauagagaau

SEQ ID NO: 499963 - RNA, 18 nt, Chlamydophila pneumoniae CWL029
cagguucugaaauugucu

SEQ ID NO: 499964 - RNA, 21 nt, Chlamydophila pneumoniae CWL029
cagguucugaaauugucuuca

SEQ ID NO: 499965 - RNA, 19 nt, Chlamydophila pneumoniae CWL029
caguagguaagaagcuguc

SEQ ID NO: 499966 - RNA, 15 nt, Chlamydophila pneumoniae CWL029
caguaucguaacuuc

SEQ ID NO: 499967 - RNA, 21 nt, Chlamydophila pneumoniae CWL029
caguaucguaacuuccuuuuu

SEQ ID NO: 499968 - RNA, 18 nt, Chlamydophila pneumoniae CWL029
caguauucccuccgcagu

SEQ ID NO: 499969 - RNA, 19 nt, Chlamydophila pneumoniae CWL029
caguauggcguuuuuuuug

SEQ ID NO: 499970 - RNA, 23 nt, Chlamydophila pneumoniae CWL029
caguauuauaaauagaaaucuua

SEQ ID NO: 499971 - RNA, 20 nt, Chlamydophila pneumoniae CWL029
caggucguaaacggacgcua

SEQ ID NO: 499972 - RNA, 15 nt, Chlamydophila pneumoniae CWL029
caggucugcugagga

SEQ ID NO: 499973 - RNA, 18 nt, Chlamydophila pneumoniae CWL029
cagguccuucuggaguga

SEQ ID NO: 499974 - RNA, 22 nt, Chlamydophila pneumoniae CWL029
cagguagucccuuucuauuuca

SEQ ID NO: 499975 - RNA, 14 nt, Chlamydophila pneumoniae CWL029
cagguaguaggaca

SEQ ID NO: 499976 - RNA, 13 nt, Chlamydophila pneumoniae CWL029
cagguagucccuu

SEQ ID NO: 499977 - RNA, 16 nt, Chlamydophila pneumoniae CWL029
cagguagucccuuucu

SEQ ID NO: 499978 - RNA, 24 nt, Chlamydophila pneumoniae CWL029
cagggauauuuugagcuacaagaa

SEQ ID NO: 499979 - RNA, 12 nt, Chlamydophila pneumoniae CWL029
cagggauauuuu

SEQ ID NO: 499980 - RNA, 17 nt, Chlamydophila pneumoniae CWL029
cagguaagggaugcucu

SEQ ID NO: 499981 - RNA, 14 nt, Chlamydophila pneumoniae CWL029
caggcugaaccaaa

SEQ ID NO: 499982 - RNA, 23 nt, Chlamydophila pneumoniae CWL029
caggcugaaccaaaucuaucugc

SEQ ID NO: 499983 - RNA, 19 nt, Chlamydophila pneumoniae CWL029
caggcugcgcuacacccag

SEQ ID NO: 499984 - RNA, 14 nt, Chlamydophila pneumoniae CWL029
cagggaaagaacag

SEQ ID NO: 499985 - RNA, 17 nt, Chlamydophila pneumoniae CWL029
cagggaaagaacagcag

SEQ ID NO: 499986 - RNA, 23 nt, Chlamydophila pneumoniae CWL029
cagggaaagaacagcagaaacgg

SEQ ID NO: 499987 - RNA, 13 nt, Chlamydophila pneumoniae CWL029
caggcuucaccau

SEQ ID NO: 499988 - RNA, 18 nt, Chlamydophila pneumoniae CWL029
caggccuggugcuuaaaa

SEQ ID NO: 499989 - RNA, 14 nt, Chlamydophila pneumoniae CWL029
caggccugaugucu

SEQ ID NO: 499990 - RNA, 13 nt, Chlamydophila pneumoniae CWL029
caggauuuuccau

SEQ ID NO: 499991 - RNA, 15 nt, Chlamydophila pneumoniae CWL029
caggauuuuccauua

SEQ ID NO: 499992 - RNA, 17 nt, Chlamydophila pneumoniae CWL029
caggauauugcggaaau

SEQ ID NO: 499993 - RNA, 13 nt, Chlamydophila pneumoniae CWL029
caggcauucuuca

SEQ ID NO: 499994 - RNA, 15 nt, Chlamydophila pneumoniae CWL029
caggcaucacuaauc

SEQ ID NO: 499995 - RNA, 17 nt, Chlamydophila pneumoniae CWL029
cagcuucuauugcugua

SEQ ID NO: 499996 - RNA, 15 nt, Chlamydophila pneumoniae CWL029
cagcuucuacagcau

SEQ ID NO: 499997 - RNA, 15 nt, Chlamydophila pneumoniae CWL029
cagcuucgcaaucuu

SEQ ID NO: 499998 - RNA, 16 nt, Chlamydophila pneumoniae CWL029
cagcuucgcaaucuuu

SEQ ID NO: 499999 - RNA, 18 nt, Chlamydophila pneumoniae CWL029
cagcuucgcaaucuuuga

SEQ ID NO: 500000 - RNA, 13 nt, Chlamydophila pneumoniae CWL029
cagcuucccaagc

SEQ ID NO: 500001 - RNA, 23 nt, Chlamydophila pneumoniae CWL029
cagcuucccaagcagaagacccu

SEQ ID NO: 500002 - RNA, 18 nt, Chlamydophila pneumoniae CWL029
cagcuggguaaguccaca

SEQ ID NO: 500003 - RNA, 17 nt, Chlamydophila pneumoniae CWL029
cagcuuuaucaggaucu

SEQ ID NO: 500004 - RNA, 23 nt, Chlamydophila pneumoniae CWL029
cagcuuugcuuaaaaagucugaa

SEQ ID NO: 500005 - RNA, 17 nt, Chlamydophila pneumoniae CWL029
cagcuuuuucaauagca

SEQ ID NO: 500006 - RNA, 18 nt, Chlamydophila pneumoniae CWL029
caggaaacuagauuucua

SEQ ID NO: 500007 - RNA, 17 nt, Chlamydophila pneumoniae CWL029
caggaaagaauaggggu

SEQ ID NO: 500008 - RNA, 17 nt, Chlamydophila pneumoniae CWL029
cagcugauauccuugcu

SEQ ID NO: 500009 - RNA, 19 nt, Chlamydophila pneumoniae CWL029
cagcuaauuuaaaugccuu

SEQ ID NO: 500010 - RNA, 21 nt, Chlamydophila pneumoniae CWL029
cagcuaauuuaaaugccuuaa

SEQ ID NO: 500011 - RNA, 14 nt, Chlamydophila pneumoniae CWL029
cagcucgagaucuu

SEQ ID NO: 500012 - RNA, 15 nt, Chlamydophila pneumoniae CWL029
cagcuaacgaaguga

SEQ ID NO: 500013 - RNA, 19 nt, Chlamydophila pneumoniae CWL029
cagcuaaucaauccaagaa

SEQ ID NO: 500014 - RNA, 20 nt, Chlamydophila pneumoniae CWL029
cagcuaaucaauccaagaau

SEQ ID NO: 500015 - RNA, 19 nt, Chlamydophila pneumoniae CWL029
cagcuaaucauagccauca

SEQ ID NO: 500016 - RNA, 22 nt, Chlamydophila pneumoniae CWL029
cagcuaauuuaaaugccuuaaa

SEQ ID NO: 500017 - RNA, 18 nt, Chlamydophila pneumoniae CWL029
cagcguagguuugcugcu

SEQ ID NO: 500018 - RNA, 14 nt, Chlamydophila pneumoniae CWL029
cacugaugaaaaag

SEQ ID NO: 500019 - RNA, 18 nt, Chlamydophila pneumoniae CWL029
cacugaugaaaaagcuga

SEQ ID NO: 500020 - RNA, 20 nt, Chlamydophila pneumoniae CWL029
ccccguucguggagcaucau

SEQ ID NO: 500021 - RNA, 20 nt, Chlamydophila pneumoniae CWL029
ccccggguuguccagagaca

SEQ ID NO: 500022 - RNA, 17 nt, Chlamydophila pneumoniae CWL029
cccccugcugccaugca

SEQ ID NO: 500023 - RNA, 15 nt, Chlamydophila pneumoniae CWL029
ccccaucuaauccug

SEQ ID NO: 500024 - RNA, 14 nt, Chlamydophila pneumoniae CWL029
cccauaaaaauuaa

SEQ ID NO: 500025 - RNA, 23 nt, Chlamydophila pneumoniae CWL029
cccauacauagggaaaguucagu

SEQ ID NO: 500026 - RNA, 13 nt, Chlamydophila pneumoniae CWL029
cccauagcaaugc

SEQ ID NO: 500027 - RNA, 17 nt, Chlamydophila pneumoniae CWL029
cccaguuguauccagcu

SEQ ID NO: 500028 - RNA, 17 nt, Chlamydophila pneumoniae CWL029
cccagauuuuuuugguu

SEQ ID NO: 500029 - RNA, 12 nt, Chlamydophila pneumoniae CWL029
cccacuucuacc

SEQ ID NO: 500030 - RNA, 14 nt, Chlamydophila pneumoniae CWL029
cccaauuucuuuuu

SEQ ID NO: 500031 - RNA, 16 nt, Chlamydophila pneumoniae CWL029
cccaccauucuugaag

SEQ ID NO: 500032 - RNA, 16 nt, Chlamydophila pneumoniae CWL029
cccaauauccagaaau

SEQ ID NO: 500033 - RNA, 18 nt, Chlamydophila pneumoniae CWL029
cccaaucaguucaucuag

SEQ ID NO: 500034 - RNA, 22 nt, Chlamydophila pneumoniae CWL029
cccaaguuguagugaaugagcu

SEQ ID NO: 500035 - RNA, 20 nt, Chlamydophila pneumoniae CWL029
cccaagggccgaaccaaaau

SEQ ID NO: 500036 - RNA, 16 nt, Chlamydophila pneumoniae CWL029
cccaagcaagaagugu

SEQ ID NO: 500037 - RNA, 14 nt, Chlamydophila pneumoniae CWL029
ccauucuuaucugc

SEQ ID NO: 500038 - RNA, 15 nt, Chlamydophila pneumoniae CWL029
ccauuccuuaggaug

SEQ ID NO: 500039 - RNA, 20 nt, Chlamydophila pneumoniae CWL029
ccauucagauggucagucuc

SEQ ID NO: 500040 - RNA, 14 nt, Chlamydophila pneumoniae CWL029
ccauuccauaucca

SEQ ID NO: 500041 - RNA, 14 nt, Chlamydophila pneumoniae CWL029
ccauucacaaaucu

SEQ ID NO: 500042 - RNA, 18 nt, Chlamydophila pneumoniae CWL029
ccauucacaaaucuuccc

SEQ ID NO: 500043 - RNA, 14 nt, Chlamydophila pneumoniae CWL029
ccauuauacuuuuu

SEQ ID NO: 500044 - RNA, 12 nt, Chlamydophila pneumoniae CWL029
ccauuaaggaau

SEQ ID NO: 500045 - RNA, 13 nt, Chlamydophila pneumoniae CWL029
ccauuaaggaauc

SEQ ID NO: 500046 - RNA, 14 nt, Chlamydophila pneumoniae CWL029
ccaugcuuaucuau

SEQ ID NO: 500047 - RNA, 19 nt, Chlamydophila pneumoniae CWL029
ccaugcuaauaauuccuga

SEQ ID NO: 500048 - RNA, 14 nt, Chlamydophila pneumoniae CWL029
ccauggcuggaaag

SEQ ID NO: 500049 - RNA, 17 nt, Chlamydophila pneumoniae CWL029
ccauggcuggaaagcca

SEQ ID NO: 500050 - RNA, 17 nt, Chlamydophila pneumoniae CWL029
ccaugguuauagauacg

SEQ ID NO: 500051 - RNA, 18 nt, Chlamydophila pneumoniae CWL029
ccauguacaugcaggcga

SEQ ID NO: 500052 - RNA, 15 nt, Chlamydophila pneumoniae CWL029
ccaugucuaaagauu

SEQ ID NO: 500053 - RNA, 17 nt, Chlamydophila pneumoniae CWL029
ccaugucuaaaggagug

SEQ ID NO: 500054 - RNA, 15 nt, Chlamydophila pneumoniae CWL029
ccaugagaugggcua

SEQ ID NO: 500055 - RNA, 17 nt, Chlamydophila pneumoniae CWL029
ccaugaguuuuucagau

SEQ ID NO: 500056 - RNA, 15 nt, Chlamydophila pneumoniae CWL029
ccaucuaauccuguu

SEQ ID NO: 500057 - RNA, 22 nt, Chlamydophila pneumoniae CWL029
ccaucggaauuugccugaaauc

SEQ ID NO: 500058 - RNA, 22 nt, Chlamydophila pneumoniae CWL029
ccauccugucuauuucuuaauu

SEQ ID NO: 500059 - RNA, 18 nt, Chlamydophila pneumoniae CWL029
ccauccacgaccugcaaa

SEQ ID NO: 500060 - RNA, 18 nt, Chlamydophila pneumoniae CWL029
ccauacugauauacaguu

SEQ ID NO: 500061 - RNA, 16 nt, Chlamydophila pneumoniae CWL029
ccauagaguaucuaaa

SEQ ID NO: 500062 - RNA, 12 nt, Chlamydophila pneumoniae CWL029
ccauagcaaugc

SEQ ID NO: 500063 - RNA, 20 nt, Chlamydophila pneumoniae CWL029
ccauaaugagacagacaguc

SEQ ID NO: 500064 - RNA, 17 nt, Chlamydophila pneumoniae CWL029
ccauaauuagaacagca

SEQ ID NO: 500065 - RNA, 22 nt, Chlamydophila pneumoniae CWL029
ccauacgguaaggaggaaucuu

SEQ ID NO: 500066 - RNA, 17 nt, Chlamydophila pneumoniae CWL029
ccauauuugaauaaagg

SEQ ID NO: 500067 - RNA, 18 nt, Chlamydophila pneumoniae CWL029
ccauauuugaauaaagga

SEQ ID NO: 500068 - RNA, 16 nt, Chlamydophila pneumoniae CWL029
ccauaaguucacgauu

SEQ ID NO: 500069 - RNA, 13 nt, Chlamydophila pneumoniae CWL029
ccauaauaaaggu

SEQ ID NO: 500070 - RNA, 20 nt, Chlamydophila pneumoniae CWL029
ccauaaaaauguaauuuuuu

SEQ ID NO: 500071 - RNA, 17 nt, Chlamydophila pneumoniae CWL029
ccaguuucuugauauuu

SEQ ID NO: 500072 - RNA, 15 nt, Chlamydophila pneumoniae CWL029
ccagggaucuucauc

SEQ ID NO: 500073 - RNA, 23 nt, Chlamydophila pneumoniae CWL029
ccagggaucuucaucccuacccu

SEQ ID NO: 500074 - RNA, 20 nt, Chlamydophila pneumoniae CWL029
ccaggguguuugcauaguau

SEQ ID NO: 500075 - RNA, 18 nt, Chlamydophila pneumoniae CWL029
ccagcugagcuaucuuca

SEQ ID NO: 500076 - RNA, 14 nt, Chlamydophila pneumoniae CWL029
ccagcuucuuucua

SEQ ID NO: 500077 - RNA, 22 nt, Chlamydophila pneumoniae CWL029
ccagcuucuuucuaggccggga

SEQ ID NO: 500078 - RNA, 15 nt, Chlamydophila pneumoniae CWL029
ccaggagcuccuccu

SEQ ID NO: 500079 - RNA, 18 nt, Chlamydophila pneumoniae CWL029
ccaggagagcuaacagca

SEQ ID NO: 500080 - RNA, 19 nt, Chlamydophila pneumoniae CWL029
ccaggagagcuaacagcac

SEQ ID NO: 500081 - RNA, 22 nt, Chlamydophila pneumoniae CWL029
ccaggagagcuaacagcacgua

SEQ ID NO: 500082 - RNA, 17 nt, Chlamydophila pneumoniae CWL029
ccaggaaacguucuuuc

SEQ ID NO: 500083 - RNA, 22 nt, Chlamydophila pneumoniae CWL029
ccaggaaacguucuuucaauaa

SEQ ID NO: 500084 - RNA, 13 nt, Chlamydophila pneumoniae CWL029
ccagcauuuuugg

SEQ ID NO: 500085 - RNA, 15 nt, Chlamydophila pneumoniae CWL029
ccagcaucuucucga

SEQ ID NO: 500086 - RNA, 16 nt, Chlamydophila pneumoniae CWL029
ccagaugauuuuuuga

SEQ ID NO: 500087 - RNA, 19 nt, Chlamydophila pneumoniae CWL029
ccagacuuuccucucuuua

SEQ ID NO: 500088 - RNA, 18 nt, Chlamydophila pneumoniae CWL029
ccagagacaaagccacag

SEQ ID NO: 500089 - RNA, 23 nt, Chlamydophila pneumoniae CWL029
ccagagagcuuuuagguagagaa

SEQ ID NO: 500090 - RNA, 16 nt, Chlamydophila pneumoniae CWL029
ccacuuuuuucccucc

SEQ ID NO: 500091 - RNA, 16 nt, Chlamydophila pneumoniae CWL029
ccagaagcaugaauga

SEQ ID NO: 500092 - RNA, 21 nt, Chlamydophila pneumoniae CWL029
ccagaaucuccauuuagaaug

SEQ ID NO: 500093 - RNA, 22 nt, Chlamydophila pneumoniae CWL029
ccagaagcaacuaaacucucca

SEQ ID NO: 500094 - RNA, 23 nt, Chlamydophila pneumoniae CWL029
ccagaaagauucugcccaaagcu

SEQ ID NO: 500095 - RNA, 14 nt, Chlamydophila pneumoniae CWL029
ccacgagauucugc

SEQ ID NO: 500096 - RNA, 23 nt, Chlamydophila pneumoniae CWL029
ccacgaguucgcggaucuucuuc

SEQ ID NO: 500097 - RNA, 18 nt, Chlamydophila pneumoniae CWL029
ccacccuuggcagagccg

SEQ ID NO: 500098 - RNA, 16 nt, Chlamydophila pneumoniae CWL029
ccacggauuuucucua

SEQ ID NO: 500099 - RNA, 15 nt, Chlamydophila pneumoniae CWL029
ccacggauuuucucu

SEQ ID NO: 500100 - RNA, 21 nt, Chlamydophila pneumoniae CWL029
ccacgggucaggagguggugg

SEQ ID NO: 500101 - RNA, 21 nt, Chlamydophila pneumoniae CWL029
ccaccagggguuucuaaauac

SEQ ID NO: 500102 - RNA, 19 nt, Chlamydophila pneumoniae CWL029
ccaccaggagcuccuccuu

SEQ ID NO: 500103 - RNA, 20 nt, Chlamydophila pneumoniae CWL029
ccacauugcgggcucaaaga

SEQ ID NO: 500104 - RNA, 19 nt, Chlamydophila pneumoniae CWL029
ccaccaaagugacuuccuc

SEQ ID NO: 500105 - RNA, 16 nt, Chlamydophila pneumoniae CWL029
ccaccaacaaugcgau

SEQ ID NO: 500106 - RNA, 15 nt, Chlamydophila pneumoniae CWL029
ccaccaacaguccug

SEQ ID NO: 500107 - RNA, 22 nt, Chlamydophila pneumoniae CWL029
ccacaucaaagcaauuucuccu

SEQ ID NO: 500108 - RNA, 23 nt, Chlamydophila pneumoniae CWL029
ccacaucuugagcuucaaaaagc

SEQ ID NO: 500109 - RNA, 23 nt, Chlamydophila pneumoniae CWL029
ccacagccaaguucguuggccca

SEQ ID NO: 500110 - RNA, 21 nt, Chlamydophila pneumoniae CWL029
ccacagagaccuucucuucag

SEQ ID NO: 500111 - RNA, 15 nt, Chlamydophila pneumoniae CWL029
ccacacaacucguuu

SEQ ID NO: 500112 - RNA, 17 nt, Chlamydophila pneumoniae CWL029
ccacaaaccucuaaaaa

SEQ ID NO: 500113 - RNA, 17 nt, Chlamydophila pneumoniae CWL029
ccaauuguaucuguauc

SEQ ID NO: 500114 - RNA, 23 nt, Chlamydophila pneumoniae CWL029
ccacaacuaaacgagcuguccag

SEQ ID NO: 500115 - RNA, 23 nt, Chlamydophila pneumoniae CWL029
ccacaaguuauccuuaucuugcu

SEQ ID NO: 500116 - RNA, 14 nt, Chlamydophila pneumoniae CWL029
ccacaagcuuuucg

SEQ ID NO: 500117 - RNA, 13 nt, Chlamydophila pneumoniae CWL029
ccacaauuccuaa

SEQ ID NO: 500118 - RNA, 14 nt, Chlamydophila pneumoniae CWL029
ccacaauuccuaaa

SEQ ID NO: 500119 - RNA, 21 nt, Chlamydophila pneumoniae CWL029
ccaaugcaugaaucucuucug

SEQ ID NO: 500120 - RNA, 17 nt, Chlamydophila pneumoniae CWL029
ccaaugcuauuggaaca

SEQ ID NO: 500121 - RNA, 22 nt, Chlamydophila pneumoniae CWL029
ccaaugggaauuugauuuuuca

SEQ ID NO: 500122 - RNA, 20 nt, Chlamydophila pneumoniae CWL029
ccaauauccagaaauacguc

SEQ ID NO: 500123 - RNA, 15 nt, Chlamydophila pneumoniae CWL029
ccaauaaauccaaaa

SEQ ID NO: 500124 - RNA, 22 nt, Chlamydophila pneumoniae CWL029
ccaauaaccgaaacuucucaga

SEQ ID NO: 500125 - RNA, 20 nt, Chlamydophila pneumoniae CWL029
ccaauaaccgaaacuucuca

SEQ ID NO: 500126 - RNA, 18 nt, Chlamydophila pneumoniae CWL029
ccaauacagcauaaaaau

SEQ ID NO: 500127 - RNA, 17 nt, Chlamydophila pneumoniae CWL029
ccaaugacgggagcucu

SEQ ID NO: 500128 - RNA, 16 nt, Chlamydophila pneumoniae CWL029
ccaaugagcucuauuu

SEQ ID NO: 500129 - RNA, 18 nt, Chlamydophila pneumoniae CWL029
ccaaugagcucuauuucu

SEQ ID NO: 500130 - RNA, 14 nt, Chlamydophila pneumoniae CWL029
ccaaucgauaacgu

SEQ ID NO: 500131 - RNA, 22 nt, Chlamydophila pneumoniae CWL029
ccaauccauucugagaaagaag

SEQ ID NO: 500132 - RNA, 18 nt, Chlamydophila pneumoniae CWL029
ccaaguuguagugaauga

SEQ ID NO: 500133 - RNA, 22 nt, Chlamydophila pneumoniae CWL029
ccaaguguugccagcccauguc

SEQ ID NO: 500134 - RNA, 22 nt, Chlamydophila pneumoniae CWL029
ccaagggagggacgacaaggag

SEQ ID NO: 500135 - RNA, 16 nt, Chlamydophila pneumoniae CWL029
ccaagaaauauacugc

SEQ ID NO: 500136 - RNA, 13 nt, Chlamydophila pneumoniae CWL029
ccaagacgcggaa

SEQ ID NO: 500137 - RNA, 21 nt, Chlamydophila pneumoniae CWL029
ccaagacgcggaacucucuuc

SEQ ID NO: 500138 - RNA, 16 nt, Chlamydophila pneumoniae CWL029
ccaagacaauggaaau

SEQ ID NO: 500139 - RNA, 22 nt, Chlamydophila pneumoniae CWL029
ccaagacaauggaaauagagaa

SEQ ID NO: 500140 - RNA, 17 nt, Chlamydophila pneumoniae CWL029
ccaacggcauaggauug

SEQ ID NO: 500141 - RNA, 20 nt, Chlamydophila pneumoniae CWL029
ccaacuuccuauaaaaaccu

SEQ ID NO: 500142 - RNA, 22 nt, Chlamydophila pneumoniae CWL029
ccaacuuuugaagauccugagu

SEQ ID NO: 500143 - RNA, 14 nt, Chlamydophila pneumoniae CWL029
ccaacuaaaacagc

SEQ ID NO: 500144 - RNA, 21 nt, Chlamydophila pneumoniae CWL029
ccaacuaaaacagccuagcaa

SEQ ID NO: 500145 - RNA, 14 nt, Chlamydophila pneumoniae CWL029
ccaaauguucucuc

SEQ ID NO: 500146 - RNA, 13 nt, Chlamydophila pneumoniae CWL029
ccaacccuauuua

SEQ ID NO: 500147 - RNA, 16 nt, Chlamydophila pneumoniae CWL029
ccaaaccaugaggcug

SEQ ID NO: 500148 - RNA, 22 nt, Chlamydophila pneumoniae CWL029
ccaaacccugggcucacucuaa

SEQ ID NO: 500149 - RNA, 11 nt, Chlamydophila pneumoniae CWL029
ccaaacaugga

SEQ ID NO: 500150 - RNA, 21 nt, Chlamydophila pneumoniae CWL029
ccaaacauggacaauauagag

SEQ ID NO: 500151 - RNA, 22 nt, Chlamydophila pneumoniae CWL029
ccaaaauuaccguuuccuccuc

SEQ ID NO: 500152 - RNA, 15 nt, Chlamydophila pneumoniae CWL029
ccaaaauaaaaggag

SEQ ID NO: 500153 - RNA, 16 nt, Chlamydophila pneumoniae CWL029
ccaaaauaaaaggagc

SEQ ID NO: 500154 - RNA, 22 nt, Chlamydophila pneumoniae CWL029
ccaaaaaaugcccguccccucu

SEQ ID NO: 500155 - RNA, 22 nt, Chlamydophila pneumoniae CWL029
cauuucuggagaaugccccuuc

SEQ ID NO: 500156 - RNA, 13 nt, Chlamydophila pneumoniae CWL029
cauuucguuuuuu

SEQ ID NO: 500157 - RNA, 23 nt, Chlamydophila pneumoniae CWL029
ccaaaagaauuccuaaaacgagc

SEQ ID NO: 500158 - RNA, 13 nt, Chlamydophila pneumoniae CWL029
ccaaaagaccaaa

SEQ ID NO: 500159 - RNA, 15 nt, Chlamydophila pneumoniae CWL029
ccaaaaauucccaua

SEQ ID NO: 500160 - RNA, 15 nt, Chlamydophila pneumoniae CWL029
ccaaagaacagcacu

SEQ ID NO: 500161 - RNA, 17 nt, Chlamydophila pneumoniae CWL029
ccaaagcagauccugcu

SEQ ID NO: 500162 - RNA, 18 nt, Chlamydophila pneumoniae CWL029
ccaaagcagauccugcuu

SEQ ID NO: 500163 - RNA, 19 nt, Chlamydophila pneumoniae CWL029
ccaaagcaguguauaacgu

SEQ ID NO: 500164 - RNA, 16 nt, Chlamydophila pneumoniae CWL029
ccaaagcauauacugu

SEQ ID NO: 500165 - RNA, 14 nt, Chlamydophila pneumoniae CWL029
ccaaagcuucuuuc

SEQ ID NO: 500166 - RNA, 20 nt, Chlamydophila pneumoniae CWL029
ccaaagcuauuucucuauca

SEQ ID NO: 500167 - RNA, 15 nt, Chlamydophila pneumoniae CWL029
ccaaauccuccgccu

SEQ ID NO: 500168 - RNA, 16 nt, Chlamydophila pneumoniae CWL029
ccaaauacgaacugua

SEQ ID NO: 500169 - RNA, 17 nt, Chlamydophila pneumoniae CWL029
ccaaaguuuguagcauu

SEQ ID NO: 500170 - RNA, 19 nt, Chlamydophila pneumoniae CWL029
ccaaagucacucaaacccu

SEQ ID NO: 500171 - RNA, 20 nt, Chlamydophila pneumoniae CWL029
ccaaagucacucaaacccuc

SEQ ID NO: 500172 - RNA, 17 nt, Chlamydophila pneumoniae CWL029
ccaaagugacuuccucc

SEQ ID NO: 500173 - RNA, 20 nt, Chlamydophila pneumoniae CWL029
cgaaugucguuaaaaacuau

SEQ ID NO: 500174 - RNA, 16 nt, Chlamydophila pneumoniae CWL029
cgaaucuuuauuucug

SEQ ID NO: 500175 - RNA, 20 nt, Chlamydophila pneumoniae CWL029
cgaaugcugcacaguucaca

SEQ ID NO: 500176 - RNA, 12 nt, Chlamydophila pneumoniae CWL029
cgaaucucucca

SEQ ID NO: 500177 - RNA, 16 nt, Chlamydophila pneumoniae CWL029
cgaauccugaggaugc

SEQ ID NO: 500178 - RNA, 21 nt, Chlamydophila pneumoniae CWL029
cgaauaaguuuugauuuugca

SEQ ID NO: 500179 - RNA, 18 nt, Chlamydophila pneumoniae CWL029
cgaauagaaaagguauua

SEQ ID NO: 500180 - RNA, 14 nt, Chlamydophila pneumoniae CWL029
cgacaaaaaugccu

SEQ ID NO: 500181 - RNA, 20 nt, Chlamydophila pneumoniae CWL029
cgacagcagcauuuucuaaa

SEQ ID NO: 500182 - RNA, 21 nt, Chlamydophila pneumoniae CWL029
cgacacuauguguuuccuuuu

SEQ ID NO: 500183 - RNA, 15 nt, Chlamydophila pneumoniae CWL029
cgacacucaaaucuu

SEQ ID NO: 500184 - RNA, 20 nt, Chlamydophila pneumoniae CWL029
cgaaggggaagaggaaugcc

SEQ ID NO: 500185 - RNA, 23 nt, Chlamydophila pneumoniae CWL029
cgaagggaguuucccgacauuua

SEQ ID NO: 500186 - RNA, 19 nt, Chlamydophila pneumoniae CWL029
cgaaggggaagaggaaugc

SEQ ID NO: 500187 - RNA, 18 nt, Chlamydophila pneumoniae CWL029
cgaagcgccgcauuacag

SEQ ID NO: 500188 - RNA, 15 nt, Chlamydophila pneumoniae CWL029
cgaagacuuguucuu

SEQ ID NO: 500189 - RNA, 16 nt, Chlamydophila pneumoniae CWL029
cgaagaacagaggauc

SEQ ID NO: 500190 - RNA, 17 nt, Chlamydophila pneumoniae CWL029
cgaagauccuagagaau

SEQ ID NO: 500191 - RNA, 20 nt, Chlamydophila pneumoniae CWL029
cgaagcauucccgacucaau

SEQ ID NO: 500192 - RNA, 19 nt, Chlamydophila pneumoniae CWL029
cgaagauucaaagaagucg

SEQ ID NO: 500193 - RNA, 19 nt, Chlamydophila pneumoniae CWL029
cgaagauuuagggaagagu

SEQ ID NO: 500194 - RNA, 17 nt, Chlamydophila pneumoniae CWL029
cgaacuguacgaauuuc

SEQ ID NO: 500195 - RNA, 21 nt, Chlamydophila pneumoniae CWL029
cgaacuguacgaauuucacac

SEQ ID NO: 500196 - RNA, 21 nt, Chlamydophila pneumoniae CWL029
cgaacuauagcaauccauagu

SEQ ID NO: 500197 - RNA, 22 nt, Chlamydophila pneumoniae CWL029
cgacgacgucuucuuagaagag

SEQ ID NO: 500198 - RNA, 15 nt, Chlamydophila pneumoniae CWL029
cgacgagaaggaaga

SEQ ID NO: 500199 - RNA, 18 nt, Chlamydophila pneumoniae CWL029
cgaccucgaauuccuccc

SEQ ID NO: 500200 - RNA, 17 nt, Chlamydophila pneumoniae CWL029
cgaccuaggagaaauca

SEQ ID NO: 500201 - RNA, 22 nt, Chlamydophila pneumoniae CWL029
cgaccuaggagaaaucacacuu

SEQ ID NO: 500202 - RNA, 22 nt, Chlamydophila pneumoniae CWL029
cgacauacaucaaaaugcugcu

SEQ ID NO: 500203 - RNA, 15 nt, Chlamydophila pneumoniae CWL029
cgacaugagaaaucu

SEQ ID NO: 500204 - RNA, 21 nt, Chlamydophila pneumoniae CWL029
cgacaugccuaaauagcucag

SEQ ID NO: 500205 - RNA, 15 nt, Chlamydophila pneumoniae CWL029
cgaccaacuccucaa

SEQ ID NO: 500206 - RNA, 19 nt, Chlamydophila pneumoniae CWL029
cgaacacgucgaacaugac

SEQ ID NO: 500207 - RNA, 12 nt, Chlamydophila pneumoniae CWL029
cgaacaguuccu

SEQ ID NO: 500208 - RNA, 13 nt, Chlamydophila pneumoniae CWL029
cgaacaguuccua

SEQ ID NO: 500209 - RNA, 18 nt, Chlamydophila pneumoniae CWL029
cgaaacucuuugaggaua

SEQ ID NO: 500210 - RNA, 18 nt, Chlamydophila pneumoniae CWL029
cgaaagcuacagcuaacg

SEQ ID NO: 500211 - RNA, 23 nt, Chlamydophila pneumoniae CWL029
cgaaagaacuacuuaaauccuaa

SEQ ID NO: 500212 - RNA, 15 nt, Chlamydophila pneumoniae CWL029
cgaaauccuaaaaag

SEQ ID NO: 500213 - RNA, 14 nt, Chlamydophila pneumoniae CWL029
cgaaauccuaaaaa

SEQ ID NO: 500214 - RNA, 21 nt, Chlamydophila pneumoniae CWL029
cgaaacaacuuuuuucguuug

SEQ ID NO: 500215 - RNA, 15 nt, Chlamydophila pneumoniae CWL029
cgaaaaauaccucag

SEQ ID NO: 500216 - RNA, 18 nt, Chlamydophila pneumoniae CWL029
cgaaaaacgguaaauauc

SEQ ID NO: 500217 - RNA, 19 nt, Chlamydophila pneumoniae CWL029
ccuuuuucauugaugcuua

SEQ ID NO: 500218 - RNA, 18 nt, Chlamydophila pneumoniae CWL029
ccuuuucagauuuuuuaa

SEQ ID NO: 500219 - RNA, 19 nt, Chlamydophila pneumoniae CWL029
ccuuuucagauuuuuuaac

SEQ ID NO: 500220 - RNA, 20 nt, Chlamydophila pneumoniae CWL029
ccuuucacaaagaauucaga

SEQ ID NO: 500221 - RNA, 15 nt, Chlamydophila pneumoniae CWL029
ccuuuagcugcugaa

SEQ ID NO: 500222 - RNA, 22 nt, Chlamydophila pneumoniae CWL029
ccuuuauauaaagguuacaagc

SEQ ID NO: 500223 - RNA, 14 nt, Chlamydophila pneumoniae CWL029
ccuuucuuuugcuu

SEQ ID NO: 500224 - RNA, 23 nt, Chlamydophila pneumoniae CWL029
ccuuucucuuccgauuaacuuua

SEQ ID NO: 500225 - RNA, 18 nt, Chlamydophila pneumoniae CWL029
ccuuugagucuuuuucag

SEQ ID NO: 500226 - RNA, 21 nt, Chlamydophila pneumoniae CWL029
ccuuugcaaaccaaucuugag

SEQ ID NO: 500227 - RNA, 20 nt, Chlamydophila pneumoniae CWL029
ccuuuguuuuaucuuuaguu

SEQ ID NO: 500228 - RNA, 22 nt, Chlamydophila pneumoniae CWL029
ccuuuuaaaauuuugauaccuc

SEQ ID NO: 500229 - RNA, 22 nt, Chlamydophila pneumoniae CWL029
ccuuugguagaaagacaaaaaa

SEQ ID NO: 500230 - RNA, 13 nt, Chlamydophila pneumoniae CWL029
ccuuguuuuccug

SEQ ID NO: 500231 - RNA, 15 nt, Chlamydophila pneumoniae CWL029
ccuugugagaggguc

SEQ ID NO: 500232 - RNA, 16 nt, Chlamydophila pneumoniae CWL029
ccuugugucuuaaagc

SEQ ID NO: 500233 - RNA, 13 nt, Chlamydophila pneumoniae CWL029
ccuuggcagagcc

SEQ ID NO: 500234 - RNA, 23 nt, Chlamydophila pneumoniae CWL029
ccuugggauuccuuaaugguagc

SEQ ID NO: 500235 - RNA, 14 nt, Chlamydophila pneumoniae CWL029
ccuugguaucccaa

SEQ ID NO: 500236 - RNA, 15 nt, Chlamydophila pneumoniae CWL029
ccuugacuaaaucca

SEQ ID NO: 500237 - RNA, 21 nt, Chlamydophila pneumoniae CWL029
ccuugcagcgacaacacgccc

SEQ ID NO: 500238 - RNA, 13 nt, Chlamydophila pneumoniae CWL029
ccuugcauuagau

SEQ ID NO: 500239 - RNA, 22 nt, Chlamydophila pneumoniae CWL029
ccuugcuaauaccucaaagcca

SEQ ID NO: 500240 - RNA, 19 nt, Chlamydophila pneumoniae CWL029
ccuugaaauugcucuugcu

SEQ ID NO: 500241 - RNA, 13 nt, Chlamydophila pneumoniae CWL029
ccuucuucuucag

SEQ ID NO: 500242 - RNA, 21 nt, Chlamydophila pneumoniae CWL029
ccuucuugcaaagauaaccau

SEQ ID NO: 500243 - RNA, 15 nt, Chlamydophila pneumoniae CWL029
ccuucuuucaauagc

SEQ ID NO: 500244 - RNA, 21 nt, Chlamydophila pneumoniae CWL029
ccuucuuucaauagcuuccaa

SEQ ID NO: 500245 - RNA, 14 nt, Chlamydophila pneumoniae CWL029
ccuucuuuccauaa

SEQ ID NO: 500246 - RNA, 16 nt, Chlamydophila pneumoniae CWL029
ccuucucgucauucug

SEQ ID NO: 500247 - RNA, 16 nt, Chlamydophila pneumoniae CWL029
ccuucuguuuucacau

SEQ ID NO: 500248 - RNA, 11 nt, Chlamydophila pneumoniae CWL029
ccuucucccuc

SEQ ID NO: 500249 - RNA, 14 nt, Chlamydophila pneumoniae CWL029
ccuucuaauuucag

SEQ ID NO: 500250 - RNA, 15 nt, Chlamydophila pneumoniae CWL029
ccuucucauugcggc

SEQ ID NO: 500251 - RNA, 11 nt, Chlamydophila pneumoniae CWL029
ccuucggcuuc

SEQ ID NO: 500252 - RNA, 14 nt, Chlamydophila pneumoniae CWL029
ccuucgauuccagg

SEQ ID NO: 500253 - RNA, 21 nt, Chlamydophila pneumoniae CWL029
ccugugugguuggauccaucg

SEQ ID NO: 500254 - RNA, 19 nt, Chlamydophila pneumoniae CWL029
ccuuccaagugcucaguaa

SEQ ID NO: 500255 - RNA, 15 nt, Chlamydophila pneumoniae CWL029
cgcauuacaaauggc

SEQ ID NO: 500256 - RNA, 18 nt, Chlamydophila pneumoniae CWL029
cgcauggcggucuuuguu

SEQ ID NO: 500257 - RNA, 21 nt, Chlamydophila pneumoniae CWL029
cgcaugccucuuggugcuuug

SEQ ID NO: 500258 - RNA, 17 nt, Chlamydophila pneumoniae CWL029
cgccaaacgaauuucuu

SEQ ID NO: 500259 - RNA, 23 nt, Chlamydophila pneumoniae CWL029
cgccaaacgaauuucuuguucca

SEQ ID NO: 500260 - RNA, 15 nt, Chlamydophila pneumoniae CWL029
cgccaaaccaugagg

SEQ ID NO: 500261 - RNA, 20 nt, Chlamydophila pneumoniae CWL029
cgccaaucugagcacauuuu

SEQ ID NO: 500262 - RNA, 14 nt, Chlamydophila pneumoniae CWL029
cgcaucuagaagca

SEQ ID NO: 500263 - RNA, 20 nt, Chlamydophila pneumoniae CWL029
cgcaucaaaaaauacauagg

SEQ ID NO: 500264 - RNA, 16 nt, Chlamydophila pneumoniae CWL029
cgcaucauggucccua

SEQ ID NO: 500265 - RNA, 20 nt, Chlamydophila pneumoniae CWL029
cgcaguggacggggagagcc

SEQ ID NO: 500266 - RNA, 21 nt, Chlamydophila pneumoniae CWL029
cgcaguggacggggagagcca

SEQ ID NO: 500267 - RNA, 21 nt, Chlamydophila pneumoniae CWL029
cgcaagcacuuguuuuuucuu

SEQ ID NO: 500268 - RNA, 15 nt, Chlamydophila pneumoniae CWL029
cgauuuggaagauug

SEQ ID NO: 500269 - RNA, 18 nt, Chlamydophila pneumoniae CWL029
cgauuugaacaugaggau

SEQ ID NO: 500270 - RNA, 13 nt, Chlamydophila pneumoniae CWL029
cgauuucccagaa

SEQ ID NO: 500271 - RNA, 20 nt, Chlamydophila pneumoniae CWL029
cgauguuuaugaaaaucugc

SEQ ID NO: 500272 - RNA, 14 nt, Chlamydophila pneumoniae CWL029
cgauuccugaggcu

SEQ ID NO: 500273 - RNA, 15 nt, Chlamydophila pneumoniae CWL029
cgauuccugaggcua

SEQ ID NO: 500274 - RNA, 21 nt, Chlamydophila pneumoniae CWL029
cgauucgaaaaacgguaaaua

SEQ ID NO: 500275 - RNA, 22 nt, Chlamydophila pneumoniae CWL029
cgaucaaauuccuucucagaaa

SEQ ID NO: 500276 - RNA, 21 nt, Chlamydophila pneumoniae CWL029
cgauauuuagagagaaacauc

SEQ ID NO: 500277 - RNA, 20 nt, Chlamydophila pneumoniae CWL029
cgauauuuagagagaaacau

SEQ ID NO: 500278 - RNA, 17 nt, Chlamydophila pneumoniae CWL029
cgaugggaauaaaaaug

SEQ ID NO: 500279 - RNA, 20 nt, Chlamydophila pneumoniae CWL029
cgauaaucaaagguuuuuga

SEQ ID NO: 500280 - RNA, 22 nt, Chlamydophila pneumoniae CWL029
cgaguucgcggaucuucuucug

SEQ ID NO: 500281 - RNA, 19 nt, Chlamydophila pneumoniae CWL029
cgauagagauucuuucucg

SEQ ID NO: 500282 - RNA, 17 nt, Chlamydophila pneumoniae CWL029
cgauagcaaugauguuu

SEQ ID NO: 500283 - RNA, 19 nt, Chlamydophila pneumoniae CWL029
cgaguaccucaucucugga

SEQ ID NO: 500284 - RNA, 15 nt, Chlamydophila pneumoniae CWL029
cgaguaguccugacg

SEQ ID NO: 500285 - RNA, 15 nt, Chlamydophila pneumoniae CWL029
cgagucccuucuuuc

SEQ ID NO: 500286 - RNA, 19 nt, Chlamydophila pneumoniae CWL029
cgaggucuuuucuuuuuag

SEQ ID NO: 500287 - RNA, 14 nt, Chlamydophila pneumoniae CWL029
cgaggaaaaaggag

SEQ ID NO: 500288 - RNA, 20 nt, Chlamydophila pneumoniae CWL029
cgagcuuuuugcuuuucccu

SEQ ID NO: 500289 - RNA, 17 nt, Chlamydophila pneumoniae CWL029
cgagcucgcaaaagcug

SEQ ID NO: 500290 - RNA, 17 nt, Chlamydophila pneumoniae CWL029
cgagcugaucuucuaaa

SEQ ID NO: 500291 - RNA, 22 nt, Chlamydophila pneumoniae CWL029
cgagcaucucaagaguaggcaa

SEQ ID NO: 500292 - RNA, 16 nt, Chlamydophila pneumoniae CWL029
cgagaucuuugagauc

SEQ ID NO: 500293 - RNA, 19 nt, Chlamydophila pneumoniae CWL029
cgagaucauuagcaucauc

SEQ ID NO: 500294 - RNA, 20 nt, Chlamydophila pneumoniae CWL029
cgagaucauuagcaucaucu

SEQ ID NO: 500295 - RNA, 18 nt, Chlamydophila pneumoniae CWL029
cgagauccuccuggaaga

SEQ ID NO: 500296 - RNA, 22 nt, Chlamydophila pneumoniae CWL029
cgagaucauuagcaucaucucc

SEQ ID NO: 500297 - RNA, 17 nt, Chlamydophila pneumoniae CWL029
cgagacuauuuuggaaa

SEQ ID NO: 500298 - RNA, 22 nt, Chlamydophila pneumoniae CWL029
cgagaggaaaucccgagauaug

SEQ ID NO: 500299 - RNA, 19 nt, Chlamydophila pneumoniae CWL029
cgagaguugccaggaaacg

SEQ ID NO: 500300 - RNA, 13 nt, Chlamydophila pneumoniae CWL029
cgagaaccuccac

SEQ ID NO: 500301 - RNA, 21 nt, Chlamydophila pneumoniae CWL029
cgagaaccuccaccaggagcu

SEQ ID NO: 500302 - RNA, 22 nt, Chlamydophila pneumoniae CWL029
cgagaaaauccguauuuggcuu

SEQ ID NO: 500303 - RNA, 17 nt, Chlamydophila pneumoniae CWL029
cgagacaguuuuggauu

SEQ ID NO: 500304 - RNA, 15 nt, Chlamydophila pneumoniae CWL029
cgagacuauuuugga

SEQ ID NO: 500305 - RNA, 16 nt, Chlamydophila pneumoniae CWL029
cgagacugcaaaggaa

SEQ ID NO: 500306 - RNA, 16 nt, Chlamydophila pneumoniae CWL029
cgacucugccaugucu

SEQ ID NO: 500307 - RNA, 22 nt, Chlamydophila pneumoniae CWL029
ccuguaguuucuaaaacagaaa

SEQ ID NO: 500308 - RNA, 16 nt, Chlamydophila pneumoniae CWL029
ccuguauuaaagaauc

SEQ ID NO: 500309 - RNA, 21 nt, Chlamydophila pneumoniae CWL029
ccuguauuaaagaaucuaacu

SEQ ID NO: 500310 - RNA, 13 nt, Chlamydophila pneumoniae CWL029
ccuguagaaacau

SEQ ID NO: 500311 - RNA, 18 nt, Chlamydophila pneumoniae CWL029
ccuguagcgaagagagua

SEQ ID NO: 500312 - RNA, 19 nt, Chlamydophila pneumoniae CWL029
ccugucacaauaccaucuc

SEQ ID NO: 500313 - RNA, 21 nt, Chlamydophila pneumoniae CWL029
ccuguccaacuaaaacagccu

SEQ ID NO: 500314 - RNA, 13 nt, Chlamydophila pneumoniae CWL029
ccuguaacacccu

SEQ ID NO: 500315 - RNA, 22 nt, Chlamydophila pneumoniae CWL029
ccuguaccacauacucuucauc

SEQ ID NO: 500316 - RNA, 15 nt, Chlamydophila pneumoniae CWL029
ccuguacuaucuuuu

SEQ ID NO: 500317 - RNA, 23 nt, Chlamydophila pneumoniae CWL029
ccugggcucacucuaagcgaaac

SEQ ID NO: 500318 - RNA, 21 nt, Chlamydophila pneumoniae CWL029
ccuggaggcgguggcaugcca

SEQ ID NO: 500319 - RNA, 16 nt, Chlamydophila pneumoniae CWL029
ccuggaugaacuccag

SEQ ID NO: 500320 - RNA, 16 nt, Chlamydophila pneumoniae CWL029
ccugcuaaacuuuuuu

SEQ ID NO: 500321 - RNA, 20 nt, Chlamydophila pneumoniae CWL029
ccugcuaaacuuuuuuucaa

SEQ ID NO: 500322 - RNA, 18 nt, Chlamydophila pneumoniae CWL029
ccuggauugauccacaga

SEQ ID NO: 500323 - RNA, 14 nt, Chlamydophila pneumoniae CWL029
ccuggauuuaggau

SEQ ID NO: 500324 - RNA, 20 nt, Chlamydophila pneumoniae CWL029
ccugccgauguuuaugaaaa

SEQ ID NO: 500325 - RNA, 16 nt, Chlamydophila pneumoniae CWL029
ccugccucacagcuaa

SEQ ID NO: 500326 - RNA, 21 nt, Chlamydophila pneumoniae CWL029
ccugcggaaggcuaaaaccua

SEQ ID NO: 500327 - RNA, 22 nt, Chlamydophila pneumoniae CWL029
ccucucaugaaauuuucuaaga

SEQ ID NO: 500328 - RNA, 22 nt, Chlamydophila pneumoniae CWL029
ccucuaaacauaaagacccuuc

SEQ ID NO: 500329 - RNA, 15 nt, Chlamydophila pneumoniae CWL029
ccucuaaaaacccua

SEQ ID NO: 500330 - RNA, 20 nt, Chlamydophila pneumoniae CWL029
ccucucucaagucuauuuga

SEQ ID NO: 500331 - RNA, 18 nt, Chlamydophila pneumoniae CWL029
ccucuucuucccuuucaa

SEQ ID NO: 500332 - RNA, 12 nt, Chlamydophila pneumoniae CWL029
ccucuucuucau

SEQ ID NO: 500333 - RNA, 16 nt, Chlamydophila pneumoniae CWL029
ccugaaauccugggca

SEQ ID NO: 500334 - RNA, 13 nt, Chlamydophila pneumoniae CWL029
ccugaagcagcuu

SEQ ID NO: 500335 - RNA, 17 nt, Chlamydophila pneumoniae CWL029
ccugaagccaugacaaa

SEQ ID NO: 500336 - RNA, 14 nt, Chlamydophila pneumoniae CWL029
ccucuugcuuuucc

SEQ ID NO: 500337 - RNA, 13 nt, Chlamydophila pneumoniae CWL029
ccugaaaaaacag

SEQ ID NO: 500338 - RNA, 14 nt, Chlamydophila pneumoniae CWL029
ccucgacuuccucc

SEQ ID NO: 500339 - RNA, 18 nt, Chlamydophila pneumoniae CWL029
ccuccucuucuauucuga

SEQ ID NO: 500340 - RNA, 20 nt, Chlamydophila pneumoniae CWL029
ccuccucuucuauucugaua

SEQ ID NO: 500341 - RNA, 11 nt, Chlamydophila pneumoniae CWL029
ccuccucuucu

SEQ ID NO: 500342 - RNA, 12 nt, Chlamydophila pneumoniae CWL029
ccuccucuucuu

SEQ ID NO: 500343 - RNA, 13 nt, Chlamydophila pneumoniae CWL029
ccuccugcagggg

SEQ ID NO: 500344 - RNA, 16 nt, Chlamydophila pneumoniae CWL029
ccuccauggaaagaaa

SEQ ID NO: 500345 - RNA, 21 nt, Chlamydophila pneumoniae CWL029
ccuccgaggagggaaacaccg

SEQ ID NO: 500346 - RNA, 22 nt, Chlamydophila pneumoniae CWL029
ccuccgaggagggaaacaccgu

SEQ ID NO: 500347 - RNA, 21 nt, Chlamydophila pneumoniae CWL029
ccuccgcccccuugcacccca

SEQ ID NO: 500348 - RNA, 17 nt, Chlamydophila pneumoniae CWL029
ccuccauaaugcugaga

SEQ ID NO: 500349 - RNA, 22 nt, Chlamydophila pneumoniae CWL029
ccuccaaaagaccaaaaauaaa

SEQ ID NO: 500350 - RNA, 21 nt, Chlamydophila pneumoniae CWL029
ccuccaaaaucaucagcuccg

SEQ ID NO: 500351 - RNA, 15 nt, Chlamydophila pneumoniae CWL029
ccuccaccagaagca

SEQ ID NO: 500352 - RNA, 14 nt, Chlamydophila pneumoniae CWL029
ccuccaccaggagc

SEQ ID NO: 500353 - RNA, 14 nt, Chlamydophila pneumoniae CWL029
ccuacccaauuugu

SEQ ID NO: 500354 - RNA, 19 nt, Chlamydophila pneumoniae CWL029
ccuaccuauuuaagggaaa

SEQ ID NO: 500355 - RNA, 18 nt, Chlamydophila pneumoniae CWL029
ccuaccucugggaagacu

SEQ ID NO: 500356 - RNA, 11 nt, Chlamydophila pneumoniae CWL029
ccuaccugcua

SEQ ID NO: 500357 - RNA, 22 nt, Chlamydophila pneumoniae CWL029
ccuacgacaugccuaaauagcu

SEQ ID NO: 500358 - RNA, 16 nt, Chlamydophila pneumoniae CWL029
ccucauucaaggcgcc

SEQ ID NO: 500359 - RNA, 19 nt, Chlamydophila pneumoniae CWL029
ccucauccccucagaaagg

SEQ ID NO: 500360 - RNA, 17 nt, Chlamydophila pneumoniae CWL029
ccucauccccucagaaa

SEQ ID NO: 500361 - RNA, 20 nt, Chlamydophila pneumoniae CWL029
ccucaucagaggccaccaaa

SEQ ID NO: 500362 - RNA, 21 nt, Chlamydophila pneumoniae CWL029
ccucaucagaggccaccaaaa

SEQ ID NO: 500363 - RNA, 23 nt, Chlamydophila pneumoniae CWL029
ccucaucagaggccaccaaaaau

SEQ ID NO: 500364 - RNA, 13 nt, Chlamydophila pneumoniae CWL029
ccucaucaucaga

SEQ ID NO: 500365 - RNA, 17 nt, Chlamydophila pneumoniae CWL029
ccucaucaucagaaauc

SEQ ID NO: 500366 - RNA, 23 nt, Chlamydophila pneumoniae CWL029
ccuaacuaucucuguuuuuugaa

SEQ ID NO: 500367 - RNA, 24 nt, Chlamydophila pneumoniae CWL029
ccuaauuccuucaaagcuuguucc

SEQ ID NO: 500368 - RNA, 19 nt, Chlamydophila pneumoniae CWL029
ccuaauucucgagcagcug

SEQ ID NO: 500369 - RNA, 21 nt, Chlamydophila pneumoniae CWL029
ccuacaggcaggccacuuccu

SEQ ID NO: 500370 - RNA, 13 nt, Chlamydophila pneumoniae CWL029
ccguucgagaggu

SEQ ID NO: 500371 - RNA, 16 nt, Chlamydophila pneumoniae CWL029
ccguggaauagcuucu

SEQ ID NO: 500372 - RNA, 15 nt, Chlamydophila pneumoniae CWL029
ccgugacuccagaag

SEQ ID NO: 500373 - RNA, 18 nt, Chlamydophila pneumoniae CWL029
ccguaaagaaaagcaauc

SEQ ID NO: 500374 - RNA, 20 nt, Chlamydophila pneumoniae CWL029
ccguaggguauccugcucca

SEQ ID NO: 500375 - RNA, 16 nt, Chlamydophila pneumoniae CWL029
ccguauaacuuuaugu

SEQ ID NO: 500376 - RNA, 14 nt, Chlamydophila pneumoniae CWL029
ccgggaaacaucag

SEQ ID NO: 500377 - RNA, 17 nt, Chlamydophila pneumoniae CWL029
ccggcgguggaaaagga

SEQ ID NO: 500378 - RNA, 23 nt, Chlamydophila pneumoniae CWL029
ccgcucuaagcugugcauuuucu

SEQ ID NO: 500379 - RNA, 20 nt, Chlamydophila pneumoniae CWL029
ccgccuugacggguugugaa

SEQ ID NO: 500380 - RNA, 19 nt, Chlamydophila pneumoniae CWL029
ccgcaggucgcaucaauga

SEQ ID NO: 500381 - RNA, 19 nt, Chlamydophila pneumoniae CWL029
ccgcacucauaggguaguu

SEQ ID NO: 500382 - RNA, 21 nt, Chlamydophila pneumoniae CWL029
ccgaugaggguaucucgucau

SEQ ID NO: 500383 - RNA, 15 nt, Chlamydophila pneumoniae CWL029
ccgacuuuccucaaa

SEQ ID NO: 500384 - RNA, 13 nt, Chlamydophila pneumoniae CWL029
ccgaaucucucca

SEQ ID NO: 500385 - RNA, 15 nt, Chlamydophila pneumoniae CWL029
ccgaaucucuccagc

SEQ ID NO: 500386 - RNA, 16 nt, Chlamydophila pneumoniae CWL029
ccgaucauuuuugcua

SEQ ID NO: 500387 - RNA, 17 nt, Chlamydophila pneumoniae CWL029
ccgaagcauucccgacu

SEQ ID NO: 500388 - RNA, 15 nt, Chlamydophila pneumoniae CWL029
ccgaauaggcauuac

SEQ ID NO: 500389 - RNA, 15 nt, Chlamydophila pneumoniae CWL029
ccgaagacuaccaau

SEQ ID NO: 500390 - RNA, 22 nt, Chlamydophila pneumoniae CWL029
ccgaagacaaugucgucucaga

SEQ ID NO: 500391 - RNA, 12 nt, Chlamydophila pneumoniae CWL029
cccuucuuagua

SEQ ID NO: 500392 - RNA, 12 nt, Chlamydophila pneumoniae CWL029
cccuucuaauac

SEQ ID NO: 500393 - RNA, 17 nt, Chlamydophila pneumoniae CWL029
cccuugcaaaaguuguc

SEQ ID NO: 500394 - RNA, 13 nt, Chlamydophila pneumoniae CWL029
cccuugaaucaua

SEQ ID NO: 500395 - RNA, 14 nt, Chlamydophila pneumoniae CWL029
cccuguauuaaaga

SEQ ID NO: 500396 - RNA, 21 nt, Chlamydophila pneumoniae CWL029
cccuguccaacuaaaacagcc

SEQ ID NO: 500397 - RNA, 17 nt, Chlamydophila pneumoniae CWL029
cccuggucuguauuuuc

SEQ ID NO: 500398 - RNA, 22 nt, Chlamydophila pneumoniae CWL029
cccucuaaugacagcugagaaa

SEQ ID NO: 500399 - RNA, 23 nt, Chlamydophila pneumoniae CWL029
cccucgguuauuuuuccagaaau

SEQ ID NO: 500400 - RNA, 14 nt, Chlamydophila pneumoniae CWL029
cccucuccagaagu

SEQ ID NO: 500401 - RNA, 11 nt, Chlamydophila pneumoniae CWL029
cccucuccuug

SEQ ID NO: 500402 - RNA, 18 nt, Chlamydophila pneumoniae CWL029
cccucugauuauuucuaa

SEQ ID NO: 500403 - RNA, 12 nt, Chlamydophila pneumoniae CWL029
cccucuucuucc

SEQ ID NO: 500404 - RNA, 18 nt, Chlamydophila pneumoniae CWL029
cccucuugcuuuuccguu

SEQ ID NO: 500405 - RNA, 12 nt, Chlamydophila pneumoniae CWL029
cccucuucaucc

SEQ ID NO: 500406 - RNA, 18 nt, Chlamydophila pneumoniae CWL029
cguacgcaaguaaagaaa

SEQ ID NO: 500407 - RNA, 20 nt, Chlamydophila pneumoniae CWL029
cguacgcaaguaaagaaauu

SEQ ID NO: 500408 - RNA, 15 nt, Chlamydophila pneumoniae CWL029
cguaaucuuuuuuaa

SEQ ID NO: 500409 - RNA, 19 nt, Chlamydophila pneumoniae CWL029
cguaaugcuccacggaaau

SEQ ID NO: 500410 - RNA, 18 nt, Chlamydophila pneumoniae CWL029
cguaaugcuuagccaugg

SEQ ID NO: 500411 - RNA, 15 nt, Chlamydophila pneumoniae CWL029
cguaaugcagauagc

SEQ ID NO: 500412 - RNA, 18 nt, Chlamydophila pneumoniae CWL029
cguaauccuucuuucugc

SEQ ID NO: 500413 - RNA, 17 nt, Chlamydophila pneumoniae CWL029
cguaauccuucuuucug

SEQ ID NO: 500414 - RNA, 17 nt, Chlamydophila pneumoniae CWL029
cgguucggucucuucuc

SEQ ID NO: 500415 - RNA, 20 nt, Chlamydophila pneumoniae CWL029
cguaacaauucgauguuaag

SEQ ID NO: 500416 - RNA, 19 nt, Chlamydophila pneumoniae CWL029
cguaagcugcaaucucaaa

SEQ ID NO: 500417 - RNA, 23 nt, Chlamydophila pneumoniae CWL029
cguaauacggacuucacaaagaa

SEQ ID NO: 500418 - RNA, 14 nt, Chlamydophila pneumoniae CWL029
cguaaccacaggau

SEQ ID NO: 500419 - RNA, 18 nt, Chlamydophila pneumoniae CWL029
cguaacugaggcaaagau

SEQ ID NO: 500420 - RNA, 20 nt, Chlamydophila pneumoniae CWL029
cgguaaggaggaaucuugau

SEQ ID NO: 500421 - RNA, 23 nt, Chlamydophila pneumoniae CWL029
cggguucauuuccaaauucuugc

SEQ ID NO: 500422 - RNA, 16 nt, Chlamydophila pneumoniae CWL029
cgggguuguauuuccu

SEQ ID NO: 500423 - RNA, 21 nt, Chlamydophila pneumoniae CWL029
cgggucaggaggugguggagc

SEQ ID NO: 500424 - RNA, 15 nt, Chlamydophila pneumoniae CWL029
cgggagcucuuucuu

SEQ ID NO: 500425 - RNA, 14 nt, Chlamydophila pneumoniae CWL029
cgggagucuucagc

SEQ ID NO: 500426 - RNA, 15 nt, Chlamydophila pneumoniae CWL029
cgggaucuaaaagca

SEQ ID NO: 500427 - RNA, 18 nt, Chlamydophila pneumoniae CWL029
cggccaucauuaaguacu

SEQ ID NO: 500428 - RNA, 19 nt, Chlamydophila pneumoniae CWL029
cggcaacuacuguagaguu

SEQ ID NO: 500429 - RNA, 17 nt, Chlamydophila pneumoniae CWL029
cggaucccguaaaagaa

SEQ ID NO: 500430 - RNA, 17 nt, Chlamydophila pneumoniae CWL029
cggaguaacuaauaauc

SEQ ID NO: 500431 - RNA, 21 nt, Chlamydophila pneumoniae CWL029
cggaguccuucuugcaaagau

SEQ ID NO: 500432 - RNA, 23 nt, Chlamydophila pneumoniae CWL029
cggaguccuucuugcaaagauaa

SEQ ID NO: 500433 - RNA, 17 nt, Chlamydophila pneumoniae CWL029
cggacuccugaugcucc

SEQ ID NO: 500434 - RNA, 19 nt, Chlamydophila pneumoniae CWL029
cggagaacuuccugauucu

SEQ ID NO: 500435 - RNA, 12 nt, Chlamydophila pneumoniae CWL029
cggagaccaaaa

SEQ ID NO: 500436 - RNA, 22 nt, Chlamydophila pneumoniae CWL029
cggacuucacaaagaaccauag

SEQ ID NO: 500437 - RNA, 22 nt, Chlamydophila pneumoniae CWL029
cggacauaccuacuaaacccug

SEQ ID NO: 500438 - RNA, 19 nt, Chlamydophila pneumoniae CWL029
cggacaaugcuaucuccag

SEQ ID NO: 500439 - RNA, 14 nt, Chlamydophila pneumoniae CWL029
cggacaacaacagc

SEQ ID NO: 500440 - RNA, 16 nt, Chlamydophila pneumoniae CWL029
cggaauacuucuccuc

SEQ ID NO: 500441 - RNA, 19 nt, Chlamydophila pneumoniae CWL029
cggaaggaguucuuuuuua

SEQ ID NO: 500442 - RNA, 12 nt, Chlamydophila pneumoniae CWL029
cggaagauaaau

SEQ ID NO: 500443 - RNA, 22 nt, Chlamydophila pneumoniae CWL029
cgcuuucuuuuauuaagggaag

SEQ ID NO: 500444 - RNA, 19 nt, Chlamydophila pneumoniae CWL029
cgcuuugauaauagucuuc

SEQ ID NO: 500445 - RNA, 14 nt, Chlamydophila pneumoniae CWL029
cgcuuccagcuucu

SEQ ID NO: 500446 - RNA, 17 nt, Chlamydophila pneumoniae CWL029
cgcuauagccuuguaaa

SEQ ID NO: 500447 - RNA, 19 nt, Chlamydophila pneumoniae CWL029
cgcuaagcucuuaauuucu

SEQ ID NO: 500448 - RNA, 17 nt, Chlamydophila pneumoniae CWL029
cgcuaccauaucuugag

SEQ ID NO: 500449 - RNA, 17 nt, Chlamydophila pneumoniae CWL029
cgcgggauggacugaug

SEQ ID NO: 500450 - RNA, 22 nt, Chlamydophila pneumoniae CWL029
cgugagagucaggaagaugcug

SEQ ID NO: 500451 - RNA, 20 nt, Chlamydophila pneumoniae CWL029
cgugacugcguugauguauu

SEQ ID NO: 500452 - RNA, 20 nt, Chlamydophila pneumoniae CWL029
cgugacucuuaucuggagau

SEQ ID NO: 500453 - RNA, 16 nt, Chlamydophila pneumoniae CWL029
cgugaagcagaggguu

SEQ ID NO: 500454 - RNA, 18 nt, Chlamydophila pneumoniae CWL029
cgugaauaucaucacuaa

SEQ ID NO: 500455 - RNA, 20 nt, Chlamydophila pneumoniae CWL029
cgugauugcugucagaacaa

SEQ ID NO: 500456 - RNA, 14 nt, Chlamydophila pneumoniae CWL029
cgucuuucaccaac

SEQ ID NO: 500457 - RNA, 17 nt, Chlamydophila pneumoniae CWL029
cgucuuugcuuucuagg

SEQ ID NO: 500458 - RNA, 13 nt, Chlamydophila pneumoniae CWL029
cgucuuuuaaaga

SEQ ID NO: 500459 - RNA, 14 nt, Chlamydophila pneumoniae CWL029
cgugaacaaaaacu

SEQ ID NO: 500460 - RNA, 12 nt, Chlamydophila pneumoniae CWL029
cgugaacaaaau

SEQ ID NO: 500461 - RNA, 17 nt, Chlamydophila pneumoniae CWL029
cgucuuagaauccucua

SEQ ID NO: 500462 - RNA, 20 nt, Chlamydophila pneumoniae CWL029
cgucuuagaauccaaagacu

SEQ ID NO: 500463 - RNA, 21 nt, Chlamydophila pneumoniae CWL029
cgucugcgauaggaucuucua

SEQ ID NO: 500464 - RNA, 20 nt, Chlamydophila pneumoniae CWL029
cgucguaaucuuuuuuaaag

SEQ ID NO: 500465 - RNA, 18 nt, Chlamydophila pneumoniae CWL029
cguccagccugcaccaga

SEQ ID NO: 500466 - RNA, 12 nt, Chlamydophila pneumoniae CWL029
cgucccacaaaa

SEQ ID NO: 500467 - RNA, 15 nt, Chlamydophila pneumoniae CWL029
cgucgcuaaugcuau

SEQ ID NO: 500468 - RNA, 17 nt, Chlamydophila pneumoniae CWL029
cguuggacugcaagagc

SEQ ID NO: 500469 - RNA, 17 nt, Chlamydophila pneumoniae CWL029
cguugguucaaauccag

SEQ ID NO: 500470 - RNA, 18 nt, Chlamydophila pneumoniae CWL029
cuaaaaaggucagcccug

SEQ ID NO: 500471 - RNA, 19 nt, Chlamydophila pneumoniae CWL029
cuaaaaaugcacuuugaau

SEQ ID NO: 500472 - RNA, 15 nt, Chlamydophila pneumoniae CWL029
cuaaaaccacagaau

SEQ ID NO: 500473 - RNA, 13 nt, Chlamydophila pneumoniae CWL029
cuaaaaccuagac

SEQ ID NO: 500474 - RNA, 19 nt, Chlamydophila pneumoniae CWL029
cuaaacccuguccaacuaa

SEQ ID NO: 500475 - RNA, 17 nt, Chlamydophila pneumoniae CWL029
cuaaaccuaaaauggug

SEQ ID NO: 500476 - RNA, 16 nt, Chlamydophila pneumoniae CWL029
cuaaaacuacaacagg

SEQ ID NO: 500477 - RNA, 22 nt, Chlamydophila pneumoniae CWL029
cguuuguuuugcuuuuugaaug

SEQ ID NO: 500478 - RNA, 18 nt, Chlamydophila pneumoniae CWL029
cuaaguuuaggcaggaag

SEQ ID NO: 500479 - RNA, 17 nt, Chlamydophila pneumoniae CWL029
cuaagugauaaggaaga

SEQ ID NO: 500480 - RNA, 20 nt, Chlamydophila pneumoniae CWL029
cuaagcugaaagaacacucc

SEQ ID NO: 500481 - RNA, 21 nt, Chlamydophila pneumoniae CWL029
cuaagcucuuaauuucugcug

SEQ ID NO: 500482 - RNA, 17 nt, Chlamydophila pneumoniae CWL029
cuaagcuauaucucaac

SEQ ID NO: 500483 - RNA, 20 nt, Chlamydophila pneumoniae CWL029
cuaaguccaacaucagcugu

SEQ ID NO: 500484 - RNA, 14 nt, Chlamydophila pneumoniae CWL029
cuaagaauauggac

SEQ ID NO: 500485 - RNA, 14 nt, Chlamydophila pneumoniae CWL029
cuaagaaugagaac

SEQ ID NO: 500486 - RNA, 17 nt, Chlamydophila pneumoniae CWL029
cuaagaagcucacucuu

SEQ ID NO: 500487 - RNA, 16 nt, Chlamydophila pneumoniae CWL029
cuaagcauucgacucu

SEQ ID NO: 500488 - RNA, 15 nt, Chlamydophila pneumoniae CWL029
cuaagcgaaccaaag

SEQ ID NO: 500489 - RNA, 16 nt, Chlamydophila pneumoniae CWL029
cuaacuuagagcgaau

SEQ ID NO: 500490 - RNA, 15 nt, Chlamydophila pneumoniae CWL029
cuaacuuauccucag

SEQ ID NO: 500491 - RNA, 15 nt, Chlamydophila pneumoniae CWL029
cuaacgacauugaag

SEQ ID NO: 500492 - RNA, 20 nt, Chlamydophila pneumoniae CWL029
cuaacgaagccucacagaau

SEQ ID NO: 500493 - RNA, 12 nt, Chlamydophila pneumoniae CWL029
cuaacaacuccu

SEQ ID NO: 500494 - RNA, 19 nt, Chlamydophila pneumoniae CWL029
cuaacaagauaaccugaga

SEQ ID NO: 500495 - RNA, 17 nt, Chlamydophila pneumoniae CWL029
cuaaauuugucaucaca

SEQ ID NO: 500496 - RNA, 18 nt, Chlamydophila pneumoniae CWL029
cuaaauuugucaucacau

SEQ ID NO: 500497 - RNA, 18 nt, Chlamydophila pneumoniae CWL029
cuaaauuaguaaaugccu

SEQ ID NO: 500498 - RNA, 14 nt, Chlamydophila pneumoniae CWL029
cuaaauuaguaaau

SEQ ID NO: 500499 - RNA, 16 nt, Chlamydophila pneumoniae CWL029
cuaaauuaguaaaugc

SEQ ID NO: 500500 - RNA, 14 nt, Chlamydophila pneumoniae CWL029
cuaaauuaaauauc

SEQ ID NO: 500501 - RNA, 23 nt, Chlamydophila pneumoniae CWL029
cuaaagaaagagucucacucuuu

SEQ ID NO: 500502 - RNA, 16 nt, Chlamydophila pneumoniae CWL029
cuaaagaagauucaag

SEQ ID NO: 500503 - RNA, 12 nt, Chlamydophila pneumoniae CWL029
cuaaacuuuuuu

SEQ ID NO: 500504 - RNA, 22 nt, Chlamydophila pneumoniae CWL029
cuaaacuuuuuuucaaaucauc

SEQ ID NO: 500505 - RNA, 17 nt, Chlamydophila pneumoniae CWL029
cuaaacgacguuuaauu

SEQ ID NO: 500506 - RNA, 18 nt, Chlamydophila pneumoniae CWL029
cuaaacgacguuuaauuc

SEQ ID NO: 500507 - RNA, 22 nt, Chlamydophila pneumoniae CWL029
cuaaacgacguuuaauuccuug

SEQ ID NO: 500508 - RNA, 15 nt, Chlamydophila pneumoniae CWL029
cuaaaccuucaauga

SEQ ID NO: 500509 - RNA, 19 nt, Chlamydophila pneumoniae CWL029
cuaaagaauuuguaacucu

SEQ ID NO: 500510 - RNA, 22 nt, Chlamydophila pneumoniae CWL029
cuaaagaauuuguaacucuuaa

SEQ ID NO: 500511 - RNA, 20 nt, Chlamydophila pneumoniae CWL029
cuaaagcaggagcaucauua

SEQ ID NO: 500512 - RNA, 15 nt, Chlamydophila pneumoniae CWL029
cuaaagcagaauccc

SEQ ID NO: 500513 - RNA, 11 nt, Chlamydophila pneumoniae CWL029
cuaaagagaua

SEQ ID NO: 500514 - RNA, 19 nt, Chlamydophila pneumoniae CWL029
cuaaagauacuuaucuuua

SEQ ID NO: 500515 - RNA, 22 nt, Chlamydophila pneumoniae CWL029
cguucaacuuuguuaauagaag

SEQ ID NO: 500516 - RNA, 19 nt, Chlamydophila pneumoniae CWL029
cguuccagccugugagcuc

SEQ ID NO: 500517 - RNA, 15 nt, Chlamydophila pneumoniae CWL029
cguuaccaaaaacug

SEQ ID NO: 500518 - RNA, 13 nt, Chlamydophila pneumoniae CWL029
cguuaauaaagag

SEQ ID NO: 500519 - RNA, 19 nt, Chlamydophila pneumoniae CWL029
cguuaauaagaaccucuaa

SEQ ID NO: 500520 - RNA, 21 nt, Chlamydophila pneumoniae CWL029
cguguacagaccguccucccc

SEQ ID NO: 500521 - RNA, 19 nt, Chlamydophila pneumoniae CWL029
cguguggguaaugccaaua

SEQ ID NO: 500522 - RNA, 13 nt, Chlamydophila pneumoniae CWL029
cguggagcaucau

SEQ ID NO: 500523 - RNA, 16 nt, Chlamydophila pneumoniae CWL029
cgugcucucuucuucu

SEQ ID NO: 500524 - RNA, 14 nt, Chlamydophila pneumoniae CWL029
cgugcucugcaauc

SEQ ID NO: 500525 - RNA, 12 nt, Chlamydophila pneumoniae CWL029
cgugcucuuaug

SEQ ID NO: 500526 - RNA, 16 nt, Chlamydophila pneumoniae CWL029
cguggcuuuuguauua

SEQ ID NO: 500527 - RNA, 17 nt, Chlamydophila pneumoniae CWL029
cguggcuuuguaaaaau

SEQ ID NO: 500528 - RNA, 18 nt, Chlamydophila pneumoniae CWL029
cguggcuuccauaacgag

SEQ ID NO: 500529 - RNA, 14 nt, Chlamydophila pneumoniae CWL029
cucagcaaagacau

SEQ ID NO: 500530 - RNA, 18 nt, Chlamydophila pneumoniae CWL029
cucaggagauacaagcaa

SEQ ID NO: 500531 - RNA, 15 nt, Chlamydophila pneumoniae CWL029
cucaggaaaacuuaa

SEQ ID NO: 500532 - RNA, 17 nt, Chlamydophila pneumoniae CWL029
cucaucggaucuuuucu

SEQ ID NO: 500533 - RNA, 16 nt, Chlamydophila pneumoniae CWL029
cucaucuagaaagauu

SEQ ID NO: 500534 - RNA, 22 nt, Chlamydophila pneumoniae CWL029
cucaucucgcaguccaaagacu

SEQ ID NO: 500535 - RNA, 16 nt, Chlamydophila pneumoniae CWL029
cucauccuaaauuaaa

SEQ ID NO: 500536 - RNA, 20 nt, Chlamydophila pneumoniae CWL029
cucauccuaaauuaaauauc

SEQ ID NO: 500537 - RNA, 21 nt, Chlamydophila pneumoniae CWL029
cucaucagaggccaccaaaaa

SEQ ID NO: 500538 - RNA, 14 nt, Chlamydophila pneumoniae CWL029
cucaucagcaaccu

SEQ ID NO: 500539 - RNA, 20 nt, Chlamydophila pneumoniae CWL029
cucaucacaauuuuaaaauc

SEQ ID NO: 500540 - RNA, 22 nt, Chlamydophila pneumoniae CWL029
cucaucagaaguggccuugcca

SEQ ID NO: 500541 - RNA, 21 nt, Chlamydophila pneumoniae CWL029
cucauauuuugucuucaucau

SEQ ID NO: 500542 - RNA, 15 nt, Chlamydophila pneumoniae CWL029
cucauauuuugucuu

SEQ ID NO: 500543 - RNA, 16 nt, Chlamydophila pneumoniae CWL029
cucaguaggagcagcg

SEQ ID NO: 500544 - RNA, 15 nt, Chlamydophila pneumoniae CWL029
cucagucacaauaua

SEQ ID NO: 500545 - RNA, 14 nt, Chlamydophila pneumoniae CWL029
cucaaagaaagucu

SEQ ID NO: 500546 - RNA, 13 nt, Chlamydophila pneumoniae CWL029
cucaaagaauacu

SEQ ID NO: 500547 - RNA, 14 nt, Chlamydophila pneumoniae CWL029
cuauuuucccuuug

SEQ ID NO: 500548 - RNA, 21 nt, Chlamydophila pneumoniae CWL029
cuauuuucccuuugucuauga

SEQ ID NO: 500549 - RNA, 12 nt, Chlamydophila pneumoniae CWL029
cuauuuuaaacu

SEQ ID NO: 500550 - RNA, 18 nt, Chlamydophila pneumoniae CWL029
cuauuuuaaacuuacagc

SEQ ID NO: 500551 - RNA, 19 nt, Chlamydophila pneumoniae CWL029
cuauuuuuccauggcuauu

SEQ ID NO: 500552 - RNA, 12 nt, Chlamydophila pneumoniae CWL029
cuauuuuuuaag

SEQ ID NO: 500553 - RNA, 15 nt, Chlamydophila pneumoniae CWL029
cuauggugcaugccu

SEQ ID NO: 500554 - RNA, 13 nt, Chlamydophila pneumoniae CWL029
cuauuaagucacc

SEQ ID NO: 500555 - RNA, 15 nt, Chlamydophila pneumoniae CWL029
cuauuacuagauccc

SEQ ID NO: 500556 - RNA, 16 nt, Chlamydophila pneumoniae CWL029
cuauuagauuuccucc

SEQ ID NO: 500557 - RNA, 14 nt, Chlamydophila pneumoniae CWL029
cuauuguuuguccu

SEQ ID NO: 500558 - RNA, 18 nt, Chlamydophila pneumoniae CWL029
cuauuucauauaaaguuu

SEQ ID NO: 500559 - RNA, 20 nt, Chlamydophila pneumoniae CWL029
cuauuucugccuuaugcuca

SEQ ID NO: 500560 - RNA, 20 nt, Chlamydophila pneumoniae CWL029
cuauuucuuaauuuccuucu

SEQ ID NO: 500561 - RNA, 16 nt, Chlamydophila pneumoniae CWL029
cucacaaaagucucua

SEQ ID NO: 500562 - RNA, 13 nt, Chlamydophila pneumoniae CWL029
cucacaucuccuu

SEQ ID NO: 500563 - RNA, 17 nt, Chlamydophila pneumoniae CWL029
cucacauguuucacuua

SEQ ID NO: 500564 - RNA, 16 nt, Chlamydophila pneumoniae CWL029
cucacauguuucacuu

SEQ ID NO: 500565 - RNA, 23 nt, Chlamydophila pneumoniae CWL029
cucaccacggaagauaugucgcu

SEQ ID NO: 500566 - RNA, 20 nt, Chlamydophila pneumoniae CWL029
cucaaggucacagcauuuuc

SEQ ID NO: 500567 - RNA, 20 nt, Chlamydophila pneumoniae CWL029
cucaaggcaucuagagucuc

SEQ ID NO: 500568 - RNA, 21 nt, Chlamydophila pneumoniae CWL029
cucaaguaagaagucuucagg

SEQ ID NO: 500569 - RNA, 19 nt, Chlamydophila pneumoniae CWL029
cucaaucgauaaucaaagg

SEQ ID NO: 500570 - RNA, 18 nt, Chlamydophila pneumoniae CWL029
cucaaggaucuuauauaa

SEQ ID NO: 500571 - RNA, 19 nt, Chlamydophila pneumoniae CWL029
cucaaggaucuuauauaaa

SEQ ID NO: 500572 - RNA, 22 nt, Chlamydophila pneumoniae CWL029
cucaaggaucuuauauaaaacu

SEQ ID NO: 500573 - RNA, 14 nt, Chlamydophila pneumoniae CWL029
cucaaggcaucuag

SEQ ID NO: 500574 - RNA, 18 nt, Chlamydophila pneumoniae CWL029
cuauacguaauccagauu

SEQ ID NO: 500575 - RNA, 24 nt, Chlamydophila pneumoniae CWL029
cuauacucucuguagcacuucuca

SEQ ID NO: 500576 - RNA, 19 nt, Chlamydophila pneumoniae CWL029
cuauagaaaaggaugcauc

SEQ ID NO: 500577 - RNA, 22 nt, Chlamydophila pneumoniae CWL029
cuauagaauacacagcuaugau

SEQ ID NO: 500578 - RNA, 15 nt, Chlamydophila pneumoniae CWL029
cuauagagacacgaa

SEQ ID NO: 500579 - RNA, 14 nt, Chlamydophila pneumoniae CWL029
cuauacccucugcu

SEQ ID NO: 500580 - RNA, 17 nt, Chlamydophila pneumoniae CWL029
cuauaccaucuuuaaaa

SEQ ID NO: 500581 - RNA, 17 nt, Chlamydophila pneumoniae CWL029
cuauaauuaauccuuga

SEQ ID NO: 500582 - RNA, 15 nt, Chlamydophila pneumoniae CWL029
cuauaacuacaaaau

SEQ ID NO: 500583 - RNA, 20 nt, Chlamydophila pneumoniae CWL029
cuauaagacauuauagaggu

SEQ ID NO: 500584 - RNA, 23 nt, Chlamydophila pneumoniae CWL029
cuaggacguaauuacgcucucca

SEQ ID NO: 500585 - RNA, 22 nt, Chlamydophila pneumoniae CWL029
cuaggccuaaagaauuuguaac

SEQ ID NO: 500586 - RNA, 21 nt, Chlamydophila pneumoniae CWL029
cuaggccgggauuuuaauuca

SEQ ID NO: 500587 - RNA, 19 nt, Chlamydophila pneumoniae CWL029
cuaggcaugguaggagccg

SEQ ID NO: 500588 - RNA, 23 nt, Chlamydophila pneumoniae CWL029
cuauaaccaacuuccuauaaaaa

SEQ ID NO: 500589 - RNA, 13 nt, Chlamydophila pneumoniae CWL029
cuauaacaacauu

SEQ ID NO: 500590 - RNA, 23 nt, Chlamydophila pneumoniae CWL029
cuaugaggaacugggcauagugg

SEQ ID NO: 500591 - RNA, 19 nt, Chlamydophila pneumoniae CWL029
cuaucuuuacuaacaaaau

SEQ ID NO: 500592 - RNA, 22 nt, Chlamydophila pneumoniae CWL029
cuaucuuugguaugcagaguuu

SEQ ID NO: 500593 - RNA, 18 nt, Chlamydophila pneumoniae CWL029
cuaucuuuauuuaaauaa

SEQ ID NO: 500594 - RNA, 23 nt, Chlamydophila pneumoniae CWL029
cuaucuuuauuuaaauaaaacca

SEQ ID NO: 500595 - RNA, 21 nt, Chlamydophila pneumoniae CWL029
cuaugggaggaauuccucuca

SEQ ID NO: 500596 - RNA, 15 nt, Chlamydophila pneumoniae CWL029
cuaugguaaucaccu

SEQ ID NO: 500597 - RNA, 19 nt, Chlamydophila pneumoniae CWL029
cuauggucucccucacaag

SEQ ID NO: 500598 - RNA, 20 nt, Chlamydophila pneumoniae CWL029
cuauggucucccucacaaga

SEQ ID NO: 500599 - RNA, 21 nt, Chlamydophila pneumoniae CWL029
cuauggucucccucacaagaa

SEQ ID NO: 500600 - RNA, 22 nt, Chlamydophila pneumoniae CWL029
cuauggcagcaggaauaaucaa

SEQ ID NO: 500601 - RNA, 13 nt, Chlamydophila pneumoniae CWL029
cuaugacuucuug

SEQ ID NO: 500602 - RNA, 15 nt, Chlamydophila pneumoniae CWL029
cuaugauaucaccag

SEQ ID NO: 500603 - RNA, 17 nt, Chlamydophila pneumoniae CWL029
cuaugauccgaaaacuc

SEQ ID NO: 500604 - RNA, 19 nt, Chlamydophila pneumoniae CWL029
cuaugauccgaaaacucuu

SEQ ID NO: 500605 - RNA, 14 nt, Chlamydophila pneumoniae CWL029
cuauggaaagaguc

SEQ ID NO: 500606 - RNA, 16 nt, Chlamydophila pneumoniae CWL029
cuaucucuguuuuuug

SEQ ID NO: 500607 - RNA, 13 nt, Chlamydophila pneumoniae CWL029
cuaucuccagaaa

SEQ ID NO: 500608 - RNA, 23 nt, Chlamydophila pneumoniae CWL029
cuaucugccauaggauccaggag

SEQ ID NO: 500609 - RNA, 14 nt, Chlamydophila pneumoniae CWL029
cuaucgaagagccc

SEQ ID NO: 500610 - RNA, 20 nt, Chlamydophila pneumoniae CWL029
cuaucgauagccauuagaau

SEQ ID NO: 500611 - RNA, 19 nt, Chlamydophila pneumoniae CWL029
cuauaugaaugauuuccau

SEQ ID NO: 500612 - RNA, 20 nt, Chlamydophila pneumoniae CWL029
cuauaugaaugauuuccaua

SEQ ID NO: 500613 - RNA, 14 nt, Chlamydophila pneumoniae CWL029
cuauaucuacagcu

SEQ ID NO: 500614 - RNA, 15 nt, Chlamydophila pneumoniae CWL029
cuauccuguuucaac

SEQ ID NO: 500615 - RNA, 16 nt, Chlamydophila pneumoniae CWL029
cuagcaguugcaauac

SEQ ID NO: 500616 - RNA, 15 nt, Chlamydophila pneumoniae CWL029
cuagcaccuaauaaa

SEQ ID NO: 500617 - RNA, 20 nt, Chlamydophila pneumoniae CWL029
cuagcagaaguccuaucaaa

SEQ ID NO: 500618 - RNA, 14 nt, Chlamydophila pneumoniae CWL029
cuagagucucuuuc

SEQ ID NO: 500619 - RNA, 18 nt, Chlamydophila pneumoniae CWL029
cuagaguacccccgggcg

SEQ ID NO: 500620 - RNA, 19 nt, Chlamydophila pneumoniae CWL029
cuagagucacuagcagaag

SEQ ID NO: 500621 - RNA, 22 nt, Chlamydophila pneumoniae CWL029
cuagaguccaagguucugggaa

SEQ ID NO: 500622 - RNA, 15 nt, Chlamydophila pneumoniae CWL029
cuagaggaucuucaa

SEQ ID NO: 500623 - RNA, 19 nt, Chlamydophila pneumoniae CWL029
cuagagcuuucagaaaaga

SEQ ID NO: 500624 - RNA, 17 nt, Chlamydophila pneumoniae CWL029
cuagagguauuuccuuc

SEQ ID NO: 500625 - RNA, 22 nt, Chlamydophila pneumoniae CWL029
cuagaagaugaguguucucaau

SEQ ID NO: 500626 - RNA, 14 nt, Chlamydophila pneumoniae CWL029
cuagaagcgcuuua

SEQ ID NO: 500627 - RNA, 19 nt, Chlamydophila pneumoniae CWL029
cuagaacuugggaugcuac

SEQ ID NO: 500628 - RNA, 18 nt, Chlamydophila pneumoniae CWL029
cuagaagacauucauuuu

SEQ ID NO: 500629 - RNA, 15 nt, Chlamydophila pneumoniae CWL029
cuagagauccaauga

SEQ ID NO: 500630 - RNA, 16 nt, Chlamydophila pneumoniae CWL029
cuagagauuguaauuu

SEQ ID NO: 500631 - RNA, 21 nt, Chlamydophila pneumoniae CWL029
cuagagauuguaauuuccuua

SEQ ID NO: 500632 - RNA, 17 nt, Chlamydophila pneumoniae CWL029
cuagagauuuuucuagg

SEQ ID NO: 500633 - RNA, 16 nt, Chlamydophila pneumoniae CWL029
cuagagcacauagaaa

SEQ ID NO: 500634 - RNA, 20 nt, Chlamydophila pneumoniae CWL029
cuagagcacauagaaacagu

SEQ ID NO: 500635 - RNA, 23 nt, Chlamydophila pneumoniae CWL029
cuagagcuucaaguuucuuuugc

SEQ ID NO: 500636 - RNA, 22 nt, Chlamydophila pneumoniae CWL029
cuagaaacugcuccugaagcug

SEQ ID NO: 500637 - RNA, 19 nt, Chlamydophila pneumoniae CWL029
cuagaaagauuuauuuugu

SEQ ID NO: 500638 - RNA, 16 nt, Chlamydophila pneumoniae CWL029
cuacgugaucaaaauu

SEQ ID NO: 500639 - RNA, 21 nt, Chlamydophila pneumoniae CWL029
cuagaaaagauucuaaaucaa

SEQ ID NO: 500640 - RNA, 13 nt, Chlamydophila pneumoniae CWL029
cuagaaaauauuc

SEQ ID NO: 500641 - RNA, 19 nt, Chlamydophila pneumoniae CWL029
cuagaaaaucucuaagaau

SEQ ID NO: 500642 - RNA, 21 nt, Chlamydophila pneumoniae CWL029
cuaauaccuuucuaagaauuc

SEQ ID NO: 500643 - RNA, 15 nt, Chlamydophila pneumoniae CWL029
cuaauacuuuaggag

SEQ ID NO: 500644 - RNA, 20 nt, Chlamydophila pneumoniae CWL029
cuaauacacccgcaagcacu

SEQ ID NO: 500645 - RNA, 17 nt, Chlamydophila pneumoniae CWL029
cuaauacaucaccacug

SEQ ID NO: 500646 - RNA, 20 nt, Chlamydophila pneumoniae CWL029
cuaauaggggaccuaucggg

SEQ ID NO: 500647 - RNA, 14 nt, Chlamydophila pneumoniae CWL029
cuaccuauauuuuu

SEQ ID NO: 500648 - RNA, 22 nt, Chlamydophila pneumoniae CWL029
cucuacgcuauucuuaagcuac

SEQ ID NO: 500649 - RNA, 13 nt, Chlamydophila pneumoniae CWL029
cucuaccaacuga

SEQ ID NO: 500650 - RNA, 19 nt, Chlamydophila pneumoniae CWL029
cucuaccccacgcuaaacu

SEQ ID NO: 500651 - RNA, 20 nt, Chlamydophila pneumoniae CWL029
cucuacccccagcuucuuca

SEQ ID NO: 500652 - RNA, 18 nt, Chlamydophila pneumoniae CWL029
cucuaaacucucuuccuu

SEQ ID NO: 500653 - RNA, 21 nt, Chlamydophila pneumoniae CWL029
cucuacaguaguaaauaauaa

SEQ ID NO: 500654 - RNA, 16 nt, Chlamydophila pneumoniae CWL029
cucuacaggagaagcg

SEQ ID NO: 500655 - RNA, 16 nt, Chlamydophila pneumoniae CWL029
cucuaaacauaaagac

SEQ ID NO: 500656 - RNA, 14 nt, Chlamydophila pneumoniae CWL029
cucuaaaaaagaua

SEQ ID NO: 500657 - RNA, 21 nt, Chlamydophila pneumoniae CWL029
cucuaaaaaagauaaagcuac

SEQ ID NO: 500658 - RNA, 21 nt, Chlamydophila pneumoniae CWL029
cucuaaaaacccuaguucauu

SEQ ID NO: 500659 - RNA, 14 nt, Chlamydophila pneumoniae CWL029
cucgugcauaauga

SEQ ID NO: 500660 - RNA, 17 nt, Chlamydophila pneumoniae CWL029
cucguaauccuucuuuc

SEQ ID NO: 500661 - RNA, 15 nt, Chlamydophila pneumoniae CWL029
cucggaaaucaggga

SEQ ID NO: 500662 - RNA, 18 nt, Chlamydophila pneumoniae CWL029
cucgcuguuucaacaccu

SEQ ID NO: 500663 - RNA, 16 nt, Chlamydophila pneumoniae CWL029
cucgcuauuccauaaa

SEQ ID NO: 500664 - RNA, 22 nt, Chlamydophila pneumoniae CWL029
cucgauuaucgggguuguauuu

SEQ ID NO: 500665 - RNA, 14 nt, Chlamydophila pneumoniae CWL029
cucgauuauuucuu

SEQ ID NO: 500666 - RNA, 14 nt, Chlamydophila pneumoniae CWL029
cucgcaaaagcugu

SEQ ID NO: 500667 - RNA, 21 nt, Chlamydophila pneumoniae CWL029
cucgccaaaccaugaggcugc

SEQ ID NO: 500668 - RNA, 21 nt, Chlamydophila pneumoniae CWL029
cucgauacuguugauccuucu

SEQ ID NO: 500669 - RNA, 21 nt, Chlamydophila pneumoniae CWL029
cucgagcagaaacuccaaaau

SEQ ID NO: 500670 - RNA, 21 nt, Chlamydophila pneumoniae CWL029
cuccugacucuuuuaagacaa

SEQ ID NO: 500671 - RNA, 18 nt, Chlamydophila pneumoniae CWL029
cucgacaccgauucgcua

SEQ ID NO: 500672 - RNA, 20 nt, Chlamydophila pneumoniae CWL029
cucgacguauuugccaaaau

SEQ ID NO: 500673 - RNA, 22 nt, Chlamydophila pneumoniae CWL029
cucgacguauuugccaaaauaa

SEQ ID NO: 500674 - RNA, 12 nt, Chlamydophila pneumoniae CWL029
cuccuaggggaa

SEQ ID NO: 500675 - RNA, 14 nt, Chlamydophila pneumoniae CWL029
cuccuagacagccu

SEQ ID NO: 500676 - RNA, 21 nt, Chlamydophila pneumoniae CWL029
cuccuaagucguuaacaucaa

SEQ ID NO: 500677 - RNA, 18 nt, Chlamydophila pneumoniae CWL029
cuccuauugguguaucuc

SEQ ID NO: 500678 - RNA, 20 nt, Chlamydophila pneumoniae CWL029
cuccuauugguguaucucuu

SEQ ID NO: 500679 - RNA, 20 nt, Chlamydophila pneumoniae CWL029
cuccugacucuuauugcaga

SEQ ID NO: 500680 - RNA, 23 nt, Chlamydophila pneumoniae CWL029
cuccugacucuuuuaagacaaua

SEQ ID NO: 500681 - RNA, 21 nt, Chlamydophila pneumoniae CWL029
cucccuggucuguauuuucuu

SEQ ID NO: 500682 - RNA, 15 nt, Chlamydophila pneumoniae CWL029
cucccauagcaaugc

SEQ ID NO: 500683 - RNA, 19 nt, Chlamydophila pneumoniae CWL029
cucccauguaguaaauucc

SEQ ID NO: 500684 - RNA, 14 nt, Chlamydophila pneumoniae CWL029
cucccauuucugga

SEQ ID NO: 500685 - RNA, 22 nt, Chlamydophila pneumoniae CWL029
cucccauuucuggagaaugccc

SEQ ID NO: 500686 - RNA, 13 nt, Chlamydophila pneumoniae CWL029
cuccccauacaua

SEQ ID NO: 500687 - RNA, 18 nt, Chlamydophila pneumoniae CWL029
cuccauuuagaaugaccg

SEQ ID NO: 500688 - RNA, 20 nt, Chlamydophila pneumoniae CWL029
cucccaacaagggaaagaaa

SEQ ID NO: 500689 - RNA, 17 nt, Chlamydophila pneumoniae CWL029
cucccaauauccagaaa

SEQ ID NO: 500690 - RNA, 17 nt, Chlamydophila pneumoniae CWL029
cuccauuggcauagagc

SEQ ID NO: 500691 - RNA, 15 nt, Chlamydophila pneumoniae CWL029
cuccauaagcuuuuc

SEQ ID NO: 500692 - RNA, 23 nt, Chlamydophila pneumoniae CWL029
cuccaucggaauuugccugaaau

SEQ ID NO: 500693 - RNA, 17 nt, Chlamydophila pneumoniae CWL029
cuccaucuauacagaca

SEQ ID NO: 500694 - RNA, 17 nt, Chlamydophila pneumoniae CWL029
cuccaguaucuucucuu

SEQ ID NO: 500695 - RNA, 17 nt, Chlamydophila pneumoniae CWL029
cuccaggggauaaaacu

SEQ ID NO: 500696 - RNA, 22 nt, Chlamydophila pneumoniae CWL029
cuccaggguguuugcauaguau

SEQ ID NO: 500697 - RNA, 23 nt, Chlamydophila pneumoniae CWL029
cuccagguagcagaguuuuuccc

SEQ ID NO: 500698 - RNA, 13 nt, Chlamydophila pneumoniae CWL029
cuccagcauaagg

SEQ ID NO: 500699 - RNA, 14 nt, Chlamydophila pneumoniae CWL029
cuccagcagcuucc

SEQ ID NO: 500700 - RNA, 14 nt, Chlamydophila pneumoniae CWL029
cuccagagcaagau

SEQ ID NO: 500701 - RNA, 18 nt, Chlamydophila pneumoniae CWL029
cuccagaaacgcagcuuu

SEQ ID NO: 500702 - RNA, 20 nt, Chlamydophila pneumoniae CWL029
cuccagaaacgcagcuuucc

SEQ ID NO: 500703 - RNA, 18 nt, Chlamydophila pneumoniae CWL029
cuccagaaaguauuccuc

SEQ ID NO: 500704 - RNA, 15 nt, Chlamydophila pneumoniae CWL029
cuccaaaacucaagg

SEQ ID NO: 500705 - RNA, 18 nt, Chlamydophila pneumoniae CWL029
cuccaaaagaccaaaaau

SEQ ID NO: 500706 - RNA, 18 nt, Chlamydophila pneumoniae CWL029
cuccaaaagcucuacaag

SEQ ID NO: 500707 - RNA, 23 nt, Chlamydophila pneumoniae CWL029
cucauuucguagacgcucuaaac

SEQ ID NO: 500708 - RNA, 19 nt, Chlamydophila pneumoniae CWL029
cucuauauuuuuucccaca

SEQ ID NO: 500709 - RNA, 23 nt, Chlamydophila pneumoniae CWL029
cucuaucagggcuacgguaaaau

SEQ ID NO: 500710 - RNA, 23 nt, Chlamydophila pneumoniae CWL029
cugagcuuuuaguagguaauccc

SEQ ID NO: 500711 - RNA, 21 nt, Chlamydophila pneumoniae CWL029
cugaggaaaucgcauuacaaa

SEQ ID NO: 500712 - RNA, 17 nt, Chlamydophila pneumoniae CWL029
cugaggacgcagagaug

SEQ ID NO: 500713 - RNA, 16 nt, Chlamydophila pneumoniae CWL029
cugagcuaucuucaag

SEQ ID NO: 500714 - RNA, 17 nt, Chlamydophila pneumoniae CWL029
cugagcuucuauuucua

SEQ ID NO: 500715 - RNA, 14 nt, Chlamydophila pneumoniae CWL029
cugagguugggcag

SEQ ID NO: 500716 - RNA, 16 nt, Chlamydophila pneumoniae CWL029
cugagguuauuuaauc

SEQ ID NO: 500717 - RNA, 17 nt, Chlamydophila pneumoniae CWL029
cugagggaucuucucua

SEQ ID NO: 500718 - RNA, 22 nt, Chlamydophila pneumoniae CWL029
cugaggcuauagaauacacagc

SEQ ID NO: 500719 - RNA, 23 nt, Chlamydophila pneumoniae CWL029
cugagucauaagcucuauuucug

SEQ ID NO: 500720 - RNA, 15 nt, Chlamydophila pneumoniae CWL029
cugauaagaucauag

SEQ ID NO: 500721 - RNA, 17 nt, Chlamydophila pneumoniae CWL029
cugauaaaauaaacucu

SEQ ID NO: 500722 - RNA, 20 nt, Chlamydophila pneumoniae CWL029
cugauaaucagaggagccuc

SEQ ID NO: 500723 - RNA, 21 nt, Chlamydophila pneumoniae CWL029
cugauccucggcaucuuuggc

SEQ ID NO: 500724 - RNA, 17 nt, Chlamydophila pneumoniae CWL029
cugauccagcuccauaa

SEQ ID NO: 500725 - RNA, 17 nt, Chlamydophila pneumoniae CWL029
cugcagagaaauucaug

SEQ ID NO: 500726 - RNA, 12 nt, Chlamydophila pneumoniae CWL029
cugcagcaaaac

SEQ ID NO: 500727 - RNA, 20 nt, Chlamydophila pneumoniae CWL029
cugcagcaaaacuaggaaaa

SEQ ID NO: 500728 - RNA, 21 nt, Chlamydophila pneumoniae CWL029
cugcaguauuauaaauagaaa

SEQ ID NO: 500729 - RNA, 19 nt, Chlamydophila pneumoniae CWL029
cugcaguauuauaaauaga

SEQ ID NO: 500730 - RNA, 20 nt, Chlamydophila pneumoniae CWL029
cugcaguauuauaaauagaa

SEQ ID NO: 500731 - RNA, 23 nt, Chlamydophila pneumoniae CWL029
cugcaaucagugcugccaugaca

SEQ ID NO: 500732 - RNA, 18 nt, Chlamydophila pneumoniae CWL029
cugcacuuucuuuuuuaa

SEQ ID NO: 500733 - RNA, 11 nt, Chlamydophila pneumoniae CWL029
cugcagaagua

SEQ ID NO: 500734 - RNA, 23 nt, Chlamydophila pneumoniae CWL029
cugcaaacgcaaugauuucucua

SEQ ID NO: 500735 - RNA, 22 nt, Chlamydophila pneumoniae CWL029
cugcaaacuccccaguuuucca

SEQ ID NO: 500736 - RNA, 21 nt, Chlamydophila pneumoniae CWL029
cugauuucuuuuucagcuucu

SEQ ID NO: 500737 - RNA, 17 nt, Chlamydophila pneumoniae CWL029
cugaugucuccauacag

SEQ ID NO: 500738 - RNA, 17 nt, Chlamydophila pneumoniae CWL029
cugauguuuuauagaua

SEQ ID NO: 500739 - RNA, 20 nt, Chlamydophila pneumoniae CWL029
cugauuaguucucuaagacu

SEQ ID NO: 500740 - RNA, 16 nt, Chlamydophila pneumoniae CWL029
cugcguuucuuucuga

SEQ ID NO: 500741 - RNA, 15 nt, Chlamydophila pneumoniae CWL029
cugcuaaacagggaa

SEQ ID NO: 500742 - RNA, 17 nt, Chlamydophila pneumoniae CWL029
cugcgugauuauuuaag

SEQ ID NO: 500743 - RNA, 22 nt, Chlamydophila pneumoniae CWL029
cugcgugauuauuuaagaccaa

SEQ ID NO: 500744 - RNA, 15 nt, Chlamydophila pneumoniae CWL029
cugcccuuucugcaa

SEQ ID NO: 500745 - RNA, 15 nt, Chlamydophila pneumoniae CWL029
cugccucacagcuaa

SEQ ID NO: 500746 - RNA, 16 nt, Chlamydophila pneumoniae CWL029
cugcauaaucucacca

SEQ ID NO: 500747 - RNA, 22 nt, Chlamydophila pneumoniae CWL029
cuguauuaaagaaucuaacucu

SEQ ID NO: 500748 - RNA, 23 nt, Chlamydophila pneumoniae CWL029
cuguauuuuauagcguugauucc

SEQ ID NO: 500749 - RNA, 15 nt, Chlamydophila pneumoniae CWL029
cuguauuuucagcac

SEQ ID NO: 500750 - RNA, 12 nt, Chlamydophila pneumoniae CWL029
cugucagaacaa

SEQ ID NO: 500751 - RNA, 20 nt, Chlamydophila pneumoniae CWL029
cuguaacacccucccucaua

SEQ ID NO: 500752 - RNA, 21 nt, Chlamydophila pneumoniae CWL029
cuguaacacccucccucauaa

SEQ ID NO: 500753 - RNA, 21 nt, Chlamydophila pneumoniae CWL029
cuguaaagaccaaauagagag

SEQ ID NO: 500754 - RNA, 12 nt, Chlamydophila pneumoniae CWL029
cuguaaauccgg

SEQ ID NO: 500755 - RNA, 15 nt, Chlamydophila pneumoniae CWL029
cugguuuuucgauuu

SEQ ID NO: 500756 - RNA, 17 nt, Chlamydophila pneumoniae CWL029
cugguuuuucuccugac

SEQ ID NO: 500757 - RNA, 18 nt, Chlamydophila pneumoniae CWL029
cugguuuuucuccugacu

SEQ ID NO: 500758 - RNA, 18 nt, Chlamydophila pneumoniae CWL029
cuguaguaaaauaagaaa

SEQ ID NO: 500759 - RNA, 16 nt, Chlamydophila pneumoniae CWL029
cuguagugauacuuua

SEQ ID NO: 500760 - RNA, 21 nt, Chlamydophila pneumoniae CWL029
cuguagguuuuuccaacuuca

SEQ ID NO: 500761 - RNA, 22 nt, Chlamydophila pneumoniae CWL029
cuguagguuuuuccaacuucaa

SEQ ID NO: 500762 - RNA, 21 nt, Chlamydophila pneumoniae CWL029
cuguaauuuuuuucaaaggag

SEQ ID NO: 500763 - RNA, 17 nt, Chlamydophila pneumoniae CWL029
cugguauagacuccuua

SEQ ID NO: 500764 - RNA, 17 nt, Chlamydophila pneumoniae CWL029
cugguacuuauguacug

SEQ ID NO: 500765 - RNA, 16 nt, Chlamydophila pneumoniae CWL029
cuggucucaugaccuu

SEQ ID NO: 500766 - RNA, 18 nt, Chlamydophila pneumoniae CWL029
cuggucuguauuuucuuc

SEQ ID NO: 500767 - RNA, 23 nt, Chlamydophila pneumoniae CWL029
cugggugcgucguaaucuuuuuu

SEQ ID NO: 500768 - RNA, 19 nt, Chlamydophila pneumoniae CWL029
cugggcuuauuauugaaua

SEQ ID NO: 500769 - RNA, 14 nt, Chlamydophila pneumoniae CWL029
cuggcgacuugcca

SEQ ID NO: 500770 - RNA, 16 nt, Chlamydophila pneumoniae CWL029
cuggaguggaggauac

SEQ ID NO: 500771 - RNA, 15 nt, Chlamydophila pneumoniae CWL029
cuggaguagcucaau

SEQ ID NO: 500772 - RNA, 22 nt, Chlamydophila pneumoniae CWL029
cuggaaagccaagcuuccaacu

SEQ ID NO: 500773 - RNA, 14 nt, Chlamydophila pneumoniae CWL029
cuggaaagccaagc

SEQ ID NO: 500774 - RNA, 19 nt, Chlamydophila pneumoniae CWL029
cuggaaugacauaagcacu

SEQ ID NO: 500775 - RNA, 20 nt, Chlamydophila pneumoniae CWL029
cuggaaggucgcugauaaaa

SEQ ID NO: 500776 - RNA, 17 nt, Chlamydophila pneumoniae CWL029
cuggagagguaaccaga

SEQ ID NO: 500777 - RNA, 13 nt, Chlamydophila pneumoniae CWL029
cuggaauuuccca

SEQ ID NO: 500778 - RNA, 18 nt, Chlamydophila pneumoniae CWL029
cugcuuuuguuguuuuug

SEQ ID NO: 500779 - RNA, 20 nt, Chlamydophila pneumoniae CWL029
cugcuuuuuuucuagaguuc

SEQ ID NO: 500780 - RNA, 14 nt, Chlamydophila pneumoniae CWL029
cugcuuuuuuucua

SEQ ID NO: 500781 - RNA, 19 nt, Chlamydophila pneumoniae CWL029
cugcuagaguccaagguuc

SEQ ID NO: 500782 - RNA, 14 nt, Chlamydophila pneumoniae CWL029
cugcucaaugacac

SEQ ID NO: 500783 - RNA, 23 nt, Chlamydophila pneumoniae CWL029
cugcuacgugaucaaaauuaucc

SEQ ID NO: 500784 - RNA, 17 nt, Chlamydophila pneumoniae CWL029
cugcuacuuuaaagugg

SEQ ID NO: 500785 - RNA, 12 nt, Chlamydophila pneumoniae CWL029
cugcuagagcuu

SEQ ID NO: 500786 - RNA, 12 nt, Chlamydophila pneumoniae CWL029
cugcuccaaaau

SEQ ID NO: 500787 - RNA, 17 nt, Chlamydophila pneumoniae CWL029
cuguuuuucguaagcug

SEQ ID NO: 500788 - RNA, 22 nt, Chlamydophila pneumoniae CWL029
cuguuuuuugaaaacuucaaaa

SEQ ID NO: 500789 - RNA, 17 nt, Chlamydophila pneumoniae CWL029
cuuaaaaaacuuccuaa

SEQ ID NO: 500790 - RNA, 16 nt, Chlamydophila pneumoniae CWL029
cuuaaaaaacuuccua

SEQ ID NO: 500791 - RNA, 14 nt, Chlamydophila pneumoniae CWL029
cuuaaaacaugaga

SEQ ID NO: 500792 - RNA, 12 nt, Chlamydophila pneumoniae CWL029
cuuaaaauauua

SEQ ID NO: 500793 - RNA, 15 nt, Chlamydophila pneumoniae CWL029
cuuaaaauucuguaa

SEQ ID NO: 500794 - RNA, 20 nt, Chlamydophila pneumoniae CWL029
cuuaaaauucuguaaaguga

SEQ ID NO: 500795 - RNA, 19 nt, Chlamydophila pneumoniae CWL029
cuguuuauggauuaucuua

SEQ ID NO: 500796 - RNA, 18 nt, Chlamydophila pneumoniae CWL029
cuguuuucacauggccaa

SEQ ID NO: 500797 - RNA, 19 nt, Chlamydophila pneumoniae CWL029
cugucguccuaauuuuccu

SEQ ID NO: 500798 - RNA, 21 nt, Chlamydophila pneumoniae CWL029
cuguuguacuaucacagccau

SEQ ID NO: 500799 - RNA, 23 nt, Chlamydophila pneumoniae CWL029
cuguuguacuaucacagccaucg

SEQ ID NO: 500800 - RNA, 19 nt, Chlamydophila pneumoniae CWL029
cuguugggagcuuccucca

SEQ ID NO: 500801 - RNA, 20 nt, Chlamydophila pneumoniae CWL029
cuguugggagcuuccuccaa

SEQ ID NO: 500802 - RNA, 15 nt, Chlamydophila pneumoniae CWL029
cuguugcacuuuccg

SEQ ID NO: 500803 - RNA, 17 nt, Chlamydophila pneumoniae CWL029
cuguugcauuagauacg

SEQ ID NO: 500804 - RNA, 23 nt, Chlamydophila pneumoniae CWL029
cuuacggauacguugguucaaau

SEQ ID NO: 500805 - RNA, 17 nt, Chlamydophila pneumoniae CWL029
cuuacguaaacuauacu

SEQ ID NO: 500806 - RNA, 20 nt, Chlamydophila pneumoniae CWL029
cuuacuaaagaaagagucuc

SEQ ID NO: 500807 - RNA, 15 nt, Chlamydophila pneumoniae CWL029
cuuacuaaaggugaa

SEQ ID NO: 500808 - RNA, 18 nt, Chlamydophila pneumoniae CWL029
cuuacaagcuuccuuggu

SEQ ID NO: 500809 - RNA, 17 nt, Chlamydophila pneumoniae CWL029
cuuaauuuccuucucca

SEQ ID NO: 500810 - RNA, 16 nt, Chlamydophila pneumoniae CWL029
cuuaaagcuugagaaa

SEQ ID NO: 500811 - RNA, 20 nt, Chlamydophila pneumoniae CWL029
cuuaaagagaaucuccucau

SEQ ID NO: 500812 - RNA, 12 nt, Chlamydophila pneumoniae CWL029
cuuaaagaguuu

SEQ ID NO: 500813 - RNA, 23 nt, Chlamydophila pneumoniae CWL029
cuuaaagguaaaacuacaggaaa

SEQ ID NO: 500814 - RNA, 14 nt, Chlamydophila pneumoniae CWL029
cuuaauauaaaaga

SEQ ID NO: 500815 - RNA, 16 nt, Chlamydophila pneumoniae CWL029
cuuaauauaaaagaag

SEQ ID NO: 500816 - RNA, 13 nt, Chlamydophila pneumoniae CWL029
cuuaauuaaaaac

SEQ ID NO: 500817 - RNA, 13 nt, Chlamydophila pneumoniae CWL029
cuuauacacucca

SEQ ID NO: 500818 - RNA, 17 nt, Chlamydophila pneumoniae CWL029
cuuagcaaugaaggcca

SEQ ID NO: 500819 - RNA, 15 nt, Chlamydophila pneumoniae CWL029
cuuagcagcacccau

SEQ ID NO: 500820 - RNA, 17 nt, Chlamydophila pneumoniae CWL029
cuuauacccacaaagau

SEQ ID NO: 500821 - RNA, 16 nt, Chlamydophila pneumoniae CWL029
cuuauacccacaaaga

SEQ ID NO: 500822 - RNA, 19 nt, Chlamydophila pneumoniae CWL029
cuuauagggaauuuuuucu

SEQ ID NO: 500823 - RNA, 19 nt, Chlamydophila pneumoniae CWL029
cuuagagucuucgacaagg

SEQ ID NO: 500824 - RNA, 22 nt, Chlamydophila pneumoniae CWL029
cuuacugaagaaguaagcgauu

SEQ ID NO: 500825 - RNA, 14 nt, Chlamydophila pneumoniae CWL029
cuuacugaagaagu

SEQ ID NO: 500826 - RNA, 17 nt, Chlamydophila pneumoniae CWL029
cuuaucaagagcucgua

SEQ ID NO: 500827 - RNA, 16 nt, Chlamydophila pneumoniae CWL029
cuuaucccauaaaugu

SEQ ID NO: 500828 - RNA, 21 nt, Chlamydophila pneumoniae CWL029
cuuauccgucagccuuagcag

SEQ ID NO: 500829 - RNA, 14 nt, Chlamydophila pneumoniae CWL029
cuuauccucagggg

SEQ ID NO: 500830 - RNA, 15 nt, Chlamydophila pneumoniae CWL029
cuuauccugaacauc

SEQ ID NO: 500831 - RNA, 20 nt, Chlamydophila pneumoniae CWL029
cuuauccugaacaucuccag

SEQ ID NO: 500832 - RNA, 13 nt, Chlamydophila pneumoniae CWL029
cuuauccuuuuca

SEQ ID NO: 500833 - RNA, 22 nt, Chlamydophila pneumoniae CWL029
cuucagcauagagagaaggaau

SEQ ID NO: 500834 - RNA, 21 nt, Chlamydophila pneumoniae CWL029
cuucagcacgaauaaagcccu

SEQ ID NO: 500835 - RNA, 17 nt, Chlamydophila pneumoniae CWL029
cuucagcaacuaaagca

SEQ ID NO: 500836 - RNA, 22 nt, Chlamydophila pneumoniae CWL029
cuucagcccacuguuuugcuuc

SEQ ID NO: 500837 - RNA, 23 nt, Chlamydophila pneumoniae CWL029
cuucagagauuuuaaagccuccu

SEQ ID NO: 500838 - RNA, 22 nt, Chlamydophila pneumoniae CWL029
cuuauguuaaaaauaccaagau

SEQ ID NO: 500839 - RNA, 22 nt, Chlamydophila pneumoniae CWL029
cuuauuacagaaaggcuuuucu

SEQ ID NO: 500840 - RNA, 15 nt, Chlamydophila pneumoniae CWL029
cuuauuacagaaagg

SEQ ID NO: 500841 - RNA, 14 nt, Chlamydophila pneumoniae CWL029
cuuaucuaaagaaa

SEQ ID NO: 500842 - RNA, 14 nt, Chlamydophila pneumoniae CWL029
cuucacaagaaaac

SEQ ID NO: 500843 - RNA, 19 nt, Chlamydophila pneumoniae CWL029
cuuauuauugaauaagcuu

SEQ ID NO: 500844 - RNA, 12 nt, Chlamydophila pneumoniae CWL029
cuucaucagaag

SEQ ID NO: 500845 - RNA, 19 nt, Chlamydophila pneumoniae CWL029
cuucaucaaaacauaauga

SEQ ID NO: 500846 - RNA, 16 nt, Chlamydophila pneumoniae CWL029
cuucauaugcucuccc

SEQ ID NO: 500847 - RNA, 21 nt, Chlamydophila pneumoniae CWL029
cuucauccgaagacucaaaga

SEQ ID NO: 500848 - RNA, 19 nt, Chlamydophila pneumoniae CWL029
cuucagcuuguuuuugcaa

SEQ ID NO: 500849 - RNA, 16 nt, Chlamydophila pneumoniae CWL029
cuucaggauuacggaa

SEQ ID NO: 500850 - RNA, 21 nt, Chlamydophila pneumoniae CWL029
cuucaggugaaggaagaucuu

SEQ ID NO: 500851 - RNA, 15 nt, Chlamydophila pneumoniae CWL029
cuucagucugaugua

SEQ ID NO: 500852 - RNA, 17 nt, Chlamydophila pneumoniae CWL029
cuuccugauucuguaua

SEQ ID NO: 500853 - RNA, 15 nt, Chlamydophila pneumoniae CWL029
cuucgaugucuuucc

SEQ ID NO: 500854 - RNA, 21 nt, Chlamydophila pneumoniae CWL029
cuucgaugucuuuccaggcaa

SEQ ID NO: 500855 - RNA, 19 nt, Chlamydophila pneumoniae CWL029
cuucgauguuauaagugac

SEQ ID NO: 500856 - RNA, 17 nt, Chlamydophila pneumoniae CWL029
cuucgauuguaacuucg

SEQ ID NO: 500857 - RNA, 15 nt, Chlamydophila pneumoniae CWL029
cuucgcaaauuuuuc

SEQ ID NO: 500858 - RNA, 16 nt, Chlamydophila pneumoniae CWL029
cuuccucuuuuauaua

SEQ ID NO: 500859 - RNA, 22 nt, Chlamydophila pneumoniae CWL029
cuucgccuuggguuugucucca

SEQ ID NO: 500860 - RNA, 20 nt, Chlamydophila pneumoniae CWL029
cuucccaagcagaagacccu

SEQ ID NO: 500861 - RNA, 14 nt, Chlamydophila pneumoniae CWL029
cuucccagccuuga

SEQ ID NO: 500862 - RNA, 18 nt, Chlamydophila pneumoniae CWL029
cuucauuuucuuuuaaga

SEQ ID NO: 500863 - RNA, 17 nt, Chlamydophila pneumoniae CWL029
cuuccaaaaguaggggc

SEQ ID NO: 500864 - RNA, 19 nt, Chlamydophila pneumoniae CWL029
cuuccaaaaguaggggcag

SEQ ID NO: 500865 - RNA, 23 nt, Chlamydophila pneumoniae CWL029
cuuccauacaggcuccucugcua

SEQ ID NO: 500866 - RNA, 23 nt, Chlamydophila pneumoniae CWL029
cuuccauaugagguaauccucga

SEQ ID NO: 500867 - RNA, 11 nt, Chlamydophila pneumoniae CWL029
cuucauucaca

SEQ ID NO: 500868 - RNA, 14 nt, Chlamydophila pneumoniae CWL029
cuucauugcaaaaa

SEQ ID NO: 500869 - RNA, 21 nt, Chlamydophila pneumoniae CWL029
cuuucuccagcauuuuugggg

SEQ ID NO: 500870 - RNA, 13 nt, Chlamydophila pneumoniae CWL029
cuuucuaggaucu

SEQ ID NO: 500871 - RNA, 17 nt, Chlamydophila pneumoniae CWL029
cuuucuaggaucucuag

SEQ ID NO: 500872 - RNA, 22 nt, Chlamydophila pneumoniae CWL029
cuuucuaggccgggauuuuaau

SEQ ID NO: 500873 - RNA, 20 nt, Chlamydophila pneumoniae CWL029
cuuucuauuucgucgucauc

SEQ ID NO: 500874 - RNA, 13 nt, Chlamydophila pneumoniae CWL029
cuuucgaugcuau

SEQ ID NO: 500875 - RNA, 11 nt, Chlamydophila pneumoniae CWL029
cuuuccucucu

SEQ ID NO: 500876 - RNA, 20 nt, Chlamydophila pneumoniae CWL029
cuuucccuaagcaaaaacuu

SEQ ID NO: 500877 - RNA, 22 nt, Chlamydophila pneumoniae CWL029
cuuuccauaaagccccacccac

SEQ ID NO: 500878 - RNA, 12 nt, Chlamydophila pneumoniae CWL029
cuuucauucccu

SEQ ID NO: 500879 - RNA, 14 nt, Chlamydophila pneumoniae CWL029
cuuucacaaagaau

SEQ ID NO: 500880 - RNA, 20 nt, Chlamydophila pneumoniae CWL029
cuuucacgauaucuaccaaa

SEQ ID NO: 500881 - RNA, 21 nt, Chlamydophila pneumoniae CWL029
cuuuaaucaagccuaaaucua

SEQ ID NO: 500882 - RNA, 15 nt, Chlamydophila pneumoniae CWL029
cuuuaauccugcaau

SEQ ID NO: 500883 - RNA, 17 nt, Chlamydophila pneumoniae CWL029
cuuuaauccaguuuuuu

SEQ ID NO: 500884 - RNA, 20 nt, Chlamydophila pneumoniae CWL029
cuuuaaauucgccaaacgaa

SEQ ID NO: 500885 - RNA, 18 nt, Chlamydophila pneumoniae CWL029
cuuuaaauuuuuuaggau

SEQ ID NO: 500886 - RNA, 18 nt, Chlamydophila pneumoniae CWL029
cuuuaaaaauauaucuuc

SEQ ID NO: 500887 - RNA, 13 nt, Chlamydophila pneumoniae CWL029
cuuguucuucauu

SEQ ID NO: 500888 - RNA, 19 nt, Chlamydophila pneumoniae CWL029
cuuguucuucuugauuaag

SEQ ID NO: 500889 - RNA, 18 nt, Chlamydophila pneumoniae CWL029
cuuguuggauugaaaagc

SEQ ID NO: 500890 - RNA, 15 nt, Chlamydophila pneumoniae CWL029
cuuguugcaauugcc

SEQ ID NO: 500891 - RNA, 16 nt, Chlamydophila pneumoniae CWL029
cuuguugcaugggaau

SEQ ID NO: 500892 - RNA, 18 nt, Chlamydophila pneumoniae CWL029
cuuguuucguaagagaau

SEQ ID NO: 500893 - RNA, 23 nt, Chlamydophila pneumoniae CWL029
cuuguuucguaagagaauuauua

SEQ ID NO: 500894 - RNA, 15 nt, Chlamydophila pneumoniae CWL029
cuuguuucuguuuuc

SEQ ID NO: 500895 - RNA, 22 nt, Chlamydophila pneumoniae CWL029
cuugugcaucuauaauuaaucc

SEQ ID NO: 500896 - RNA, 22 nt, Chlamydophila pneumoniae CWL029
cuugugcuaaagcaggagcauc

SEQ ID NO: 500897 - RNA, 13 nt, Chlamydophila pneumoniae CWL029
cuugugagaugaa

SEQ ID NO: 500898 - RNA, 14 nt, Chlamydophila pneumoniae CWL029
cuugugagaugaac

SEQ ID NO: 500899 - RNA, 22 nt, Chlamydophila pneumoniae CWL029
cuuguuaugaugauccacugcu

SEQ ID NO: 500900 - RNA, 13 nt, Chlamydophila pneumoniae CWL029
cuuguuaugaaaa

SEQ ID NO: 500901 - RNA, 18 nt, Chlamydophila pneumoniae CWL029
cuuguaagacuaaaaaag

SEQ ID NO: 500902 - RNA, 21 nt, Chlamydophila pneumoniae CWL029
cuuguaagacuaaaaaagaga

SEQ ID NO: 500903 - RNA, 19 nt, Chlamydophila pneumoniae CWL029
cuuguaaguuacggaacuc

SEQ ID NO: 500904 - RNA, 18 nt, Chlamydophila pneumoniae CWL029
cuugcugauuucuuuuuc

SEQ ID NO: 500905 - RNA, 23 nt, Chlamydophila pneumoniae CWL029
cuugcuuugugaguucuuccuuc

SEQ ID NO: 500906 - RNA, 16 nt, Chlamydophila pneumoniae CWL029
cuugcuuuuaacgcua

SEQ ID NO: 500907 - RNA, 17 nt, Chlamydophila pneumoniae CWL029
cuugcucuuuaauaagg

SEQ ID NO: 500908 - RNA, 22 nt, Chlamydophila pneumoniae CWL029
cuugcugauccucggcaucuuu

SEQ ID NO: 500909 - RNA, 18 nt, Chlamydophila pneumoniae CWL029
cuugcagcccugcauagu

SEQ ID NO: 500910 - RNA, 15 nt, Chlamydophila pneumoniae CWL029
cuugauucucuucca

SEQ ID NO: 500911 - RNA, 15 nt, Chlamydophila pneumoniae CWL029
cuugagguauuccua

SEQ ID NO: 500912 - RNA, 16 nt, Chlamydophila pneumoniae CWL029
cuugauacugaauccc

SEQ ID NO: 500913 - RNA, 20 nt, Chlamydophila pneumoniae CWL029
cuugauaaaacgcuauuguu

SEQ ID NO: 500914 - RNA, 17 nt, Chlamydophila pneumoniae CWL029
cuugauaaaagauagug

SEQ ID NO: 500915 - RNA, 17 nt, Chlamydophila pneumoniae CWL029
cuucuuguuuuugugga

SEQ ID NO: 500916 - RNA, 16 nt, Chlamydophila pneumoniae CWL029
cuucuuuacucaagug

SEQ ID NO: 500917 - RNA, 20 nt, Chlamydophila pneumoniae CWL029
cuucuuuaggguaaagaaau

SEQ ID NO: 500918 - RNA, 23 nt, Chlamydophila pneumoniae CWL029
cuugaaaguacaggcuccaucac

SEQ ID NO: 500919 - RNA, 13 nt, Chlamydophila pneumoniae CWL029
cuugaaacucuau

SEQ ID NO: 500920 - RNA, 23 nt, Chlamydophila pneumoniae CWL029
cuugaggaggauugacaaucgcu

SEQ ID NO: 500921 - RNA, 23 nt, Chlamydophila pneumoniae CWL029
cuugagccaacagguucacuuca

SEQ ID NO: 500922 - RNA, 19 nt, Chlamydophila pneumoniae CWL029
cuugaaauugcucuugcuc

SEQ ID NO: 500923 - RNA, 18 nt, Chlamydophila pneumoniae CWL029
cuugaacagagacuuccu

SEQ ID NO: 500924 - RNA, 14 nt, Chlamydophila pneumoniae CWL029
cuucuuguuuuugu

SEQ ID NO: 500925 - RNA, 21 nt, Chlamydophila pneumoniae CWL029
cuucuuggcguuccagcuccu

SEQ ID NO: 500926 - RNA, 14 nt, Chlamydophila pneumoniae CWL029
cuucuugauuaaga

SEQ ID NO: 500927 - RNA, 12 nt, Chlamydophila pneumoniae CWL029
cuucuugcaaag

SEQ ID NO: 500928 - RNA, 16 nt, Chlamydophila pneumoniae CWL029
cuucuugcaaagauaa

SEQ ID NO: 500929 - RNA, 22 nt, Chlamydophila pneumoniae CWL029
cuucuucuggcugagagaagca

SEQ ID NO: 500930 - RNA, 20 nt, Chlamydophila pneumoniae CWL029
cuucuucccuuucaaaggca

SEQ ID NO: 500931 - RNA, 18 nt, Chlamydophila pneumoniae CWL029
cuucuucccagccuugau

SEQ ID NO: 500932 - RNA, 15 nt, Chlamydophila pneumoniae CWL029
cuucuucaaagucaa

SEQ ID NO: 500933 - RNA, 14 nt, Chlamydophila pneumoniae CWL029
cuucuucaagaaau

SEQ ID NO: 500934 - RNA, 16 nt, Chlamydophila pneumoniae CWL029
cuucuuaguaaagaau

SEQ ID NO: 500935 - RNA, 14 nt, Chlamydophila pneumoniae CWL029
cuucuuaucuucua

SEQ ID NO: 500936 - RNA, 14 nt, Chlamydophila pneumoniae CWL029
cuucuucagagcuc

SEQ ID NO: 500937 - RNA, 12 nt, Chlamydophila pneumoniae CWL029
cuucuucagagu

SEQ ID NO: 500938 - RNA, 18 nt, Chlamydophila pneumoniae CWL029
cuucuuagaagagaaagu

SEQ ID NO: 500939 - RNA, 17 nt, Chlamydophila pneumoniae CWL029
cuucuuagccaaaauuu

SEQ ID NO: 500940 - RNA, 12 nt, Chlamydophila pneumoniae CWL029
cuucugugcauc

SEQ ID NO: 500941 - RNA, 17 nt, Chlamydophila pneumoniae CWL029
cuucugugcaucaguca

SEQ ID NO: 500942 - RNA, 18 nt, Chlamydophila pneumoniae CWL029
cuucuggguucuccacau

SEQ ID NO: 500943 - RNA, 16 nt, Chlamydophila pneumoniae CWL029
cuucuggcugagagaa

SEQ ID NO: 500944 - RNA, 15 nt, Chlamydophila pneumoniae CWL029
cuucuguaggaacaa

SEQ ID NO: 500945 - RNA, 23 nt, Chlamydophila pneumoniae CWL029
cuucuguaauuuuuuucaaagga

SEQ ID NO: 500946 - RNA, 15 nt, Chlamydophila pneumoniae CWL029
cuucugcaggauuug

SEQ ID NO: 500947 - RNA, 23 nt, Chlamydophila pneumoniae CWL029
cuucuggauacguuuuucccuuu

SEQ ID NO: 500948 - RNA, 15 nt, Chlamydophila pneumoniae CWL029
cuucuggagaaaaaa

SEQ ID NO: 500949 - RNA, 17 nt, Chlamydophila pneumoniae CWL029
cuucugauacaucauca

SEQ ID NO: 500950 - RNA, 14 nt, Chlamydophila pneumoniae CWL029
cuucugacaauaac

SEQ ID NO: 500951 - RNA, 16 nt, Chlamydophila pneumoniae CWL029
cuucugacaauaacau

SEQ ID NO: 500952 - RNA, 21 nt, Chlamydophila pneumoniae CWL029
cuucucuuaugaaguccagac

SEQ ID NO: 500953 - RNA, 22 nt, Chlamydophila pneumoniae CWL029
cuucucuguugggagcuuccuc

SEQ ID NO: 500954 - RNA, 22 nt, Chlamydophila pneumoniae CWL029
cuucucuaguuguaauuucuug

SEQ ID NO: 500955 - RNA, 14 nt, Chlamydophila pneumoniae CWL029
cuucucuauaaaaa

SEQ ID NO: 500956 - RNA, 15 nt, Chlamydophila pneumoniae CWL029
cuucucucuuaaauu

SEQ ID NO: 500957 - RNA, 14 nt, Chlamydophila pneumoniae CWL029
cuucucuacuaaaa

SEQ ID NO: 500958 - RNA, 18 nt, Chlamydophila pneumoniae CWL029
cuucucuaguuguaauuu

SEQ ID NO: 500959 - RNA, 22 nt, Chlamydophila pneumoniae CWL029
cuucucgguuuaaggcaauaga

SEQ ID NO: 500960 - RNA, 19 nt, Chlamydophila pneumoniae CWL029
cuucucgucauucugcaag

SEQ ID NO: 500961 - RNA, 13 nt, Chlamydophila pneumoniae CWL029
cuucucccucuaa

SEQ ID NO: 500962 - RNA, 14 nt, Chlamydophila pneumoniae CWL029
cuucucccuguauu

SEQ ID NO: 500963 - RNA, 13 nt, Chlamydophila pneumoniae CWL029
cuucuccucgcaa

SEQ ID NO: 500964 - RNA, 16 nt, Chlamydophila pneumoniae CWL029
cuucuccucgcaaucc

SEQ ID NO: 500965 - RNA, 14 nt, Chlamydophila pneumoniae CWL029
gaacuugggaugcu

SEQ ID NO: 500966 - RNA, 14 nt, Chlamydophila pneumoniae CWL029
gaacuuuagggaag

SEQ ID NO: 500967 - RNA, 20 nt, Chlamydophila pneumoniae CWL029
gaacuuuagggaagaaauua

SEQ ID NO: 500968 - RNA, 16 nt, Chlamydophila pneumoniae CWL029
gaacuuucgucuuugc

SEQ ID NO: 500969 - RNA, 16 nt, Chlamydophila pneumoniae CWL029
gaagaacuuagcaaug

SEQ ID NO: 500970 - RNA, 14 nt, Chlamydophila pneumoniae CWL029
gaagaaauuaacaa

SEQ ID NO: 500971 - RNA, 15 nt, Chlamydophila pneumoniae CWL029
gaagaaaggaccauu

SEQ ID NO: 500972 - RNA, 19 nt, Chlamydophila pneumoniae CWL029
gaagaaacuucucuaggaa

SEQ ID NO: 500973 - RNA, 17 nt, Chlamydophila pneumoniae CWL029
gaagacuuguucuucau

SEQ ID NO: 500974 - RNA, 23 nt, Chlamydophila pneumoniae CWL029
gaagaaguacaagugaagacaag

SEQ ID NO: 500975 - RNA, 13 nt, Chlamydophila pneumoniae CWL029
gaagaagggacuu

SEQ ID NO: 500976 - RNA, 18 nt, Chlamydophila pneumoniae CWL029
gaagaauuucgucuucau

SEQ ID NO: 500977 - RNA, 14 nt, Chlamydophila pneumoniae CWL029
gaagacaaguaaac

SEQ ID NO: 500978 - RNA, 21 nt, Chlamydophila pneumoniae CWL029
gaagacaaguaaacagcaaag

SEQ ID NO: 500979 - RNA, 14 nt, Chlamydophila pneumoniae CWL029
gaagcaagaaucac

SEQ ID NO: 500980 - RNA, 18 nt, Chlamydophila pneumoniae CWL029
gaagcagaaacuuuaaaa

SEQ ID NO: 500981 - RNA, 17 nt, Chlamydophila pneumoniae CWL029
gaagcagggaaaaugcg

SEQ ID NO: 500982 - RNA, 15 nt, Chlamydophila pneumoniae CWL029
gaagcaguuuaggua

SEQ ID NO: 500983 - RNA, 18 nt, Chlamydophila pneumoniae CWL029
gaagcaacuaaacucucc

SEQ ID NO: 500984 - RNA, 20 nt, Chlamydophila pneumoniae CWL029
gaagcaacuaaacucuccaa

SEQ ID NO: 500985 - RNA, 16 nt, Chlamydophila pneumoniae CWL029
gaagauuuagggaaga

SEQ ID NO: 500986 - RNA, 18 nt, Chlamydophila pneumoniae CWL029
gaagauggcaaggaaaau

SEQ ID NO: 500987 - RNA, 23 nt, Chlamydophila pneumoniae CWL029
gaagauguauaaggauaucuucu

SEQ ID NO: 500988 - RNA, 15 nt, Chlamydophila pneumoniae CWL029
gaagauucaaagaag

SEQ ID NO: 500989 - RNA, 12 nt, Chlamydophila pneumoniae CWL029
gaagauucaagc

SEQ ID NO: 500990 - RNA, 20 nt, Chlamydophila pneumoniae CWL029
gaagagcauuuaaaacggcu

SEQ ID NO: 500991 - RNA, 19 nt, Chlamydophila pneumoniae CWL029
gaagagcaauuaagaaacu

SEQ ID NO: 500992 - RNA, 21 nt, Chlamydophila pneumoniae CWL029
gaagauauuaucgauaggaag

SEQ ID NO: 500993 - RNA, 13 nt, Chlamydophila pneumoniae CWL029
gaagauaaauccg

SEQ ID NO: 500994 - RNA, 15 nt, Chlamydophila pneumoniae CWL029
gaagaguuguugugg

SEQ ID NO: 500995 - RNA, 17 nt, Chlamydophila pneumoniae CWL029
gaagaucuugaacagag

SEQ ID NO: 500996 - RNA, 18 nt, Chlamydophila pneumoniae CWL029
gaagaucucccgaugagg

SEQ ID NO: 500997 - RNA, 13 nt, Chlamydophila pneumoniae CWL029
gaagauccugagu

SEQ ID NO: 500998 - RNA, 19 nt, Chlamydophila pneumoniae CWL029
gaagaucgucggaagacuu

SEQ ID NO: 500999 - RNA, 21 nt, Chlamydophila pneumoniae CWL029
gaaggccaagauucucacucu

SEQ ID NO: 501000 - RNA, 12 nt, Chlamydophila pneumoniae CWL029
gaaggcagagaa

SEQ ID NO: 501001 - RNA, 18 nt, Chlamydophila pneumoniae CWL029
gaaggaucugaugcacca

SEQ ID NO: 501002 - RNA, 21 nt, Chlamydophila pneumoniae CWL029
gaaggaucauaccgacaagca

SEQ ID NO: 501003 - RNA, 15 nt, Chlamydophila pneumoniae CWL029
gaaggcaccaacacu

SEQ ID NO: 501004 - RNA, 23 nt, Chlamydophila pneumoniae CWL029
gaaggcaccaacacuuuuaaaga

SEQ ID NO: 501005 - RNA, 23 nt, Chlamydophila pneumoniae CWL029
gaagcugucgcaaaugcagucuc

SEQ ID NO: 501006 - RNA, 14 nt, Chlamydophila pneumoniae CWL029
gaagcuucaaugau

SEQ ID NO: 501007 - RNA, 17 nt, Chlamydophila pneumoniae CWL029
gaaggaggaguccuucu

SEQ ID NO: 501008 - RNA, 13 nt, Chlamydophila pneumoniae CWL029
gaaggaauuugcu

SEQ ID NO: 501009 - RNA, 15 nt, Chlamydophila pneumoniae CWL029
gaagcucuaucuuug

SEQ ID NO: 501010 - RNA, 15 nt, Chlamydophila pneumoniae CWL029
gaagcugacaaauag

SEQ ID NO: 501011 - RNA, 17 nt, Chlamydophila pneumoniae CWL029
gaagcucuucuacuuua

SEQ ID NO: 501012 - RNA, 19 nt, Chlamydophila pneumoniae CWL029
gaagcugucguccuaauuu

SEQ ID NO: 501013 - RNA, 18 nt, Chlamydophila pneumoniae CWL029
gaagcugcucguuuuagc

SEQ ID NO: 501014 - RNA, 13 nt, Chlamydophila pneumoniae CWL029
gaagcugcugcua

SEQ ID NO: 501015 - RNA, 23 nt, Chlamydophila pneumoniae CWL029
gaagcuaucauuauacuucguua

SEQ ID NO: 501016 - RNA, 14 nt, Chlamydophila pneumoniae CWL029
gaagcguagcaaag

SEQ ID NO: 501017 - RNA, 21 nt, Chlamydophila pneumoniae CWL029
gaagcgccgcauuacagggaa

SEQ ID NO: 501018 - RNA, 19 nt, Chlamydophila pneumoniae CWL029
gaagcgccgcauuacaggg

SEQ ID NO: 501019 - RNA, 17 nt, Chlamydophila pneumoniae CWL029
gaagcgcgaggagcgau

SEQ ID NO: 501020 - RNA, 18 nt, Chlamydophila pneumoniae CWL029
gaagccauuuucuaagag

SEQ ID NO: 501021 - RNA, 16 nt, Chlamydophila pneumoniae CWL029
gaagccaccaucuguu

SEQ ID NO: 501022 - RNA, 23 nt, Chlamydophila pneumoniae CWL029
gaagcauucccgacucaaucaaa

SEQ ID NO: 501023 - RNA, 14 nt, Chlamydophila pneumoniae CWL029
gaagcaucuucgau

SEQ ID NO: 501024 - RNA, 17 nt, Chlamydophila pneumoniae CWL029
gaacuccuuugagucuu

SEQ ID NO: 501025 - RNA, 21 nt, Chlamydophila pneumoniae CWL029
gaacuccuuugagucuuuuuc

SEQ ID NO: 501026 - RNA, 19 nt, Chlamydophila pneumoniae CWL029
gaacucugcccgucuuaga

SEQ ID NO: 501027 - RNA, 23 nt, Chlamydophila pneumoniae CWL029
gaacucuuaaagguaaagcuucu

SEQ ID NO: 501028 - RNA, 15 nt, Chlamydophila pneumoniae CWL029
gaacucuuuaaaagg

SEQ ID NO: 501029 - RNA, 13 nt, Chlamydophila pneumoniae CWL029
gaacugaagaguc

SEQ ID NO: 501030 - RNA, 15 nt, Chlamydophila pneumoniae CWL029
gaacuguacgaauuu

SEQ ID NO: 501031 - RNA, 16 nt, Chlamydophila pneumoniae CWL029
gaacuuaaaauucaaa

SEQ ID NO: 501032 - RNA, 18 nt, Chlamydophila pneumoniae CWL029
gaacugggcauaguggcu

SEQ ID NO: 501033 - RNA, 23 nt, Chlamydophila pneumoniae CWL029
gaacguagcagaggcagguaguc

SEQ ID NO: 501034 - RNA, 23 nt, Chlamydophila pneumoniae CWL029
gaacgguugaggguucaauuccu

SEQ ID NO: 501035 - RNA, 21 nt, Chlamydophila pneumoniae CWL029
gaacguauacgucccacaaaa

SEQ ID NO: 501036 - RNA, 13 nt, Chlamydophila pneumoniae CWL029
gaacgugcugcga

SEQ ID NO: 501037 - RNA, 16 nt, Chlamydophila pneumoniae CWL029
gaacguuacgucuuag

SEQ ID NO: 501038 - RNA, 15 nt, Chlamydophila pneumoniae CWL029
gaacuaaaaguuuuu

SEQ ID NO: 501039 - RNA, 16 nt, Chlamydophila pneumoniae CWL029
gaacuaacuguaauuu

SEQ ID NO: 501040 - RNA, 23 nt, Chlamydophila pneumoniae CWL029
gaacuaccuaccuauuuaaggga

SEQ ID NO: 501041 - RNA, 22 nt, Chlamydophila pneumoniae CWL029
gaacuacgggcaauauauccag

SEQ ID NO: 501042 - RNA, 13 nt, Chlamydophila pneumoniae CWL029
gaacuagaaaaaa

SEQ ID NO: 501043 - RNA, 19 nt, Chlamydophila pneumoniae CWL029
gaacuauaggaagcucuuc

SEQ ID NO: 501044 - RNA, 15 nt, Chlamydophila pneumoniae CWL029
gaacgcugaguguau

SEQ ID NO: 501045 - RNA, 21 nt, Chlamydophila pneumoniae CWL029
gaacggacaaugcuaucucca

SEQ ID NO: 501046 - RNA, 13 nt, Chlamydophila pneumoniae CWL029
gaacgaagaaaac

SEQ ID NO: 501047 - RNA, 18 nt, Chlamydophila pneumoniae CWL029
gaacgaagacuuguucuu

SEQ ID NO: 501048 - RNA, 19 nt, Chlamydophila pneumoniae CWL029
gaacgaagacuuguucuuc

SEQ ID NO: 501049 - RNA, 21 nt, Chlamydophila pneumoniae CWL029
gaaccgucgagcucgcaaaag

SEQ ID NO: 501050 - RNA, 17 nt, Chlamydophila pneumoniae CWL029
gaaccucuaauuugaug

SEQ ID NO: 501051 - RNA, 17 nt, Chlamydophila pneumoniae CWL029
gaacccuggaugaacau

SEQ ID NO: 501052 - RNA, 19 nt, Chlamydophila pneumoniae CWL029
gaaccccccccccucucuc

SEQ ID NO: 501053 - RNA, 14 nt, Chlamydophila pneumoniae CWL029
gaauugcauuaaga

SEQ ID NO: 501054 - RNA, 14 nt, Chlamydophila pneumoniae CWL029
gaauucucaaguaa

SEQ ID NO: 501055 - RNA, 14 nt, Chlamydophila pneumoniae CWL029
gaauuguaguucuu

SEQ ID NO: 501056 - RNA, 17 nt, Chlamydophila pneumoniae CWL029
gaauuguguguuuucau

SEQ ID NO: 501057 - RNA, 16 nt, Chlamydophila pneumoniae CWL029
gaauuccucugauucc

SEQ ID NO: 501058 - RNA, 17 nt, Chlamydophila pneumoniae CWL029
gaauucauuaagauccu

SEQ ID NO: 501059 - RNA, 21 nt, Chlamydophila pneumoniae CWL029
gaauucaaacuccuuuuaaaa

SEQ ID NO: 501060 - RNA, 14 nt, Chlamydophila pneumoniae CWL029
gaauucaaacuccu

SEQ ID NO: 501061 - RNA, 17 nt, Chlamydophila pneumoniae CWL029
gaauuagagaaauuuuu

SEQ ID NO: 501062 - RNA, 21 nt, Chlamydophila pneumoniae CWL029
gaauuauuauuaguuaauuau

SEQ ID NO: 501063 - RNA, 23 nt, Chlamydophila pneumoniae CWL029
gaauuaaaaguuccaaaucucaa

SEQ ID NO: 501064 - RNA, 23 nt, Chlamydophila pneumoniae CWL029
gaauguugggggagcucgcuaaa

SEQ ID NO: 501065 - RNA, 19 nt, Chlamydophila pneumoniae CWL029
gaauguacauagaggagau

SEQ ID NO: 501066 - RNA, 19 nt, Chlamydophila pneumoniae CWL029
gaauguagccaauccuucc

SEQ ID NO: 501067 - RNA, 19 nt, Chlamydophila pneumoniae CWL029
gaauguaugugaaagauua

SEQ ID NO: 501068 - RNA, 15 nt, Chlamydophila pneumoniae CWL029
gaaugcggcuaauuu

SEQ ID NO: 501069 - RNA, 19 nt, Chlamydophila pneumoniae CWL029
gaaugccaaaccucuuagc

SEQ ID NO: 501070 - RNA, 17 nt, Chlamydophila pneumoniae CWL029
gaaugcccuuuagggaa

SEQ ID NO: 501071 - RNA, 18 nt, Chlamydophila pneumoniae CWL029
gaaugcccuuuagggaau

SEQ ID NO: 501072 - RNA, 21 nt, Chlamydophila pneumoniae CWL029
gaaugccauucuuaucugcug

SEQ ID NO: 501073 - RNA, 20 nt, Chlamydophila pneumoniae CWL029
gaaugacugcagauugcacu

SEQ ID NO: 501074 - RNA, 14 nt, Chlamydophila pneumoniae CWL029
gaaugagaacgucu

SEQ ID NO: 501075 - RNA, 23 nt, Chlamydophila pneumoniae CWL029
gaaugaucccuaacgaugcaggc

SEQ ID NO: 501076 - RNA, 17 nt, Chlamydophila pneumoniae CWL029
gaaugacacagagaaca

SEQ ID NO: 501077 - RNA, 20 nt, Chlamydophila pneumoniae CWL029
gaaugacacagagaacaaua

SEQ ID NO: 501078 - RNA, 19 nt, Chlamydophila pneumoniae CWL029
gaaucuuaugggagaagcu

SEQ ID NO: 501079 - RNA, 17 nt, Chlamydophila pneumoniae CWL029
gaaucuuuuguuuuagc

SEQ ID NO: 501080 - RNA, 14 nt, Chlamydophila pneumoniae CWL029
gaaucuuucaaaag

SEQ ID NO: 501081 - RNA, 14 nt, Chlamydophila pneumoniae CWL029
gaaucggaucuuca

SEQ ID NO: 501082 - RNA, 14 nt, Chlamydophila pneumoniae CWL029
gaaucguucccauc

SEQ ID NO: 501083 - RNA, 23 nt, Chlamydophila pneumoniae CWL029
gaaucuccauuuagaaugaccgc

SEQ ID NO: 501084 - RNA, 17 nt, Chlamydophila pneumoniae CWL029
gaaucucgggagaacau

SEQ ID NO: 501085 - RNA, 11 nt, Chlamydophila pneumoniae CWL029
gaauccuucuc

SEQ ID NO: 501086 - RNA, 22 nt, Chlamydophila pneumoniae CWL029
gaauccuugaaagacucgcucu

SEQ ID NO: 501087 - RNA, 18 nt, Chlamydophila pneumoniae CWL029
gaauccucggaagauaaa

SEQ ID NO: 501088 - RNA, 18 nt, Chlamydophila pneumoniae CWL029
gaauccucuauccaucau

SEQ ID NO: 501089 - RNA, 21 nt, Chlamydophila pneumoniae CWL029
gaauccccccuucuaauacuu

SEQ ID NO: 501090 - RNA, 17 nt, Chlamydophila pneumoniae CWL029
gaaucagcuuaucuaua

SEQ ID NO: 501091 - RNA, 13 nt, Chlamydophila pneumoniae CWL029
gaaucacucucua

SEQ ID NO: 501092 - RNA, 19 nt, Chlamydophila pneumoniae CWL029
gaaucacuguaucagcaag

SEQ ID NO: 501093 - RNA, 19 nt, Chlamydophila pneumoniae CWL029
gaauaaagcccuuuugaau

SEQ ID NO: 501094 - RNA, 13 nt, Chlamydophila pneumoniae CWL029
gaaguuuuuucuc

SEQ ID NO: 501095 - RNA, 15 nt, Chlamydophila pneumoniae CWL029
gaaguuuuuucucuc

SEQ ID NO: 501096 - RNA, 17 nt, Chlamydophila pneumoniae CWL029
gaaguuuacaaauaaaa

SEQ ID NO: 501097 - RNA, 15 nt, Chlamydophila pneumoniae CWL029
gaaguuuugcucucu

SEQ ID NO: 501098 - RNA, 20 nt, Chlamydophila pneumoniae CWL029
gaaguuuuuuaagugcuuuu

SEQ ID NO: 501099 - RNA, 16 nt, Chlamydophila pneumoniae CWL029
gaaguuacgugagaac

SEQ ID NO: 501100 - RNA, 21 nt, Chlamydophila pneumoniae CWL029
gaaguuccuacuucugcagga

SEQ ID NO: 501101 - RNA, 14 nt, Chlamydophila pneumoniae CWL029
gaaguuccuucagg

SEQ ID NO: 501102 - RNA, 15 nt, Chlamydophila pneumoniae CWL029
gaaguuccuucagga

SEQ ID NO: 501103 - RNA, 21 nt, Chlamydophila pneumoniae CWL029
gaagucguuuagauuuuucuu

SEQ ID NO: 501104 - RNA, 17 nt, Chlamydophila pneumoniae CWL029
gaaguccagacuuuccu

SEQ ID NO: 501105 - RNA, 18 nt, Chlamydophila pneumoniae CWL029
gaagucccacaaaugaua

SEQ ID NO: 501106 - RNA, 17 nt, Chlamydophila pneumoniae CWL029
gaagucccacaaaugau

SEQ ID NO: 501107 - RNA, 16 nt, Chlamydophila pneumoniae CWL029
gaagucuucuugcuga

SEQ ID NO: 501108 - RNA, 16 nt, Chlamydophila pneumoniae CWL029
gaagucuucaggugaa

SEQ ID NO: 501109 - RNA, 13 nt, Chlamydophila pneumoniae CWL029
gaagugcuuugag

SEQ ID NO: 501110 - RNA, 19 nt, Chlamydophila pneumoniae CWL029
gaaguauucgauuccugag

SEQ ID NO: 501111 - RNA, 23 nt, Chlamydophila pneumoniae CWL029
gaaguaguggacuauagaugcca

SEQ ID NO: 501112 - RNA, 15 nt, Chlamydophila pneumoniae CWL029
gaaguagggucccuu

SEQ ID NO: 501113 - RNA, 20 nt, Chlamydophila pneumoniae CWL029
gaaguacaagugaagacaag

SEQ ID NO: 501114 - RNA, 16 nt, Chlamydophila pneumoniae CWL029
gaaguacaagugaaga

SEQ ID NO: 501115 - RNA, 18 nt, Chlamydophila pneumoniae CWL029
gaagguguggguacaggg

SEQ ID NO: 501116 - RNA, 18 nt, Chlamydophila pneumoniae CWL029
gaaggggaagaggaaugc

SEQ ID NO: 501117 - RNA, 22 nt, Chlamydophila pneumoniae CWL029
gaagguaaauuuuuaaaacucc

SEQ ID NO: 501118 - RNA, 16 nt, Chlamydophila pneumoniae CWL029
gaaggcuuguuucugu

SEQ ID NO: 501119 - RNA, 14 nt, Chlamydophila pneumoniae CWL029
gaauacucuagguu

SEQ ID NO: 501120 - RNA, 18 nt, Chlamydophila pneumoniae CWL029
gaauaccguuucaggaaa

SEQ ID NO: 501121 - RNA, 20 nt, Chlamydophila pneumoniae CWL029
gaauaccguuucaggaaacu

SEQ ID NO: 501122 - RNA, 17 nt, Chlamydophila pneumoniae CWL029
gaauaccguuuuaggaa

SEQ ID NO: 501123 - RNA, 17 nt, Chlamydophila pneumoniae CWL029
gaauaccucaagaugca

SEQ ID NO: 501124 - RNA, 20 nt, Chlamydophila pneumoniae CWL029
gaauaaguuuugauuuugca

SEQ ID NO: 501125 - RNA, 22 nt, Chlamydophila pneumoniae CWL029
gaauaagauuuugaaaauugca

SEQ ID NO: 501126 - RNA, 14 nt, Chlamydophila pneumoniae CWL029
gaauaaucaaccaa

SEQ ID NO: 501127 - RNA, 12 nt, Chlamydophila pneumoniae CWL029
gaauaaucaacc

SEQ ID NO: 501128 - RNA, 23 nt, Chlamydophila pneumoniae CWL029
gaauaaucucuuucauaaauuca

SEQ ID NO: 501129 - RNA, 16 nt, Chlamydophila pneumoniae CWL029
gaauaaaggacauaga

SEQ ID NO: 501130 - RNA, 18 nt, Chlamydophila pneumoniae CWL029
gaauagcaagcacuuucg

SEQ ID NO: 501131 - RNA, 18 nt, Chlamydophila pneumoniae CWL029
gaauagaauguaugugaa

SEQ ID NO: 501132 - RNA, 22 nt, Chlamydophila pneumoniae CWL029
gaauauaauuccaauugccaug

SEQ ID NO: 501133 - RNA, 12 nt, Chlamydophila pneumoniae CWL029
gaauaguuguga

SEQ ID NO: 501134 - RNA, 21 nt, Chlamydophila pneumoniae CWL029
gaauaguugugagacuuucug

SEQ ID NO: 501135 - RNA, 14 nt, Chlamydophila pneumoniae CWL029
gaauaugcuuuuca

SEQ ID NO: 501136 - RNA, 18 nt, Chlamydophila pneumoniae CWL029
gaauaugcuuuucaaaua

SEQ ID NO: 501137 - RNA, 14 nt, Chlamydophila pneumoniae CWL029
gaauaucaucuucc

SEQ ID NO: 501138 - RNA, 18 nt, Chlamydophila pneumoniae CWL029
gaauaucaucacuaagau

SEQ ID NO: 501139 - RNA, 12 nt, Chlamydophila pneumoniae CWL029
gaauauagacuu

SEQ ID NO: 501140 - RNA, 15 nt, Chlamydophila pneumoniae CWL029
gaacaugccaaauau

SEQ ID NO: 501141 - RNA, 17 nt, Chlamydophila pneumoniae CWL029
gaacaugccugaaaaca

SEQ ID NO: 501142 - RNA, 14 nt, Chlamydophila pneumoniae CWL029
gaacaugccaaaua

SEQ ID NO: 501143 - RNA, 19 nt, Chlamydophila pneumoniae CWL029
gaacagucuugcgccagca

SEQ ID NO: 501144 - RNA, 17 nt, Chlamydophila pneumoniae CWL029
gaacaguuugcucugga

SEQ ID NO: 501145 - RNA, 20 nt, Chlamydophila pneumoniae CWL029
gaacaggcacagcaaucaca

SEQ ID NO: 501146 - RNA, 18 nt, Chlamydophila pneumoniae CWL029
gaacaggagagagaaggc

SEQ ID NO: 501147 - RNA, 17 nt, Chlamydophila pneumoniae CWL029
gaacagcacucucugca

SEQ ID NO: 501148 - RNA, 23 nt, Chlamydophila pneumoniae CWL029
gaacagcacucucugcagggaau

SEQ ID NO: 501149 - RNA, 21 nt, Chlamydophila pneumoniae CWL029
gaacagaggaucuagaaaaug

SEQ ID NO: 501150 - RNA, 19 nt, Chlamydophila pneumoniae CWL029
gaacaauacucucugcuuc

SEQ ID NO: 501151 - RNA, 20 nt, Chlamydophila pneumoniae CWL029
gaacaaguuuuuucaauccu

SEQ ID NO: 501152 - RNA, 15 nt, Chlamydophila pneumoniae CWL029
gaacaauacucucug

SEQ ID NO: 501153 - RNA, 19 nt, Chlamydophila pneumoniae CWL029
gaacaaguuuuuucaaucc

SEQ ID NO: 501154 - RNA, 15 nt, Chlamydophila pneumoniae CWL029
gaacaacugugguuu

SEQ ID NO: 501155 - RNA, 13 nt, Chlamydophila pneumoniae CWL029
gaacaaggcuccg

SEQ ID NO: 501156 - RNA, 22 nt, Chlamydophila pneumoniae CWL029
gaacaagucggcaggagaggua

SEQ ID NO: 501157 - RNA, 23 nt, Chlamydophila pneumoniae CWL029
gaacacccccgcagcuucucuag

SEQ ID NO: 501158 - RNA, 20 nt, Chlamydophila pneumoniae CWL029
gaacacccccgcagcuucuc

SEQ ID NO: 501159 - RNA, 11 nt, Chlamydophila pneumoniae CWL029
gaaauucuucc

SEQ ID NO: 501160 - RNA, 19 nt, Chlamydophila pneumoniae CWL029
gaaauuccgacccagucaa

SEQ ID NO: 501161 - RNA, 15 nt, Chlamydophila pneumoniae CWL029
gaaauuagguagugg

SEQ ID NO: 501162 - RNA, 12 nt, Chlamydophila pneumoniae CWL029
gaaauuaacaga

SEQ ID NO: 501163 - RNA, 20 nt, Chlamydophila pneumoniae CWL029
gaacaaagcucuccuucaga

SEQ ID NO: 501164 - RNA, 12 nt, Chlamydophila pneumoniae CWL029
gaaauuuucuaa

SEQ ID NO: 501165 - RNA, 15 nt, Chlamydophila pneumoniae CWL029
gaacaaaaaaucaau

SEQ ID NO: 501166 - RNA, 14 nt, Chlamydophila pneumoniae CWL029
gaaauuucauucuc

SEQ ID NO: 501167 - RNA, 21 nt, Chlamydophila pneumoniae CWL029
gaaauuuaggucgacuuccuu

SEQ ID NO: 501168 - RNA, 22 nt, Chlamydophila pneumoniae CWL029
gaaauugucuucagugcaaugu

SEQ ID NO: 501169 - RNA, 14 nt, Chlamydophila pneumoniae CWL029
gaaauugcucuugc

SEQ ID NO: 501170 - RNA, 15 nt, Chlamydophila pneumoniae CWL029
gaaaucacacuuaaa

SEQ ID NO: 501171 - RNA, 18 nt, Chlamydophila pneumoniae CWL029
gaaauccguaaagguugu

SEQ ID NO: 501172 - RNA, 20 nt, Chlamydophila pneumoniae CWL029
gaaauccugggcaaugauca

SEQ ID NO: 501173 - RNA, 17 nt, Chlamydophila pneumoniae CWL029
gaaaugcucuucugcag

SEQ ID NO: 501174 - RNA, 21 nt, Chlamydophila pneumoniae CWL029
gaaaugucacucuagaaaaua

SEQ ID NO: 501175 - RNA, 22 nt, Chlamydophila pneumoniae CWL029
gaaaugcaguucuuguuaaagu

SEQ ID NO: 501176 - RNA, 13 nt, Chlamydophila pneumoniae CWL029
gaaaugagugaga

SEQ ID NO: 501177 - RNA, 22 nt, Chlamydophila pneumoniae CWL029
gaaaucuuuagaauuaacaacu

SEQ ID NO: 501178 - RNA, 21 nt, Chlamydophila pneumoniae CWL029
gaaauacgcuuuucuucuuua

SEQ ID NO: 501179 - RNA, 22 nt, Chlamydophila pneumoniae CWL029
gaaauaauuuguuuagaaaaag

SEQ ID NO: 501180 - RNA, 22 nt, Chlamydophila pneumoniae CWL029
gaaauaccacagcuguacagaa

SEQ ID NO: 501181 - RNA, 15 nt, Chlamydophila pneumoniae CWL029
gaaaguucacaagca

SEQ ID NO: 501182 - RNA, 19 nt, Chlamydophila pneumoniae CWL029
gaaaguagcaucccaaguu

SEQ ID NO: 501183 - RNA, 20 nt, Chlamydophila pneumoniae CWL029
gaaaggcacuccaaaacuca

SEQ ID NO: 501184 - RNA, 14 nt, Chlamydophila pneumoniae CWL029
gaaagcuguauugg

SEQ ID NO: 501185 - RNA, 17 nt, Chlamydophila pneumoniae CWL029
gaaaggaccuccucaca

SEQ ID NO: 501186 - RNA, 21 nt, Chlamydophila pneumoniae CWL029
gaaaggcuuuucuuuuucuag

SEQ ID NO: 501187 - RNA, 17 nt, Chlamydophila pneumoniae CWL029
gaaagccaagaagaugu

SEQ ID NO: 501188 - RNA, 15 nt, Chlamydophila pneumoniae CWL029
gaaagcaucuuucau

SEQ ID NO: 501189 - RNA, 19 nt, Chlamydophila pneumoniae CWL029
gaaagauucugcccaaagc

SEQ ID NO: 501190 - RNA, 14 nt, Chlamydophila pneumoniae CWL029
gaaagauaaugucu

SEQ ID NO: 501191 - RNA, 21 nt, Chlamydophila pneumoniae CWL029
gaaacuucucagauaaaaaga

SEQ ID NO: 501192 - RNA, 12 nt, Chlamydophila pneumoniae CWL029
gaaacuucugac

SEQ ID NO: 501193 - RNA, 15 nt, Chlamydophila pneumoniae CWL029
gaaacuuuaggauuc

SEQ ID NO: 501194 - RNA, 22 nt, Chlamydophila pneumoniae CWL029
gaaacuuuuccaaauuccuuca

SEQ ID NO: 501195 - RNA, 18 nt, Chlamydophila pneumoniae CWL029
gaaacuuuuuuucuucuc

SEQ ID NO: 501196 - RNA, 21 nt, Chlamydophila pneumoniae CWL029
gaaacuuuuuuucuucucuaa

SEQ ID NO: 501197 - RNA, 22 nt, Chlamydophila pneumoniae CWL029
gaaacuuuuuuucuucucuaag

SEQ ID NO: 501198 - RNA, 20 nt, Chlamydophila pneumoniae CWL029
gaaacuuuuuuucuucucua

SEQ ID NO: 501199 - RNA, 16 nt, Chlamydophila pneumoniae CWL029
gaaacugcuccugaag

SEQ ID NO: 501200 - RNA, 19 nt, Chlamydophila pneumoniae CWL029
gaaagaauuguaguucuuu

SEQ ID NO: 501201 - RNA, 13 nt, Chlamydophila pneumoniae CWL029
gaaagacucgcuc

SEQ ID NO: 501202 - RNA, 22 nt, Chlamydophila pneumoniae CWL029
gaaagagucucacucuuuucua

SEQ ID NO: 501203 - RNA, 18 nt, Chlamydophila pneumoniae CWL029
gaaagacucaucuuugaa

SEQ ID NO: 501204 - RNA, 16 nt, Chlamydophila pneumoniae CWL029
gaaagaaugccauucu

SEQ ID NO: 501205 - RNA, 14 nt, Chlamydophila pneumoniae CWL029
gaaagaaugacaca

SEQ ID NO: 501206 - RNA, 12 nt, Chlamydophila pneumoniae CWL029
gaaagaaacaaa

SEQ ID NO: 501207 - RNA, 13 nt, Chlamydophila pneumoniae CWL029
gaaagaacuacuu

SEQ ID NO: 501208 - RNA, 13 nt, Chlamydophila pneumoniae CWL029
gaaacuagauuuc

SEQ ID NO: 501209 - RNA, 13 nt, Chlamydophila pneumoniae CWL029
gaaaccuucucuc

SEQ ID NO: 501210 - RNA, 13 nt, Chlamydophila pneumoniae CWL029
gaaaccuucagau

SEQ ID NO: 501211 - RNA, 16 nt, Chlamydophila pneumoniae CWL029
gaaaccuucucucuua

SEQ ID NO: 501212 - RNA, 17 nt, Chlamydophila pneumoniae CWL029
gaaacgcagcuuuccuu

SEQ ID NO: 501213 - RNA, 23 nt, Chlamydophila pneumoniae CWL029
gaaaccggacugacuucuaugau

SEQ ID NO: 501214 - RNA, 20 nt, Chlamydophila pneumoniae CWL029
gaaacacucaugaaagugcu

SEQ ID NO: 501215 - RNA, 19 nt, Chlamydophila pneumoniae CWL029
gaaacaccguuaauuuuug

SEQ ID NO: 501216 - RNA, 19 nt, Chlamydophila pneumoniae CWL029
gaaacauagaaucauugag

SEQ ID NO: 501217 - RNA, 24 nt, Chlamydophila pneumoniae CWL029
gaaacaucggagaacuuccugauu

SEQ ID NO: 501218 - RNA, 12 nt, Chlamydophila pneumoniae CWL029
gaaaaucugcuc

SEQ ID NO: 501219 - RNA, 21 nt, Chlamydophila pneumoniae CWL029
gaaaaucucuaagaaucuaua

SEQ ID NO: 501220 - RNA, 16 nt, Chlamydophila pneumoniae CWL029
gaaaaucugcagcaga

SEQ ID NO: 501221 - RNA, 19 nt, Chlamydophila pneumoniae CWL029
gaaaaugauucauaacauu

SEQ ID NO: 501222 - RNA, 16 nt, Chlamydophila pneumoniae CWL029
gaaaaucauucaaaua

SEQ ID NO: 501223 - RNA, 16 nt, Chlamydophila pneumoniae CWL029
gaaaaucaagaagaga

SEQ ID NO: 501224 - RNA, 18 nt, Chlamydophila pneumoniae CWL029
gaaaaucaagaagagaaa

SEQ ID NO: 501225 - RNA, 23 nt, Chlamydophila pneumoniae CWL029
gaaaauaguacgcuuuuuacuga

SEQ ID NO: 501226 - RNA, 16 nt, Chlamydophila pneumoniae CWL029
gaaaaucaacucucca

SEQ ID NO: 501227 - RNA, 16 nt, Chlamydophila pneumoniae CWL029
gaaacaaccaucccau

SEQ ID NO: 501228 - RNA, 20 nt, Chlamydophila pneumoniae CWL029
gaaacacaguuugagaaaga

SEQ ID NO: 501229 - RNA, 15 nt, Chlamydophila pneumoniae CWL029
gaaaauguaaaaaau

SEQ ID NO: 501230 - RNA, 16 nt, Chlamydophila pneumoniae CWL029
gaaaaggaugcaucuc

SEQ ID NO: 501231 - RNA, 21 nt, Chlamydophila pneumoniae CWL029
gaaaagccucgaaauuuucag

SEQ ID NO: 501232 - RNA, 19 nt, Chlamydophila pneumoniae CWL029
gaaaagauucuaaaucaac

SEQ ID NO: 501233 - RNA, 12 nt, Chlamydophila pneumoniae CWL029
gaaaagaaaaga

SEQ ID NO: 501234 - RNA, 14 nt, Chlamydophila pneumoniae CWL029
gaaaagaaccuagg

SEQ ID NO: 501235 - RNA, 13 nt, Chlamydophila pneumoniae CWL029
gaaaagaaagaau

SEQ ID NO: 501236 - RNA, 10 nt, Chlamydophila pneumoniae CWL029
gaaaacuuca

SEQ ID NO: 501237 - RNA, 12 nt, Chlamydophila pneumoniae CWL029
gaaaauaaucuu

SEQ ID NO: 501238 - RNA, 16 nt, Chlamydophila pneumoniae CWL029
gaaaagugugaggaga

SEQ ID NO: 501239 - RNA, 18 nt, Chlamydophila pneumoniae CWL029
gaaaaaucuacauguaaa

SEQ ID NO: 501240 - RNA, 23 nt, Chlamydophila pneumoniae CWL029
gaaaaaucuacauguaaagcaag

SEQ ID NO: 501241 - RNA, 13 nt, Chlamydophila pneumoniae CWL029
gaaaaaggaggau

SEQ ID NO: 501242 - RNA, 19 nt, Chlamydophila pneumoniae CWL029
gaaaaccaugaguuuuuca

SEQ ID NO: 501243 - RNA, 14 nt, Chlamydophila pneumoniae CWL029
gaaaacauagagau

SEQ ID NO: 501244 - RNA, 19 nt, Chlamydophila pneumoniae CWL029
gaaaacaucuguauauucu

SEQ ID NO: 501245 - RNA, 17 nt, Chlamydophila pneumoniae CWL029
gaaaacgcccucuagaa

SEQ ID NO: 501246 - RNA, 19 nt, Chlamydophila pneumoniae CWL029
gaaaacaaggcaaaaaguu

SEQ ID NO: 501247 - RNA, 21 nt, Chlamydophila pneumoniae CWL029
cuuuuuggaaguuguuuuuug

SEQ ID NO: 501248 - RNA, 23 nt, Chlamydophila pneumoniae CWL029
cuuuuuggaaguuguuuuuugag

SEQ ID NO: 501249 - RNA, 23 nt, Chlamydophila pneumoniae CWL029
cuuuuuuauguccguauuuuuua

SEQ ID NO: 501250 - RNA, 20 nt, Chlamydophila pneumoniae CWL029
cuuuuuuacuaucuccuaga

SEQ ID NO: 501251 - RNA, 13 nt, Chlamydophila pneumoniae CWL029
cuuuuuuuaaaaa

SEQ ID NO: 501252 - RNA, 14 nt, Chlamydophila pneumoniae CWL029
cuuuuuuuuuucuu

SEQ ID NO: 501253 - RNA, 16 nt, Chlamydophila pneumoniae CWL029
gaaaaaaaaucugcua

SEQ ID NO: 501254 - RNA, 12 nt, Chlamydophila pneumoniae CWL029
gaaaaaauagau

SEQ ID NO: 501255 - RNA, 11 nt, Chlamydophila pneumoniae CWL029
gaaaaaauucu

SEQ ID NO: 501256 - RNA, 23 nt, Chlamydophila pneumoniae CWL029
gaaaaaccccuagaacuuuacaa

SEQ ID NO: 501257 - RNA, 14 nt, Chlamydophila pneumoniae CWL029
cuuuuugcagaucu

SEQ ID NO: 501258 - RNA, 20 nt, Chlamydophila pneumoniae CWL029
cuuuuugauuagaguuuuug

SEQ ID NO: 501259 - RNA, 15 nt, Chlamydophila pneumoniae CWL029
cuuuuugccaauuuu

SEQ ID NO: 501260 - RNA, 20 nt, Chlamydophila pneumoniae CWL029
cuuuuucuugaaaaauccug

SEQ ID NO: 501261 - RNA, 11 nt, Chlamydophila pneumoniae CWL029
cuuuuucuagg

SEQ ID NO: 501262 - RNA, 19 nt, Chlamydophila pneumoniae CWL029
cuuuuucuugauuagagaa

SEQ ID NO: 501263 - RNA, 14 nt, Chlamydophila pneumoniae CWL029
cuuuuucagcuucu

SEQ ID NO: 501264 - RNA, 12 nt, Chlamydophila pneumoniae CWL029
cuuuuuccaaaa

SEQ ID NO: 501265 - RNA, 20 nt, Chlamydophila pneumoniae CWL029
cuuuuuaggaaaggauaucu

SEQ ID NO: 501266 - RNA, 17 nt, Chlamydophila pneumoniae CWL029
cuuuuuaucaugagaau

SEQ ID NO: 501267 - RNA, 18 nt, Chlamydophila pneumoniae CWL029
cuuuuuauugauaaugau

SEQ ID NO: 501268 - RNA, 15 nt, Chlamydophila pneumoniae CWL029
cuuuugcaaaucuuc

SEQ ID NO: 501269 - RNA, 13 nt, Chlamydophila pneumoniae CWL029
cuuuugcaaguuu

SEQ ID NO: 501270 - RNA, 14 nt, Chlamydophila pneumoniae CWL029
cuuuugcugcagca

SEQ ID NO: 501271 - RNA, 18 nt, Chlamydophila pneumoniae CWL029
cuuuuguuguuuuugcug

SEQ ID NO: 501272 - RNA, 15 nt, Chlamydophila pneumoniae CWL029
cuuuuguuugucuuc

SEQ ID NO: 501273 - RNA, 14 nt, Chlamydophila pneumoniae CWL029
cuuuuguagauuag

SEQ ID NO: 501274 - RNA, 15 nt, Chlamydophila pneumoniae CWL029
cuuuugugauaccuc

SEQ ID NO: 501275 - RNA, 18 nt, Chlamydophila pneumoniae CWL029
cuuuucugaagauuuuuu

SEQ ID NO: 501276 - RNA, 13 nt, Chlamydophila pneumoniae CWL029
cuuuucuccuucu

SEQ ID NO: 501277 - RNA, 15 nt, Chlamydophila pneumoniae CWL029
cuuuucucuucaaaa

SEQ ID NO: 501278 - RNA, 19 nt, Chlamydophila pneumoniae CWL029
cuuuuccuucuguagauuu

SEQ ID NO: 501279 - RNA, 10 nt, Chlamydophila pneumoniae CWL029
cuuuucuaga

SEQ ID NO: 501280 - RNA, 23 nt, Chlamydophila pneumoniae CWL029
cuuuucuagaaacugcuccugaa

SEQ ID NO: 501281 - RNA, 19 nt, Chlamydophila pneumoniae CWL029
cuuuucuacaugcucaaga

SEQ ID NO: 501282 - RNA, 19 nt, Chlamydophila pneumoniae CWL029
cuuuucggaucagaaugca

SEQ ID NO: 501283 - RNA, 15 nt, Chlamydophila pneumoniae CWL029
cuuuuauuaagggaa

SEQ ID NO: 501284 - RNA, 17 nt, Chlamydophila pneumoniae CWL029
cuuuuagagccuuuuca

SEQ ID NO: 501285 - RNA, 20 nt, Chlamydophila pneumoniae CWL029
cuuuuacuguacuugcuaug

SEQ ID NO: 501286 - RNA, 15 nt, Chlamydophila pneumoniae CWL029
cuuuucagauuuuuu

SEQ ID NO: 501287 - RNA, 13 nt, Chlamydophila pneumoniae CWL029
cuuuucauuuuua

SEQ ID NO: 501288 - RNA, 17 nt, Chlamydophila pneumoniae CWL029
cuuuucauuuuuaggau

SEQ ID NO: 501289 - RNA, 20 nt, Chlamydophila pneumoniae CWL029
cuuuuccggggagaacuuca

SEQ ID NO: 501290 - RNA, 21 nt, Chlamydophila pneumoniae CWL029
cuuuuccggggagaacuucaa

SEQ ID NO: 501291 - RNA, 12 nt, Chlamydophila pneumoniae CWL029
cuuucuuuuagc

SEQ ID NO: 501292 - RNA, 11 nt, Chlamydophila pneumoniae CWL029
cuuucuucucu

SEQ ID NO: 501293 - RNA, 22 nt, Chlamydophila pneumoniae CWL029
cuuugugaguucuuccuucuuc

SEQ ID NO: 501294 - RNA, 16 nt, Chlamydophila pneumoniae CWL029
cuuugugauuacagca

SEQ ID NO: 501295 - RNA, 16 nt, Chlamydophila pneumoniae CWL029
cuuugugaguucuucc

SEQ ID NO: 501296 - RNA, 23 nt, Chlamydophila pneumoniae CWL029
cuuuuaagacaauauaagcacca

SEQ ID NO: 501297 - RNA, 22 nt, Chlamydophila pneumoniae CWL029
cuuuuaaagagcgcguuucaaa

SEQ ID NO: 501298 - RNA, 11 nt, Chlamydophila pneumoniae CWL029
aaaaaagagac

SEQ ID NO: 501299 - RNA, 18 nt, Chlamydophila pneumoniae CWL029
aaaaaagaccaaauaauu

SEQ ID NO: 501300 - RNA, 17 nt, Chlamydophila pneumoniae CWL029
aaaaagccaagaaaaca

SEQ ID NO: 501301 - RNA, 11 nt, Chlamydophila pneumoniae CWL029
aaaaagaauaa

SEQ ID NO: 501302 - RNA, 14 nt, Chlamydophila pneumoniae CWL029
aaaaagaauaaaaa

SEQ ID NO: 501303 - RNA, 12 nt, Chlamydophila pneumoniae CWL029
aaaaagaaagag

SEQ ID NO: 501304 - RNA, 21 nt, Chlamydophila pneumoniae CWL029
aaaaacuucccaucuuguucu

SEQ ID NO: 501305 - RNA, 16 nt, Chlamydophila pneumoniae CWL029
aaaaacuucuaacugu

SEQ ID NO: 501306 - RNA, 21 nt, Chlamydophila pneumoniae CWL029
aaaaagcugacacucagcucc

SEQ ID NO: 501307 - RNA, 15 nt, Chlamydophila pneumoniae CWL029
aaaaagcuaaacaac

SEQ ID NO: 501308 - RNA, 18 nt, Chlamydophila pneumoniae CWL029
aaaaaguaguuuuaagaa

SEQ ID NO: 501309 - RNA, 19 nt, Chlamydophila pneumoniae CWL029
aaaaacugcgcuagcucca

SEQ ID NO: 501310 - RNA, 18 nt, Chlamydophila pneumoniae CWL029
aaaaacuguguuuucuag

SEQ ID NO: 501311 - RNA, 16 nt, Chlamydophila pneumoniae CWL029
aaaaacgguaaauauc

SEQ ID NO: 501312 - RNA, 17 nt, Chlamydophila pneumoniae CWL029
aaaaacgguaaauaucu

SEQ ID NO: 501313 - RNA, 17 nt, Chlamydophila pneumoniae CWL029
aaaaacucuucaucgau

SEQ ID NO: 501314 - RNA, 21 nt, Chlamydophila pneumoniae CWL029
aaaaacugcaaaaagaucguu

SEQ ID NO: 501315 - RNA, 18 nt, Chlamydophila pneumoniae CWL029
aaaaaguugaggaaagga

SEQ ID NO: 501316 - RNA, 12 nt, Chlamydophila pneumoniae CWL029
aaaaaucugcua

SEQ ID NO: 501317 - RNA, 23 nt, Chlamydophila pneumoniae CWL029
aaaaaucugcuauaaccaacuuc

SEQ ID NO: 501318 - RNA, 13 nt, Chlamydophila pneumoniae CWL029
aaaaauucucaua

SEQ ID NO: 501319 - RNA, 22 nt, Chlamydophila pneumoniae CWL029
aaaaauucuucgagagcaugca

SEQ ID NO: 501320 - RNA, 16 nt, Chlamydophila pneumoniae CWL029
aaaaauucuuuaggga

SEQ ID NO: 501321 - RNA, 14 nt, Chlamydophila pneumoniae CWL029
aaaaauuuaaaaga

SEQ ID NO: 501322 - RNA, 16 nt, Chlamydophila pneumoniae CWL029
aaaaauguaauuuuuu

SEQ ID NO: 501323 - RNA, 13 nt, Chlamydophila pneumoniae CWL029
aaaaauucccaua

SEQ ID NO: 501324 - RNA, 20 nt, Chlamydophila pneumoniae CWL029
aaaaaucuucuuagccaaaa

SEQ ID NO: 501325 - RNA, 22 nt, Chlamydophila pneumoniae CWL029
aaaaaugccugaaaauucgaau

SEQ ID NO: 501326 - RNA, 15 nt, Chlamydophila pneumoniae CWL029
aaaaaugcuccugca

SEQ ID NO: 501327 - RNA, 13 nt, Chlamydophila pneumoniae CWL029
aaaaccacagaau

SEQ ID NO: 501328 - RNA, 13 nt, Chlamydophila pneumoniae CWL029
aaaacauauccca

SEQ ID NO: 501329 - RNA, 15 nt, Chlamydophila pneumoniae CWL029
aaaacaaaccuccua

SEQ ID NO: 501330 - RNA, 11 nt, Chlamydophila pneumoniae CWL029
aaaacaagaag

SEQ ID NO: 501331 - RNA, 15 nt, Chlamydophila pneumoniae CWL029
aaaacccauguuucu

SEQ ID NO: 501332 - RNA, 22 nt, Chlamydophila pneumoniae CWL029
aaaacccauguuucuuccugaa

SEQ ID NO: 501333 - RNA, 16 nt, Chlamydophila pneumoniae CWL029
aaaacccucaaagaau

SEQ ID NO: 501334 - RNA, 20 nt, Chlamydophila pneumoniae CWL029
aaaccacagaaugauaagaa

SEQ ID NO: 501335 - RNA, 18 nt, Chlamydophila pneumoniae CWL029
aaacauuuuuauuuccuu

SEQ ID NO: 501336 - RNA, 13 nt, Chlamydophila pneumoniae CWL029
aaacauuuaaguc

SEQ ID NO: 501337 - RNA, 19 nt, Chlamydophila pneumoniae CWL029
aaacauuaccguucccuaa

SEQ ID NO: 501338 - RNA, 15 nt, Chlamydophila pneumoniae CWL029
aaacauuagucaaug

SEQ ID NO: 501339 - RNA, 15 nt, Chlamydophila pneumoniae CWL029
aaacaucagcaacau

SEQ ID NO: 501340 - RNA, 13 nt, Chlamydophila pneumoniae CWL029
aaaccaggaacaa

SEQ ID NO: 501341 - RNA, 16 nt, Chlamydophila pneumoniae CWL029
aaaccaggaacaaagg

SEQ ID NO: 501342 - RNA, 18 nt, Chlamydophila pneumoniae CWL029
aaacccaauucuuaaaaa

SEQ ID NO: 501343 - RNA, 22 nt, Chlamydophila pneumoniae CWL029
aaacccugggcucacucuaagc

SEQ ID NO: 501344 - RNA, 23 nt, Chlamydophila pneumoniae CWL029
aaaccguaacugaggcaaagauu

SEQ ID NO: 501345 - RNA, 15 nt, Chlamydophila pneumoniae CWL029
aaacaucacucagga

SEQ ID NO: 501346 - RNA, 16 nt, Chlamydophila pneumoniae CWL029
aaacagguaauacccu

SEQ ID NO: 501347 - RNA, 21 nt, Chlamydophila pneumoniae CWL029
aaacagauuuuucaagaacuc

SEQ ID NO: 501348 - RNA, 22 nt, Chlamydophila pneumoniae CWL029
aaacacuuuggauaggauagga

SEQ ID NO: 501349 - RNA, 23 nt, Chlamydophila pneumoniae CWL029
aaacagcaucaggauucucucug

SEQ ID NO: 501350 - RNA, 18 nt, Chlamydophila pneumoniae CWL029
aaacaaucuaaagguuuu

SEQ ID NO: 501351 - RNA, 22 nt, Chlamydophila pneumoniae CWL029
aaacaaucuaaagguuuuaaau

SEQ ID NO: 501352 - RNA, 14 nt, Chlamydophila pneumoniae CWL029
aaaauugaaaucuu

SEQ ID NO: 501353 - RNA, 21 nt, Chlamydophila pneumoniae CWL029
aaaauugaacguagcuacaaa

SEQ ID NO: 501354 - RNA, 22 nt, Chlamydophila pneumoniae CWL029
aaaauugauaguguucgagcau

SEQ ID NO: 501355 - RNA, 18 nt, Chlamydophila pneumoniae CWL029
aaaauugcauuuaaacua

SEQ ID NO: 501356 - RNA, 22 nt, Chlamydophila pneumoniae CWL029
aaaauugcccauugaccugcuu

SEQ ID NO: 501357 - RNA, 12 nt, Chlamydophila pneumoniae CWL029
aaacaauuucaa

SEQ ID NO: 501358 - RNA, 11 nt, Chlamydophila pneumoniae CWL029
aaacacaaaua

SEQ ID NO: 501359 - RNA, 17 nt, Chlamydophila pneumoniae CWL029
aaacacaaauagcaaga

SEQ ID NO: 501360 - RNA, 19 nt, Chlamydophila pneumoniae CWL029
aaacacaaauagcaagagc

SEQ ID NO: 501361 - RNA, 12 nt, Chlamydophila pneumoniae CWL029
aaaaagaaaaga

SEQ ID NO: 501362 - RNA, 17 nt, Chlamydophila pneumoniae CWL029
aaaaagaacauaagaua

SEQ ID NO: 501363 - RNA, 16 nt, Chlamydophila pneumoniae CWL029
aaaaacuguguuuucu

SEQ ID NO: 501364 - RNA, 15 nt, Chlamydophila pneumoniae CWL029
aaaaagaauaaaaau

SEQ ID NO: 501365 - RNA, 16 nt, Chlamydophila pneumoniae CWL029
aaaaagaauaaaaaua

SEQ ID NO: 501366 - RNA, 18 nt, Chlamydophila pneumoniae CWL029
aaaagcuuuuuucucuug

SEQ ID NO: 501367 - RNA, 23 nt, Chlamydophila pneumoniae CWL029
aaaagcuuaucccauaaauguau

SEQ ID NO: 501368 - RNA, 15 nt, Chlamydophila pneumoniae CWL029
aaaacgccauacuga

SEQ ID NO: 501369 - RNA, 18 nt, Chlamydophila pneumoniae CWL029
aaaacgccauacugauau

SEQ ID NO: 501370 - RNA, 17 nt, Chlamydophila pneumoniae CWL029
aaaacgagcaggguaau

SEQ ID NO: 501371 - RNA, 15 nt, Chlamydophila pneumoniae CWL029
aaaagcuaaacaacu

SEQ ID NO: 501372 - RNA, 19 nt, Chlamydophila pneumoniae CWL029
aaaagcgcaaaucuuacau

SEQ ID NO: 501373 - RNA, 13 nt, Chlamydophila pneumoniae CWL029
aaaagguuuugaa

SEQ ID NO: 501374 - RNA, 17 nt, Chlamydophila pneumoniae CWL029
aaaagucaugaggacug

SEQ ID NO: 501375 - RNA, 18 nt, Chlamydophila pneumoniae CWL029
aaaagucaugaggacugu

SEQ ID NO: 501376 - RNA, 15 nt, Chlamydophila pneumoniae CWL029
aaaagucaugaggac

SEQ ID NO: 501377 - RNA, 21 nt, Chlamydophila pneumoniae CWL029
aaaaggaugcaucucuuaaaa

SEQ ID NO: 501378 - RNA, 13 nt, Chlamydophila pneumoniae CWL029
aaaaggaggagga

SEQ ID NO: 501379 - RNA, 23 nt, Chlamydophila pneumoniae CWL029
aaaaggaggaggagcacuaggca

SEQ ID NO: 501380 - RNA, 12 nt, Chlamydophila pneumoniae CWL029
aaaagggaagcu

SEQ ID NO: 501381 - RNA, 21 nt, Chlamydophila pneumoniae CWL029
aaaaggcccccuacagcagaa

SEQ ID NO: 501382 - RNA, 22 nt, Chlamydophila pneumoniae CWL029
aaaauaaccccuccaaaaucau

SEQ ID NO: 501383 - RNA, 14 nt, Chlamydophila pneumoniae CWL029
aaaagucucuaggg

SEQ ID NO: 501384 - RNA, 22 nt, Chlamydophila pneumoniae CWL029
aaaagucucuagggaaaggagc

SEQ ID NO: 501385 - RNA, 21 nt, Chlamydophila pneumoniae CWL029
aaaagucucuagggaaaggag

SEQ ID NO: 501386 - RNA, 15 nt, Chlamydophila pneumoniae CWL029
aaaauauucuuucaa

SEQ ID NO: 501387 - RNA, 20 nt, Chlamydophila pneumoniae CWL029
aaaauaucauucacuauugu

SEQ ID NO: 501388 - RNA, 17 nt, Chlamydophila pneumoniae CWL029
aaaauacagccagcaga

SEQ ID NO: 501389 - RNA, 18 nt, Chlamydophila pneumoniae CWL029
aaaauacagccagcagaa

SEQ ID NO: 501390 - RNA, 18 nt, Chlamydophila pneumoniae CWL029
aaaauaucaccuacauca

SEQ ID NO: 501391 - RNA, 21 nt, Chlamydophila pneumoniae CWL029
aaaauaccaguagagaauguu

SEQ ID NO: 501392 - RNA, 20 nt, Chlamydophila pneumoniae CWL029
aaaaucauaggcuauaauua

SEQ ID NO: 501393 - RNA, 17 nt, Chlamydophila pneumoniae CWL029
aaaaucuuauuugaguu

SEQ ID NO: 501394 - RNA, 19 nt, Chlamydophila pneumoniae CWL029
aaaaucugcagcagauacc

SEQ ID NO: 501395 - RNA, 19 nt, Chlamydophila pneumoniae CWL029
aaaaucugcuauaaccaac

SEQ ID NO: 501396 - RNA, 16 nt, Chlamydophila pneumoniae CWL029
aaaaucauucaaauau

SEQ ID NO: 501397 - RNA, 19 nt, Chlamydophila pneumoniae CWL029
aaaaucucuaagaaucuau

SEQ ID NO: 501398 - RNA, 16 nt, Chlamydophila pneumoniae CWL029
aaaaucugcagcagau

SEQ ID NO: 501399 - RNA, 14 nt, Chlamydophila pneumoniae CWL029
aaaauucuuaaaac

SEQ ID NO: 501400 - RNA, 17 nt, Chlamydophila pneumoniae CWL029
aaaauucuguaaaguga

SEQ ID NO: 501401 - RNA, 18 nt, Chlamydophila pneumoniae CWL029
aaaauucuucgagagcau

SEQ ID NO: 501402 - RNA, 20 nt, Chlamydophila pneumoniae CWL029
aaaauucucagauugcuuga

SEQ ID NO: 501403 - RNA, 20 nt, Chlamydophila pneumoniae CWL029
aaaauuaagaacccgauaca

SEQ ID NO: 501404 - RNA, 16 nt, Chlamydophila pneumoniae CWL029
aaaauguaaaaaauua

SEQ ID NO: 501405 - RNA, 19 nt, Chlamydophila pneumoniae CWL029
aaaauuaaagugaaagcaa

SEQ ID NO: 501406 - RNA, 17 nt, Chlamydophila pneumoniae CWL029
aaaaugaggacacaacu

SEQ ID NO: 501407 - RNA, 11 nt, Chlamydophila pneumoniae CWL029
aaaaugaccgc

SEQ ID NO: 501408 - RNA, 14 nt, Chlamydophila pneumoniae CWL029
aaaaugaaagaaac

SEQ ID NO: 501409 - RNA, 17 nt, Chlamydophila pneumoniae CWL029
aaaaugggauccugcaa

SEQ ID NO: 501410 - RNA, 19 nt, Chlamydophila pneumoniae CWL029
aaaaugauaccaccuaaaa

SEQ ID NO: 501411 - RNA, 18 nt, Chlamydophila pneumoniae CWL029
aaagaguccuuuuuguuc

SEQ ID NO: 501412 - RNA, 21 nt, Chlamydophila pneumoniae CWL029
aaagaucgugaucaaagaaca

SEQ ID NO: 501413 - RNA, 12 nt, Chlamydophila pneumoniae CWL029
aaagaucugaau

SEQ ID NO: 501414 - RNA, 20 nt, Chlamydophila pneumoniae CWL029
aaagagucucacucuuuucu

SEQ ID NO: 501415 - RNA, 17 nt, Chlamydophila pneumoniae CWL029
aaagagugccaagagca

SEQ ID NO: 501416 - RNA, 20 nt, Chlamydophila pneumoniae CWL029
aaagaucggaguuaucaaaa

SEQ ID NO: 501417 - RNA, 22 nt, Chlamydophila pneumoniae CWL029
aaagaucgggucuacaacaguu

SEQ ID NO: 501418 - RNA, 15 nt, Chlamydophila pneumoniae CWL029
aaagacaaaaaaucu

SEQ ID NO: 501419 - RNA, 20 nt, Chlamydophila pneumoniae CWL029
aaagacaaaaaaucugaucu

SEQ ID NO: 501420 - RNA, 15 nt, Chlamydophila pneumoniae CWL029
aaagacaucucuuua

SEQ ID NO: 501421 - RNA, 16 nt, Chlamydophila pneumoniae CWL029
aaagacauccuucuuu

SEQ ID NO: 501422 - RNA, 18 nt, Chlamydophila pneumoniae CWL029
aaagacauccuucuuuac

SEQ ID NO: 501423 - RNA, 16 nt, Chlamydophila pneumoniae CWL029
aaagaccaaaaauaaa

SEQ ID NO: 501424 - RNA, 20 nt, Chlamydophila pneumoniae CWL029
aaagaggaagaugauauucu

SEQ ID NO: 501425 - RNA, 14 nt, Chlamydophila pneumoniae CWL029
aaagaggaaugaag

SEQ ID NO: 501426 - RNA, 21 nt, Chlamydophila pneumoniae CWL029
aaagacccuucuuuccauaaa

SEQ ID NO: 501427 - RNA, 23 nt, Chlamydophila pneumoniae CWL029
aaagagcuuugauucacguauag

SEQ ID NO: 501428 - RNA, 17 nt, Chlamydophila pneumoniae CWL029
aaagauuauucuagagu

SEQ ID NO: 501429 - RNA, 14 nt, Chlamydophila pneumoniae CWL029
aaagauuccccaua

SEQ ID NO: 501430 - RNA, 12 nt, Chlamydophila pneumoniae CWL029
aaagauuccuaa

SEQ ID NO: 501431 - RNA, 18 nt, Chlamydophila pneumoniae CWL029
aaagcaauuucuccuagg

SEQ ID NO: 501432 - RNA, 21 nt, Chlamydophila pneumoniae CWL029
aaagcaauuucuccuaggucu

SEQ ID NO: 501433 - RNA, 21 nt, Chlamydophila pneumoniae CWL029
aaagcacauaagaugaaguuu

SEQ ID NO: 501434 - RNA, 11 nt, Chlamydophila pneumoniae CWL029
aaagcacauac

SEQ ID NO: 501435 - RNA, 20 nt, Chlamydophila pneumoniae CWL029
aaagcaaucguguuuuccug

SEQ ID NO: 501436 - RNA, 20 nt, Chlamydophila pneumoniae CWL029
aaagauuccuaagcuauaga

SEQ ID NO: 501437 - RNA, 19 nt, Chlamydophila pneumoniae CWL029
aaagauuccuuaccuauau

SEQ ID NO: 501438 - RNA, 15 nt, Chlamydophila pneumoniae CWL029
aaagauucugcccaa

SEQ ID NO: 501439 - RNA, 22 nt, Chlamydophila pneumoniae CWL029
aaagaaacuucugacccuguag

SEQ ID NO: 501440 - RNA, 13 nt, Chlamydophila pneumoniae CWL029
aaagaaagaauau

SEQ ID NO: 501441 - RNA, 19 nt, Chlamydophila pneumoniae CWL029
aaacuuuuuuucaaaucau

SEQ ID NO: 501442 - RNA, 22 nt, Chlamydophila pneumoniae CWL029
aaacuuuuuuucaaaucaucaa

SEQ ID NO: 501443 - RNA, 16 nt, Chlamydophila pneumoniae CWL029
aaacuuuuuuucuucu

SEQ ID NO: 501444 - RNA, 18 nt, Chlamydophila pneumoniae CWL029
aaacuuuuuuucuucucu

SEQ ID NO: 501445 - RNA, 13 nt, Chlamydophila pneumoniae CWL029
aaaccucuaaaaa

SEQ ID NO: 501446 - RNA, 22 nt, Chlamydophila pneumoniae CWL029
aaaccuccuagaagcgcuuuau

SEQ ID NO: 501447 - RNA, 12 nt, Chlamydophila pneumoniae CWL029
aaagaacagcac

SEQ ID NO: 501448 - RNA, 24 nt, Chlamydophila pneumoniae CWL029
aaagaacagcacucucugcaggga

SEQ ID NO: 501449 - RNA, 16 nt, Chlamydophila pneumoniae CWL029
aaagaaauguaagaag

SEQ ID NO: 501450 - RNA, 21 nt, Chlamydophila pneumoniae CWL029
aaagaaauucuggagucgagc

SEQ ID NO: 501451 - RNA, 20 nt, Chlamydophila pneumoniae CWL029
aaagaauuuguaacucuuaa

SEQ ID NO: 501452 - RNA, 17 nt, Chlamydophila pneumoniae CWL029
aaagaaugacacagaga

SEQ ID NO: 501453 - RNA, 18 nt, Chlamydophila pneumoniae CWL029
aaagaaugacacagagaa

SEQ ID NO: 501454 - RNA, 13 nt, Chlamydophila pneumoniae CWL029
aaagaaucucuga

SEQ ID NO: 501455 - RNA, 22 nt, Chlamydophila pneumoniae CWL029
aaagaaugccauucuuaucugc

SEQ ID NO: 501456 - RNA, 12 nt, Chlamydophila pneumoniae CWL029
aaagaagauuca

SEQ ID NO: 501457 - RNA, 16 nt, Chlamydophila pneumoniae CWL029
aaagaagacacuguug

SEQ ID NO: 501458 - RNA, 12 nt, Chlamydophila pneumoniae CWL029
aaagccugucuu

SEQ ID NO: 501459 - RNA, 15 nt, Chlamydophila pneumoniae CWL029
aaagccuaugggagg

SEQ ID NO: 501460 - RNA, 19 nt, Chlamydophila pneumoniae CWL029
aaagccuaugauaaagccu

SEQ ID NO: 501461 - RNA, 23 nt, Chlamydophila pneumoniae CWL029
aaagccguguaccucucaucaaa

SEQ ID NO: 501462 - RNA, 22 nt, Chlamydophila pneumoniae CWL029
aaagcauacuuauauuggcuuu

SEQ ID NO: 501463 - RNA, 15 nt, Chlamydophila pneumoniae CWL029
aaagcucuuucauaa

SEQ ID NO: 501464 - RNA, 14 nt, Chlamydophila pneumoniae CWL029
aaagcugaaauucu

SEQ ID NO: 501465 - RNA, 23 nt, Chlamydophila pneumoniae CWL029
aaagcuauuucucuaucaucaau

SEQ ID NO: 501466 - RNA, 20 nt, Chlamydophila pneumoniae CWL029
aaagcuauuguuuuucaaua

SEQ ID NO: 501467 - RNA, 16 nt, Chlamydophila pneumoniae CWL029
aaagcuauauaggguu

SEQ ID NO: 501468 - RNA, 19 nt, Chlamydophila pneumoniae CWL029
aaagcugaauccagguugu

SEQ ID NO: 501469 - RNA, 14 nt, Chlamydophila pneumoniae CWL029
aaagcuucuuucuu

SEQ ID NO: 501470 - RNA, 12 nt, Chlamydophila pneumoniae CWL029
aaagcuugagaa

SEQ ID NO: 501471 - RNA, 17 nt, Chlamydophila pneumoniae CWL029
aaagcuuuuuucucuug

SEQ ID NO: 501472 - RNA, 13 nt, Chlamydophila pneumoniae CWL029
aaagcuuuugcua

SEQ ID NO: 501473 - RNA, 23 nt, Chlamydophila pneumoniae CWL029
aaagcuuuuccguaaguaaccaa

SEQ ID NO: 501474 - RNA, 21 nt, Chlamydophila pneumoniae CWL029
aaaggagugggcuucaacucu

SEQ ID NO: 501475 - RNA, 12 nt, Chlamydophila pneumoniae CWL029
aaaggauauuga

SEQ ID NO: 501476 - RNA, 22 nt, Chlamydophila pneumoniae CWL029
aaaggcugauugaaagucagca

SEQ ID NO: 501477 - RNA, 15 nt, Chlamydophila pneumoniae CWL029
aaaggcucuuuuaga

SEQ ID NO: 501478 - RNA, 21 nt, Chlamydophila pneumoniae CWL029
aaaggcucuuuuagagccuuu

SEQ ID NO: 501479 - RNA, 16 nt, Chlamydophila pneumoniae CWL029
aaaguaacuaucuaca

SEQ ID NO: 501480 - RNA, 16 nt, Chlamydophila pneumoniae CWL029
aaaggugaaaguacag

SEQ ID NO: 501481 - RNA, 22 nt, Chlamydophila pneumoniae CWL029
aaauaaaaaaacccucaaagaa

SEQ ID NO: 501482 - RNA, 21 nt, Chlamydophila pneumoniae CWL029
aaauaaaaaaacccucaaaga

SEQ ID NO: 501483 - RNA, 15 nt, Chlamydophila pneumoniae CWL029
aaaguuuaugacaca

SEQ ID NO: 501484 - RNA, 15 nt, Chlamydophila pneumoniae CWL029
aaaguuuccaaguga

SEQ ID NO: 501485 - RNA, 15 nt, Chlamydophila pneumoniae CWL029
aaaguugaggaaagg

SEQ ID NO: 501486 - RNA, 16 nt, Chlamydophila pneumoniae CWL029
aaaguugaggaaagga

SEQ ID NO: 501487 - RNA, 19 nt, Chlamydophila pneumoniae CWL029
aaaguugcaacucucuuua

SEQ ID NO: 501488 - RNA, 18 nt, Chlamydophila pneumoniae CWL029
aaaguuccaaaucucaau

SEQ ID NO: 501489 - RNA, 13 nt, Chlamydophila pneumoniae CWL029
aaaguugaacuga

SEQ ID NO: 501490 - RNA, 21 nt, Chlamydophila pneumoniae CWL029
aaaguuaaugcaagcaacucu

SEQ ID NO: 501491 - RNA, 20 nt, Chlamydophila pneumoniae CWL029
aaaguuagguagauagaaau

SEQ ID NO: 501492 - RNA, 23 nt, Chlamydophila pneumoniae CWL029
aaaguuagguagauagaaauucu

SEQ ID NO: 501493 - RNA, 16 nt, Chlamydophila pneumoniae CWL029
aaagugaaaccauuua

SEQ ID NO: 501494 - RNA, 14 nt, Chlamydophila pneumoniae CWL029
aaagugaaagcaac

SEQ ID NO: 501495 - RNA, 23 nt, Chlamydophila pneumoniae CWL029
aaagugaaauugaacucucaguu

SEQ ID NO: 501496 - RNA, 18 nt, Chlamydophila pneumoniae CWL029
aaagucucuagggaaagg

SEQ ID NO: 501497 - RNA, 13 nt, Chlamydophila pneumoniae CWL029
aaagucucucuaa

SEQ ID NO: 501498 - RNA, 16 nt, Chlamydophila pneumoniae CWL029
aaaguaguuuuaagaa

SEQ ID NO: 501499 - RNA, 20 nt, Chlamydophila pneumoniae CWL029
aaaguaggggcaguuccuaa

SEQ ID NO: 501500 - RNA, 16 nt, Chlamydophila pneumoniae CWL029
aaaguaggauugauaa

SEQ ID NO: 501501 - RNA, 17 nt, Chlamydophila pneumoniae CWL029
aaaguaggcacaucauu

SEQ ID NO: 501502 - RNA, 19 nt, Chlamydophila pneumoniae CWL029
aaaguagccauuccaugga

SEQ ID NO: 501503 - RNA, 14 nt, Chlamydophila pneumoniae CWL029
aaaguaaucacuuc

SEQ ID NO: 501504 - RNA, 20 nt, Chlamydophila pneumoniae CWL029
aaagugacuuccuccaaaau

SEQ ID NO: 501505 - RNA, 19 nt, Chlamydophila pneumoniae CWL029
aaagugaugccuggacugc

SEQ ID NO: 501506 - RNA, 19 nt, Chlamydophila pneumoniae CWL029
aaaguggcaaucuuuucuu

SEQ ID NO: 501507 - RNA, 15 nt, Chlamydophila pneumoniae CWL029
aaaguuaaaccuuuu

SEQ ID NO: 501508 - RNA, 12 nt, Chlamydophila pneumoniae CWL029
aaauaucuuaac

SEQ ID NO: 501509 - RNA, 22 nt, Chlamydophila pneumoniae CWL029
aaauaucuccguuaccaaaaac

SEQ ID NO: 501510 - RNA, 23 nt, Chlamydophila pneumoniae CWL029
aaauaucuccguuaccaaaaacu

SEQ ID NO: 501511 - RNA, 21 nt, Chlamydophila pneumoniae CWL029
aaauaucucuggcauaauccu

SEQ ID NO: 501512 - RNA, 14 nt, Chlamydophila pneumoniae CWL029
aaauaucauucacu

SEQ ID NO: 501513 - RNA, 14 nt, Chlamydophila pneumoniae CWL029
aaauaucggaagag

SEQ ID NO: 501514 - RNA, 15 nt, Chlamydophila pneumoniae CWL029
aaauaucacauucca

SEQ ID NO: 501515 - RNA, 18 nt, Chlamydophila pneumoniae CWL029
aaauaucacauuccaaug

SEQ ID NO: 501516 - RNA, 18 nt, Chlamydophila pneumoniae CWL029
aaauauaguuuucauaau

SEQ ID NO: 501517 - RNA, 19 nt, Chlamydophila pneumoniae CWL029
aaauauaguuuucauaauc

SEQ ID NO: 501518 - RNA, 14 nt, Chlamydophila pneumoniae CWL029
aaauagauccugaa

SEQ ID NO: 501519 - RNA, 20 nt, Chlamydophila pneumoniae CWL029
aaauagauccugaaaguaca

SEQ ID NO: 501520 - RNA, 16 nt, Chlamydophila pneumoniae CWL029
aaauaguucaucauau

SEQ ID NO: 501521 - RNA, 17 nt, Chlamydophila pneumoniae CWL029
aaauauagaaaaucauu

SEQ ID NO: 501522 - RNA, 22 nt, Chlamydophila pneumoniae CWL029
aaauaccacagcuguacagaac

SEQ ID NO: 501523 - RNA, 16 nt, Chlamydophila pneumoniae CWL029
aaauaccaagaugucu

SEQ ID NO: 501524 - RNA, 17 nt, Chlamydophila pneumoniae CWL029
aaauaccaguagagaau

SEQ ID NO: 501525 - RNA, 22 nt, Chlamydophila pneumoniae CWL029
aaauacccucggagacucagag

SEQ ID NO: 501526 - RNA, 14 nt, Chlamydophila pneumoniae CWL029
aaauagaaaucuua

SEQ ID NO: 501527 - RNA, 12 nt, Chlamydophila pneumoniae CWL029
aaauagaaauaa

SEQ ID NO: 501528 - RNA, 15 nt, Chlamydophila pneumoniae CWL029
aaauaauuuuauuag

SEQ ID NO: 501529 - RNA, 17 nt, Chlamydophila pneumoniae CWL029
aaauacaggccugaugu

SEQ ID NO: 501530 - RNA, 23 nt, Chlamydophila pneumoniae CWL029
aaauuugcucuccugcaaaaagu

SEQ ID NO: 501531 - RNA, 16 nt, Chlamydophila pneumoniae CWL029
aaauuucuuauaaaaa

SEQ ID NO: 501532 - RNA, 11 nt, Chlamydophila pneumoniae CWL029
aaauuucugaa

SEQ ID NO: 501533 - RNA, 21 nt, Chlamydophila pneumoniae CWL029
aaauuuaucggcuaaagaaaa

SEQ ID NO: 501534 - RNA, 16 nt, Chlamydophila pneumoniae CWL029
aaauugugaaaaaaaa

SEQ ID NO: 501535 - RNA, 20 nt, Chlamydophila pneumoniae CWL029
aaauuguuggaauugcauua

SEQ ID NO: 501536 - RNA, 20 nt, Chlamydophila pneumoniae CWL029
aaauuguuuguaucaaagaa

SEQ ID NO: 501537 - RNA, 13 nt, Chlamydophila pneumoniae CWL029
aaauuguuuuugc

SEQ ID NO: 501538 - RNA, 17 nt, Chlamydophila pneumoniae CWL029
aaauugcauuuaaacua

SEQ ID NO: 501539 - RNA, 12 nt, Chlamydophila pneumoniae CWL029
aaauugcucuug

SEQ ID NO: 501540 - RNA, 20 nt, Chlamydophila pneumoniae CWL029
aaauugaugagcucuccauu

SEQ ID NO: 501541 - RNA, 17 nt, Chlamydophila pneumoniae CWL029
aaauugaauaucgaguu

SEQ ID NO: 501542 - RNA, 19 nt, Chlamydophila pneumoniae CWL029
aaauucaguauaagaugcu

SEQ ID NO: 501543 - RNA, 14 nt, Chlamydophila pneumoniae CWL029
aaauucauuaagaa

SEQ ID NO: 501544 - RNA, 21 nt, Chlamydophila pneumoniae CWL029
aaauuccaauuuuugcauaga

SEQ ID NO: 501545 - RNA, 20 nt, Chlamydophila pneumoniae CWL029
aacaaaauuucuuauaaaaa

SEQ ID NO: 501546 - RNA, 16 nt, Chlamydophila pneumoniae CWL029
aacaaaaacugcgcua

SEQ ID NO: 501547 - RNA, 14 nt, Chlamydophila pneumoniae CWL029
aacaaaaaaucaau

SEQ ID NO: 501548 - RNA, 12 nt, Chlamydophila pneumoniae CWL029
aaauuuuuaaaa

SEQ ID NO: 501549 - RNA, 11 nt, Chlamydophila pneumoniae CWL029
aaauuuucuaa

SEQ ID NO: 501550 - RNA, 14 nt, Chlamydophila pneumoniae CWL029
aacaacugaaaaac

SEQ ID NO: 501551 - RNA, 22 nt, Chlamydophila pneumoniae CWL029
aacaacucucccauguaguaaa

SEQ ID NO: 501552 - RNA, 23 nt, Chlamydophila pneumoniae CWL029
aacaagauaaccugagaguguug

SEQ ID NO: 501553 - RNA, 22 nt, Chlamydophila pneumoniae CWL029
aacaagcugcugagcagcaaaa

SEQ ID NO: 501554 - RNA, 19 nt, Chlamydophila pneumoniae CWL029
aacaaccaucccauaugga

SEQ ID NO: 501555 - RNA, 21 nt, Chlamydophila pneumoniae CWL029
aacaacauucguuaggugacc

SEQ ID NO: 501556 - RNA, 22 nt, Chlamydophila pneumoniae CWL029
aacaacaucacuuauauuuucu

SEQ ID NO: 501557 - RNA, 14 nt, Chlamydophila pneumoniae CWL029
aacaacauaaagaa

SEQ ID NO: 501558 - RNA, 15 nt, Chlamydophila pneumoniae CWL029
aacaacauaaagaag

SEQ ID NO: 501559 - RNA, 16 nt, Chlamydophila pneumoniae CWL029
aacaacauaaagaagg

SEQ ID NO: 501560 - RNA, 19 nt, Chlamydophila pneumoniae CWL029
aacaacauaaagaagguuu

SEQ ID NO: 501561 - RNA, 23 nt, Chlamydophila pneumoniae CWL029
aacaacaucacuaucauggacaa

SEQ ID NO: 501562 - RNA, 14 nt, Chlamydophila pneumoniae CWL029
aacaacagaaaugu

SEQ ID NO: 501563 - RNA, 15 nt, Chlamydophila pneumoniae CWL029
aacaacagaaauguu

SEQ ID NO: 501564 - RNA, 22 nt, Chlamydophila pneumoniae CWL029
aacaaaguuuaugacacagcua

SEQ ID NO: 501565 - RNA, 12 nt, Chlamydophila pneumoniae CWL029
aacaaaguuuau

SEQ ID NO: 501566 - RNA, 16 nt, Chlamydophila pneumoniae CWL029
aacaaauugaugauuu

SEQ ID NO: 501567 - RNA, 22 nt, Chlamydophila pneumoniae CWL029
aaauuaagucacacuuuccguu

SEQ ID NO: 501568 - RNA, 14 nt, Chlamydophila pneumoniae CWL029
aaaaagagcccaaa

SEQ ID NO: 501569 - RNA, 20 nt, Chlamydophila pneumoniae CWL029
aaaaagagcccaaaaacacu

SEQ ID NO: 501570 - RNA, 20 nt, Chlamydophila pneumoniae CWL029
aaauuaguaaaugccucuuu

SEQ ID NO: 501571 - RNA, 14 nt, Chlamydophila pneumoniae CWL029
aaauguuuuuaaac

SEQ ID NO: 501572 - RNA, 18 nt, Chlamydophila pneumoniae CWL029
aaaugugaaaucguaucu

SEQ ID NO: 501573 - RNA, 22 nt, Chlamydophila pneumoniae CWL029
aaauggugaagaauaauagcaa

SEQ ID NO: 501574 - RNA, 16 nt, Chlamydophila pneumoniae CWL029
aaaugguaauuuuuca

SEQ ID NO: 501575 - RNA, 20 nt, Chlamydophila pneumoniae CWL029
aaaugguaauuuuucaguuc

SEQ ID NO: 501576 - RNA, 10 nt, Chlamydophila pneumoniae CWL029
aaauguaggg

SEQ ID NO: 501577 - RNA, 16 nt, Chlamydophila pneumoniae CWL029
aaaugcacuuugaaua

SEQ ID NO: 501578 - RNA, 17 nt, Chlamydophila pneumoniae CWL029
aaaugaauauaauucca

SEQ ID NO: 501579 - RNA, 19 nt, Chlamydophila pneumoniae CWL029
aaaucgugcuuagagccuu

SEQ ID NO: 501580 - RNA, 22 nt, Chlamydophila pneumoniae CWL029
aaaucucgagcuaccuaggguc

SEQ ID NO: 501581 - RNA, 17 nt, Chlamydophila pneumoniae CWL029
aaaucguacuucacuuc

SEQ ID NO: 501582 - RNA, 18 nt, Chlamydophila pneumoniae CWL029
aaaucugcucuacuuguc

SEQ ID NO: 501583 - RNA, 18 nt, Chlamydophila pneumoniae CWL029
aaaucuucuggagggagu

SEQ ID NO: 501584 - RNA, 16 nt, Chlamydophila pneumoniae CWL029
aaaucuuuagaauuaa

SEQ ID NO: 501585 - RNA, 15 nt, Chlamydophila pneumoniae CWL029
aaaucgacaggggag

SEQ ID NO: 501586 - RNA, 12 nt, Chlamydophila pneumoniae CWL029
aaauccuaaaaa

SEQ ID NO: 501587 - RNA, 14 nt, Chlamydophila pneumoniae CWL029
aaauccuaaaaagg

SEQ ID NO: 501588 - RNA, 16 nt, Chlamydophila pneumoniae CWL029
aaauccgauaagauaa

SEQ ID NO: 501589 - RNA, 16 nt, Chlamydophila pneumoniae CWL029
aaauccaccaaugaua

SEQ ID NO: 501590 - RNA, 16 nt, Chlamydophila pneumoniae CWL029
aaaucccgccuuucua

SEQ ID NO: 501591 - RNA, 23 nt, Chlamydophila pneumoniae CWL029
aaauccacauccuuguagaacuu

SEQ ID NO: 501592 - RNA, 14 nt, Chlamydophila pneumoniae CWL029
aagagucucuugcu

SEQ ID NO: 501593 - RNA, 17 nt, Chlamydophila pneumoniae CWL029
aagagucucacucuuuu

SEQ ID NO: 501594 - RNA, 12 nt, Chlamydophila pneumoniae CWL029
aagagucuugca

SEQ ID NO: 501595 - RNA, 20 nt, Chlamydophila pneumoniae CWL029
aagagugguuccugaaaagc

SEQ ID NO: 501596 - RNA, 22 nt, Chlamydophila pneumoniae CWL029
aagaguuguuguggaaucacgu

SEQ ID NO: 501597 - RNA, 17 nt, Chlamydophila pneumoniae CWL029
aagagugccaagagcau

SEQ ID NO: 501598 - RNA, 20 nt, Chlamydophila pneumoniae CWL029
aagaguuccaagacaauaaa

SEQ ID NO: 501599 - RNA, 18 nt, Chlamydophila pneumoniae CWL029
aagauaaucuguaagaaa

SEQ ID NO: 501600 - RNA, 19 nt, Chlamydophila pneumoniae CWL029
aagauaauagagaagaagc

SEQ ID NO: 501601 - RNA, 13 nt, Chlamydophila pneumoniae CWL029
aagauaaacagca

SEQ ID NO: 501602 - RNA, 17 nt, Chlamydophila pneumoniae CWL029
aagauaaacagcacagg

SEQ ID NO: 501603 - RNA, 13 nt, Chlamydophila pneumoniae CWL029
aagauaaacauac

SEQ ID NO: 501604 - RNA, 13 nt, Chlamydophila pneumoniae CWL029
aagauaaacauua

SEQ ID NO: 501605 - RNA, 15 nt, Chlamydophila pneumoniae CWL029
aagauaaagaauucu

SEQ ID NO: 501606 - RNA, 12 nt, Chlamydophila pneumoniae CWL029
aagauaaauccc

SEQ ID NO: 501607 - RNA, 23 nt, Chlamydophila pneumoniae CWL029
aagaucaauauagagaacuccau

SEQ ID NO: 501608 - RNA, 15 nt, Chlamydophila pneumoniae CWL029
aagauauguccguga

SEQ ID NO: 501609 - RNA, 15 nt, Chlamydophila pneumoniae CWL029
aagauauauuuuuaa

SEQ ID NO: 501610 - RNA, 13 nt, Chlamydophila pneumoniae CWL029
aagauauccuuuu

SEQ ID NO: 501611 - RNA, 18 nt, Chlamydophila pneumoniae CWL029
aagauauagauucaugaa

SEQ ID NO: 501612 - RNA, 19 nt, Chlamydophila pneumoniae CWL029
aagauaguauuuuugaaac

SEQ ID NO: 501613 - RNA, 17 nt, Chlamydophila pneumoniae CWL029
aagauaguuauuaauaa

SEQ ID NO: 501614 - RNA, 13 nt, Chlamydophila pneumoniae CWL029
aagauaguauuuu

SEQ ID NO: 501615 - RNA, 18 nt, Chlamydophila pneumoniae CWL029
aagauaguauuuuugaaa

SEQ ID NO: 501616 - RNA, 16 nt, Chlamydophila pneumoniae CWL029
aagauacgaaguccca

SEQ ID NO: 501617 - RNA, 14 nt, Chlamydophila pneumoniae CWL029
aagauagacucuca

SEQ ID NO: 501618 - RNA, 21 nt, Chlamydophila pneumoniae CWL029
aagagcaacaguaauuauuuu

SEQ ID NO: 501619 - RNA, 16 nt, Chlamydophila pneumoniae CWL029
aagagcaucuuuggga

SEQ ID NO: 501620 - RNA, 17 nt, Chlamydophila pneumoniae CWL029
aagagaucacagggaca

SEQ ID NO: 501621 - RNA, 20 nt, Chlamydophila pneumoniae CWL029
aagagagcuugucacacugc

SEQ ID NO: 501622 - RNA, 17 nt, Chlamydophila pneumoniae CWL029
aagagacaagaaaauau

SEQ ID NO: 501623 - RNA, 11 nt, Chlamydophila pneumoniae CWL029
aagagaauuau

SEQ ID NO: 501624 - RNA, 16 nt, Chlamydophila pneumoniae CWL029
aagagguucuugcuua

SEQ ID NO: 501625 - RNA, 12 nt, Chlamydophila pneumoniae CWL029
aagaggggagcu

SEQ ID NO: 501626 - RNA, 18 nt, Chlamydophila pneumoniae CWL029
aagagguaauaauaguga

SEQ ID NO: 501627 - RNA, 17 nt, Chlamydophila pneumoniae CWL029
aagaggcuuuaaauuuu

SEQ ID NO: 501628 - RNA, 20 nt, Chlamydophila pneumoniae CWL029
aagaggcucccaucgucccu

SEQ ID NO: 501629 - RNA, 19 nt, Chlamydophila pneumoniae CWL029
aagagcgcguuucaaauag

SEQ ID NO: 501630 - RNA, 14 nt, Chlamydophila pneumoniae CWL029
aagagcgcauuuua

SEQ ID NO: 501631 - RNA, 15 nt, Chlamydophila pneumoniae CWL029
aagagcuaaagaaac

SEQ ID NO: 501632 - RNA, 16 nt, Chlamydophila pneumoniae CWL029
aagagcuaaagaaacu

SEQ ID NO: 501633 - RNA, 16 nt, Chlamydophila pneumoniae CWL029
aagagcuaugaugaga

SEQ ID NO: 501634 - RNA, 23 nt, Chlamydophila pneumoniae CWL029
aagagcucguaauccuucuuucu

SEQ ID NO: 501635 - RNA, 14 nt, Chlamydophila pneumoniae CWL029
aagagcucuugaga

SEQ ID NO: 501636 - RNA, 18 nt, Chlamydophila pneumoniae CWL029
aagagcucuugagaaagc

SEQ ID NO: 501637 - RNA, 21 nt, Chlamydophila pneumoniae CWL029
aagacuccaagucagccaaga

SEQ ID NO: 501638 - RNA, 17 nt, Chlamydophila pneumoniae CWL029
aagacucccaaggaaau

SEQ ID NO: 501639 - RNA, 14 nt, Chlamydophila pneumoniae CWL029
aagacucucaucag

SEQ ID NO: 501640 - RNA, 16 nt, Chlamydophila pneumoniae CWL029
aagacucucaucagca

SEQ ID NO: 501641 - RNA, 17 nt, Chlamydophila pneumoniae CWL029
aagacuacgacagaagu

SEQ ID NO: 501642 - RNA, 14 nt, Chlamydophila pneumoniae CWL029
aagacuaaaaaaga

SEQ ID NO: 501643 - RNA, 15 nt, Chlamydophila pneumoniae CWL029
aagacuaaaaaagag

SEQ ID NO: 501644 - RNA, 16 nt, Chlamydophila pneumoniae CWL029
aagacuaaaaaagaga

SEQ ID NO: 501645 - RNA, 18 nt, Chlamydophila pneumoniae CWL029
aagacuacgacagaagua

SEQ ID NO: 501646 - RNA, 13 nt, Chlamydophila pneumoniae CWL029
aagacuaaaaaag

SEQ ID NO: 501647 - RNA, 14 nt, Chlamydophila pneumoniae CWL029
aagagaaaagauag

SEQ ID NO: 501648 - RNA, 23 nt, Chlamydophila pneumoniae CWL029
aagacuuuuuaguauacuaagac

SEQ ID NO: 501649 - RNA, 20 nt, Chlamydophila pneumoniae CWL029
aagacuucgaugucuuucca

SEQ ID NO: 501650 - RNA, 15 nt, Chlamydophila pneumoniae CWL029
aagacugucuaugau

SEQ ID NO: 501651 - RNA, 20 nt, Chlamydophila pneumoniae CWL029
aagaccuaacgcaacaucca

SEQ ID NO: 501652 - RNA, 14 nt, Chlamydophila pneumoniae CWL029
aagacccuucuuuc

SEQ ID NO: 501653 - RNA, 17 nt, Chlamydophila pneumoniae CWL029
aagacgcggaacucucu

SEQ ID NO: 501654 - RNA, 20 nt, Chlamydophila pneumoniae CWL029
aagacaauggaaauagagaa

SEQ ID NO: 501655 - RNA, 20 nt, Chlamydophila pneumoniae CWL029
aagacaaugucgucucagaa

SEQ ID NO: 501656 - RNA, 15 nt, Chlamydophila pneumoniae CWL029
aagacaauaaaaaag

SEQ ID NO: 501657 - RNA, 16 nt, Chlamydophila pneumoniae CWL029
aagacaauaaaaaaga

SEQ ID NO: 501658 - RNA, 16 nt, Chlamydophila pneumoniae CWL029
aagacaccgaaagaaa

SEQ ID NO: 501659 - RNA, 20 nt, Chlamydophila pneumoniae CWL029
aagaauuucuucuuuccaua

SEQ ID NO: 501660 - RNA, 22 nt, Chlamydophila pneumoniae CWL029
aagaauuuguaacucuuaagaa

SEQ ID NO: 501661 - RNA, 19 nt, Chlamydophila pneumoniae CWL029
aagacaggcucaugaaauu

SEQ ID NO: 501662 - RNA, 20 nt, Chlamydophila pneumoniae CWL029
aagaaaucuacucuuuaaaa

SEQ ID NO: 501663 - RNA, 21 nt, Chlamydophila pneumoniae CWL029
aagaaaugcaaaccaaaaaag

SEQ ID NO: 501664 - RNA, 20 nt, Chlamydophila pneumoniae CWL029
aagaaauauacugccagcga

SEQ ID NO: 501665 - RNA, 22 nt, Chlamydophila pneumoniae CWL029
aagaaauauuaacccaccagaa

SEQ ID NO: 501666 - RNA, 15 nt, Chlamydophila pneumoniae CWL029
aagaaaucaaacauu

SEQ ID NO: 501667 - RNA, 16 nt, Chlamydophila pneumoniae CWL029
aagaaaucaaacauua

SEQ ID NO: 501668 - RNA, 17 nt, Chlamydophila pneumoniae CWL029
aagaaugagaacgucua

SEQ ID NO: 501669 - RNA, 16 nt, Chlamydophila pneumoniae CWL029
aagaaugacacagaga

SEQ ID NO: 501670 - RNA, 14 nt, Chlamydophila pneumoniae CWL029
aagaaucguucuua

SEQ ID NO: 501671 - RNA, 17 nt, Chlamydophila pneumoniae CWL029
aagaaucuauaaauuca

SEQ ID NO: 501672 - RNA, 18 nt, Chlamydophila pneumoniae CWL029
aagaaucuauagaacuaa

SEQ ID NO: 501673 - RNA, 20 nt, Chlamydophila pneumoniae CWL029
aacucuuaaagguaaagcuu

SEQ ID NO: 501674 - RNA, 23 nt, Chlamydophila pneumoniae CWL029
aacucuuaaagguaaagcuucuu

SEQ ID NO: 501675 - RNA, 16 nt, Chlamydophila pneumoniae CWL029
aacucuuaagaauaaa

SEQ ID NO: 501676 - RNA, 18 nt, Chlamydophila pneumoniae CWL029
aacucugcccgucuuaga

SEQ ID NO: 501677 - RNA, 13 nt, Chlamydophila pneumoniae CWL029
aacucucuuuaaa

SEQ ID NO: 501678 - RNA, 17 nt, Chlamydophila pneumoniae CWL029
aacucucuucccccaga

SEQ ID NO: 501679 - RNA, 18 nt, Chlamydophila pneumoniae CWL029
aacucugaaguacacuac

SEQ ID NO: 501680 - RNA, 14 nt, Chlamydophila pneumoniae CWL029
aacucuaaucugau

SEQ ID NO: 501681 - RNA, 15 nt, Chlamydophila pneumoniae CWL029
aacucccguuuuguu

SEQ ID NO: 501682 - RNA, 17 nt, Chlamydophila pneumoniae CWL029
aacuccaggggauaaaa

SEQ ID NO: 501683 - RNA, 22 nt, Chlamydophila pneumoniae CWL029
aacuccuaagucguuaacauca

SEQ ID NO: 501684 - RNA, 23 nt, Chlamydophila pneumoniae CWL029
aacuccucuaaggacaaaucucc

SEQ ID NO: 501685 - RNA, 13 nt, Chlamydophila pneumoniae CWL029
aacuccuuuuaaa

SEQ ID NO: 501686 - RNA, 20 nt, Chlamydophila pneumoniae CWL029
aacggcucuuucuaaaacau

SEQ ID NO: 501687 - RNA, 17 nt, Chlamydophila pneumoniae CWL029
aacucaaucucuuugac

SEQ ID NO: 501688 - RNA, 15 nt, Chlamydophila pneumoniae CWL029
aacucacaaacaaca

SEQ ID NO: 501689 - RNA, 17 nt, Chlamydophila pneumoniae CWL029
aacucagcgcaucacga

SEQ ID NO: 501690 - RNA, 13 nt, Chlamydophila pneumoniae CWL029
aacuccaaaauau

SEQ ID NO: 501691 - RNA, 12 nt, Chlamydophila pneumoniae CWL029
aacuccaaaaua

SEQ ID NO: 501692 - RNA, 12 nt, Chlamydophila pneumoniae CWL029
aacuccacgcca

SEQ ID NO: 501693 - RNA, 21 nt, Chlamydophila pneumoniae CWL029
aacugcgauacucucagcaaa

SEQ ID NO: 501694 - RNA, 18 nt, Chlamydophila pneumoniae CWL029
aacugccugagaaaaguu

SEQ ID NO: 501695 - RNA, 18 nt, Chlamydophila pneumoniae CWL029
aacuucagcaagaaaaua

SEQ ID NO: 501696 - RNA, 19 nt, Chlamydophila pneumoniae CWL029
aacuguguucaauagcaaa

SEQ ID NO: 501697 - RNA, 21 nt, Chlamydophila pneumoniae CWL029
aacuucguuucgcuuugauaa

SEQ ID NO: 501698 - RNA, 14 nt, Chlamydophila pneumoniae CWL029
aacuucuaaaagca

SEQ ID NO: 501699 - RNA, 13 nt, Chlamydophila pneumoniae CWL029
aacuucuaacugu

SEQ ID NO: 501700 - RNA, 19 nt, Chlamydophila pneumoniae CWL029
aacuuugaccagaugauuu

SEQ ID NO: 501701 - RNA, 23 nt, Chlamydophila pneumoniae CWL029
aacuuugaccagaugauuuuuug

SEQ ID NO: 501702 - RNA, 17 nt, Chlamydophila pneumoniae CWL029
aacuuucugggagaaag

SEQ ID NO: 501703 - RNA, 23 nt, Chlamydophila pneumoniae CWL029
aacuuucgaagcgcucuacaaau

SEQ ID NO: 501704 - RNA, 22 nt, Chlamydophila pneumoniae CWL029
aacuuucgaagcgcucuacaaa

SEQ ID NO: 501705 - RNA, 24 nt, Chlamydophila pneumoniae CWL029
aacuuuaggauucaguuccucauc

SEQ ID NO: 501706 - RNA, 17 nt, Chlamydophila pneumoniae CWL029
aacuuuagggaagaaau

SEQ ID NO: 501707 - RNA, 20 nt, Chlamydophila pneumoniae CWL029
aacuuuaggauucaguuccu

SEQ ID NO: 501708 - RNA, 17 nt, Chlamydophila pneumoniae CWL029
aacuuuaggauucaguu

SEQ ID NO: 501709 - RNA, 12 nt, Chlamydophila pneumoniae CWL029
aacuucucuagg

SEQ ID NO: 501710 - RNA, 19 nt, Chlamydophila pneumoniae CWL029
aacuuguuuucguaagaga

SEQ ID NO: 501711 - RNA, 19 nt, Chlamydophila pneumoniae CWL029
aacuuuugaagauccugag

SEQ ID NO: 501712 - RNA, 14 nt, Chlamydophila pneumoniae CWL029
aacuuuugaauuaa

SEQ ID NO: 501713 - RNA, 22 nt, Chlamydophila pneumoniae CWL029
aagaaaauaucaccuacaucag

SEQ ID NO: 501714 - RNA, 17 nt, Chlamydophila pneumoniae CWL029
aacuuuuuuucuucucu

SEQ ID NO: 501715 - RNA, 23 nt, Chlamydophila pneumoniae CWL029
aacuuuuuuucuucucuaagaaa

SEQ ID NO: 501716 - RNA, 15 nt, Chlamydophila pneumoniae CWL029
aagaaaauaaagauc

SEQ ID NO: 501717 - RNA, 21 nt, Chlamydophila pneumoniae CWL029
aagaaaauucucagauugcuu

SEQ ID NO: 501718 - RNA, 18 nt, Chlamydophila pneumoniae CWL029
aacgcgagcuauuuuacu

SEQ ID NO: 501719 - RNA, 17 nt, Chlamydophila pneumoniae CWL029
aacgagaaguuugauaa

SEQ ID NO: 501720 - RNA, 22 nt, Chlamydophila pneumoniae CWL029
aacgacguuuaauuccuuggau

SEQ ID NO: 501721 - RNA, 15 nt, Chlamydophila pneumoniae CWL029
aacgacauugaagag

SEQ ID NO: 501722 - RNA, 14 nt, Chlamydophila pneumoniae CWL029
aacgcacgccaaga

SEQ ID NO: 501723 - RNA, 16 nt, Chlamydophila pneumoniae CWL029
aacgcacgccaagaga

SEQ ID NO: 501724 - RNA, 22 nt, Chlamydophila pneumoniae CWL029
aacgcaugaaccuauaggcaag

SEQ ID NO: 501725 - RNA, 15 nt, Chlamydophila pneumoniae CWL029
aacgcaggaagaaca

SEQ ID NO: 501726 - RNA, 20 nt, Chlamydophila pneumoniae CWL029
aacgcaggaagaacaaguuu

SEQ ID NO: 501727 - RNA, 16 nt, Chlamydophila pneumoniae CWL029
aacgcauaagagacau

SEQ ID NO: 501728 - RNA, 14 nt, Chlamydophila pneumoniae CWL029
aaccuucucucuua

SEQ ID NO: 501729 - RNA, 19 nt, Chlamydophila pneumoniae CWL029
aaccuucgauuccaggcuc

SEQ ID NO: 501730 - RNA, 13 nt, Chlamydophila pneumoniae CWL029
aaccuucaaugau

SEQ ID NO: 501731 - RNA, 14 nt, Chlamydophila pneumoniae CWL029
aaccuuuccuaaaa

SEQ ID NO: 501732 - RNA, 16 nt, Chlamydophila pneumoniae CWL029
aaccuuuccuaaaaua

SEQ ID NO: 501733 - RNA, 22 nt, Chlamydophila pneumoniae CWL029
aaccucggucucgcuguuucaa

SEQ ID NO: 501734 - RNA, 12 nt, Chlamydophila pneumoniae CWL029
aaccucuuuucu

SEQ ID NO: 501735 - RNA, 13 nt, Chlamydophila pneumoniae CWL029
aaccucuuuucuu

SEQ ID NO: 501736 - RNA, 14 nt, Chlamydophila pneumoniae CWL029
aaccucuuuucuua

SEQ ID NO: 501737 - RNA, 22 nt, Chlamydophila pneumoniae CWL029
aaccuggcauugccauaauaaa

SEQ ID NO: 501738 - RNA, 17 nt, Chlamydophila pneumoniae CWL029
aaccugggcaauauuuu

SEQ ID NO: 501739 - RNA, 24 nt, Chlamydophila pneumoniae CWL029
aaccuagaaggaggaguccuucua

SEQ ID NO: 501740 - RNA, 21 nt, Chlamydophila pneumoniae CWL029
aaccuagaaucacauaaaaua

SEQ ID NO: 501741 - RNA, 20 nt, Chlamydophila pneumoniae CWL029
aaccggguguggcaaaggac

SEQ ID NO: 501742 - RNA, 13 nt, Chlamydophila pneumoniae CWL029
aaccccuccaaaa

SEQ ID NO: 501743 - RNA, 13 nt, Chlamydophila pneumoniae CWL029
aaccauaaagaau

SEQ ID NO: 501744 - RNA, 14 nt, Chlamydophila pneumoniae CWL029
aaccauagagagcc

SEQ ID NO: 501745 - RNA, 15 nt, Chlamydophila pneumoniae CWL029
aaccauagagagccu

SEQ ID NO: 501746 - RNA, 15 nt, Chlamydophila pneumoniae CWL029
aaccaggaacaaagg

SEQ ID NO: 501747 - RNA, 11 nt, Chlamydophila pneumoniae CWL029
aaccagagagc

SEQ ID NO: 501748 - RNA, 13 nt, Chlamydophila pneumoniae CWL029
aacaucuaaaaau

SEQ ID NO: 501749 - RNA, 23 nt, Chlamydophila pneumoniae CWL029
aacauggcgguguuuccuucgaa

SEQ ID NO: 501750 - RNA, 20 nt, Chlamydophila pneumoniae CWL029
aacauuuuuaaggaaaguuc

SEQ ID NO: 501751 - RNA, 23 nt, Chlamydophila pneumoniae CWL029
aacauuuuucaauaaccagaaga

SEQ ID NO: 501752 - RNA, 11 nt, Chlamydophila pneumoniae CWL029
aaccacagaau

SEQ ID NO: 501753 - RNA, 13 nt, Chlamydophila pneumoniae CWL029
aaccaaaaugagu

SEQ ID NO: 501754 - RNA, 13 nt, Chlamydophila pneumoniae CWL029
aaccaaaaugcau

SEQ ID NO: 501755 - RNA, 22 nt, Chlamydophila pneumoniae CWL029
aaccacagugauuuagaaaucu

SEQ ID NO: 501756 - RNA, 18 nt, Chlamydophila pneumoniae CWL029
aacaagggaaagaaacua

SEQ ID NO: 501757 - RNA, 19 nt, Chlamydophila pneumoniae CWL029
aacaagggaagagaaaacg

SEQ ID NO: 501758 - RNA, 15 nt, Chlamydophila pneumoniae CWL029
aacaaggauuaugaa

SEQ ID NO: 501759 - RNA, 22 nt, Chlamydophila pneumoniae CWL029
aacagcuccuggauauugucaa

SEQ ID NO: 501760 - RNA, 13 nt, Chlamydophila pneumoniae CWL029
aacagcuucagga

SEQ ID NO: 501761 - RNA, 14 nt, Chlamydophila pneumoniae CWL029
aacagguucacuuc

SEQ ID NO: 501762 - RNA, 17 nt, Chlamydophila pneumoniae CWL029
aacaggaauagaaaauc

SEQ ID NO: 501763 - RNA, 16 nt, Chlamydophila pneumoniae CWL029
aacaggauugauaaau

SEQ ID NO: 501764 - RNA, 15 nt, Chlamydophila pneumoniae CWL029
aacaucaaagaauua

SEQ ID NO: 501765 - RNA, 13 nt, Chlamydophila pneumoniae CWL029
aacaucaaagaga

SEQ ID NO: 501766 - RNA, 15 nt, Chlamydophila pneumoniae CWL029
aacaucaagaauuuc

SEQ ID NO: 501767 - RNA, 17 nt, Chlamydophila pneumoniae CWL029
aacaucacucaggauau

SEQ ID NO: 501768 - RNA, 18 nt, Chlamydophila pneumoniae CWL029
aacaucacuuauauuuuc

SEQ ID NO: 501769 - RNA, 18 nt, Chlamydophila pneumoniae CWL029
aacaucggagaacuuccu

SEQ ID NO: 501770 - RNA, 15 nt, Chlamydophila pneumoniae CWL029
aacaguccucucccu

SEQ ID NO: 501771 - RNA, 15 nt, Chlamydophila pneumoniae CWL029
aacagugguaugcuu

SEQ ID NO: 501772 - RNA, 22 nt, Chlamydophila pneumoniae CWL029
aacaguuccuauuuuuugugaa

SEQ ID NO: 501773 - RNA, 15 nt, Chlamydophila pneumoniae CWL029
aacauaaagaagguu

SEQ ID NO: 501774 - RNA, 19 nt, Chlamydophila pneumoniae CWL029
aacauaaagacccuucuuu

SEQ ID NO: 501775 - RNA, 15 nt, Chlamydophila pneumoniae CWL029
aacauaacaugagaa

SEQ ID NO: 501776 - RNA, 20 nt, Chlamydophila pneumoniae CWL029
aacaguucgggcuaaucauu

SEQ ID NO: 501777 - RNA, 19 nt, Chlamydophila pneumoniae CWL029
aagccuuugcucacuguuu

SEQ ID NO: 501778 - RNA, 20 nt, Chlamydophila pneumoniae CWL029
aagccuuucuuauuacagaa

SEQ ID NO: 501779 - RNA, 17 nt, Chlamydophila pneumoniae CWL029
aagccucgaaauuuuca

SEQ ID NO: 501780 - RNA, 17 nt, Chlamydophila pneumoniae CWL029
aagccugcggcaaguau

SEQ ID NO: 501781 - RNA, 13 nt, Chlamydophila pneumoniae CWL029
aagccuucauucc

SEQ ID NO: 501782 - RNA, 12 nt, Chlamydophila pneumoniae CWL029
aagccuuccuug

SEQ ID NO: 501783 - RNA, 22 nt, Chlamydophila pneumoniae CWL029
aagaucauggauucacaucuua

SEQ ID NO: 501784 - RNA, 15 nt, Chlamydophila pneumoniae CWL029
aagaucaguuuuuuc

SEQ ID NO: 501785 - RNA, 14 nt, Chlamydophila pneumoniae CWL029
aagaucauaugcac

SEQ ID NO: 501786 - RNA, 23 nt, Chlamydophila pneumoniae CWL029
aagaucgcucgaucgugcucugc

SEQ ID NO: 501787 - RNA, 22 nt, Chlamydophila pneumoniae CWL029
aagaucggaguuaucaaaagga

SEQ ID NO: 501788 - RNA, 17 nt, Chlamydophila pneumoniae CWL029
aagaucuaacuucacca

SEQ ID NO: 501789 - RNA, 22 nt, Chlamydophila pneumoniae CWL029
aagaucuaacuucaccauauaa

SEQ ID NO: 501790 - RNA, 22 nt, Chlamydophila pneumoniae CWL029
aagccguguaccucucaucaaa

SEQ ID NO: 501791 - RNA, 18 nt, Chlamydophila pneumoniae CWL029
aagccggcccacucaaaa

SEQ ID NO: 501792 - RNA, 23 nt, Chlamydophila pneumoniae CWL029
aagccggcccacucaaaagaaga

SEQ ID NO: 501793 - RNA, 14 nt, Chlamydophila pneumoniae CWL029
aagcucauaagaaa

SEQ ID NO: 501794 - RNA, 16 nt, Chlamydophila pneumoniae CWL029
aagcucacucuuuaaa

SEQ ID NO: 501795 - RNA, 16 nt, Chlamydophila pneumoniae CWL029
aagcuagucuucuuag

SEQ ID NO: 501796 - RNA, 21 nt, Chlamydophila pneumoniae CWL029
aagcgcaaaucuuacauaaac

SEQ ID NO: 501797 - RNA, 19 nt, Chlamydophila pneumoniae CWL029
aagcgauuucgacagcagc

SEQ ID NO: 501798 - RNA, 19 nt, Chlamydophila pneumoniae CWL029
aaggcuuguuucuguuuuc

SEQ ID NO: 501799 - RNA, 21 nt, Chlamydophila pneumoniae CWL029
aaggcucucaaggucacagca

SEQ ID NO: 501800 - RNA, 23 nt, Chlamydophila pneumoniae CWL029
aaggcugccagagauucuucaca

SEQ ID NO: 501801 - RNA, 14 nt, Chlamydophila pneumoniae CWL029
aaggccuauagauu

SEQ ID NO: 501802 - RNA, 13 nt, Chlamydophila pneumoniae CWL029
aaggccuaaucuu

SEQ ID NO: 501803 - RNA, 22 nt, Chlamydophila pneumoniae CWL029
aaggcguuuuuuaauucucuga

SEQ ID NO: 501804 - RNA, 13 nt, Chlamydophila pneumoniae CWL029
aaggcauaacugu

SEQ ID NO: 501805 - RNA, 14 nt, Chlamydophila pneumoniae CWL029
aaggcauagauaca

SEQ ID NO: 501806 - RNA, 16 nt, Chlamydophila pneumoniae CWL029
aaggcaucuucuuugc

SEQ ID NO: 501807 - RNA, 19 nt, Chlamydophila pneumoniae CWL029
aaggcccccuacagcagaa

SEQ ID NO: 501808 - RNA, 19 nt, Chlamydophila pneumoniae CWL029
aaggcaugccuacaggcaa

SEQ ID NO: 501809 - RNA, 22 nt, Chlamydophila pneumoniae CWL029
aaggcagagaacuuucgucuuu

SEQ ID NO: 501810 - RNA, 16 nt, Chlamydophila pneumoniae CWL029
aaggcaccaacacuuu

SEQ ID NO: 501811 - RNA, 22 nt, Chlamydophila pneumoniae CWL029
aagcuucguccugacacaacuc

SEQ ID NO: 501812 - RNA, 17 nt, Chlamydophila pneumoniae CWL029
aagcuucuuuaauucca

SEQ ID NO: 501813 - RNA, 13 nt, Chlamydophila pneumoniae CWL029
aagcuucuuucuc

SEQ ID NO: 501814 - RNA, 22 nt, Chlamydophila pneumoniae CWL029
aagcuucggggaagcguagcaa

SEQ ID NO: 501815 - RNA, 21 nt, Chlamydophila pneumoniae CWL029
aagcuucguccugacacaacu

SEQ ID NO: 501816 - RNA, 17 nt, Chlamydophila pneumoniae CWL029
aagcuuccaucguuaga

SEQ ID NO: 501817 - RNA, 20 nt, Chlamydophila pneumoniae CWL029
aagcuguaaccaacaucaaa

SEQ ID NO: 501818 - RNA, 16 nt, Chlamydophila pneumoniae CWL029
aagcugcuuuuucuac

SEQ ID NO: 501819 - RNA, 18 nt, Chlamydophila pneumoniae CWL029
aaggaucugauagaacag

SEQ ID NO: 501820 - RNA, 23 nt, Chlamydophila pneumoniae CWL029
aaggaccuguuuucuuuucugaa

SEQ ID NO: 501821 - RNA, 18 nt, Chlamydophila pneumoniae CWL029
aaggaaucccaagggaga

SEQ ID NO: 501822 - RNA, 19 nt, Chlamydophila pneumoniae CWL029
aaggaauaugcucuccuug

SEQ ID NO: 501823 - RNA, 15 nt, Chlamydophila pneumoniae CWL029
aaggacaaaucuccc

SEQ ID NO: 501824 - RNA, 20 nt, Chlamydophila pneumoniae CWL029
aaguucagacgugcucucua

SEQ ID NO: 501825 - RNA, 17 nt, Chlamydophila pneumoniae CWL029
aaguugaccuuuuucau

SEQ ID NO: 501826 - RNA, 18 nt, Chlamydophila pneumoniae CWL029
aaguugacgcgcuucuuc

SEQ ID NO: 501827 - RNA, 15 nt, Chlamydophila pneumoniae CWL029
aaguugaccuuuuuc

SEQ ID NO: 501828 - RNA, 15 nt, Chlamydophila pneumoniae CWL029
aaguuauuauauaua

SEQ ID NO: 501829 - RNA, 13 nt, Chlamydophila pneumoniae CWL029
aaguucacaagca

SEQ ID NO: 501830 - RNA, 15 nt, Chlamydophila pneumoniae CWL029
aagugacuuccucca

SEQ ID NO: 501831 - RNA, 16 nt, Chlamydophila pneumoniae CWL029
aagugacuuccuccaa

SEQ ID NO: 501832 - RNA, 18 nt, Chlamydophila pneumoniae CWL029
aaguguguaaauguuuug

SEQ ID NO: 501833 - RNA, 23 nt, Chlamydophila pneumoniae CWL029
aaguccagacuuuccucucuuua

SEQ ID NO: 501834 - RNA, 16 nt, Chlamydophila pneumoniae CWL029
aaguccagacuuuccu

SEQ ID NO: 501835 - RNA, 17 nt, Chlamydophila pneumoniae CWL029
aaguccagacuuuccuc

SEQ ID NO: 501836 - RNA, 17 nt, Chlamydophila pneumoniae CWL029
aagucuccauaauucug

SEQ ID NO: 501837 - RNA, 19 nt, Chlamydophila pneumoniae CWL029
aagucgauacccaaagagg

SEQ ID NO: 501838 - RNA, 17 nt, Chlamydophila pneumoniae CWL029
aagucgaaucuaaaaac

SEQ ID NO: 501839 - RNA, 16 nt, Chlamydophila pneumoniae CWL029
aaguaucucaucacgu

SEQ ID NO: 501840 - RNA, 23 nt, Chlamydophila pneumoniae CWL029
aaguauagacgggcuuauaaacu

SEQ ID NO: 501841 - RNA, 21 nt, Chlamydophila pneumoniae CWL029
aaguaguggacuauagaugcc

SEQ ID NO: 501842 - RNA, 18 nt, Chlamydophila pneumoniae CWL029
aaguagggaacaaaaaag

SEQ ID NO: 501843 - RNA, 18 nt, Chlamydophila pneumoniae CWL029
aaguaggauugauaaauu

SEQ ID NO: 501844 - RNA, 22 nt, Chlamydophila pneumoniae CWL029
aaguaggauugauaaauuugcu

SEQ ID NO: 501845 - RNA, 11 nt, Chlamydophila pneumoniae CWL029
aagucaaaaug

SEQ ID NO: 501846 - RNA, 23 nt, Chlamydophila pneumoniae CWL029
aagucaaacaucacucaggauau

SEQ ID NO: 501847 - RNA, 21 nt, Chlamydophila pneumoniae CWL029
aaguauuccucuuaggagagc

SEQ ID NO: 501848 - RNA, 16 nt, Chlamydophila pneumoniae CWL029
aagucacaaauuuuug

SEQ ID NO: 501849 - RNA, 14 nt, Chlamydophila pneumoniae CWL029
aagucacaaauuuu

SEQ ID NO: 501850 - RNA, 18 nt, Chlamydophila pneumoniae CWL029
aagucaaauacuucuccu

SEQ ID NO: 501851 - RNA, 17 nt, Chlamydophila pneumoniae CWL029
aagucacggcgaaagcu

SEQ ID NO: 501852 - RNA, 18 nt, Chlamydophila pneumoniae CWL029
aagucacggcgaaagcua

SEQ ID NO: 501853 - RNA, 21 nt, Chlamydophila pneumoniae CWL029
aagucagccaagacaaaaaag

SEQ ID NO: 501854 - RNA, 15 nt, Chlamydophila pneumoniae CWL029
aaguacugggguagu

SEQ ID NO: 501855 - RNA, 22 nt, Chlamydophila pneumoniae CWL029
aaguacgaccaacuccucaaaa

SEQ ID NO: 501856 - RNA, 22 nt, Chlamydophila pneumoniae CWL029
aaguacgcaguaucguaacuuc

SEQ ID NO: 501857 - RNA, 15 nt, Chlamydophila pneumoniae CWL029
aaguacacauugucu

SEQ ID NO: 501858 - RNA, 20 nt, Chlamydophila pneumoniae CWL029
aaguaccuucucgucauucu

SEQ ID NO: 501859 - RNA, 23 nt, Chlamydophila pneumoniae CWL029
aaguaaugugcgcacaagggauu

SEQ ID NO: 501860 - RNA, 21 nt, Chlamydophila pneumoniae CWL029
aaguacaagugaagacaagua

SEQ ID NO: 501861 - RNA, 22 nt, Chlamydophila pneumoniae CWL029
aaguacaagugaagacaaguaa

SEQ ID NO: 501862 - RNA, 17 nt, Chlamydophila pneumoniae CWL029
aaggggcguucuugaaa

SEQ ID NO: 501863 - RNA, 15 nt, Chlamydophila pneumoniae CWL029
aagguuuugaagcuc

SEQ ID NO: 501864 - RNA, 15 nt, Chlamydophila pneumoniae CWL029
aaguaaaacugcgcu

SEQ ID NO: 501865 - RNA, 13 nt, Chlamydophila pneumoniae CWL029
aaggcuuugccuu

SEQ ID NO: 501866 - RNA, 20 nt, Chlamydophila pneumoniae CWL029
aauaccaguagagaauguuc

SEQ ID NO: 501867 - RNA, 19 nt, Chlamydophila pneumoniae CWL029
aauaccagaagcaaaggua

SEQ ID NO: 501868 - RNA, 13 nt, Chlamydophila pneumoniae CWL029
aauaccagauaaa

SEQ ID NO: 501869 - RNA, 17 nt, Chlamydophila pneumoniae CWL029
aauaccagauaaagcaa

SEQ ID NO: 501870 - RNA, 18 nt, Chlamydophila pneumoniae CWL029
aauacaaaaaauaaaauc

SEQ ID NO: 501871 - RNA, 20 nt, Chlamydophila pneumoniae CWL029
aaaaaucuaacacagucccu

SEQ ID NO: 501872 - RNA, 21 nt, Chlamydophila pneumoniae CWL029
aaaaaucccagauuacaagag

SEQ ID NO: 501873 - RNA, 23 nt, Chlamydophila pneumoniae CWL029
aaaaaucccagauuacaagaggu

SEQ ID NO: 501874 - RNA, 16 nt, Chlamydophila pneumoniae CWL029
aaaaaucccuguucua

SEQ ID NO: 501875 - RNA, 16 nt, Chlamydophila pneumoniae CWL029
aauaauggcaugacgg

SEQ ID NO: 501876 - RNA, 13 nt, Chlamydophila pneumoniae CWL029
aauaagauccaaa

SEQ ID NO: 501877 - RNA, 17 nt, Chlamydophila pneumoniae CWL029
aauaagauccaaaaauu

SEQ ID NO: 501878 - RNA, 15 nt, Chlamydophila pneumoniae CWL029
aauaagauccaaaaa

SEQ ID NO: 501879 - RNA, 13 nt, Chlamydophila pneumoniae CWL029
aauaaccagaaga

SEQ ID NO: 501880 - RNA, 14 nt, Chlamydophila pneumoniae CWL029
aaguuuacaaauaa

SEQ ID NO: 501881 - RNA, 16 nt, Chlamydophila pneumoniae CWL029
aaguuuacaaauaaaa

SEQ ID NO: 501882 - RNA, 16 nt, Chlamydophila pneumoniae CWL029
aauaaauccaaaaaau

SEQ ID NO: 501883 - RNA, 22 nt, Chlamydophila pneumoniae CWL029
aaguuguuucuuguagcucccg

SEQ ID NO: 501884 - RNA, 20 nt, Chlamydophila pneumoniae CWL029
aaguuguagugaaugagcuu

SEQ ID NO: 501885 - RNA, 17 nt, Chlamydophila pneumoniae CWL029
aaguuguugauaauuac

SEQ ID NO: 501886 - RNA, 15 nt, Chlamydophila pneumoniae CWL029
aaguugauacuugua

SEQ ID NO: 501887 - RNA, 17 nt, Chlamydophila pneumoniae CWL029
aaaaauaaacauauucu

SEQ ID NO: 501888 - RNA, 21 nt, Chlamydophila pneumoniae CWL029
aauaagcuuuccucuccaaaa

SEQ ID NO: 501889 - RNA, 21 nt, Chlamydophila pneumoniae CWL029
aaaaaguuccauagaguaucu

SEQ ID NO: 501890 - RNA, 19 nt, Chlamydophila pneumoniae CWL029
aaaaaguugaggaaaggag

SEQ ID NO: 501891 - RNA, 18 nt, Chlamydophila pneumoniae CWL029
aauaagccaguacuaaau

SEQ ID NO: 501892 - RNA, 18 nt, Chlamydophila pneumoniae CWL029
aauaagcuugccagcaga

SEQ ID NO: 501893 - RNA, 19 nt, Chlamydophila pneumoniae CWL029
aauaagcuugccagcagaa

SEQ ID NO: 501894 - RNA, 20 nt, Chlamydophila pneumoniae CWL029
aauaagcuugccagcagaag

SEQ ID NO: 501895 - RNA, 14 nt, Chlamydophila pneumoniae CWL029
aauaucucuggcau

SEQ ID NO: 501896 - RNA, 12 nt, Chlamydophila pneumoniae CWL029
aauaucuugaau

SEQ ID NO: 501897 - RNA, 21 nt, Chlamydophila pneumoniae CWL029
aauaucuccgccauaacacuu

SEQ ID NO: 501898 - RNA, 18 nt, Chlamydophila pneumoniae CWL029
aauaucgaguucuuuuug

SEQ ID NO: 501899 - RNA, 14 nt, Chlamydophila pneumoniae CWL029
aauauccagaaaua

SEQ ID NO: 501900 - RNA, 15 nt, Chlamydophila pneumoniae CWL029
aauaucaggacaaug

SEQ ID NO: 501901 - RNA, 20 nt, Chlamydophila pneumoniae CWL029
aauaucaggacaaugaagaa

SEQ ID NO: 501902 - RNA, 20 nt, Chlamydophila pneumoniae CWL029
aauauaucgcguguaaaagc

SEQ ID NO: 501903 - RNA, 21 nt, Chlamydophila pneumoniae CWL029
aauauauccaggaucugugug

SEQ ID NO: 501904 - RNA, 19 nt, Chlamydophila pneumoniae CWL029
aauauagguuaagccaauc

SEQ ID NO: 501905 - RNA, 17 nt, Chlamydophila pneumoniae CWL029
aauauacagauguuuuc

SEQ ID NO: 501906 - RNA, 23 nt, Chlamydophila pneumoniae CWL029
aauauacagauguuuucguaaau

SEQ ID NO: 501907 - RNA, 14 nt, Chlamydophila pneumoniae CWL029
aauauaacucucua

SEQ ID NO: 501908 - RNA, 21 nt, Chlamydophila pneumoniae CWL029
aauaccucaaagccaucuucu

SEQ ID NO: 501909 - RNA, 18 nt, Chlamydophila pneumoniae CWL029
aauaccucagaaauuccu

SEQ ID NO: 501910 - RNA, 20 nt, Chlamydophila pneumoniae CWL029
aauagaagccaccaucuguu

SEQ ID NO: 501911 - RNA, 15 nt, Chlamydophila pneumoniae CWL029
aauagacaggaugga

SEQ ID NO: 501912 - RNA, 22 nt, Chlamydophila pneumoniae CWL029
aauagcaaagacaucuccugca

SEQ ID NO: 501913 - RNA, 16 nt, Chlamydophila pneumoniae CWL029
aauagcucuggagauu

SEQ ID NO: 501914 - RNA, 17 nt, Chlamydophila pneumoniae CWL029
aauagcucuuuucauga

SEQ ID NO: 501915 - RNA, 14 nt, Chlamydophila pneumoniae CWL029
aauagcuaaaguga

SEQ ID NO: 501916 - RNA, 14 nt, Chlamydophila pneumoniae CWL029
aauaggucucuugc

SEQ ID NO: 501917 - RNA, 15 nt, Chlamydophila pneumoniae CWL029
aauagguuucaauag

SEQ ID NO: 501918 - RNA, 14 nt, Chlamydophila pneumoniae CWL029
aauaguacgcuuuu

SEQ ID NO: 501919 - RNA, 18 nt, Chlamydophila pneumoniae CWL029
aauaggcacccaaacuga

SEQ ID NO: 501920 - RNA, 22 nt, Chlamydophila pneumoniae CWL029
aauaggcauuacacaacucuuu

SEQ ID NO: 501921 - RNA, 14 nt, Chlamydophila pneumoniae CWL029
aauaggcacccaaa

SEQ ID NO: 501922 - RNA, 14 nt, Chlamydophila pneumoniae CWL029
aauaggagaagccc

SEQ ID NO: 501923 - RNA, 21 nt, Chlamydophila pneumoniae CWL029
aauaggaauuagagaaauuuu

SEQ ID NO: 501924 - RNA, 22 nt, Chlamydophila pneumoniae CWL029
aauagcuucugacucuguugca

SEQ ID NO: 501925 - RNA, 23 nt, Chlamydophila pneumoniae CWL029
aauagugaggccuccauuucuag

SEQ ID NO: 501926 - RNA, 22 nt, Chlamydophila pneumoniae CWL029
aauaguugugagacuuucugag

SEQ ID NO: 501927 - RNA, 15 nt, Chlamydophila pneumoniae CWL029
aauauaaaagaagac

SEQ ID NO: 501928 - RNA, 18 nt, Chlamydophila pneumoniae CWL029
aauauaaauuuauaaacu

SEQ ID NO: 501929 - RNA, 15 nt, Chlamydophila pneumoniae CWL029
accacguccauuuca

SEQ ID NO: 501930 - RNA, 15 nt, Chlamydophila pneumoniae CWL029
accacuauacccucu

SEQ ID NO: 501931 - RNA, 19 nt, Chlamydophila pneumoniae CWL029
accacuaccgaauuuucaa

SEQ ID NO: 501932 - RNA, 19 nt, Chlamydophila pneumoniae CWL029
accacuuaggguucucaaa

SEQ ID NO: 501933 - RNA, 15 nt, Chlamydophila pneumoniae CWL029
accacgaaauguuaa

SEQ ID NO: 501934 - RNA, 16 nt, Chlamydophila pneumoniae CWL029
accacgaaauguuaaa

SEQ ID NO: 501935 - RNA, 13 nt, Chlamydophila pneumoniae CWL029
accaccuucccca

SEQ ID NO: 501936 - RNA, 14 nt, Chlamydophila pneumoniae CWL029
accaccuuccccaa

SEQ ID NO: 501937 - RNA, 17 nt, Chlamydophila pneumoniae CWL029
accaccccaaagcagau

SEQ ID NO: 501938 - RNA, 19 nt, Chlamydophila pneumoniae CWL029
accaaccuuguugaaaggc

SEQ ID NO: 501939 - RNA, 22 nt, Chlamydophila pneumoniae CWL029
accaaguuauuauauauaagau

SEQ ID NO: 501940 - RNA, 20 nt, Chlamydophila pneumoniae CWL029
accaauaaacuuugugggga

SEQ ID NO: 501941 - RNA, 16 nt, Chlamydophila pneumoniae CWL029
accaaguaaaucagac

SEQ ID NO: 501942 - RNA, 20 nt, Chlamydophila pneumoniae CWL029
accaaguaaaucagacuuaa

SEQ ID NO: 501943 - RNA, 22 nt, Chlamydophila pneumoniae CWL029
accaaguacaguaucgacuuuu

SEQ ID NO: 501944 - RNA, 23 nt, Chlamydophila pneumoniae CWL029
accaaggggcguucuugaaaaaa

SEQ ID NO: 501945 - RNA, 13 nt, Chlamydophila pneumoniae CWL029
accaacuccucaa

SEQ ID NO: 501946 - RNA, 18 nt, Chlamydophila pneumoniae CWL029
accaacuccucaaaagau

SEQ ID NO: 501947 - RNA, 20 nt, Chlamydophila pneumoniae CWL029
accaaucuugagcauccaaa

SEQ ID NO: 501948 - RNA, 14 nt, Chlamydophila pneumoniae CWL029
accaauaugcucug

SEQ ID NO: 501949 - RNA, 15 nt, Chlamydophila pneumoniae CWL029
accaauaugcucugc

SEQ ID NO: 501950 - RNA, 24 nt, Chlamydophila pneumoniae CWL029
accacaauuccuaaaacaagaaga

SEQ ID NO: 501951 - RNA, 18 nt, Chlamydophila pneumoniae CWL029
accaauugagcucucuag

SEQ ID NO: 501952 - RNA, 23 nt, Chlamydophila pneumoniae CWL029
accacagugauuuagaaaucuca

SEQ ID NO: 501953 - RNA, 19 nt, Chlamydophila pneumoniae CWL029
accacagaaugauaagaaa

SEQ ID NO: 501954 - RNA, 21 nt, Chlamydophila pneumoniae CWL029
accacagcuguacagaacaau

SEQ ID NO: 501955 - RNA, 22 nt, Chlamydophila pneumoniae CWL029
acauuccaagaaaaauucuucg

SEQ ID NO: 501956 - RNA, 16 nt, Chlamydophila pneumoniae CWL029
acauuccaaugcauga

SEQ ID NO: 501957 - RNA, 14 nt, Chlamydophila pneumoniae CWL029
acauucauuuuuua

SEQ ID NO: 501958 - RNA, 21 nt, Chlamydophila pneumoniae CWL029
acauucauuuuuuaauaaaau

SEQ ID NO: 501959 - RNA, 13 nt, Chlamydophila pneumoniae CWL029
acauuaagaggaa

SEQ ID NO: 501960 - RNA, 16 nt, Chlamydophila pneumoniae CWL029
acauucgcaagaauga

SEQ ID NO: 501961 - RNA, 22 nt, Chlamydophila pneumoniae CWL029
acauugcugccaggcuuaaaua

SEQ ID NO: 501962 - RNA, 13 nt, Chlamydophila pneumoniae CWL029
acauguuucacuu

SEQ ID NO: 501963 - RNA, 14 nt, Chlamydophila pneumoniae CWL029
acauggccaaaaau

SEQ ID NO: 501964 - RNA, 19 nt, Chlamydophila pneumoniae CWL029
acauggccaaaaaucuuau

SEQ ID NO: 501965 - RNA, 14 nt, Chlamydophila pneumoniae CWL029
acaugcuuuccuuc

SEQ ID NO: 501966 - RNA, 14 nt, Chlamydophila pneumoniae CWL029
acaugccaaaaguu

SEQ ID NO: 501967 - RNA, 13 nt, Chlamydophila pneumoniae CWL029
acauccuucuuua

SEQ ID NO: 501968 - RNA, 18 nt, Chlamydophila pneumoniae CWL029
acaucgaaaccacagcaa

SEQ ID NO: 501969 - RNA, 17 nt, Chlamydophila pneumoniae CWL029
acauccuuguagaacuu

SEQ ID NO: 501970 - RNA, 21 nt, Chlamydophila pneumoniae CWL029
acauccuuguagaacuucuca

SEQ ID NO: 501971 - RNA, 15 nt, Chlamydophila pneumoniae CWL029
acaucuuuagaauca

SEQ ID NO: 501972 - RNA, 13 nt, Chlamydophila pneumoniae CWL029
acaucuuucucua

SEQ ID NO: 501973 - RNA, 15 nt, Chlamydophila pneumoniae CWL029
acaucuuaaaaacua

SEQ ID NO: 501974 - RNA, 12 nt, Chlamydophila pneumoniae CWL029
acauacaucaaa

SEQ ID NO: 501975 - RNA, 16 nt, Chlamydophila pneumoniae CWL029
acauacauucuauucu

SEQ ID NO: 501976 - RNA, 18 nt, Chlamydophila pneumoniae CWL029
acaggcaggccacuuccu

SEQ ID NO: 501977 - RNA, 18 nt, Chlamydophila pneumoniae CWL029
acauagggaaaguucagu

SEQ ID NO: 501978 - RNA, 20 nt, Chlamydophila pneumoniae CWL029
acauagguaaaaccagcaua

SEQ ID NO: 501979 - RNA, 15 nt, Chlamydophila pneumoniae CWL029
acauagacuuugagu

SEQ ID NO: 501980 - RNA, 18 nt, Chlamydophila pneumoniae CWL029
acauacucgucaaauuca

SEQ ID NO: 501981 - RNA, 23 nt, Chlamydophila pneumoniae CWL029
acauaucuccuuuaaauaaaauc

SEQ ID NO: 501982 - RNA, 20 nt, Chlamydophila pneumoniae CWL029
acauaucgauaggauucgga

SEQ ID NO: 501983 - RNA, 13 nt, Chlamydophila pneumoniae CWL029
acauauccaauga

SEQ ID NO: 501984 - RNA, 18 nt, Chlamydophila pneumoniae CWL029
acauauccaaugagagag

SEQ ID NO: 501985 - RNA, 18 nt, Chlamydophila pneumoniae CWL029
acauauacguggcuucca

SEQ ID NO: 501986 - RNA, 21 nt, Chlamydophila pneumoniae CWL029
acauaguuuuuauuuuuaaau

SEQ ID NO: 501987 - RNA, 15 nt, Chlamydophila pneumoniae CWL029
acauauugaagauau

SEQ ID NO: 501988 - RNA, 19 nt, Chlamydophila pneumoniae CWL029
acaucagacugaagagcaa

SEQ ID NO: 501989 - RNA, 18 nt, Chlamydophila pneumoniae CWL029
acaucagacugaagagca

SEQ ID NO: 501990 - RNA, 16 nt, Chlamydophila pneumoniae CWL029
acaucaaauaguucau

SEQ ID NO: 501991 - RNA, 15 nt, Chlamydophila pneumoniae CWL029
acaucaaaaugcugc

SEQ ID NO: 501992 - RNA, 14 nt, Chlamydophila pneumoniae CWL029
acaucaaagcaauu

SEQ ID NO: 501993 - RNA, 12 nt, Chlamydophila pneumoniae CWL029
acauccauucuu

SEQ ID NO: 501994 - RNA, 19 nt, Chlamydophila pneumoniae CWL029
acaucaucagaagcuccug

SEQ ID NO: 501995 - RNA, 13 nt, Chlamydophila pneumoniae CWL029
acaucagcaacau

SEQ ID NO: 501996 - RNA, 18 nt, Chlamydophila pneumoniae CWL029
acaucagcuguugcguuu

SEQ ID NO: 501997 - RNA, 12 nt, Chlamydophila pneumoniae CWL029
acaggagaagcg

SEQ ID NO: 501998 - RNA, 15 nt, Chlamydophila pneumoniae CWL029
acaggagagagaagg

SEQ ID NO: 501999 - RNA, 17 nt, Chlamydophila pneumoniae CWL029
acaggagagagaaggcu

SEQ ID NO: 502000 - RNA, 20 nt, Chlamydophila pneumoniae CWL029
acagcugcuagagcagcugu

SEQ ID NO: 502001 - RNA, 21 nt, Chlamydophila pneumoniae CWL029
acagcauggacuccaagaaua

SEQ ID NO: 502002 - RNA, 18 nt, Chlamydophila pneumoniae CWL029
acagcauggacuccaaga

SEQ ID NO: 502003 - RNA, 15 nt, Chlamydophila pneumoniae CWL029
acagauuucuucuuc

SEQ ID NO: 502004 - RNA, 14 nt, Chlamydophila pneumoniae CWL029
acagcauaaaaauu

SEQ ID NO: 502005 - RNA, 22 nt, Chlamydophila pneumoniae CWL029
acagcaucaggauucucucugc

SEQ ID NO: 502006 - RNA, 16 nt, Chlamydophila pneumoniae CWL029
acagcaucggcaacca

SEQ ID NO: 502007 - RNA, 21 nt, Chlamydophila pneumoniae CWL029
acagaguucgcgaccugugau

SEQ ID NO: 502008 - RNA, 18 nt, Chlamydophila pneumoniae CWL029
acagagucagaagcuauu

SEQ ID NO: 502009 - RNA, 21 nt, Chlamydophila pneumoniae CWL029
acagagcgucuauuagauuuc

SEQ ID NO: 502010 - RNA, 17 nt, Chlamydophila pneumoniae CWL029
acagagaccuucucuuc

SEQ ID NO: 502011 - RNA, 16 nt, Chlamydophila pneumoniae CWL029
acagauaggaaccacu

SEQ ID NO: 502012 - RNA, 20 nt, Chlamydophila pneumoniae CWL029
acagauaggguaagauugca

SEQ ID NO: 502013 - RNA, 16 nt, Chlamydophila pneumoniae CWL029
acagaaaggcuuuucu

SEQ ID NO: 502014 - RNA, 20 nt, Chlamydophila pneumoniae CWL029
acagaaaggcuuuucuuuuu

SEQ ID NO: 502015 - RNA, 20 nt, Chlamydophila pneumoniae CWL029
acagaaagagcuaaagaaac

SEQ ID NO: 502016 - RNA, 20 nt, Chlamydophila pneumoniae CWL029
acagaaauugcuucuuccaa

SEQ ID NO: 502017 - RNA, 17 nt, Chlamydophila pneumoniae CWL029
acacuuucuuuaaagaa

SEQ ID NO: 502018 - RNA, 13 nt, Chlamydophila pneumoniae CWL029
acagaaguacgca

SEQ ID NO: 502019 - RNA, 20 nt, Chlamydophila pneumoniae CWL029
acagaaguuccuacuucugc

SEQ ID NO: 502020 - RNA, 14 nt, Chlamydophila pneumoniae CWL029
acagacuugaggaa

SEQ ID NO: 502021 - RNA, 16 nt, Chlamydophila pneumoniae CWL029
acagacugaagucguu

SEQ ID NO: 502022 - RNA, 17 nt, Chlamydophila pneumoniae CWL029
acacugcgcaaagaacu

SEQ ID NO: 502023 - RNA, 21 nt, Chlamydophila pneumoniae CWL029
acacucaaaucuuucaaggaa

SEQ ID NO: 502024 - RNA, 17 nt, Chlamydophila pneumoniae CWL029
acacucagcucccaugu

SEQ ID NO: 502025 - RNA, 14 nt, Chlamydophila pneumoniae CWL029
acacuccucagaau

SEQ ID NO: 502026 - RNA, 12 nt, Chlamydophila pneumoniae CWL029
acacucuaucau

SEQ ID NO: 502027 - RNA, 21 nt, Chlamydophila pneumoniae CWL029
acacugaacgccaucuccaca

SEQ ID NO: 502028 - RNA, 22 nt, Chlamydophila pneumoniae CWL029
acacuauguguuuccuuuucuc

SEQ ID NO: 502029 - RNA, 14 nt, Chlamydophila pneumoniae CWL029
acaccgaaagaaau

SEQ ID NO: 502030 - RNA, 12 nt, Chlamydophila pneumoniae CWL029
acacacuuucuu

SEQ ID NO: 502031 - RNA, 16 nt, Chlamydophila pneumoniae CWL029
acacagagaacaauaa

SEQ ID NO: 502032 - RNA, 11 nt, Chlamydophila pneumoniae CWL029
acacagagaac

SEQ ID NO: 502033 - RNA, 20 nt, Chlamydophila pneumoniae CWL029
acacagagaugcuucuaaac

SEQ ID NO: 502034 - RNA, 14 nt, Chlamydophila pneumoniae CWL029
acaccaggaagucc

SEQ ID NO: 502035 - RNA, 20 nt, Chlamydophila pneumoniae CWL029
acaccaggaguuggagaauu

SEQ ID NO: 502036 - RNA, 16 nt, Chlamydophila pneumoniae CWL029
acaccaucacauccug

SEQ ID NO: 502037 - RNA, 13 nt, Chlamydophila pneumoniae CWL029
acaccauaaaaca

SEQ ID NO: 502038 - RNA, 16 nt, Chlamydophila pneumoniae CWL029
acaaucucuuuaaaaa

SEQ ID NO: 502039 - RNA, 22 nt, Chlamydophila pneumoniae CWL029
acaaucucuuuaaaaauuaaag

SEQ ID NO: 502040 - RNA, 21 nt, Chlamydophila pneumoniae CWL029
acaaucuacggcauaaccuuu

SEQ ID NO: 502041 - RNA, 17 nt, Chlamydophila pneumoniae CWL029
acaauauagagaucuag

SEQ ID NO: 502042 - RNA, 19 nt, Chlamydophila pneumoniae CWL029
acaaugaagucuucuuucc

SEQ ID NO: 502043 - RNA, 22 nt, Chlamydophila pneumoniae CWL029
acaaugaagaacuacucucauu

SEQ ID NO: 502044 - RNA, 14 nt, Chlamydophila pneumoniae CWL029
acaaugcuaucucc

SEQ ID NO: 502045 - RNA, 12 nt, Chlamydophila pneumoniae CWL029
acaauggaaaua

SEQ ID NO: 502046 - RNA, 17 nt, Chlamydophila pneumoniae CWL029
acaauggaaauagagaa

SEQ ID NO: 502047 - RNA, 15 nt, Chlamydophila pneumoniae CWL029
acacaaguucuaccu

SEQ ID NO: 502048 - RNA, 23 nt, Chlamydophila pneumoniae CWL029
acaauuuccuugguaucccaauc

SEQ ID NO: 502049 - RNA, 14 nt, Chlamydophila pneumoniae CWL029
acaauguuuagaau

SEQ ID NO: 502050 - RNA, 14 nt, Chlamydophila pneumoniae CWL029
acaauuacaggaaa

SEQ ID NO: 502051 - RNA, 21 nt, Chlamydophila pneumoniae CWL029
acaauuguaaauacaaaacaa

SEQ ID NO: 502052 - RNA, 13 nt, Chlamydophila pneumoniae CWL029
acaagaaaacaaa

SEQ ID NO: 502053 - RNA, 14 nt, Chlamydophila pneumoniae CWL029
acaagaaaacaaag

SEQ ID NO: 502054 - RNA, 15 nt, Chlamydophila pneumoniae CWL029
acaacuucugacaau

SEQ ID NO: 502055 - RNA, 13 nt, Chlamydophila pneumoniae CWL029
acaacuccuaagu

SEQ ID NO: 502056 - RNA, 22 nt, Chlamydophila pneumoniae CWL029
acaacuagguuauuaucaaagu

SEQ ID NO: 502057 - RNA, 15 nt, Chlamydophila pneumoniae CWL029
acaacuagaccaaua

SEQ ID NO: 502058 - RNA, 22 nt, Chlamydophila pneumoniae CWL029
acaacuagaccaauaaauccaa

SEQ ID NO: 502059 - RNA, 17 nt, Chlamydophila pneumoniae CWL029
aauuuuugcuaaacaau

SEQ ID NO: 502060 - RNA, 19 nt, Chlamydophila pneumoniae CWL029
aauuuuugcuaaacaaugc

SEQ ID NO: 502061 - RNA, 17 nt, Chlamydophila pneumoniae CWL029
aauuuuuguagacaaua

SEQ ID NO: 502062 - RNA, 21 nt, Chlamydophila pneumoniae CWL029
acaacgccuacauggaucccu

SEQ ID NO: 502063 - RNA, 19 nt, Chlamydophila pneumoniae CWL029
aauuuuuuguuaaauuccc

SEQ ID NO: 502064 - RNA, 17 nt, Chlamydophila pneumoniae CWL029
acaacgcugcuucucua

SEQ ID NO: 502065 - RNA, 19 nt, Chlamydophila pneumoniae CWL029
acaacgcugcuucucuacu

SEQ ID NO: 502066 - RNA, 22 nt, Chlamydophila pneumoniae CWL029
acaacgcugcuucucuacuaaa

SEQ ID NO: 502067 - RNA, 14 nt, Chlamydophila pneumoniae CWL029
acaauauaagcacc

SEQ ID NO: 502068 - RNA, 16 nt, Chlamydophila pneumoniae CWL029
acaauaagaaaauccu

SEQ ID NO: 502069 - RNA, 22 nt, Chlamydophila pneumoniae CWL029
acaauaaccaggggcuuuccuu

SEQ ID NO: 502070 - RNA, 15 nt, Chlamydophila pneumoniae CWL029
acaaguaccaagaaa

SEQ ID NO: 502071 - RNA, 16 nt, Chlamydophila pneumoniae CWL029
acaaguaccaagaaaa

SEQ ID NO: 502072 - RNA, 21 nt, Chlamydophila pneumoniae CWL029
acaaguacgacgaaguuagcu

SEQ ID NO: 502073 - RNA, 22 nt, Chlamydophila pneumoniae CWL029
acaaguacgacgaaguuagcua

SEQ ID NO: 502074 - RNA, 23 nt, Chlamydophila pneumoniae CWL029
acaagcaguaacugcaaagagaa

SEQ ID NO: 502075 - RNA, 20 nt, Chlamydophila pneumoniae CWL029
acaagcaauacuaagaagcu

SEQ ID NO: 502076 - RNA, 15 nt, Chlamydophila pneumoniae CWL029
acaagcaaggaaaaa

SEQ ID NO: 502077 - RNA, 17 nt, Chlamydophila pneumoniae CWL029
acaagcaaggaaaaaaa

SEQ ID NO: 502078 - RNA, 16 nt, Chlamydophila pneumoniae CWL029
acaagaagaucaaaga

SEQ ID NO: 502079 - RNA, 23 nt, Chlamydophila pneumoniae CWL029
acaagacaaugacuguaggaccu

SEQ ID NO: 502080 - RNA, 18 nt, Chlamydophila pneumoniae CWL029
acaagacaccgaaagaaa

SEQ ID NO: 502081 - RNA, 14 nt, Chlamydophila pneumoniae CWL029
acaagacgaaagca

SEQ ID NO: 502082 - RNA, 22 nt, Chlamydophila pneumoniae CWL029
acaagacgaaagcacauaagau

SEQ ID NO: 502083 - RNA, 20 nt, Chlamydophila pneumoniae CWL029
aauucgcucagaaaauguaa

SEQ ID NO: 502084 - RNA, 15 nt, Chlamydophila pneumoniae CWL029
aauucggcagaaggc

SEQ ID NO: 502085 - RNA, 13 nt, Chlamydophila pneumoniae CWL029
aauucuuaaaaag

SEQ ID NO: 502086 - RNA, 13 nt, Chlamydophila pneumoniae CWL029
aauucaaaaagag

SEQ ID NO: 502087 - RNA, 14 nt, Chlamydophila pneumoniae CWL029
aauucaaaaagaga

SEQ ID NO: 502088 - RNA, 23 nt, Chlamydophila pneumoniae CWL029
aauucaaaaucaaaguauauauu

SEQ ID NO: 502089 - RNA, 13 nt, Chlamydophila pneumoniae CWL029
aauucgcauuuuu

SEQ ID NO: 502090 - RNA, 15 nt, Chlamydophila pneumoniae CWL029
aauucgcauuuuugg

SEQ ID NO: 502091 - RNA, 22 nt, Chlamydophila pneumoniae CWL029
aauucuuuaugagagagcucuu

SEQ ID NO: 502092 - RNA, 21 nt, Chlamydophila pneumoniae CWL029
aauucuucuacagaauaggaa

SEQ ID NO: 502093 - RNA, 22 nt, Chlamydophila pneumoniae CWL029
aauucuucuacagaauaggaac

SEQ ID NO: 502094 - RNA, 22 nt, Chlamydophila pneumoniae CWL029
aauugagaaauauaacucucua

SEQ ID NO: 502095 - RNA, 23 nt, Chlamydophila pneumoniae CWL029
aauugagaaauauaacucucuag

SEQ ID NO: 502096 - RNA, 22 nt, Chlamydophila pneumoniae CWL029
aauugacugcuagaguccaagg

SEQ ID NO: 502097 - RNA, 14 nt, Chlamydophila pneumoniae CWL029
aauugacuggaggc

SEQ ID NO: 502098 - RNA, 15 nt, Chlamydophila pneumoniae CWL029
aauuaguaaaugccu

SEQ ID NO: 502099 - RNA, 22 nt, Chlamydophila pneumoniae CWL029
aauuaguaaaugccucuuucau

SEQ ID NO: 502100 - RNA, 17 nt, Chlamydophila pneumoniae CWL029
aauuagggcuuuuacuc

SEQ ID NO: 502101 - RNA, 22 nt, Chlamydophila pneumoniae CWL029
aauuaguuucacauaguuuaau

SEQ ID NO: 502102 - RNA, 18 nt, Chlamydophila pneumoniae CWL029
aauuaugcccaaggaaaa

SEQ ID NO: 502103 - RNA, 20 nt, Chlamydophila pneumoniae CWL029
aauuaugcccaaggaaaaac

SEQ ID NO: 502104 - RNA, 13 nt, Chlamydophila pneumoniae CWL029
aauuauuaaacuc

SEQ ID NO: 502105 - RNA, 19 nt, Chlamydophila pneumoniae CWL029
aauuagagaaauuuuuaau

SEQ ID NO: 502106 - RNA, 13 nt, Chlamydophila pneumoniae CWL029
aauuagagagaau

SEQ ID NO: 502107 - RNA, 15 nt, Chlamydophila pneumoniae CWL029
aauuagaacagcaug

SEQ ID NO: 502108 - RNA, 20 nt, Chlamydophila pneumoniae CWL029
aauuacucgcucugcacgga

SEQ ID NO: 502109 - RNA, 22 nt, Chlamydophila pneumoniae CWL029
aauguagcuguuccaagagucu

SEQ ID NO: 502110 - RNA, 22 nt, Chlamydophila pneumoniae CWL029
aauguagucaugauuuuucaau

SEQ ID NO: 502111 - RNA, 21 nt, Chlamydophila pneumoniae CWL029
aauguauccuucuacaaugau

SEQ ID NO: 502112 - RNA, 14 nt, Chlamydophila pneumoniae CWL029
aauuaauaaaagag

SEQ ID NO: 502113 - RNA, 15 nt, Chlamydophila pneumoniae CWL029
aauuucugaaacaau

SEQ ID NO: 502114 - RNA, 14 nt, Chlamydophila pneumoniae CWL029
aauuucugaaacaa

SEQ ID NO: 502115 - RNA, 15 nt, Chlamydophila pneumoniae CWL029
aauuucuccuagguc

SEQ ID NO: 502116 - RNA, 18 nt, Chlamydophila pneumoniae CWL029
aauuuccuaccuauauuu

SEQ ID NO: 502117 - RNA, 21 nt, Chlamydophila pneumoniae CWL029
aauuuccuucaggauuuucca

SEQ ID NO: 502118 - RNA, 14 nt, Chlamydophila pneumoniae CWL029
aauuucgucuucau

SEQ ID NO: 502119 - RNA, 17 nt, Chlamydophila pneumoniae CWL029
aauuucauguccuccau

SEQ ID NO: 502120 - RNA, 19 nt, Chlamydophila pneumoniae CWL029
aauuucauuugaaauauga

SEQ ID NO: 502121 - RNA, 20 nt, Chlamydophila pneumoniae CWL029
aauuuaucggcuaaagaaaa

SEQ ID NO: 502122 - RNA, 22 nt, Chlamydophila pneumoniae CWL029
aauuucaaagaugcagauacua

SEQ ID NO: 502123 - RNA, 12 nt, Chlamydophila pneumoniae CWL029
aauuuaaauaua

SEQ ID NO: 502124 - RNA, 13 nt, Chlamydophila pneumoniae CWL029
aauuuaaauauag

SEQ ID NO: 502125 - RNA, 15 nt, Chlamydophila pneumoniae CWL029
aauuuaaauauagaa

SEQ ID NO: 502126 - RNA, 15 nt, Chlamydophila pneumoniae CWL029
aauuuuucgagaaua

SEQ ID NO: 502127 - RNA, 19 nt, Chlamydophila pneumoniae CWL029
aauuuuuccuucaacacac

SEQ ID NO: 502128 - RNA, 22 nt, Chlamydophila pneumoniae CWL029
aauuuugauaccucuccgucau

SEQ ID NO: 502129 - RNA, 23 nt, Chlamydophila pneumoniae CWL029
aauuuucuugcgacauaaccauc

SEQ ID NO: 502130 - RNA, 16 nt, Chlamydophila pneumoniae CWL029
aauuuucuaaagauuu

SEQ ID NO: 502131 - RNA, 12 nt, Chlamydophila pneumoniae CWL029
aauuuucccauu

SEQ ID NO: 502132 - RNA, 16 nt, Chlamydophila pneumoniae CWL029
aauuuucguaaccaca

SEQ ID NO: 502133 - RNA, 17 nt, Chlamydophila pneumoniae CWL029
aauuuucguaaccacag

SEQ ID NO: 502134 - RNA, 14 nt, Chlamydophila pneumoniae CWL029
aauuuucuaaagau

SEQ ID NO: 502135 - RNA, 23 nt, Chlamydophila pneumoniae CWL029
aauuuucagccugucuauaaaau

SEQ ID NO: 502136 - RNA, 20 nt, Chlamydophila pneumoniae CWL029
aauuuuauaggaauaacacc

SEQ ID NO: 502137 - RNA, 22 nt, Chlamydophila pneumoniae CWL029
aauuuuauaggaauaacaccaa

SEQ ID NO: 502138 - RNA, 15 nt, Chlamydophila pneumoniae CWL029
aauuugcucuccugc

SEQ ID NO: 502139 - RNA, 14 nt, Chlamydophila pneumoniae CWL029
aauuugcgaagucc

SEQ ID NO: 502140 - RNA, 16 nt, Chlamydophila pneumoniae CWL029
aauuugcuaugucugu

SEQ ID NO: 502141 - RNA, 15 nt, Chlamydophila pneumoniae CWL029
aauuugccugaaauc

SEQ ID NO: 502142 - RNA, 20 nt, Chlamydophila pneumoniae CWL029
aauuugauuuuucaaauucu

SEQ ID NO: 502143 - RNA, 23 nt, Chlamydophila pneumoniae CWL029
aauuucuuguuccaauagagucu

SEQ ID NO: 502144 - RNA, 18 nt, Chlamydophila pneumoniae CWL029
aauuucuuucacaucuuu

SEQ ID NO: 502145 - RNA, 21 nt, Chlamydophila pneumoniae CWL029
aauuucuuuuugccaauuuuc

SEQ ID NO: 502146 - RNA, 15 nt, Chlamydophila pneumoniae CWL029
aauuuguuuagaaaa

SEQ ID NO: 502147 - RNA, 21 nt, Chlamydophila pneumoniae CWL029
aauggcuuuuuuugucccaac

SEQ ID NO: 502148 - RNA, 19 nt, Chlamydophila pneumoniae CWL029
aaugcugagggaucuucuc

SEQ ID NO: 502149 - RNA, 15 nt, Chlamydophila pneumoniae CWL029
aaugcucuucugcag

SEQ ID NO: 502150 - RNA, 13 nt, Chlamydophila pneumoniae CWL029
aaugcuagaguuu

SEQ ID NO: 502151 - RNA, 13 nt, Chlamydophila pneumoniae CWL029
aaugcuauuuucc

SEQ ID NO: 502152 - RNA, 22 nt, Chlamydophila pneumoniae CWL029
aaugccucuuucauacuaaaau

SEQ ID NO: 502153 - RNA, 13 nt, Chlamydophila pneumoniae CWL029
aaugauagggaau

SEQ ID NO: 502154 - RNA, 20 nt, Chlamydophila pneumoniae CWL029
aaugauucauaacauugcuu

SEQ ID NO: 502155 - RNA, 17 nt, Chlamydophila pneumoniae CWL029
aaugccgaguaguccug

SEQ ID NO: 502156 - RNA, 16 nt, Chlamydophila pneumoniae CWL029
aaugauacgugcagug

SEQ ID NO: 502157 - RNA, 15 nt, Chlamydophila pneumoniae CWL029
aaugagcucuauuuc

SEQ ID NO: 502158 - RNA, 14 nt, Chlamydophila pneumoniae CWL029
aaugagaucugcaa

SEQ ID NO: 502159 - RNA, 19 nt, Chlamydophila pneumoniae CWL029
aaugacucuagaguacccc

SEQ ID NO: 502160 - RNA, 20 nt, Chlamydophila pneumoniae CWL029
aaugacuuuagaaauuccaa

SEQ ID NO: 502161 - RNA, 17 nt, Chlamydophila pneumoniae CWL029
aaugacuuuuuuguuaa

SEQ ID NO: 502162 - RNA, 17 nt, Chlamydophila pneumoniae CWL029
aaugacuaaaugcgagg

SEQ ID NO: 502163 - RNA, 21 nt, Chlamydophila pneumoniae CWL029
aaugacagcugagaaauuccu

SEQ ID NO: 502164 - RNA, 16 nt, Chlamydophila pneumoniae CWL029
aaugaaacgaaagcag

SEQ ID NO: 502165 - RNA, 18 nt, Chlamydophila pneumoniae CWL029
aaucuuuuagaguacaca

SEQ ID NO: 502166 - RNA, 17 nt, Chlamydophila pneumoniae CWL029
aaucuuugaacaaaaag

SEQ ID NO: 502167 - RNA, 20 nt, Chlamydophila pneumoniae CWL029
aaucuuugaagcucgaccuc

SEQ ID NO: 502168 - RNA, 17 nt, Chlamydophila pneumoniae CWL029
aaucuuucaaaagaaau

SEQ ID NO: 502169 - RNA, 15 nt, Chlamydophila pneumoniae CWL029
aaucuuucaauguaa

SEQ ID NO: 502170 - RNA, 18 nt, Chlamydophila pneumoniae CWL029
aaugaaggccaagauucu

SEQ ID NO: 502171 - RNA, 19 nt, Chlamydophila pneumoniae CWL029
aaugaagucuucuuucccc

SEQ ID NO: 502172 - RNA, 15 nt, Chlamydophila pneumoniae CWL029
aaugaagccaaaagg

SEQ ID NO: 502173 - RNA, 16 nt, Chlamydophila pneumoniae CWL029
aaugaaucgaagaaca

SEQ ID NO: 502174 - RNA, 17 nt, Chlamydophila pneumoniae CWL029
aaugaauggguuuuguu

SEQ ID NO: 502175 - RNA, 21 nt, Chlamydophila pneumoniae CWL029
aauccuuuuuaggaaaggaua

SEQ ID NO: 502176 - RNA, 20 nt, Chlamydophila pneumoniae CWL029
aauccuguagggaaagacuc

SEQ ID NO: 502177 - RNA, 18 nt, Chlamydophila pneumoniae CWL029
aauccuuucacaaagaau

SEQ ID NO: 502178 - RNA, 21 nt, Chlamydophila pneumoniae CWL029
aauccuguaacacccucccuc

SEQ ID NO: 502179 - RNA, 16 nt, Chlamydophila pneumoniae CWL029
aauccugggcaaugau

SEQ ID NO: 502180 - RNA, 21 nt, Chlamydophila pneumoniae CWL029
aauccugcauacccuucuucu

SEQ ID NO: 502181 - RNA, 23 nt, Chlamydophila pneumoniae CWL029
aauccugcucguaaaucuggaau

SEQ ID NO: 502182 - RNA, 17 nt, Chlamydophila pneumoniae CWL029
aauccugaguaaaauca

SEQ ID NO: 502183 - RNA, 18 nt, Chlamydophila pneumoniae CWL029
aauccugaguaaaaucau

SEQ ID NO: 502184 - RNA, 20 nt, Chlamydophila pneumoniae CWL029
aauccucugaaggauuugcu

SEQ ID NO: 502185 - RNA, 16 nt, Chlamydophila pneumoniae CWL029
aauccugaguaaaauc

SEQ ID NO: 502186 - RNA, 20 nt, Chlamydophila pneumoniae CWL029
aauccauaguccuagcagag

SEQ ID NO: 502187 - RNA, 23 nt, Chlamydophila pneumoniae CWL029
aaucgaauagcucuggagauugc

SEQ ID NO: 502188 - RNA, 23 nt, Chlamydophila pneumoniae CWL029
aaaaauuugcgaaguccuggauu

SEQ ID NO: 502189 - RNA, 22 nt, Chlamydophila pneumoniae CWL029
aaaaauuuuauaggaauaacac

SEQ ID NO: 502190 - RNA, 19 nt, Chlamydophila pneumoniae CWL029
aaucgccuuacaauuuaaa

SEQ ID NO: 502191 - RNA, 16 nt, Chlamydophila pneumoniae CWL029
aaucucgggagaacau

SEQ ID NO: 502192 - RNA, 14 nt, Chlamydophila pneumoniae CWL029
aaucucgcuauucc

SEQ ID NO: 502193 - RNA, 17 nt, Chlamydophila pneumoniae CWL029
aaucuauccuucgaccu

SEQ ID NO: 502194 - RNA, 13 nt, Chlamydophila pneumoniae CWL029
aaucuaagaaucu

SEQ ID NO: 502195 - RNA, 15 nt, Chlamydophila pneumoniae CWL029
aaucuaacucuugua

SEQ ID NO: 502196 - RNA, 16 nt, Chlamydophila pneumoniae CWL029
aaucuauaggauuugc

SEQ ID NO: 502197 - RNA, 19 nt, Chlamydophila pneumoniae CWL029
aaucuaaaaacuucccauc

SEQ ID NO: 502198 - RNA, 23 nt, Chlamydophila pneumoniae CWL029
aaucuaaaaacuucccaucuugu

SEQ ID NO: 502199 - RNA, 16 nt, Chlamydophila pneumoniae CWL029
aaucuaaaaucacacu

SEQ ID NO: 502200 - RNA, 18 nt, Chlamydophila pneumoniae CWL029
aaucguuuuauuuuagga

SEQ ID NO: 502201 - RNA, 21 nt, Chlamydophila pneumoniae CWL029
aaucgcuguuuuagcauagca

SEQ ID NO: 502202 - RNA, 16 nt, Chlamydophila pneumoniae CWL029
aaucgcuguaaauuca

SEQ ID NO: 502203 - RNA, 12 nt, Chlamydophila pneumoniae CWL029
aauccacauccu

SEQ ID NO: 502204 - RNA, 21 nt, Chlamydophila pneumoniae CWL029
aauccaccaaugauaauuuca

SEQ ID NO: 502205 - RNA, 16 nt, Chlamydophila pneumoniae CWL029
aauccaacaaagauga

SEQ ID NO: 502206 - RNA, 13 nt, Chlamydophila pneumoniae CWL029
aaucauucaaaua

SEQ ID NO: 502207 - RNA, 21 nt, Chlamydophila pneumoniae CWL029
aaaaauucucauaaccuaagg

SEQ ID NO: 502208 - RNA, 13 nt, Chlamydophila pneumoniae CWL029
aaucauaucugcg

SEQ ID NO: 502209 - RNA, 15 nt, Chlamydophila pneumoniae CWL029
aaucagugcugccau

SEQ ID NO: 502210 - RNA, 23 nt, Chlamydophila pneumoniae CWL029
aaucauaacaagucuaucgacac

SEQ ID NO: 502211 - RNA, 20 nt, Chlamydophila pneumoniae CWL029
aaucauaaccaaaagaauua

SEQ ID NO: 502212 - RNA, 21 nt, Chlamydophila pneumoniae CWL029
aaucauagagauaucaucaaa

SEQ ID NO: 502213 - RNA, 21 nt, Chlamydophila pneumoniae CWL029
aaucauagccaucauagcaaa

SEQ ID NO: 502214 - RNA, 13 nt, Chlamydophila pneumoniae CWL029
aaucaguccuaaa

SEQ ID NO: 502215 - RNA, 19 nt, Chlamydophila pneumoniae CWL029
acucuucaucgauaggaug

SEQ ID NO: 502216 - RNA, 23 nt, Chlamydophila pneumoniae CWL029
acucuuccaauuguaaaucauug

SEQ ID NO: 502217 - RNA, 22 nt, Chlamydophila pneumoniae CWL029
acucuuguugucuauggaagcg

SEQ ID NO: 502218 - RNA, 13 nt, Chlamydophila pneumoniae CWL029
acucuuuaaaaau

SEQ ID NO: 502219 - RNA, 16 nt, Chlamydophila pneumoniae CWL029
acucuuauugcagaau

SEQ ID NO: 502220 - RNA, 23 nt, Chlamydophila pneumoniae CWL029
acucuguuuccuugugucuuaaa

SEQ ID NO: 502221 - RNA, 15 nt, Chlamydophila pneumoniae CWL029
acucuguaauauuca

SEQ ID NO: 502222 - RNA, 19 nt, Chlamydophila pneumoniae CWL029
acucuacaguaguaaauaa

SEQ ID NO: 502223 - RNA, 21 nt, Chlamydophila pneumoniae CWL029
acucuacaguaguaaauaaua

SEQ ID NO: 502224 - RNA, 22 nt, Chlamydophila pneumoniae CWL029
acucuacaguaguaaauaauaa

SEQ ID NO: 502225 - RNA, 19 nt, Chlamydophila pneumoniae CWL029
acucuacccccagcuucuu

SEQ ID NO: 502226 - RNA, 14 nt, Chlamydophila pneumoniae CWL029
acucuacaaguguc

SEQ ID NO: 502227 - RNA, 22 nt, Chlamydophila pneumoniae CWL029
acucuaaucugauucaauugag

SEQ ID NO: 502228 - RNA, 13 nt, Chlamydophila pneumoniae CWL029
acucucuuccuuc

SEQ ID NO: 502229 - RNA, 17 nt, Chlamydophila pneumoniae CWL029
acucucuuccuucuccu

SEQ ID NO: 502230 - RNA, 18 nt, Chlamydophila pneumoniae CWL029
acucucuuccuucuccug

SEQ ID NO: 502231 - RNA, 13 nt, Chlamydophila pneumoniae CWL029
acucaaaagaaga

SEQ ID NO: 502232 - RNA, 18 nt, Chlamydophila pneumoniae CWL029
acuauuuuggaaagcucu

SEQ ID NO: 502233 - RNA, 23 nt, Chlamydophila pneumoniae CWL029
acucccuagguuuuaucuuuaga

SEQ ID NO: 502234 - RNA, 15 nt, Chlamydophila pneumoniae CWL029
acucccguuuuguug

SEQ ID NO: 502235 - RNA, 22 nt, Chlamydophila pneumoniae CWL029
acucccuagguuuuaucuuuag

SEQ ID NO: 502236 - RNA, 16 nt, Chlamydophila pneumoniae CWL029
acucggaaaaaauaga

SEQ ID NO: 502237 - RNA, 22 nt, Chlamydophila pneumoniae CWL029
acuggagagguaaccagagagc

SEQ ID NO: 502238 - RNA, 20 nt, Chlamydophila pneumoniae CWL029
acugcgaaggguuguugcca

SEQ ID NO: 502239 - RNA, 22 nt, Chlamydophila pneumoniae CWL029
acugcgaaggguuguugccagu

SEQ ID NO: 502240 - RNA, 17 nt, Chlamydophila pneumoniae CWL029
acugaaaccuucucucu

SEQ ID NO: 502241 - RNA, 14 nt, Chlamydophila pneumoniae CWL029
acugaggcaaagau

SEQ ID NO: 502242 - RNA, 19 nt, Chlamydophila pneumoniae CWL029
acugagcuucuaucuugaa

SEQ ID NO: 502243 - RNA, 19 nt, Chlamydophila pneumoniae CWL029
acucuuuuauuuuaggaag

SEQ ID NO: 502244 - RNA, 23 nt, Chlamydophila pneumoniae CWL029
acucuuuaaaagggcgcuucccu

SEQ ID NO: 502245 - RNA, 15 nt, Chlamydophila pneumoniae CWL029
acucuuucagaaaga

SEQ ID NO: 502246 - RNA, 21 nt, Chlamydophila pneumoniae CWL029
acugcaaaggaagggauguuu

SEQ ID NO: 502247 - RNA, 16 nt, Chlamydophila pneumoniae CWL029
acugcauaaucucacc

SEQ ID NO: 502248 - RNA, 19 nt, Chlamydophila pneumoniae CWL029
acuucugguccaaacccug

SEQ ID NO: 502249 - RNA, 21 nt, Chlamydophila pneumoniae CWL029
acuucuguaguuuguucacuu

SEQ ID NO: 502250 - RNA, 14 nt, Chlamydophila pneumoniae CWL029
acuucugaaggaaa

SEQ ID NO: 502251 - RNA, 19 nt, Chlamydophila pneumoniae CWL029
acuucuaugauaucaccag

SEQ ID NO: 502252 - RNA, 12 nt, Chlamydophila pneumoniae CWL029
acuucucaaaga

SEQ ID NO: 502253 - RNA, 14 nt, Chlamydophila pneumoniae CWL029
acuucucaaagaca

SEQ ID NO: 502254 - RNA, 16 nt, Chlamydophila pneumoniae CWL029
acuucucaaagacaau

SEQ ID NO: 502255 - RNA, 22 nt, Chlamydophila pneumoniae CWL029
acuucguuucgcuuugauaaua

SEQ ID NO: 502256 - RNA, 23 nt, Chlamydophila pneumoniae CWL029
acuucguuagaaaccaugaugca

SEQ ID NO: 502257 - RNA, 15 nt, Chlamydophila pneumoniae CWL029
acuucuaaaagcaag

SEQ ID NO: 502258 - RNA, 14 nt, Chlamydophila pneumoniae CWL029
acuucuaacuguac

SEQ ID NO: 502259 - RNA, 22 nt, Chlamydophila pneumoniae CWL029
acuucuucguuagagaagaggu

SEQ ID NO: 502260 - RNA, 21 nt, Chlamydophila pneumoniae CWL029
acuucuugugauccuugcaaa

SEQ ID NO: 502261 - RNA, 23 nt, Chlamydophila pneumoniae CWL029
acuucuuuaggagcauagacucu

SEQ ID NO: 502262 - RNA, 19 nt, Chlamydophila pneumoniae CWL029
acuuccuccaauaaucacu

SEQ ID NO: 502263 - RNA, 22 nt, Chlamydophila pneumoniae CWL029
acuucgauuggaagcaaagaaa

SEQ ID NO: 502264 - RNA, 16 nt, Chlamydophila pneumoniae CWL029
acuucgcaaauuuuuc

SEQ ID NO: 502265 - RNA, 17 nt, Chlamydophila pneumoniae CWL029
acuucaucgacaguauu

SEQ ID NO: 502266 - RNA, 17 nt, Chlamydophila pneumoniae CWL029
acuucccaucuuguucu

SEQ ID NO: 502267 - RNA, 16 nt, Chlamydophila pneumoniae CWL029
acuuaggaauuuuucu

SEQ ID NO: 502268 - RNA, 15 nt, Chlamydophila pneumoniae CWL029
acuuagagucuucga

SEQ ID NO: 502269 - RNA, 20 nt, Chlamydophila pneumoniae CWL029
acuuagagucuucgacaagg

SEQ ID NO: 502270 - RNA, 19 nt, Chlamydophila pneumoniae CWL029
acuuagaacuauaggaagc

SEQ ID NO: 502271 - RNA, 14 nt, Chlamydophila pneumoniae CWL029
acuuauuguucuug

SEQ ID NO: 502272 - RNA, 16 nt, Chlamydophila pneumoniae CWL029
acuucaacuucuccaa

SEQ ID NO: 502273 - RNA, 14 nt, Chlamydophila pneumoniae CWL029
acuucaaaugaaau

SEQ ID NO: 502274 - RNA, 17 nt, Chlamydophila pneumoniae CWL029
acuucaaaugaaauucu

SEQ ID NO: 502275 - RNA, 21 nt, Chlamydophila pneumoniae CWL029
acuucaacaaaggcuccaaac

SEQ ID NO: 502276 - RNA, 22 nt, Chlamydophila pneumoniae CWL029
acuucaacaaaggcuccaaacg

SEQ ID NO: 502277 - RNA, 19 nt, Chlamydophila pneumoniae CWL029
acuucaaugaaagcuguau

SEQ ID NO: 502278 - RNA, 22 nt, Chlamydophila pneumoniae CWL029
acuucaccauauaauagauaua

SEQ ID NO: 502279 - RNA, 19 nt, Chlamydophila pneumoniae CWL029
acuucaggaaauaauuugu

SEQ ID NO: 502280 - RNA, 15 nt, Chlamydophila pneumoniae CWL029
acuucagcaagaaaa

SEQ ID NO: 502281 - RNA, 16 nt, Chlamydophila pneumoniae CWL029
acuucagcaagaaaau

SEQ ID NO: 502282 - RNA, 23 nt, Chlamydophila pneumoniae CWL029
acuucaccuugaaguuuuuucuc

SEQ ID NO: 502283 - RNA, 21 nt, Chlamydophila pneumoniae CWL029
acuuacuaaaggugaaaguac

SEQ ID NO: 502284 - RNA, 22 nt, Chlamydophila pneumoniae CWL029
acuuacuaaaggugaaaguaca

SEQ ID NO: 502285 - RNA, 23 nt, Chlamydophila pneumoniae CWL029
acuuacagccaccuuggcuucua

SEQ ID NO: 502286 - RNA, 20 nt, Chlamydophila pneumoniae CWL029
acuguuguaauaaaaucaug

SEQ ID NO: 502287 - RNA, 16 nt, Chlamydophila pneumoniae CWL029
acuuaaagacuugcuu

SEQ ID NO: 502288 - RNA, 15 nt, Chlamydophila pneumoniae CWL029
acuguugauccuucu

SEQ ID NO: 502289 - RNA, 17 nt, Chlamydophila pneumoniae CWL029
acuguugauccuucuua

SEQ ID NO: 502290 - RNA, 18 nt, Chlamydophila pneumoniae CWL029
acuguugauccuucuuau

SEQ ID NO: 502291 - RNA, 16 nt, Chlamydophila pneumoniae CWL029
acuguugcauuagaua

SEQ ID NO: 502292 - RNA, 22 nt, Chlamydophila pneumoniae CWL029
acuguucgauaagaacuuuagg

SEQ ID NO: 502293 - RNA, 20 nt, Chlamydophila pneumoniae CWL029
acugucuagcaguugcaaua

SEQ ID NO: 502294 - RNA, 13 nt, Chlamydophila pneumoniae CWL029
acuaaagauacuu

SEQ ID NO: 502295 - RNA, 18 nt, Chlamydophila pneumoniae CWL029
acuaaagauacuuaucuu

SEQ ID NO: 502296 - RNA, 19 nt, Chlamydophila pneumoniae CWL029
acuaaagauacuuaucuuu

SEQ ID NO: 502297 - RNA, 19 nt, Chlamydophila pneumoniae CWL029
acguuuucucuucccuugu

SEQ ID NO: 502298 - RNA, 18 nt, Chlamydophila pneumoniae CWL029
acguuuuucccuuuaaaa

SEQ ID NO: 502299 - RNA, 14 nt, Chlamydophila pneumoniae CWL029
acuaaaaaagagac

SEQ ID NO: 502300 - RNA, 19 nt, Chlamydophila pneumoniae CWL029
acguugcgaacagcuccug

SEQ ID NO: 502301 - RNA, 18 nt, Chlamydophila pneumoniae CWL029
acgucuucuuagaagaga

SEQ ID NO: 502302 - RNA, 18 nt, Chlamydophila pneumoniae CWL029
acguagcuacaaaauuau

SEQ ID NO: 502303 - RNA, 18 nt, Chlamydophila pneumoniae CWL029
acguaguccuuauuucaa

SEQ ID NO: 502304 - RNA, 22 nt, Chlamydophila pneumoniae CWL029
acguucugcaacaaguugcauu

SEQ ID NO: 502305 - RNA, 18 nt, Chlamydophila pneumoniae CWL029
acgugcucucuacuucug

SEQ ID NO: 502306 - RNA, 19 nt, Chlamydophila pneumoniae CWL029
acgugcucucuucuucuca

SEQ ID NO: 502307 - RNA, 17 nt, Chlamydophila pneumoniae CWL029
acuaagauaucuccagg

SEQ ID NO: 502308 - RNA, 16 nt, Chlamydophila pneumoniae CWL029
acuaacuguaauuuca

SEQ ID NO: 502309 - RNA, 12 nt, Chlamydophila pneumoniae CWL029
acuaacauagau

SEQ ID NO: 502310 - RNA, 21 nt, Chlamydophila pneumoniae CWL029
acuaacaaaauuucuuauaaa

SEQ ID NO: 502311 - RNA, 20 nt, Chlamydophila pneumoniae CWL029
acuaaucaccuuaggcuuaa

SEQ ID NO: 502312 - RNA, 12 nt, Chlamydophila pneumoniae CWL029
acuacagaggga

SEQ ID NO: 502313 - RNA, 19 nt, Chlamydophila pneumoniae CWL029
acuacagagggcuucauuc

SEQ ID NO: 502314 - RNA, 16 nt, Chlamydophila pneumoniae CWL029
acuacaagauaguggu

SEQ ID NO: 502315 - RNA, 22 nt, Chlamydophila pneumoniae CWL029
acuacacgcacuugcuuaucca

SEQ ID NO: 502316 - RNA, 23 nt, Chlamydophila pneumoniae CWL029
acuauaagagguucucuuaacug

SEQ ID NO: 502317 - RNA, 15 nt, Chlamydophila pneumoniae CWL029
acuagauuucuacaa

SEQ ID NO: 502318 - RNA, 13 nt, Chlamydophila pneumoniae CWL029
acuagagaaaaag

SEQ ID NO: 502319 - RNA, 17 nt, Chlamydophila pneumoniae CWL029
acuagauaguucacaag

SEQ ID NO: 502320 - RNA, 18 nt, Chlamydophila pneumoniae CWL029
acuaccgaauuuucaauu

SEQ ID NO: 502321 - RNA, 13 nt, Chlamydophila pneumoniae CWL029
acuagaauaccgu

SEQ ID NO: 502322 - RNA, 20 nt, Chlamydophila pneumoniae CWL029
acuagaaucaccaauuuuuu

SEQ ID NO: 502323 - RNA, 18 nt, Chlamydophila pneumoniae CWL029
acuauuaauacuuugcca

SEQ ID NO: 502324 - RNA, 16 nt, Chlamydophila pneumoniae CWL029
acuauuaggcuuuuuu

SEQ ID NO: 502325 - RNA, 23 nt, Chlamydophila pneumoniae CWL029
acuauuaggcuuuuuucuauuuu

SEQ ID NO: 502326 - RNA, 16 nt, Chlamydophila pneumoniae CWL029
acuauagaaaaggaug

SEQ ID NO: 502327 - RNA, 18 nt, Chlamydophila pneumoniae CWL029
acuauagaaaaggaugca

SEQ ID NO: 502328 - RNA, 17 nt, Chlamydophila pneumoniae CWL029
acuauagcaauccauag

SEQ ID NO: 502329 - RNA, 17 nt, Chlamydophila pneumoniae CWL029
acuauagaucucuugaa

SEQ ID NO: 502330 - RNA, 17 nt, Chlamydophila pneumoniae CWL029
acgguaaugccagcagc

SEQ ID NO: 502331 - RNA, 22 nt, Chlamydophila pneumoniae CWL029
acgguuuucugccuuaccacuu

SEQ ID NO: 502332 - RNA, 14 nt, Chlamydophila pneumoniae CWL029
acguaaaaagaaag

SEQ ID NO: 502333 - RNA, 15 nt, Chlamydophila pneumoniae CWL029
acguaauccagauug

SEQ ID NO: 502334 - RNA, 17 nt, Chlamydophila pneumoniae CWL029
acggcugauucucccaa

SEQ ID NO: 502335 - RNA, 20 nt, Chlamydophila pneumoniae CWL029
acggauccuagaauaggaau

SEQ ID NO: 502336 - RNA, 14 nt, Chlamydophila pneumoniae CWL029
acggauucuaaaag

SEQ ID NO: 502337 - RNA, 17 nt, Chlamydophila pneumoniae CWL029
acggauucuaaaagagc

SEQ ID NO: 502338 - RNA, 20 nt, Chlamydophila pneumoniae CWL029
acggacaaugcuaucuccag

SEQ ID NO: 502339 - RNA, 17 nt, Chlamydophila pneumoniae CWL029
acgcuuucgucuaaaau

SEQ ID NO: 502340 - RNA, 18 nt, Chlamydophila pneumoniae CWL029
acgcuuucgucuaaaaua

SEQ ID NO: 502341 - RNA, 19 nt, Chlamydophila pneumoniae CWL029
acgcuuuuaucuguuaaaa

SEQ ID NO: 502342 - RNA, 12 nt, Chlamydophila pneumoniae CWL029
acgcuuuucuaa

SEQ ID NO: 502343 - RNA, 16 nt, Chlamydophila pneumoniae CWL029
acgcuuuucuucuuua

SEQ ID NO: 502344 - RNA, 19 nt, Chlamydophila pneumoniae CWL029
acgcuucuuuuuggauauc

SEQ ID NO: 502345 - RNA, 18 nt, Chlamydophila pneumoniae CWL029
acggaacaagucuucaau

SEQ ID NO: 502346 - RNA, 14 nt, Chlamydophila pneumoniae CWL029
acggaacuaaagag

SEQ ID NO: 502347 - RNA, 21 nt, Chlamydophila pneumoniae CWL029
acggaacucauuaagaagaac

SEQ ID NO: 502348 - RNA, 13 nt, Chlamydophila pneumoniae CWL029
acgcuuuuucuug

SEQ ID NO: 502349 - RNA, 21 nt, Chlamydophila pneumoniae CWL029
acggaaaauacagccagcaga

SEQ ID NO: 502350 - RNA, 15 nt, Chlamydophila pneumoniae CWL029
acggaaaaucacacu

SEQ ID NO: 502351 - RNA, 14 nt, Chlamydophila pneumoniae CWL029
acggaaagcacaua

SEQ ID NO: 502352 - RNA, 17 nt, Chlamydophila pneumoniae CWL029
acgcucuccauggcuuc

SEQ ID NO: 502353 - RNA, 21 nt, Chlamydophila pneumoniae CWL029
acgcucuaaacucucuuccuu

SEQ ID NO: 502354 - RNA, 14 nt, Chlamydophila pneumoniae CWL029
acgcuauccuauug

SEQ ID NO: 502355 - RNA, 16 nt, Chlamydophila pneumoniae CWL029
acgcuguugaaaugca

SEQ ID NO: 502356 - RNA, 15 nt, Chlamydophila pneumoniae CWL029
acgcaugacgcuuuu

SEQ ID NO: 502357 - RNA, 21 nt, Chlamydophila pneumoniae CWL029
acgcauaagagacauuucuug

SEQ ID NO: 502358 - RNA, 18 nt, Chlamydophila pneumoniae CWL029
acgcauagcacuaugaau

SEQ ID NO: 502359 - RNA, 22 nt, Chlamydophila pneumoniae CWL029
acgccaaugggaauuugauuuu

SEQ ID NO: 502360 - RNA, 18 nt, Chlamydophila pneumoniae CWL029
acgcaagagacaagaaaa

SEQ ID NO: 502361 - RNA, 15 nt, Chlamydophila pneumoniae CWL029
acgcaacaucucaca

SEQ ID NO: 502362 - RNA, 17 nt, Chlamydophila pneumoniae CWL029
acgcaacaucucacaga

SEQ ID NO: 502363 - RNA, 21 nt, Chlamydophila pneumoniae CWL029
acgcaacaucucacagauacc

SEQ ID NO: 502364 - RNA, 15 nt, Chlamydophila pneumoniae CWL029
acgcacauuuagaag

SEQ ID NO: 502365 - RNA, 13 nt, Chlamydophila pneumoniae CWL029
acgcacgccaaga

SEQ ID NO: 502366 - RNA, 20 nt, Chlamydophila pneumoniae CWL029
acgcagagaugcuaacaacu

SEQ ID NO: 502367 - RNA, 21 nt, Chlamydophila pneumoniae CWL029
acgauucuaggccuaaagaau

SEQ ID NO: 502368 - RNA, 13 nt, Chlamydophila pneumoniae CWL029
acgauuucuuuua

SEQ ID NO: 502369 - RNA, 20 nt, Chlamydophila pneumoniae CWL029
acgaucgucaguaaaacaca

SEQ ID NO: 502370 - RNA, 21 nt, Chlamydophila pneumoniae CWL029
acgaucgucaguaaaacacaa

SEQ ID NO: 502371 - RNA, 16 nt, Chlamydophila pneumoniae CWL029
acgaucgcgauaagaa

SEQ ID NO: 502372 - RNA, 17 nt, Chlamydophila pneumoniae CWL029
acgaucgcgauaagaag

SEQ ID NO: 502373 - RNA, 20 nt, Chlamydophila pneumoniae CWL029
acgaggagaagucgaaagau

SEQ ID NO: 502374 - RNA, 13 nt, Chlamydophila pneumoniae CWL029
acgaggagcuuuu

SEQ ID NO: 502375 - RNA, 17 nt, Chlamydophila pneumoniae CWL029
acgagacugcaaaggaa

SEQ ID NO: 502376 - RNA, 21 nt, Chlamydophila pneumoniae CWL029
acgagaacaugaccuuuagga

SEQ ID NO: 502377 - RNA, 20 nt, Chlamydophila pneumoniae CWL029
acgagaaccaaagcagugua

SEQ ID NO: 502378 - RNA, 15 nt, Chlamydophila pneumoniae CWL029
acgaacuaaaggaac

SEQ ID NO: 502379 - RNA, 15 nt, Chlamydophila pneumoniae CWL029
acgaaggaaucugau

SEQ ID NO: 502380 - RNA, 20 nt, Chlamydophila pneumoniae CWL029
accuuacauccaauuuuguu

SEQ ID NO: 502381 - RNA, 16 nt, Chlamydophila pneumoniae CWL029
accuuagagugacuca

SEQ ID NO: 502382 - RNA, 21 nt, Chlamydophila pneumoniae CWL029
accugggggacuucaaaugaa

SEQ ID NO: 502383 - RNA, 13 nt, Chlamydophila pneumoniae CWL029
accuguuuucuuu

SEQ ID NO: 502384 - RNA, 19 nt, Chlamydophila pneumoniae CWL029
accuguguaaugagcugga

SEQ ID NO: 502385 - RNA, 14 nt, Chlamydophila pneumoniae CWL029
accugugugcuuua

SEQ ID NO: 502386 - RNA, 15 nt, Chlamydophila pneumoniae CWL029
accuuuccuaaaaua

SEQ ID NO: 502387 - RNA, 17 nt, Chlamydophila pneumoniae CWL029
accuuuuuuuaaaaaua

SEQ ID NO: 502388 - RNA, 18 nt, Chlamydophila pneumoniae CWL029
acgaaaaggagaauacaa

SEQ ID NO: 502389 - RNA, 14 nt, Chlamydophila pneumoniae CWL029
acgaaaacaucugu

SEQ ID NO: 502390 - RNA, 14 nt, Chlamydophila pneumoniae CWL029
acgaaauguuaaag

SEQ ID NO: 502391 - RNA, 17 nt, Chlamydophila pneumoniae CWL029
acgaacaagacgaaagc

SEQ ID NO: 502392 - RNA, 17 nt, Chlamydophila pneumoniae CWL029
accuuuaggaagcugua

SEQ ID NO: 502393 - RNA, 23 nt, Chlamydophila pneumoniae CWL029
accuuuaggaagcuguacuugau

SEQ ID NO: 502394 - RNA, 18 nt, Chlamydophila pneumoniae CWL029
accuucgauuccaggcuc

SEQ ID NO: 502395 - RNA, 14 nt, Chlamydophila pneumoniae CWL029
accuuccuuaucuu

SEQ ID NO: 502396 - RNA, 22 nt, Chlamydophila pneumoniae CWL029
accucuccgucauauuuaaaag

SEQ ID NO: 502397 - RNA, 22 nt, Chlamydophila pneumoniae CWL029
accucucccuugggauuccuua

SEQ ID NO: 502398 - RNA, 22 nt, Chlamydophila pneumoniae CWL029
accugaaagcgcguuccuguag

SEQ ID NO: 502399 - RNA, 16 nt, Chlamydophila pneumoniae CWL029
accugagaguguuguu

SEQ ID NO: 502400 - RNA, 18 nt, Chlamydophila pneumoniae CWL029
accucucaucaaagcaaa

SEQ ID NO: 502401 - RNA, 12 nt, Chlamydophila pneumoniae CWL029
accuaggaggau

SEQ ID NO: 502402 - RNA, 16 nt, Chlamydophila pneumoniae CWL029
accuagggucuucucg

SEQ ID NO: 502403 - RNA, 17 nt, Chlamydophila pneumoniae CWL029
accuaggagaaaucaca

SEQ ID NO: 502404 - RNA, 21 nt, Chlamydophila pneumoniae CWL029
accuaggagaaaucacacuua

SEQ ID NO: 502405 - RNA, 13 nt, Chlamydophila pneumoniae CWL029
accuauaggcaag

SEQ ID NO: 502406 - RNA, 22 nt, Chlamydophila pneumoniae CWL029
accuauagguucaccagaagca

SEQ ID NO: 502407 - RNA, 15 nt, Chlamydophila pneumoniae CWL029
accuagaaucacaua

SEQ ID NO: 502408 - RNA, 17 nt, Chlamydophila pneumoniae CWL029
accucaauaaaucuauu

SEQ ID NO: 502409 - RNA, 20 nt, Chlamydophila pneumoniae CWL029
accuaugacggauccuagaa

SEQ ID NO: 502410 - RNA, 22 nt, Chlamydophila pneumoniae CWL029
accuaugacggauccuagaaua

SEQ ID NO: 502411 - RNA, 21 nt, Chlamydophila pneumoniae CWL029
accuccucuucuucaucuucu

SEQ ID NO: 502412 - RNA, 21 nt, Chlamydophila pneumoniae CWL029
accucgaauuccucccagccc

SEQ ID NO: 502413 - RNA, 23 nt, Chlamydophila pneumoniae CWL029
accuccuagaagcgcuuuauguu

SEQ ID NO: 502414 - RNA, 20 nt, Chlamydophila pneumoniae CWL029
accuccuauuuucuuaugac

SEQ ID NO: 502415 - RNA, 15 nt, Chlamydophila pneumoniae CWL029
accgcgagugugacu

SEQ ID NO: 502416 - RNA, 22 nt, Chlamydophila pneumoniae CWL029
accgaucucaguaggagcagcg

SEQ ID NO: 502417 - RNA, 15 nt, Chlamydophila pneumoniae CWL029
acccucgaaccacug

SEQ ID NO: 502418 - RNA, 16 nt, Chlamydophila pneumoniae CWL029
acccucggagacucag

SEQ ID NO: 502419 - RNA, 14 nt, Chlamydophila pneumoniae CWL029
acccuccuuuguau

SEQ ID NO: 502420 - RNA, 17 nt, Chlamydophila pneumoniae CWL029
accccaucagcaaugau

SEQ ID NO: 502421 - RNA, 13 nt, Chlamydophila pneumoniae CWL029
acccaucuagaaa

SEQ ID NO: 502422 - RNA, 20 nt, Chlamydophila pneumoniae CWL029
acccauauuugaauaaagga

SEQ ID NO: 502423 - RNA, 14 nt, Chlamydophila pneumoniae CWL029
acccaccagaagga

SEQ ID NO: 502424 - RNA, 14 nt, Chlamydophila pneumoniae CWL029
accauucuugaaga

SEQ ID NO: 502425 - RNA, 13 nt, Chlamydophila pneumoniae CWL029
acccaagagaccc

SEQ ID NO: 502426 - RNA, 16 nt, Chlamydophila pneumoniae CWL029
acccaaagaggggagc

SEQ ID NO: 502427 - RNA, 14 nt, Chlamydophila pneumoniae CWL029
acccaacaguucuu

SEQ ID NO: 502428 - RNA, 18 nt, Chlamydophila pneumoniae CWL029
accauaaggagauuccua

SEQ ID NO: 502429 - RNA, 16 nt, Chlamydophila pneumoniae CWL029
accagaagacucccaa

SEQ ID NO: 502430 - RNA, 19 nt, Chlamydophila pneumoniae CWL029
accauacacaaaucauuua

SEQ ID NO: 502431 - RNA, 23 nt, Chlamydophila pneumoniae CWL029
accaucaugaaucuuaugggaga

SEQ ID NO: 502432 - RNA, 13 nt, Chlamydophila pneumoniae CWL029
accaucaccuucg

SEQ ID NO: 502433 - RNA, 16 nt, Chlamydophila pneumoniae CWL029
accauccgacuuuccu

SEQ ID NO: 502434 - RNA, 13 nt, Chlamydophila pneumoniae CWL029
accaugaggcugc

SEQ ID NO: 502435 - RNA, 14 nt, Chlamydophila pneumoniae CWL029
agcauagagagaag

SEQ ID NO: 502436 - RNA, 20 nt, Chlamydophila pneumoniae CWL029
agcauagacucuuccuucua

SEQ ID NO: 502437 - RNA, 14 nt, Chlamydophila pneumoniae CWL029
agcauacuuauauu

SEQ ID NO: 502438 - RNA, 23 nt, Chlamydophila pneumoniae CWL029
agcauagcccgaaauucauuaaa

SEQ ID NO: 502439 - RNA, 15 nt, Chlamydophila pneumoniae CWL029
agcauaaucuuuaac

SEQ ID NO: 502440 - RNA, 19 nt, Chlamydophila pneumoniae CWL029
agcaguauagagaagauuu

SEQ ID NO: 502441 - RNA, 15 nt, Chlamydophila pneumoniae CWL029
agcaugaagcagaaa

SEQ ID NO: 502442 - RNA, 19 nt, Chlamydophila pneumoniae CWL029
agcaucgcuuaacaaacuu

SEQ ID NO: 502443 - RNA, 13 nt, Chlamydophila pneumoniae CWL029
agcaggagcauca

SEQ ID NO: 502444 - RNA, 18 nt, Chlamydophila pneumoniae CWL029
agcagcccgcacaucaug

SEQ ID NO: 502445 - RNA, 21 nt, Chlamydophila pneumoniae CWL029
agcaggaguuuucaagucugu

SEQ ID NO: 502446 - RNA, 13 nt, Chlamydophila pneumoniae CWL029
agcagcaagaaca

SEQ ID NO: 502447 - RNA, 14 nt, Chlamydophila pneumoniae CWL029
agcagcaagaacau

SEQ ID NO: 502448 - RNA, 16 nt, Chlamydophila pneumoniae CWL029
agcagauagagcuucu

SEQ ID NO: 502449 - RNA, 13 nt, Chlamydophila pneumoniae CWL029
agcagaaacucca

SEQ ID NO: 502450 - RNA, 18 nt, Chlamydophila pneumoniae CWL029
agcagaaacuccaaaaua

SEQ ID NO: 502451 - RNA, 17 nt, Chlamydophila pneumoniae CWL029
agcacuucuuuaggagc

SEQ ID NO: 502452 - RNA, 18 nt, Chlamydophila pneumoniae CWL029
agcacucuuuuucuaaga

SEQ ID NO: 502453 - RNA, 22 nt, Chlamydophila pneumoniae CWL029
agcacuuguuuuuucuucuguu

SEQ ID NO: 502454 - RNA, 18 nt, Chlamydophila pneumoniae CWL029
agcacguagguuguacuu

SEQ ID NO: 502455 - RNA, 16 nt, Chlamydophila pneumoniae CWL029
agcaacccgaauuccu

SEQ ID NO: 502456 - RNA, 21 nt, Chlamydophila pneumoniae CWL029
agcaccuaauaaagaagguug

SEQ ID NO: 502457 - RNA, 14 nt, Chlamydophila pneumoniae CWL029
agcccgaaauucau

SEQ ID NO: 502458 - RNA, 12 nt, Chlamydophila pneumoniae CWL029
agccccacccac

SEQ ID NO: 502459 - RNA, 19 nt, Chlamydophila pneumoniae CWL029
agccgauacccaucuagaa

SEQ ID NO: 502460 - RNA, 15 nt, Chlamydophila pneumoniae CWL029
agccauuuucuaaga

SEQ ID NO: 502461 - RNA, 16 nt, Chlamydophila pneumoniae CWL029
agccaugacaaagggu

SEQ ID NO: 502462 - RNA, 15 nt, Chlamydophila pneumoniae CWL029
agccaagaaaacaua

SEQ ID NO: 502463 - RNA, 23 nt, Chlamydophila pneumoniae CWL029
agccaagaaaacauaaaguuaua

SEQ ID NO: 502464 - RNA, 21 nt, Chlamydophila pneumoniae CWL029
agcaugcuaagcaucagaauc

SEQ ID NO: 502465 - RNA, 20 nt, Chlamydophila pneumoniae CWL029
agcauggagaauaaucucuu

SEQ ID NO: 502466 - RNA, 23 nt, Chlamydophila pneumoniae CWL029
agcauggagaauaaucucuuuca

SEQ ID NO: 502467 - RNA, 16 nt, Chlamydophila pneumoniae CWL029
agcaugcuaagcauca

SEQ ID NO: 502468 - RNA, 17 nt, Chlamydophila pneumoniae CWL029
agcaugcuaagcaucag

SEQ ID NO: 502469 - RNA, 14 nt, Chlamydophila pneumoniae CWL029
agccaccuuggcuu

SEQ ID NO: 502470 - RNA, 21 nt, Chlamydophila pneumoniae CWL029
agccaccuuggcuucuaucuu

SEQ ID NO: 502471 - RNA, 20 nt, Chlamydophila pneumoniae CWL029
agcucauuaucaagaaauuc

SEQ ID NO: 502472 - RNA, 21 nt, Chlamydophila pneumoniae CWL029
agcucauuaucaagaaauucu

SEQ ID NO: 502473 - RNA, 13 nt, Chlamydophila pneumoniae CWL029
agcuccaaaauaa

SEQ ID NO: 502474 - RNA, 17 nt, Chlamydophila pneumoniae CWL029
agcucauuaucaagaaa

SEQ ID NO: 502475 - RNA, 18 nt, Chlamydophila pneumoniae CWL029
agcucaucggaucuuuuc

SEQ ID NO: 502476 - RNA, 17 nt, Chlamydophila pneumoniae CWL029
agcucaucuagaaagau

SEQ ID NO: 502477 - RNA, 19 nt, Chlamydophila pneumoniae CWL029
agcucaucuagaaagauuu

SEQ ID NO: 502478 - RNA, 12 nt, Chlamydophila pneumoniae CWL029
agcucauaagaa

SEQ ID NO: 502479 - RNA, 17 nt, Chlamydophila pneumoniae CWL029
agcucaucagcaaccuu

SEQ ID NO: 502480 - RNA, 13 nt, Chlamydophila pneumoniae CWL029
agcucacaacccu

SEQ ID NO: 502481 - RNA, 20 nt, Chlamydophila pneumoniae CWL029
agcucacgcaccauuccuua

SEQ ID NO: 502482 - RNA, 18 nt, Chlamydophila pneumoniae CWL029
agcucacucuuuaaaaac

SEQ ID NO: 502483 - RNA, 12 nt, Chlamydophila pneumoniae CWL029
agcucaaggcau

SEQ ID NO: 502484 - RNA, 14 nt, Chlamydophila pneumoniae CWL029
agcuauuugaaaua

SEQ ID NO: 502485 - RNA, 23 nt, Chlamydophila pneumoniae CWL029
agcuauuuuugaggaacgcacgc

SEQ ID NO: 502486 - RNA, 15 nt, Chlamydophila pneumoniae CWL029
agcuauuucucuauc

SEQ ID NO: 502487 - RNA, 20 nt, Chlamydophila pneumoniae CWL029
agcuauuucucuaucaucaa

SEQ ID NO: 502488 - RNA, 20 nt, Chlamydophila pneumoniae CWL029
agcuauuuuacuuacuaaag

SEQ ID NO: 502489 - RNA, 20 nt, Chlamydophila pneumoniae CWL029
agcuauagauuuuggagaca

SEQ ID NO: 502490 - RNA, 23 nt, Chlamydophila pneumoniae CWL029
agcuauauaggguugugucucug

SEQ ID NO: 502491 - RNA, 15 nt, Chlamydophila pneumoniae CWL029
agcuaugaugagaac

SEQ ID NO: 502492 - RNA, 17 nt, Chlamydophila pneumoniae CWL029
agcuaugaugagaacgu

SEQ ID NO: 502493 - RNA, 18 nt, Chlamydophila pneumoniae CWL029
agcuagucuuucuaagaa

SEQ ID NO: 502494 - RNA, 14 nt, Chlamydophila pneumoniae CWL029
agcuagucuucuua

SEQ ID NO: 502495 - RNA, 21 nt, Chlamydophila pneumoniae CWL029
agcuaauuuaaaugccuuaaa

SEQ ID NO: 502496 - RNA, 20 nt, Chlamydophila pneumoniae CWL029
agcuacaagaacugaagagu

SEQ ID NO: 502497 - RNA, 19 nt, Chlamydophila pneumoniae CWL029
agcuaaguaacaguccucu

SEQ ID NO: 502498 - RNA, 21 nt, Chlamydophila pneumoniae CWL029
agcuaaguaacaguccucucc

SEQ ID NO: 502499 - RNA, 18 nt, Chlamydophila pneumoniae CWL029
agcuaagucuccauaauu

SEQ ID NO: 502500 - RNA, 17 nt, Chlamydophila pneumoniae CWL029
agcuaauaagauccaaa

SEQ ID NO: 502501 - RNA, 19 nt, Chlamydophila pneumoniae CWL029
agcuaauaagauccaaaaa

SEQ ID NO: 502502 - RNA, 17 nt, Chlamydophila pneumoniae CWL029
agcuaauacaucaccac

SEQ ID NO: 502503 - RNA, 16 nt, Chlamydophila pneumoniae CWL029
agcuaaucaauccaag

SEQ ID NO: 502504 - RNA, 18 nt, Chlamydophila pneumoniae CWL029
agcuaaucaauccaagaa

SEQ ID NO: 502505 - RNA, 20 nt, Chlamydophila pneumoniae CWL029
agcuagagcacauagaaaca

SEQ ID NO: 502506 - RNA, 20 nt, Chlamydophila pneumoniae CWL029
agcuaccuagggucuucucg

SEQ ID NO: 502507 - RNA, 21 nt, Chlamydophila pneumoniae CWL029
agcuacggagagguuauguac

SEQ ID NO: 502508 - RNA, 16 nt, Chlamydophila pneumoniae CWL029
agcuacagaaagagcu

SEQ ID NO: 502509 - RNA, 19 nt, Chlamydophila pneumoniae CWL029
agcguucgcucucuuuaaa

SEQ ID NO: 502510 - RNA, 14 nt, Chlamydophila pneumoniae CWL029
agcguugcuaagca

SEQ ID NO: 502511 - RNA, 20 nt, Chlamydophila pneumoniae CWL029
agcguuucgauaauuuucac

SEQ ID NO: 502512 - RNA, 19 nt, Chlamydophila pneumoniae CWL029
agcuaaagaaacuucugac

SEQ ID NO: 502513 - RNA, 15 nt, Chlamydophila pneumoniae CWL029
agcguguauccaucu

SEQ ID NO: 502514 - RNA, 15 nt, Chlamydophila pneumoniae CWL029
agcgugaauaucauc

SEQ ID NO: 502515 - RNA, 17 nt, Chlamydophila pneumoniae CWL029
agcgggauaggcaagau

SEQ ID NO: 502516 - RNA, 22 nt, Chlamydophila pneumoniae CWL029
agcgcuacuguauucuguaaga

SEQ ID NO: 502517 - RNA, 12 nt, Chlamydophila pneumoniae CWL029
agcgcaaaucuu

SEQ ID NO: 502518 - RNA, 14 nt, Chlamydophila pneumoniae CWL029
agcgcaucacgaaa

SEQ ID NO: 502519 - RNA, 14 nt, Chlamydophila pneumoniae CWL029
agcgauagcuaaac

SEQ ID NO: 502520 - RNA, 20 nt, Chlamydophila pneumoniae CWL029
agcgaucgcaaucagcaaca

SEQ ID NO: 502521 - RNA, 22 nt, Chlamydophila pneumoniae CWL029
agcgaucucucuuccugcugcu

SEQ ID NO: 502522 - RNA, 15 nt, Chlamydophila pneumoniae CWL029
agcgaucacauagaa

SEQ ID NO: 502523 - RNA, 19 nt, Chlamydophila pneumoniae CWL029
agcgaucacauagaaaaca

SEQ ID NO: 502524 - RNA, 12 nt, Chlamydophila pneumoniae CWL029
agcgaaugaaaa

SEQ ID NO: 502525 - RNA, 13 nt, Chlamydophila pneumoniae CWL029
agccuuuucagau

SEQ ID NO: 502526 - RNA, 19 nt, Chlamydophila pneumoniae CWL029
agccuuuucagauuuuuua

SEQ ID NO: 502527 - RNA, 17 nt, Chlamydophila pneumoniae CWL029
agcgaaagucaaagggc

SEQ ID NO: 502528 - RNA, 11 nt, Chlamydophila pneumoniae CWL029
agccuuuccua

SEQ ID NO: 502529 - RNA, 16 nt, Chlamydophila pneumoniae CWL029
agccuggcuaaaggau

SEQ ID NO: 502530 - RNA, 14 nt, Chlamydophila pneumoniae CWL029
agccuggaaagcuu

SEQ ID NO: 502531 - RNA, 14 nt, Chlamydophila pneumoniae CWL029
agccugcgacuaca

SEQ ID NO: 502532 - RNA, 18 nt, Chlamydophila pneumoniae CWL029
agccugcgacuacaagau

SEQ ID NO: 502533 - RNA, 14 nt, Chlamydophila pneumoniae CWL029
agccugcaccagac

SEQ ID NO: 502534 - RNA, 17 nt, Chlamydophila pneumoniae CWL029
agcaaagguaaauugac

SEQ ID NO: 502535 - RNA, 15 nt, Chlamydophila pneumoniae CWL029
agcaacaaccaaaag

SEQ ID NO: 502536 - RNA, 13 nt, Chlamydophila pneumoniae CWL029
agcaacaaccaaa

SEQ ID NO: 502537 - RNA, 17 nt, Chlamydophila pneumoniae CWL029
agcaaaaauuguuuuug

SEQ ID NO: 502538 - RNA, 17 nt, Chlamydophila pneumoniae CWL029
agcaaacaucaaagaga

SEQ ID NO: 502539 - RNA, 18 nt, Chlamydophila pneumoniae CWL029
agcaaacggaacuaaaga

SEQ ID NO: 502540 - RNA, 15 nt, Chlamydophila pneumoniae CWL029
agcaaacggagagca

SEQ ID NO: 502541 - RNA, 19 nt, Chlamydophila pneumoniae CWL029
agcaaacggagagcauuua

SEQ ID NO: 502542 - RNA, 16 nt, Chlamydophila pneumoniae CWL029
agcaaagauaaagaag

SEQ ID NO: 502543 - RNA, 13 nt, Chlamydophila pneumoniae CWL029
agcaaagaaaauu

SEQ ID NO: 502544 - RNA, 21 nt, Chlamydophila pneumoniae CWL029
agcaaagaaaauucucagauu

SEQ ID NO: 502545 - RNA, 20 nt, Chlamydophila pneumoniae CWL029
agcaaagcggcucuuacuuc

SEQ ID NO: 502546 - RNA, 21 nt, Chlamydophila pneumoniae CWL029
agauuuuucaagaacuccuuu

SEQ ID NO: 502547 - RNA, 18 nt, Chlamydophila pneumoniae CWL029
agauuuuggagacacacu

SEQ ID NO: 502548 - RNA, 22 nt, Chlamydophila pneumoniae CWL029
agauuuuggagacacacuuucu

SEQ ID NO: 502549 - RNA, 21 nt, Chlamydophila pneumoniae CWL029
agauuuuucuuuuagagaaau

SEQ ID NO: 502550 - RNA, 22 nt, Chlamydophila pneumoniae CWL029
agauuuuuuaaccucuuuucuu

SEQ ID NO: 502551 - RNA, 14 nt, Chlamydophila pneumoniae CWL029
agauuuuuucuugg

SEQ ID NO: 502552 - RNA, 16 nt, Chlamydophila pneumoniae CWL029
agauuuguuagagcuu

SEQ ID NO: 502553 - RNA, 19 nt, Chlamydophila pneumoniae CWL029
agauuucuaauccuccaaa

SEQ ID NO: 502554 - RNA, 15 nt, Chlamydophila pneumoniae CWL029
agauuucuacaaaca

SEQ ID NO: 502555 - RNA, 14 nt, Chlamydophila pneumoniae CWL029
agauuucuaauccu

SEQ ID NO: 502556 - RNA, 15 nt, Chlamydophila pneumoniae CWL029
agauuuauuuugucu

SEQ ID NO: 502557 - RNA, 16 nt, Chlamydophila pneumoniae CWL029
agauuuauuuugucuu

SEQ ID NO: 502558 - RNA, 21 nt, Chlamydophila pneumoniae CWL029
agauuggaauauaaucguuuu

SEQ ID NO: 502559 - RNA, 15 nt, Chlamydophila pneumoniae CWL029
agauuguaauuuccu

SEQ ID NO: 502560 - RNA, 16 nt, Chlamydophila pneumoniae CWL029
agauuguuagugagau

SEQ ID NO: 502561 - RNA, 17 nt, Chlamydophila pneumoniae CWL029
agauuguucaaaaauag

SEQ ID NO: 502562 - RNA, 23 nt, Chlamydophila pneumoniae CWL029
agauuguucaaaaauagauaaga

SEQ ID NO: 502563 - RNA, 19 nt, Chlamydophila pneumoniae CWL029
agauugccaggagagcuaa

SEQ ID NO: 502564 - RNA, 23 nt, Chlamydophila pneumoniae CWL029
agauugcacuugcgguuuuggau

SEQ ID NO: 502565 - RNA, 15 nt, Chlamydophila pneumoniae CWL029
agauugaaucccauc

SEQ ID NO: 502566 - RNA, 23 nt, Chlamydophila pneumoniae CWL029
agauugaugcugacagcuccauu

SEQ ID NO: 502567 - RNA, 22 nt, Chlamydophila pneumoniae CWL029
agauucccugcggacagaaacu

SEQ ID NO: 502568 - RNA, 15 nt, Chlamydophila pneumoniae CWL029
agauucuaaaucaac

SEQ ID NO: 502569 - RNA, 16 nt, Chlamydophila pneumoniae CWL029
agauucuaaaucaacu

SEQ ID NO: 502570 - RNA, 20 nt, Chlamydophila pneumoniae CWL029
agauucuaaaucaacuacac

SEQ ID NO: 502571 - RNA, 12 nt, Chlamydophila pneumoniae CWL029
agauucuacaaa

SEQ ID NO: 502572 - RNA, 12 nt, Chlamydophila pneumoniae CWL029
agauucugaaga

SEQ ID NO: 502573 - RNA, 16 nt, Chlamydophila pneumoniae CWL029
agauucugaagagaga

SEQ ID NO: 502574 - RNA, 21 nt, Chlamydophila pneumoniae CWL029
agauucugcccaaagcuaaaa

SEQ ID NO: 502575 - RNA, 20 nt, Chlamydophila pneumoniae CWL029
agauucugcuuuaucucuau

SEQ ID NO: 502576 - RNA, 21 nt, Chlamydophila pneumoniae CWL029
agauucaugaaaugcuuucag

SEQ ID NO: 502577 - RNA, 15 nt, Chlamydophila pneumoniae CWL029
agauucauaaaacug

SEQ ID NO: 502578 - RNA, 17 nt, Chlamydophila pneumoniae CWL029
agauucaagcaaugccu

SEQ ID NO: 502579 - RNA, 21 nt, Chlamydophila pneumoniae CWL029
agauguguacggguaaccuga

SEQ ID NO: 502580 - RNA, 22 nt, Chlamydophila pneumoniae CWL029
agauguggcagaguccuucuuu

SEQ ID NO: 502581 - RNA, 21 nt, Chlamydophila pneumoniae CWL029
agauggcaaggaaaauucagu

SEQ ID NO: 502582 - RNA, 17 nt, Chlamydophila pneumoniae CWL029
aaaacccucaaagaaua

SEQ ID NO: 502583 - RNA, 21 nt, Chlamydophila pneumoniae CWL029
agauccucuauagauugguaa

SEQ ID NO: 502584 - RNA, 16 nt, Chlamydophila pneumoniae CWL029
agauccuagagaaugu

SEQ ID NO: 502585 - RNA, 21 nt, Chlamydophila pneumoniae CWL029
agauccuauaguaauuucucc

SEQ ID NO: 502586 - RNA, 22 nt, Chlamydophila pneumoniae CWL029
agauccugagaccauacacaaa

SEQ ID NO: 502587 - RNA, 15 nt, Chlamydophila pneumoniae CWL029
agauccaaagacgua

SEQ ID NO: 502588 - RNA, 18 nt, Chlamydophila pneumoniae CWL029
agaucauuagcaucaucu

SEQ ID NO: 502589 - RNA, 13 nt, Chlamydophila pneumoniae CWL029
agauccaaaaauu

SEQ ID NO: 502590 - RNA, 13 nt, Chlamydophila pneumoniae CWL029
agaucauaucuua

SEQ ID NO: 502591 - RNA, 20 nt, Chlamydophila pneumoniae CWL029
agaucaucucccaaauagcu

SEQ ID NO: 502592 - RNA, 22 nt, Chlamydophila pneumoniae CWL029
agaucaucuacgauguuuucuu

SEQ ID NO: 502593 - RNA, 17 nt, Chlamydophila pneumoniae CWL029
agaucaggauucuaaaa

SEQ ID NO: 502594 - RNA, 20 nt, Chlamydophila pneumoniae CWL029
agaucagaggaaucuaagaa

SEQ ID NO: 502595 - RNA, 12 nt, Chlamydophila pneumoniae CWL029
agauaucuugua

SEQ ID NO: 502596 - RNA, 23 nt, Chlamydophila pneumoniae CWL029
agauauuaucgauaggaagccag

SEQ ID NO: 502597 - RNA, 19 nt, Chlamydophila pneumoniae CWL029
agauauagcguacaggaag

SEQ ID NO: 502598 - RNA, 18 nt, Chlamydophila pneumoniae CWL029
agauagcgacgucaucau

SEQ ID NO: 502599 - RNA, 22 nt, Chlamydophila pneumoniae CWL029
agauaucgaccuuaaaauugaa

SEQ ID NO: 502600 - RNA, 17 nt, Chlamydophila pneumoniae CWL029
agaguagacaagagaga

SEQ ID NO: 502601 - RNA, 20 nt, Chlamydophila pneumoniae CWL029
agaguacgugaucucacgaa

SEQ ID NO: 502602 - RNA, 20 nt, Chlamydophila pneumoniae CWL029
agaguuccaagacaauaaaa

SEQ ID NO: 502603 - RNA, 20 nt, Chlamydophila pneumoniae CWL029
agaguguuguuggagcagaa

SEQ ID NO: 502604 - RNA, 15 nt, Chlamydophila pneumoniae CWL029
agagugugccagaau

SEQ ID NO: 502605 - RNA, 21 nt, Chlamydophila pneumoniae CWL029
agaguguuguuggagcagaaa

SEQ ID NO: 502606 - RNA, 12 nt, Chlamydophila pneumoniae CWL029
agaguugauugu

SEQ ID NO: 502607 - RNA, 15 nt, Chlamydophila pneumoniae CWL029
agaguugcuuuaugg

SEQ ID NO: 502608 - RNA, 21 nt, Chlamydophila pneumoniae CWL029
agaguuggaucauucuuuaua

SEQ ID NO: 502609 - RNA, 12 nt, Chlamydophila pneumoniae CWL029
agauaaaggcau

SEQ ID NO: 502610 - RNA, 14 nt, Chlamydophila pneumoniae CWL029
agauaaaggcauaa

SEQ ID NO: 502611 - RNA, 17 nt, Chlamydophila pneumoniae CWL029
agauaaagcaaagauaa

SEQ ID NO: 502612 - RNA, 13 nt, Chlamydophila pneumoniae CWL029
agauaagauaaac

SEQ ID NO: 502613 - RNA, 18 nt, Chlamydophila pneumoniae CWL029
agauacuuugcaauacac

SEQ ID NO: 502614 - RNA, 12 nt, Chlamydophila pneumoniae CWL029
agauagagcgac

SEQ ID NO: 502615 - RNA, 15 nt, Chlamydophila pneumoniae CWL029
agauacggaggauua

SEQ ID NO: 502616 - RNA, 23 nt, Chlamydophila pneumoniae CWL029
agauaagucgaaucuaaaaacuu

SEQ ID NO: 502617 - RNA, 19 nt, Chlamydophila pneumoniae CWL029
agauaaguuacuuucugau

SEQ ID NO: 502618 - RNA, 15 nt, Chlamydophila pneumoniae CWL029
agauacgaaguccca

SEQ ID NO: 502619 - RNA, 15 nt, Chlamydophila pneumoniae CWL029
agauacgcuuacaaa

SEQ ID NO: 502620 - RNA, 15 nt, Chlamydophila pneumoniae CWL029
agagguugagugaau

SEQ ID NO: 502621 - RNA, 17 nt, Chlamydophila pneumoniae CWL029
agaggucacuauagauc

SEQ ID NO: 502622 - RNA, 23 nt, Chlamydophila pneumoniae CWL029
agaggguuuuuuugcugcgaaug

SEQ ID NO: 502623 - RNA, 16 nt, Chlamydophila pneumoniae CWL029
agaggcuguccuugca

SEQ ID NO: 502624 - RNA, 17 nt, Chlamydophila pneumoniae CWL029
agaggcuuuaaauuuuu

SEQ ID NO: 502625 - RNA, 14 nt, Chlamydophila pneumoniae CWL029
agagggaaggaaua

SEQ ID NO: 502626 - RNA, 16 nt, Chlamydophila pneumoniae CWL029
agaggaucuagaaaau

SEQ ID NO: 502627 - RNA, 23 nt, Chlamydophila pneumoniae CWL029
agaggaucuagaaaaugaagagc

SEQ ID NO: 502628 - RNA, 14 nt, Chlamydophila pneumoniae CWL029
agaggagccuccau

SEQ ID NO: 502629 - RNA, 12 nt, Chlamydophila pneumoniae CWL029
agaggagauccu

SEQ ID NO: 502630 - RNA, 17 nt, Chlamydophila pneumoniae CWL029
agaggagauccuaagag

SEQ ID NO: 502631 - RNA, 21 nt, Chlamydophila pneumoniae CWL029
agaggacucccucaaaauuua

SEQ ID NO: 502632 - RNA, 15 nt, Chlamydophila pneumoniae CWL029
agaggccaccaaaaa

SEQ ID NO: 502633 - RNA, 15 nt, Chlamydophila pneumoniae CWL029
agagcuucuuuaucu

SEQ ID NO: 502634 - RNA, 15 nt, Chlamydophila pneumoniae CWL029
agagcuuucagaaaa

SEQ ID NO: 502635 - RNA, 17 nt, Chlamydophila pneumoniae CWL029
agagcuuucagaaaaga

SEQ ID NO: 502636 - RNA, 13 nt, Chlamydophila pneumoniae CWL029
agaggaaugaaga

SEQ ID NO: 502637 - RNA, 18 nt, Chlamydophila pneumoniae CWL029
agaggaaugaagagaguu

SEQ ID NO: 502638 - RNA, 16 nt, Chlamydophila pneumoniae CWL029
agagcuugguuuucuc

SEQ ID NO: 502639 - RNA, 19 nt, Chlamydophila pneumoniae CWL029
agagcuugguuuucuccuu

SEQ ID NO: 502640 - RNA, 20 nt, Chlamydophila pneumoniae CWL029
agagcuugucacacugcgag

SEQ ID NO: 502641 - RNA, 17 nt, Chlamydophila pneumoniae CWL029
agagauucauaaaacug

SEQ ID NO: 502642 - RNA, 17 nt, Chlamydophila pneumoniae CWL029
agagcaauuaagaaacu

SEQ ID NO: 502643 - RNA, 14 nt, Chlamydophila pneumoniae CWL029
agagcacauagaaa

SEQ ID NO: 502644 - RNA, 16 nt, Chlamydophila pneumoniae CWL029
agagauucauaaaacu

SEQ ID NO: 502645 - RNA, 15 nt, Chlamydophila pneumoniae CWL029
agagaugcuaacaac

SEQ ID NO: 502646 - RNA, 22 nt, Chlamydophila pneumoniae CWL029
agagaugcaaauccuguagaaa

SEQ ID NO: 502647 - RNA, 19 nt, Chlamydophila pneumoniae CWL029
agagaucuuuuuauuaaaa

SEQ ID NO: 502648 - RNA, 14 nt, Chlamydophila pneumoniae CWL029
agacuaaaaaagag

SEQ ID NO: 502649 - RNA, 21 nt, Chlamydophila pneumoniae CWL029
agacuaaaugacgaguugaag

SEQ ID NO: 502650 - RNA, 21 nt, Chlamydophila pneumoniae CWL029
agacgugcucucuacuucugu

SEQ ID NO: 502651 - RNA, 22 nt, Chlamydophila pneumoniae CWL029
agacgugcucucuucuucucag

SEQ ID NO: 502652 - RNA, 22 nt, Chlamydophila pneumoniae CWL029
agagccuuuucagauuuuuuaa

SEQ ID NO: 502653 - RNA, 15 nt, Chlamydophila pneumoniae CWL029
agagccuuuucagau

SEQ ID NO: 502654 - RNA, 16 nt, Chlamydophila pneumoniae CWL029
agagcgaucgcaauca

SEQ ID NO: 502655 - RNA, 15 nt, Chlamydophila pneumoniae CWL029
agagccucuaagaaa

SEQ ID NO: 502656 - RNA, 15 nt, Chlamydophila pneumoniae CWL029
agagccggaacuuca

SEQ ID NO: 502657 - RNA, 13 nt, Chlamydophila pneumoniae CWL029
agagcagaccucu

SEQ ID NO: 502658 - RNA, 23 nt, Chlamydophila pneumoniae CWL029
agagcagcuuccugcuccucuuc

SEQ ID NO: 502659 - RNA, 13 nt, Chlamydophila pneumoniae CWL029
agacguaaccaca

SEQ ID NO: 502660 - RNA, 18 nt, Chlamydophila pneumoniae CWL029
agacccaacaguucuuuc

SEQ ID NO: 502661 - RNA, 21 nt, Chlamydophila pneumoniae CWL029
agaccgagaagcuucaaugau

SEQ ID NO: 502662 - RNA, 23 nt, Chlamydophila pneumoniae CWL029
agaccggaucccguaaaagaacg

SEQ ID NO: 502663 - RNA, 22 nt, Chlamydophila pneumoniae CWL029
agaccggaucccguaaaagaac

SEQ ID NO: 502664 - RNA, 15 nt, Chlamydophila pneumoniae CWL029
agaccugccaagaua

SEQ ID NO: 502665 - RNA, 13 nt, Chlamydophila pneumoniae CWL029
agaccagggaucu

SEQ ID NO: 502666 - RNA, 14 nt, Chlamydophila pneumoniae CWL029
agaccauaaaauca

SEQ ID NO: 502667 - RNA, 23 nt, Chlamydophila pneumoniae CWL029
agaccauaaaaucaacaaguucu

SEQ ID NO: 502668 - RNA, 22 nt, Chlamydophila pneumoniae CWL029
agaccacgaaauguuaaaggaa

SEQ ID NO: 502669 - RNA, 14 nt, Chlamydophila pneumoniae CWL029
agaccacgaaaugu

SEQ ID NO: 502670 - RNA, 19 nt, Chlamydophila pneumoniae CWL029
agaccacgaaauguuaaag

SEQ ID NO: 502671 - RNA, 19 nt, Chlamydophila pneumoniae CWL029
agaccaauugguggagcuc

SEQ ID NO: 502672 - RNA, 15 nt, Chlamydophila pneumoniae CWL029
agaccaauaaaucca

SEQ ID NO: 502673 - RNA, 20 nt, Chlamydophila pneumoniae CWL029
agaccaaacuuucuuuucua

SEQ ID NO: 502674 - RNA, 21 nt, Chlamydophila pneumoniae CWL029
agaccaaacuuucuuuucuau

SEQ ID NO: 502675 - RNA, 21 nt, Chlamydophila pneumoniae CWL029
agaccaaaucaucgcaaucaa

SEQ ID NO: 502676 - RNA, 22 nt, Chlamydophila pneumoniae CWL029
agacaggagcuacugaaagaug

SEQ ID NO: 502677 - RNA, 19 nt, Chlamydophila pneumoniae CWL029
agacauauccaaugagaga

SEQ ID NO: 502678 - RNA, 17 nt, Chlamydophila pneumoniae CWL029
agacaugcgaagggagg

SEQ ID NO: 502679 - RNA, 21 nt, Chlamydophila pneumoniae CWL029
agacauuucuugauccaucug

SEQ ID NO: 502680 - RNA, 20 nt, Chlamydophila pneumoniae CWL029
agacagccuguuuucuucua

SEQ ID NO: 502681 - RNA, 22 nt, Chlamydophila pneumoniae CWL029
agacagaugcuucaaggcaucu

SEQ ID NO: 502682 - RNA, 22 nt, Chlamydophila pneumoniae CWL029
agacacgccuccuucaaagaua

SEQ ID NO: 502683 - RNA, 23 nt, Chlamydophila pneumoniae CWL029
agacacgccuccuucaaagauau

SEQ ID NO: 502684 - RNA, 23 nt, Chlamydophila pneumoniae CWL029
agacaaugucgucucagaaaaau

SEQ ID NO: 502685 - RNA, 14 nt, Chlamydophila pneumoniae CWL029
agacacacuuucuu

SEQ ID NO: 502686 - RNA, 22 nt, Chlamydophila pneumoniae CWL029
agacacacuuucuuuaaagaau

SEQ ID NO: 502687 - RNA, 22 nt, Chlamydophila pneumoniae CWL029
agacacaggggaacgcucucua

SEQ ID NO: 502688 - RNA, 15 nt, Chlamydophila pneumoniae CWL029
agacaccgaaagaaa

SEQ ID NO: 502689 - RNA, 13 nt, Chlamydophila pneumoniae CWL029
agacaagagaaga

SEQ ID NO: 502690 - RNA, 15 nt, Chlamydophila pneumoniae CWL029
agacaagagagagcu

SEQ ID NO: 502691 - RNA, 16 nt, Chlamydophila pneumoniae CWL029
agacaagagagagcug

SEQ ID NO: 502692 - RNA, 19 nt, Chlamydophila pneumoniae CWL029
agacaaccuagaaucacau

SEQ ID NO: 502693 - RNA, 18 nt, Chlamydophila pneumoniae CWL029
agacaaccuagaaucaca

SEQ ID NO: 502694 - RNA, 12 nt, Chlamydophila pneumoniae CWL029
agacaagacacc

SEQ ID NO: 502695 - RNA, 16 nt, Chlamydophila pneumoniae CWL029
agacaaguucaucaaa

SEQ ID NO: 502696 - RNA, 17 nt, Chlamydophila pneumoniae CWL029
agacaauaaaauagccc

SEQ ID NO: 502697 - RNA, 20 nt, Chlamydophila pneumoniae CWL029
agacaauaccagauaaagca

SEQ ID NO: 502698 - RNA, 13 nt, Chlamydophila pneumoniae CWL029
agacaaagccaca

SEQ ID NO: 502699 - RNA, 22 nt, Chlamydophila pneumoniae CWL029
agacaaaaaagggaucuccuuc

SEQ ID NO: 502700 - RNA, 20 nt, Chlamydophila pneumoniae CWL029
agaauuuucuuuugcagcaa

SEQ ID NO: 502701 - RNA, 15 nt, Chlamydophila pneumoniae CWL029
agaauugcaaaguac

SEQ ID NO: 502702 - RNA, 19 nt, Chlamydophila pneumoniae CWL029
agaauguucccaaauagaa

SEQ ID NO: 502703 - RNA, 20 nt, Chlamydophila pneumoniae CWL029
agaauguacauagaggagau

SEQ ID NO: 502704 - RNA, 17 nt, Chlamydophila pneumoniae CWL029
agaauguaugugaaaga

SEQ ID NO: 502705 - RNA, 12 nt, Chlamydophila pneumoniae CWL029
agaaucuuuucu

SEQ ID NO: 502706 - RNA, 14 nt, Chlamydophila pneumoniae CWL029
agaaucuuuucuag

SEQ ID NO: 502707 - RNA, 16 nt, Chlamydophila pneumoniae CWL029
agaaugacacagagaa

SEQ ID NO: 502708 - RNA, 20 nt, Chlamydophila pneumoniae CWL029
agaaugacacagagaacaau

SEQ ID NO: 502709 - RNA, 23 nt, Chlamydophila pneumoniae CWL029
agaaugacacagagaacaauaaa

SEQ ID NO: 502710 - RNA, 17 nt, Chlamydophila pneumoniae CWL029
agaauccugaguaaaau

SEQ ID NO: 502711 - RNA, 18 nt, Chlamydophila pneumoniae CWL029
agaaucggaucuucaauu

SEQ ID NO: 502712 - RNA, 22 nt, Chlamydophila pneumoniae CWL029
agaaguccuaucaaagcaaaag

SEQ ID NO: 502713 - RNA, 19 nt, Chlamydophila pneumoniae CWL029
agaauccucuauccaucau

SEQ ID NO: 502714 - RNA, 22 nt, Chlamydophila pneumoniae CWL029
agaaguauucgauuccugaggc

SEQ ID NO: 502715 - RNA, 20 nt, Chlamydophila pneumoniae CWL029
agaaguauucgauuccugag

SEQ ID NO: 502716 - RNA, 14 nt, Chlamydophila pneumoniae CWL029
agaagucacaaauu

SEQ ID NO: 502717 - RNA, 17 nt, Chlamydophila pneumoniae CWL029
agaauccauuuugccca

SEQ ID NO: 502718 - RNA, 19 nt, Chlamydophila pneumoniae CWL029
agaauccacuacugucaau

SEQ ID NO: 502719 - RNA, 19 nt, Chlamydophila pneumoniae CWL029
agaaguaauccuaauuccu

SEQ ID NO: 502720 - RNA, 18 nt, Chlamydophila pneumoniae CWL029
agaaguagggucccuuga

SEQ ID NO: 502721 - RNA, 16 nt, Chlamydophila pneumoniae CWL029
agaagguuuauuagaa

SEQ ID NO: 502722 - RNA, 20 nt, Chlamydophila pneumoniae CWL029
agaagguuuauuagaaguau

SEQ ID NO: 502723 - RNA, 12 nt, Chlamydophila pneumoniae CWL029
agaagguuucua

SEQ ID NO: 502724 - RNA, 22 nt, Chlamydophila pneumoniae CWL029
agaagguccaugucuaaagauu

SEQ ID NO: 502725 - RNA, 23 nt, Chlamydophila pneumoniae CWL029
agaagguccaugucuaaagauug

SEQ ID NO: 502726 - RNA, 23 nt, Chlamydophila pneumoniae CWL029
agaagguguuuuggcugcuuuug

SEQ ID NO: 502727 - RNA, 13 nt, Chlamydophila pneumoniae CWL029
agaaggggguucu

SEQ ID NO: 502728 - RNA, 13 nt, Chlamydophila pneumoniae CWL029
agaagggacuugu

SEQ ID NO: 502729 - RNA, 15 nt, Chlamydophila pneumoniae CWL029
agaagcuucaaugau

SEQ ID NO: 502730 - RNA, 22 nt, Chlamydophila pneumoniae CWL029
agaagcugacaaauagaaagga

SEQ ID NO: 502731 - RNA, 11 nt, Chlamydophila pneumoniae CWL029
agaaggaucug

SEQ ID NO: 502732 - RNA, 15 nt, Chlamydophila pneumoniae CWL029
agaaggcaucccgaa

SEQ ID NO: 502733 - RNA, 23 nt, Chlamydophila pneumoniae CWL029
agaagaucucgucuuggaaugcu

SEQ ID NO: 502734 - RNA, 13 nt, Chlamydophila pneumoniae CWL029
agaagcaaaggua

SEQ ID NO: 502735 - RNA, 15 nt, Chlamydophila pneumoniae CWL029
agaagcaacuaaacu

SEQ ID NO: 502736 - RNA, 17 nt, Chlamydophila pneumoniae CWL029
agaagcaacuaaacucu

SEQ ID NO: 502737 - RNA, 22 nt, Chlamydophila pneumoniae CWL029
agaagcacuucuuuaggagcau

SEQ ID NO: 502738 - RNA, 14 nt, Chlamydophila pneumoniae CWL029
agaacuuagcaaug

SEQ ID NO: 502739 - RNA, 16 nt, Chlamydophila pneumoniae CWL029
agaacuucaaugaaag

SEQ ID NO: 502740 - RNA, 23 nt, Chlamydophila pneumoniae CWL029
agaacugcauaaucucaccagaa

SEQ ID NO: 502741 - RNA, 15 nt, Chlamydophila pneumoniae CWL029
agaacuccuuugagu

SEQ ID NO: 502742 - RNA, 14 nt, Chlamydophila pneumoniae CWL029
agaacuccuuugag

SEQ ID NO: 502743 - RNA, 18 nt, Chlamydophila pneumoniae CWL029
agaacucuuaaagguaaa

SEQ ID NO: 502744 - RNA, 15 nt, Chlamydophila pneumoniae CWL029
agaacuacucucauu

SEQ ID NO: 502745 - RNA, 22 nt, Chlamydophila pneumoniae CWL029
agaaccuaggaaauccuccuag

SEQ ID NO: 502746 - RNA, 22 nt, Chlamydophila pneumoniae CWL029
agaacagcacucucugcaggga

SEQ ID NO: 502747 - RNA, 22 nt, Chlamydophila pneumoniae CWL029
agaacagaggaucuagaaaaug

SEQ ID NO: 502748 - RNA, 24 nt, Chlamydophila pneumoniae CWL029
agaacagaggaucuagaaaaugaa

SEQ ID NO: 502749 - RNA, 17 nt, Chlamydophila pneumoniae CWL029
agaacaccucuucucua

SEQ ID NO: 502750 - RNA, 17 nt, Chlamydophila pneumoniae CWL029
agaacacgccugcgaaa

SEQ ID NO: 502751 - RNA, 17 nt, Chlamydophila pneumoniae CWL029
agaacacucagagaugu

SEQ ID NO: 502752 - RNA, 21 nt, Chlamydophila pneumoniae CWL029
agaacacucagagauguggca

SEQ ID NO: 502753 - RNA, 16 nt, Chlamydophila pneumoniae CWL029
agaacaauaucagcag

SEQ ID NO: 502754 - RNA, 11 nt, Chlamydophila pneumoniae CWL029
agaacaagaag

SEQ ID NO: 502755 - RNA, 22 nt, Chlamydophila pneumoniae CWL029
agaacaaguuuuuucaauccuu

SEQ ID NO: 502756 - RNA, 18 nt, Chlamydophila pneumoniae CWL029
agaacaauaucagcagcu

SEQ ID NO: 502757 - RNA, 13 nt, Chlamydophila pneumoniae CWL029
agaaauucuuccc

SEQ ID NO: 502758 - RNA, 13 nt, Chlamydophila pneumoniae CWL029
agaaauucugacu

SEQ ID NO: 502759 - RNA, 14 nt, Chlamydophila pneumoniae CWL029
agaaauuccaauuu

SEQ ID NO: 502760 - RNA, 19 nt, Chlamydophila pneumoniae CWL029
agaaauuccaauuuuugca

SEQ ID NO: 502761 - RNA, 21 nt, Chlamydophila pneumoniae CWL029
agaaauuccaauuuuugcaua

SEQ ID NO: 502762 - RNA, 13 nt, Chlamydophila pneumoniae CWL029
agaaauucuaaga

SEQ ID NO: 502763 - RNA, 21 nt, Chlamydophila pneumoniae CWL029
agaaauucuaagcgcucuuca

SEQ ID NO: 502764 - RNA, 15 nt, Chlamydophila pneumoniae CWL029
agaaaucaaacauua

SEQ ID NO: 502765 - RNA, 19 nt, Chlamydophila pneumoniae CWL029
aaaacaaucuaaagguuuu

SEQ ID NO: 502766 - RNA, 18 nt, Chlamydophila pneumoniae CWL029
agaaauauacucuugcuu

SEQ ID NO: 502767 - RNA, 19 nt, Chlamydophila pneumoniae CWL029
agaaauaggucucuugcca

SEQ ID NO: 502768 - RNA, 14 nt, Chlamydophila pneumoniae CWL029
agaaauauaacucu

SEQ ID NO: 502769 - RNA, 17 nt, Chlamydophila pneumoniae CWL029
agaaauauaacucucua

SEQ ID NO: 502770 - RNA, 17 nt, Chlamydophila pneumoniae CWL029
agaaauacgcuuuucuu

SEQ ID NO: 502771 - RNA, 21 nt, Chlamydophila pneumoniae CWL029
agaaauacgcuuuucuucuuu

SEQ ID NO: 502772 - RNA, 19 nt, Chlamydophila pneumoniae CWL029
agaaaggcuuuuuccaaaa

SEQ ID NO: 502773 - RNA, 23 nt, Chlamydophila pneumoniae CWL029
agaaagccuuugcucacuguuuu

SEQ ID NO: 502774 - RNA, 20 nt, Chlamydophila pneumoniae CWL029
agaaaggagauccacagacu

SEQ ID NO: 502775 - RNA, 22 nt, Chlamydophila pneumoniae CWL029
agaaagagucucacucuuuucu

SEQ ID NO: 502776 - RNA, 23 nt, Chlamydophila pneumoniae CWL029
agaaagagucucacucuuuucua

SEQ ID NO: 502777 - RNA, 21 nt, Chlamydophila pneumoniae CWL029
agaaagagucucacucuuuuc

SEQ ID NO: 502778 - RNA, 11 nt, Chlamydophila pneumoniae CWL029
agaaagauauc

SEQ ID NO: 502779 - RNA, 13 nt, Chlamydophila pneumoniae CWL029
agaaagauauccc

SEQ ID NO: 502780 - RNA, 22 nt, Chlamydophila pneumoniae CWL029
agaaagauucugcccaaagcua

SEQ ID NO: 502781 - RNA, 20 nt, Chlamydophila pneumoniae CWL029
agaaagauuuauuuugucuu

SEQ ID NO: 502782 - RNA, 20 nt, Chlamydophila pneumoniae CWL029
agaaagagcuaaagaaacuu

SEQ ID NO: 502783 - RNA, 14 nt, Chlamydophila pneumoniae CWL029
agaaagacauccuu

SEQ ID NO: 502784 - RNA, 17 nt, Chlamydophila pneumoniae CWL029
agaaagaagccuuccuu

SEQ ID NO: 502785 - RNA, 22 nt, Chlamydophila pneumoniae CWL029
agaaacuuaguuuugaaaagau

SEQ ID NO: 502786 - RNA, 23 nt, Chlamydophila pneumoniae CWL029
agaaacuuaguuuugaaaagauu

SEQ ID NO: 502787 - RNA, 13 nt, Chlamydophila pneumoniae CWL029
agaaacuucucua

SEQ ID NO: 502788 - RNA, 23 nt, Chlamydophila pneumoniae CWL029
agaaacuucugacccuguagcga

SEQ ID NO: 502789 - RNA, 14 nt, Chlamydophila pneumoniae CWL029
agaaacuccaaaau

SEQ ID NO: 502790 - RNA, 19 nt, Chlamydophila pneumoniae CWL029
agaaacccgcaacucuuua

SEQ ID NO: 502791 - RNA, 22 nt, Chlamydophila pneumoniae CWL029
agaaaaauucuucgagagcaug

SEQ ID NO: 502792 - RNA, 21 nt, Chlamydophila pneumoniae CWL029
agaaaaauucuuuagggaggc

SEQ ID NO: 502793 - RNA, 14 nt, Chlamydophila pneumoniae CWL029
agaaaacaaaguca

SEQ ID NO: 502794 - RNA, 14 nt, Chlamydophila pneumoniae CWL029
agaaaaagaaucuc

SEQ ID NO: 502795 - RNA, 15 nt, Chlamydophila pneumoniae CWL029
acuuuuguacacaga

SEQ ID NO: 502796 - RNA, 12 nt, Chlamydophila pneumoniae CWL029
agaaacaucgga

SEQ ID NO: 502797 - RNA, 14 nt, Chlamydophila pneumoniae CWL029
agaaaagaaagaag

SEQ ID NO: 502798 - RNA, 15 nt, Chlamydophila pneumoniae CWL029
agaaaagaacagggg

SEQ ID NO: 502799 - RNA, 18 nt, Chlamydophila pneumoniae CWL029
agaaaacgccaacuguau

SEQ ID NO: 502800 - RNA, 15 nt, Chlamydophila pneumoniae CWL029
agaaaagauaaaaca

SEQ ID NO: 502801 - RNA, 15 nt, Chlamydophila pneumoniae CWL029
aggaagauaguauuu

SEQ ID NO: 502802 - RNA, 19 nt, Chlamydophila pneumoniae CWL029
aggaagaucuugaacagag

SEQ ID NO: 502803 - RNA, 22 nt, Chlamydophila pneumoniae CWL029
aggaagaugaauaccagaagca

SEQ ID NO: 502804 - RNA, 14 nt, Chlamydophila pneumoniae CWL029
aggaagccugcggc

SEQ ID NO: 502805 - RNA, 17 nt, Chlamydophila pneumoniae CWL029
aggaacuugaauaccaa

SEQ ID NO: 502806 - RNA, 14 nt, Chlamydophila pneumoniae CWL029
aggaacaugccaaa

SEQ ID NO: 502807 - RNA, 17 nt, Chlamydophila pneumoniae CWL029
aggaacgcacgccaaga

SEQ ID NO: 502808 - RNA, 21 nt, Chlamydophila pneumoniae CWL029
aggaaauaccacagcuguaca

SEQ ID NO: 502809 - RNA, 18 nt, Chlamydophila pneumoniae CWL029
aggaaaguucacaagcag

SEQ ID NO: 502810 - RNA, 21 nt, Chlamydophila pneumoniae CWL029
aggaaaguugcaacucucuuu

SEQ ID NO: 502811 - RNA, 14 nt, Chlamydophila pneumoniae CWL029
aggaacaaagccaa

SEQ ID NO: 502812 - RNA, 20 nt, Chlamydophila pneumoniae CWL029
aggaacaaagcucuccuuca

SEQ ID NO: 502813 - RNA, 16 nt, Chlamydophila pneumoniae CWL029
agcuuuucguauagag

SEQ ID NO: 502814 - RNA, 23 nt, Chlamydophila pneumoniae CWL029
agcuuuuccguaaguaaccaaua

SEQ ID NO: 502815 - RNA, 21 nt, Chlamydophila pneumoniae CWL029
agcuuugucucuauagugcau

SEQ ID NO: 502816 - RNA, 22 nt, Chlamydophila pneumoniae CWL029
agcuuuggcgucugcccuuucu

SEQ ID NO: 502817 - RNA, 23 nt, Chlamydophila pneumoniae CWL029
agcuuugcuuaaaaagucugaau

SEQ ID NO: 502818 - RNA, 12 nt, Chlamydophila pneumoniae CWL029
aggagaacaaua

SEQ ID NO: 502819 - RNA, 21 nt, Chlamydophila pneumoniae CWL029
aggagaacaauaucagcagcu

SEQ ID NO: 502820 - RNA, 22 nt, Chlamydophila pneumoniae CWL029
aggagaacaauaucagcagcuu

SEQ ID NO: 502821 - RNA, 20 nt, Chlamydophila pneumoniae CWL029
aggagaccuuuauagauaug

SEQ ID NO: 502822 - RNA, 17 nt, Chlamydophila pneumoniae CWL029
aggagacuaaaagaaua

SEQ ID NO: 502823 - RNA, 20 nt, Chlamydophila pneumoniae CWL029
aggagacuaaaagaauaaua

SEQ ID NO: 502824 - RNA, 21 nt, Chlamydophila pneumoniae CWL029
aggagacucuaguuuuucuuu

SEQ ID NO: 502825 - RNA, 12 nt, Chlamydophila pneumoniae CWL029
aggagagagaag

SEQ ID NO: 502826 - RNA, 12 nt, Chlamydophila pneumoniae CWL029
aggagagcacuu

SEQ ID NO: 502827 - RNA, 16 nt, Chlamydophila pneumoniae CWL029
aggagauccacagacu

SEQ ID NO: 502828 - RNA, 21 nt, Chlamydophila pneumoniae CWL029
aggagagcuugguuuucuccu

SEQ ID NO: 502829 - RNA, 17 nt, Chlamydophila pneumoniae CWL029
aggagagcuagugguau

SEQ ID NO: 502830 - RNA, 23 nt, Chlamydophila pneumoniae CWL029
aggacuguuuguuuauuaucuac

SEQ ID NO: 502831 - RNA, 16 nt, Chlamydophila pneumoniae CWL029
aggacaguauucccuc

SEQ ID NO: 502832 - RNA, 12 nt, Chlamydophila pneumoniae CWL029
aggaagcucuuc

SEQ ID NO: 502833 - RNA, 15 nt, Chlamydophila pneumoniae CWL029
aggaauuagagaaau

SEQ ID NO: 502834 - RNA, 21 nt, Chlamydophila pneumoniae CWL029
aggacaaucaacauucuucug

SEQ ID NO: 502835 - RNA, 13 nt, Chlamydophila pneumoniae CWL029
aggacaaaucucc

SEQ ID NO: 502836 - RNA, 19 nt, Chlamydophila pneumoniae CWL029
agcuuguucuguaacacuu

SEQ ID NO: 502837 - RNA, 23 nt, Chlamydophila pneumoniae CWL029
agcuugucacacugcgagagaaa

SEQ ID NO: 502838 - RNA, 20 nt, Chlamydophila pneumoniae CWL029
agcuugguuuucuccuucuc

SEQ ID NO: 502839 - RNA, 22 nt, Chlamydophila pneumoniae CWL029
agcuugcccuucguaacgcuuu

SEQ ID NO: 502840 - RNA, 21 nt, Chlamydophila pneumoniae CWL029
agcuuggggguggucuagaga

SEQ ID NO: 502841 - RNA, 16 nt, Chlamydophila pneumoniae CWL029
agcuucugaacuguuc

SEQ ID NO: 502842 - RNA, 15 nt, Chlamydophila pneumoniae CWL029
agcuucuacagcauc

SEQ ID NO: 502843 - RNA, 20 nt, Chlamydophila pneumoniae CWL029
agcuucaucagaagguaaau

SEQ ID NO: 502844 - RNA, 12 nt, Chlamydophila pneumoniae CWL029
agcuucaucaaa

SEQ ID NO: 502845 - RNA, 18 nt, Chlamydophila pneumoniae CWL029
agcuuacguguugcauga

SEQ ID NO: 502846 - RNA, 21 nt, Chlamydophila pneumoniae CWL029
agcuuacuuagaacuauagga

SEQ ID NO: 502847 - RNA, 15 nt, Chlamydophila pneumoniae CWL029
agcuucccaauugua

SEQ ID NO: 502848 - RNA, 12 nt, Chlamydophila pneumoniae CWL029
agcuucuaaaaa

SEQ ID NO: 502849 - RNA, 17 nt, Chlamydophila pneumoniae CWL029
agcuuccugcuccucuu

SEQ ID NO: 502850 - RNA, 14 nt, Chlamydophila pneumoniae CWL029
agcugucaauccaa

SEQ ID NO: 502851 - RNA, 14 nt, Chlamydophila pneumoniae CWL029
agcuguccuccgag

SEQ ID NO: 502852 - RNA, 14 nt, Chlamydophila pneumoniae CWL029
agcugugcauuuuc

SEQ ID NO: 502853 - RNA, 20 nt, Chlamydophila pneumoniae CWL029
agcugcugguccuaaaaaaa

SEQ ID NO: 502854 - RNA, 15 nt, Chlamydophila pneumoniae CWL029
agcuguacagaacaa

SEQ ID NO: 502855 - RNA, 18 nt, Chlamydophila pneumoniae CWL029
agcugccagugacauaau

SEQ ID NO: 502856 - RNA, 14 nt, Chlamydophila pneumoniae CWL029
agcuccauuuaaau

SEQ ID NO: 502857 - RNA, 21 nt, Chlamydophila pneumoniae CWL029
agcucccaacaagggaaagaa

SEQ ID NO: 502858 - RNA, 18 nt, Chlamydophila pneumoniae CWL029
aggcgcauaugcuccaga

SEQ ID NO: 502859 - RNA, 20 nt, Chlamydophila pneumoniae CWL029
aggcgcauaugcuccagaaa

SEQ ID NO: 502860 - RNA, 23 nt, Chlamydophila pneumoniae CWL029
aggccuaaaaucaccauauccau

SEQ ID NO: 502861 - RNA, 16 nt, Chlamydophila pneumoniae CWL029
aggccuccuucauuca

SEQ ID NO: 502862 - RNA, 15 nt, Chlamydophila pneumoniae CWL029
aggagcauagacucu

SEQ ID NO: 502863 - RNA, 16 nt, Chlamydophila pneumoniae CWL029
aggagccuccauaaug

SEQ ID NO: 502864 - RNA, 15 nt, Chlamydophila pneumoniae CWL029
aggagcgauagcuca

SEQ ID NO: 502865 - RNA, 14 nt, Chlamydophila pneumoniae CWL029
aggauuaguaacua

SEQ ID NO: 502866 - RNA, 10 nt, Chlamydophila pneumoniae CWL029
aggaggagca

SEQ ID NO: 502867 - RNA, 13 nt, Chlamydophila pneumoniae CWL029
aggaggaggagca

SEQ ID NO: 502868 - RNA, 16 nt, Chlamydophila pneumoniae CWL029
aggagcuccuccuuga

SEQ ID NO: 502869 - RNA, 13 nt, Chlamydophila pneumoniae CWL029
aggauuuagacua

SEQ ID NO: 502870 - RNA, 17 nt, Chlamydophila pneumoniae CWL029
aggauucucucugccua

SEQ ID NO: 502871 - RNA, 14 nt, Chlamydophila pneumoniae CWL029
aggauugauaaaua

SEQ ID NO: 502872 - RNA, 21 nt, Chlamydophila pneumoniae CWL029
aggauuucuugcaaggagcuu

SEQ ID NO: 502873 - RNA, 23 nt, Chlamydophila pneumoniae CWL029
aggauucugagaaguuaagacaa

SEQ ID NO: 502874 - RNA, 19 nt, Chlamydophila pneumoniae CWL029
aggauucuaaaaagaaaag

SEQ ID NO: 502875 - RNA, 13 nt, Chlamydophila pneumoniae CWL029
aggauucucucug

SEQ ID NO: 502876 - RNA, 14 nt, Chlamydophila pneumoniae CWL029
aggcacauguagga

SEQ ID NO: 502877 - RNA, 19 nt, Chlamydophila pneumoniae CWL029
aggcaacgcgauuuucaac

SEQ ID NO: 502878 - RNA, 16 nt, Chlamydophila pneumoniae CWL029
aggcaagauuaugaug

SEQ ID NO: 502879 - RNA, 16 nt, Chlamydophila pneumoniae CWL029
aggcaaggagagcuuc

SEQ ID NO: 502880 - RNA, 17 nt, Chlamydophila pneumoniae CWL029
aggcaaggagagcuucu

SEQ ID NO: 502881 - RNA, 16 nt, Chlamydophila pneumoniae CWL029
aggcauuggaaaucuu

SEQ ID NO: 502882 - RNA, 14 nt, Chlamydophila pneumoniae CWL029
aggccaaagaacag

SEQ ID NO: 502883 - RNA, 18 nt, Chlamydophila pneumoniae CWL029
aggccaaagaacagcacu

SEQ ID NO: 502884 - RNA, 18 nt, Chlamydophila pneumoniae CWL029
aggcacuccaaaacucaa

SEQ ID NO: 502885 - RNA, 23 nt, Chlamydophila pneumoniae CWL029
aggcaucuagagucucuuucagc

SEQ ID NO: 502886 - RNA, 15 nt, Chlamydophila pneumoniae CWL029
aggcaucuagagucu

SEQ ID NO: 502887 - RNA, 17 nt, Chlamydophila pneumoniae CWL029
aggcaucuucuuugcca

SEQ ID NO: 502888 - RNA, 19 nt, Chlamydophila pneumoniae CWL029
aggcauuacacaacucuuu

SEQ ID NO: 502889 - RNA, 16 nt, Chlamydophila pneumoniae CWL029
aggcaugccuacaggc

SEQ ID NO: 502890 - RNA, 22 nt, Chlamydophila pneumoniae CWL029
agguaagggaugcucuagaaaa

SEQ ID NO: 502891 - RNA, 15 nt, Chlamydophila pneumoniae CWL029
agguaagaagcuguc

SEQ ID NO: 502892 - RNA, 16 nt, Chlamydophila pneumoniae CWL029
agguaauacccucaaa

SEQ ID NO: 502893 - RNA, 20 nt, Chlamydophila pneumoniae CWL029
aggguagcgcuuuuuuaaag

SEQ ID NO: 502894 - RNA, 18 nt, Chlamydophila pneumoniae CWL029
aggguaagauugcaggua

SEQ ID NO: 502895 - RNA, 21 nt, Chlamydophila pneumoniae CWL029
aggguauccugcuccaaaaug

SEQ ID NO: 502896 - RNA, 14 nt, Chlamydophila pneumoniae CWL029
agguagagugucuu

SEQ ID NO: 502897 - RNA, 23 nt, Chlamydophila pneumoniae CWL029
agguagaguccacagucauaaaa

SEQ ID NO: 502898 - RNA, 16 nt, Chlamydophila pneumoniae CWL029
agguaaugucguaccc

SEQ ID NO: 502899 - RNA, 18 nt, Chlamydophila pneumoniae CWL029
agguaaugucguaccccg

SEQ ID NO: 502900 - RNA, 21 nt, Chlamydophila pneumoniae CWL029
agguacuuuauagaaaguaca

SEQ ID NO: 502901 - RNA, 22 nt, Chlamydophila pneumoniae CWL029
agguaucaauaaugacucuaga

SEQ ID NO: 502902 - RNA, 14 nt, Chlamydophila pneumoniae CWL029
agguaucagcaaga

SEQ ID NO: 502903 - RNA, 16 nt, Chlamydophila pneumoniae CWL029
agguaucccacgauau

SEQ ID NO: 502904 - RNA, 16 nt, Chlamydophila pneumoniae CWL029
aggugcaucauuuuca

SEQ ID NO: 502905 - RNA, 13 nt, Chlamydophila pneumoniae CWL029
aggucguaaacgg

SEQ ID NO: 502906 - RNA, 22 nt, Chlamydophila pneumoniae CWL029
aggucggggagaacaccucuuc

SEQ ID NO: 502907 - RNA, 14 nt, Chlamydophila pneumoniae CWL029
aggggcaguuccua

SEQ ID NO: 502908 - RNA, 18 nt, Chlamydophila pneumoniae CWL029
agggcuucguggaacuuu

SEQ ID NO: 502909 - RNA, 16 nt, Chlamydophila pneumoniae CWL029
agggcugcgucaugag

SEQ ID NO: 502910 - RNA, 19 nt, Chlamydophila pneumoniae CWL029
agggcuauccacaacuaaa

SEQ ID NO: 502911 - RNA, 18 nt, Chlamydophila pneumoniae CWL029
aggguaaagaaauauuaa

SEQ ID NO: 502912 - RNA, 14 nt, Chlamydophila pneumoniae CWL029
aggggcuccuaaag

SEQ ID NO: 502913 - RNA, 22 nt, Chlamydophila pneumoniae CWL029
agggauucuuguuggauugaaa

SEQ ID NO: 502914 - RNA, 19 nt, Chlamydophila pneumoniae CWL029
agggacguuguaucccugu

SEQ ID NO: 502915 - RNA, 23 nt, Chlamydophila pneumoniae CWL029
agggacagucuccuggaacagua

SEQ ID NO: 502916 - RNA, 18 nt, Chlamydophila pneumoniae CWL029
agggacuucucaaagaca

SEQ ID NO: 502917 - RNA, 15 nt, Chlamydophila pneumoniae CWL029
agggaagaaauuaac

SEQ ID NO: 502918 - RNA, 13 nt, Chlamydophila pneumoniae CWL029
agggaagagaaaa

SEQ ID NO: 502919 - RNA, 23 nt, Chlamydophila pneumoniae CWL029
agggaauuuucucauagcuuccu

SEQ ID NO: 502920 - RNA, 14 nt, Chlamydophila pneumoniae CWL029
agggacaaguacga

SEQ ID NO: 502921 - RNA, 19 nt, Chlamydophila pneumoniae CWL029
agggaauccccaauguuuu

SEQ ID NO: 502922 - RNA, 18 nt, Chlamydophila pneumoniae CWL029
agggaaaugucacucuag

SEQ ID NO: 502923 - RNA, 22 nt, Chlamydophila pneumoniae CWL029
agggaaauccacagauacguuu

SEQ ID NO: 502924 - RNA, 13 nt, Chlamydophila pneumoniae CWL029
agggaaacaccgu

SEQ ID NO: 502925 - RNA, 23 nt, Chlamydophila pneumoniae CWL029
agggaaaaugcgaucuucacgac

SEQ ID NO: 502926 - RNA, 23 nt, Chlamydophila pneumoniae CWL029
agggaaaccauauugcaaagcau

SEQ ID NO: 502927 - RNA, 20 nt, Chlamydophila pneumoniae CWL029
aggcuuuaaguguuucuuca

SEQ ID NO: 502928 - RNA, 18 nt, Chlamydophila pneumoniae CWL029
aguauuauaaauagaaau

SEQ ID NO: 502929 - RNA, 22 nt, Chlamydophila pneumoniae CWL029
aguauggcguuuuuuuugauuu

SEQ ID NO: 502930 - RNA, 21 nt, Chlamydophila pneumoniae CWL029
aguauucuguggaauaucagg

SEQ ID NO: 502931 - RNA, 18 nt, Chlamydophila pneumoniae CWL029
aguauuccaucacaguua

SEQ ID NO: 502932 - RNA, 19 nt, Chlamydophila pneumoniae CWL029
aguauucgauuccugaggc

SEQ ID NO: 502933 - RNA, 23 nt, Chlamydophila pneumoniae CWL029
aguauccuccuucugcaugaaua

SEQ ID NO: 502934 - RNA, 17 nt, Chlamydophila pneumoniae CWL029
aguaucuaaaacuucuu

SEQ ID NO: 502935 - RNA, 17 nt, Chlamydophila pneumoniae CWL029
aguaucgggauuuuguc

SEQ ID NO: 502936 - RNA, 11 nt, Chlamydophila pneumoniae CWL029
aguauagagaa

SEQ ID NO: 502937 - RNA, 21 nt, Chlamydophila pneumoniae CWL029
aguagauuaaaggcauagaua

SEQ ID NO: 502938 - RNA, 21 nt, Chlamydophila pneumoniae CWL029
aguagaucuucugaaaucaaa

SEQ ID NO: 502939 - RNA, 19 nt, Chlamydophila pneumoniae CWL029
aguagagccucuaagaaaa

SEQ ID NO: 502940 - RNA, 21 nt, Chlamydophila pneumoniae CWL029
aguagccagacuggucuaacu

SEQ ID NO: 502941 - RNA, 17 nt, Chlamydophila pneumoniae CWL029
aguagucgauugccgug

SEQ ID NO: 502942 - RNA, 18 nt, Chlamydophila pneumoniae CWL029
aguaggucucccuggucu

SEQ ID NO: 502943 - RNA, 18 nt, Chlamydophila pneumoniae CWL029
aguaguaaugcagccaca

SEQ ID NO: 502944 - RNA, 15 nt, Chlamydophila pneumoniae CWL029
aguaggcgaugcaaa

SEQ ID NO: 502945 - RNA, 12 nt, Chlamydophila pneumoniae CWL029
aguaggaauuuu

SEQ ID NO: 502946 - RNA, 20 nt, Chlamydophila pneumoniae CWL029
aguagcuugugcuaaagcag

SEQ ID NO: 502947 - RNA, 18 nt, Chlamydophila pneumoniae CWL029
aguagcuauucucaaauu

SEQ ID NO: 502948 - RNA, 20 nt, Chlamydophila pneumoniae CWL029
aguaaaaucauaggcuauaa

SEQ ID NO: 502949 - RNA, 22 nt, Chlamydophila pneumoniae CWL029
aguaaaaucauaggcuauaauu

SEQ ID NO: 502950 - RNA, 15 nt, Chlamydophila pneumoniae CWL029
aguaaaacacaaaua

SEQ ID NO: 502951 - RNA, 22 nt, Chlamydophila pneumoniae CWL029
aguaaaauuucuguagugagau

SEQ ID NO: 502952 - RNA, 15 nt, Chlamydophila pneumoniae CWL029
aguaaaauuucugua

SEQ ID NO: 502953 - RNA, 18 nt, Chlamydophila pneumoniae CWL029
aguaaacccucagaacac

SEQ ID NO: 502954 - RNA, 23 nt, Chlamydophila pneumoniae CWL029
agguuugcaauuuucucaauagu

SEQ ID NO: 502955 - RNA, 18 nt, Chlamydophila pneumoniae CWL029
agguugagugaauuucuu

SEQ ID NO: 502956 - RNA, 14 nt, Chlamydophila pneumoniae CWL029
agguugcuuuucua

SEQ ID NO: 502957 - RNA, 15 nt, Chlamydophila pneumoniae CWL029
agguugcuuuucuag

SEQ ID NO: 502958 - RNA, 16 nt, Chlamydophila pneumoniae CWL029
aguaauccuaauuccu

SEQ ID NO: 502959 - RNA, 23 nt, Chlamydophila pneumoniae CWL029
aguaauaucuccgccauaacacu

SEQ ID NO: 502960 - RNA, 13 nt, Chlamydophila pneumoniae CWL029
aguaauuucuccg

SEQ ID NO: 502961 - RNA, 18 nt, Chlamydophila pneumoniae CWL029
aguaccaagaaaauagua

SEQ ID NO: 502962 - RNA, 19 nt, Chlamydophila pneumoniae CWL029
aguaaagaaucacucucua

SEQ ID NO: 502963 - RNA, 14 nt, Chlamydophila pneumoniae CWL029
aguaaagccacauu

SEQ ID NO: 502964 - RNA, 13 nt, Chlamydophila pneumoniae CWL029
aguaagucuucga

SEQ ID NO: 502965 - RNA, 18 nt, Chlamydophila pneumoniae CWL029
agucgauuucccagaagg

SEQ ID NO: 502966 - RNA, 16 nt, Chlamydophila pneumoniae CWL029
agucgaaucuaaaaac

SEQ ID NO: 502967 - RNA, 20 nt, Chlamydophila pneumoniae CWL029
aguccucucccuuaaggaaa

SEQ ID NO: 502968 - RNA, 13 nt, Chlamydophila pneumoniae CWL029
aguccuaaaauuu

SEQ ID NO: 502969 - RNA, 15 nt, Chlamydophila pneumoniae CWL029
aguccugauuuuuca

SEQ ID NO: 502970 - RNA, 19 nt, Chlamydophila pneumoniae CWL029
aguccugcaggcuucacca

SEQ ID NO: 502971 - RNA, 14 nt, Chlamydophila pneumoniae CWL029
aguauuuuuaaaua

SEQ ID NO: 502972 - RNA, 21 nt, Chlamydophila pneumoniae CWL029
aguauuuuuaaauacagauuc

SEQ ID NO: 502973 - RNA, 16 nt, Chlamydophila pneumoniae CWL029
agucaaaaauucuucg

SEQ ID NO: 502974 - RNA, 17 nt, Chlamydophila pneumoniae CWL029
agucaaaggauccauaa

SEQ ID NO: 502975 - RNA, 22 nt, Chlamydophila pneumoniae CWL029
agucaaauacuucuccugaacc

SEQ ID NO: 502976 - RNA, 20 nt, Chlamydophila pneumoniae CWL029
agucaaaggauccauaaccu

SEQ ID NO: 502977 - RNA, 22 nt, Chlamydophila pneumoniae CWL029
agugaacuuuuguacacagaga

SEQ ID NO: 502978 - RNA, 23 nt, Chlamydophila pneumoniae CWL029
agugaagacaaguaaacagcaaa

SEQ ID NO: 502979 - RNA, 17 nt, Chlamydophila pneumoniae CWL029
agucugcagcagaugaa

SEQ ID NO: 502980 - RNA, 14 nt, Chlamydophila pneumoniae CWL029
agucucucuaucua

SEQ ID NO: 502981 - RNA, 23 nt, Chlamydophila pneumoniae CWL029
agucucuuucagcucaaguuggc

SEQ ID NO: 502982 - RNA, 18 nt, Chlamydophila pneumoniae CWL029
agucucuuucagcucaag

SEQ ID NO: 502983 - RNA, 18 nt, Chlamydophila pneumoniae CWL029
agucuccuggaacaguau

SEQ ID NO: 502984 - RNA, 18 nt, Chlamydophila pneumoniae CWL029
agucuccauaauucugca

SEQ ID NO: 502985 - RNA, 19 nt, Chlamydophila pneumoniae CWL029
agucgggaccauaaagaau

SEQ ID NO: 502986 - RNA, 20 nt, Chlamydophila pneumoniae CWL029
agugguaugcuuuuccuucu

SEQ ID NO: 502987 - RNA, 15 nt, Chlamydophila pneumoniae CWL029
aguguauaacguaga

SEQ ID NO: 502988 - RNA, 14 nt, Chlamydophila pneumoniae CWL029
agugauggggauua

SEQ ID NO: 502989 - RNA, 16 nt, Chlamydophila pneumoniae CWL029
agugaucagaaaugaa

SEQ ID NO: 502990 - RNA, 13 nt, Chlamydophila pneumoniae CWL029
agugaucagaaau

SEQ ID NO: 502991 - RNA, 17 nt, Chlamydophila pneumoniae CWL029
agugaaugagcuucaca

SEQ ID NO: 502992 - RNA, 22 nt, Chlamydophila pneumoniae CWL029
aguuugagaaagaccaccuucc

SEQ ID NO: 502993 - RNA, 15 nt, Chlamydophila pneumoniae CWL029
aguuucuuuugcaaa

SEQ ID NO: 502994 - RNA, 16 nt, Chlamydophila pneumoniae CWL029
aguuugccuucuuauc

SEQ ID NO: 502995 - RNA, 17 nt, Chlamydophila pneumoniae CWL029
aguuuuaaugagagcau

SEQ ID NO: 502996 - RNA, 15 nt, Chlamydophila pneumoniae CWL029
aguuuggauguuuau

SEQ ID NO: 502997 - RNA, 21 nt, Chlamydophila pneumoniae CWL029
aguuuguagcagcaagaacau

SEQ ID NO: 502998 - RNA, 17 nt, Chlamydophila pneumoniae CWL029
aguuuguucacauuuuc

SEQ ID NO: 502999 - RNA, 16 nt, Chlamydophila pneumoniae CWL029
aguuuguucacuuggu

SEQ ID NO: 503000 - RNA, 23 nt, Chlamydophila pneumoniae CWL029
aguuucaaucucuccuugacaaa

SEQ ID NO: 503001 - RNA, 17 nt, Chlamydophila pneumoniae CWL029
aguuucuaucuaaucaa

SEQ ID NO: 503002 - RNA, 23 nt, Chlamydophila pneumoniae CWL029
aguuucuaaaacagaaauugcuu

SEQ ID NO: 503003 - RNA, 15 nt, Chlamydophila pneumoniae CWL029
aguuuacaaauaaaa

SEQ ID NO: 503004 - RNA, 20 nt, Chlamydophila pneumoniae CWL029
aguuuacaaauaaaaugauu

SEQ ID NO: 503005 - RNA, 18 nt, Chlamydophila pneumoniae CWL029
aguuuaaacgucuuauga

SEQ ID NO: 503006 - RNA, 19 nt, Chlamydophila pneumoniae CWL029
aguuguuuuuugagauaca

SEQ ID NO: 503007 - RNA, 16 nt, Chlamydophila pneumoniae CWL029
aguuguuucuagaaaa

SEQ ID NO: 503008 - RNA, 18 nt, Chlamydophila pneumoniae CWL029
aguuguagugaaugagcu

SEQ ID NO: 503009 - RNA, 18 nt, Chlamydophila pneumoniae CWL029
aguuguauccagcucaag

SEQ ID NO: 503010 - RNA, 22 nt, Chlamydophila pneumoniae CWL029
aguuguacaauuugcuccucca

SEQ ID NO: 503011 - RNA, 14 nt, Chlamydophila pneumoniae CWL029
aguugcgcagugga

SEQ ID NO: 503012 - RNA, 18 nt, Chlamydophila pneumoniae CWL029
aguuccaagacaauaaaa

SEQ ID NO: 503013 - RNA, 20 nt, Chlamydophila pneumoniae CWL029
aguuccaagacaauaaaaaa

SEQ ID NO: 503014 - RNA, 18 nt, Chlamydophila pneumoniae CWL029
aguuccauagaguaucua

SEQ ID NO: 503015 - RNA, 21 nt, Chlamydophila pneumoniae CWL029
aguucuaggaugcuugugaga

SEQ ID NO: 503016 - RNA, 20 nt, Chlamydophila pneumoniae CWL029
aguucgggcuaaucauuaga

SEQ ID NO: 503017 - RNA, 17 nt, Chlamydophila pneumoniae CWL029
aguucuugaaacucuau

SEQ ID NO: 503018 - RNA, 21 nt, Chlamydophila pneumoniae CWL029
aguucuucuuuacucaagugu

SEQ ID NO: 503019 - RNA, 13 nt, Chlamydophila pneumoniae CWL029
aguucuugaaacu

SEQ ID NO: 503020 - RNA, 16 nt, Chlamydophila pneumoniae CWL029
aguugaugagaaaaag

SEQ ID NO: 503021 - RNA, 19 nt, Chlamydophila pneumoniae CWL029
aguugauuuagaaucuuuu

SEQ ID NO: 503022 - RNA, 22 nt, Chlamydophila pneumoniae CWL029
aguugauuuagaaucuuuucua

SEQ ID NO: 503023 - RNA, 17 nt, Chlamydophila pneumoniae CWL029
aguucucuaagacugug

SEQ ID NO: 503024 - RNA, 13 nt, Chlamydophila pneumoniae CWL029
aguucuucauucc

SEQ ID NO: 503025 - RNA, 13 nt, Chlamydophila pneumoniae CWL029
aguucuuccuucu

SEQ ID NO: 503026 - RNA, 22 nt, Chlamydophila pneumoniae CWL029
aguucucccgugaacaaaaacu

SEQ ID NO: 503027 - RNA, 14 nt, Chlamydophila pneumoniae CWL029
aguucucaaagaca

SEQ ID NO: 503028 - RNA, 14 nt, Chlamydophila pneumoniae CWL029
aguuauuauauaua

SEQ ID NO: 503029 - RNA, 13 nt, Chlamydophila pneumoniae CWL029
aguuaucaaaagg

SEQ ID NO: 503030 - RNA, 18 nt, Chlamydophila pneumoniae CWL029
aguuagagacacagaagg

SEQ ID NO: 503031 - RNA, 20 nt, Chlamydophila pneumoniae CWL029
aguuagauguaaucauaaaa

SEQ ID NO: 503032 - RNA, 22 nt, Chlamydophila pneumoniae CWL029
aguguauuguuugcuauacaga

SEQ ID NO: 503033 - RNA, 17 nt, Chlamydophila pneumoniae CWL029
agugucauacgcagcac

SEQ ID NO: 503034 - RNA, 21 nt, Chlamydophila pneumoniae CWL029
agugucaucggcuucuccaac

SEQ ID NO: 503035 - RNA, 19 nt, Chlamydophila pneumoniae CWL029
aguuacgcgaccucuguag

SEQ ID NO: 503036 - RNA, 16 nt, Chlamydophila pneumoniae CWL029
aguuacggaacucauu

SEQ ID NO: 503037 - RNA, 18 nt, Chlamydophila pneumoniae CWL029
aguuacugucugcaaaga

SEQ ID NO: 503038 - RNA, 12 nt, Chlamydophila pneumoniae CWL029
auacaaaaaaua

SEQ ID NO: 503039 - RNA, 18 nt, Chlamydophila pneumoniae CWL029
auacaaaacaaaagccau

SEQ ID NO: 503040 - RNA, 15 nt, Chlamydophila pneumoniae CWL029
auacaaacaucgaaa

SEQ ID NO: 503041 - RNA, 23 nt, Chlamydophila pneumoniae CWL029
auaauuuguuuagaaaaagaucu

SEQ ID NO: 503042 - RNA, 21 nt, Chlamydophila pneumoniae CWL029
auaauuggcguaauaauucca

SEQ ID NO: 503043 - RNA, 15 nt, Chlamydophila pneumoniae CWL029
auaaugguacaauac

SEQ ID NO: 503044 - RNA, 22 nt, Chlamydophila pneumoniae CWL029
auacagauguaaaugcuccuug

SEQ ID NO: 503045 - RNA, 22 nt, Chlamydophila pneumoniae CWL029
auacagauguuuucguaaauau

SEQ ID NO: 503046 - RNA, 16 nt, Chlamydophila pneumoniae CWL029
auacagcauaaaaauu

SEQ ID NO: 503047 - RNA, 21 nt, Chlamydophila pneumoniae CWL029
auacacccgcaagcacuuguu

SEQ ID NO: 503048 - RNA, 14 nt, Chlamydophila pneumoniae CWL029
auacacaaaucauu

SEQ ID NO: 503049 - RNA, 22 nt, Chlamydophila pneumoniae CWL029
auacacaaaucauuuaaagcug

SEQ ID NO: 503050 - RNA, 18 nt, Chlamydophila pneumoniae CWL029
auacaauccagaaucucc

SEQ ID NO: 503051 - RNA, 22 nt, Chlamydophila pneumoniae CWL029
auacaaacaagaagcguacuuu

SEQ ID NO: 503052 - RNA, 17 nt, Chlamydophila pneumoniae CWL029
auacaagcgaaagcagc

SEQ ID NO: 503053 - RNA, 17 nt, Chlamydophila pneumoniae CWL029
auacaagcaauuccccu

SEQ ID NO: 503054 - RNA, 19 nt, Chlamydophila pneumoniae CWL029
auacaacgguauguauggu

SEQ ID NO: 503055 - RNA, 15 nt, Chlamydophila pneumoniae CWL029
auaauaggauaagaa

SEQ ID NO: 503056 - RNA, 16 nt, Chlamydophila pneumoniae CWL029
auaauaggauaagaaa

SEQ ID NO: 503057 - RNA, 17 nt, Chlamydophila pneumoniae CWL029
auaauaggauaagaaau

SEQ ID NO: 503058 - RNA, 20 nt, Chlamydophila pneumoniae CWL029
auaauaagcaggaaaagcaa

SEQ ID NO: 503059 - RNA, 23 nt, Chlamydophila pneumoniae CWL029
auaaguuacuuucugauugagaa

SEQ ID NO: 503060 - RNA, 13 nt, Chlamydophila pneumoniae CWL029
auaaguucuucca

SEQ ID NO: 503061 - RNA, 17 nt, Chlamydophila pneumoniae CWL029
auaagaaccucuaauuu

SEQ ID NO: 503062 - RNA, 18 nt, Chlamydophila pneumoniae CWL029
auaagaaaucaguccuaa

SEQ ID NO: 503063 - RNA, 17 nt, Chlamydophila pneumoniae CWL029
auaagaacuuuagggaa

SEQ ID NO: 503064 - RNA, 20 nt, Chlamydophila pneumoniae CWL029
auaagucgaaucuaaaaacu

SEQ ID NO: 503065 - RNA, 13 nt, Chlamydophila pneumoniae CWL029
auaaugaagcagg

SEQ ID NO: 503066 - RNA, 21 nt, Chlamydophila pneumoniae CWL029
auaaucugcgugucguugguu

SEQ ID NO: 503067 - RNA, 17 nt, Chlamydophila pneumoniae CWL029
auaaucuguaagaaaau

SEQ ID NO: 503068 - RNA, 14 nt, Chlamydophila pneumoniae CWL029
auaaucuucaaaag

SEQ ID NO: 503069 - RNA, 22 nt, Chlamydophila pneumoniae CWL029
auaaucuucaaaagacuuaccg

SEQ ID NO: 503070 - RNA, 16 nt, Chlamydophila pneumoniae CWL029
auaauagucucuguaa

SEQ ID NO: 503071 - RNA, 14 nt, Chlamydophila pneumoniae CWL029
auaauagugagcuc

SEQ ID NO: 503072 - RNA, 18 nt, Chlamydophila pneumoniae CWL029
auaauaggauaagaaauu

SEQ ID NO: 503073 - RNA, 17 nt, Chlamydophila pneumoniae CWL029
auaauauaacugcauac

SEQ ID NO: 503074 - RNA, 20 nt, Chlamydophila pneumoniae CWL029
auaaucagaacaacgcugcu

SEQ ID NO: 503075 - RNA, 14 nt, Chlamydophila pneumoniae CWL029
auaaucagaggagc

SEQ ID NO: 503076 - RNA, 21 nt, Chlamydophila pneumoniae CWL029
auaacaucuaaaaaugcacuu

SEQ ID NO: 503077 - RNA, 16 nt, Chlamydophila pneumoniae CWL029
auaacaucaagaauuu

SEQ ID NO: 503078 - RNA, 18 nt, Chlamydophila pneumoniae CWL029
auaaccaaguaaaucaga

SEQ ID NO: 503079 - RNA, 20 nt, Chlamydophila pneumoniae CWL029
auaaccaaguaaaucagacu

SEQ ID NO: 503080 - RNA, 23 nt, Chlamydophila pneumoniae CWL029
auaacagagauggucuuggguuu

SEQ ID NO: 503081 - RNA, 22 nt, Chlamydophila pneumoniae CWL029
auaacacuucuuucuugcucug

SEQ ID NO: 503082 - RNA, 14 nt, Chlamydophila pneumoniae CWL029
auaacaccaaaaga

SEQ ID NO: 503083 - RNA, 15 nt, Chlamydophila pneumoniae CWL029
auaacaccaaaagaa

SEQ ID NO: 503084 - RNA, 20 nt, Chlamydophila pneumoniae CWL029
auaacaccaaaagaauacuc

SEQ ID NO: 503085 - RNA, 16 nt, Chlamydophila pneumoniae CWL029
auaacaaucagaugag

SEQ ID NO: 503086 - RNA, 17 nt, Chlamydophila pneumoniae CWL029
auaaauccccaccaaca

SEQ ID NO: 503087 - RNA, 21 nt, Chlamydophila pneumoniae CWL029
auaaauccccaccaacaaugc

SEQ ID NO: 503088 - RNA, 20 nt, Chlamydophila pneumoniae CWL029
auaaccuaaggcauggcaca

SEQ ID NO: 503089 - RNA, 23 nt, Chlamydophila pneumoniae CWL029
auaacccaggacaucacaauuac

SEQ ID NO: 503090 - RNA, 21 nt, Chlamydophila pneumoniae CWL029
auaacugcauacaaggcacau

SEQ ID NO: 503091 - RNA, 21 nt, Chlamydophila pneumoniae CWL029
auaaaauugaaaucuuuagaa

SEQ ID NO: 503092 - RNA, 15 nt, Chlamydophila pneumoniae CWL029
auaaaaucauguccu

SEQ ID NO: 503093 - RNA, 16 nt, Chlamydophila pneumoniae CWL029
auaaaaucaagccaca

SEQ ID NO: 503094 - RNA, 23 nt, Chlamydophila pneumoniae CWL029
auaaaaucguuuuauuuuaggag

SEQ ID NO: 503095 - RNA, 12 nt, Chlamydophila pneumoniae CWL029
auaaaauaggaa

SEQ ID NO: 503096 - RNA, 16 nt, Chlamydophila pneumoniae CWL029
aguuuucaaacugauu

SEQ ID NO: 503097 - RNA, 13 nt, Chlamydophila pneumoniae CWL029
aguuuucauaauc

SEQ ID NO: 503098 - RNA, 19 nt, Chlamydophila pneumoniae CWL029
aguuuucauaauccaagaa

SEQ ID NO: 503099 - RNA, 14 nt, Chlamydophila pneumoniae CWL029
aguuuuccauccac

SEQ ID NO: 503100 - RNA, 19 nt, Chlamydophila pneumoniae CWL029
auaaauacaggccugaugu

SEQ ID NO: 503101 - RNA, 22 nt, Chlamydophila pneumoniae CWL029
auaaagcaaagauaaagaaguu

SEQ ID NO: 503102 - RNA, 21 nt, Chlamydophila pneumoniae CWL029
auaaagcccuuuugaauaucc

SEQ ID NO: 503103 - RNA, 17 nt, Chlamydophila pneumoniae CWL029
auaaagguuacaagcaa

SEQ ID NO: 503104 - RNA, 22 nt, Chlamydophila pneumoniae CWL029
auaaagguuacaagcaauacua

SEQ ID NO: 503105 - RNA, 20 nt, Chlamydophila pneumoniae CWL029
aucagauguaaagagcaaca

SEQ ID NO: 503106 - RNA, 19 nt, Chlamydophila pneumoniae CWL029
aucagauguaaagagcaac

SEQ ID NO: 503107 - RNA, 18 nt, Chlamydophila pneumoniae CWL029
aucagauguaaagagcaa

SEQ ID NO: 503108 - RNA, 16 nt, Chlamydophila pneumoniae CWL029
aucagauccaugaaca

SEQ ID NO: 503109 - RNA, 17 nt, Chlamydophila pneumoniae CWL029
aucagcaagaucuaacu

SEQ ID NO: 503110 - RNA, 12 nt, Chlamydophila pneumoniae CWL029
aucagaggagcc

SEQ ID NO: 503111 - RNA, 16 nt, Chlamydophila pneumoniae CWL029
aucagaggagccucca

SEQ ID NO: 503112 - RNA, 19 nt, Chlamydophila pneumoniae CWL029
aucagauccaugaacagca

SEQ ID NO: 503113 - RNA, 17 nt, Chlamydophila pneumoniae CWL029
aucagacugaagagcaa

SEQ ID NO: 503114 - RNA, 20 nt, Chlamydophila pneumoniae CWL029
aucagaaaaaaugcguuuug

SEQ ID NO: 503115 - RNA, 14 nt, Chlamydophila pneumoniae CWL029
aucaaugguuaaaa

SEQ ID NO: 503116 - RNA, 15 nt, Chlamydophila pneumoniae CWL029
aucaccuacaucaga

SEQ ID NO: 503117 - RNA, 16 nt, Chlamydophila pneumoniae CWL029
aucacgacgucaucac

SEQ ID NO: 503118 - RNA, 18 nt, Chlamydophila pneumoniae CWL029
aucaucaaugguuaaaac

SEQ ID NO: 503119 - RNA, 19 nt, Chlamydophila pneumoniae CWL029
aucauauuuuuguccugca

SEQ ID NO: 503120 - RNA, 12 nt, Chlamydophila pneumoniae CWL029
aucauauuuuuc

SEQ ID NO: 503121 - RNA, 13 nt, Chlamydophila pneumoniae CWL029
aucauaucuucaa

SEQ ID NO: 503122 - RNA, 15 nt, Chlamydophila pneumoniae CWL029
aucaucagaaaucaa

SEQ ID NO: 503123 - RNA, 12 nt, Chlamydophila pneumoniae CWL029
aucaucagaaau

SEQ ID NO: 503124 - RNA, 13 nt, Chlamydophila pneumoniae CWL029
aaaacgcuauugu

SEQ ID NO: 503125 - RNA, 17 nt, Chlamydophila pneumoniae CWL029
aucaggacaaugaagaa

SEQ ID NO: 503126 - RNA, 16 nt, Chlamydophila pneumoniae CWL029
aucaguuaacugugua

SEQ ID NO: 503127 - RNA, 15 nt, Chlamydophila pneumoniae CWL029
aucauaacuagggua

SEQ ID NO: 503128 - RNA, 22 nt, Chlamydophila pneumoniae CWL029
aucauagaugucaguaucaaua

SEQ ID NO: 503129 - RNA, 18 nt, Chlamydophila pneumoniae CWL029
aucauagccaucauagca

SEQ ID NO: 503130 - RNA, 19 nt, Chlamydophila pneumoniae CWL029
aucauagccaucauagcaa

SEQ ID NO: 503131 - RNA, 20 nt, Chlamydophila pneumoniae CWL029
aucauagccaucauagcaaa

SEQ ID NO: 503132 - RNA, 14 nt, Chlamydophila pneumoniae CWL029
aucaaucacucuau

SEQ ID NO: 503133 - RNA, 22 nt, Chlamydophila pneumoniae CWL029
aucaauccuauggcagcaggaa

SEQ ID NO: 503134 - RNA, 15 nt, Chlamydophila pneumoniae CWL029
aucaaggaguacucu

SEQ ID NO: 503135 - RNA, 15 nt, Chlamydophila pneumoniae CWL029
aucaagagcucguaa

SEQ ID NO: 503136 - RNA, 17 nt, Chlamydophila pneumoniae CWL029
aucaagacgacacucaa

SEQ ID NO: 503137 - RNA, 14 nt, Chlamydophila pneumoniae CWL029
aucaagaggaguga

SEQ ID NO: 503138 - RNA, 16 nt, Chlamydophila pneumoniae CWL029
aucaagauaaaggcau

SEQ ID NO: 503139 - RNA, 14 nt, Chlamydophila pneumoniae CWL029
aucaagaagagaaa

SEQ ID NO: 503140 - RNA, 18 nt, Chlamydophila pneumoniae CWL029
aucaagaagagaaaagau

SEQ ID NO: 503141 - RNA, 15 nt, Chlamydophila pneumoniae CWL029
aucaaaaugcugcuu

SEQ ID NO: 503142 - RNA, 16 nt, Chlamydophila pneumoniae CWL029
auauugacaacacgau

SEQ ID NO: 503143 - RNA, 13 nt, Chlamydophila pneumoniae CWL029
auauugaucuuuc

SEQ ID NO: 503144 - RNA, 14 nt, Chlamydophila pneumoniae CWL029
auauugcucuugua

SEQ ID NO: 503145 - RNA, 22 nt, Chlamydophila pneumoniae CWL029
auauugccuucuucuuguucuu

SEQ ID NO: 503146 - RNA, 12 nt, Chlamydophila pneumoniae CWL029
auauuuaaaagg

SEQ ID NO: 503147 - RNA, 16 nt, Chlamydophila pneumoniae CWL029
auauuuccaguauucu

SEQ ID NO: 503148 - RNA, 17 nt, Chlamydophila pneumoniae CWL029
auauugugcauuaccuc

SEQ ID NO: 503149 - RNA, 16 nt, Chlamydophila pneumoniae CWL029
aucaaaacauaaugau

SEQ ID NO: 503150 - RNA, 13 nt, Chlamydophila pneumoniae CWL029
auauuuuuaaaga

SEQ ID NO: 503151 - RNA, 13 nt, Chlamydophila pneumoniae CWL029
auauuuuaccauu

SEQ ID NO: 503152 - RNA, 15 nt, Chlamydophila pneumoniae CWL029
auaucuauaaaugua

SEQ ID NO: 503153 - RNA, 17 nt, Chlamydophila pneumoniae CWL029
auaucuauagaaggcau

SEQ ID NO: 503154 - RNA, 21 nt, Chlamydophila pneumoniae CWL029
auaucuauagaaggcaucccg

SEQ ID NO: 503155 - RNA, 15 nt, Chlamydophila pneumoniae CWL029
auaucguaggaccua

SEQ ID NO: 503156 - RNA, 23 nt, Chlamydophila pneumoniae CWL029
auaucuccguuaccaaaaacugg

SEQ ID NO: 503157 - RNA, 21 nt, Chlamydophila pneumoniae CWL029
auaucucuaccgaacagagcg

SEQ ID NO: 503158 - RNA, 14 nt, Chlamydophila pneumoniae CWL029
auaucugagcauaa

SEQ ID NO: 503159 - RNA, 13 nt, Chlamydophila pneumoniae CWL029
auaugaagagacg

SEQ ID NO: 503160 - RNA, 16 nt, Chlamydophila pneumoniae CWL029
auaucgcguguaaaag

SEQ ID NO: 503161 - RNA, 19 nt, Chlamydophila pneumoniae CWL029
auaucgcguguaaaagcuu

SEQ ID NO: 503162 - RNA, 22 nt, Chlamydophila pneumoniae CWL029
auaucgccuuccuuaacaacau

SEQ ID NO: 503163 - RNA, 17 nt, Chlamydophila pneumoniae CWL029
auaucgaccuuaaaauu

SEQ ID NO: 503164 - RNA, 18 nt, Chlamydophila pneumoniae CWL029
auaucgaguucuuuuugc

SEQ ID NO: 503165 - RNA, 13 nt, Chlamydophila pneumoniae CWL029
auaucgauaggau

SEQ ID NO: 503166 - RNA, 22 nt, Chlamydophila pneumoniae CWL029
auauccauggaauggcuacuuu

SEQ ID NO: 503167 - RNA, 15 nt, Chlamydophila pneumoniae CWL029
auaucaucuuccucu

SEQ ID NO: 503168 - RNA, 19 nt, Chlamydophila pneumoniae CWL029
auaucauauuuuuguccug

SEQ ID NO: 503169 - RNA, 15 nt, Chlamydophila pneumoniae CWL029
auauaccacuacuga

SEQ ID NO: 503170 - RNA, 11 nt, Chlamydophila pneumoniae CWL029
auauaccacua

SEQ ID NO: 503171 - RNA, 21 nt, Chlamydophila pneumoniae CWL029
auauaagggggaucuucagag

SEQ ID NO: 503172 - RNA, 15 nt, Chlamydophila pneumoniae CWL029
auauaaagaucuuuu

SEQ ID NO: 503173 - RNA, 22 nt, Chlamydophila pneumoniae CWL029
auauaagauaauagagaagaag

SEQ ID NO: 503174 - RNA, 19 nt, Chlamydophila pneumoniae CWL029
auauaaagguuacaagcaa

SEQ ID NO: 503175 - RNA, 22 nt, Chlamydophila pneumoniae CWL029
auauacugccagcgaucacaua

SEQ ID NO: 503176 - RNA, 13 nt, Chlamydophila pneumoniae CWL029
auauacuuauacc

SEQ ID NO: 503177 - RNA, 14 nt, Chlamydophila pneumoniae CWL029
auauacuuauacca

SEQ ID NO: 503178 - RNA, 18 nt, Chlamydophila pneumoniae CWL029
auauacuuauaccacccc

SEQ ID NO: 503179 - RNA, 17 nt, Chlamydophila pneumoniae CWL029
auauagaagcugcugcu

SEQ ID NO: 503180 - RNA, 13 nt, Chlamydophila pneumoniae CWL029
auauauagagcag

SEQ ID NO: 503181 - RNA, 12 nt, Chlamydophila pneumoniae CWL029
auauauccugag

SEQ ID NO: 503182 - RNA, 16 nt, Chlamydophila pneumoniae CWL029
auagcucagcucuaau

SEQ ID NO: 503183 - RNA, 20 nt, Chlamydophila pneumoniae CWL029
auagcucagcucuaauucuu

SEQ ID NO: 503184 - RNA, 12 nt, Chlamydophila pneumoniae CWL029
auagcuccuugg

SEQ ID NO: 503185 - RNA, 17 nt, Chlamydophila pneumoniae CWL029
auagcuccuuggcuaug

SEQ ID NO: 503186 - RNA, 14 nt, Chlamydophila pneumoniae CWL029
auagcucuuuucau

SEQ ID NO: 503187 - RNA, 20 nt, Chlamydophila pneumoniae CWL029
auagcucguuauauuuuucu

SEQ ID NO: 503188 - RNA, 15 nt, Chlamydophila pneumoniae CWL029
auauaaaacuuauaa

SEQ ID NO: 503189 - RNA, 19 nt, Chlamydophila pneumoniae CWL029
auaguuuuuauuuuuaaau

SEQ ID NO: 503190 - RNA, 22 nt, Chlamydophila pneumoniae CWL029
auaguuugagcaguaauguuaa

SEQ ID NO: 503191 - RNA, 20 nt, Chlamydophila pneumoniae CWL029
auagcggucacugugauuuu

SEQ ID NO: 503192 - RNA, 13 nt, Chlamydophila pneumoniae CWL029
auagcgucuguua

SEQ ID NO: 503193 - RNA, 15 nt, Chlamydophila pneumoniae CWL029
auagccaaagacucu

SEQ ID NO: 503194 - RNA, 16 nt, Chlamydophila pneumoniae CWL029
auagcauuauucccua

SEQ ID NO: 503195 - RNA, 18 nt, Chlamydophila pneumoniae CWL029
auagccuccauuuagaca

SEQ ID NO: 503196 - RNA, 15 nt, Chlamydophila pneumoniae CWL029
auagcaaugauguuu

SEQ ID NO: 503197 - RNA, 17 nt, Chlamydophila pneumoniae CWL029
auagcaauggcuuuuuu

SEQ ID NO: 503198 - RNA, 20 nt, Chlamydophila pneumoniae CWL029
auagcaauggcuuuuuuugu

SEQ ID NO: 503199 - RNA, 17 nt, Chlamydophila pneumoniae CWL029
auagcaagcacuuucgc

SEQ ID NO: 503200 - RNA, 18 nt, Chlamydophila pneumoniae CWL029
auagcaaacggaacuaaa

SEQ ID NO: 503201 - RNA, 17 nt, Chlamydophila pneumoniae CWL029
auagcaaagauuucugc

SEQ ID NO: 503202 - RNA, 20 nt, Chlamydophila pneumoniae CWL029
auagcauggagaauaaucuc

SEQ ID NO: 503203 - RNA, 18 nt, Chlamydophila pneumoniae CWL029
auagcauguucgauuuuc

SEQ ID NO: 503204 - RNA, 17 nt, Chlamydophila pneumoniae CWL029
auagcaucccuucuucu

SEQ ID NO: 503205 - RNA, 17 nt, Chlamydophila pneumoniae CWL029
auagcauggagaauaau

SEQ ID NO: 503206 - RNA, 15 nt, Chlamydophila pneumoniae CWL029
auagauacaaacauc

SEQ ID NO: 503207 - RNA, 13 nt, Chlamydophila pneumoniae CWL029
auagagucucuug

SEQ ID NO: 503208 - RNA, 19 nt, Chlamydophila pneumoniae CWL029
auagaguucgcacuaauuu

SEQ ID NO: 503209 - RNA, 13 nt, Chlamydophila pneumoniae CWL029
auagauccugaaa

SEQ ID NO: 503210 - RNA, 21 nt, Chlamydophila pneumoniae CWL029
auagauccugaaaguacagaa

SEQ ID NO: 503211 - RNA, 16 nt, Chlamydophila pneumoniae CWL029
auagaucacaucaaga

SEQ ID NO: 503212 - RNA, 13 nt, Chlamydophila pneumoniae CWL029
auagauaugccuc

SEQ ID NO: 503213 - RNA, 16 nt, Chlamydophila pneumoniae CWL029
auagauucaugaaaug

SEQ ID NO: 503214 - RNA, 21 nt, Chlamydophila pneumoniae CWL029
auagaaaaucauucaaauaua

SEQ ID NO: 503215 - RNA, 15 nt, Chlamydophila pneumoniae CWL029
auagaaaaucuuguu

SEQ ID NO: 503216 - RNA, 11 nt, Chlamydophila pneumoniae CWL029
auagagaagau

SEQ ID NO: 503217 - RNA, 14 nt, Chlamydophila pneumoniae CWL029
auagaggucuuuga

SEQ ID NO: 503218 - RNA, 20 nt, Chlamydophila pneumoniae CWL029
auagaguaucuaaaacuucu

SEQ ID NO: 503219 - RNA, 23 nt, Chlamydophila pneumoniae CWL029
auagacuuguauucuugagaguc

SEQ ID NO: 503220 - RNA, 15 nt, Chlamydophila pneumoniae CWL029
auagacuuugaguuc

SEQ ID NO: 503221 - RNA, 15 nt, Chlamydophila pneumoniae CWL029
auagacuccuuaaca

SEQ ID NO: 503222 - RNA, 15 nt, Chlamydophila pneumoniae CWL029
auagacucucacuga

SEQ ID NO: 503223 - RNA, 20 nt, Chlamydophila pneumoniae CWL029
auagacucucacugaguguc

SEQ ID NO: 503224 - RNA, 13 nt, Chlamydophila pneumoniae CWL029
auagacucuuccu

SEQ ID NO: 503225 - RNA, 23 nt, Chlamydophila pneumoniae CWL029
auacagcuguuuacuuuucucuu

SEQ ID NO: 503226 - RNA, 19 nt, Chlamydophila pneumoniae CWL029
auaccgcuguuuuauagca

SEQ ID NO: 503227 - RNA, 20 nt, Chlamydophila pneumoniae CWL029
auaccuguacgguaaaucca

SEQ ID NO: 503228 - RNA, 15 nt, Chlamydophila pneumoniae CWL029
auaccggcaaauaaa

SEQ ID NO: 503229 - RNA, 13 nt, Chlamydophila pneumoniae CWL029
auacgcagcacgc

SEQ ID NO: 503230 - RNA, 20 nt, Chlamydophila pneumoniae CWL029
auacgccgggccacuucauc

SEQ ID NO: 503231 - RNA, 18 nt, Chlamydophila pneumoniae CWL029
auacuccacuuuuuuccc

SEQ ID NO: 503232 - RNA, 22 nt, Chlamydophila pneumoniae CWL029
auacuccacuuuuuucccucca

SEQ ID NO: 503233 - RNA, 19 nt, Chlamydophila pneumoniae CWL029
auacgcuuacaaauaacua

SEQ ID NO: 503234 - RNA, 18 nt, Chlamydophila pneumoniae CWL029
auacgcuagcucuuaaau

SEQ ID NO: 503235 - RNA, 21 nt, Chlamydophila pneumoniae CWL029
auacuuguaccguaaagaaaa

SEQ ID NO: 503236 - RNA, 20 nt, Chlamydophila pneumoniae CWL029
auacuucuuccacgagauuc

SEQ ID NO: 503237 - RNA, 16 nt, Chlamydophila pneumoniae CWL029
auacuuauauuggcuu

SEQ ID NO: 503238 - RNA, 15 nt, Chlamydophila pneumoniae CWL029
auacuucaggacgca

SEQ ID NO: 503239 - RNA, 17 nt, Chlamydophila pneumoniae CWL029
auacuucaggacgcaca

SEQ ID NO: 503240 - RNA, 20 nt, Chlamydophila pneumoniae CWL029
auacuucguuaugaagcuuc

SEQ ID NO: 503241 - RNA, 12 nt, Chlamydophila pneumoniae CWL029
auacuucuccug

SEQ ID NO: 503242 - RNA, 15 nt, Chlamydophila pneumoniae CWL029
auacuucuccugaac

SEQ ID NO: 503243 - RNA, 18 nt, Chlamydophila pneumoniae CWL029
auacugcugcuaagccaa

SEQ ID NO: 503244 - RNA, 23 nt, Chlamydophila pneumoniae CWL029
auacuuaauccuguagggaaaga

SEQ ID NO: 503245 - RNA, 12 nt, Chlamydophila pneumoniae CWL029
auacuuauacca

SEQ ID NO: 503246 - RNA, 13 nt, Chlamydophila pneumoniae CWL029
aucgacucuucca

SEQ ID NO: 503247 - RNA, 15 nt, Chlamydophila pneumoniae CWL029
aucgaccuuaaaauu

SEQ ID NO: 503248 - RNA, 16 nt, Chlamydophila pneumoniae CWL029
aucgacaaguaccuuc

SEQ ID NO: 503249 - RNA, 23 nt, Chlamydophila pneumoniae CWL029
aucgauaacgauuucuugaagau

SEQ ID NO: 503250 - RNA, 21 nt, Chlamydophila pneumoniae CWL029
auccuucuacaaugauauaaa

SEQ ID NO: 503251 - RNA, 14 nt, Chlamydophila pneumoniae CWL029
auccuucucccucu

SEQ ID NO: 503252 - RNA, 13 nt, Chlamydophila pneumoniae CWL029
auccuucuuuacc

SEQ ID NO: 503253 - RNA, 22 nt, Chlamydophila pneumoniae CWL029
auccuugaaagacucgcucucc

SEQ ID NO: 503254 - RNA, 16 nt, Chlamydophila pneumoniae CWL029
auccuuccuuacaagc

SEQ ID NO: 503255 - RNA, 17 nt, Chlamydophila pneumoniae CWL029
auccuuccuuauuggua

SEQ ID NO: 503256 - RNA, 16 nt, Chlamydophila pneumoniae CWL029
auccuucgaccuauuu

SEQ ID NO: 503257 - RNA, 17 nt, Chlamydophila pneumoniae CWL029
auccuguagcuuuaugc

SEQ ID NO: 503258 - RNA, 14 nt, Chlamydophila pneumoniae CWL029
auccuugcaaaaca

SEQ ID NO: 503259 - RNA, 16 nt, Chlamydophila pneumoniae CWL029
auccuugcaaaacagc

SEQ ID NO: 503260 - RNA, 19 nt, Chlamydophila pneumoniae CWL029
auccuugcaaaacagcauc

SEQ ID NO: 503261 - RNA, 20 nt, Chlamydophila pneumoniae CWL029
aucgaagaacuuagcaauga

SEQ ID NO: 503262 - RNA, 18 nt, Chlamydophila pneumoniae CWL029
auccugcauacccuucuu

SEQ ID NO: 503263 - RNA, 11 nt, Chlamydophila pneumoniae CWL029
auccugggcaa

SEQ ID NO: 503264 - RNA, 15 nt, Chlamydophila pneumoniae CWL029
auccugcuccaaaau

SEQ ID NO: 503265 - RNA, 16 nt, Chlamydophila pneumoniae CWL029
aucguacuucacuucu

SEQ ID NO: 503266 - RNA, 22 nt, Chlamydophila pneumoniae CWL029
aucguaagccggcgguggaaaa

SEQ ID NO: 503267 - RNA, 21 nt, Chlamydophila pneumoniae CWL029
aucguaauguauccuucuaca

SEQ ID NO: 503268 - RNA, 18 nt, Chlamydophila pneumoniae CWL029
aucgggguuucagaagga

SEQ ID NO: 503269 - RNA, 22 nt, Chlamydophila pneumoniae CWL029
aucggaagcgauguuccuuuuu

SEQ ID NO: 503270 - RNA, 19 nt, Chlamydophila pneumoniae CWL029
aucgcucucuccaugagcu

SEQ ID NO: 503271 - RNA, 18 nt, Chlamydophila pneumoniae CWL029
auccgaagacucaaagaa

SEQ ID NO: 503272 - RNA, 17 nt, Chlamydophila pneumoniae CWL029
auccgaaucuauccaua

SEQ ID NO: 503273 - RNA, 14 nt, Chlamydophila pneumoniae CWL029
auccgauauacuua

SEQ ID NO: 503274 - RNA, 23 nt, Chlamydophila pneumoniae CWL029
aucccugcacucuuucagaaaga

SEQ ID NO: 503275 - RNA, 15 nt, Chlamydophila pneumoniae CWL029
aucccuggauuucuu

SEQ ID NO: 503276 - RNA, 21 nt, Chlamydophila pneumoniae CWL029
aucccuguaguuucuaaaaca

SEQ ID NO: 503277 - RNA, 17 nt, Chlamydophila pneumoniae CWL029
aucccuagggaaagcau

SEQ ID NO: 503278 - RNA, 21 nt, Chlamydophila pneumoniae CWL029
aucccauaaauguauaggcau

SEQ ID NO: 503279 - RNA, 16 nt, Chlamydophila pneumoniae CWL029
aucccaucaaaggcaa

SEQ ID NO: 503280 - RNA, 22 nt, Chlamydophila pneumoniae CWL029
aucccagauuuuuuugguugcu

SEQ ID NO: 503281 - RNA, 17 nt, Chlamydophila pneumoniae CWL029
auccccguccuguacca

SEQ ID NO: 503282 - RNA, 12 nt, Chlamydophila pneumoniae CWL029
auccccucagaa

SEQ ID NO: 503283 - RNA, 14 nt, Chlamydophila pneumoniae CWL029
auccccucagaaag

SEQ ID NO: 503284 - RNA, 18 nt, Chlamydophila pneumoniae CWL029
auccccucagaaaggaga

SEQ ID NO: 503285 - RNA, 13 nt, Chlamydophila pneumoniae CWL029
auccauuuugccc

SEQ ID NO: 503286 - RNA, 12 nt, Chlamydophila pneumoniae CWL029
auccauucuuaa

SEQ ID NO: 503287 - RNA, 20 nt, Chlamydophila pneumoniae CWL029
auccaggaauagaaagacau

SEQ ID NO: 503288 - RNA, 15 nt, Chlamydophila pneumoniae CWL029
auccaggaauagaaa

SEQ ID NO: 503289 - RNA, 19 nt, Chlamydophila pneumoniae CWL029
auccaggaauagaaagaca

SEQ ID NO: 503290 - RNA, 15 nt, Chlamydophila pneumoniae CWL029
auccagguuguccua

SEQ ID NO: 503291 - RNA, 17 nt, Chlamydophila pneumoniae CWL029
auccagguuguccuaua

SEQ ID NO: 503292 - RNA, 13 nt, Chlamydophila pneumoniae CWL029
auccaagaaugaa

SEQ ID NO: 503293 - RNA, 15 nt, Chlamydophila pneumoniae CWL029
auccaagaaugaauc

SEQ ID NO: 503294 - RNA, 22 nt, Chlamydophila pneumoniae CWL029
auccaaguguucgaguucuuua

SEQ ID NO: 503295 - RNA, 16 nt, Chlamydophila pneumoniae CWL029
auccaaugacaauccg

SEQ ID NO: 503296 - RNA, 13 nt, Chlamydophila pneumoniae CWL029
auccaaaagcggc

SEQ ID NO: 503297 - RNA, 23 nt, Chlamydophila pneumoniae CWL029
auccaaaagcggcccagaucacc

SEQ ID NO: 503298 - RNA, 21 nt, Chlamydophila pneumoniae CWL029
auccaaaaaagagcccaaaaa

SEQ ID NO: 503299 - RNA, 13 nt, Chlamydophila pneumoniae CWL029
aucauuuuugcua

SEQ ID NO: 503300 - RNA, 19 nt, Chlamydophila pneumoniae CWL029
aucauuuucauagcagcua

SEQ ID NO: 503301 - RNA, 16 nt, Chlamydophila pneumoniae CWL029
auccagacaagacacu

SEQ ID NO: 503302 - RNA, 23 nt, Chlamydophila pneumoniae CWL029
auccagaaucuccauuuagaaug

SEQ ID NO: 503303 - RNA, 21 nt, Chlamydophila pneumoniae CWL029
auccagccacccccacuucuu

SEQ ID NO: 503304 - RNA, 18 nt, Chlamydophila pneumoniae CWL029
aaaacuuucgaagcgcuc

SEQ ID NO: 503305 - RNA, 23 nt, Chlamydophila pneumoniae CWL029
aaaacuucuugugauccuugcaa

SEQ ID NO: 503306 - RNA, 16 nt, Chlamydophila pneumoniae CWL029
aucauuaagaagauuc

SEQ ID NO: 503307 - RNA, 19 nt, Chlamydophila pneumoniae CWL029
aucauuaaggugugcuccu

SEQ ID NO: 503308 - RNA, 12 nt, Chlamydophila pneumoniae CWL029
aucauuagcauc

SEQ ID NO: 503309 - RNA, 20 nt, Chlamydophila pneumoniae CWL029
aaaagaaagaagccuuccuu

SEQ ID NO: 503310 - RNA, 21 nt, Chlamydophila pneumoniae CWL029
aaaagaaagaagccuuccuug

SEQ ID NO: 503311 - RNA, 12 nt, Chlamydophila pneumoniae CWL029
aaaagaaaagac

SEQ ID NO: 503312 - RNA, 22 nt, Chlamydophila pneumoniae CWL029
aucauuuaaagcugaaauucuu

SEQ ID NO: 503313 - RNA, 19 nt, Chlamydophila pneumoniae CWL029
aucugcguuucuuucugau

SEQ ID NO: 503314 - RNA, 19 nt, Chlamydophila pneumoniae CWL029
aucugcuauaaccaacuuc

SEQ ID NO: 503315 - RNA, 16 nt, Chlamydophila pneumoniae CWL029
aucugaauuuuagcuc

SEQ ID NO: 503316 - RNA, 14 nt, Chlamydophila pneumoniae CWL029
aucuguaguaggca

SEQ ID NO: 503317 - RNA, 18 nt, Chlamydophila pneumoniae CWL029
aucuguaguaggcacuua

SEQ ID NO: 503318 - RNA, 15 nt, Chlamydophila pneumoniae CWL029
aucuguauccuuccu

SEQ ID NO: 503319 - RNA, 20 nt, Chlamydophila pneumoniae CWL029
aucuguauaugcuuggcaau

SEQ ID NO: 503320 - RNA, 17 nt, Chlamydophila pneumoniae CWL029
aucuuccccuaaaaauu

SEQ ID NO: 503321 - RNA, 15 nt, Chlamydophila pneumoniae CWL029
aucuuccccuaaaaa

SEQ ID NO: 503322 - RNA, 13 nt, Chlamydophila pneumoniae CWL029
aucuucagagaga

SEQ ID NO: 503323 - RNA, 15 nt, Chlamydophila pneumoniae CWL029
aucuucagagagaac

SEQ ID NO: 503324 - RNA, 16 nt, Chlamydophila pneumoniae CWL029
aucuucagagagaaca

SEQ ID NO: 503325 - RNA, 21 nt, Chlamydophila pneumoniae CWL029
aucuucauccccgagagagau

SEQ ID NO: 503326 - RNA, 11 nt, Chlamydophila pneumoniae CWL029
aucuucaaaag

SEQ ID NO: 503327 - RNA, 15 nt, Chlamydophila pneumoniae CWL029
aucuucaagaccacu

SEQ ID NO: 503328 - RNA, 12 nt, Chlamydophila pneumoniae CWL029
aucuuauagaca

SEQ ID NO: 503329 - RNA, 22 nt, Chlamydophila pneumoniae CWL029
aucuuaugccuuuguuuuaucu

SEQ ID NO: 503330 - RNA, 17 nt, Chlamydophila pneumoniae CWL029
aucuuacauaaaccuuu

SEQ ID NO: 503331 - RNA, 12 nt, Chlamydophila pneumoniae CWL029
aucuccucucuc

SEQ ID NO: 503332 - RNA, 15 nt, Chlamydophila pneumoniae CWL029
aucuccugaagccau

SEQ ID NO: 503333 - RNA, 21 nt, Chlamydophila pneumoniae CWL029
aucuccugaagccaugacaaa

SEQ ID NO: 503334 - RNA, 14 nt, Chlamydophila pneumoniae CWL029
aucuccucaucaga

SEQ ID NO: 503335 - RNA, 21 nt, Chlamydophila pneumoniae CWL029
aucuccaagccaugcaaugaa

SEQ ID NO: 503336 - RNA, 17 nt, Chlamydophila pneumoniae CWL029
aucuccagaaauuuuua

SEQ ID NO: 503337 - RNA, 19 nt, Chlamydophila pneumoniae CWL029
aucuccaagccaugcaaug

SEQ ID NO: 503338 - RNA, 21 nt, Chlamydophila pneumoniae CWL029
aucuccaaacauuuuuaagga

SEQ ID NO: 503339 - RNA, 22 nt, Chlamydophila pneumoniae CWL029
aucucauuucguagacgcucua

SEQ ID NO: 503340 - RNA, 21 nt, Chlamydophila pneumoniae CWL029
aucucaucacguaaggugucu

SEQ ID NO: 503341 - RNA, 20 nt, Chlamydophila pneumoniae CWL029
aucucaugcggacuuuauuc

SEQ ID NO: 503342 - RNA, 23 nt, Chlamydophila pneumoniae CWL029
aucucuuuuggaagaccuuugga

SEQ ID NO: 503343 - RNA, 18 nt, Chlamydophila pneumoniae CWL029
aucucuuucauaaauuca

SEQ ID NO: 503344 - RNA, 11 nt, Chlamydophila pneumoniae CWL029
aucucuuucac

SEQ ID NO: 503345 - RNA, 14 nt, Chlamydophila pneumoniae CWL029
aucucuuucacaaa

SEQ ID NO: 503346 - RNA, 16 nt, Chlamydophila pneumoniae CWL029
aucucuggaauacauu

SEQ ID NO: 503347 - RNA, 13 nt, Chlamydophila pneumoniae CWL029
aucucugugccau

SEQ ID NO: 503348 - RNA, 22 nt, Chlamydophila pneumoniae CWL029
aucucugugccaucuguagacc

SEQ ID NO: 503349 - RNA, 13 nt, Chlamydophila pneumoniae CWL029
aucucuuuaacuu

SEQ ID NO: 503350 - RNA, 18 nt, Chlamydophila pneumoniae CWL029
aucucuggaauacauucc

SEQ ID NO: 503351 - RNA, 17 nt, Chlamydophila pneumoniae CWL029
aucuccuuucaagagca

SEQ ID NO: 503352 - RNA, 14 nt, Chlamydophila pneumoniae CWL029
aucucgcaguccuu

SEQ ID NO: 503353 - RNA, 13 nt, Chlamydophila pneumoniae CWL029
aucucuccucccc

SEQ ID NO: 503354 - RNA, 17 nt, Chlamydophila pneumoniae CWL029
aucucugaccaucaaug

SEQ ID NO: 503355 - RNA, 19 nt, Chlamydophila pneumoniae CWL029
aucucugaccaucaaugag

SEQ ID NO: 503356 - RNA, 22 nt, Chlamydophila pneumoniae CWL029
aucuauccuuaggugaaauauu

SEQ ID NO: 503357 - RNA, 10 nt, Chlamydophila pneumoniae CWL029
aucucaguag

SEQ ID NO: 503358 - RNA, 22 nt, Chlamydophila pneumoniae CWL029
aucucaguaggagcagcggcac

SEQ ID NO: 503359 - RNA, 19 nt, Chlamydophila pneumoniae CWL029
aucuauagaauuuccaauc

SEQ ID NO: 503360 - RNA, 23 nt, Chlamydophila pneumoniae CWL029
aucuauacagacaagcaaggaaa

SEQ ID NO: 503361 - RNA, 20 nt, Chlamydophila pneumoniae CWL029
aucuagauuuugagaaugaa

SEQ ID NO: 503362 - RNA, 13 nt, Chlamydophila pneumoniae CWL029
aucuagaugauaa

SEQ ID NO: 503363 - RNA, 13 nt, Chlamydophila pneumoniae CWL029
aucuagcucuuca

SEQ ID NO: 503364 - RNA, 18 nt, Chlamydophila pneumoniae CWL029
aucuacagagagaaacuu

SEQ ID NO: 503365 - RNA, 18 nt, Chlamydophila pneumoniae CWL029
aucuacagcuauagaagc

SEQ ID NO: 503366 - RNA, 18 nt, Chlamydophila pneumoniae CWL029
aucuacaaacagauuuuu

SEQ ID NO: 503367 - RNA, 20 nt, Chlamydophila pneumoniae CWL029
aucuaauuuuagaacuucaa

SEQ ID NO: 503368 - RNA, 22 nt, Chlamydophila pneumoniae CWL029
aucuacacacaugacaaauaaa

SEQ ID NO: 503369 - RNA, 21 nt, Chlamydophila pneumoniae CWL029
aucuacacgcuauagcaacag

SEQ ID NO: 503370 - RNA, 18 nt, Chlamydophila pneumoniae CWL029
augauaccaccuaaaaug

SEQ ID NO: 503371 - RNA, 20 nt, Chlamydophila pneumoniae CWL029
augaguggguucacuccuga

SEQ ID NO: 503372 - RNA, 17 nt, Chlamydophila pneumoniae CWL029
augauaaagccugcacg

SEQ ID NO: 503373 - RNA, 18 nt, Chlamydophila pneumoniae CWL029
augauauuuuuauuuaaa

SEQ ID NO: 503374 - RNA, 22 nt, Chlamydophila pneumoniae CWL029
augauccaauagccaaagacuc

SEQ ID NO: 503375 - RNA, 23 nt, Chlamydophila pneumoniae CWL029
augauauccucaauuuguuucuu

SEQ ID NO: 503376 - RNA, 19 nt, Chlamydophila pneumoniae CWL029
augagggucggauuuagau

SEQ ID NO: 503377 - RNA, 15 nt, Chlamydophila pneumoniae CWL029
augaggcuccuccuu

SEQ ID NO: 503378 - RNA, 13 nt, Chlamydophila pneumoniae CWL029
augagggaaaugc

SEQ ID NO: 503379 - RNA, 21 nt, Chlamydophila pneumoniae CWL029
augaggagcucccucuagagc

SEQ ID NO: 503380 - RNA, 21 nt, Chlamydophila pneumoniae CWL029
augagcucacgcaccauuccu

SEQ ID NO: 503381 - RNA, 20 nt, Chlamydophila pneumoniae CWL029
augagcuccaaaauaaucuc

SEQ ID NO: 503382 - RNA, 15 nt, Chlamydophila pneumoniae CWL029
augagcucuauuucu

SEQ ID NO: 503383 - RNA, 16 nt, Chlamydophila pneumoniae CWL029
augacauugcaauaca

SEQ ID NO: 503384 - RNA, 22 nt, Chlamydophila pneumoniae CWL029
augacauugcaauacaucuuaa

SEQ ID NO: 503385 - RNA, 20 nt, Chlamydophila pneumoniae CWL029
augacguuaauaaagaggcu

SEQ ID NO: 503386 - RNA, 17 nt, Chlamydophila pneumoniae CWL029
augacagggaaagaaca

SEQ ID NO: 503387 - RNA, 17 nt, Chlamydophila pneumoniae CWL029
augacaguguccacugc

SEQ ID NO: 503388 - RNA, 20 nt, Chlamydophila pneumoniae CWL029
augacugcagauugcacuug

SEQ ID NO: 503389 - RNA, 18 nt, Chlamydophila pneumoniae CWL029
augacuggcgacuugcca

SEQ ID NO: 503390 - RNA, 12 nt, Chlamydophila pneumoniae CWL029
augacucuagag

SEQ ID NO: 503391 - RNA, 16 nt, Chlamydophila pneumoniae CWL029
augaaucugguuccuu

SEQ ID NO: 503392 - RNA, 20 nt, Chlamydophila pneumoniae CWL029
augaaucacaucuaaagauu

SEQ ID NO: 503393 - RNA, 17 nt, Chlamydophila pneumoniae CWL029
augaaucacagcgcugu

SEQ ID NO: 503394 - RNA, 18 nt, Chlamydophila pneumoniae CWL029
augaagucuucuuucccc

SEQ ID NO: 503395 - RNA, 14 nt, Chlamydophila pneumoniae CWL029
augaacgauuucuu

SEQ ID NO: 503396 - RNA, 17 nt, Chlamydophila pneumoniae CWL029
augaaauacuccacuuu

SEQ ID NO: 503397 - RNA, 13 nt, Chlamydophila pneumoniae CWL029
augaaaaucugcu

SEQ ID NO: 503398 - RNA, 18 nt, Chlamydophila pneumoniae CWL029
augaaaaucugcucucug

SEQ ID NO: 503399 - RNA, 21 nt, Chlamydophila pneumoniae CWL029
augaaagugcucuuuuaacuu

SEQ ID NO: 503400 - RNA, 22 nt, Chlamydophila pneumoniae CWL029
aucuuucaucaaugcgauuacu

SEQ ID NO: 503401 - RNA, 14 nt, Chlamydophila pneumoniae CWL029
aucuuuauuuuuaa

SEQ ID NO: 503402 - RNA, 19 nt, Chlamydophila pneumoniae CWL029
aucuuucaauguaauugcg

SEQ ID NO: 503403 - RNA, 14 nt, Chlamydophila pneumoniae CWL029
aucuucuaaaacac

SEQ ID NO: 503404 - RNA, 17 nt, Chlamydophila pneumoniae CWL029
aucuucuaaaacuucag

SEQ ID NO: 503405 - RNA, 13 nt, Chlamydophila pneumoniae CWL029
aucuuccucuuuu

SEQ ID NO: 503406 - RNA, 20 nt, Chlamydophila pneumoniae CWL029
auguccuccauggaaagaaa

SEQ ID NO: 503407 - RNA, 17 nt, Chlamydophila pneumoniae CWL029
auguccuccauggaaag

SEQ ID NO: 503408 - RNA, 21 nt, Chlamydophila pneumoniae CWL029
auguccgugagcaacaagcug

SEQ ID NO: 503409 - RNA, 16 nt, Chlamydophila pneumoniae CWL029
auguccuucaaaaugu

SEQ ID NO: 503410 - RNA, 20 nt, Chlamydophila pneumoniae CWL029
auguugcuaagcgaaccaaa

SEQ ID NO: 503411 - RNA, 14 nt, Chlamydophila pneumoniae CWL029
auguuuaaagcaua

SEQ ID NO: 503412 - RNA, 22 nt, Chlamydophila pneumoniae CWL029
auguuuaugaaaaucugcucuc

SEQ ID NO: 503413 - RNA, 20 nt, Chlamydophila pneumoniae CWL029
auguuucuaagcugaaagaa

SEQ ID NO: 503414 - RNA, 15 nt, Chlamydophila pneumoniae CWL029
auguuucuuccugaa

SEQ ID NO: 503415 - RNA, 20 nt, Chlamydophila pneumoniae CWL029
auguuucuuccugaaucagc

SEQ ID NO: 503416 - RNA, 23 nt, Chlamydophila pneumoniae CWL029
auuaaaguccaagaucaaacgaa

SEQ ID NO: 503417 - RNA, 24 nt, Chlamydophila pneumoniae CWL029
auuaaauucuuuucuacaugcuca

SEQ ID NO: 503418 - RNA, 19 nt, Chlamydophila pneumoniae CWL029
auuaaauuguauggaauuc

SEQ ID NO: 503419 - RNA, 22 nt, Chlamydophila pneumoniae CWL029
auuaaauuguauggaauucaaa

SEQ ID NO: 503420 - RNA, 22 nt, Chlamydophila pneumoniae CWL029
auuacagcaucuauagaauuuc

SEQ ID NO: 503421 - RNA, 22 nt, Chlamydophila pneumoniae CWL029
auuacagauuucuucuucagag

SEQ ID NO: 503422 - RNA, 12 nt, Chlamydophila pneumoniae CWL029
auuacaggaaac

SEQ ID NO: 503423 - RNA, 12 nt, Chlamydophila pneumoniae CWL029
auuacagaaagg

SEQ ID NO: 503424 - RNA, 21 nt, Chlamydophila pneumoniae CWL029
auuacagaaaggcuuuucuuu

SEQ ID NO: 503425 - RNA, 23 nt, Chlamydophila pneumoniae CWL029
auuacagaucugcauaauuuuuc

SEQ ID NO: 503426 - RNA, 22 nt, Chlamydophila pneumoniae CWL029
auuaaggcuccagcauaaggau

SEQ ID NO: 503427 - RNA, 15 nt, Chlamydophila pneumoniae CWL029
auuaagucaccuuaa

SEQ ID NO: 503428 - RNA, 21 nt, Chlamydophila pneumoniae CWL029
auuaacagagcgccuccaccu

SEQ ID NO: 503429 - RNA, 15 nt, Chlamydophila pneumoniae CWL029
aaaagcagacgaaua

SEQ ID NO: 503430 - RNA, 22 nt, Chlamydophila pneumoniae CWL029
auuaauccuugagggcuaucca

SEQ ID NO: 503431 - RNA, 18 nt, Chlamydophila pneumoniae CWL029
auuaauccuugagggcua

SEQ ID NO: 503432 - RNA, 23 nt, Chlamydophila pneumoniae CWL029
auuaauccuugagggcuauccac

SEQ ID NO: 503433 - RNA, 16 nt, Chlamydophila pneumoniae CWL029
auucacaucuuaaaaa

SEQ ID NO: 503434 - RNA, 15 nt, Chlamydophila pneumoniae CWL029
auuauucuagaguug

SEQ ID NO: 503435 - RNA, 18 nt, Chlamydophila pneumoniae CWL029
auucaaugagcaucugag

SEQ ID NO: 503436 - RNA, 16 nt, Chlamydophila pneumoniae CWL029
auucaauaauuucaaa

SEQ ID NO: 503437 - RNA, 21 nt, Chlamydophila pneumoniae CWL029
auucaauaauuucaaagaugc

SEQ ID NO: 503438 - RNA, 17 nt, Chlamydophila pneumoniae CWL029
auucaacauguuaauaa

SEQ ID NO: 503439 - RNA, 13 nt, Chlamydophila pneumoniae CWL029
auucaaccaaacg

SEQ ID NO: 503440 - RNA, 12 nt, Chlamydophila pneumoniae CWL029
auucagagaaag

SEQ ID NO: 503441 - RNA, 17 nt, Chlamydophila pneumoniae CWL029
auucagauccaaagacg

SEQ ID NO: 503442 - RNA, 18 nt, Chlamydophila pneumoniae CWL029
auucacguauagguugaa

SEQ ID NO: 503443 - RNA, 16 nt, Chlamydophila pneumoniae CWL029
auucaguuccucaucc

SEQ ID NO: 503444 - RNA, 17 nt, Chlamydophila pneumoniae CWL029
auucaguuccucauccu

SEQ ID NO: 503445 - RNA, 20 nt, Chlamydophila pneumoniae CWL029
auucagggggaaagccaaga

SEQ ID NO: 503446 - RNA, 18 nt, Chlamydophila pneumoniae CWL029
auucaggauacucugaac

SEQ ID NO: 503447 - RNA, 23 nt, Chlamydophila pneumoniae CWL029
auuaguuucacauaguuuaauaa

SEQ ID NO: 503448 - RNA, 20 nt, Chlamydophila pneumoniae CWL029
auuaguaacuaaauucuuaa

SEQ ID NO: 503449 - RNA, 22 nt, Chlamydophila pneumoniae CWL029
aaaagcuagucuuucuaagaag

SEQ ID NO: 503450 - RNA, 15 nt, Chlamydophila pneumoniae CWL029
auuagcuaaaucaaa

SEQ ID NO: 503451 - RNA, 19 nt, Chlamydophila pneumoniae CWL029
auuagcuaaaucaaaauuu

SEQ ID NO: 503452 - RNA, 23 nt, Chlamydophila pneumoniae CWL029
auuauucccuaagguagagucca

SEQ ID NO: 503453 - RNA, 19 nt, Chlamydophila pneumoniae CWL029
auuaucuucguaauaacua

SEQ ID NO: 503454 - RNA, 13 nt, Chlamydophila pneumoniae CWL029
auuaucaagaaau

SEQ ID NO: 503455 - RNA, 19 nt, Chlamydophila pneumoniae CWL029
auuaucaagaaauucuucc

SEQ ID NO: 503456 - RNA, 14 nt, Chlamydophila pneumoniae CWL029
auuaucagagacaa

SEQ ID NO: 503457 - RNA, 21 nt, Chlamydophila pneumoniae CWL029
auuaucagagacaaguucauc

SEQ ID NO: 503458 - RNA, 15 nt, Chlamydophila pneumoniae CWL029
auuaucauaaauacg

SEQ ID NO: 503459 - RNA, 20 nt, Chlamydophila pneumoniae CWL029
aaaagaucggaguuaucaaa

SEQ ID NO: 503460 - RNA, 22 nt, Chlamydophila pneumoniae CWL029
aaaagaucggaguuaucaaaag

SEQ ID NO: 503461 - RNA, 23 nt, Chlamydophila pneumoniae CWL029
aaaagaucggaguuaucaaaagg

SEQ ID NO: 503462 - RNA, 14 nt, Chlamydophila pneumoniae CWL029
aaaagauaaagcua

SEQ ID NO: 503463 - RNA, 15 nt, Chlamydophila pneumoniae CWL029
auguaguuagagaag

SEQ ID NO: 503464 - RNA, 21 nt, Chlamydophila pneumoniae CWL029
auguaguuugggaugacuggc

SEQ ID NO: 503465 - RNA, 13 nt, Chlamydophila pneumoniae CWL029
auguauaaaguuu

SEQ ID NO: 503466 - RNA, 22 nt, Chlamydophila pneumoniae CWL029
aaaagauuugcgaaucuaagau

SEQ ID NO: 503467 - RNA, 13 nt, Chlamydophila pneumoniae CWL029
aaaagauucuaaa

SEQ ID NO: 503468 - RNA, 16 nt, Chlamydophila pneumoniae CWL029
aaaagauucuaaauca

SEQ ID NO: 503469 - RNA, 12 nt, Chlamydophila pneumoniae CWL029
aaaagauaguga

SEQ ID NO: 503470 - RNA, 16 nt, Chlamydophila pneumoniae CWL029
aaaagauuuucccgug

SEQ ID NO: 503471 - RNA, 18 nt, Chlamydophila pneumoniae CWL029
aaaagcaaccuuaaagau

SEQ ID NO: 503472 - RNA, 22 nt, Chlamydophila pneumoniae CWL029
auguaucggggauugcaaaauu

SEQ ID NO: 503473 - RNA, 23 nt, Chlamydophila pneumoniae CWL029
auguaucggggauugcaaaauuu

SEQ ID NO: 503474 - RNA, 22 nt, Chlamydophila pneumoniae CWL029
augucaguaucaauaaucggcc

SEQ ID NO: 503475 - RNA, 22 nt, Chlamydophila pneumoniae CWL029
auguauggugcgcgucuccuug

SEQ ID NO: 503476 - RNA, 23 nt, Chlamydophila pneumoniae CWL029
auguauggugcgcgucuccuuga

SEQ ID NO: 503477 - RNA, 18 nt, Chlamydophila pneumoniae CWL029
augucacucuagaaaaua

SEQ ID NO: 503478 - RNA, 17 nt, Chlamydophila pneumoniae CWL029
auguaaucauaaaaaaa

SEQ ID NO: 503479 - RNA, 18 nt, Chlamydophila pneumoniae CWL029
auguaaucccagauuuuu

SEQ ID NO: 503480 - RNA, 19 nt, Chlamydophila pneumoniae CWL029
auguaaucccagauuuuuu

SEQ ID NO: 503481 - RNA, 14 nt, Chlamydophila pneumoniae CWL029
auguaagaauguag

SEQ ID NO: 503482 - RNA, 11 nt, Chlamydophila pneumoniae CWL029
auguagagucg

SEQ ID NO: 503483 - RNA, 15 nt, Chlamydophila pneumoniae CWL029
auguacugaugugaa

SEQ ID NO: 503484 - RNA, 22 nt, Chlamydophila pneumoniae CWL029
auguagaaggggguucuaagaa

SEQ ID NO: 503485 - RNA, 24 nt, Chlamydophila pneumoniae CWL029
auguagaaggggguucuaagaaau

SEQ ID NO: 503486 - RNA, 13 nt, Chlamydophila pneumoniae CWL029
auguagcagagcc

SEQ ID NO: 503487 - RNA, 16 nt, Chlamydophila pneumoniae CWL029
auguaggaugugaagg

SEQ ID NO: 503488 - RNA, 20 nt, Chlamydophila pneumoniae CWL029
auguaguaaauuccucuuga

SEQ ID NO: 503489 - RNA, 18 nt, Chlamydophila pneumoniae CWL029
auggucucccucacaaga

SEQ ID NO: 503490 - RNA, 20 nt, Chlamydophila pneumoniae CWL029
auggucucccucacaagaag

SEQ ID NO: 503491 - RNA, 13 nt, Chlamydophila pneumoniae CWL029
auggucuuccccc

SEQ ID NO: 503492 - RNA, 19 nt, Chlamydophila pneumoniae CWL029
auggucuuggguuuuaaau

SEQ ID NO: 503493 - RNA, 16 nt, Chlamydophila pneumoniae CWL029
auggucccuauagaac

SEQ ID NO: 503494 - RNA, 16 nt, Chlamydophila pneumoniae CWL029
auggucaggaagaaag

SEQ ID NO: 503495 - RNA, 19 nt, Chlamydophila pneumoniae CWL029
auggucagucucgugcaua

SEQ ID NO: 503496 - RNA, 16 nt, Chlamydophila pneumoniae CWL029
auguaaaaaauuauuu

SEQ ID NO: 503497 - RNA, 22 nt, Chlamydophila pneumoniae CWL029
augguauucccuaacaggaaag

SEQ ID NO: 503498 - RNA, 23 nt, Chlamydophila pneumoniae CWL029
augguauucccuaacaggaaaga

SEQ ID NO: 503499 - RNA, 18 nt, Chlamydophila pneumoniae CWL029
augggauccugcaaagcc

SEQ ID NO: 503500 - RNA, 14 nt, Chlamydophila pneumoniae CWL029
augggaauaaaaau

SEQ ID NO: 503501 - RNA, 11 nt, Chlamydophila pneumoniae CWL029
augggaauuug

SEQ ID NO: 503502 - RNA, 15 nt, Chlamydophila pneumoniae CWL029
auggcggucuuuguu

SEQ ID NO: 503503 - RNA, 20 nt, Chlamydophila pneumoniae CWL029
auggcauugggaaggaucug

SEQ ID NO: 503504 - RNA, 16 nt, Chlamydophila pneumoniae CWL029
auggcgauaaaugcug

SEQ ID NO: 503505 - RNA, 11 nt, Chlamydophila pneumoniae CWL029
augcuggaacu

SEQ ID NO: 503506 - RNA, 20 nt, Chlamydophila pneumoniae CWL029
aaaagagaacauguuucuaa

SEQ ID NO: 503507 - RNA, 13 nt, Chlamydophila pneumoniae CWL029
aaaagaccaaaaa

SEQ ID NO: 503508 - RNA, 13 nt, Chlamydophila pneumoniae CWL029
aaaagaccgccuu

SEQ ID NO: 503509 - RNA, 13 nt, Chlamydophila pneumoniae CWL029
aaaagacaagaga

SEQ ID NO: 503510 - RNA, 21 nt, Chlamydophila pneumoniae CWL029
augcuaaauuugucaucacau

SEQ ID NO: 503511 - RNA, 16 nt, Chlamydophila pneumoniae CWL029
augcuaagcaucagaa

SEQ ID NO: 503512 - RNA, 15 nt, Chlamydophila pneumoniae CWL029
augcuaauaaaaugc

SEQ ID NO: 503513 - RNA, 21 nt, Chlamydophila pneumoniae CWL029
augcuaauuggauauagggag

SEQ ID NO: 503514 - RNA, 12 nt, Chlamydophila pneumoniae CWL029
augcuaauaaaa

SEQ ID NO: 503515 - RNA, 17 nt, Chlamydophila pneumoniae CWL029
augcuauuuuccucuau

SEQ ID NO: 503516 - RNA, 13 nt, Chlamydophila pneumoniae CWL029
augcuauuuuucc

SEQ ID NO: 503517 - RNA, 22 nt, Chlamydophila pneumoniae CWL029
augcuauagcuggaucuucuga

SEQ ID NO: 503518 - RNA, 16 nt, Chlamydophila pneumoniae CWL029
augcugaaccuuuggu

SEQ ID NO: 503519 - RNA, 16 nt, Chlamydophila pneumoniae CWL029
augcggaccuuaagau

SEQ ID NO: 503520 - RNA, 12 nt, Chlamydophila pneumoniae CWL029
augcgcucuaag

SEQ ID NO: 503521 - RNA, 19 nt, Chlamydophila pneumoniae CWL029
augcgcacggauucuaaaa

SEQ ID NO: 503522 - RNA, 17 nt, Chlamydophila pneumoniae CWL029
augccuaaauagcucag

SEQ ID NO: 503523 - RNA, 23 nt, Chlamydophila pneumoniae CWL029
augcauuuguuuggaaaugagag

SEQ ID NO: 503524 - RNA, 21 nt, Chlamydophila pneumoniae CWL029
augcaucucuuaaaacaugag

SEQ ID NO: 503525 - RNA, 16 nt, Chlamydophila pneumoniae CWL029
augcaucucuagccaa

SEQ ID NO: 503526 - RNA, 15 nt, Chlamydophila pneumoniae CWL029
augcaucucuuaaaa

SEQ ID NO: 503527 - RNA, 21 nt, Chlamydophila pneumoniae CWL029
augcauagaauaaagauuuua

SEQ ID NO: 503528 - RNA, 18 nt, Chlamydophila pneumoniae CWL029
augcauauugccuucuuc

SEQ ID NO: 503529 - RNA, 13 nt, Chlamydophila pneumoniae CWL029
augcaucaagaga

SEQ ID NO: 503530 - RNA, 19 nt, Chlamydophila pneumoniae CWL029
augcauacguuaacaagga

SEQ ID NO: 503531 - RNA, 15 nt, Chlamydophila pneumoniae CWL029
augcaggccaggaga

SEQ ID NO: 503532 - RNA, 15 nt, Chlamydophila pneumoniae CWL029
auucucagaaagccu

SEQ ID NO: 503533 - RNA, 15 nt, Chlamydophila pneumoniae CWL029
auucucagauugcuu

SEQ ID NO: 503534 - RNA, 17 nt, Chlamydophila pneumoniae CWL029
auucuauaacuacaaaa

SEQ ID NO: 503535 - RNA, 18 nt, Chlamydophila pneumoniae CWL029
auucuaggccuaaagaau

SEQ ID NO: 503536 - RNA, 22 nt, Chlamydophila pneumoniae CWL029
auucuaggggagguaaaauaaa

SEQ ID NO: 503537 - RNA, 20 nt, Chlamydophila pneumoniae CWL029
auucuguauaaacaauaaga

SEQ ID NO: 503538 - RNA, 16 nt, Chlamydophila pneumoniae CWL029
auucuguauaaacaau

SEQ ID NO: 503539 - RNA, 15 nt, Chlamydophila pneumoniae CWL029
auucuccgccagagu

SEQ ID NO: 503540 - RNA, 17 nt, Chlamydophila pneumoniae CWL029
auucuccgccagaguuu

SEQ ID NO: 503541 - RNA, 14 nt, Chlamydophila pneumoniae CWL029
auucuguaauuuug

SEQ ID NO: 503542 - RNA, 13 nt, Chlamydophila pneumoniae CWL029
auucuuaaaaagc

SEQ ID NO: 503543 - RNA, 15 nt, Chlamydophila pneumoniae CWL029
auucuuaaaaagcua

SEQ ID NO: 503544 - RNA, 15 nt, Chlamydophila pneumoniae CWL029
auucuuaacaauaua

SEQ ID NO: 503545 - RNA, 12 nt, Chlamydophila pneumoniae CWL029
auucuuaauaua

SEQ ID NO: 503546 - RNA, 22 nt, Chlamydophila pneumoniae CWL029
auucuucacaaucuaaauaaga

SEQ ID NO: 503547 - RNA, 14 nt, Chlamydophila pneumoniae CWL029
auucuuucgauauc

SEQ ID NO: 503548 - RNA, 18 nt, Chlamydophila pneumoniae CWL029
auucuucagaaucuuugu

SEQ ID NO: 503549 - RNA, 21 nt, Chlamydophila pneumoniae CWL029
auucuuuaugagagagcucuu

SEQ ID NO: 503550 - RNA, 14 nt, Chlamydophila pneumoniae CWL029
auucuuuuccugca

SEQ ID NO: 503551 - RNA, 23 nt, Chlamydophila pneumoniae CWL029
auugaacagucuugcgccagcaa

SEQ ID NO: 503552 - RNA, 21 nt, Chlamydophila pneumoniae CWL029
auugaccugcuuuuuuucuag

SEQ ID NO: 503553 - RNA, 20 nt, Chlamydophila pneumoniae CWL029
auugacuagcucucuugcua

SEQ ID NO: 503554 - RNA, 20 nt, Chlamydophila pneumoniae CWL029
auugaauaucgaguucuuuu

SEQ ID NO: 503555 - RNA, 16 nt, Chlamydophila pneumoniae CWL029
auugaaucccaucaaa

SEQ ID NO: 503556 - RNA, 18 nt, Chlamydophila pneumoniae CWL029
auugaaucccaucaaagg

SEQ ID NO: 503557 - RNA, 21 nt, Chlamydophila pneumoniae CWL029
auugaaucccaucaaaggcaa

SEQ ID NO: 503558 - RNA, 12 nt, Chlamydophila pneumoniae CWL029
auugaguguugu

SEQ ID NO: 503559 - RNA, 23 nt, Chlamydophila pneumoniae CWL029
auugaggacaacagcaacacucg

SEQ ID NO: 503560 - RNA, 16 nt, Chlamydophila pneumoniae CWL029
auugaggauaaguucu

SEQ ID NO: 503561 - RNA, 20 nt, Chlamydophila pneumoniae CWL029
auugaggauaaguucuucca

SEQ ID NO: 503562 - RNA, 14 nt, Chlamydophila pneumoniae CWL029
auugagaauaaaac

SEQ ID NO: 503563 - RNA, 16 nt, Chlamydophila pneumoniae CWL029
auugagaauaaaacuu

SEQ ID NO: 503564 - RNA, 17 nt, Chlamydophila pneumoniae CWL029
auucgauguuaaggcuu

SEQ ID NO: 503565 - RNA, 19 nt, Chlamydophila pneumoniae CWL029
auucgauuccugaggcuau

SEQ ID NO: 503566 - RNA, 16 nt, Chlamydophila pneumoniae CWL029
auucgagauauggaag

SEQ ID NO: 503567 - RNA, 16 nt, Chlamydophila pneumoniae CWL029
auucgacucuccacga

SEQ ID NO: 503568 - RNA, 19 nt, Chlamydophila pneumoniae CWL029
auucgaauucucagaaagc

SEQ ID NO: 503569 - RNA, 20 nt, Chlamydophila pneumoniae CWL029
auuccugaggcuauagaaua

SEQ ID NO: 503570 - RNA, 15 nt, Chlamydophila pneumoniae CWL029
auuccugucauuccu

SEQ ID NO: 503571 - RNA, 23 nt, Chlamydophila pneumoniae CWL029
auuccguacgcuauaaauaauua

SEQ ID NO: 503572 - RNA, 22 nt, Chlamydophila pneumoniae CWL029
auucggcagaaggcuuguuucu

SEQ ID NO: 503573 - RNA, 11 nt, Chlamydophila pneumoniae CWL029
auucuaaaaag

SEQ ID NO: 503574 - RNA, 12 nt, Chlamydophila pneumoniae CWL029
auucuaaaaaga

SEQ ID NO: 503575 - RNA, 15 nt, Chlamydophila pneumoniae CWL029
auucuaaaaagaaaa

SEQ ID NO: 503576 - RNA, 22 nt, Chlamydophila pneumoniae CWL029
auucuaaaucaacuacacuuau

SEQ ID NO: 503577 - RNA, 17 nt, Chlamydophila pneumoniae CWL029
auucuagaccugccaag

SEQ ID NO: 503578 - RNA, 17 nt, Chlamydophila pneumoniae CWL029
auuccucucacauuugc

SEQ ID NO: 503579 - RNA, 14 nt, Chlamydophila pneumoniae CWL029
auuccucuugaucu

SEQ ID NO: 503580 - RNA, 21 nt, Chlamydophila pneumoniae CWL029
auuccgaauugcgaauccuga

SEQ ID NO: 503581 - RNA, 23 nt, Chlamydophila pneumoniae CWL029
auucauaaagaggaaugaagaga

SEQ ID NO: 503582 - RNA, 14 nt, Chlamydophila pneumoniae CWL029
auuccaggcucuag

SEQ ID NO: 503583 - RNA, 17 nt, Chlamydophila pneumoniae CWL029
auuccaggauucuauaa

SEQ ID NO: 503584 - RNA, 23 nt, Chlamydophila pneumoniae CWL029
aaaaguacgaccaacuccucaaa

SEQ ID NO: 503585 - RNA, 21 nt, Chlamydophila pneumoniae CWL029
aaaaguacgaccaacuccuca

SEQ ID NO: 503586 - RNA, 15 nt, Chlamydophila pneumoniae CWL029
auugguaaggagagu

SEQ ID NO: 503587 - RNA, 15 nt, Chlamydophila pneumoniae CWL029
aaaagguuuugaagc

SEQ ID NO: 503588 - RNA, 20 nt, Chlamydophila pneumoniae CWL029
auuggcauagagccuagaga

SEQ ID NO: 503589 - RNA, 20 nt, Chlamydophila pneumoniae CWL029
auuggaauucgcauuuuugg

SEQ ID NO: 503590 - RNA, 12 nt, Chlamydophila pneumoniae CWL029
auuggagucuaa

SEQ ID NO: 503591 - RNA, 13 nt, Chlamydophila pneumoniae CWL029
auuggaucuugau

SEQ ID NO: 503592 - RNA, 20 nt, Chlamydophila pneumoniae CWL029
auuggaucuugauaaaagau

SEQ ID NO: 503593 - RNA, 13 nt, Chlamydophila pneumoniae CWL029
auugauaaugauu

SEQ ID NO: 503594 - RNA, 13 nt, Chlamydophila pneumoniae CWL029
auugaucagaauc

SEQ ID NO: 503595 - RNA, 21 nt, Chlamydophila pneumoniae CWL029
auugcuugcgcaucagcagcu

SEQ ID NO: 503596 - RNA, 18 nt, Chlamydophila pneumoniae CWL029
auugcuacuguccaucca

SEQ ID NO: 503597 - RNA, 20 nt, Chlamydophila pneumoniae CWL029
auugcucguauuagaguuuc

SEQ ID NO: 503598 - RNA, 23 nt, Chlamydophila pneumoniae CWL029
auuuaagauaucgaccuuaaaau

SEQ ID NO: 503599 - RNA, 20 nt, Chlamydophila pneumoniae CWL029
auuguggaacgcauaagaga

SEQ ID NO: 503600 - RNA, 16 nt, Chlamydophila pneumoniae CWL029
auuguuuguaucaaag

SEQ ID NO: 503601 - RNA, 12 nt, Chlamydophila pneumoniae CWL029
auugucuucagu

SEQ ID NO: 503602 - RNA, 20 nt, Chlamydophila pneumoniae CWL029
auuuaggagggguaaaccaa

SEQ ID NO: 503603 - RNA, 18 nt, Chlamydophila pneumoniae CWL029
auuuagaaaucucacugg

SEQ ID NO: 503604 - RNA, 20 nt, Chlamydophila pneumoniae CWL029
auuuacuuuuaauccuuuca

SEQ ID NO: 503605 - RNA, 22 nt, Chlamydophila pneumoniae CWL029
auuuacuuuuaauccuuucaca

SEQ ID NO: 503606 - RNA, 20 nt, Chlamydophila pneumoniae CWL029
auuuacaauuguguuugcag

SEQ ID NO: 503607 - RNA, 15 nt, Chlamydophila pneumoniae CWL029
auuuuuaauuuuucu

SEQ ID NO: 503608 - RNA, 12 nt, Chlamydophila pneumoniae CWL029
auuuuuagaaua

SEQ ID NO: 503609 - RNA, 11 nt, Chlamydophila pneumoniae CWL029
auuuuggugag

SEQ ID NO: 503610 - RNA, 16 nt, Chlamydophila pneumoniae CWL029
auuuuggugagaucau

SEQ ID NO: 503611 - RNA, 21 nt, Chlamydophila pneumoniae CWL029
auuuuguaggaacaugccaaa

SEQ ID NO: 503612 - RNA, 14 nt, Chlamydophila pneumoniae CWL029
auuuugaugcuucu

SEQ ID NO: 503613 - RNA, 17 nt, Chlamydophila pneumoniae CWL029
auuuucuugucucuugc

SEQ ID NO: 503614 - RNA, 17 nt, Chlamydophila pneumoniae CWL029
auuuucacgagcucaca

SEQ ID NO: 503615 - RNA, 18 nt, Chlamydophila pneumoniae CWL029
auuuuaaagucacuuuca

SEQ ID NO: 503616 - RNA, 22 nt, Chlamydophila pneumoniae CWL029
auuuguugucagcuuugcuuau

SEQ ID NO: 503617 - RNA, 18 nt, Chlamydophila pneumoniae CWL029
auuuuaaacuuacagcca

SEQ ID NO: 503618 - RNA, 16 nt, Chlamydophila pneumoniae CWL029
auuuuaaagcaaaaau

SEQ ID NO: 503619 - RNA, 17 nt, Chlamydophila pneumoniae CWL029
auuuuaaagcaaaaauu

SEQ ID NO: 503620 - RNA, 17 nt, Chlamydophila pneumoniae CWL029
auuuuaaagccuccuca

SEQ ID NO: 503621 - RNA, 15 nt, Chlamydophila pneumoniae CWL029
auuuucccaauaucc

SEQ ID NO: 503622 - RNA, 17 nt, Chlamydophila pneumoniae CWL029
auuuucagccugucuau

SEQ ID NO: 503623 - RNA, 17 nt, Chlamydophila pneumoniae CWL029
auuuucaggagaccagg

SEQ ID NO: 503624 - RNA, 20 nt, Chlamydophila pneumoniae CWL029
auuuucaggagaccagggau

SEQ ID NO: 503625 - RNA, 16 nt, Chlamydophila pneumoniae CWL029
auuuucagucguuuag

SEQ ID NO: 503626 - RNA, 21 nt, Chlamydophila pneumoniae CWL029
auuuucucauagcuuccugua

SEQ ID NO: 503627 - RNA, 16 nt, Chlamydophila pneumoniae CWL029
auuuucucuacacaga

SEQ ID NO: 503628 - RNA, 12 nt, Chlamydophila pneumoniae CWL029
caaaaaagagcc

SEQ ID NO: 503629 - RNA, 23 nt, Chlamydophila pneumoniae CWL029
caaaaaauuuuauaggaauaaca

SEQ ID NO: 503630 - RNA, 13 nt, Chlamydophila pneumoniae CWL029
caaaaaacgauga

SEQ ID NO: 503631 - RNA, 17 nt, Chlamydophila pneumoniae CWL029
auuuuuugugaauuuua

SEQ ID NO: 503632 - RNA, 16 nt, Chlamydophila pneumoniae CWL029
auuuuuugagaaauau

SEQ ID NO: 503633 - RNA, 21 nt, Chlamydophila pneumoniae CWL029
auuuuuugagaaauauaaaca

SEQ ID NO: 503634 - RNA, 17 nt, Chlamydophila pneumoniae CWL029
auuuuuuaauaaaauuu

SEQ ID NO: 503635 - RNA, 18 nt, Chlamydophila pneumoniae CWL029
auuuuuuaauaaaauuua

SEQ ID NO: 503636 - RNA, 11 nt, Chlamydophila pneumoniae CWL029
auuuuuucuug

SEQ ID NO: 503637 - RNA, 16 nt, Chlamydophila pneumoniae CWL029
auuuuuguagacaaua

SEQ ID NO: 503638 - RNA, 16 nt, Chlamydophila pneumoniae CWL029
auuuuuauaauauuuu

SEQ ID NO: 503639 - RNA, 13 nt, Chlamydophila pneumoniae CWL029
auuuuuauuuccu

SEQ ID NO: 503640 - RNA, 15 nt, Chlamydophila pneumoniae CWL029
auuuuugcuaaacaa

SEQ ID NO: 503641 - RNA, 18 nt, Chlamydophila pneumoniae CWL029
auuuuugcuaagagcucu

SEQ ID NO: 503642 - RNA, 18 nt, Chlamydophila pneumoniae CWL029
caaaaaguuccauagagu

SEQ ID NO: 503643 - RNA, 15 nt, Chlamydophila pneumoniae CWL029
caaaaaguugaggaa

SEQ ID NO: 503644 - RNA, 16 nt, Chlamydophila pneumoniae CWL029
caaaaaguuucaaucu

SEQ ID NO: 503645 - RNA, 21 nt, Chlamydophila pneumoniae CWL029
caaaaauaaacauauucuccu

SEQ ID NO: 503646 - RNA, 23 nt, Chlamydophila pneumoniae CWL029
caaaaauaaacauauucuccuua

SEQ ID NO: 503647 - RNA, 18 nt, Chlamydophila pneumoniae CWL029
caaaaagcuucuuucuua

SEQ ID NO: 503648 - RNA, 15 nt, Chlamydophila pneumoniae CWL029
caaaaaggacucuuu

SEQ ID NO: 503649 - RNA, 19 nt, Chlamydophila pneumoniae CWL029
caaaaacgauucgaaaaac

SEQ ID NO: 503650 - RNA, 19 nt, Chlamydophila pneumoniae CWL029
caaaaacacugcgcaaaga

SEQ ID NO: 503651 - RNA, 22 nt, Chlamydophila pneumoniae CWL029
caaaaaugauaccaccuaaaau

SEQ ID NO: 503652 - RNA, 17 nt, Chlamydophila pneumoniae CWL029
caaaaauucuucgugag

SEQ ID NO: 503653 - RNA, 12 nt, Chlamydophila pneumoniae CWL029
caaaacaggaau

SEQ ID NO: 503654 - RNA, 20 nt, Chlamydophila pneumoniae CWL029
caaaacagcaucaggauucu

SEQ ID NO: 503655 - RNA, 19 nt, Chlamydophila pneumoniae CWL029
caaaacauaaccuccucuu

SEQ ID NO: 503656 - RNA, 22 nt, Chlamydophila pneumoniae CWL029
auuugcgaaguccuggauuuua

SEQ ID NO: 503657 - RNA, 17 nt, Chlamydophila pneumoniae CWL029
auuugcgacaccuacaa

SEQ ID NO: 503658 - RNA, 22 nt, Chlamydophila pneumoniae CWL029
auuugcauuaccuuaucgccaa

SEQ ID NO: 503659 - RNA, 13 nt, Chlamydophila pneumoniae CWL029
auuugauuuuuca

SEQ ID NO: 503660 - RNA, 16 nt, Chlamydophila pneumoniae CWL029
auuugauuuuucaaau

SEQ ID NO: 503661 - RNA, 19 nt, Chlamydophila pneumoniae CWL029
auuugcaacaaucuuucuu

SEQ ID NO: 503662 - RNA, 23 nt, Chlamydophila pneumoniae CWL029
auuugcaagagccggaacuucag

SEQ ID NO: 503663 - RNA, 20 nt, Chlamydophila pneumoniae CWL029
auuugacguuguguugcaag

SEQ ID NO: 503664 - RNA, 23 nt, Chlamydophila pneumoniae CWL029
auuugaauaguugugagacuuuc

SEQ ID NO: 503665 - RNA, 14 nt, Chlamydophila pneumoniae CWL029
auuucuuucucuuc

SEQ ID NO: 503666 - RNA, 18 nt, Chlamydophila pneumoniae CWL029
auuucuccgucaagaaca

SEQ ID NO: 503667 - RNA, 16 nt, Chlamydophila pneumoniae CWL029
auuucuccaguaucuu

SEQ ID NO: 503668 - RNA, 22 nt, Chlamydophila pneumoniae CWL029
auuucuccgucaagaacaagag

SEQ ID NO: 503669 - RNA, 17 nt, Chlamydophila pneumoniae CWL029
auuugugcgucaucaac

SEQ ID NO: 503670 - RNA, 16 nt, Chlamydophila pneumoniae CWL029
auuugucaucacauca

SEQ ID NO: 503671 - RNA, 17 nt, Chlamydophila pneumoniae CWL029
auuugucaucacaucag

SEQ ID NO: 503672 - RNA, 12 nt, Chlamydophila pneumoniae CWL029
auuugucaucac

SEQ ID NO: 503673 - RNA, 19 nt, Chlamydophila pneumoniae CWL029
auuugucucagcauuuuau

SEQ ID NO: 503674 - RNA, 17 nt, Chlamydophila pneumoniae CWL029
auuugcuauuuucccuu

SEQ ID NO: 503675 - RNA, 23 nt, Chlamydophila pneumoniae CWL029
auuugguaguuuuucagucucga

SEQ ID NO: 503676 - RNA, 18 nt, Chlamydophila pneumoniae CWL029
auuuccugacuauaaaau

SEQ ID NO: 503677 - RNA, 20 nt, Chlamydophila pneumoniae CWL029
auuuccauaggaucugcaug

SEQ ID NO: 503678 - RNA, 21 nt, Chlamydophila pneumoniae CWL029
auuuccuaccuauauuuuuua

SEQ ID NO: 503679 - RNA, 18 nt, Chlamydophila pneumoniae CWL029
auuuccuagguucuuuuc

SEQ ID NO: 503680 - RNA, 16 nt, Chlamydophila pneumoniae CWL029
auuuccaaauucuugc

SEQ ID NO: 503681 - RNA, 15 nt, Chlamydophila pneumoniae CWL029
auuucauuugaaaua

SEQ ID NO: 503682 - RNA, 14 nt, Chlamydophila pneumoniae CWL029
auuucuaacuuaau

SEQ ID NO: 503683 - RNA, 19 nt, Chlamydophila pneumoniae CWL029
auuucuaacuuaauagauu

SEQ ID NO: 503684 - RNA, 22 nt, Chlamydophila pneumoniae CWL029
auuucgauaacacuucuuucuu

SEQ ID NO: 503685 - RNA, 16 nt, Chlamydophila pneumoniae CWL029
auuucuagcuaauaau

SEQ ID NO: 503686 - RNA, 22 nt, Chlamydophila pneumoniae CWL029
auuucuaggacagcacauagag

SEQ ID NO: 503687 - RNA, 19 nt, Chlamydophila pneumoniae CWL029
auuucuauagagcaucaua

SEQ ID NO: 503688 - RNA, 23 nt, Chlamydophila pneumoniae CWL029
auuucaugaauugucaucucaua

SEQ ID NO: 503689 - RNA, 15 nt, Chlamydophila pneumoniae CWL029
auuucauguccucca

SEQ ID NO: 503690 - RNA, 18 nt, Chlamydophila pneumoniae CWL029
auuucauaagagaacuuu

SEQ ID NO: 503691 - RNA, 23 nt, Chlamydophila pneumoniae CWL029
auuuaggaugaauccaaaauaaa

SEQ ID NO: 503692 - RNA, 18 nt, Chlamydophila pneumoniae CWL029
auuuaggucgacuuccuu

SEQ ID NO: 503693 - RNA, 15 nt, Chlamydophila pneumoniae CWL029
aaaauaucacauucc

SEQ ID NO: 503694 - RNA, 16 nt, Chlamydophila pneumoniae CWL029
aaaauaucaccuacau

SEQ ID NO: 503695 - RNA, 16 nt, Chlamydophila pneumoniae CWL029
cacguaggcauacagu

SEQ ID NO: 503696 - RNA, 21 nt, Chlamydophila pneumoniae CWL029
cacguaggcauacaguagaaa

SEQ ID NO: 503697 - RNA, 13 nt, Chlamydophila pneumoniae CWL029
cacguaagguguc

SEQ ID NO: 503698 - RNA, 23 nt, Chlamydophila pneumoniae CWL029
cacgcuugugguuagaggaagca

SEQ ID NO: 503699 - RNA, 14 nt, Chlamydophila pneumoniae CWL029
cacggacuccgucu

SEQ ID NO: 503700 - RNA, 21 nt, Chlamydophila pneumoniae CWL029
cacgcacaaacuaacauagau

SEQ ID NO: 503701 - RNA, 14 nt, Chlamydophila pneumoniae CWL029
cacgccaaaguacu

SEQ ID NO: 503702 - RNA, 14 nt, Chlamydophila pneumoniae CWL029
cacgacgucaucac

SEQ ID NO: 503703 - RNA, 21 nt, Chlamydophila pneumoniae CWL029
cacgaccuauaccaucuuuaa

SEQ ID NO: 503704 - RNA, 19 nt, Chlamydophila pneumoniae CWL029
caccuugaaguuuuuucuc

SEQ ID NO: 503705 - RNA, 13 nt, Chlamydophila pneumoniae CWL029
caccucuucucua

SEQ ID NO: 503706 - RNA, 21 nt, Chlamydophila pneumoniae CWL029
caccugaagagcgcuauugcu

SEQ ID NO: 503707 - RNA, 12 nt, Chlamydophila pneumoniae CWL029
cacccugacagg

SEQ ID NO: 503708 - RNA, 15 nt, Chlamydophila pneumoniae CWL029
cacccgcaagcacuu

SEQ ID NO: 503709 - RNA, 22 nt, Chlamydophila pneumoniae CWL029
cacccaaacugaugccaagaaa

SEQ ID NO: 503710 - RNA, 22 nt, Chlamydophila pneumoniae CWL029
caccgcgcauagcaacuacaga

SEQ ID NO: 503711 - RNA, 14 nt, Chlamydophila pneumoniae CWL029
aaaaguugaggaaa

SEQ ID NO: 503712 - RNA, 19 nt, Chlamydophila pneumoniae CWL029
caccagaagcaacuaaacu

SEQ ID NO: 503713 - RNA, 18 nt, Chlamydophila pneumoniae CWL029
aaaaguugaggaaaggag

SEQ ID NO: 503714 - RNA, 22 nt, Chlamydophila pneumoniae CWL029
aaaaguugccuaaagagauaua

SEQ ID NO: 503715 - RNA, 14 nt, Chlamydophila pneumoniae CWL029
aaaaguugucuuug

SEQ ID NO: 503716 - RNA, 13 nt, Chlamydophila pneumoniae CWL029
aaaaguuucaauc

SEQ ID NO: 503717 - RNA, 22 nt, Chlamydophila pneumoniae CWL029
aaaaguuuuuguucauccagaa

SEQ ID NO: 503718 - RNA, 22 nt, Chlamydophila pneumoniae CWL029
caccauauccaugacuuuuguu

SEQ ID NO: 503719 - RNA, 19 nt, Chlamydophila pneumoniae CWL029
caccaucacauccuguagu

SEQ ID NO: 503720 - RNA, 15 nt, Chlamydophila pneumoniae CWL029
caccagguccuucug

SEQ ID NO: 503721 - RNA, 18 nt, Chlamydophila pneumoniae CWL029
caccagggguuucuaaau

SEQ ID NO: 503722 - RNA, 21 nt, Chlamydophila pneumoniae CWL029
caccauccaaagcuauuucuc

SEQ ID NO: 503723 - RNA, 17 nt, Chlamydophila pneumoniae CWL029
caccaaugauaauuuca

SEQ ID NO: 503724 - RNA, 19 nt, Chlamydophila pneumoniae CWL029
caccaaugauaauuucauu

SEQ ID NO: 503725 - RNA, 13 nt, Chlamydophila pneumoniae CWL029
cacauaaaauaau

SEQ ID NO: 503726 - RNA, 17 nt, Chlamydophila pneumoniae CWL029
cacauaaagaucuuuau

SEQ ID NO: 503727 - RNA, 17 nt, Chlamydophila pneumoniae CWL029
cacauacaguacgcaaa

SEQ ID NO: 503728 - RNA, 17 nt, Chlamydophila pneumoniae CWL029
cacaucuccuuucaaga

SEQ ID NO: 503729 - RNA, 16 nt, Chlamydophila pneumoniae CWL029
cacaucuuuagaauca

SEQ ID NO: 503730 - RNA, 15 nt, Chlamydophila pneumoniae CWL029
cacaugacaaauaaa

SEQ ID NO: 503731 - RNA, 21 nt, Chlamydophila pneumoniae CWL029
cacaugacaaauaaacugacg

SEQ ID NO: 503732 - RNA, 14 nt, Chlamydophila pneumoniae CWL029
cacauucuucugau

SEQ ID NO: 503733 - RNA, 19 nt, Chlamydophila pneumoniae CWL029
cacauugcgggcucaaaga

SEQ ID NO: 503734 - RNA, 23 nt, Chlamydophila pneumoniae CWL029
cacauuguuuaaguccuucuucc

SEQ ID NO: 503735 - RNA, 13 nt, Chlamydophila pneumoniae CWL029
caccaagggaugc

SEQ ID NO: 503736 - RNA, 21 nt, Chlamydophila pneumoniae CWL029
cacagagaacaauaaacgaga

SEQ ID NO: 503737 - RNA, 14 nt, Chlamydophila pneumoniae CWL029
cacagagaauugca

SEQ ID NO: 503738 - RNA, 18 nt, Chlamydophila pneumoniae CWL029
cacagagaugcuucuaaa

SEQ ID NO: 503739 - RNA, 22 nt, Chlamydophila pneumoniae CWL029
cacagagaugcuucuaaacaau

SEQ ID NO: 503740 - RNA, 18 nt, Chlamydophila pneumoniae CWL029
cacaggaaugaaaccuuc

SEQ ID NO: 503741 - RNA, 15 nt, Chlamydophila pneumoniae CWL029
cacagugacacgcuu

SEQ ID NO: 503742 - RNA, 20 nt, Chlamydophila pneumoniae CWL029
cacaguauuccaucacaguu

SEQ ID NO: 503743 - RNA, 19 nt, Chlamydophila pneumoniae CWL029
cacaggggaacgcucucua

SEQ ID NO: 503744 - RNA, 20 nt, Chlamydophila pneumoniae CWL029
cacaggggaacgcucucuag

SEQ ID NO: 503745 - RNA, 14 nt, Chlamydophila pneumoniae CWL029
cacaaauucaccaa

SEQ ID NO: 503746 - RNA, 18 nt, Chlamydophila pneumoniae CWL029
cacaauuguaaauacaaa

SEQ ID NO: 503747 - RNA, 17 nt, Chlamydophila pneumoniae CWL029
cacaauuguaaauacaa

SEQ ID NO: 503748 - RNA, 16 nt, Chlamydophila pneumoniae CWL029
cacaauuuuaaaaucu

SEQ ID NO: 503749 - RNA, 13 nt, Chlamydophila pneumoniae CWL029
cacacuccauuuc

SEQ ID NO: 503750 - RNA, 22 nt, Chlamydophila pneumoniae CWL029
cacacugcuuacaauugaaaau

SEQ ID NO: 503751 - RNA, 22 nt, Chlamydophila pneumoniae CWL029
caauugaaucagauuagaguua

SEQ ID NO: 503752 - RNA, 15 nt, Chlamydophila pneumoniae CWL029
caauugaaucagauu

SEQ ID NO: 503753 - RNA, 17 nt, Chlamydophila pneumoniae CWL029
caauugagccucgauuu

SEQ ID NO: 503754 - RNA, 18 nt, Chlamydophila pneumoniae CWL029
caauuagagauucauaaa

SEQ ID NO: 503755 - RNA, 18 nt, Chlamydophila pneumoniae CWL029
caauuaugcccaaggaaa

SEQ ID NO: 503756 - RNA, 21 nt, Chlamydophila pneumoniae CWL029
caauuaugcccaaggaaaaac

SEQ ID NO: 503757 - RNA, 16 nt, Chlamydophila pneumoniae CWL029
caauuaaaaaauuauc

SEQ ID NO: 503758 - RNA, 16 nt, Chlamydophila pneumoniae CWL029
cacaaagaauucagag

SEQ ID NO: 503759 - RNA, 19 nt, Chlamydophila pneumoniae CWL029
cacaaagaauucagagaaa

SEQ ID NO: 503760 - RNA, 19 nt, Chlamydophila pneumoniae CWL029
cacaaacaacagaaauguu

SEQ ID NO: 503761 - RNA, 12 nt, Chlamydophila pneumoniae CWL029
cacaaaauaaaa

SEQ ID NO: 503762 - RNA, 17 nt, Chlamydophila pneumoniae CWL029
caauuuuuauaauauuu

SEQ ID NO: 503763 - RNA, 21 nt, Chlamydophila pneumoniae CWL029
caauuuuuguagacaauacca

SEQ ID NO: 503764 - RNA, 21 nt, Chlamydophila pneumoniae CWL029
cacaaaaagcuuuuuucucuu

SEQ ID NO: 503765 - RNA, 23 nt, Chlamydophila pneumoniae CWL029
caauuuguuucuucugugcauca

SEQ ID NO: 503766 - RNA, 23 nt, Chlamydophila pneumoniae CWL029
caauuuucuucagcacuuuuauu

SEQ ID NO: 503767 - RNA, 22 nt, Chlamydophila pneumoniae CWL029
caauaacaugcgcagaauaaaa

SEQ ID NO: 503768 - RNA, 22 nt, Chlamydophila pneumoniae CWL029
caauaaccaggggcuuuccuuc

SEQ ID NO: 503769 - RNA, 18 nt, Chlamydophila pneumoniae CWL029
caauaaccagaagacucc

SEQ ID NO: 503770 - RNA, 21 nt, Chlamydophila pneumoniae CWL029
caauaaccgaaacuucucaga

SEQ ID NO: 503771 - RNA, 23 nt, Chlamydophila pneumoniae CWL029
caauaaucggccgaguuucuccg

SEQ ID NO: 503772 - RNA, 18 nt, Chlamydophila pneumoniae CWL029
caaguaccuucucgucau

SEQ ID NO: 503773 - RNA, 21 nt, Chlamydophila pneumoniae CWL029
caaguuguugauaauuacaga

SEQ ID NO: 503774 - RNA, 18 nt, Chlamydophila pneumoniae CWL029
caauaaauccaaaaaaug

SEQ ID NO: 503775 - RNA, 18 nt, Chlamydophila pneumoniae CWL029
caauaaaucuauuccccu

SEQ ID NO: 503776 - RNA, 19 nt, Chlamydophila pneumoniae CWL029
caauaguguaacauugacc

SEQ ID NO: 503777 - RNA, 15 nt, Chlamydophila pneumoniae CWL029
caauaguaaagcauu

SEQ ID NO: 503778 - RNA, 12 nt, Chlamydophila pneumoniae CWL029
caauagcuucca

SEQ ID NO: 503779 - RNA, 18 nt, Chlamydophila pneumoniae CWL029
caauaggaauuagagaaa

SEQ ID NO: 503780 - RNA, 16 nt, Chlamydophila pneumoniae CWL029
caauagccaaagacuc

SEQ ID NO: 503781 - RNA, 19 nt, Chlamydophila pneumoniae CWL029
caauagcaauggcuuuuuu

SEQ ID NO: 503782 - RNA, 18 nt, Chlamydophila pneumoniae CWL029
caauagaagcuuguugag

SEQ ID NO: 503783 - RNA, 23 nt, Chlamydophila pneumoniae CWL029
caauaccagauaaagcaaagaua

SEQ ID NO: 503784 - RNA, 16 nt, Chlamydophila pneumoniae CWL029
caauacccuaucuauu

SEQ ID NO: 503785 - RNA, 19 nt, Chlamydophila pneumoniae CWL029
caauacucuguuuguaguc

SEQ ID NO: 503786 - RNA, 12 nt, Chlamydophila pneumoniae CWL029
caaugcgauacg

SEQ ID NO: 503787 - RNA, 16 nt, Chlamydophila pneumoniae CWL029
caaugcagcuaacgaa

SEQ ID NO: 503788 - RNA, 12 nt, Chlamydophila pneumoniae CWL029
caaugaagaaaa

SEQ ID NO: 503789 - RNA, 15 nt, Chlamydophila pneumoniae CWL029
caaugaaggccaaga

SEQ ID NO: 503790 - RNA, 14 nt, Chlamydophila pneumoniae CWL029
caaucuuucuucua

SEQ ID NO: 503791 - RNA, 10 nt, Chlamydophila pneumoniae CWL029
caaucuuuga

SEQ ID NO: 503792 - RNA, 23 nt, Chlamydophila pneumoniae CWL029
caaucuuugaucgcuugugcaug

SEQ ID NO: 503793 - RNA, 19 nt, Chlamydophila pneumoniae CWL029
caaucuugagcauccaaaa

SEQ ID NO: 503794 - RNA, 15 nt, Chlamydophila pneumoniae CWL029
caaugauaauuucau

SEQ ID NO: 503795 - RNA, 15 nt, Chlamydophila pneumoniae CWL029
caaugauauaaaagc

SEQ ID NO: 503796 - RNA, 16 nt, Chlamydophila pneumoniae CWL029
caaugauauaaaagcu

SEQ ID NO: 503797 - RNA, 14 nt, Chlamydophila pneumoniae CWL029
caaugauuucucua

SEQ ID NO: 503798 - RNA, 19 nt, Chlamydophila pneumoniae CWL029
caauccuauggcagcagga

SEQ ID NO: 503799 - RNA, 19 nt, Chlamydophila pneumoniae CWL029
caaucucgcuauuccauaa

SEQ ID NO: 503800 - RNA, 20 nt, Chlamydophila pneumoniae CWL029
caaucucgcuauuccauaaa

SEQ ID NO: 503801 - RNA, 19 nt, Chlamydophila pneumoniae CWL029
caaucucuagggauaauua

SEQ ID NO: 503802 - RNA, 15 nt, Chlamydophila pneumoniae CWL029
caaucucuagggaua

SEQ ID NO: 503803 - RNA, 20 nt, Chlamydophila pneumoniae CWL029
caagguguugauuucgugaa

SEQ ID NO: 503804 - RNA, 15 nt, Chlamydophila pneumoniae CWL029
caagguaacauccau

SEQ ID NO: 503805 - RNA, 16 nt, Chlamydophila pneumoniae CWL029
caagguaacauccaua

SEQ ID NO: 503806 - RNA, 15 nt, Chlamydophila pneumoniae CWL029
caagguacuuuauag

SEQ ID NO: 503807 - RNA, 15 nt, Chlamydophila pneumoniae CWL029
caagggaagagaaaa

SEQ ID NO: 503808 - RNA, 18 nt, Chlamydophila pneumoniae CWL029
caagggagaggucugcuc

SEQ ID NO: 503809 - RNA, 18 nt, Chlamydophila pneumoniae CWL029
caaggccuaaucuuguag

SEQ ID NO: 503810 - RNA, 23 nt, Chlamydophila pneumoniae CWL029
caaggcgaguguagauuauugau

SEQ ID NO: 503811 - RNA, 17 nt, Chlamydophila pneumoniae CWL029
caaggcgccuaacaacu

SEQ ID NO: 503812 - RNA, 15 nt, Chlamydophila pneumoniae CWL029
caaggaacauuugag

SEQ ID NO: 503813 - RNA, 23 nt, Chlamydophila pneumoniae CWL029
caaggaagccugcggcaaguauc

SEQ ID NO: 503814 - RNA, 15 nt, Chlamydophila pneumoniae CWL029
caaggaaaaaaaauc

SEQ ID NO: 503815 - RNA, 16 nt, Chlamydophila pneumoniae CWL029
caaggaaaaaaaaucu

SEQ ID NO: 503816 - RNA, 17 nt, Chlamydophila pneumoniae CWL029
caaggaaaaacaaaccu

SEQ ID NO: 503817 - RNA, 16 nt, Chlamydophila pneumoniae CWL029
caaggagagaaaauau

SEQ ID NO: 503818 - RNA, 22 nt, Chlamydophila pneumoniae CWL029
caagaguuucgaauucaaugag

SEQ ID NO: 503819 - RNA, 23 nt, Chlamydophila pneumoniae CWL029
caagauucucacucuaugagaac

SEQ ID NO: 503820 - RNA, 17 nt, Chlamydophila pneumoniae CWL029
caagauuaugaugccuc

SEQ ID NO: 503821 - RNA, 22 nt, Chlamydophila pneumoniae CWL029
caagauucucagcuucaucaga

SEQ ID NO: 503822 - RNA, 15 nt, Chlamydophila pneumoniae CWL029
caagaggucgaagau

SEQ ID NO: 503823 - RNA, 21 nt, Chlamydophila pneumoniae CWL029
caagaggucgaagauucaaag

SEQ ID NO: 503824 - RNA, 16 nt, Chlamydophila pneumoniae CWL029
caagagcuugucuucc

SEQ ID NO: 503825 - RNA, 17 nt, Chlamydophila pneumoniae CWL029
caagagcucuugagaaa

SEQ ID NO: 503826 - RNA, 21 nt, Chlamydophila pneumoniae CWL029
caagcaacugauguuuuauag

SEQ ID NO: 503827 - RNA, 13 nt, Chlamydophila pneumoniae CWL029
caagcaaggaaaa

SEQ ID NO: 503828 - RNA, 15 nt, Chlamydophila pneumoniae CWL029
caagcaaggaaaaaa

SEQ ID NO: 503829 - RNA, 15 nt, Chlamydophila pneumoniae CWL029
caagacuauagaaaa

SEQ ID NO: 503830 - RNA, 19 nt, Chlamydophila pneumoniae CWL029
caagacuauagaaaaggau

SEQ ID NO: 503831 - RNA, 20 nt, Chlamydophila pneumoniae CWL029
caagacuauagaaaaggaug

SEQ ID NO: 503832 - RNA, 16 nt, Chlamydophila pneumoniae CWL029
caagacgcggaacucu

SEQ ID NO: 503833 - RNA, 17 nt, Chlamydophila pneumoniae CWL029
caagacuacgacagaag

SEQ ID NO: 503834 - RNA, 22 nt, Chlamydophila pneumoniae CWL029
caagaagaugauuggacaagug

SEQ ID NO: 503835 - RNA, 21 nt, Chlamydophila pneumoniae CWL029
caagacgaaagcacauaagau

SEQ ID NO: 503836 - RNA, 12 nt, Chlamydophila pneumoniae CWL029
caagacgacacu

SEQ ID NO: 503837 - RNA, 14 nt, Chlamydophila pneumoniae CWL029
caagacgagaacau

SEQ ID NO: 503838 - RNA, 19 nt, Chlamydophila pneumoniae CWL029
caagaaauucuucccaggu

SEQ ID NO: 503839 - RNA, 16 nt, Chlamydophila pneumoniae CWL029
caagaacaauaaguag

SEQ ID NO: 503840 - RNA, 14 nt, Chlamydophila pneumoniae CWL029
caagaacugaagag

SEQ ID NO: 503841 - RNA, 18 nt, Chlamydophila pneumoniae CWL029
caagaacaguuugcucug

SEQ ID NO: 503842 - RNA, 14 nt, Chlamydophila pneumoniae CWL029
caagaacauaaccu

SEQ ID NO: 503843 - RNA, 22 nt, Chlamydophila pneumoniae CWL029
caagaacauaaccucggucucg

SEQ ID NO: 503844 - RNA, 16 nt, Chlamydophila pneumoniae CWL029
caagaaaauaucaccu

SEQ ID NO: 503845 - RNA, 14 nt, Chlamydophila pneumoniae CWL029
caacuucuccaacu

SEQ ID NO: 503846 - RNA, 14 nt, Chlamydophila pneumoniae CWL029
caacuucugacaau

SEQ ID NO: 503847 - RNA, 14 nt, Chlamydophila pneumoniae CWL029
caacuucuucguua

SEQ ID NO: 503848 - RNA, 16 nt, Chlamydophila pneumoniae CWL029
caacuaaagcauacuu

SEQ ID NO: 503849 - RNA, 20 nt, Chlamydophila pneumoniae CWL029
caacuaaacgagcuguccag

SEQ ID NO: 503850 - RNA, 13 nt, Chlamydophila pneumoniae CWL029
caacuaaagcaua

SEQ ID NO: 503851 - RNA, 13 nt, Chlamydophila pneumoniae CWL029
caacuccucaaaa

SEQ ID NO: 503852 - RNA, 19 nt, Chlamydophila pneumoniae CWL029
caacgaucgucaguaaaac

SEQ ID NO: 503853 - RNA, 19 nt, Chlamydophila pneumoniae CWL029
caacgcaugacgcuuuucc

SEQ ID NO: 503854 - RNA, 22 nt, Chlamydophila pneumoniae CWL029
caaccuucgauuccaggcucua

SEQ ID NO: 503855 - RNA, 16 nt, Chlamydophila pneumoniae CWL029
caaccuuuccuaaaau

SEQ ID NO: 503856 - RNA, 20 nt, Chlamydophila pneumoniae CWL029
caaccgccuuuauauaaagg

SEQ ID NO: 503857 - RNA, 15 nt, Chlamydophila pneumoniae CWL029
caacccgaauuccuc

SEQ ID NO: 503858 - RNA, 22 nt, Chlamydophila pneumoniae CWL029
caacauacaccccaguuucuug

SEQ ID NO: 503859 - RNA, 19 nt, Chlamydophila pneumoniae CWL029
caacauaacaugagaaaua

SEQ ID NO: 503860 - RNA, 20 nt, Chlamydophila pneumoniae CWL029
caacauaacaugagaaauac

SEQ ID NO: 503861 - RNA, 23 nt, Chlamydophila pneumoniae CWL029
caaccaaaaugcauuugccccua

SEQ ID NO: 503862 - RNA, 13 nt, Chlamydophila pneumoniae CWL029
caacaucaaagaa

SEQ ID NO: 503863 - RNA, 16 nt, Chlamydophila pneumoniae CWL029
caacauuuugccuuua

SEQ ID NO: 503864 - RNA, 15 nt, Chlamydophila pneumoniae CWL029
caaauucaaaauaga

SEQ ID NO: 503865 - RNA, 16 nt, Chlamydophila pneumoniae CWL029
caaauucaaaauagaa

SEQ ID NO: 503866 - RNA, 14 nt, Chlamydophila pneumoniae CWL029
caaauucaaccaaa

SEQ ID NO: 503867 - RNA, 12 nt, Chlamydophila pneumoniae CWL029
caaauugagaaa

SEQ ID NO: 503868 - RNA, 17 nt, Chlamydophila pneumoniae CWL029
caaauugcaauuuucua

SEQ ID NO: 503869 - RNA, 22 nt, Chlamydophila pneumoniae CWL029
caaauuaccuugagacaaagaa

SEQ ID NO: 503870 - RNA, 19 nt, Chlamydophila pneumoniae CWL029
caaaugcagucucaggaaa

SEQ ID NO: 503871 - RNA, 15 nt, Chlamydophila pneumoniae CWL029
caaauaggagagcac

SEQ ID NO: 503872 - RNA, 21 nt, Chlamydophila pneumoniae CWL029
caaauaggaucucucuuuccu

SEQ ID NO: 503873 - RNA, 14 nt, Chlamydophila pneumoniae CWL029
caaauagauuuuua

SEQ ID NO: 503874 - RNA, 22 nt, Chlamydophila pneumoniae CWL029
caacaaguucuuggaaaaaagg

SEQ ID NO: 503875 - RNA, 18 nt, Chlamydophila pneumoniae CWL029
caacaagggaaagaaacu

SEQ ID NO: 503876 - RNA, 21 nt, Chlamydophila pneumoniae CWL029
caacaagcugcugagcagcaa

SEQ ID NO: 503877 - RNA, 14 nt, Chlamydophila pneumoniae CWL029
caacagaaauguug

SEQ ID NO: 503878 - RNA, 16 nt, Chlamydophila pneumoniae CWL029
caacacgcacaaacua

SEQ ID NO: 503879 - RNA, 22 nt, Chlamydophila pneumoniae CWL029
caacacggacacuauuaucugc

SEQ ID NO: 503880 - RNA, 24 nt, Chlamydophila pneumoniae CWL029
caacacgucacuggggcauaagaa

SEQ ID NO: 503881 - RNA, 13 nt, Chlamydophila pneumoniae CWL029
caacaccucccac

SEQ ID NO: 503882 - RNA, 19 nt, Chlamydophila pneumoniae CWL029
caaacccugggcucacucu

SEQ ID NO: 503883 - RNA, 21 nt, Chlamydophila pneumoniae CWL029
caaacccugggcucacucuaa

SEQ ID NO: 503884 - RNA, 20 nt, Chlamydophila pneumoniae CWL029
caaacccucuccagaagucg

SEQ ID NO: 503885 - RNA, 21 nt, Chlamydophila pneumoniae CWL029
caaacccauauuugaauaaag

SEQ ID NO: 503886 - RNA, 18 nt, Chlamydophila pneumoniae CWL029
caaacgcaaugauuucuc

SEQ ID NO: 503887 - RNA, 21 nt, Chlamydophila pneumoniae CWL029
caaacgcaaugauuucucuaa

SEQ ID NO: 503888 - RNA, 12 nt, Chlamydophila pneumoniae CWL029
caaacaucaaag

SEQ ID NO: 503889 - RNA, 15 nt, Chlamydophila pneumoniae CWL029
caaacaucaaagaga

SEQ ID NO: 503890 - RNA, 22 nt, Chlamydophila pneumoniae CWL029
caaacauggacaauauagagau

SEQ ID NO: 503891 - RNA, 21 nt, Chlamydophila pneumoniae CWL029
caaacagauuuuucaagaacu

SEQ ID NO: 503892 - RNA, 14 nt, Chlamydophila pneumoniae CWL029
caaaauuuaaauau

SEQ ID NO: 503893 - RNA, 19 nt, Chlamydophila pneumoniae CWL029
caaaauuucuuauaaaaaa

SEQ ID NO: 503894 - RNA, 21 nt, Chlamydophila pneumoniae CWL029
caaaauccacauccuuguaga

SEQ ID NO: 503895 - RNA, 19 nt, Chlamydophila pneumoniae CWL029
caaaaguuuugaggauuuc

SEQ ID NO: 503896 - RNA, 24 nt, Chlamydophila pneumoniae CWL029
caaaauaaaaaaacccucaaagaa

SEQ ID NO: 503897 - RNA, 17 nt, Chlamydophila pneumoniae CWL029
caaaauaaaaaaacccu

SEQ ID NO: 503898 - RNA, 13 nt, Chlamydophila pneumoniae CWL029
caaauaaggcugc

SEQ ID NO: 503899 - RNA, 21 nt, Chlamydophila pneumoniae CWL029
caaauaaguccuguuugaaaa

SEQ ID NO: 503900 - RNA, 21 nt, Chlamydophila pneumoniae CWL029
caaauaaggcugcuaucaaca

SEQ ID NO: 503901 - RNA, 16 nt, Chlamydophila pneumoniae CWL029
caaauaaagcaacugu

SEQ ID NO: 503902 - RNA, 12 nt, Chlamydophila pneumoniae CWL029
caaauaaaacaa

SEQ ID NO: 503903 - RNA, 15 nt, Chlamydophila pneumoniae CWL029
caaagaguuuuuuag

SEQ ID NO: 503904 - RNA, 22 nt, Chlamydophila pneumoniae CWL029
caaagagucucuugcuuuugua

SEQ ID NO: 503905 - RNA, 14 nt, Chlamydophila pneumoniae CWL029
caaacugaucugaa

SEQ ID NO: 503906 - RNA, 16 nt, Chlamydophila pneumoniae CWL029
caaacugaucugaaau

SEQ ID NO: 503907 - RNA, 17 nt, Chlamydophila pneumoniae CWL029
caaacugaugccaagaa

SEQ ID NO: 503908 - RNA, 22 nt, Chlamydophila pneumoniae CWL029
caaacugauuaguuuguuuuaa

SEQ ID NO: 503909 - RNA, 22 nt, Chlamydophila pneumoniae CWL029
caaacuccccaguuuuccaucc

SEQ ID NO: 503910 - RNA, 19 nt, Chlamydophila pneumoniae CWL029
caaagcaucuuguauugcu

SEQ ID NO: 503911 - RNA, 17 nt, Chlamydophila pneumoniae CWL029
caaagcucuccuucaga

SEQ ID NO: 503912 - RNA, 20 nt, Chlamydophila pneumoniae CWL029
caaagcgucuaucuagauuu

SEQ ID NO: 503913 - RNA, 20 nt, Chlamydophila pneumoniae CWL029
caaagcuauuucucuaucau

SEQ ID NO: 503914 - RNA, 15 nt, Chlamydophila pneumoniae CWL029
cagaugauuuuaucu

SEQ ID NO: 503915 - RNA, 12 nt, Chlamydophila pneumoniae CWL029
cagaugauuuua

SEQ ID NO: 503916 - RNA, 16 nt, Chlamydophila pneumoniae CWL029
cagaucugcauaauuu

SEQ ID NO: 503917 - RNA, 13 nt, Chlamydophila pneumoniae CWL029
aaaaugaaagaaa

SEQ ID NO: 503918 - RNA, 13 nt, Chlamydophila pneumoniae CWL029
cagauuagaguua

SEQ ID NO: 503919 - RNA, 18 nt, Chlamydophila pneumoniae CWL029
cagauuagaguuagaugu

SEQ ID NO: 503920 - RNA, 16 nt, Chlamydophila pneumoniae CWL029
cagauuguucaaaaau

SEQ ID NO: 503921 - RNA, 19 nt, Chlamydophila pneumoniae CWL029
cagaugcuucaaggcaucu

SEQ ID NO: 503922 - RNA, 14 nt, Chlamydophila pneumoniae CWL029
cagaugcuucaagg

SEQ ID NO: 503923 - RNA, 18 nt, Chlamydophila pneumoniae CWL029
aaaaucugcuauaaccaa

SEQ ID NO: 503924 - RNA, 20 nt, Chlamydophila pneumoniae CWL029
aaaaucugcuauaaccaacu

SEQ ID NO: 503925 - RNA, 16 nt, Chlamydophila pneumoniae CWL029
cagauguuuucguaaa

SEQ ID NO: 503926 - RNA, 21 nt, Chlamydophila pneumoniae CWL029
aaaaucuccucucucaauaag

SEQ ID NO: 503927 - RNA, 15 nt, Chlamydophila pneumoniae CWL029
cagauguaaaugcuc

SEQ ID NO: 503928 - RNA, 17 nt, Chlamydophila pneumoniae CWL029
cagcaaccuuuccuaaa

SEQ ID NO: 503929 - RNA, 19 nt, Chlamydophila pneumoniae CWL029
cagcaacaucguuaauaua

SEQ ID NO: 503930 - RNA, 16 nt, Chlamydophila pneumoniae CWL029
cagagacuuccucuuc

SEQ ID NO: 503931 - RNA, 14 nt, Chlamydophila pneumoniae CWL029
cagagaccuucucu

SEQ ID NO: 503932 - RNA, 17 nt, Chlamydophila pneumoniae CWL029
cagagaccuucucuuca

SEQ ID NO: 503933 - RNA, 14 nt, Chlamydophila pneumoniae CWL029
cagagagaacagga

SEQ ID NO: 503934 - RNA, 11 nt, Chlamydophila pneumoniae CWL029
cagaggagccu

SEQ ID NO: 503935 - RNA, 14 nt, Chlamydophila pneumoniae CWL029
cagaggagccucca

SEQ ID NO: 503936 - RNA, 13 nt, Chlamydophila pneumoniae CWL029
cagagucugggau

SEQ ID NO: 503937 - RNA, 22 nt, Chlamydophila pneumoniae CWL029
cagagucugggauguucaaagc

SEQ ID NO: 503938 - RNA, 18 nt, Chlamydophila pneumoniae CWL029
cagaguggucauugccuu

SEQ ID NO: 503939 - RNA, 19 nt, Chlamydophila pneumoniae CWL029
cagagcauucgauuuguaa

SEQ ID NO: 503940 - RNA, 16 nt, Chlamydophila pneumoniae CWL029
cagagcauaggguuuc

SEQ ID NO: 503941 - RNA, 17 nt, Chlamydophila pneumoniae CWL029
cagagcuucuaaaaacu

SEQ ID NO: 503942 - RNA, 18 nt, Chlamydophila pneumoniae CWL029
cagagcuucuaaaaacuc

SEQ ID NO: 503943 - RNA, 16 nt, Chlamydophila pneumoniae CWL029
cagaggaaucuaagaa

SEQ ID NO: 503944 - RNA, 18 nt, Chlamydophila pneumoniae CWL029
cagagaauguucccaaau

SEQ ID NO: 503945 - RNA, 22 nt, Chlamydophila pneumoniae CWL029
cagagaauugcauucuuaauag

SEQ ID NO: 503946 - RNA, 15 nt, Chlamydophila pneumoniae CWL029
cagagaaauucaugc

SEQ ID NO: 503947 - RNA, 18 nt, Chlamydophila pneumoniae CWL029
cagacuucguaucuucga

SEQ ID NO: 503948 - RNA, 16 nt, Chlamydophila pneumoniae CWL029
cagacuugaggaaucu

SEQ ID NO: 503949 - RNA, 15 nt, Chlamydophila pneumoniae CWL029
cagacacaaaaagcu

SEQ ID NO: 503950 - RNA, 14 nt, Chlamydophila pneumoniae CWL029
cagaauuguuuugu

SEQ ID NO: 503951 - RNA, 13 nt, Chlamydophila pneumoniae CWL029
cagacaagacacu

SEQ ID NO: 503952 - RNA, 17 nt, Chlamydophila pneumoniae CWL029
cagacaagcaaggaaaa

SEQ ID NO: 503953 - RNA, 17 nt, Chlamydophila pneumoniae CWL029
cagacagucugugagaa

SEQ ID NO: 503954 - RNA, 21 nt, Chlamydophila pneumoniae CWL029
cagaagcaacuaaacucucca

SEQ ID NO: 503955 - RNA, 18 nt, Chlamydophila pneumoniae CWL029
cagaaauugcuucuucca

SEQ ID NO: 503956 - RNA, 15 nt, Chlamydophila pneumoniae CWL029
cagaaaugggcaaca

SEQ ID NO: 503957 - RNA, 15 nt, Chlamydophila pneumoniae CWL029
cagaaaugucgugug

SEQ ID NO: 503958 - RNA, 14 nt, Chlamydophila pneumoniae CWL029
cagaaaaagaacau

SEQ ID NO: 503959 - RNA, 15 nt, Chlamydophila pneumoniae CWL029
cacuuucugauguga

SEQ ID NO: 503960 - RNA, 17 nt, Chlamydophila pneumoniae CWL029
cacuuucuuuuuuaauc

SEQ ID NO: 503961 - RNA, 20 nt, Chlamydophila pneumoniae CWL029
cacgucuaagaaucguucuu

SEQ ID NO: 503962 - RNA, 15 nt, Chlamydophila pneumoniae CWL029
cagccucuucucuac

SEQ ID NO: 503963 - RNA, 20 nt, Chlamydophila pneumoniae CWL029
cagccggagcuucuaagauc

SEQ ID NO: 503964 - RNA, 12 nt, Chlamydophila pneumoniae CWL029
cagcccugccuc

SEQ ID NO: 503965 - RNA, 16 nt, Chlamydophila pneumoniae CWL029
cagccgcaucaugguc

SEQ ID NO: 503966 - RNA, 14 nt, Chlamydophila pneumoniae CWL029
cagcauuuucucug

SEQ ID NO: 503967 - RNA, 22 nt, Chlamydophila pneumoniae CWL029
cagcauuaagauaaacagcaca

SEQ ID NO: 503968 - RNA, 20 nt, Chlamydophila pneumoniae CWL029
cagcauuaagauaaacagca

SEQ ID NO: 503969 - RNA, 15 nt, Chlamydophila pneumoniae CWL029
cagcauggacuccaa

SEQ ID NO: 503970 - RNA, 18 nt, Chlamydophila pneumoniae CWL029
cagcauggacuccaagaa

SEQ ID NO: 503971 - RNA, 19 nt, Chlamydophila pneumoniae CWL029
cagcauggacuccaagaau

SEQ ID NO: 503972 - RNA, 18 nt, Chlamydophila pneumoniae CWL029
cagcaucaggauucucuc

SEQ ID NO: 503973 - RNA, 20 nt, Chlamydophila pneumoniae CWL029
cagcaucaggauucucucug

SEQ ID NO: 503974 - RNA, 22 nt, Chlamydophila pneumoniae CWL029
cagcaucacguauaauacguac

SEQ ID NO: 503975 - RNA, 15 nt, Chlamydophila pneumoniae CWL029
cagcauaaaaauucu

SEQ ID NO: 503976 - RNA, 18 nt, Chlamydophila pneumoniae CWL029
cagcauaaguuagccugg

SEQ ID NO: 503977 - RNA, 16 nt, Chlamydophila pneumoniae CWL029
cagcagguucuugaau

SEQ ID NO: 503978 - RNA, 22 nt, Chlamydophila pneumoniae CWL029
cagcagcuucccaagcagaaga

SEQ ID NO: 503979 - RNA, 18 nt, Chlamydophila pneumoniae CWL029
cagcagcugucaauccaa

SEQ ID NO: 503980 - RNA, 22 nt, Chlamydophila pneumoniae CWL029
cagcagcugucaauccaacaaa

SEQ ID NO: 503981 - RNA, 20 nt, Chlamydophila pneumoniae CWL029
cagcagcgucccccccgggu

SEQ ID NO: 503982 - RNA, 16 nt, Chlamydophila pneumoniae CWL029
cagcagcguccccccc

SEQ ID NO: 503983 - RNA, 22 nt, Chlamydophila pneumoniae CWL029
cagucucauggauuacugaaga

SEQ ID NO: 503984 - RNA, 22 nt, Chlamydophila pneumoniae CWL029
cagucuccuggaacaguauaau

SEQ ID NO: 503985 - RNA, 16 nt, Chlamydophila pneumoniae CWL029
cagucucgaguccagu

SEQ ID NO: 503986 - RNA, 18 nt, Chlamydophila pneumoniae CWL029
cagucuauagccucuucu

SEQ ID NO: 503987 - RNA, 14 nt, Chlamydophila pneumoniae CWL029
caguccucucccuu

SEQ ID NO: 503988 - RNA, 18 nt, Chlamydophila pneumoniae CWL029
cagugaaauuuugcaaca

SEQ ID NO: 503989 - RNA, 19 nt, Chlamydophila pneumoniae CWL029
cagugaacucuucaagagc

SEQ ID NO: 503990 - RNA, 17 nt, Chlamydophila pneumoniae CWL029
cagucacaauauagccc

SEQ ID NO: 503991 - RNA, 17 nt, Chlamydophila pneumoniae CWL029
caguauggcguuuuuuu

SEQ ID NO: 503992 - RNA, 20 nt, Chlamydophila pneumoniae CWL029
caguauggcguuuuuuuuga

SEQ ID NO: 503993 - RNA, 15 nt, Chlamydophila pneumoniae CWL029
caguauuauaaauag

SEQ ID NO: 503994 - RNA, 23 nt, Chlamydophila pneumoniae CWL029
caguauuccaucacaguuaagac

SEQ ID NO: 503995 - RNA, 20 nt, Chlamydophila pneumoniae CWL029
caguagagccucuaagaaaa

SEQ ID NO: 503996 - RNA, 17 nt, Chlamydophila pneumoniae CWL029
caguagaggaauucugg

SEQ ID NO: 503997 - RNA, 14 nt, Chlamydophila pneumoniae CWL029
caguaguguaucua

SEQ ID NO: 503998 - RNA, 16 nt, Chlamydophila pneumoniae CWL029
caguauaaucagaagu

SEQ ID NO: 503999 - RNA, 14 nt, Chlamydophila pneumoniae CWL029
caguagguaagaag

SEQ ID NO: 504000 - RNA, 22 nt, Chlamydophila pneumoniae CWL029
caguaggagcagcggcacccuc

SEQ ID NO: 504001 - RNA, 22 nt, Chlamydophila pneumoniae CWL029
caguaggcgaugcaaauuccag

SEQ ID NO: 504002 - RNA, 15 nt, Chlamydophila pneumoniae CWL029
caguagccuucuucu

SEQ ID NO: 504003 - RNA, 16 nt, Chlamydophila pneumoniae CWL029
caguaaaacacaaaua

SEQ ID NO: 504004 - RNA, 22 nt, Chlamydophila pneumoniae CWL029
caguaaaagacugaaaagaucg

SEQ ID NO: 504005 - RNA, 21 nt, Chlamydophila pneumoniae CWL029
caguaauguuaacgaauugcu

SEQ ID NO: 504006 - RNA, 15 nt, Chlamydophila pneumoniae CWL029
aaacaacagaaaugu

SEQ ID NO: 504007 - RNA, 15 nt, Chlamydophila pneumoniae CWL029
aaacaagaaaaagca

SEQ ID NO: 504008 - RNA, 23 nt, Chlamydophila pneumoniae CWL029
aaacaacgaucgucaguaaaaca

SEQ ID NO: 504009 - RNA, 21 nt, Chlamydophila pneumoniae CWL029
aaacaacucccguuuuguugg

SEQ ID NO: 504010 - RNA, 18 nt, Chlamydophila pneumoniae CWL029
aaacaacugaaaaaccau

SEQ ID NO: 504011 - RNA, 18 nt, Chlamydophila pneumoniae CWL029
caggucugcugaggagag

SEQ ID NO: 504012 - RNA, 18 nt, Chlamydophila pneumoniae CWL029
cagguucacuucaucgac

SEQ ID NO: 504013 - RNA, 23 nt, Chlamydophila pneumoniae CWL029
cagggagaucuacgccuucaagu

SEQ ID NO: 504014 - RNA, 14 nt, Chlamydophila pneumoniae CWL029
cagggacagaaguc

SEQ ID NO: 504015 - RNA, 14 nt, Chlamydophila pneumoniae CWL029
cagggaauagguag

SEQ ID NO: 504016 - RNA, 23 nt, Chlamydophila pneumoniae CWL029
caggagagagaaggcucucaagg

SEQ ID NO: 504017 - RNA, 16 nt, Chlamydophila pneumoniae CWL029
caggagagagaaggcu

SEQ ID NO: 504018 - RNA, 22 nt, Chlamydophila pneumoniae CWL029
caggauacucugaacaggaaua

SEQ ID NO: 504019 - RNA, 17 nt, Chlamydophila pneumoniae CWL029
caggauaccauaaggag

SEQ ID NO: 504020 - RNA, 17 nt, Chlamydophila pneumoniae CWL029
caggacguaaaaagaaa

SEQ ID NO: 504021 - RNA, 20 nt, Chlamydophila pneumoniae CWL029
caggagaacaauaucagcag

SEQ ID NO: 504022 - RNA, 16 nt, Chlamydophila pneumoniae CWL029
caggacgcacauuuag

SEQ ID NO: 504023 - RNA, 12 nt, Chlamydophila pneumoniae CWL029
aaaauuuuccca

SEQ ID NO: 504024 - RNA, 17 nt, Chlamydophila pneumoniae CWL029
aaaauuuucaggaacuu

SEQ ID NO: 504025 - RNA, 19 nt, Chlamydophila pneumoniae CWL029
caggaauaaucaaccaaaa

SEQ ID NO: 504026 - RNA, 20 nt, Chlamydophila pneumoniae CWL029
aaaauuucuuauaaaaaagg

SEQ ID NO: 504027 - RNA, 21 nt, Chlamydophila pneumoniae CWL029
caggaaguaagguuccaaaaa

SEQ ID NO: 504028 - RNA, 13 nt, Chlamydophila pneumoniae CWL029
caggaaguccaug

SEQ ID NO: 504029 - RNA, 23 nt, Chlamydophila pneumoniae CWL029
caggaaguccauguacagaaaau

SEQ ID NO: 504030 - RNA, 17 nt, Chlamydophila pneumoniae CWL029
caggaacccuggaugaa

SEQ ID NO: 504031 - RNA, 23 nt, Chlamydophila pneumoniae CWL029
cagcucucuugauugcuaucaaa

SEQ ID NO: 504032 - RNA, 19 nt, Chlamydophila pneumoniae CWL029
cagcugucaauccaacaaa

SEQ ID NO: 504033 - RNA, 13 nt, Chlamydophila pneumoniae CWL029
cagcugugguggu

SEQ ID NO: 504034 - RNA, 14 nt, Chlamydophila pneumoniae CWL029
cagcuucaucagaa

SEQ ID NO: 504035 - RNA, 14 nt, Chlamydophila pneumoniae CWL029
cagcuucuuuucca

SEQ ID NO: 504036 - RNA, 15 nt, Chlamydophila pneumoniae CWL029
cagcuucuuuuccag

SEQ ID NO: 504037 - RNA, 19 nt, Chlamydophila pneumoniae CWL029
cagcuuugcuuauuucccc

SEQ ID NO: 504038 - RNA, 13 nt, Chlamydophila pneumoniae CWL029
caggaacaaaggu

SEQ ID NO: 504039 - RNA, 12 nt, Chlamydophila pneumoniae CWL029
caggaaauuccg

SEQ ID NO: 504040 - RNA, 21 nt, Chlamydophila pneumoniae CWL029
cagcuaaucauagccaucaua

SEQ ID NO: 504041 - RNA, 13 nt, Chlamydophila pneumoniae CWL029
cagcuaaucaauc

SEQ ID NO: 504042 - RNA, 16 nt, Chlamydophila pneumoniae CWL029
cagcgcugugaggaaa

SEQ ID NO: 504043 - RNA, 21 nt, Chlamydophila pneumoniae CWL029
aaaauugcauuuaaacuaaga

SEQ ID NO: 504044 - RNA, 13 nt, Chlamydophila pneumoniae CWL029
aaaauuguuggaa

SEQ ID NO: 504045 - RNA, 22 nt, Chlamydophila pneumoniae CWL029
aaaauuguuuguaucaaagaaa

SEQ ID NO: 504046 - RNA, 19 nt, Chlamydophila pneumoniae CWL029
cagcuagagcacauagaaa

SEQ ID NO: 504047 - RNA, 14 nt, Chlamydophila pneumoniae CWL029
cagcucggaaugcu

SEQ ID NO: 504048 - RNA, 13 nt, Chlamydophila pneumoniae CWL029
cagcuccuggaua

SEQ ID NO: 504049 - RNA, 12 nt, Chlamydophila pneumoniae CWL029
cagcuccauaag

SEQ ID NO: 504050 - RNA, 19 nt, Chlamydophila pneumoniae CWL029
cagcuccauaagcuuuucu

SEQ ID NO: 504051 - RNA, 16 nt, Chlamydophila pneumoniae CWL029
cagcuccauuuaaaug

SEQ ID NO: 504052 - RNA, 14 nt, Chlamydophila pneumoniae CWL029
cagcucccaugugc

SEQ ID NO: 504053 - RNA, 20 nt, Chlamydophila pneumoniae CWL029
cagcucccaugugcugaaga

SEQ ID NO: 504054 - RNA, 18 nt, Chlamydophila pneumoniae CWL029
cagcucccaugugcugaa

SEQ ID NO: 504055 - RNA, 11 nt, Chlamydophila pneumoniae CWL029
aaaauuuaaau

SEQ ID NO: 504056 - RNA, 14 nt, Chlamydophila pneumoniae CWL029
ccagcaucuucucg

SEQ ID NO: 504057 - RNA, 22 nt, Chlamydophila pneumoniae CWL029
ccagcauuaagauaaacagcac

SEQ ID NO: 504058 - RNA, 23 nt, Chlamydophila pneumoniae CWL029
ccagcauuaagauaaacagcaca

SEQ ID NO: 504059 - RNA, 21 nt, Chlamydophila pneumoniae CWL029
ccagccacccccacuucuuuu

SEQ ID NO: 504060 - RNA, 22 nt, Chlamydophila pneumoniae CWL029
ccagauuuuuuugguugcuucu

SEQ ID NO: 504061 - RNA, 19 nt, Chlamydophila pneumoniae CWL029
ccagauuguucaaaaauag

SEQ ID NO: 504062 - RNA, 22 nt, Chlamydophila pneumoniae CWL029
ccagauuguucaaaaauagaua

SEQ ID NO: 504063 - RNA, 14 nt, Chlamydophila pneumoniae CWL029
ccagaugauuuuuu

SEQ ID NO: 504064 - RNA, 18 nt, Chlamydophila pneumoniae CWL029
ccagaugauuuuuugaau

SEQ ID NO: 504065 - RNA, 18 nt, Chlamydophila pneumoniae CWL029
ccagauucugaagagaga

SEQ ID NO: 504066 - RNA, 14 nt, Chlamydophila pneumoniae CWL029
ccagagagcuuuua

SEQ ID NO: 504067 - RNA, 16 nt, Chlamydophila pneumoniae CWL029
ccagacuuuccucucu

SEQ ID NO: 504068 - RNA, 17 nt, Chlamydophila pneumoniae CWL029
ccagagaauguucccaa

SEQ ID NO: 504069 - RNA, 14 nt, Chlamydophila pneumoniae CWL029
ccagaaauuuuuac

SEQ ID NO: 504070 - RNA, 16 nt, Chlamydophila pneumoniae CWL029
ccagaaauuuuuacaa

SEQ ID NO: 504071 - RNA, 21 nt, Chlamydophila pneumoniae CWL029
ccagaaacgcagcuuuccuuu

SEQ ID NO: 504072 - RNA, 12 nt, Chlamydophila pneumoniae CWL029
ccagaaaguauu

SEQ ID NO: 504073 - RNA, 22 nt, Chlamydophila pneumoniae CWL029
ccacuuuuaauuucuuacaaga

SEQ ID NO: 504074 - RNA, 22 nt, Chlamydophila pneumoniae CWL029
ccacuuuuuucccuccaccaga

SEQ ID NO: 504075 - RNA, 20 nt, Chlamydophila pneumoniae CWL029
ccagaagguguggguacagg

SEQ ID NO: 504076 - RNA, 15 nt, Chlamydophila pneumoniae CWL029
ccacuugcauggauc

SEQ ID NO: 504077 - RNA, 15 nt, Chlamydophila pneumoniae CWL029
ccacuggacuucguu

SEQ ID NO: 504078 - RNA, 17 nt, Chlamydophila pneumoniae CWL029
ccaccuuccccaagcuc

SEQ ID NO: 504079 - RNA, 13 nt, Chlamydophila pneumoniae CWL029
ccacgaaauguua

SEQ ID NO: 504080 - RNA, 21 nt, Chlamydophila pneumoniae CWL029
ccaccuuggcuucuaucuuua

SEQ ID NO: 504081 - RNA, 22 nt, Chlamydophila pneumoniae CWL029
ccaccaaagugacuuccuccaa

SEQ ID NO: 504082 - RNA, 12 nt, Chlamydophila pneumoniae CWL029
ccaccaggagcu

SEQ ID NO: 504083 - RNA, 16 nt, Chlamydophila pneumoniae CWL029
ccaccaggagcuccuc

SEQ ID NO: 504084 - RNA, 15 nt, Chlamydophila pneumoniae CWL029
ccacaugaaguccug

SEQ ID NO: 504085 - RNA, 16 nt, Chlamydophila pneumoniae CWL029
ccacaugcccaaacau

SEQ ID NO: 504086 - RNA, 19 nt, Chlamydophila pneumoniae CWL029
ccacaauuccuaaaacaag

SEQ ID NO: 504087 - RNA, 14 nt, Chlamydophila pneumoniae CWL029
ccaaguacaguauc

SEQ ID NO: 504088 - RNA, 18 nt, Chlamydophila pneumoniae CWL029
ccaauaaauccaaaaaau

SEQ ID NO: 504089 - RNA, 12 nt, Chlamydophila pneumoniae CWL029
ccaaucuuucau

SEQ ID NO: 504090 - RNA, 15 nt, Chlamydophila pneumoniae CWL029
ccacaacauaacagg

SEQ ID NO: 504091 - RNA, 13 nt, Chlamydophila pneumoniae CWL029
ccaaauaaagcaa

SEQ ID NO: 504092 - RNA, 11 nt, Chlamydophila pneumoniae CWL029
ccaaagaacag

SEQ ID NO: 504093 - RNA, 14 nt, Chlamydophila pneumoniae CWL029
ccaaagaacagcac

SEQ ID NO: 504094 - RNA, 21 nt, Chlamydophila pneumoniae CWL029
ccaaagaacagcacucucugc

SEQ ID NO: 504095 - RNA, 21 nt, Chlamydophila pneumoniae CWL029
ccaaagaggggagcuauaaau

SEQ ID NO: 504096 - RNA, 16 nt, Chlamydophila pneumoniae CWL029
ccaaagaucaucuuca

SEQ ID NO: 504097 - RNA, 14 nt, Chlamydophila pneumoniae CWL029
ccaaaguuuguagc

SEQ ID NO: 504098 - RNA, 20 nt, Chlamydophila pneumoniae CWL029
ccaacacuuuuaaagauaag

SEQ ID NO: 504099 - RNA, 16 nt, Chlamydophila pneumoniae CWL029
ccaaauguucucucca

SEQ ID NO: 504100 - RNA, 21 nt, Chlamydophila pneumoniae CWL029
ccaaauguucucuccagcugu

SEQ ID NO: 504101 - RNA, 16 nt, Chlamydophila pneumoniae CWL029
ccaaauuccuucauac

SEQ ID NO: 504102 - RNA, 23 nt, Chlamydophila pneumoniae CWL029
ccaacacgcacaaacuaacauag

SEQ ID NO: 504103 - RNA, 19 nt, Chlamydophila pneumoniae CWL029
ccaagggagaggucugcuc

SEQ ID NO: 504104 - RNA, 22 nt, Chlamydophila pneumoniae CWL029
ccaaggggcguucuugaaaaaa

SEQ ID NO: 504105 - RNA, 22 nt, Chlamydophila pneumoniae CWL029
ccaagcaggugugugguaaaaa

SEQ ID NO: 504106 - RNA, 17 nt, Chlamydophila pneumoniae CWL029
ccaagaaaucucaguga

SEQ ID NO: 504107 - RNA, 21 nt, Chlamydophila pneumoniae CWL029
ccaagaaugaaucgaagaaca

SEQ ID NO: 504108 - RNA, 13 nt, Chlamydophila pneumoniae CWL029
ccaagacaaaaaa

SEQ ID NO: 504109 - RNA, 11 nt, Chlamydophila pneumoniae CWL029
ccaacuagaau

SEQ ID NO: 504110 - RNA, 22 nt, Chlamydophila pneumoniae CWL029
ccaacucccgcuagaucaaaac

SEQ ID NO: 504111 - RNA, 13 nt, Chlamydophila pneumoniae CWL029
ccaacuccucuaa

SEQ ID NO: 504112 - RNA, 14 nt, Chlamydophila pneumoniae CWL029
ccaacuuccuauaa

SEQ ID NO: 504113 - RNA, 18 nt, Chlamydophila pneumoniae CWL029
ccaacuuuugaagauccu

SEQ ID NO: 504114 - RNA, 21 nt, Chlamydophila pneumoniae CWL029
ccaaaaaagagcccaaaaaca

SEQ ID NO: 504115 - RNA, 20 nt, Chlamydophila pneumoniae CWL029
ccaaaaaaugcccguccccu

SEQ ID NO: 504116 - RNA, 17 nt, Chlamydophila pneumoniae CWL029
ccaaaaggcacaacaau

SEQ ID NO: 504117 - RNA, 20 nt, Chlamydophila pneumoniae CWL029
ccaaaagaauuaagaagaag

SEQ ID NO: 504118 - RNA, 23 nt, Chlamydophila pneumoniae CWL029
ccaaaagaauuaagaagaagcug

SEQ ID NO: 504119 - RNA, 16 nt, Chlamydophila pneumoniae CWL029
ccaaaaugucuuuuuc

SEQ ID NO: 504120 - RNA, 23 nt, Chlamydophila pneumoniae CWL029
ccaaaauuaccguuuccuccucu

SEQ ID NO: 504121 - RNA, 21 nt, Chlamydophila pneumoniae CWL029
ccaaacgucaggcuccugacg

SEQ ID NO: 504122 - RNA, 19 nt, Chlamydophila pneumoniae CWL029
ccaaaccucuuagcuauca

SEQ ID NO: 504123 - RNA, 20 nt, Chlamydophila pneumoniae CWL029
ccaaacgaauuucuuguucc

SEQ ID NO: 504124 - RNA, 20 nt, Chlamydophila pneumoniae CWL029
ccaaacggcugauucuccca

SEQ ID NO: 504125 - RNA, 19 nt, Chlamydophila pneumoniae CWL029
ccaaacuuggucauuauag

SEQ ID NO: 504126 - RNA, 14 nt, Chlamydophila pneumoniae CWL029
cauuuucuaaagua

SEQ ID NO: 504127 - RNA, 14 nt, Chlamydophila pneumoniae CWL029
cauugaucagaauc

SEQ ID NO: 504128 - RNA, 21 nt, Chlamydophila pneumoniae CWL029
cauuuucuucuugcaaucuuu

SEQ ID NO: 504129 - RNA, 13 nt, Chlamydophila pneumoniae CWL029
cauuuugguaucu

SEQ ID NO: 504130 - RNA, 14 nt, Chlamydophila pneumoniae CWL029
cauuuugguaucug

SEQ ID NO: 504131 - RNA, 13 nt, Chlamydophila pneumoniae CWL029
cauuuuuccuccu

SEQ ID NO: 504132 - RNA, 14 nt, Chlamydophila pneumoniae CWL029
cauuuuuaaggaaa

SEQ ID NO: 504133 - RNA, 12 nt, Chlamydophila pneumoniae CWL029
cauuuuuaggau

SEQ ID NO: 504134 - RNA, 16 nt, Chlamydophila pneumoniae CWL029
cauuuuucuauaauaa

SEQ ID NO: 504135 - RNA, 23 nt, Chlamydophila pneumoniae CWL029
cauucuccgccagaguuuaaagc

SEQ ID NO: 504136 - RNA, 15 nt, Chlamydophila pneumoniae CWL029
cauucucaauucugu

SEQ ID NO: 504137 - RNA, 18 nt, Chlamydophila pneumoniae CWL029
cauucccuaaagcugcca

SEQ ID NO: 504138 - RNA, 13 nt, Chlamydophila pneumoniae CWL029
cauucuauucuau

SEQ ID NO: 504139 - RNA, 16 nt, Chlamydophila pneumoniae CWL029
cauucuuaauauaaaa

SEQ ID NO: 504140 - RNA, 15 nt, Chlamydophila pneumoniae CWL029
cauugagauccauag

SEQ ID NO: 504141 - RNA, 17 nt, Chlamydophila pneumoniae CWL029
cauugaccugcuuuuuu

SEQ ID NO: 504142 - RNA, 22 nt, Chlamydophila pneumoniae CWL029
cauugacgcuuaaaaucagcac

SEQ ID NO: 504143 - RNA, 15 nt, Chlamydophila pneumoniae CWL029
cauugaauccuucua

SEQ ID NO: 504144 - RNA, 13 nt, Chlamydophila pneumoniae CWL029
cauuauucccuaa

SEQ ID NO: 504145 - RNA, 22 nt, Chlamydophila pneumoniae CWL029
cauucacagcagucgugauauc

SEQ ID NO: 504146 - RNA, 13 nt, Chlamydophila pneumoniae CWL029
cauucacuaaaua

SEQ ID NO: 504147 - RNA, 15 nt, Chlamydophila pneumoniae CWL029
cauuccagcaucuuc

SEQ ID NO: 504148 - RNA, 16 nt, Chlamydophila pneumoniae CWL029
cauuccaagaaaaauu

SEQ ID NO: 504149 - RNA, 15 nt, Chlamydophila pneumoniae CWL029
cauuauuaaacgaau

SEQ ID NO: 504150 - RNA, 21 nt, Chlamydophila pneumoniae CWL029
cauuacacaacucuuucccua

SEQ ID NO: 504151 - RNA, 16 nt, Chlamydophila pneumoniae CWL029
cauuaucacagaugua

SEQ ID NO: 504152 - RNA, 15 nt, Chlamydophila pneumoniae CWL029
cauuaucacagcaau

SEQ ID NO: 504153 - RNA, 13 nt, Chlamydophila pneumoniae CWL029
cauuaagaacauc

SEQ ID NO: 504154 - RNA, 17 nt, Chlamydophila pneumoniae CWL029
cauuaagauaaacauua

SEQ ID NO: 504155 - RNA, 12 nt, Chlamydophila pneumoniae CWL029
cauuaagcaauc

SEQ ID NO: 504156 - RNA, 19 nt, Chlamydophila pneumoniae CWL029
cauguauccgaaaucugac

SEQ ID NO: 504157 - RNA, 20 nt, Chlamydophila pneumoniae CWL029
cauguauuguguucccucuu

SEQ ID NO: 504158 - RNA, 20 nt, Chlamydophila pneumoniae CWL029
cauguaggaugugaaggauc

SEQ ID NO: 504159 - RNA, 14 nt, Chlamydophila pneumoniae CWL029
cauguugcaaagca

SEQ ID NO: 504160 - RNA, 14 nt, Chlamydophila pneumoniae CWL029
caugguuauagaua

SEQ ID NO: 504161 - RNA, 20 nt, Chlamydophila pneumoniae CWL029
caugccuuuggcaaucaucu

SEQ ID NO: 504162 - RNA, 17 nt, Chlamydophila pneumoniae CWL029
caugcgaagggaggaga

SEQ ID NO: 504163 - RNA, 16 nt, Chlamydophila pneumoniae CWL029
caugccugaaaacaag

SEQ ID NO: 504164 - RNA, 18 nt, Chlamydophila pneumoniae CWL029
caugcgcagaauaaaaug

SEQ ID NO: 504165 - RNA, 19 nt, Chlamydophila pneumoniae CWL029
caugcgcagaauaaaaugg

SEQ ID NO: 504166 - RNA, 12 nt, Chlamydophila pneumoniae CWL029
caugccaaauau

SEQ ID NO: 504167 - RNA, 19 nt, Chlamydophila pneumoniae CWL029
caugccaaauaucucuggc

SEQ ID NO: 504168 - RNA, 22 nt, Chlamydophila pneumoniae CWL029
caugcccccacaaaaccuggau

SEQ ID NO: 504169 - RNA, 13 nt, Chlamydophila pneumoniae CWL029
caugauuuuucaa

SEQ ID NO: 504170 - RNA, 17 nt, Chlamydophila pneumoniae CWL029
caugcaauacuuuucuc

SEQ ID NO: 504171 - RNA, 18 nt, Chlamydophila pneumoniae CWL029
caugcacgagagccucgg

SEQ ID NO: 504172 - RNA, 20 nt, Chlamydophila pneumoniae CWL029
caugauauuuuuauuuaaaa

SEQ ID NO: 504173 - RNA, 14 nt, Chlamydophila pneumoniae CWL029
caugaugccauuga

SEQ ID NO: 504174 - RNA, 20 nt, Chlamydophila pneumoniae CWL029
caugaguuuuucagauguac

SEQ ID NO: 504175 - RNA, 21 nt, Chlamydophila pneumoniae CWL029
caugauaaaaauuuucaggaa

SEQ ID NO: 504176 - RNA, 21 nt, Chlamydophila pneumoniae CWL029
caugagccgauguugcagaau

SEQ ID NO: 504177 - RNA, 12 nt, Chlamydophila pneumoniae CWL029
caugaggcugcu

SEQ ID NO: 504178 - RNA, 23 nt, Chlamydophila pneumoniae CWL029
caugagggcaugccuaucuaucu

SEQ ID NO: 504179 - RNA, 21 nt, Chlamydophila pneumoniae CWL029
caugagagucgaaacacucau

SEQ ID NO: 504180 - RNA, 20 nt, Chlamydophila pneumoniae CWL029
caugagaaauacgcuuuucu

SEQ ID NO: 504181 - RNA, 15 nt, Chlamydophila pneumoniae CWL029
caugacgcuuuucca

SEQ ID NO: 504182 - RNA, 21 nt, Chlamydophila pneumoniae CWL029
caugaccuuuaggaacuugaa

SEQ ID NO: 504183 - RNA, 22 nt, Chlamydophila pneumoniae CWL029
caugaccuuuaggaacuugaau

SEQ ID NO: 504184 - RNA, 18 nt, Chlamydophila pneumoniae CWL029
caugaaucugguuccuua

SEQ ID NO: 504185 - RNA, 15 nt, Chlamydophila pneumoniae CWL029
caugaaucucuucug

SEQ ID NO: 504186 - RNA, 13 nt, Chlamydophila pneumoniae CWL029
caucuuuuacaga

SEQ ID NO: 504187 - RNA, 17 nt, Chlamydophila pneumoniae CWL029
caucuuuuacagacuga

SEQ ID NO: 504188 - RNA, 15 nt, Chlamydophila pneumoniae CWL029
caucuuuggcacaau

SEQ ID NO: 504189 - RNA, 18 nt, Chlamydophila pneumoniae CWL029
caugaaaauacaacggau

SEQ ID NO: 504190 - RNA, 16 nt, Chlamydophila pneumoniae CWL029
caugaacgugcaucuc

SEQ ID NO: 504191 - RNA, 19 nt, Chlamydophila pneumoniae CWL029
caugaaauaguguuucuuu

SEQ ID NO: 504192 - RNA, 21 nt, Chlamydophila pneumoniae CWL029
caugaaauaguguuucuuuau

SEQ ID NO: 504193 - RNA, 13 nt, Chlamydophila pneumoniae CWL029
caucuuucaucaa

SEQ ID NO: 504194 - RNA, 21 nt, Chlamydophila pneumoniae CWL029
caucuucucgaacaggagaga

SEQ ID NO: 504195 - RNA, 17 nt, Chlamydophila pneumoniae CWL029
caucuucuuggcuuucc

SEQ ID NO: 504196 - RNA, 19 nt, Chlamydophila pneumoniae CWL029
caucgucuccaaaaauucc

SEQ ID NO: 504197 - RNA, 22 nt, Chlamydophila pneumoniae CWL029
caucgccgaccaucauaauuug

SEQ ID NO: 504198 - RNA, 22 nt, Chlamydophila pneumoniae CWL029
caucggcauuucuccacaugcc

SEQ ID NO: 504199 - RNA, 19 nt, Chlamydophila pneumoniae CWL029
caucgaagcgccgcauuac

SEQ ID NO: 504200 - RNA, 15 nt, Chlamydophila pneumoniae CWL029
caucgaaaccacagc

SEQ ID NO: 504201 - RNA, 21 nt, Chlamydophila pneumoniae CWL029
cauccuuuagcuguuucucug

SEQ ID NO: 504202 - RNA, 12 nt, Chlamydophila pneumoniae CWL029
caucgaagaacu

SEQ ID NO: 504203 - RNA, 13 nt, Chlamydophila pneumoniae CWL029
caucgaagaacuu

SEQ ID NO: 504204 - RNA, 12 nt, Chlamydophila pneumoniae CWL029
cauccuucuuua

SEQ ID NO: 504205 - RNA, 17 nt, Chlamydophila pneumoniae CWL029
caucccauucaauaauu

SEQ ID NO: 504206 - RNA, 21 nt, Chlamydophila pneumoniae CWL029
caucccgaacgcuagggaaac

SEQ ID NO: 504207 - RNA, 18 nt, Chlamydophila pneumoniae CWL029
cauccauucuuaauauaa

SEQ ID NO: 504208 - RNA, 22 nt, Chlamydophila pneumoniae CWL029
cauccacgaccucgaauuccuc

SEQ ID NO: 504209 - RNA, 16 nt, Chlamydophila pneumoniae CWL029
cauccaaauagaguga

SEQ ID NO: 504210 - RNA, 21 nt, Chlamydophila pneumoniae CWL029
caucagcagcugucaauccaa

SEQ ID NO: 504211 - RNA, 23 nt, Chlamydophila pneumoniae CWL029
caucaaugguuaaaacccauguu

SEQ ID NO: 504212 - RNA, 16 nt, Chlamydophila pneumoniae CWL029
caucacaauuuuaaaa

SEQ ID NO: 504213 - RNA, 14 nt, Chlamydophila pneumoniae CWL029
caucacuaaucuca

SEQ ID NO: 504214 - RNA, 18 nt, Chlamydophila pneumoniae CWL029
caucacgaaaaggagaau

SEQ ID NO: 504215 - RNA, 23 nt, Chlamydophila pneumoniae CWL029
caucaccuucggaucuucccauu

SEQ ID NO: 504216 - RNA, 18 nt, Chlamydophila pneumoniae CWL029
cauauucuaagcuuauuu

SEQ ID NO: 504217 - RNA, 22 nt, Chlamydophila pneumoniae CWL029
cauauugagcagcguagacagg

SEQ ID NO: 504218 - RNA, 16 nt, Chlamydophila pneumoniae CWL029
cauauuccuauaacaa

SEQ ID NO: 504219 - RNA, 17 nt, Chlamydophila pneumoniae CWL029
cauauuuugucuucauc

SEQ ID NO: 504220 - RNA, 16 nt, Chlamydophila pneumoniae CWL029
cauauuuuucuugaag

SEQ ID NO: 504221 - RNA, 16 nt, Chlamydophila pneumoniae CWL029
cauagcugaggcaucu

SEQ ID NO: 504222 - RNA, 22 nt, Chlamydophila pneumoniae CWL029
cauagcuaaguaacaguccucu

SEQ ID NO: 504223 - RNA, 17 nt, Chlamydophila pneumoniae CWL029
cauagccaucauagcaa

SEQ ID NO: 504224 - RNA, 16 nt, Chlamydophila pneumoniae CWL029
cauagcagcuauacgu

SEQ ID NO: 504225 - RNA, 19 nt, Chlamydophila pneumoniae CWL029
cauagccuuccuguuaagg

SEQ ID NO: 504226 - RNA, 20 nt, Chlamydophila pneumoniae CWL029
cauagcgaaagucaaagggc

SEQ ID NO: 504227 - RNA, 19 nt, Chlamydophila pneumoniae CWL029
cauagggaugacccaaaaa

SEQ ID NO: 504228 - RNA, 20 nt, Chlamydophila pneumoniae CWL029
cauagguaauacgagaggaa

SEQ ID NO: 504229 - RNA, 15 nt, Chlamydophila pneumoniae CWL029
cauaguuuuuauuuu

SEQ ID NO: 504230 - RNA, 21 nt, Chlamydophila pneumoniae CWL029
cauaguuuuuauuuuuaaaua

SEQ ID NO: 504231 - RNA, 20 nt, Chlamydophila pneumoniae CWL029
cauauaaagacucucuucca

SEQ ID NO: 504232 - RNA, 20 nt, Chlamydophila pneumoniae CWL029
cauauagcucguuauauuuu

SEQ ID NO: 504233 - RNA, 14 nt, Chlamydophila pneumoniae CWL029
cauagcaacuacag

SEQ ID NO: 504234 - RNA, 23 nt, Chlamydophila pneumoniae CWL029
cauagagagaaggaauuaaaaua

SEQ ID NO: 504235 - RNA, 15 nt, Chlamydophila pneumoniae CWL029
cauagagauaucauc

SEQ ID NO: 504236 - RNA, 18 nt, Chlamydophila pneumoniae CWL029
cauagagauaucaucaaa

SEQ ID NO: 504237 - RNA, 21 nt, Chlamydophila pneumoniae CWL029
cauagagauaucaucaaaaga

SEQ ID NO: 504238 - RNA, 18 nt, Chlamydophila pneumoniae CWL029
cauagagugugccagaau

SEQ ID NO: 504239 - RNA, 15 nt, Chlamydophila pneumoniae CWL029
cauagauacaaacau

SEQ ID NO: 504240 - RNA, 15 nt, Chlamydophila pneumoniae CWL029
cauagacucuuccuu

SEQ ID NO: 504241 - RNA, 22 nt, Chlamydophila pneumoniae CWL029
cauagaauccucggaagauaaa

SEQ ID NO: 504242 - RNA, 18 nt, Chlamydophila pneumoniae CWL029
cauacucuucauccugau

SEQ ID NO: 504243 - RNA, 14 nt, Chlamydophila pneumoniae CWL029
cauacugauauaca

SEQ ID NO: 504244 - RNA, 20 nt, Chlamydophila pneumoniae CWL029
cauacugauauacaguuggc

SEQ ID NO: 504245 - RNA, 22 nt, Chlamydophila pneumoniae CWL029
cgacacuauguguuuccuuuuc

SEQ ID NO: 504246 - RNA, 14 nt, Chlamydophila pneumoniae CWL029
cgacauacaucaaa

SEQ ID NO: 504247 - RNA, 14 nt, Chlamydophila pneumoniae CWL029
cgaauuucuuguuc

SEQ ID NO: 504248 - RNA, 18 nt, Chlamydophila pneumoniae CWL029
cgaauuucaacagcuuca

SEQ ID NO: 504249 - RNA, 13 nt, Chlamydophila pneumoniae CWL029
cgaauucucagaa

SEQ ID NO: 504250 - RNA, 13 nt, Chlamydophila pneumoniae CWL029
cgacaaggaagcc

SEQ ID NO: 504251 - RNA, 13 nt, Chlamydophila pneumoniae CWL029
cgacacgaauuuc

SEQ ID NO: 504252 - RNA, 21 nt, Chlamydophila pneumoniae CWL029
cgaauguagccaauccuucca

SEQ ID NO: 504253 - RNA, 18 nt, Chlamydophila pneumoniae CWL029
cgaaugucguuaaaaacu

SEQ ID NO: 504254 - RNA, 21 nt, Chlamydophila pneumoniae CWL029
cgaauccuagagaaccuccua

SEQ ID NO: 504255 - RNA, 21 nt, Chlamydophila pneumoniae CWL029
cgaaucccuguguguuuuuuc

SEQ ID NO: 504256 - RNA, 13 nt, Chlamydophila pneumoniae CWL029
cgaaucuaaaaac

SEQ ID NO: 504257 - RNA, 13 nt, Chlamydophila pneumoniae CWL029
cgaaucucuccag

SEQ ID NO: 504258 - RNA, 17 nt, Chlamydophila pneumoniae CWL029
cgaaucuuucaaaagaa

SEQ ID NO: 504259 - RNA, 22 nt, Chlamydophila pneumoniae CWL029
cgaaucuaaaaacuucccaucu

SEQ ID NO: 504260 - RNA, 11 nt, Chlamydophila pneumoniae CWL029
cgaauaacuac

SEQ ID NO: 504261 - RNA, 18 nt, Chlamydophila pneumoniae CWL029
cgaagcuugcugauuucu

SEQ ID NO: 504262 - RNA, 23 nt, Chlamydophila pneumoniae CWL029
cgaagcuugcugauuucuuuuuc

SEQ ID NO: 504263 - RNA, 21 nt, Chlamydophila pneumoniae CWL029
cgaaguugauuguagagacau

SEQ ID NO: 504264 - RNA, 20 nt, Chlamydophila pneumoniae CWL029
cgaacuucagcaagaaaaua

SEQ ID NO: 504265 - RNA, 13 nt, Chlamydophila pneumoniae CWL029
ccuuuuuaggaaa

SEQ ID NO: 504266 - RNA, 19 nt, Chlamydophila pneumoniae CWL029
cgaacuaaaggaacugugc

SEQ ID NO: 504267 - RNA, 23 nt, Chlamydophila pneumoniae CWL029
cgaacgguugaggguucaauucc

SEQ ID NO: 504268 - RNA, 16 nt, Chlamydophila pneumoniae CWL029
cgacaugcuuuccuuc

SEQ ID NO: 504269 - RNA, 22 nt, Chlamydophila pneumoniae CWL029
cgaccugagguaucaauaauga

SEQ ID NO: 504270 - RNA, 23 nt, Chlamydophila pneumoniae CWL029
cgaccugagguaucaauaaugac

SEQ ID NO: 504271 - RNA, 19 nt, Chlamydophila pneumoniae CWL029
cgaccugcaaacuccccag

SEQ ID NO: 504272 - RNA, 17 nt, Chlamydophila pneumoniae CWL029
cgaccucgaauuccucc

SEQ ID NO: 504273 - RNA, 20 nt, Chlamydophila pneumoniae CWL029
cgaccucgaauuccucccag

SEQ ID NO: 504274 - RNA, 16 nt, Chlamydophila pneumoniae CWL029
ccuuuaaauaaaaucg

SEQ ID NO: 504275 - RNA, 12 nt, Chlamydophila pneumoniae CWL029
ccuuguuuuccu

SEQ ID NO: 504276 - RNA, 22 nt, Chlamydophila pneumoniae CWL029
ccuuuauacuguuuuucuucca

SEQ ID NO: 504277 - RNA, 16 nt, Chlamydophila pneumoniae CWL029
ccuuuaggaagcugua

SEQ ID NO: 504278 - RNA, 18 nt, Chlamydophila pneumoniae CWL029
ccuuuagggaaaaaguag

SEQ ID NO: 504279 - RNA, 16 nt, Chlamydophila pneumoniae CWL029
ccuuuaguuaacuccu

SEQ ID NO: 504280 - RNA, 23 nt, Chlamydophila pneumoniae CWL029
ccuuuagagacgcuuuuaucugu

SEQ ID NO: 504281 - RNA, 22 nt, Chlamydophila pneumoniae CWL029
ccuuuugaauucugaugaccuc

SEQ ID NO: 504282 - RNA, 22 nt, Chlamydophila pneumoniae CWL029
ccuuguuguauggcagccugga

SEQ ID NO: 504283 - RNA, 15 nt, Chlamydophila pneumoniae CWL029
ccuuguauaagagca

SEQ ID NO: 504284 - RNA, 16 nt, Chlamydophila pneumoniae CWL029
ccuugagacaaagaau

SEQ ID NO: 504285 - RNA, 22 nt, Chlamydophila pneumoniae CWL029
ccuugaaucauagagauaucau

SEQ ID NO: 504286 - RNA, 13 nt, Chlamydophila pneumoniae CWL029
ccuuggaaaucag

SEQ ID NO: 504287 - RNA, 18 nt, Chlamydophila pneumoniae CWL029
ccuuggauuucuucuucu

SEQ ID NO: 504288 - RNA, 23 nt, Chlamydophila pneumoniae CWL029
ccuuggauuucuucuucuaaagc

SEQ ID NO: 504289 - RNA, 23 nt, Chlamydophila pneumoniae CWL029
ccuucuucuuguucuucuugauu

SEQ ID NO: 504290 - RNA, 15 nt, Chlamydophila pneumoniae CWL029
ccuucuucuuuuaga

SEQ ID NO: 504291 - RNA, 18 nt, Chlamydophila pneumoniae CWL029
ccuucuuucaauagcuuc

SEQ ID NO: 504292 - RNA, 20 nt, Chlamydophila pneumoniae CWL029
ccuucuuucaauagcuucca

SEQ ID NO: 504293 - RNA, 15 nt, Chlamydophila pneumoniae CWL029
ccuucuuuccauaaa

SEQ ID NO: 504294 - RNA, 14 nt, Chlamydophila pneumoniae CWL029
ccuugaaaaucaag

SEQ ID NO: 504295 - RNA, 22 nt, Chlamydophila pneumoniae CWL029
ccuugaaaaucaagaagagaaa

SEQ ID NO: 504296 - RNA, 21 nt, Chlamydophila pneumoniae CWL029
ccuugaaagacucgcucuccu

SEQ ID NO: 504297 - RNA, 16 nt, Chlamydophila pneumoniae CWL029
ccuucggaucuuccca

SEQ ID NO: 504298 - RNA, 15 nt, Chlamydophila pneumoniae CWL029
ccuucuuaguaaaga

SEQ ID NO: 504299 - RNA, 12 nt, Chlamydophila pneumoniae CWL029
ccuucuucuuca

SEQ ID NO: 504300 - RNA, 23 nt, Chlamydophila pneumoniae CWL029
ccuucgaagcggagcaucuuuuc

SEQ ID NO: 504301 - RNA, 11 nt, Chlamydophila pneumoniae CWL029
ccuucagaucg

SEQ ID NO: 504302 - RNA, 17 nt, Chlamydophila pneumoniae CWL029
ccuuacaagcuuccuug

SEQ ID NO: 504303 - RNA, 23 nt, Chlamydophila pneumoniae CWL029
ccuuaugcucauuaauaauaucu

SEQ ID NO: 504304 - RNA, 17 nt, Chlamydophila pneumoniae CWL029
ccuuaucuucagaaugc

SEQ ID NO: 504305 - RNA, 19 nt, Chlamydophila pneumoniae CWL029
ccuguacgguaaauccauu

SEQ ID NO: 504306 - RNA, 17 nt, Chlamydophila pneumoniae CWL029
ccuguacgguaaaucca

SEQ ID NO: 504307 - RNA, 20 nt, Chlamydophila pneumoniae CWL029
ccuguaauugauguuccuug

SEQ ID NO: 504308 - RNA, 21 nt, Chlamydophila pneumoniae CWL029
ccugggggacuucaaaugaaa

SEQ ID NO: 504309 - RNA, 21 nt, Chlamydophila pneumoniae CWL029
ccugggcuuauuauugaauaa

SEQ ID NO: 504310 - RNA, 22 nt, Chlamydophila pneumoniae CWL029
ccugggcuuauuauugaauaag

SEQ ID NO: 504311 - RNA, 21 nt, Chlamydophila pneumoniae CWL029
ccugcuucuauagagacacga

SEQ ID NO: 504312 - RNA, 17 nt, Chlamydophila pneumoniae CWL029
ccugcuuuuuuucuaga

SEQ ID NO: 504313 - RNA, 22 nt, Chlamydophila pneumoniae CWL029
ccuggacugcugacaucuccaa

SEQ ID NO: 504314 - RNA, 18 nt, Chlamydophila pneumoniae CWL029
ccuggacgauauaaucac

SEQ ID NO: 504315 - RNA, 17 nt, Chlamydophila pneumoniae CWL029
ccugcaccagacccucg

SEQ ID NO: 504316 - RNA, 22 nt, Chlamydophila pneumoniae CWL029
ccugcaguauuauaaauagaaa

SEQ ID NO: 504317 - RNA, 15 nt, Chlamydophila pneumoniae CWL029
ccucgccgcugcccu

SEQ ID NO: 504318 - RNA, 16 nt, Chlamydophila pneumoniae CWL029
ccucgccgcugcccua

SEQ ID NO: 504319 - RNA, 17 nt, Chlamydophila pneumoniae CWL029
ccucgaauuccucccag

SEQ ID NO: 504320 - RNA, 22 nt, Chlamydophila pneumoniae CWL029
ccuccugcagggggcauucccu

SEQ ID NO: 504321 - RNA, 17 nt, Chlamydophila pneumoniae CWL029
ccuccuucugcaugaau

SEQ ID NO: 504322 - RNA, 15 nt, Chlamydophila pneumoniae CWL029
ccuccaccaggagcu

SEQ ID NO: 504323 - RNA, 14 nt, Chlamydophila pneumoniae CWL029
aaacgcaccuuagc

SEQ ID NO: 504324 - RNA, 15 nt, Chlamydophila pneumoniae CWL029
ccuccaaauacgaac

SEQ ID NO: 504325 - RNA, 19 nt, Chlamydophila pneumoniae CWL029
aaacgcaaugauuucucua

SEQ ID NO: 504326 - RNA, 17 nt, Chlamydophila pneumoniae CWL029
ccucauccucaucauca

SEQ ID NO: 504327 - RNA, 20 nt, Chlamydophila pneumoniae CWL029
ccucacagaauuguuuuguu

SEQ ID NO: 504328 - RNA, 15 nt, Chlamydophila pneumoniae CWL029
ccucacaucuccuuu

SEQ ID NO: 504329 - RNA, 23 nt, Chlamydophila pneumoniae CWL029
ccuauuuucuuaugaccaagaac

SEQ ID NO: 504330 - RNA, 14 nt, Chlamydophila pneumoniae CWL029
ccuagggucuucuc

SEQ ID NO: 504331 - RNA, 16 nt, Chlamydophila pneumoniae CWL029
ccuagggucuucucga

SEQ ID NO: 504332 - RNA, 11 nt, Chlamydophila pneumoniae CWL029
ccuaggaggau

SEQ ID NO: 504333 - RNA, 13 nt, Chlamydophila pneumoniae CWL029
ccuagguucuuuu

SEQ ID NO: 504334 - RNA, 14 nt, Chlamydophila pneumoniae CWL029
ccuagguucuuuuc

SEQ ID NO: 504335 - RNA, 21 nt, Chlamydophila pneumoniae CWL029
ccuaguucauuagcuaaauca

SEQ ID NO: 504336 - RNA, 23 nt, Chlamydophila pneumoniae CWL029
ccuaguucauuagcuaaaucaaa

SEQ ID NO: 504337 - RNA, 18 nt, Chlamydophila pneumoniae CWL029
ccuauaaaaaccuuaucg

SEQ ID NO: 504338 - RNA, 13 nt, Chlamydophila pneumoniae CWL029
ccuauauuuuuua

SEQ ID NO: 504339 - RNA, 21 nt, Chlamydophila pneumoniae CWL029
ccuauauuuuuuacauaacac

SEQ ID NO: 504340 - RNA, 22 nt, Chlamydophila pneumoniae CWL029
ccuauaucgccguuaaagacuu

SEQ ID NO: 504341 - RNA, 21 nt, Chlamydophila pneumoniae CWL029
ccuauaguauaauagugagcu

SEQ ID NO: 504342 - RNA, 13 nt, Chlamydophila pneumoniae CWL029
ccuaucaaagcaa

SEQ ID NO: 504343 - RNA, 14 nt, Chlamydophila pneumoniae CWL029
ccuaucaaagcaaa

SEQ ID NO: 504344 - RNA, 23 nt, Chlamydophila pneumoniae CWL029
ccuacagaucaggauucuaaaaa

SEQ ID NO: 504345 - RNA, 17 nt, Chlamydophila pneumoniae CWL029
ccuacauggaucccugu

SEQ ID NO: 504346 - RNA, 14 nt, Chlamydophila pneumoniae CWL029
ccuacaucugugau

SEQ ID NO: 504347 - RNA, 20 nt, Chlamydophila pneumoniae CWL029
ccuaccaaaguuuguagcau

SEQ ID NO: 504348 - RNA, 15 nt, Chlamydophila pneumoniae CWL029
ccuacguuuucucua

SEQ ID NO: 504349 - RNA, 16 nt, Chlamydophila pneumoniae CWL029
ccuacugggaaaucua

SEQ ID NO: 504350 - RNA, 20 nt, Chlamydophila pneumoniae CWL029
ccuagaaaagcaaccuuaaa

SEQ ID NO: 504351 - RNA, 19 nt, Chlamydophila pneumoniae CWL029
ccuagagaguucuuguaau

SEQ ID NO: 504352 - RNA, 21 nt, Chlamydophila pneumoniae CWL029
ccuagagaguucuuguaauaa

SEQ ID NO: 504353 - RNA, 23 nt, Chlamydophila pneumoniae CWL029
ccuagaaggaggaguccuucuag

SEQ ID NO: 504354 - RNA, 19 nt, Chlamydophila pneumoniae CWL029
ccuagaauaggaauugcag

SEQ ID NO: 504355 - RNA, 18 nt, Chlamydophila pneumoniae CWL029
ccuagaaucacauaaaau

SEQ ID NO: 504356 - RNA, 15 nt, Chlamydophila pneumoniae CWL029
ccuaccugaggagcg

SEQ ID NO: 504357 - RNA, 15 nt, Chlamydophila pneumoniae CWL029
ccuacgaauccaaaa

SEQ ID NO: 504358 - RNA, 16 nt, Chlamydophila pneumoniae CWL029
ccuaagggcucuccua

SEQ ID NO: 504359 - RNA, 20 nt, Chlamydophila pneumoniae CWL029
ccuaagguuuccaugagaau

SEQ ID NO: 504360 - RNA, 15 nt, Chlamydophila pneumoniae CWL029
ccuaagagauuuucc

SEQ ID NO: 504361 - RNA, 15 nt, Chlamydophila pneumoniae CWL029
ccuaacggcuugccu

SEQ ID NO: 504362 - RNA, 16 nt, Chlamydophila pneumoniae CWL029
ccuaacuaucucuguu

SEQ ID NO: 504363 - RNA, 17 nt, Chlamydophila pneumoniae CWL029
ccuaaauucauaacacc

SEQ ID NO: 504364 - RNA, 19 nt, Chlamydophila pneumoniae CWL029
ccuaaaucugcuuuuaucu

SEQ ID NO: 504365 - RNA, 20 nt, Chlamydophila pneumoniae CWL029
ccuaaaguaacgauaagaag

SEQ ID NO: 504366 - RNA, 21 nt, Chlamydophila pneumoniae CWL029
ccuaaagaauuuguaacucuu

SEQ ID NO: 504367 - RNA, 19 nt, Chlamydophila pneumoniae CWL029
ccuaaaaaggucagcccug

SEQ ID NO: 504368 - RNA, 13 nt, Chlamydophila pneumoniae CWL029
ccguuuccuccuc

SEQ ID NO: 504369 - RNA, 14 nt, Chlamydophila pneumoniae CWL029
ccguuuccuccucu

SEQ ID NO: 504370 - RNA, 13 nt, Chlamydophila pneumoniae CWL029
ccguuugucccuu

SEQ ID NO: 504371 - RNA, 23 nt, Chlamydophila pneumoniae CWL029
ccguuucaggaaacucaaucucu

SEQ ID NO: 504372 - RNA, 14 nt, Chlamydophila pneumoniae CWL029
ccguuaauuuuugc

SEQ ID NO: 504373 - RNA, 17 nt, Chlamydophila pneumoniae CWL029
aaacgaucccuacacug

SEQ ID NO: 504374 - RNA, 16 nt, Chlamydophila pneumoniae CWL029
aaacgaauuucuuguu

SEQ ID NO: 504375 - RNA, 19 nt, Chlamydophila pneumoniae CWL029
aaacgagacugcaaaggaa

SEQ ID NO: 504376 - RNA, 21 nt, Chlamydophila pneumoniae CWL029
ccgcuguauuuucagcacuga

SEQ ID NO: 504377 - RNA, 14 nt, Chlamydophila pneumoniae CWL029
ccgcuguauuuuca

SEQ ID NO: 504378 - RNA, 18 nt, Chlamydophila pneumoniae CWL029
ccggauucuuuaucccca

SEQ ID NO: 504379 - RNA, 15 nt, Chlamydophila pneumoniae CWL029
aaacccgcaacucuu

SEQ ID NO: 504380 - RNA, 14 nt, Chlamydophila pneumoniae CWL029
aaacccauguuucu

SEQ ID NO: 504381 - RNA, 16 nt, Chlamydophila pneumoniae CWL029
ccgccguggaauagcu

SEQ ID NO: 504382 - RNA, 17 nt, Chlamydophila pneumoniae CWL029
aaaccauaagaaugguu

SEQ ID NO: 504383 - RNA, 21 nt, Chlamydophila pneumoniae CWL029
aaaccauauugcaaagcaucu

SEQ ID NO: 504384 - RNA, 17 nt, Chlamydophila pneumoniae CWL029
aaaccaucacuuccugu

SEQ ID NO: 504385 - RNA, 14 nt, Chlamydophila pneumoniae CWL029
aaaccacuucucug

SEQ ID NO: 504386 - RNA, 13 nt, Chlamydophila pneumoniae CWL029
ccgcauauugauc

SEQ ID NO: 504387 - RNA, 13 nt, Chlamydophila pneumoniae CWL029
ccgcagcuucucu

SEQ ID NO: 504388 - RNA, 19 nt, Chlamydophila pneumoniae CWL029
aaaccacggauuuucucua

SEQ ID NO: 504389 - RNA, 17 nt, Chlamydophila pneumoniae CWL029
ccgacauucacccucau

SEQ ID NO: 504390 - RNA, 14 nt, Chlamydophila pneumoniae CWL029
ccgacauuuaacau

SEQ ID NO: 504391 - RNA, 13 nt, Chlamydophila pneumoniae CWL029
ccgagaauacaga

SEQ ID NO: 504392 - RNA, 16 nt, Chlamydophila pneumoniae CWL029
aaacaucgcagcagga

SEQ ID NO: 504393 - RNA, 13 nt, Chlamydophila pneumoniae CWL029
ccgaagcauuccc

SEQ ID NO: 504394 - RNA, 21 nt, Chlamydophila pneumoniae CWL029
ccgaagccuucauuccaugag

SEQ ID NO: 504395 - RNA, 15 nt, Chlamydophila pneumoniae CWL029
aaacaucagagaacu

SEQ ID NO: 504396 - RNA, 19 nt, Chlamydophila pneumoniae CWL029
cccuuacgguaauccccaa

SEQ ID NO: 504397 - RNA, 23 nt, Chlamydophila pneumoniae CWL029
cccuuaaagagaaucuccucauc

SEQ ID NO: 504398 - RNA, 18 nt, Chlamydophila pneumoniae CWL029
aaacagauuuuucaagaa

SEQ ID NO: 504399 - RNA, 14 nt, Chlamydophila pneumoniae CWL029
aaacagcaaaguaa

SEQ ID NO: 504400 - RNA, 16 nt, Chlamydophila pneumoniae CWL029
aaacaggaauaggcuc

SEQ ID NO: 504401 - RNA, 17 nt, Chlamydophila pneumoniae CWL029
aaacaggaauaggcucu

SEQ ID NO: 504402 - RNA, 22 nt, Chlamydophila pneumoniae CWL029
aaacagcgguugccuuucucuu

SEQ ID NO: 504403 - RNA, 15 nt, Chlamydophila pneumoniae CWL029
aaacagcaucaggau

SEQ ID NO: 504404 - RNA, 11 nt, Chlamydophila pneumoniae CWL029
cccucuucauc

SEQ ID NO: 504405 - RNA, 23 nt, Chlamydophila pneumoniae CWL029
cccucuucauccgaagacucaaa

SEQ ID NO: 504406 - RNA, 18 nt, Chlamydophila pneumoniae CWL029
cccugaaugcaacagagu

SEQ ID NO: 504407 - RNA, 15 nt, Chlamydophila pneumoniae CWL029
cccugagccugugau

SEQ ID NO: 504408 - RNA, 21 nt, Chlamydophila pneumoniae CWL029
cccugauuccauccugucuau

SEQ ID NO: 504409 - RNA, 13 nt, Chlamydophila pneumoniae CWL029
cccucgccaaacc

SEQ ID NO: 504410 - RNA, 14 nt, Chlamydophila pneumoniae CWL029
cccucgccaaacca

SEQ ID NO: 504411 - RNA, 13 nt, Chlamydophila pneumoniae CWL029
cccucgaaccacu

SEQ ID NO: 504412 - RNA, 20 nt, Chlamydophila pneumoniae CWL029
cccucauaagauuuccccaa

SEQ ID NO: 504413 - RNA, 21 nt, Chlamydophila pneumoniae CWL029
cccucauaagauuuccccaag

SEQ ID NO: 504414 - RNA, 19 nt, Chlamydophila pneumoniae CWL029
cccuccaaaaucaucagcu

SEQ ID NO: 504415 - RNA, 13 nt, Chlamydophila pneumoniae CWL029
cccuccaccagaa

SEQ ID NO: 504416 - RNA, 12 nt, Chlamydophila pneumoniae CWL029
cccuacccucau

SEQ ID NO: 504417 - RNA, 17 nt, Chlamydophila pneumoniae CWL029
cccuagagguauuuccu

SEQ ID NO: 504418 - RNA, 22 nt, Chlamydophila pneumoniae CWL029
cccuauagaacaugaggcacau

SEQ ID NO: 504419 - RNA, 20 nt, Chlamydophila pneumoniae CWL029
cccuaagguagaguccacag

SEQ ID NO: 504420 - RNA, 13 nt, Chlamydophila pneumoniae CWL029
cccgugacugcgu

SEQ ID NO: 504421 - RNA, 10 nt, Chlamydophila pneumoniae CWL029
ccccucucuc

SEQ ID NO: 504422 - RNA, 14 nt, Chlamydophila pneumoniae CWL029
ccccuugcacccca

SEQ ID NO: 504423 - RNA, 17 nt, Chlamydophila pneumoniae CWL029
ccccuucuaauacuuua

SEQ ID NO: 504424 - RNA, 13 nt, Chlamydophila pneumoniae CWL029
cccgagcuuccau

SEQ ID NO: 504425 - RNA, 14 nt, Chlamydophila pneumoniae CWL029
cccccagcauucac

SEQ ID NO: 504426 - RNA, 22 nt, Chlamydophila pneumoniae CWL029
ccccaguuucuugauauuuguc

SEQ ID NO: 504427 - RNA, 13 nt, Chlamydophila pneumoniae CWL029
ccccauaaaaauu

SEQ ID NO: 504428 - RNA, 12 nt, Chlamydophila pneumoniae CWL029
cccauguuucuu

SEQ ID NO: 504429 - RNA, 14 nt, Chlamydophila pneumoniae CWL029
ccccacccacucca

SEQ ID NO: 504430 - RNA, 22 nt, Chlamydophila pneumoniae CWL029
ccccaccaaagugacuuccucc

SEQ ID NO: 504431 - RNA, 19 nt, Chlamydophila pneumoniae CWL029
cccaguuuuccauccacga

SEQ ID NO: 504432 - RNA, 20 nt, Chlamydophila pneumoniae CWL029
aaacacaaauagcaagagcu

SEQ ID NO: 504433 - RNA, 22 nt, Chlamydophila pneumoniae CWL029
aaacaauuuccugcauggcuuu

SEQ ID NO: 504434 - RNA, 14 nt, Chlamydophila pneumoniae CWL029
cccauagagccuug

SEQ ID NO: 504435 - RNA, 13 nt, Chlamydophila pneumoniae CWL029
cccauagcaugag

SEQ ID NO: 504436 - RNA, 13 nt, Chlamydophila pneumoniae CWL029
cccauauuccuau

SEQ ID NO: 504437 - RNA, 13 nt, Chlamydophila pneumoniae CWL029
cccagauuuuuuu

SEQ ID NO: 504438 - RNA, 13 nt, Chlamydophila pneumoniae CWL029
cccaagggccaga

SEQ ID NO: 504439 - RNA, 11 nt, Chlamydophila pneumoniae CWL029
cccagccuuga

SEQ ID NO: 504440 - RNA, 13 nt, Chlamydophila pneumoniae CWL029
cccaagcucucuc

SEQ ID NO: 504441 - RNA, 13 nt, Chlamydophila pneumoniae CWL029
cccaaggaaaaac

SEQ ID NO: 504442 - RNA, 13 nt, Chlamydophila pneumoniae CWL029
ccauuuuuccucc

SEQ ID NO: 504443 - RNA, 17 nt, Chlamydophila pneumoniae CWL029
ccauuuucuaagagauc

SEQ ID NO: 504444 - RNA, 14 nt, Chlamydophila pneumoniae CWL029
ccauuuggagagcu

SEQ ID NO: 504445 - RNA, 14 nt, Chlamydophila pneumoniae CWL029
ccauucugaccaaa

SEQ ID NO: 504446 - RNA, 17 nt, Chlamydophila pneumoniae CWL029
ccauuagggcauucugu

SEQ ID NO: 504447 - RNA, 16 nt, Chlamydophila pneumoniae CWL029
ccauguuucuuccuga

SEQ ID NO: 504448 - RNA, 23 nt, Chlamydophila pneumoniae CWL029
ccauuaaauuguauggaauucaa

SEQ ID NO: 504449 - RNA, 17 nt, Chlamydophila pneumoniae CWL029
ccauuaauaucccaguu

SEQ ID NO: 504450 - RNA, 18 nt, Chlamydophila pneumoniae CWL029
ccauuaauaucccaguuu

SEQ ID NO: 504451 - RNA, 19 nt, Chlamydophila pneumoniae CWL029
ccaugucuaaagauuggaa

SEQ ID NO: 504452 - RNA, 21 nt, Chlamydophila pneumoniae CWL029
ccaugucuaaagauuggaaua

SEQ ID NO: 504453 - RNA, 15 nt, Chlamydophila pneumoniae CWL029
ccaugucuaaaggag

SEQ ID NO: 504454 - RNA, 20 nt, Chlamydophila pneumoniae CWL029
ccauggaauggcuacuuuaa

SEQ ID NO: 504455 - RNA, 16 nt, Chlamydophila pneumoniae CWL029
ccauggauauggaaug

SEQ ID NO: 504456 - RNA, 22 nt, Chlamydophila pneumoniae CWL029
ccaugcagccugcgacuacaag

SEQ ID NO: 504457 - RNA, 16 nt, Chlamydophila pneumoniae CWL029
ccaucuuguucuaaaa

SEQ ID NO: 504458 - RNA, 15 nt, Chlamydophila pneumoniae CWL029
ccaucauaauuugac

SEQ ID NO: 504459 - RNA, 17 nt, Chlamydophila pneumoniae CWL029
aaacaaucuaaagguuu

SEQ ID NO: 504460 - RNA, 22 nt, Chlamydophila pneumoniae CWL029
aaacaaucuuguaaguuacgga

SEQ ID NO: 504461 - RNA, 21 nt, Chlamydophila pneumoniae CWL029
ccauauuccuauaacaacauu

SEQ ID NO: 504462 - RNA, 14 nt, Chlamydophila pneumoniae CWL029
ccauccucagucuc

SEQ ID NO: 504463 - RNA, 17 nt, Chlamydophila pneumoniae CWL029
ccauccacgaccucgaa

SEQ ID NO: 504464 - RNA, 17 nt, Chlamydophila pneumoniae CWL029
ccauccacgaccugcaa

SEQ ID NO: 504465 - RNA, 13 nt, Chlamydophila pneumoniae CWL029
ccauccacgaccu

SEQ ID NO: 504466 - RNA, 15 nt, Chlamydophila pneumoniae CWL029
ccauaggaucugcau

SEQ ID NO: 504467 - RNA, 19 nt, Chlamydophila pneumoniae CWL029
ccauagcgauagcuaaacc

SEQ ID NO: 504468 - RNA, 12 nt, Chlamydophila pneumoniae CWL029
ccauacccaaau

SEQ ID NO: 504469 - RNA, 20 nt, Chlamydophila pneumoniae CWL029
ccauacccaaauuucuucug

SEQ ID NO: 504470 - RNA, 21 nt, Chlamydophila pneumoniae CWL029
ccauaaaaauguaauuuuuuc

SEQ ID NO: 504471 - RNA, 22 nt, Chlamydophila pneumoniae CWL029
ccauaaaaauguaauuuuuuca

SEQ ID NO: 504472 - RNA, 22 nt, Chlamydophila pneumoniae CWL029
ccauaaugagacagacagucug

SEQ ID NO: 504473 - RNA, 19 nt, Chlamydophila pneumoniae CWL029
ccaguuguauccagcucaa

SEQ ID NO: 504474 - RNA, 18 nt, Chlamydophila pneumoniae CWL029
ccaguuuuccauccacga

SEQ ID NO: 504475 - RNA, 15 nt, Chlamydophila pneumoniae CWL029
ccaguuacugucugc

SEQ ID NO: 504476 - RNA, 23 nt, Chlamydophila pneumoniae CWL029
ccaguagaucuucugaaaucaaa

SEQ ID NO: 504477 - RNA, 19 nt, Chlamydophila pneumoniae CWL029
ccagguguagguuccugcu

SEQ ID NO: 504478 - RNA, 14 nt, Chlamydophila pneumoniae CWL029
cgcaaucagcaaca

SEQ ID NO: 504479 - RNA, 20 nt, Chlamydophila pneumoniae CWL029
cgcaaguaaagaaauucugg

SEQ ID NO: 504480 - RNA, 21 nt, Chlamydophila pneumoniae CWL029
cgcaauccaggaauagaaaga

SEQ ID NO: 504481 - RNA, 14 nt, Chlamydophila pneumoniae CWL029
cgcacuucuauuuc

SEQ ID NO: 504482 - RNA, 12 nt, Chlamydophila pneumoniae CWL029
cgcaguaaugcc

SEQ ID NO: 504483 - RNA, 20 nt, Chlamydophila pneumoniae CWL029
cgauucucguguagaauuca

SEQ ID NO: 504484 - RNA, 20 nt, Chlamydophila pneumoniae CWL029
cgauuuagccguagauagua

SEQ ID NO: 504485 - RNA, 22 nt, Chlamydophila pneumoniae CWL029
cgauggcaguuuuaaugagagc

SEQ ID NO: 504486 - RNA, 20 nt, Chlamydophila pneumoniae CWL029
cgaucucucuuccugcugcu

SEQ ID NO: 504487 - RNA, 15 nt, Chlamydophila pneumoniae CWL029
cgaugacuuggcugg

SEQ ID NO: 504488 - RNA, 18 nt, Chlamydophila pneumoniae CWL029
cgaucgcaaucagcaaca

SEQ ID NO: 504489 - RNA, 17 nt, Chlamydophila pneumoniae CWL029
cgaucgcgauaagaagc

SEQ ID NO: 504490 - RNA, 17 nt, Chlamydophila pneumoniae CWL029
cgauaccgcuguuuuau

SEQ ID NO: 504491 - RNA, 20 nt, Chlamydophila pneumoniae CWL029
cgauacccaucuagaaacau

SEQ ID NO: 504492 - RNA, 16 nt, Chlamydophila pneumoniae CWL029
cgauaacgauuucuug

SEQ ID NO: 504493 - RNA, 21 nt, Chlamydophila pneumoniae CWL029
cgauaacguugccuguuuuau

SEQ ID NO: 504494 - RNA, 20 nt, Chlamydophila pneumoniae CWL029
cgcccuucaggacaugccuu

SEQ ID NO: 504495 - RNA, 13 nt, Chlamydophila pneumoniae CWL029
cgcauaagagaca

SEQ ID NO: 504496 - RNA, 18 nt, Chlamydophila pneumoniae CWL029
cgcauaagagacauuucu

SEQ ID NO: 504497 - RNA, 14 nt, Chlamydophila pneumoniae CWL029
cgccagcaaagauu

SEQ ID NO: 504498 - RNA, 14 nt, Chlamydophila pneumoniae CWL029
cgcuuaaaaucagc

SEQ ID NO: 504499 - RNA, 21 nt, Chlamydophila pneumoniae CWL029
cgcuuaaaaucagcacacugc

SEQ ID NO: 504500 - RNA, 12 nt, Chlamydophila pneumoniae CWL029
cgcuucuuuuug

SEQ ID NO: 504501 - RNA, 20 nt, Chlamydophila pneumoniae CWL029
cgcuuccgacggagagagau

SEQ ID NO: 504502 - RNA, 22 nt, Chlamydophila pneumoniae CWL029
cgcuguaaauucagugauuccu

SEQ ID NO: 504503 - RNA, 21 nt, Chlamydophila pneumoniae CWL029
cgcucuugauagcuaagagca

SEQ ID NO: 504504 - RNA, 14 nt, Chlamydophila pneumoniae CWL029
cgcucucuuuaaaa

SEQ ID NO: 504505 - RNA, 13 nt, Chlamydophila pneumoniae CWL029
cgcucuuaacgag

SEQ ID NO: 504506 - RNA, 16 nt, Chlamydophila pneumoniae CWL029
cgcucguagguaugag

SEQ ID NO: 504507 - RNA, 16 nt, Chlamydophila pneumoniae CWL029
cgcucuaagcugugca

SEQ ID NO: 504508 - RNA, 21 nt, Chlamydophila pneumoniae CWL029
cgcuauccaugcuagaagaca

SEQ ID NO: 504509 - RNA, 22 nt, Chlamydophila pneumoniae CWL029
cgcuagagacagccuguuuucu

SEQ ID NO: 504510 - RNA, 15 nt, Chlamydophila pneumoniae CWL029
cgcuagccauagugu

SEQ ID NO: 504511 - RNA, 17 nt, Chlamydophila pneumoniae CWL029
cgcuacgguacuuuaca

SEQ ID NO: 504512 - RNA, 21 nt, Chlamydophila pneumoniae CWL029
cgcuagaggaucuucaaggua

SEQ ID NO: 504513 - RNA, 19 nt, Chlamydophila pneumoniae CWL029
cgcguuggugaugauuuga

SEQ ID NO: 504514 - RNA, 21 nt, Chlamydophila pneumoniae CWL029
cgccuauagauuccccaaacu

SEQ ID NO: 504515 - RNA, 12 nt, Chlamydophila pneumoniae CWL029
cgccuacaaguu

SEQ ID NO: 504516 - RNA, 14 nt, Chlamydophila pneumoniae CWL029
cggccaucauuaag

SEQ ID NO: 504517 - RNA, 12 nt, Chlamydophila pneumoniae CWL029
cgcuugcaucuu

SEQ ID NO: 504518 - RNA, 19 nt, Chlamydophila pneumoniae CWL029
cggcggagaauaucaucuu

SEQ ID NO: 504519 - RNA, 17 nt, Chlamydophila pneumoniae CWL029
uuuuuguuaaauuccca

SEQ ID NO: 504520 - RNA, 12 nt, Chlamydophila pneumoniae CWL029
uuuuuuaaaaau

SEQ ID NO: 504521 - RNA, 12 nt, Chlamydophila pneumoniae CWL029
uuuuuuaaccuc

SEQ ID NO: 504522 - RNA, 18 nt, Chlamydophila pneumoniae CWL029
uuuuucuauaauaaccuc

SEQ ID NO: 504523 - RNA, 14 nt, Chlamydophila pneumoniae CWL029
uuuuucccucgcua

SEQ ID NO: 504524 - RNA, 20 nt, Chlamydophila pneumoniae CWL029
uuuuuccauuuuuccuccuc

SEQ ID NO: 504525 - RNA, 16 nt, Chlamydophila pneumoniae CWL029
uuuuucccucgcuaaa

SEQ ID NO: 504526 - RNA, 18 nt, Chlamydophila pneumoniae CWL029
uuuuucccuuuaaaagua

SEQ ID NO: 504527 - RNA, 17 nt, Chlamydophila pneumoniae CWL029
uuuuuccaacuucaacu

SEQ ID NO: 504528 - RNA, 21 nt, Chlamydophila pneumoniae CWL029
uuuugauuaggcuucagagau

SEQ ID NO: 504529 - RNA, 19 nt, Chlamydophila pneumoniae CWL029
uuuugauucccuccuuccu

SEQ ID NO: 504530 - RNA, 13 nt, Chlamydophila pneumoniae CWL029
uuuuuggaaaacc

SEQ ID NO: 504531 - RNA, 17 nt, Chlamydophila pneumoniae CWL029
uuuuuggaaauccguaa

SEQ ID NO: 504532 - RNA, 12 nt, Chlamydophila pneumoniae CWL029
uuuuugaaugau

SEQ ID NO: 504533 - RNA, 14 nt, Chlamydophila pneumoniae CWL029
uuuuacuaucuccu

SEQ ID NO: 504534 - RNA, 16 nt, Chlamydophila pneumoniae CWL029
uuuuacguucuuucuu

SEQ ID NO: 504535 - RNA, 15 nt, Chlamydophila pneumoniae CWL029
uuuuacgaaucuuuu

SEQ ID NO: 504536 - RNA, 14 nt, Chlamydophila pneumoniae CWL029
uuuuacgaauuuca

SEQ ID NO: 504537 - RNA, 20 nt, Chlamydophila pneumoniae CWL029
uuuuacuugcccaaaaguuu

SEQ ID NO: 504538 - RNA, 23 nt, Chlamydophila pneumoniae CWL029
uuuuagacgugcucucuucuucu

SEQ ID NO: 504539 - RNA, 22 nt, Chlamydophila pneumoniae CWL029
uuuuagcauaaucuuuaacaaa

SEQ ID NO: 504540 - RNA, 13 nt, Chlamydophila pneumoniae CWL029
uuuuacaaugaag

SEQ ID NO: 504541 - RNA, 22 nt, Chlamydophila pneumoniae CWL029
uuuuaccaauaaggauagcauu

SEQ ID NO: 504542 - RNA, 17 nt, Chlamydophila pneumoniae CWL029
uuuuauccaccaagacu

SEQ ID NO: 504543 - RNA, 20 nt, Chlamydophila pneumoniae CWL029
uuuuaggaguugguugcagu

SEQ ID NO: 504544 - RNA, 14 nt, Chlamydophila pneumoniae CWL029
uuuuauugauaaug

SEQ ID NO: 504545 - RNA, 15 nt, Chlamydophila pneumoniae CWL029
uuuuauuuaaaauuu

SEQ ID NO: 504546 - RNA, 16 nt, Chlamydophila pneumoniae CWL029
uuuuauuuccuuaucc

SEQ ID NO: 504547 - RNA, 18 nt, Chlamydophila pneumoniae CWL029
uuuuauuaguuuugaaau

SEQ ID NO: 504548 - RNA, 14 nt, Chlamydophila pneumoniae CWL029
uuuuauuuuuaaau

SEQ ID NO: 504549 - RNA, 17 nt, Chlamydophila pneumoniae CWL029
uuuucaauaaccagaag

SEQ ID NO: 504550 - RNA, 21 nt, Chlamydophila pneumoniae CWL029
uuuuccaaaaacgauucgaaa

SEQ ID NO: 504551 - RNA, 20 nt, Chlamydophila pneumoniae CWL029
uuuuccauacccaaauuucu

SEQ ID NO: 504552 - RNA, 16 nt, Chlamydophila pneumoniae CWL029
uuuucuaagagaucua

SEQ ID NO: 504553 - RNA, 22 nt, Chlamydophila pneumoniae CWL029
uuuucuacuucaggaaauaauu

SEQ ID NO: 504554 - RNA, 21 nt, Chlamydophila pneumoniae CWL029
uuuucuagaaaagauucuaaa

SEQ ID NO: 504555 - RNA, 23 nt, Chlamydophila pneumoniae CWL029
uuuucuagaaacugcuccugaag

SEQ ID NO: 504556 - RNA, 13 nt, Chlamydophila pneumoniae CWL029
uuuucuaugaucc

SEQ ID NO: 504557 - RNA, 16 nt, Chlamydophila pneumoniae CWL029
uuuucccuuuuuagaa

SEQ ID NO: 504558 - RNA, 21 nt, Chlamydophila pneumoniae CWL029
uuuuccccuuggaaaucagaa

SEQ ID NO: 504559 - RNA, 16 nt, Chlamydophila pneumoniae CWL029
uuuucccacagcuugc

SEQ ID NO: 504560 - RNA, 23 nt, Chlamydophila pneumoniae CWL029
uuuuccauacccaaauuucuucu

SEQ ID NO: 504561 - RNA, 20 nt, Chlamydophila pneumoniae CWL029
uuuugaaaauugcauuuaaa

SEQ ID NO: 504562 - RNA, 13 nt, Chlamydophila pneumoniae CWL029
uuuugaagugcuu

SEQ ID NO: 504563 - RNA, 17 nt, Chlamydophila pneumoniae CWL029
uuuucucauagcuuccu

SEQ ID NO: 504564 - RNA, 21 nt, Chlamydophila pneumoniae CWL029
uuuucuuauagggaauuuuuu

SEQ ID NO: 504565 - RNA, 17 nt, Chlamydophila pneumoniae CWL029
uuuucuuccacacaacu

SEQ ID NO: 504566 - RNA, 13 nt, Chlamydophila pneumoniae CWL029
uuuucuuccaaag

SEQ ID NO: 504567 - RNA, 13 nt, Chlamydophila pneumoniae CWL029
uuuguaaaugucg

SEQ ID NO: 504568 - RNA, 15 nt, Chlamydophila pneumoniae CWL029
uuuguacacagagau

SEQ ID NO: 504569 - RNA, 17 nt, Chlamydophila pneumoniae CWL029
uuugggauaaaaaguuu

SEQ ID NO: 504570 - RNA, 14 nt, Chlamydophila pneumoniae CWL029
uuugcuccuccaaa

SEQ ID NO: 504571 - RNA, 14 nt, Chlamydophila pneumoniae CWL029
uuugcugaagauuu

SEQ ID NO: 504572 - RNA, 18 nt, Chlamydophila pneumoniae CWL029
uuugcugaagauuuuuuc

SEQ ID NO: 504573 - RNA, 17 nt, Chlamydophila pneumoniae CWL029
uuugcuggagacaacua

SEQ ID NO: 504574 - RNA, 17 nt, Chlamydophila pneumoniae CWL029
uuugcuacagcuucuuu

SEQ ID NO: 504575 - RNA, 17 nt, Chlamydophila pneumoniae CWL029
uuugcuagaucuggaga

SEQ ID NO: 504576 - RNA, 22 nt, Chlamydophila pneumoniae CWL029
uuuggauagaagcaugaagcag

SEQ ID NO: 504577 - RNA, 20 nt, Chlamydophila pneumoniae CWL029
uuuggcacaauccucacuau

SEQ ID NO: 504578 - RNA, 17 nt, Chlamydophila pneumoniae CWL029
uuuguggggauuuucag

SEQ ID NO: 504579 - RNA, 14 nt, Chlamydophila pneumoniae CWL029
uuugugaauuuuau

SEQ ID NO: 504580 - RNA, 21 nt, Chlamydophila pneumoniae CWL029
uuuguuucuucugugcaucag

SEQ ID NO: 504581 - RNA, 16 nt, Chlamydophila pneumoniae CWL029
uuuguuuuuccauuuu

SEQ ID NO: 504582 - RNA, 16 nt, Chlamydophila pneumoniae CWL029
uuuuaaagcaaaaauu

SEQ ID NO: 504583 - RNA, 20 nt, Chlamydophila pneumoniae CWL029
uuuuaaagcaaaaauucuag

SEQ ID NO: 504584 - RNA, 22 nt, Chlamydophila pneumoniae CWL029
uuuuaaguugguccaucgagaa

SEQ ID NO: 504585 - RNA, 13 nt, Chlamydophila pneumoniae CWL029
uuuuaaccucuuu

SEQ ID NO: 504586 - RNA, 22 nt, Chlamydophila pneumoniae CWL029
uucuacacuguuguaauaaaau

SEQ ID NO: 504587 - RNA, 16 nt, Chlamydophila pneumoniae CWL029
uucuacacgacgagga

SEQ ID NO: 504588 - RNA, 23 nt, Chlamydophila pneumoniae CWL029
uucuacaaugauauaaaagcuga

SEQ ID NO: 504589 - RNA, 21 nt, Chlamydophila pneumoniae CWL029
uucuacaucccaagggccaga

SEQ ID NO: 504590 - RNA, 23 nt, Chlamydophila pneumoniae CWL029
uucuaccaauaaccgaaacuucu

SEQ ID NO: 504591 - RNA, 16 nt, Chlamydophila pneumoniae CWL029
uucuaaaacuucaguu

SEQ ID NO: 504592 - RNA, 14 nt, Chlamydophila pneumoniae CWL029
uucuaaaagagcaa

SEQ ID NO: 504593 - RNA, 17 nt, Chlamydophila pneumoniae CWL029
uucuauauguaauuucc

SEQ ID NO: 504594 - RNA, 17 nt, Chlamydophila pneumoniae CWL029
uucuauuuucaggaggc

SEQ ID NO: 504595 - RNA, 22 nt, Chlamydophila pneumoniae CWL029
uucuauucgcugucuagaacac

SEQ ID NO: 504596 - RNA, 13 nt, Chlamydophila pneumoniae CWL029
uucuauguguucu

SEQ ID NO: 504597 - RNA, 17 nt, Chlamydophila pneumoniae CWL029
uucuauguguucucgaa

SEQ ID NO: 504598 - RNA, 18 nt, Chlamydophila pneumoniae CWL029
uucguauagcuggcaaug

SEQ ID NO: 504599 - RNA, 22 nt, Chlamydophila pneumoniae CWL029
uucguagacgcucuaaacucuc

SEQ ID NO: 504600 - RNA, 19 nt, Chlamydophila pneumoniae CWL029
uucguagacgcucuaaacu

SEQ ID NO: 504601 - RNA, 15 nt, Chlamydophila pneumoniae CWL029
uucuaaaaacucuuc

SEQ ID NO: 504602 - RNA, 20 nt, Chlamydophila pneumoniae CWL029
uucuaaaaagaaaagaccuc

SEQ ID NO: 504603 - RNA, 19 nt, Chlamydophila pneumoniae CWL029
uucggggagagaacuuuug

SEQ ID NO: 504604 - RNA, 12 nt, Chlamydophila pneumoniae CWL029
uuaucaggaaau

SEQ ID NO: 504605 - RNA, 20 nt, Chlamydophila pneumoniae CWL029
uuaucaggaacuaaaaguuu

SEQ ID NO: 504606 - RNA, 21 nt, Chlamydophila pneumoniae CWL029
uucugauugagaauaaaacuu

SEQ ID NO: 504607 - RNA, 22 nt, Chlamydophila pneumoniae CWL029
uucugauugagaauaaaacuuu

SEQ ID NO: 504608 - RNA, 21 nt, Chlamydophila pneumoniae CWL029
uucucugaacuugauuuguuu

SEQ ID NO: 504609 - RNA, 14 nt, Chlamydophila pneumoniae CWL029
uucucugagcagcu

SEQ ID NO: 504610 - RNA, 13 nt, Chlamydophila pneumoniae CWL029
uucugcaggauuu

SEQ ID NO: 504611 - RNA, 14 nt, Chlamydophila pneumoniae CWL029
uucucucucugcag

SEQ ID NO: 504612 - RNA, 22 nt, Chlamydophila pneumoniae CWL029
uucucuccacaggaaugaaacc

SEQ ID NO: 504613 - RNA, 21 nt, Chlamydophila pneumoniae CWL029
uucucuaugacuucuuguccu

SEQ ID NO: 504614 - RNA, 18 nt, Chlamydophila pneumoniae CWL029
uucucuacuaaaaucuca

SEQ ID NO: 504615 - RNA, 20 nt, Chlamydophila pneumoniae CWL029
uucucccgcuaauuaccauu

SEQ ID NO: 504616 - RNA, 14 nt, Chlamydophila pneumoniae CWL029
uucucaagaucuuc

SEQ ID NO: 504617 - RNA, 18 nt, Chlamydophila pneumoniae CWL029
uucucaagaucuucauca

SEQ ID NO: 504618 - RNA, 12 nt, Chlamydophila pneumoniae CWL029
uucucagaaaga

SEQ ID NO: 504619 - RNA, 15 nt, Chlamydophila pneumoniae CWL029
uucucagaaagauau

SEQ ID NO: 504620 - RNA, 15 nt, Chlamydophila pneumoniae CWL029
uucucccauagcaau

SEQ ID NO: 504621 - RNA, 21 nt, Chlamydophila pneumoniae CWL029
uucuccaguaucuucucuuau

SEQ ID NO: 504622 - RNA, 23 nt, Chlamydophila pneumoniae CWL029
uucugucuauaagauagcucuug

SEQ ID NO: 504623 - RNA, 12 nt, Chlamydophila pneumoniae CWL029
uucugcuagagc

SEQ ID NO: 504624 - RNA, 20 nt, Chlamydophila pneumoniae CWL029
uucuucugaauagcucuuuu

SEQ ID NO: 504625 - RNA, 15 nt, Chlamydophila pneumoniae CWL029
uucuucucuaagaaa

SEQ ID NO: 504626 - RNA, 14 nt, Chlamydophila pneumoniae CWL029
uucuucucuaggaa

SEQ ID NO: 504627 - RNA, 19 nt, Chlamydophila pneumoniae CWL029
uucuucguuuauaacauca

SEQ ID NO: 504628 - RNA, 14 nt, Chlamydophila pneumoniae CWL029
uucuuaguaaagaa

SEQ ID NO: 504629 - RNA, 15 nt, Chlamydophila pneumoniae CWL029
uucuuaucuucuaaa

SEQ ID NO: 504630 - RNA, 20 nt, Chlamydophila pneumoniae CWL029
uucuuaucaaaauaaaaaaa

SEQ ID NO: 504631 - RNA, 18 nt, Chlamydophila pneumoniae CWL029
uucuuaucacaaauuguc

SEQ ID NO: 504632 - RNA, 22 nt, Chlamydophila pneumoniae CWL029
uucuuauccuugaaauugcucu

SEQ ID NO: 504633 - RNA, 15 nt, Chlamydophila pneumoniae CWL029
uucuuauuacagaaa

SEQ ID NO: 504634 - RNA, 13 nt, Chlamydophila pneumoniae CWL029
uucuucgagagca

SEQ ID NO: 504635 - RNA, 23 nt, Chlamydophila pneumoniae CWL029
uugaugugcggcgagcucuagga

SEQ ID NO: 504636 - RNA, 13 nt, Chlamydophila pneumoniae CWL029
uugauguuccuug

SEQ ID NO: 504637 - RNA, 17 nt, Chlamydophila pneumoniae CWL029
uugcaaaaaugaaagaa

SEQ ID NO: 504638 - RNA, 17 nt, Chlamydophila pneumoniae CWL029
uugcaaaugaaaagaga

SEQ ID NO: 504639 - RNA, 13 nt, Chlamydophila pneumoniae CWL029
uugcaaaugaaaa

SEQ ID NO: 504640 - RNA, 12 nt, Chlamydophila pneumoniae CWL029
uugauucaaugc

SEQ ID NO: 504641 - RNA, 10 nt, Chlamydophila pneumoniae CWL029
uugcaacucu

SEQ ID NO: 504642 - RNA, 17 nt, Chlamydophila pneumoniae CWL029
uugauagcuaagagcau

SEQ ID NO: 504643 - RNA, 14 nt, Chlamydophila pneumoniae CWL029
uugauagaccggau

SEQ ID NO: 504644 - RNA, 19 nt, Chlamydophila pneumoniae CWL029
uugaggcaagucucaaagg

SEQ ID NO: 504645 - RNA, 17 nt, Chlamydophila pneumoniae CWL029
uugaggcaagucucaaa

SEQ ID NO: 504646 - RNA, 20 nt, Chlamydophila pneumoniae CWL029
uugaggaaucugaaucucau

SEQ ID NO: 504647 - RNA, 22 nt, Chlamydophila pneumoniae CWL029
uugaggauacgaauaaguuuug

SEQ ID NO: 504648 - RNA, 21 nt, Chlamydophila pneumoniae CWL029
uugagauaaucgcacuucuau

SEQ ID NO: 504649 - RNA, 11 nt, Chlamydophila pneumoniae CWL029
uugaggaaagg

SEQ ID NO: 504650 - RNA, 14 nt, Chlamydophila pneumoniae CWL029
uugaggaaaggagg

SEQ ID NO: 504651 - RNA, 14 nt, Chlamydophila pneumoniae CWL029
uugacuagcucucu

SEQ ID NO: 504652 - RNA, 14 nt, Chlamydophila pneumoniae CWL029
uugacaucuguagu

SEQ ID NO: 504653 - RNA, 21 nt, Chlamydophila pneumoniae CWL029
uugaaguuuugcucucuagau

SEQ ID NO: 504654 - RNA, 15 nt, Chlamydophila pneumoniae CWL029
uugaaguucuucaag

SEQ ID NO: 504655 - RNA, 18 nt, Chlamydophila pneumoniae CWL029
uugaagcuccucacaucu

SEQ ID NO: 504656 - RNA, 13 nt, Chlamydophila pneumoniae CWL029
uugaaauugcucu

SEQ ID NO: 504657 - RNA, 17 nt, Chlamydophila pneumoniae CWL029
uucuuucuaggccggga

SEQ ID NO: 504658 - RNA, 22 nt, Chlamydophila pneumoniae CWL029
uucuucuggauacguuuuuccc

SEQ ID NO: 504659 - RNA, 20 nt, Chlamydophila pneumoniae CWL029
uucuucuggcugagagaagc

SEQ ID NO: 504660 - RNA, 15 nt, Chlamydophila pneumoniae CWL029
uucuucuucagagcu

SEQ ID NO: 504661 - RNA, 11 nt, Chlamydophila pneumoniae CWL029
uucuuuuccug

SEQ ID NO: 504662 - RNA, 19 nt, Chlamydophila pneumoniae CWL029
uucuuucucggucuuucuu

SEQ ID NO: 504663 - RNA, 21 nt, Chlamydophila pneumoniae CWL029
uucuuuuagcuacuucuucuu

SEQ ID NO: 504664 - RNA, 21 nt, Chlamydophila pneumoniae CWL029
uugaaaagaaagaauaucuuu

SEQ ID NO: 504665 - RNA, 19 nt, Chlamydophila pneumoniae CWL029
uugaaaauauccuaaauau

SEQ ID NO: 504666 - RNA, 19 nt, Chlamydophila pneumoniae CWL029
uugucucaauugaaucaga

SEQ ID NO: 504667 - RNA, 20 nt, Chlamydophila pneumoniae CWL029
uugucucgaaacucuuugag

SEQ ID NO: 504668 - RNA, 14 nt, Chlamydophila pneumoniae CWL029
uugucccaaucaag

SEQ ID NO: 504669 - RNA, 12 nt, Chlamydophila pneumoniae CWL029
uugucccuuuca

SEQ ID NO: 504670 - RNA, 22 nt, Chlamydophila pneumoniae CWL029
uugugcaucuauaauuaauccu

SEQ ID NO: 504671 - RNA, 22 nt, Chlamydophila pneumoniae CWL029
uugugcuaaagcaggagcauca

SEQ ID NO: 504672 - RNA, 22 nt, Chlamydophila pneumoniae CWL029
uuguguuuuuggcauaaagacc

SEQ ID NO: 504673 - RNA, 16 nt, Chlamydophila pneumoniae CWL029
uuguuaaauucccaaa

SEQ ID NO: 504674 - RNA, 15 nt, Chlamydophila pneumoniae CWL029
uugugcgucaucaac

SEQ ID NO: 504675 - RNA, 12 nt, Chlamydophila pneumoniae CWL029
uuguggaaguaa

SEQ ID NO: 504676 - RNA, 23 nt, Chlamydophila pneumoniae CWL029
uuguggacaacgauuguaaaagu

SEQ ID NO: 504677 - RNA, 18 nt, Chlamydophila pneumoniae CWL029
uuguuaauggcagcuugg

SEQ ID NO: 504678 - RNA, 23 nt, Chlamydophila pneumoniae CWL029
uugguucuuggaguuaggaaaau

SEQ ID NO: 504679 - RNA, 14 nt, Chlamydophila pneumoniae CWL029
uuguaauuuccuua

SEQ ID NO: 504680 - RNA, 18 nt, Chlamydophila pneumoniae CWL029
uuguacuuuuacugaaau

SEQ ID NO: 504681 - RNA, 14 nt, Chlamydophila pneumoniae CWL029
uuguauaagagcaa

SEQ ID NO: 504682 - RNA, 15 nt, Chlamydophila pneumoniae CWL029
uuguauaagagcaag

SEQ ID NO: 504683 - RNA, 19 nt, Chlamydophila pneumoniae CWL029
uuguauaagagcaagguaa

SEQ ID NO: 504684 - RNA, 21 nt, Chlamydophila pneumoniae CWL029
uuguauauccacgaucuagaa

SEQ ID NO: 504685 - RNA, 22 nt, Chlamydophila pneumoniae CWL029
uuuaaaacuccacgccaaagua

SEQ ID NO: 504686 - RNA, 21 nt, Chlamydophila pneumoniae CWL029
uuuaaauacagauucaccaag

SEQ ID NO: 504687 - RNA, 22 nt, Chlamydophila pneumoniae CWL029
uuuaaauagcaucccuucuucu

SEQ ID NO: 504688 - RNA, 13 nt, Chlamydophila pneumoniae CWL029
uuuaaaugccuua

SEQ ID NO: 504689 - RNA, 19 nt, Chlamydophila pneumoniae CWL029
uuuaaaugccuuaaaugua

SEQ ID NO: 504690 - RNA, 13 nt, Chlamydophila pneumoniae CWL029
uuguuuguuuucu

SEQ ID NO: 504691 - RNA, 19 nt, Chlamydophila pneumoniae CWL029
uuguuuugcuuuuugaaug

SEQ ID NO: 504692 - RNA, 16 nt, Chlamydophila pneumoniae CWL029
uuuaaguccuucuucc

SEQ ID NO: 504693 - RNA, 20 nt, Chlamydophila pneumoniae CWL029
uuuaagucacuaaagauacu

SEQ ID NO: 504694 - RNA, 23 nt, Chlamydophila pneumoniae CWL029
uuuaaccucuuuucuuaucauga

SEQ ID NO: 504695 - RNA, 21 nt, Chlamydophila pneumoniae CWL029
uuuaacgcuaagcucuuaauu

SEQ ID NO: 504696 - RNA, 21 nt, Chlamydophila pneumoniae CWL029
uuuaaccgagcuuuuugcuuu

SEQ ID NO: 504697 - RNA, 17 nt, Chlamydophila pneumoniae CWL029
uuuaaccucuuuucuua

SEQ ID NO: 504698 - RNA, 16 nt, Chlamydophila pneumoniae CWL029
uuuaacucuagaucuu

SEQ ID NO: 504699 - RNA, 15 nt, Chlamydophila pneumoniae CWL029
uuuaacuuaaagacu

SEQ ID NO: 504700 - RNA, 19 nt, Chlamydophila pneumoniae CWL029
uuggcuauggaaagagucc

SEQ ID NO: 504701 - RNA, 23 nt, Chlamydophila pneumoniae CWL029
uuggcuccuguuauuguuucuau

SEQ ID NO: 504702 - RNA, 23 nt, Chlamydophila pneumoniae CWL029
uugggaugacuggcgacuugcca

SEQ ID NO: 504703 - RNA, 21 nt, Chlamydophila pneumoniae CWL029
uugguagagcaacacauucgu

SEQ ID NO: 504704 - RNA, 17 nt, Chlamydophila pneumoniae CWL029
uugggcaucucucuuua

SEQ ID NO: 504705 - RNA, 20 nt, Chlamydophila pneumoniae CWL029
uugguaugcagaguuuuaaa

SEQ ID NO: 504706 - RNA, 21 nt, Chlamydophila pneumoniae CWL029
uugguaugccgcaucuagaag

SEQ ID NO: 504707 - RNA, 22 nt, Chlamydophila pneumoniae CWL029
uugguguaucucuuaaaauauu

SEQ ID NO: 504708 - RNA, 23 nt, Chlamydophila pneumoniae CWL029
uuggacucuagggucaagaacag

SEQ ID NO: 504709 - RNA, 14 nt, Chlamydophila pneumoniae CWL029
uuggaaaaccauga

SEQ ID NO: 504710 - RNA, 23 nt, Chlamydophila pneumoniae CWL029
uugcuuugugaguucuuccuucu

SEQ ID NO: 504711 - RNA, 14 nt, Chlamydophila pneumoniae CWL029
uugcuuuucauuuu

SEQ ID NO: 504712 - RNA, 14 nt, Chlamydophila pneumoniae CWL029
uugcugaagauuuu

SEQ ID NO: 504713 - RNA, 23 nt, Chlamydophila pneumoniae CWL029
uugcugaagauuuuuucuugguc

SEQ ID NO: 504714 - RNA, 19 nt, Chlamydophila pneumoniae CWL029
uugcugauuucuuuuucag

SEQ ID NO: 504715 - RNA, 23 nt, Chlamydophila pneumoniae CWL029
uugcugcgaaugucguuaaaaac

SEQ ID NO: 504716 - RNA, 19 nt, Chlamydophila pneumoniae CWL029
uugcuguggaauuuuccug

SEQ ID NO: 504717 - RNA, 18 nt, Chlamydophila pneumoniae CWL029
uugcuguuucuucugaau

SEQ ID NO: 504718 - RNA, 21 nt, Chlamydophila pneumoniae CWL029
uugcgcggcgcauuuuuuccu

SEQ ID NO: 504719 - RNA, 14 nt, Chlamydophila pneumoniae CWL029
uugccuuuagagac

SEQ ID NO: 504720 - RNA, 22 nt, Chlamydophila pneumoniae CWL029
uugccuuuagggaaaaaguagu

SEQ ID NO: 504721 - RNA, 12 nt, Chlamydophila pneumoniae CWL029
uugccuuucucu

SEQ ID NO: 504722 - RNA, 19 nt, Chlamydophila pneumoniae CWL029
uugcgaacagcuccuggau

SEQ ID NO: 504723 - RNA, 15 nt, Chlamydophila pneumoniae CWL029
uugccaaucuuucau

SEQ ID NO: 504724 - RNA, 19 nt, Chlamydophila pneumoniae CWL029
uugcacucgauuauuucuu

SEQ ID NO: 504725 - RNA, 14 nt, Chlamydophila pneumoniae CWL029
uugcagaagcauug

SEQ ID NO: 504726 - RNA, 16 nt, Chlamydophila pneumoniae CWL029
uugcagcaaggagagu

SEQ ID NO: 504727 - RNA, 22 nt, Chlamydophila pneumoniae CWL029
uugcagaguuggaucauucuuu

SEQ ID NO: 504728 - RNA, 22 nt, Chlamydophila pneumoniae CWL029
uugcauucagggggaaagccaa

SEQ ID NO: 504729 - RNA, 22 nt, Chlamydophila pneumoniae CWL029
uugcaugcuugaaguucucaaa

SEQ ID NO: 504730 - RNA, 18 nt, Chlamydophila pneumoniae CWL029
uugcaucuuauggaagag

SEQ ID NO: 504731 - RNA, 16 nt, Chlamydophila pneumoniae CWL029
uuuaucccagauaaag

SEQ ID NO: 504732 - RNA, 13 nt, Chlamydophila pneumoniae CWL029
uuuauccaccaag

SEQ ID NO: 504733 - RNA, 21 nt, Chlamydophila pneumoniae CWL029
uuuaucuguuaaaaacaagau

SEQ ID NO: 504734 - RNA, 14 nt, Chlamydophila pneumoniae CWL029
uuuauguuuucucg

SEQ ID NO: 504735 - RNA, 22 nt, Chlamydophila pneumoniae CWL029
uuuaugacacagcuaaucaauc

SEQ ID NO: 504736 - RNA, 16 nt, Chlamydophila pneumoniae CWL029
uuuauauaaagaucuu

SEQ ID NO: 504737 - RNA, 23 nt, Chlamydophila pneumoniae CWL029
uuuaggagcauagacucuuccuu

SEQ ID NO: 504738 - RNA, 16 nt, Chlamydophila pneumoniae CWL029
uuuagcuacagaaaga

SEQ ID NO: 504739 - RNA, 15 nt, Chlamydophila pneumoniae CWL029
uuuagccuggucuca

SEQ ID NO: 504740 - RNA, 19 nt, Chlamydophila pneumoniae CWL029
uuuagacgaggagaagucg

SEQ ID NO: 504741 - RNA, 21 nt, Chlamydophila pneumoniae CWL029
uuuagaguacacagcacaaga

SEQ ID NO: 504742 - RNA, 17 nt, Chlamydophila pneumoniae CWL029
uuuagagccuuuucaga

SEQ ID NO: 504743 - RNA, 19 nt, Chlamydophila pneumoniae CWL029
uuuagaaauguuuuuaaac

SEQ ID NO: 504744 - RNA, 19 nt, Chlamydophila pneumoniae CWL029
uuuagaaauuccaauuuuu

SEQ ID NO: 504745 - RNA, 21 nt, Chlamydophila pneumoniae CWL029
uuuagaagguguuuuggcugc

SEQ ID NO: 504746 - RNA, 22 nt, Chlamydophila pneumoniae CWL029
uuuacuuuuaauccuuucacaa

SEQ ID NO: 504747 - RNA, 14 nt, Chlamydophila pneumoniae CWL029
uuuagaaaaagauc

SEQ ID NO: 504748 - RNA, 16 nt, Chlamydophila pneumoniae CWL029
uuuagaaaaagaucua

SEQ ID NO: 504749 - RNA, 13 nt, Chlamydophila pneumoniae CWL029
uuuacugaaauua

SEQ ID NO: 504750 - RNA, 20 nt, Chlamydophila pneumoniae CWL029
uuuacuaacaaaauuucuua

SEQ ID NO: 504751 - RNA, 22 nt, Chlamydophila pneumoniae CWL029
uuuacuaacaaaauuucuuaua

SEQ ID NO: 504752 - RNA, 22 nt, Chlamydophila pneumoniae CWL029
uuuacuaacucuguaauauuca

SEQ ID NO: 504753 - RNA, 17 nt, Chlamydophila pneumoniae CWL029
uuuccaaagaucgaucu

SEQ ID NO: 504754 - RNA, 20 nt, Chlamydophila pneumoniae CWL029
uuucauuuuuaggaucuuug

SEQ ID NO: 504755 - RNA, 23 nt, Chlamydophila pneumoniae CWL029
uuuccaagugaucagaaaugaag

SEQ ID NO: 504756 - RNA, 19 nt, Chlamydophila pneumoniae CWL029
uuucauucccuuuuuccau

SEQ ID NO: 504757 - RNA, 23 nt, Chlamydophila pneumoniae CWL029
uuucauucccuuuuuccauaccc

SEQ ID NO: 504758 - RNA, 12 nt, Chlamydophila pneumoniae CWL029
uuucauucccuu

SEQ ID NO: 504759 - RNA, 13 nt, Chlamydophila pneumoniae CWL029
uuucauucccuuu

SEQ ID NO: 504760 - RNA, 18 nt, Chlamydophila pneumoniae CWL029
uuucauucccuuuuucca

SEQ ID NO: 504761 - RNA, 17 nt, Chlamydophila pneumoniae CWL029
uuucauuugaaauauga

SEQ ID NO: 504762 - RNA, 18 nt, Chlamydophila pneumoniae CWL029
uuucauguaagaauguag

SEQ ID NO: 504763 - RNA, 15 nt, Chlamydophila pneumoniae CWL029
uuucaucuucuuucu

SEQ ID NO: 504764 - RNA, 14 nt, Chlamydophila pneumoniae CWL029
uuucauaaacaauu

SEQ ID NO: 504765 - RNA, 16 nt, Chlamydophila pneumoniae CWL029
uuucauaaacaauuca

SEQ ID NO: 504766 - RNA, 16 nt, Chlamydophila pneumoniae CWL029
uuucaggucagcaagg

SEQ ID NO: 504767 - RNA, 14 nt, Chlamydophila pneumoniae CWL029
uuucagucuuccuu

SEQ ID NO: 504768 - RNA, 16 nt, Chlamydophila pneumoniae CWL029
uuucagucuuccuuua

SEQ ID NO: 504769 - RNA, 19 nt, Chlamydophila pneumoniae CWL029
uuucaguuguuucuagaaa

SEQ ID NO: 504770 - RNA, 13 nt, Chlamydophila pneumoniae CWL029
uuucagaagaucu

SEQ ID NO: 504771 - RNA, 20 nt, Chlamydophila pneumoniae CWL029
uuucagauaaguuacuuucu

SEQ ID NO: 504772 - RNA, 24 nt, Chlamydophila pneumoniae CWL029
uuucagaagucacaaauuuuugca

SEQ ID NO: 504773 - RNA, 18 nt, Chlamydophila pneumoniae CWL029
uuucagcaugugcagaag

SEQ ID NO: 504774 - RNA, 19 nt, Chlamydophila pneumoniae CWL029
uuucaggaaacucaaucuc

SEQ ID NO: 504775 - RNA, 22 nt, Chlamydophila pneumoniae CWL029
uuucaggaaacucaaucucuuu

SEQ ID NO: 504776 - RNA, 16 nt, Chlamydophila pneumoniae CWL029
uuucaaagaagacacu

SEQ ID NO: 504777 - RNA, 14 nt, Chlamydophila pneumoniae CWL029
uuucaaacaauagu

SEQ ID NO: 504778 - RNA, 16 nt, Chlamydophila pneumoniae CWL029
uuuauuagaaguaucu

SEQ ID NO: 504779 - RNA, 18 nt, Chlamydophila pneumoniae CWL029
uuuauuuaaauaaaacca

SEQ ID NO: 504780 - RNA, 15 nt, Chlamydophila pneumoniae CWL029
uuucaaucucuccuu

SEQ ID NO: 504781 - RNA, 15 nt, Chlamydophila pneumoniae CWL029
uuucaauccuuccuu

SEQ ID NO: 504782 - RNA, 21 nt, Chlamydophila pneumoniae CWL029
uuucaauagcaguaucuagaa

SEQ ID NO: 504783 - RNA, 12 nt, Chlamydophila pneumoniae CWL029
uuucaauagcuu

SEQ ID NO: 504784 - RNA, 18 nt, Chlamydophila pneumoniae CWL029
uuucaauagcuuccaagg

SEQ ID NO: 504785 - RNA, 11 nt, Chlamydophila pneumoniae CWL029
uuucaauaaua

SEQ ID NO: 504786 - RNA, 16 nt, Chlamydophila pneumoniae CWL029
uuucaagaacuccuuu

SEQ ID NO: 504787 - RNA, 24 nt, Chlamydophila pneumoniae CWL029
uuucaagauugugcucaauacaga

SEQ ID NO: 504788 - RNA, 16 nt, Chlamydophila pneumoniae CWL029
uuucaacaccucaaua

SEQ ID NO: 504789 - RNA, 20 nt, Chlamydophila pneumoniae CWL029
uuucaacauaacaugagaaa

SEQ ID NO: 504790 - RNA, 20 nt, Chlamydophila pneumoniae CWL029
uuucacaagcauaaacuccu

SEQ ID NO: 504791 - RNA, 17 nt, Chlamydophila pneumoniae CWL029
uuucaccaacuccucua

SEQ ID NO: 504792 - RNA, 18 nt, Chlamydophila pneumoniae CWL029
uuucacauacauucuauu

SEQ ID NO: 504793 - RNA, 19 nt, Chlamydophila pneumoniae CWL029
uuugccaguucuugaaacu

SEQ ID NO: 504794 - RNA, 15 nt, Chlamydophila pneumoniae CWL029
uuugccauuucuauc

SEQ ID NO: 504795 - RNA, 21 nt, Chlamydophila pneumoniae CWL029
uuugccuuuagggaaaaagua

SEQ ID NO: 504796 - RNA, 14 nt, Chlamydophila pneumoniae CWL029
uuugcgauuucagc

SEQ ID NO: 504797 - RNA, 13 nt, Chlamydophila pneumoniae CWL029
uuugcaaaucuuc

SEQ ID NO: 504798 - RNA, 13 nt, Chlamydophila pneumoniae CWL029
uuugcaugaggag

SEQ ID NO: 504799 - RNA, 13 nt, Chlamydophila pneumoniae CWL029
uuugauucauaaa

SEQ ID NO: 504800 - RNA, 22 nt, Chlamydophila pneumoniae CWL029
uuugauucccggaggcaaagau

SEQ ID NO: 504801 - RNA, 14 nt, Chlamydophila pneumoniae CWL029
uuugaucuucucua

SEQ ID NO: 504802 - RNA, 18 nt, Chlamydophila pneumoniae CWL029
uuugaucuugcucaggag

SEQ ID NO: 504803 - RNA, 14 nt, Chlamydophila pneumoniae CWL029
uuugaggauuucuu

SEQ ID NO: 504804 - RNA, 13 nt, Chlamydophila pneumoniae CWL029
uuugagaaugaac

SEQ ID NO: 504805 - RNA, 22 nt, Chlamydophila pneumoniae CWL029
uuugagauaaucgcacuucuau

SEQ ID NO: 504806 - RNA, 16 nt, Chlamydophila pneumoniae CWL029
uuucuucaacauacac

SEQ ID NO: 504807 - RNA, 18 nt, Chlamydophila pneumoniae CWL029
uuucuucaggaacagcau

SEQ ID NO: 504808 - RNA, 20 nt, Chlamydophila pneumoniae CWL029
uuucuuauagcuuuggaacg

SEQ ID NO: 504809 - RNA, 14 nt, Chlamydophila pneumoniae CWL029
uuucuuaauuuccu

SEQ ID NO: 504810 - RNA, 22 nt, Chlamydophila pneumoniae CWL029
uuucuguacaacaaaauuugca

SEQ ID NO: 504811 - RNA, 16 nt, Chlamydophila pneumoniae CWL029
uuucuguucugcuucu

SEQ ID NO: 504812 - RNA, 11 nt, Chlamydophila pneumoniae CWL029
uuucuucuuuc

SEQ ID NO: 504813 - RNA, 14 nt, Chlamydophila pneumoniae CWL029
uuucuugaaaaauc

SEQ ID NO: 504814 - RNA, 18 nt, Chlamydophila pneumoniae CWL029
uuucuucucuaagaaauu

SEQ ID NO: 504815 - RNA, 15 nt, Chlamydophila pneumoniae CWL029
uuucuuccauacagg

SEQ ID NO: 504816 - RNA, 22 nt, Chlamydophila pneumoniae CWL029
uuucuuccaaagacugagcuuc

SEQ ID NO: 504817 - RNA, 24 nt, Chlamydophila pneumoniae CWL029
uuucuuccacacaacucguuucag

SEQ ID NO: 504818 - RNA, 22 nt, Chlamydophila pneumoniae CWL029
uuucuuguuccaauagagucuc

SEQ ID NO: 504819 - RNA, 12 nt, Chlamydophila pneumoniae CWL029
uuucuuguugca

SEQ ID NO: 504820 - RNA, 15 nt, Chlamydophila pneumoniae CWL029
uuucuuuauucccuu

SEQ ID NO: 504821 - RNA, 13 nt, Chlamydophila pneumoniae CWL029
uuucuuuaaagaa

SEQ ID NO: 504822 - RNA, 15 nt, Chlamydophila pneumoniae CWL029
uuucuugcaaggagc

SEQ ID NO: 504823 - RNA, 11 nt, Chlamydophila pneumoniae CWL029
uuucuuguucc

SEQ ID NO: 504824 - RNA, 20 nt, Chlamydophila pneumoniae CWL029
uuucuuguaagacuaaaaaa

SEQ ID NO: 504825 - RNA, 18 nt, Chlamydophila pneumoniae CWL029
uuugacacccuuuaccuu

SEQ ID NO: 504826 - RNA, 16 nt, Chlamydophila pneumoniae CWL029
uuugaauuuccaaagg

SEQ ID NO: 504827 - RNA, 23 nt, Chlamydophila pneumoniae CWL029
uuugaauuuccaaaggaaaauaa

SEQ ID NO: 504828 - RNA, 16 nt, Chlamydophila pneumoniae CWL029
uuugaauuaaaaguuc

SEQ ID NO: 504829 - RNA, 15 nt, Chlamydophila pneumoniae CWL029
uuugaauucugauga

SEQ ID NO: 504830 - RNA, 15 nt, Chlamydophila pneumoniae CWL029
uuugacuugucccaa

SEQ ID NO: 504831 - RNA, 14 nt, Chlamydophila pneumoniae CWL029
uuugaaaagaaaga

SEQ ID NO: 504832 - RNA, 19 nt, Chlamydophila pneumoniae CWL029
uuucuuuucugaagauuuu

SEQ ID NO: 504833 - RNA, 14 nt, Chlamydophila pneumoniae CWL029
uuucuuuuucagcu

SEQ ID NO: 504834 - RNA, 14 nt, Chlamydophila pneumoniae CWL029
uuucuuuccaucau

SEQ ID NO: 504835 - RNA, 21 nt, Chlamydophila pneumoniae CWL029
uuucuuuuagcuacuucuucu

SEQ ID NO: 504836 - RNA, 23 nt, Chlamydophila pneumoniae CWL029
uuugaaauaauuuucagucuucc

SEQ ID NO: 504837 - RNA, 23 nt, Chlamydophila pneumoniae CWL029
uuugaagaacaaaaaaucaaucu

SEQ ID NO: 504838 - RNA, 14 nt, Chlamydophila pneumoniae CWL029
uuugaagcuccuca

SEQ ID NO: 504839 - RNA, 13 nt, Chlamydophila pneumoniae CWL029
uuugaagauguau

SEQ ID NO: 504840 - RNA, 18 nt, Chlamydophila pneumoniae CWL029
uuucugauuuaaaagguu

SEQ ID NO: 504841 - RNA, 18 nt, Chlamydophila pneumoniae CWL029
uuucugaaucuuuuguuu

SEQ ID NO: 504842 - RNA, 16 nt, Chlamydophila pneumoniae CWL029
uuucugaaacaaugca

SEQ ID NO: 504843 - RNA, 21 nt, Chlamydophila pneumoniae CWL029
uuucucuaagcagccucuucu

SEQ ID NO: 504844 - RNA, 16 nt, Chlamydophila pneumoniae CWL029
uuucuccuucucccug

SEQ ID NO: 504845 - RNA, 19 nt, Chlamydophila pneumoniae CWL029
uuucucccgcaaaguuaaa

SEQ ID NO: 504846 - RNA, 15 nt, Chlamydophila pneumoniae CWL029
uuucucauagcuucc

SEQ ID NO: 504847 - RNA, 16 nt, Chlamydophila pneumoniae CWL029
uuucucauagguaaua

SEQ ID NO: 504848 - RNA, 17 nt, Chlamydophila pneumoniae CWL029
uuucucaauaguguaac

SEQ ID NO: 504849 - RNA, 22 nt, Chlamydophila pneumoniae CWL029
uuucuauuucgucgucauccca

SEQ ID NO: 504850 - RNA, 17 nt, Chlamydophila pneumoniae CWL029
uuucuauuauuuuaaag

SEQ ID NO: 504851 - RNA, 19 nt, Chlamydophila pneumoniae CWL029
uuucuaaauagaaaacaua

SEQ ID NO: 504852 - RNA, 19 nt, Chlamydophila pneumoniae CWL029
uuucuaagagaucuacaaa

SEQ ID NO: 504853 - RNA, 18 nt, Chlamydophila pneumoniae CWL029
uuucuaagauuccuaacu

SEQ ID NO: 504854 - RNA, 20 nt, Chlamydophila pneumoniae CWL029
uuucuaagcaauauuucugu

SEQ ID NO: 504855 - RNA, 20 nt, Chlamydophila pneumoniae CWL029
uuucuaagauuccuaacuuc

SEQ ID NO: 504856 - RNA, 18 nt, Chlamydophila pneumoniae CWL029
uuucuaggaaucuuuuag

SEQ ID NO: 504857 - RNA, 21 nt, Chlamydophila pneumoniae CWL029
uuucuagaaaagauucuaaau

SEQ ID NO: 504858 - RNA, 20 nt, Chlamydophila pneumoniae CWL029
uuucuacugaaaccuucucu

SEQ ID NO: 504859 - RNA, 22 nt, Chlamydophila pneumoniae CWL029
uuucgaacacgucgaacaugac

SEQ ID NO: 504860 - RNA, 23 nt, Chlamydophila pneumoniae CWL029
uuucgaagcgcucuacaaaugcg

SEQ ID NO: 504861 - RNA, 23 nt, Chlamydophila pneumoniae CWL029
uuucgaagcguuaacaacuucua

SEQ ID NO: 504862 - RNA, 15 nt, Chlamydophila pneumoniae CWL029
uuuccuucuccagag

SEQ ID NO: 504863 - RNA, 17 nt, Chlamydophila pneumoniae CWL029
uuuccuugguaucccaa

SEQ ID NO: 504864 - RNA, 20 nt, Chlamydophila pneumoniae CWL029
uuucgacgcuguugaaaugc

SEQ ID NO: 504865 - RNA, 18 nt, Chlamydophila pneumoniae CWL029
uuucgaugcuauuuuucc

SEQ ID NO: 504866 - RNA, 16 nt, Chlamydophila pneumoniae CWL029
uuucgcagauacuucu

SEQ ID NO: 504867 - RNA, 22 nt, Chlamydophila pneumoniae CWL029
uuuccucuaucagggagcggaa

SEQ ID NO: 504868 - RNA, 14 nt, Chlamydophila pneumoniae CWL029
uuuccuccucuucu

SEQ ID NO: 504869 - RNA, 18 nt, Chlamydophila pneumoniae CWL029
uuuccuaccuauauuuuu

SEQ ID NO: 504870 - RNA, 15 nt, Chlamydophila pneumoniae CWL029
uuucccuucuaagga

SEQ ID NO: 504871 - RNA, 16 nt, Chlamydophila pneumoniae CWL029
uuucccuccaccagaa

SEQ ID NO: 504872 - RNA, 17 nt, Chlamydophila pneumoniae CWL029
uuucccuccaccagaag

SEQ ID NO: 504873 - RNA, 19 nt, Chlamydophila pneumoniae CWL029
uuuccccuuggaaaucaga

SEQ ID NO: 504874 - RNA, 22 nt, Chlamydophila pneumoniae CWL029
uuucccccugaaugcaacagag

SEQ ID NO: 504875 - RNA, 22 nt, Chlamydophila pneumoniae CWL029
uuucccgcucuuuauuaacucc

SEQ ID NO: 504876 - RNA, 22 nt, Chlamydophila pneumoniae CWL029
uuucccgacauuuaacaucuuu

SEQ ID NO: 504877 - RNA, 12 nt, Chlamydophila pneumoniae CWL029
uuucccacagcu

SEQ ID NO: 504878 - RNA, 22 nt, Chlamydophila pneumoniae CWL029
uuuccauuagggcauucuguaa

SEQ ID NO: 504879 - RNA, 19 nt, Chlamydophila pneumoniae CWL029
uuuccauacccaaauuucu

SEQ ID NO: 504880 - RNA, 18 nt, Chlamydophila pneumoniae CWL029
uuuccauaggaucugcau

SEQ ID NO: 504881 - RNA, 15 nt, Chlamydophila pneumoniae CWL029
uuuccaggaccaaac

SEQ ID NO: 504882 - RNA, 20 nt, Chlamydophila pneumoniae CWL029
uuuccacguacgagaucaga

SEQ ID NO: 504883 - RNA, 13 nt, Chlamydophila pneumoniae CWL029
ucauuaagaagau

SEQ ID NO: 504884 - RNA, 12 nt, Chlamydophila pneumoniae CWL029
ucauuaagaucc

SEQ ID NO: 504885 - RNA, 13 nt, Chlamydophila pneumoniae CWL029
ucauuaaguacug

SEQ ID NO: 504886 - RNA, 18 nt, Chlamydophila pneumoniae CWL029
ucauuaauaauaucuaac

SEQ ID NO: 504887 - RNA, 14 nt, Chlamydophila pneumoniae CWL029
ucauuaauguugcu

SEQ ID NO: 504888 - RNA, 14 nt, Chlamydophila pneumoniae CWL029
ucauuaccugcuaa

SEQ ID NO: 504889 - RNA, 17 nt, Chlamydophila pneumoniae CWL029
ucauuaucacagaugua

SEQ ID NO: 504890 - RNA, 14 nt, Chlamydophila pneumoniae CWL029
ucauuccagcaucu

SEQ ID NO: 504891 - RNA, 15 nt, Chlamydophila pneumoniae CWL029
ucauuccaggauucu

SEQ ID NO: 504892 - RNA, 14 nt, Chlamydophila pneumoniae CWL029
ucauucccuuuuuc

SEQ ID NO: 504893 - RNA, 16 nt, Chlamydophila pneumoniae CWL029
ucauucccuuuuucca

SEQ ID NO: 504894 - RNA, 18 nt, Chlamydophila pneumoniae CWL029
uccaaccucgagauccuc

SEQ ID NO: 504895 - RNA, 21 nt, Chlamydophila pneumoniae CWL029
uccaacuaaaccuucaaugau

SEQ ID NO: 504896 - RNA, 22 nt, Chlamydophila pneumoniae CWL029
uccaaauugcaauuuucuaaag

SEQ ID NO: 504897 - RNA, 14 nt, Chlamydophila pneumoniae CWL029
uccaaauguucucu

SEQ ID NO: 504898 - RNA, 20 nt, Chlamydophila pneumoniae CWL029
uccaaaggaaaauaaucuuc

SEQ ID NO: 504899 - RNA, 21 nt, Chlamydophila pneumoniae CWL029
uccaaaggaaaauaaucuuca

SEQ ID NO: 504900 - RNA, 15 nt, Chlamydophila pneumoniae CWL029
uccaaagauacauua

SEQ ID NO: 504901 - RNA, 18 nt, Chlamydophila pneumoniae CWL029
uccaaagccugaaaaaua

SEQ ID NO: 504902 - RNA, 20 nt, Chlamydophila pneumoniae CWL029
uccaaacguggucauuagcc

SEQ ID NO: 504903 - RNA, 16 nt, Chlamydophila pneumoniae CWL029
uccaaacauuuuuaag

SEQ ID NO: 504904 - RNA, 19 nt, Chlamydophila pneumoniae CWL029
uccaaaaugucuuuuucaa

SEQ ID NO: 504905 - RNA, 16 nt, Chlamydophila pneumoniae CWL029
uccaaaauaaaaggag

SEQ ID NO: 504906 - RNA, 22 nt, Chlamydophila pneumoniae CWL029
uccaaaauaaucucgcaguccu

SEQ ID NO: 504907 - RNA, 12 nt, Chlamydophila pneumoniae CWL029
uccaaaaucauc

SEQ ID NO: 504908 - RNA, 12 nt, Chlamydophila pneumoniae CWL029
ucauuuuuuaau

SEQ ID NO: 504909 - RNA, 13 nt, Chlamydophila pneumoniae CWL029
ucauuuuuuaaua

SEQ ID NO: 504910 - RNA, 15 nt, Chlamydophila pneumoniae CWL029
ucauuuuuuaauaaa

SEQ ID NO: 504911 - RNA, 21 nt, Chlamydophila pneumoniae CWL029
uccaaaaaaugcuccugcaaa

SEQ ID NO: 504912 - RNA, 17 nt, Chlamydophila pneumoniae CWL029
uccaaaaacuucuaacu

SEQ ID NO: 504913 - RNA, 12 nt, Chlamydophila pneumoniae CWL029
uccaaaacucaa

SEQ ID NO: 504914 - RNA, 15 nt, Chlamydophila pneumoniae CWL029
uccaaaagaccaaaa

SEQ ID NO: 504915 - RNA, 20 nt, Chlamydophila pneumoniae CWL029
ucauuuaucugcguuucuuu

SEQ ID NO: 504916 - RNA, 22 nt, Chlamydophila pneumoniae CWL029
ucauugcuauugaaaaaucccu

SEQ ID NO: 504917 - RNA, 23 nt, Chlamydophila pneumoniae CWL029
ucauuucgauaacacuucuuucu

SEQ ID NO: 504918 - RNA, 15 nt, Chlamydophila pneumoniae CWL029
ucaugaagaauuacc

SEQ ID NO: 504919 - RNA, 20 nt, Chlamydophila pneumoniae CWL029
ucaugaaagugcucuuuuaa

SEQ ID NO: 504920 - RNA, 13 nt, Chlamydophila pneumoniae CWL029
ucaugaaaaaaga

SEQ ID NO: 504921 - RNA, 22 nt, Chlamydophila pneumoniae CWL029
ucaugaaaaaagaauaaaaaua

SEQ ID NO: 504922 - RNA, 13 nt, Chlamydophila pneumoniae CWL029
ucaugaaaaggau

SEQ ID NO: 504923 - RNA, 10 nt, Chlamydophila pneumoniae CWL029
ucaugaggac

SEQ ID NO: 504924 - RNA, 16 nt, Chlamydophila pneumoniae CWL029
ucaugagaauuuucau

SEQ ID NO: 504925 - RNA, 21 nt, Chlamydophila pneumoniae CWL029
ucaugcggacuuuauucucuu

SEQ ID NO: 504926 - RNA, 17 nt, Chlamydophila pneumoniae CWL029
ucaugcgcuaccuuagu

SEQ ID NO: 504927 - RNA, 18 nt, Chlamydophila pneumoniae CWL029
ucaucggcauaacuuuau

SEQ ID NO: 504928 - RNA, 14 nt, Chlamydophila pneumoniae CWL029
ucaucucauaguuu

SEQ ID NO: 504929 - RNA, 23 nt, Chlamydophila pneumoniae CWL029
ucaucucauaguuucuaucuaau

SEQ ID NO: 504930 - RNA, 21 nt, Chlamydophila pneumoniae CWL029
ucaucugucauuaaaaauuua

SEQ ID NO: 504931 - RNA, 16 nt, Chlamydophila pneumoniae CWL029
ucaucuggaaaagccu

SEQ ID NO: 504932 - RNA, 21 nt, Chlamydophila pneumoniae CWL029
ucaucucacaagcauccuaga

SEQ ID NO: 504933 - RNA, 23 nt, Chlamydophila pneumoniae CWL029
ucaucucguugggcucauaaccc

SEQ ID NO: 504934 - RNA, 18 nt, Chlamydophila pneumoniae CWL029
ucaucucgcaguccaaag

SEQ ID NO: 504935 - RNA, 14 nt, Chlamydophila pneumoniae CWL029
ucaucuuccucuuu

SEQ ID NO: 504936 - RNA, 23 nt, Chlamydophila pneumoniae CWL029
ucauccuuuagcuguuucucugu

SEQ ID NO: 504937 - RNA, 16 nt, Chlamydophila pneumoniae CWL029
ucaucgcaaucaaaga

SEQ ID NO: 504938 - RNA, 21 nt, Chlamydophila pneumoniae CWL029
ucaucgcgagaggggaaccaa

SEQ ID NO: 504939 - RNA, 17 nt, Chlamydophila pneumoniae CWL029
ucaucccacgggucagg

SEQ ID NO: 504940 - RNA, 20 nt, Chlamydophila pneumoniae CWL029
ucauccagauuagaaaagau

SEQ ID NO: 504941 - RNA, 15 nt, Chlamydophila pneumoniae CWL029
ucauccccucagaaa

SEQ ID NO: 504942 - RNA, 17 nt, Chlamydophila pneumoniae CWL029
ucauccccucagaaagg

SEQ ID NO: 504943 - RNA, 23 nt, Chlamydophila pneumoniae CWL029
ucauccccucagaaaggagaucc

SEQ ID NO: 504944 - RNA, 14 nt, Chlamydophila pneumoniae CWL029
ucaucauuucuaca

SEQ ID NO: 504945 - RNA, 16 nt, Chlamydophila pneumoniae CWL029
ucaucaguaaaagacu

SEQ ID NO: 504946 - RNA, 19 nt, Chlamydophila pneumoniae CWL029
ucaucauaaauaggcucua

SEQ ID NO: 504947 - RNA, 21 nt, Chlamydophila pneumoniae CWL029
ucaucagcuucccaauuguau

SEQ ID NO: 504948 - RNA, 14 nt, Chlamydophila pneumoniae CWL029
ucaucagaggccac

SEQ ID NO: 504949 - RNA, 15 nt, Chlamydophila pneumoniae CWL029
ucaucagcaaaacuc

SEQ ID NO: 504950 - RNA, 18 nt, Chlamydophila pneumoniae CWL029
ucaucagaaaucaaaggg

SEQ ID NO: 504951 - RNA, 12 nt, Chlamydophila pneumoniae CWL029
ucaucagaagug

SEQ ID NO: 504952 - RNA, 23 nt, Chlamydophila pneumoniae CWL029
ucaucagaaguggccuugccagu

SEQ ID NO: 504953 - RNA, 17 nt, Chlamydophila pneumoniae CWL029
ucaucacaauuuuaaaa

SEQ ID NO: 504954 - RNA, 18 nt, Chlamydophila pneumoniae CWL029
ucaucacaauuuuaaaau

SEQ ID NO: 504955 - RNA, 22 nt, Chlamydophila pneumoniae CWL029
ucaucaccauccaaagcuauuu

SEQ ID NO: 504956 - RNA, 12 nt, Chlamydophila pneumoniae CWL029
ucaucaaagcaa

SEQ ID NO: 504957 - RNA, 14 nt, Chlamydophila pneumoniae CWL029
ucaucaaaaagauc

SEQ ID NO: 504958 - RNA, 18 nt, Chlamydophila pneumoniae CWL029
ucaucaaaacauaaugau

SEQ ID NO: 504959 - RNA, 22 nt, Chlamydophila pneumoniae CWL029
ucauauuuugucuucaucauaa

SEQ ID NO: 504960 - RNA, 19 nt, Chlamydophila pneumoniae CWL029
ucauauuuuucuugaaggu

SEQ ID NO: 504961 - RNA, 20 nt, Chlamydophila pneumoniae CWL029
ucauauuuuucuugaagguu

SEQ ID NO: 504962 - RNA, 15 nt, Chlamydophila pneumoniae CWL029
ucauauuuauuuaaa

SEQ ID NO: 504963 - RNA, 20 nt, Chlamydophila pneumoniae CWL029
ucauaucugcgccagcucuc

SEQ ID NO: 504964 - RNA, 19 nt, Chlamydophila pneumoniae CWL029
ucauauaaaacgaucccua

SEQ ID NO: 504965 - RNA, 19 nt, Chlamydophila pneumoniae CWL029
ucauauaaaguuuccaagu

SEQ ID NO: 504966 - RNA, 23 nt, Chlamydophila pneumoniae CWL029
ucauaauuagagagaaugcccug

SEQ ID NO: 504967 - RNA, 17 nt, Chlamydophila pneumoniae CWL029
ucauaagcucuauuucu

SEQ ID NO: 504968 - RNA, 18 nt, Chlamydophila pneumoniae CWL029
ucauaagcucuauuucug

SEQ ID NO: 504969 - RNA, 15 nt, Chlamydophila pneumoniae CWL029
ucauaaccuaaggca

SEQ ID NO: 504970 - RNA, 17 nt, Chlamydophila pneumoniae CWL029
ucauaagaguagacaag

SEQ ID NO: 504971 - RNA, 22 nt, Chlamydophila pneumoniae CWL029
ucauagagauaucaucaaaaga

SEQ ID NO: 504972 - RNA, 23 nt, Chlamydophila pneumoniae CWL029
ucauagcauguucgauuuucucu

SEQ ID NO: 504973 - RNA, 14 nt, Chlamydophila pneumoniae CWL029
ucauaaagaggaau

SEQ ID NO: 504974 - RNA, 18 nt, Chlamydophila pneumoniae CWL029
ucauaaagaggaaugaag

SEQ ID NO: 504975 - RNA, 13 nt, Chlamydophila pneumoniae CWL029
ucauaaagaggaa

SEQ ID NO: 504976 - RNA, 23 nt, Chlamydophila pneumoniae CWL029
ucauaaagugcgagguaugaaua

SEQ ID NO: 504977 - RNA, 14 nt, Chlamydophila pneumoniae CWL029
ucauaaauaggcuc

SEQ ID NO: 504978 - RNA, 14 nt, Chlamydophila pneumoniae CWL029
ucauaaccugggca

SEQ ID NO: 504979 - RNA, 15 nt, Chlamydophila pneumoniae CWL029
ucauaaccugggcaa

SEQ ID NO: 504980 - RNA, 19 nt, Chlamydophila pneumoniae CWL029
ucaguuuuuucuucugaca

SEQ ID NO: 504981 - RNA, 20 nt, Chlamydophila pneumoniae CWL029
ucaguuccucauccucauca

SEQ ID NO: 504982 - RNA, 22 nt, Chlamydophila pneumoniae CWL029
ucaguuguuucuagaaaaucuc

SEQ ID NO: 504983 - RNA, 16 nt, Chlamydophila pneumoniae CWL029
ucagucuuccuuuaua

SEQ ID NO: 504984 - RNA, 20 nt, Chlamydophila pneumoniae CWL029
ucagucucgugcauaaugau

SEQ ID NO: 504985 - RNA, 15 nt, Chlamydophila pneumoniae CWL029
ucagucuuccuuuau

SEQ ID NO: 504986 - RNA, 21 nt, Chlamydophila pneumoniae CWL029
ucaguaaacccucagaacacg

SEQ ID NO: 504987 - RNA, 14 nt, Chlamydophila pneumoniae CWL029
ucaguaaauauuuu

SEQ ID NO: 504988 - RNA, 16 nt, Chlamydophila pneumoniae CWL029
ucaguauggcguuuuu

SEQ ID NO: 504989 - RNA, 21 nt, Chlamydophila pneumoniae CWL029
ucagggagcggaauuucucau

SEQ ID NO: 504990 - RNA, 22 nt, Chlamydophila pneumoniae CWL029
ucaggcuuuaaguguuucuuca

SEQ ID NO: 504991 - RNA, 21 nt, Chlamydophila pneumoniae CWL029
ucaggcuuuaaguguuucuuc

SEQ ID NO: 504992 - RNA, 20 nt, Chlamydophila pneumoniae CWL029
ucaggagaccagggaucuuc

SEQ ID NO: 504993 - RNA, 20 nt, Chlamydophila pneumoniae CWL029
ucaggaggugguggagcuug

SEQ ID NO: 504994 - RNA, 17 nt, Chlamydophila pneumoniae CWL029
ucaggauuaguaacuaa

SEQ ID NO: 504995 - RNA, 13 nt, Chlamydophila pneumoniae CWL029
ucaggauuuucca

SEQ ID NO: 504996 - RNA, 20 nt, Chlamydophila pneumoniae CWL029
ucagcuuaucuauagcauug

SEQ ID NO: 504997 - RNA, 21 nt, Chlamydophila pneumoniae CWL029
ucagcuaauuuaaaugccuua

SEQ ID NO: 504998 - RNA, 16 nt, Chlamydophila pneumoniae CWL029
ucaggacccuuuuccu

SEQ ID NO: 504999 - RNA, 12 nt, Chlamydophila pneumoniae CWL029
ucaggagauaau

SEQ ID NO: 505000 - RNA, 19 nt, Chlamydophila pneumoniae CWL029
ucaggagauacaagcaauu

SEQ ID NO: 505001 - RNA, 15 nt, Chlamydophila pneumoniae CWL029
ucagcuucuacagca

SEQ ID NO: 505002 - RNA, 14 nt, Chlamydophila pneumoniae CWL029
ucagcuucuugaug

SEQ ID NO: 505003 - RNA, 16 nt, Chlamydophila pneumoniae CWL029
ucagcuuguuuuugca

SEQ ID NO: 505004 - RNA, 16 nt, Chlamydophila pneumoniae CWL029
ucagcuuuaacaugcc

SEQ ID NO: 505005 - RNA, 23 nt, Chlamydophila pneumoniae CWL029
ucaggaaagguaguuuucuucuu

SEQ ID NO: 505006 - RNA, 20 nt, Chlamydophila pneumoniae CWL029
uaucuucaaaaguaaucacu

SEQ ID NO: 505007 - RNA, 22 nt, Chlamydophila pneumoniae CWL029
uaucuucagaaugcccuuuagg

SEQ ID NO: 505008 - RNA, 22 nt, Chlamydophila pneumoniae CWL029
ucagcgcaucacgaaaaggaga

SEQ ID NO: 505009 - RNA, 17 nt, Chlamydophila pneumoniae CWL029
uccaauuguaaaucauu

SEQ ID NO: 505010 - RNA, 19 nt, Chlamydophila pneumoniae CWL029
uccaauuuuugcauagaca

SEQ ID NO: 505011 - RNA, 14 nt, Chlamydophila pneumoniae CWL029
uccaauuuucuuca

SEQ ID NO: 505012 - RNA, 13 nt, Chlamydophila pneumoniae CWL029
uccacaagccucc

SEQ ID NO: 505013 - RNA, 17 nt, Chlamydophila pneumoniae CWL029
uccacaagcuuuucgca

SEQ ID NO: 505014 - RNA, 17 nt, Chlamydophila pneumoniae CWL029
uccaauggcugagagau

SEQ ID NO: 505015 - RNA, 15 nt, Chlamydophila pneumoniae CWL029
uccaaugcuauugga

SEQ ID NO: 505016 - RNA, 13 nt, Chlamydophila pneumoniae CWL029
uccaaucugcuga

SEQ ID NO: 505017 - RNA, 23 nt, Chlamydophila pneumoniae CWL029
uccaauaggccagaauguacaua

SEQ ID NO: 505018 - RNA, 13 nt, Chlamydophila pneumoniae CWL029
uccaagauugaau

SEQ ID NO: 505019 - RNA, 15 nt, Chlamydophila pneumoniae CWL029
uccaagaguucucuu

SEQ ID NO: 505020 - RNA, 16 nt, Chlamydophila pneumoniae CWL029
uccaagaucaaacgaa

SEQ ID NO: 505021 - RNA, 22 nt, Chlamydophila pneumoniae CWL029
uccaagaucuccgccuacaaua

SEQ ID NO: 505022 - RNA, 19 nt, Chlamydophila pneumoniae CWL029
uccaagacaauaaaaaaga

SEQ ID NO: 505023 - RNA, 22 nt, Chlamydophila pneumoniae CWL029
uccaacuuuugaagauccugag

SEQ ID NO: 505024 - RNA, 12 nt, Chlamydophila pneumoniae CWL029
uccaagaaguca

SEQ ID NO: 505025 - RNA, 16 nt, Chlamydophila pneumoniae CWL029
uccaagaauagccaua

SEQ ID NO: 505026 - RNA, 18 nt, Chlamydophila pneumoniae CWL029
uccaagaauagccauaau

SEQ ID NO: 505027 - RNA, 12 nt, Chlamydophila pneumoniae CWL029
uccaacuucaac

SEQ ID NO: 505028 - RNA, 14 nt, Chlamydophila pneumoniae CWL029
uccaacuucuguau

SEQ ID NO: 505029 - RNA, 22 nt, Chlamydophila pneumoniae CWL029
uccaagugaucagaaaugaagc

SEQ ID NO: 505030 - RNA, 19 nt, Chlamydophila pneumoniae CWL029
uccaagugcucaguaaaua

SEQ ID NO: 505031 - RNA, 13 nt, Chlamydophila pneumoniae CWL029
uccaauacuaaaa

SEQ ID NO: 505032 - RNA, 19 nt, Chlamydophila pneumoniae CWL029
uccaagugaucagaaauga

SEQ ID NO: 505033 - RNA, 20 nt, Chlamydophila pneumoniae CWL029
uccaccaggagcuccuccuu

SEQ ID NO: 505034 - RNA, 22 nt, Chlamydophila pneumoniae CWL029
uccaccgcucacacgaauaauu

SEQ ID NO: 505035 - RNA, 21 nt, Chlamydophila pneumoniae CWL029
uccacaucuugagcuucaaaa

SEQ ID NO: 505036 - RNA, 18 nt, Chlamydophila pneumoniae CWL029
uccacaugcccaaacauc

SEQ ID NO: 505037 - RNA, 13 nt, Chlamydophila pneumoniae CWL029
uccaccaagacug

SEQ ID NO: 505038 - RNA, 20 nt, Chlamydophila pneumoniae CWL029
uccaccaaugauaauuucau

SEQ ID NO: 505039 - RNA, 21 nt, Chlamydophila pneumoniae CWL029
uccacagaucguaaucuguau

SEQ ID NO: 505040 - RNA, 17 nt, Chlamydophila pneumoniae CWL029
uccacagagaccuucuc

SEQ ID NO: 505041 - RNA, 19 nt, Chlamydophila pneumoniae CWL029
uccacagagaccuucucuu

SEQ ID NO: 505042 - RNA, 20 nt, Chlamydophila pneumoniae CWL029
uccacagagaccuucucuuc

SEQ ID NO: 505043 - RNA, 21 nt, Chlamydophila pneumoniae CWL029
uccacaaucucuuuaaaaauu

SEQ ID NO: 505044 - RNA, 16 nt, Chlamydophila pneumoniae CWL029
uccacacaacucguuu

SEQ ID NO: 505045 - RNA, 21 nt, Chlamydophila pneumoniae CWL029
uccagagacaaagccacagcc

SEQ ID NO: 505046 - RNA, 16 nt, Chlamydophila pneumoniae CWL029
uccagagacaaagcca

SEQ ID NO: 505047 - RNA, 15 nt, Chlamydophila pneumoniae CWL029
uccagaaauuuuuac

SEQ ID NO: 505048 - RNA, 17 nt, Chlamydophila pneumoniae CWL029
uccagaaaaagaacaua

SEQ ID NO: 505049 - RNA, 15 nt, Chlamydophila pneumoniae CWL029
uccagaaacgcagcu

SEQ ID NO: 505050 - RNA, 21 nt, Chlamydophila pneumoniae CWL029
uccagaaacgcagcuuuccuu

SEQ ID NO: 505051 - RNA, 20 nt, Chlamydophila pneumoniae CWL029
uccagcaaagcgaccugcaa

SEQ ID NO: 505052 - RNA, 16 nt, Chlamydophila pneumoniae CWL029
uccagauuguucaaaa

SEQ ID NO: 505053 - RNA, 23 nt, Chlamydophila pneumoniae CWL029
uccagcaccuuuaggaagcugua

SEQ ID NO: 505054 - RNA, 19 nt, Chlamydophila pneumoniae CWL029
uccacugcagcagguguca

SEQ ID NO: 505055 - RNA, 22 nt, Chlamydophila pneumoniae CWL029
uccacgaccugcaaacucccca

SEQ ID NO: 505056 - RNA, 15 nt, Chlamydophila pneumoniae CWL029
uccacggaaauauuc

SEQ ID NO: 505057 - RNA, 15 nt, Chlamydophila pneumoniae CWL029
uccauagaguaucua

SEQ ID NO: 505058 - RNA, 21 nt, Chlamydophila pneumoniae CWL029
uccauagcuaaguaacagucc

SEQ ID NO: 505059 - RNA, 18 nt, Chlamydophila pneumoniae CWL029
uccauaggaacaaagcca

SEQ ID NO: 505060 - RNA, 20 nt, Chlamydophila pneumoniae CWL029
uccauagcuuuagaagcccg

SEQ ID NO: 505061 - RNA, 18 nt, Chlamydophila pneumoniae CWL029
uccauacccaaauuucuu

SEQ ID NO: 505062 - RNA, 20 nt, Chlamydophila pneumoniae CWL029
uccauaaugcugagaugguc

SEQ ID NO: 505063 - RNA, 22 nt, Chlamydophila pneumoniae CWL029
uccauaagcuuuucuuccaaag

SEQ ID NO: 505064 - RNA, 14 nt, Chlamydophila pneumoniae CWL029
uccaguuuuuuaaa

SEQ ID NO: 505065 - RNA, 20 nt, Chlamydophila pneumoniae CWL029
uccauaaaaauguaauuuuu

SEQ ID NO: 505066 - RNA, 22 nt, Chlamydophila pneumoniae CWL029
uccauaugggacuucaagccaa

SEQ ID NO: 505067 - RNA, 23 nt, Chlamydophila pneumoniae CWL029
uccaucacgaggagcuuuuaccu

SEQ ID NO: 505068 - RNA, 18 nt, Chlamydophila pneumoniae CWL029
uccauaucaaagaucuga

SEQ ID NO: 505069 - RNA, 17 nt, Chlamydophila pneumoniae CWL029
uccauaucuagaaguuu

SEQ ID NO: 505070 - RNA, 21 nt, Chlamydophila pneumoniae CWL029
uccaucggaauuugccugaaa

SEQ ID NO: 505071 - RNA, 16 nt, Chlamydophila pneumoniae CWL029
uccaucggcauuucuc

SEQ ID NO: 505072 - RNA, 22 nt, Chlamydophila pneumoniae CWL029
uccaggguagcgcuuuuuuaaa

SEQ ID NO: 505073 - RNA, 23 nt, Chlamydophila pneumoniae CWL029
uccagguagcagaguuuuucccu

SEQ ID NO: 505074 - RNA, 18 nt, Chlamydophila pneumoniae CWL029
uccaguagaucuucugaa

SEQ ID NO: 505075 - RNA, 19 nt, Chlamydophila pneumoniae CWL029
uccaguagaucuucugaaa

SEQ ID NO: 505076 - RNA, 19 nt, Chlamydophila pneumoniae CWL029
uccagucuggcuuaggagg

SEQ ID NO: 505077 - RNA, 18 nt, Chlamydophila pneumoniae CWL029
uccaguuuguugaucucu

SEQ ID NO: 505078 - RNA, 13 nt, Chlamydophila pneumoniae CWL029
uccaguucuucau

SEQ ID NO: 505079 - RNA, 16 nt, Chlamydophila pneumoniae CWL029
uccagggacagaaguc

SEQ ID NO: 505080 - RNA, 18 nt, Chlamydophila pneumoniae CWL029
uccaggacguaaaaagaa

SEQ ID NO: 505081 - RNA, 15 nt, Chlamydophila pneumoniae CWL029
uccagcuucucccau

SEQ ID NO: 505082 - RNA, 20 nt, Chlamydophila pneumoniae CWL029
uccagcugagcuaucuucaa

SEQ ID NO: 505083 - RNA, 13 nt, Chlamydophila pneumoniae CWL029
uccagcuccauaa

SEQ ID NO: 505084 - RNA, 17 nt, Chlamydophila pneumoniae CWL029
uccagcgaggagaagua

SEQ ID NO: 505085 - RNA, 21 nt, Chlamydophila pneumoniae CWL029
uccagccugcaccagacccuc

SEQ ID NO: 505086 - RNA, 17 nt, Chlamydophila pneumoniae CWL029
uccagccugugagcucu

SEQ ID NO: 505087 - RNA, 10 nt, Chlamydophila pneumoniae CWL029
uccagccccc

SEQ ID NO: 505088 - RNA, 17 nt, Chlamydophila pneumoniae CWL029
uccagcccccaggcugc

SEQ ID NO: 505089 - RNA, 20 nt, Chlamydophila pneumoniae CWL029
ucccagaaggggaauaauau

SEQ ID NO: 505090 - RNA, 15 nt, Chlamydophila pneumoniae CWL029
ucccacuaagaauga

SEQ ID NO: 505091 - RNA, 11 nt, Chlamydophila pneumoniae CWL029
ucccacagaaa

SEQ ID NO: 505092 - RNA, 12 nt, Chlamydophila pneumoniae CWL029
ucccacagaaau

SEQ ID NO: 505093 - RNA, 16 nt, Chlamydophila pneumoniae CWL029
ucccaccauauucuca

SEQ ID NO: 505094 - RNA, 18 nt, Chlamydophila pneumoniae CWL029
ucccaagcugaaagaaug

SEQ ID NO: 505095 - RNA, 14 nt, Chlamydophila pneumoniae CWL029
ucccaagggccaga

SEQ ID NO: 505096 - RNA, 14 nt, Chlamydophila pneumoniae CWL029
ucccaagucugcuu

SEQ ID NO: 505097 - RNA, 15 nt, Chlamydophila pneumoniae CWL029
ucccaagucugcuug

SEQ ID NO: 505098 - RNA, 13 nt, Chlamydophila pneumoniae CWL029
ucccaaacuucuu

SEQ ID NO: 505099 - RNA, 17 nt, Chlamydophila pneumoniae CWL029
ucccaaacuucuucucg

SEQ ID NO: 505100 - RNA, 21 nt, Chlamydophila pneumoniae CWL029
uccauuggcauagagccuaga

SEQ ID NO: 505101 - RNA, 22 nt, Chlamydophila pneumoniae CWL029
uccauguacaguuuguaaaaag

SEQ ID NO: 505102 - RNA, 20 nt, Chlamydophila pneumoniae CWL029
uccauguagaaggggguucu

SEQ ID NO: 505103 - RNA, 18 nt, Chlamydophila pneumoniae CWL029
uccauucugagaaagaag

SEQ ID NO: 505104 - RNA, 22 nt, Chlamydophila pneumoniae CWL029
uccauucuuaauauaaaagaag

SEQ ID NO: 505105 - RNA, 15 nt, Chlamydophila pneumoniae CWL029
uccauuauacuuuuu

SEQ ID NO: 505106 - RNA, 22 nt, Chlamydophila pneumoniae CWL029
uccauucagauggucagucucg

SEQ ID NO: 505107 - RNA, 15 nt, Chlamydophila pneumoniae CWL029
uccauggcuauuuuu

SEQ ID NO: 505108 - RNA, 19 nt, Chlamydophila pneumoniae CWL029
uccauggcuauuuuuaaaa

SEQ ID NO: 505109 - RNA, 15 nt, Chlamydophila pneumoniae CWL029
uccauggaauggcua

SEQ ID NO: 505110 - RNA, 22 nt, Chlamydophila pneumoniae CWL029
uccauggauauggaauggcuuu

SEQ ID NO: 505111 - RNA, 18 nt, Chlamydophila pneumoniae CWL029
uccaugcuaauaauuccu

SEQ ID NO: 505112 - RNA, 13 nt, Chlamydophila pneumoniae CWL029
uccaucucuuuaa

SEQ ID NO: 505113 - RNA, 21 nt, Chlamydophila pneumoniae CWL029
uccaucggggcggacuauguu

SEQ ID NO: 505114 - RNA, 22 nt, Chlamydophila pneumoniae CWL029
uccaucugcucuuuugcaaguu

SEQ ID NO: 505115 - RNA, 23 nt, Chlamydophila pneumoniae CWL029
uccaugacuuuuguugcaauucc

SEQ ID NO: 505116 - RNA, 24 nt, Chlamydophila pneumoniae CWL029
uccccccucacaauauaaaugcua

SEQ ID NO: 505117 - RNA, 17 nt, Chlamydophila pneumoniae CWL029
uccccauaaccaauaaa

SEQ ID NO: 505118 - RNA, 14 nt, Chlamydophila pneumoniae CWL029
ucccccauaaaaau

SEQ ID NO: 505119 - RNA, 13 nt, Chlamydophila pneumoniae CWL029
uccccaagcucuc

SEQ ID NO: 505120 - RNA, 20 nt, Chlamydophila pneumoniae CWL029
uccccaagcucucuccaucu

SEQ ID NO: 505121 - RNA, 18 nt, Chlamydophila pneumoniae CWL029
ucccauagcaaugccuac

SEQ ID NO: 505122 - RNA, 14 nt, Chlamydophila pneumoniae CWL029
ucccaucaaaggca

SEQ ID NO: 505123 - RNA, 17 nt, Chlamydophila pneumoniae CWL029
ucccaucuuguucuaaa

SEQ ID NO: 505124 - RNA, 18 nt, Chlamydophila pneumoniae CWL029
ucccaucuuguucuaaaa

SEQ ID NO: 505125 - RNA, 19 nt, Chlamydophila pneumoniae CWL029
ucccaucuuguucuaaaau

SEQ ID NO: 505126 - RNA, 16 nt, Chlamydophila pneumoniae CWL029
ucccaucgucccuaaa

SEQ ID NO: 505127 - RNA, 17 nt, Chlamydophila pneumoniae CWL029
ucccaugugcugaagac

SEQ ID NO: 505128 - RNA, 18 nt, Chlamydophila pneumoniae CWL029
ucccaugugcugaagacc

SEQ ID NO: 505129 - RNA, 21 nt, Chlamydophila pneumoniae CWL029
ucccaugugcugaagaccaug

SEQ ID NO: 505130 - RNA, 18 nt, Chlamydophila pneumoniae CWL029
uccgaagacuaccaaucc

SEQ ID NO: 505131 - RNA, 23 nt, Chlamydophila pneumoniae CWL029
uccgaagacucaaagaacugcau

SEQ ID NO: 505132 - RNA, 14 nt, Chlamydophila pneumoniae CWL029
uccgaaaacucuua

SEQ ID NO: 505133 - RNA, 23 nt, Chlamydophila pneumoniae CWL029
uccgacucuguuuccuugugucu

SEQ ID NO: 505134 - RNA, 23 nt, Chlamydophila pneumoniae CWL029
uccgaucauuuuugcuagaucug

SEQ ID NO: 505135 - RNA, 19 nt, Chlamydophila pneumoniae CWL029
uccgaucauaauuagagag

SEQ ID NO: 505136 - RNA, 16 nt, Chlamydophila pneumoniae CWL029
uccgaggagggaaaca

SEQ ID NO: 505137 - RNA, 18 nt, Chlamydophila pneumoniae CWL029
uccgaggagggaaacacc

SEQ ID NO: 505138 - RNA, 18 nt, Chlamydophila pneumoniae CWL029
ucccuguaguuucuaaaa

SEQ ID NO: 505139 - RNA, 18 nt, Chlamydophila pneumoniae CWL029
ucccuuagaaauucuaag

SEQ ID NO: 505140 - RNA, 13 nt, Chlamydophila pneumoniae CWL029
ucccuucuucuuu

SEQ ID NO: 505141 - RNA, 18 nt, Chlamydophila pneumoniae CWL029
ucccuggauuucuucugu

SEQ ID NO: 505142 - RNA, 15 nt, Chlamydophila pneumoniae CWL029
ucccugguacuuaug

SEQ ID NO: 505143 - RNA, 12 nt, Chlamydophila pneumoniae CWL029
ucccucuucuuc

SEQ ID NO: 505144 - RNA, 14 nt, Chlamydophila pneumoniae CWL029
ucccucuucuucca

SEQ ID NO: 505145 - RNA, 18 nt, Chlamydophila pneumoniae CWL029
ucccuccgcaguuguaca

SEQ ID NO: 505146 - RNA, 23 nt, Chlamydophila pneumoniae CWL029
ucccuccuccucgucuaaagaag

SEQ ID NO: 505147 - RNA, 12 nt, Chlamydophila pneumoniae CWL029
ucccuccuuccu

SEQ ID NO: 505148 - RNA, 15 nt, Chlamydophila pneumoniae CWL029
ucccucaaaauuuaa

SEQ ID NO: 505149 - RNA, 13 nt, Chlamydophila pneumoniae CWL029
ucccguuccuuua

SEQ ID NO: 505150 - RNA, 17 nt, Chlamydophila pneumoniae CWL029
ucccuaagguagagucc

SEQ ID NO: 505151 - RNA, 16 nt, Chlamydophila pneumoniae CWL029
ucccuagcauacaucg

SEQ ID NO: 505152 - RNA, 23 nt, Chlamydophila pneumoniae CWL029
ucccuauaaagcaaaugccugua

SEQ ID NO: 505153 - RNA, 21 nt, Chlamydophila pneumoniae CWL029
ucccuauagaacaugaggcac

SEQ ID NO: 505154 - RNA, 20 nt, Chlamydophila pneumoniae CWL029
ucccuauaaagcaaaugccu

SEQ ID NO: 505155 - RNA, 17 nt, Chlamydophila pneumoniae CWL029
ucccgaguccuaaaauu

SEQ ID NO: 505156 - RNA, 23 nt, Chlamydophila pneumoniae CWL029
uccccucugauuauuucuaaaaa

SEQ ID NO: 505157 - RNA, 22 nt, Chlamydophila pneumoniae CWL029
ucccgaacgcuagggaaaccau

SEQ ID NO: 505158 - RNA, 15 nt, Chlamydophila pneumoniae CWL029
uccccuccagucugg

SEQ ID NO: 505159 - RNA, 16 nt, Chlamydophila pneumoniae CWL029
uccuagacgaucuuca

SEQ ID NO: 505160 - RNA, 20 nt, Chlamydophila pneumoniae CWL029
uccuagacagccuugacucu

SEQ ID NO: 505161 - RNA, 19 nt, Chlamydophila pneumoniae CWL029
uccuaccuacguagcauua

SEQ ID NO: 505162 - RNA, 14 nt, Chlamydophila pneumoniae CWL029
uccuaccuauauuu

SEQ ID NO: 505163 - RNA, 21 nt, Chlamydophila pneumoniae CWL029
uccuaccuauauuuuuuacau

SEQ ID NO: 505164 - RNA, 15 nt, Chlamydophila pneumoniae CWL029
uccuaacaaaaggau

SEQ ID NO: 505165 - RNA, 13 nt, Chlamydophila pneumoniae CWL029
uccuaaaucugcu

SEQ ID NO: 505166 - RNA, 23 nt, Chlamydophila pneumoniae CWL029
uccuaaauuaaauaucuaauaaa

SEQ ID NO: 505167 - RNA, 18 nt, Chlamydophila pneumoniae CWL029
uccuaagucguuaacauc

SEQ ID NO: 505168 - RNA, 21 nt, Chlamydophila pneumoniae CWL029
uccuaaguuagagacacagaa

SEQ ID NO: 505169 - RNA, 15 nt, Chlamydophila pneumoniae CWL029
uccuaaaauuucuag

SEQ ID NO: 505170 - RNA, 17 nt, Chlamydophila pneumoniae CWL029
uccuaaaauuucuagga

SEQ ID NO: 505171 - RNA, 11 nt, Chlamydophila pneumoniae CWL029
uccuaaaaaaa

SEQ ID NO: 505172 - RNA, 23 nt, Chlamydophila pneumoniae CWL029
uccuaaaacaagaagaucaaaga

SEQ ID NO: 505173 - RNA, 19 nt, Chlamydophila pneumoniae CWL029
uccuaaaaaggguuccucu

SEQ ID NO: 505174 - RNA, 14 nt, Chlamydophila pneumoniae CWL029
uccgugagcaacaa

SEQ ID NO: 505175 - RNA, 18 nt, Chlamydophila pneumoniae CWL029
uccguucgagagguuccc

SEQ ID NO: 505176 - RNA, 16 nt, Chlamydophila pneumoniae CWL029
uccguuucagaaguca

SEQ ID NO: 505177 - RNA, 15 nt, Chlamydophila pneumoniae CWL029
uccuccccauacaua

SEQ ID NO: 505178 - RNA, 12 nt, Chlamydophila pneumoniae CWL029
uccucagucucu

SEQ ID NO: 505179 - RNA, 14 nt, Chlamydophila pneumoniae CWL029
uccuccaaaagacc

SEQ ID NO: 505180 - RNA, 18 nt, Chlamydophila pneumoniae CWL029
uccuccaaugagcucuau

SEQ ID NO: 505181 - RNA, 17 nt, Chlamydophila pneumoniae CWL029
uccuauaguaauuucuc

SEQ ID NO: 505182 - RNA, 22 nt, Chlamydophila pneumoniae CWL029
uccuauaugaaugauuuccaua

SEQ ID NO: 505183 - RNA, 15 nt, Chlamydophila pneumoniae CWL029
uccuaucaaagcaaa

SEQ ID NO: 505184 - RNA, 16 nt, Chlamydophila pneumoniae CWL029
uccucacauguuucac

SEQ ID NO: 505185 - RNA, 16 nt, Chlamydophila pneumoniae CWL029
uccucacaucuccuuu

SEQ ID NO: 505186 - RNA, 15 nt, Chlamydophila pneumoniae CWL029
uccucaccgaucuca

SEQ ID NO: 505187 - RNA, 14 nt, Chlamydophila pneumoniae CWL029
uccucaaaagauau

SEQ ID NO: 505188 - RNA, 19 nt, Chlamydophila pneumoniae CWL029
uccuauugguguaucucuu

SEQ ID NO: 505189 - RNA, 22 nt, Chlamydophila pneumoniae CWL029
uccucaaagaguuuuuuagagg

SEQ ID NO: 505190 - RNA, 13 nt, Chlamydophila pneumoniae CWL029
uccucaagaauau

SEQ ID NO: 505191 - RNA, 21 nt, Chlamydophila pneumoniae CWL029
uccucaagaauaugaacugcc

SEQ ID NO: 505192 - RNA, 17 nt, Chlamydophila pneumoniae CWL029
uccucaagauaaauccc

SEQ ID NO: 505193 - RNA, 19 nt, Chlamydophila pneumoniae CWL029
uccugcaagcauuguuugu

SEQ ID NO: 505194 - RNA, 21 nt, Chlamydophila pneumoniae CWL029
uccugagagcguuguggaagu

SEQ ID NO: 505195 - RNA, 19 nt, Chlamydophila pneumoniae CWL029
uccugaagaugagaaaauc

SEQ ID NO: 505196 - RNA, 13 nt, Chlamydophila pneumoniae CWL029
uccugaaaguaca

SEQ ID NO: 505197 - RNA, 19 nt, Chlamydophila pneumoniae CWL029
uccugaagggacaaguacg

SEQ ID NO: 505198 - RNA, 21 nt, Chlamydophila pneumoniae CWL029
uccugaauggcucugucacua

SEQ ID NO: 505199 - RNA, 19 nt, Chlamydophila pneumoniae CWL029
uccugaaucagcuuaucua

SEQ ID NO: 505200 - RNA, 14 nt, Chlamydophila pneumoniae CWL029
uccucucuuuauau

SEQ ID NO: 505201 - RNA, 15 nt, Chlamydophila pneumoniae CWL029
uccucuucaauuucu

SEQ ID NO: 505202 - RNA, 17 nt, Chlamydophila pneumoniae CWL029
uccucuucuauucugau

SEQ ID NO: 505203 - RNA, 14 nt, Chlamydophila pneumoniae CWL029
uccucggaagauaa

SEQ ID NO: 505204 - RNA, 16 nt, Chlamydophila pneumoniae CWL029
uccucgaauggagugc

SEQ ID NO: 505205 - RNA, 20 nt, Chlamydophila pneumoniae CWL029
uccucgagaacguagcagag

SEQ ID NO: 505206 - RNA, 17 nt, Chlamydophila pneumoniae CWL029
uccucgauacuguugau

SEQ ID NO: 505207 - RNA, 14 nt, Chlamydophila pneumoniae CWL029
uccucgucuucaau

SEQ ID NO: 505208 - RNA, 21 nt, Chlamydophila pneumoniae CWL029
uccucuaaggacaaaucuccc

SEQ ID NO: 505209 - RNA, 22 nt, Chlamydophila pneumoniae CWL029
uccucuauauuuuuucccacaa

SEQ ID NO: 505210 - RNA, 22 nt, Chlamydophila pneumoniae CWL029
uccucucaugaaauuuucuaag

SEQ ID NO: 505211 - RNA, 16 nt, Chlamydophila pneumoniae CWL029
uccucucgauucucgu

SEQ ID NO: 505212 - RNA, 13 nt, Chlamydophila pneumoniae CWL029
uccguauaaguau

SEQ ID NO: 505213 - RNA, 20 nt, Chlamydophila pneumoniae CWL029
uccguaaggacuguagugaa

SEQ ID NO: 505214 - RNA, 12 nt, Chlamydophila pneumoniae CWL029
uccguaaguaac

SEQ ID NO: 505215 - RNA, 14 nt, Chlamydophila pneumoniae CWL029
uccggaacgcagag

SEQ ID NO: 505216 - RNA, 18 nt, Chlamydophila pneumoniae CWL029
uccggaacgcagaguuuu

SEQ ID NO: 505217 - RNA, 15 nt, Chlamydophila pneumoniae CWL029
uccgcaguuguacaa

SEQ ID NO: 505218 - RNA, 18 nt, Chlamydophila pneumoniae CWL029
uccgcauuuccuagugcu

SEQ ID NO: 505219 - RNA, 17 nt, Chlamydophila pneumoniae CWL029
uccgcaaguaaucauga

SEQ ID NO: 505220 - RNA, 15 nt, Chlamydophila pneumoniae CWL029
ucgagaaccuccacc

SEQ ID NO: 505221 - RNA, 21 nt, Chlamydophila pneumoniae CWL029
ucgagaaaugcucuucugcag

SEQ ID NO: 505222 - RNA, 15 nt, Chlamydophila pneumoniae CWL029
ucgagagaagaaauu

SEQ ID NO: 505223 - RNA, 16 nt, Chlamydophila pneumoniae CWL029
ucgagauauugugagg

SEQ ID NO: 505224 - RNA, 20 nt, Chlamydophila pneumoniae CWL029
ucgaauuguguguuuucaua

SEQ ID NO: 505225 - RNA, 22 nt, Chlamydophila pneumoniae CWL029
ucgaauuguguguuuucauaaa

SEQ ID NO: 505226 - RNA, 15 nt, Chlamydophila pneumoniae CWL029
ucgaauuuuuguuuu

SEQ ID NO: 505227 - RNA, 20 nt, Chlamydophila pneumoniae CWL029
ucgacaugcaggccaacucu

SEQ ID NO: 505228 - RNA, 16 nt, Chlamydophila pneumoniae CWL029
ucgaagcggagcaucu

SEQ ID NO: 505229 - RNA, 14 nt, Chlamydophila pneumoniae CWL029
ucgaaugcugcaca

SEQ ID NO: 505230 - RNA, 19 nt, Chlamydophila pneumoniae CWL029
ucgaaugcugcacaguuca

SEQ ID NO: 505231 - RNA, 16 nt, Chlamydophila pneumoniae CWL029
ucgaaucuuuauuucu

SEQ ID NO: 505232 - RNA, 19 nt, Chlamydophila pneumoniae CWL029
ucgaaucuuuauuucugau

SEQ ID NO: 505233 - RNA, 21 nt, Chlamydophila pneumoniae CWL029
uccuguuucaacauaacauga

SEQ ID NO: 505234 - RNA, 22 nt, Chlamydophila pneumoniae CWL029
uccuuaacaacaucacuuauau

SEQ ID NO: 505235 - RNA, 16 nt, Chlamydophila pneumoniae CWL029
uccuuaacaacaucac

SEQ ID NO: 505236 - RNA, 20 nt, Chlamydophila pneumoniae CWL029
ucgaagauucaaagaagucg

SEQ ID NO: 505237 - RNA, 22 nt, Chlamydophila pneumoniae CWL029
ucgcauuacaaauggcaugaaa

SEQ ID NO: 505238 - RNA, 23 nt, Chlamydophila pneumoniae CWL029
ucgcaaauauaguuuucauaauc

SEQ ID NO: 505239 - RNA, 22 nt, Chlamydophila pneumoniae CWL029
ucgccaaacgaauuucuuguuc

SEQ ID NO: 505240 - RNA, 14 nt, Chlamydophila pneumoniae CWL029
ucgauuauuucuug

SEQ ID NO: 505241 - RNA, 17 nt, Chlamydophila pneumoniae CWL029
ucgaugagggaaaugcg

SEQ ID NO: 505242 - RNA, 23 nt, Chlamydophila pneumoniae CWL029
ucgauaaucaaagguuuuugauu

SEQ ID NO: 505243 - RNA, 15 nt, Chlamydophila pneumoniae CWL029
ucgauacccaaagag

SEQ ID NO: 505244 - RNA, 14 nt, Chlamydophila pneumoniae CWL029
ucggcaauuguuaa

SEQ ID NO: 505245 - RNA, 21 nt, Chlamydophila pneumoniae CWL029
ucggcaauuguuaaaagaagg

SEQ ID NO: 505246 - RNA, 21 nt, Chlamydophila pneumoniae CWL029
ucggaagauagcccaaguugu

SEQ ID NO: 505247 - RNA, 14 nt, Chlamydophila pneumoniae CWL029
ucgcucuccucucg

SEQ ID NO: 505248 - RNA, 17 nt, Chlamydophila pneumoniae CWL029
ucgcuccuaagcuuuua

SEQ ID NO: 505249 - RNA, 19 nt, Chlamydophila pneumoniae CWL029
ucgcuccuaauggaaacau

SEQ ID NO: 505250 - RNA, 15 nt, Chlamydophila pneumoniae CWL029
ucgcuagaucacaag

SEQ ID NO: 505251 - RNA, 17 nt, Chlamydophila pneumoniae CWL029
ucgcuagaucacaagaa

SEQ ID NO: 505252 - RNA, 12 nt, Chlamydophila pneumoniae CWL029
ucgcuaccauau

SEQ ID NO: 505253 - RNA, 19 nt, Chlamydophila pneumoniae CWL029
ucucagauaaaaagaagua

SEQ ID NO: 505254 - RNA, 14 nt, Chlamydophila pneumoniae CWL029
ucucacucuaugag

SEQ ID NO: 505255 - RNA, 18 nt, Chlamydophila pneumoniae CWL029
ucucaccagaagcaacua

SEQ ID NO: 505256 - RNA, 16 nt, Chlamydophila pneumoniae CWL029
ucucacaagcauccua

SEQ ID NO: 505257 - RNA, 14 nt, Chlamydophila pneumoniae CWL029
ucucaagaucuuca

SEQ ID NO: 505258 - RNA, 17 nt, Chlamydophila pneumoniae CWL029
ucucaagaucuucauca

SEQ ID NO: 505259 - RNA, 22 nt, Chlamydophila pneumoniae CWL029
ucucaagaguaggcaauacaga

SEQ ID NO: 505260 - RNA, 13 nt, Chlamydophila pneumoniae CWL029
ucuauuucauaua

SEQ ID NO: 505261 - RNA, 14 nt, Chlamydophila pneumoniae CWL029
ucuauuucugccuu

SEQ ID NO: 505262 - RNA, 15 nt, Chlamydophila pneumoniae CWL029
ucuauuugaaaagaa

SEQ ID NO: 505263 - RNA, 13 nt, Chlamydophila pneumoniae CWL029
ucuauuuucagga

SEQ ID NO: 505264 - RNA, 16 nt, Chlamydophila pneumoniae CWL029
ucucaaagaucaucua

SEQ ID NO: 505265 - RNA, 20 nt, Chlamydophila pneumoniae CWL029
ucucaaagacaugagggcau

SEQ ID NO: 505266 - RNA, 13 nt, Chlamydophila pneumoniae CWL029
ucucaaauuucaa

SEQ ID NO: 505267 - RNA, 17 nt, Chlamydophila pneumoniae CWL029
ucuccaagauaauuaug

SEQ ID NO: 505268 - RNA, 14 nt, Chlamydophila pneumoniae CWL029
ucuccaaagauaca

SEQ ID NO: 505269 - RNA, 17 nt, Chlamydophila pneumoniae CWL029
ucuccacagcuucuucg

SEQ ID NO: 505270 - RNA, 21 nt, Chlamydophila pneumoniae CWL029
ucucaucggcauaacuuuauc

SEQ ID NO: 505271 - RNA, 22 nt, Chlamydophila pneumoniae CWL029
ucucauuucguagacgcucuaa

SEQ ID NO: 505272 - RNA, 15 nt, Chlamydophila pneumoniae CWL029
ucuccaaaagcucua

SEQ ID NO: 505273 - RNA, 14 nt, Chlamydophila pneumoniae CWL029
ucucauaaguauag

SEQ ID NO: 505274 - RNA, 15 nt, Chlamydophila pneumoniae CWL029
ucucauaguuucuau

SEQ ID NO: 505275 - RNA, 15 nt, Chlamydophila pneumoniae CWL029
ucucaguuaaagagc

SEQ ID NO: 505276 - RNA, 22 nt, Chlamydophila pneumoniae CWL029
ucucaggaaagguaguuuucuu

SEQ ID NO: 505277 - RNA, 17 nt, Chlamydophila pneumoniae CWL029
ucucagcuucaucagaa

SEQ ID NO: 505278 - RNA, 14 nt, Chlamydophila pneumoniae CWL029
ucucagugaacucu

SEQ ID NO: 505279 - RNA, 18 nt, Chlamydophila pneumoniae CWL029
ucucagugaacucuucaa

SEQ ID NO: 505280 - RNA, 18 nt, Chlamydophila pneumoniae CWL029
ucucccaauauccagaaa

SEQ ID NO: 505281 - RNA, 21 nt, Chlamydophila pneumoniae CWL029
ucuccauccucagucucucua

SEQ ID NO: 505282 - RNA, 18 nt, Chlamydophila pneumoniae CWL029
ucucccauagcaaugccu

SEQ ID NO: 505283 - RNA, 21 nt, Chlamydophila pneumoniae CWL029
ucucccauguaguaaauuccu

SEQ ID NO: 505284 - RNA, 13 nt, Chlamydophila pneumoniae CWL029
ucuccuugacaaa

SEQ ID NO: 505285 - RNA, 23 nt, Chlamydophila pneumoniae CWL029
ucuccuugacaaauaaguccugu

SEQ ID NO: 505286 - RNA, 18 nt, Chlamydophila pneumoniae CWL029
ucuccuaaaccaucacuu

SEQ ID NO: 505287 - RNA, 13 nt, Chlamydophila pneumoniae CWL029
ucuccucaucaga

SEQ ID NO: 505288 - RNA, 17 nt, Chlamydophila pneumoniae CWL029
ucuccgucauauuuaaa

SEQ ID NO: 505289 - RNA, 12 nt, Chlamydophila pneumoniae CWL029
ucuccguccccc

SEQ ID NO: 505290 - RNA, 13 nt, Chlamydophila pneumoniae CWL029
ucuagcugcucuu

SEQ ID NO: 505291 - RNA, 16 nt, Chlamydophila pneumoniae CWL029
ucuagcucaaaucuca

SEQ ID NO: 505292 - RNA, 17 nt, Chlamydophila pneumoniae CWL029
ucuagcaaaucuaaaac

SEQ ID NO: 505293 - RNA, 22 nt, Chlamydophila pneumoniae CWL029
ucuagcaguugcaauaccaauu

SEQ ID NO: 505294 - RNA, 22 nt, Chlamydophila pneumoniae CWL029
ucuagccaauauagaagcugcu

SEQ ID NO: 505295 - RNA, 14 nt, Chlamydophila pneumoniae CWL029
ucuagaucuucaau

SEQ ID NO: 505296 - RNA, 17 nt, Chlamydophila pneumoniae CWL029
ucuagaguugcuuuaug

SEQ ID NO: 505297 - RNA, 13 nt, Chlamydophila pneumoniae CWL029
ucuagaacacuca

SEQ ID NO: 505298 - RNA, 17 nt, Chlamydophila pneumoniae CWL029
ucuagaacacucagaga

SEQ ID NO: 505299 - RNA, 14 nt, Chlamydophila pneumoniae CWL029
ucuagaaguuuaaa

SEQ ID NO: 505300 - RNA, 16 nt, Chlamydophila pneumoniae CWL029
ucuagaaaaucucuaa

SEQ ID NO: 505301 - RNA, 23 nt, Chlamydophila pneumoniae CWL029
ucuagaaaaugaagagcuuccau

SEQ ID NO: 505302 - RNA, 17 nt, Chlamydophila pneumoniae CWL029
ucuagaaacaacugaaa

SEQ ID NO: 505303 - RNA, 13 nt, Chlamydophila pneumoniae CWL029
ucuagaaaauauu

SEQ ID NO: 505304 - RNA, 19 nt, Chlamydophila pneumoniae CWL029
ucuagaaaauauuccugga

SEQ ID NO: 505305 - RNA, 14 nt, Chlamydophila pneumoniae CWL029
ucuagaaaaucucu

SEQ ID NO: 505306 - RNA, 13 nt, Chlamydophila pneumoniae CWL029
ucuaguuuuucuu

SEQ ID NO: 505307 - RNA, 18 nt, Chlamydophila pneumoniae CWL029
ucuaguuuuucuuuagag

SEQ ID NO: 505308 - RNA, 15 nt, Chlamydophila pneumoniae CWL029
ucuauaacuacaaaa

SEQ ID NO: 505309 - RNA, 13 nt, Chlamydophila pneumoniae CWL029
ucuauaauaaccu

SEQ ID NO: 505310 - RNA, 23 nt, Chlamydophila pneumoniae CWL029
ucuauacagacaagcaaggaaaa

SEQ ID NO: 505311 - RNA, 18 nt, Chlamydophila pneumoniae CWL029
ucuagguuuucucuuccu

SEQ ID NO: 505312 - RNA, 18 nt, Chlamydophila pneumoniae CWL029
ucuaggacagcacauaga

SEQ ID NO: 505313 - RNA, 15 nt, Chlamydophila pneumoniae CWL029
ucuagggucaagaac

SEQ ID NO: 505314 - RNA, 19 nt, Chlamydophila pneumoniae CWL029
ucuagcuguuaauucccgu

SEQ ID NO: 505315 - RNA, 15 nt, Chlamydophila pneumoniae CWL029
ucuagcuuccucacg

SEQ ID NO: 505316 - RNA, 15 nt, Chlamydophila pneumoniae CWL029
ucuagcuuugucucu

SEQ ID NO: 505317 - RNA, 14 nt, Chlamydophila pneumoniae CWL029
ucuauagaucuuga

SEQ ID NO: 505318 - RNA, 18 nt, Chlamydophila pneumoniae CWL029
ucuauaucauuaagaaga

SEQ ID NO: 505319 - RNA, 14 nt, Chlamydophila pneumoniae CWL029
ucuauaucuacagc

SEQ ID NO: 505320 - RNA, 19 nt, Chlamydophila pneumoniae CWL029
ucuaucgauagccauuaga

SEQ ID NO: 505321 - RNA, 14 nt, Chlamydophila pneumoniae CWL029
ucuauccaucaucg

SEQ ID NO: 505322 - RNA, 19 nt, Chlamydophila pneumoniae CWL029
ucuaucagggcuacgguaa

SEQ ID NO: 505323 - RNA, 19 nt, Chlamydophila pneumoniae CWL029
ucuaucuuuacuaacaaaa

SEQ ID NO: 505324 - RNA, 22 nt, Chlamydophila pneumoniae CWL029
ucuaugagaguaaguuuuuaau

SEQ ID NO: 505325 - RNA, 23 nt, Chlamydophila pneumoniae CWL029
ucuaugagaguaaguuuuuaauc

SEQ ID NO: 505326 - RNA, 19 nt, Chlamydophila pneumoniae CWL029
ucuaugauccgaaaacucu

SEQ ID NO: 505327 - RNA, 17 nt, Chlamydophila pneumoniae CWL029
ucuaugagauaggaacu

SEQ ID NO: 505328 - RNA, 18 nt, Chlamydophila pneumoniae CWL029
ucuaucuacacacaugac

SEQ ID NO: 505329 - RNA, 17 nt, Chlamydophila pneumoniae CWL029
ucuaucugcacuuucuu

SEQ ID NO: 505330 - RNA, 16 nt, Chlamydophila pneumoniae CWL029
ucuaucuugaaaguac

SEQ ID NO: 505331 - RNA, 19 nt, Chlamydophila pneumoniae CWL029
ucuauuaaggauuccuuga

SEQ ID NO: 505332 - RNA, 16 nt, Chlamydophila pneumoniae CWL029
ucuauguuuugacaua

SEQ ID NO: 505333 - RNA, 13 nt, Chlamydophila pneumoniae CWL029
ucuauuaaaaaua

SEQ ID NO: 505334 - RNA, 18 nt, Chlamydophila pneumoniae CWL029
ucuauucgcugucuagaa

SEQ ID NO: 505335 - RNA, 20 nt, Chlamydophila pneumoniae CWL029
ucuauucucuucauuuucuu

SEQ ID NO: 505336 - RNA, 20 nt, Chlamydophila pneumoniae CWL029
ucuacacacaugacaaauaa

SEQ ID NO: 505337 - RNA, 15 nt, Chlamydophila pneumoniae CWL029
ucuaauacguuuuua

SEQ ID NO: 505338 - RNA, 15 nt, Chlamydophila pneumoniae CWL029
ucuaaucaauucgcu

SEQ ID NO: 505339 - RNA, 21 nt, Chlamydophila pneumoniae CWL029
ucuaaucaauucgcucagaaa

SEQ ID NO: 505340 - RNA, 15 nt, Chlamydophila pneumoniae CWL029
ucuaaucuucuuaau

SEQ ID NO: 505341 - RNA, 19 nt, Chlamydophila pneumoniae CWL029
ucuaaugacagcugagaaa

SEQ ID NO: 505342 - RNA, 17 nt, Chlamydophila pneumoniae CWL029
ucuacagaggaaucuau

SEQ ID NO: 505343 - RNA, 12 nt, Chlamydophila pneumoniae CWL029
ucuacagaauag

SEQ ID NO: 505344 - RNA, 18 nt, Chlamydophila pneumoniae CWL029
ucuaccaauucucucucu

SEQ ID NO: 505345 - RNA, 19 nt, Chlamydophila pneumoniae CWL029
ucuacagcuauagaagcug

SEQ ID NO: 505346 - RNA, 16 nt, Chlamydophila pneumoniae CWL029
ucuacccccagcuucu

SEQ ID NO: 505347 - RNA, 20 nt, Chlamydophila pneumoniae CWL029
ucuaccgaacagagcgucua

SEQ ID NO: 505348 - RNA, 18 nt, Chlamydophila pneumoniae CWL029
ucuacgcuauucuuaagc

SEQ ID NO: 505349 - RNA, 15 nt, Chlamydophila pneumoniae CWL029
ucuacuaaaaucuca

SEQ ID NO: 505350 - RNA, 17 nt, Chlamydophila pneumoniae CWL029
ucuacuaaaaucucauu

SEQ ID NO: 505351 - RNA, 22 nt, Chlamydophila pneumoniae CWL029
ucuacucuacaguaguaaauaa

SEQ ID NO: 505352 - RNA, 21 nt, Chlamydophila pneumoniae CWL029
ucuacugaaaccuucucucuu

SEQ ID NO: 505353 - RNA, 23 nt, Chlamydophila pneumoniae CWL029
ucuacugaaaccuucucucuuaa

SEQ ID NO: 505354 - RNA, 15 nt, Chlamydophila pneumoniae CWL029
ucuaaagcagaaucc

SEQ ID NO: 505355 - RNA, 18 nt, Chlamydophila pneumoniae CWL029
ucuaaagcugcuuuuucu

SEQ ID NO: 505356 - RNA, 20 nt, Chlamydophila pneumoniae CWL029
ucuaaagaaauguaagaagg

SEQ ID NO: 505357 - RNA, 12 nt, Chlamydophila pneumoniae CWL029
ucuaaagaaaug

SEQ ID NO: 505358 - RNA, 13 nt, Chlamydophila pneumoniae CWL029
ucuaaagaaaugu

SEQ ID NO: 505359 - RNA, 23 nt, Chlamydophila pneumoniae CWL029
ucuaaccaaccuuguugaaaggc

SEQ ID NO: 505360 - RNA, 12 nt, Chlamydophila pneumoniae CWL029
ucuaaacauaaa

SEQ ID NO: 505361 - RNA, 21 nt, Chlamydophila pneumoniae CWL029
ucuaaaacaccugcccauuuu

SEQ ID NO: 505362 - RNA, 18 nt, Chlamydophila pneumoniae CWL029
ucuaaaacagaaauugcu

SEQ ID NO: 505363 - RNA, 20 nt, Chlamydophila pneumoniae CWL029
ucuaaaauaaccccuccaaa

SEQ ID NO: 505364 - RNA, 13 nt, Chlamydophila pneumoniae CWL029
ucguguuuuccug

SEQ ID NO: 505365 - RNA, 22 nt, Chlamydophila pneumoniae CWL029
ucguuaaaaacuauccuauuuu

SEQ ID NO: 505366 - RNA, 17 nt, Chlamydophila pneumoniae CWL029
ucguuuucuagcauagu

SEQ ID NO: 505367 - RNA, 15 nt, Chlamydophila pneumoniae CWL029
ucgucuccaaaaauu

SEQ ID NO: 505368 - RNA, 14 nt, Chlamydophila pneumoniae CWL029
ucgucuuuuaaaga

SEQ ID NO: 505369 - RNA, 14 nt, Chlamydophila pneumoniae CWL029
ucgucauucugcaa

SEQ ID NO: 505370 - RNA, 22 nt, Chlamydophila pneumoniae CWL029
ucguccugacacaacucuuaaa

SEQ ID NO: 505371 - RNA, 21 nt, Chlamydophila pneumoniae CWL029
ucguccugacacaacucuuaa

SEQ ID NO: 505372 - RNA, 11 nt, Chlamydophila pneumoniae CWL029
ucgucaaauuc

SEQ ID NO: 505373 - RNA, 14 nt, Chlamydophila pneumoniae CWL029
ucguagcuaaauug

SEQ ID NO: 505374 - RNA, 19 nt, Chlamydophila pneumoniae CWL029
ucguagccccauagagccu

SEQ ID NO: 505375 - RNA, 17 nt, Chlamydophila pneumoniae CWL029
ucguagccuuacguaaa

SEQ ID NO: 505376 - RNA, 12 nt, Chlamydophila pneumoniae CWL029
ucgucaccugag

SEQ ID NO: 505377 - RNA, 21 nt, Chlamydophila pneumoniae CWL029
ucguagacaacaagucuuccc

SEQ ID NO: 505378 - RNA, 22 nt, Chlamydophila pneumoniae CWL029
ucgguuaagaggugauacauag

SEQ ID NO: 505379 - RNA, 23 nt, Chlamydophila pneumoniae CWL029
ucugcagguaagggaugcucuag

SEQ ID NO: 505380 - RNA, 15 nt, Chlamydophila pneumoniae CWL029
ucugcagguaaggga

SEQ ID NO: 505381 - RNA, 22 nt, Chlamydophila pneumoniae CWL029
ucugcauauaaagacucucuuc

SEQ ID NO: 505382 - RNA, 17 nt, Chlamydophila pneumoniae CWL029
ucugccuaccaaaguuu

SEQ ID NO: 505383 - RNA, 19 nt, Chlamydophila pneumoniae CWL029
ucugcccaaagcuaaaaug

SEQ ID NO: 505384 - RNA, 13 nt, Chlamydophila pneumoniae CWL029
ucugcccaaagcu

SEQ ID NO: 505385 - RNA, 22 nt, Chlamydophila pneumoniae CWL029
ucugcccgucuuagaauccaaa

SEQ ID NO: 505386 - RNA, 14 nt, Chlamydophila pneumoniae CWL029
ucucgaagaaaaua

SEQ ID NO: 505387 - RNA, 22 nt, Chlamydophila pneumoniae CWL029
ucucgaagaaaauaaagaucuu

SEQ ID NO: 505388 - RNA, 16 nt, Chlamydophila pneumoniae CWL029
ucucgaaauccuaaaa

SEQ ID NO: 505389 - RNA, 14 nt, Chlamydophila pneumoniae CWL029
ucuccuuuaaauaa

SEQ ID NO: 505390 - RNA, 18 nt, Chlamydophila pneumoniae CWL029
ucuccuuuaaauaaaauc

SEQ ID NO: 505391 - RNA, 22 nt, Chlamydophila pneumoniae CWL029
ucucgaaaaauuugcgaagucc

SEQ ID NO: 505392 - RNA, 18 nt, Chlamydophila pneumoniae CWL029
ucugaacaggaauagaaa

SEQ ID NO: 505393 - RNA, 17 nt, Chlamydophila pneumoniae CWL029
ucugaaaucaaaaaaaa

SEQ ID NO: 505394 - RNA, 17 nt, Chlamydophila pneumoniae CWL029
ucucgcuauuccauaaa

SEQ ID NO: 505395 - RNA, 13 nt, Chlamydophila pneumoniae CWL029
ucugaaacaaugc

SEQ ID NO: 505396 - RNA, 20 nt, Chlamydophila pneumoniae CWL029
ucugaaacaaugcaucccug

SEQ ID NO: 505397 - RNA, 20 nt, Chlamydophila pneumoniae CWL029
ucugauguaggugauauuuu

SEQ ID NO: 505398 - RNA, 17 nt, Chlamydophila pneumoniae CWL029
ucugauuauuucuaaaa

SEQ ID NO: 505399 - RNA, 15 nt, Chlamydophila pneumoniae CWL029
ucugauaaagcuaca

SEQ ID NO: 505400 - RNA, 16 nt, Chlamydophila pneumoniae CWL029
ucugaguuagcuuuug

SEQ ID NO: 505401 - RNA, 19 nt, Chlamydophila pneumoniae CWL029
ucugauaaucagaggagcc

SEQ ID NO: 505402 - RNA, 19 nt, Chlamydophila pneumoniae CWL029
ucugacccuguagcgaaga

SEQ ID NO: 505403 - RNA, 15 nt, Chlamydophila pneumoniae CWL029
ucuuaaaauuccuga

SEQ ID NO: 505404 - RNA, 13 nt, Chlamydophila pneumoniae CWL029
ucuguuuuuugaa

SEQ ID NO: 505405 - RNA, 15 nt, Chlamydophila pneumoniae CWL029
ucuguuuuuugaaaa

SEQ ID NO: 505406 - RNA, 19 nt, Chlamydophila pneumoniae CWL029
ucuguucugcuucuguaaa

SEQ ID NO: 505407 - RNA, 13 nt, Chlamydophila pneumoniae CWL029
ucuguugggagcu

SEQ ID NO: 505408 - RNA, 21 nt, Chlamydophila pneumoniae CWL029
ucuguuggucucuauuuagac

SEQ ID NO: 505409 - RNA, 17 nt, Chlamydophila pneumoniae CWL029
ucugguauagaaacacc

SEQ ID NO: 505410 - RNA, 17 nt, Chlamydophila pneumoniae CWL029
ucuguagauuuucccua

SEQ ID NO: 505411 - RNA, 15 nt, Chlamydophila pneumoniae CWL029
ucuguagguuuuucc

SEQ ID NO: 505412 - RNA, 16 nt, Chlamydophila pneumoniae CWL029
ucuguagguuuuucca

SEQ ID NO: 505413 - RNA, 14 nt, Chlamydophila pneumoniae CWL029
ucuguaguaaagcc

SEQ ID NO: 505414 - RNA, 15 nt, Chlamydophila pneumoniae CWL029
ucuguaguaaagcca

SEQ ID NO: 505415 - RNA, 16 nt, Chlamydophila pneumoniae CWL029
ucugucuguauuuccg

SEQ ID NO: 505416 - RNA, 22 nt, Chlamydophila pneumoniae CWL029
ucuguaucgauaacgauuucuu

SEQ ID NO: 505417 - RNA, 17 nt, Chlamydophila pneumoniae CWL029
ucuguaucgauaguuuu

SEQ ID NO: 505418 - RNA, 16 nt, Chlamydophila pneumoniae CWL029
ucuguaguuuguucac

SEQ ID NO: 505419 - RNA, 22 nt, Chlamydophila pneumoniae CWL029
ucuguaguuuguucacuuggua

SEQ ID NO: 505420 - RNA, 13 nt, Chlamydophila pneumoniae CWL029
ucuguauaguuuu

SEQ ID NO: 505421 - RNA, 15 nt, Chlamydophila pneumoniae CWL029
ucugugaguacccag

SEQ ID NO: 505422 - RNA, 19 nt, Chlamydophila pneumoniae CWL029
ucuggggcuuccagaaaca

SEQ ID NO: 505423 - RNA, 14 nt, Chlamydophila pneumoniae CWL029
ucuggguucuccac

SEQ ID NO: 505424 - RNA, 17 nt, Chlamydophila pneumoniae CWL029
ucuggauacguuuuucc

SEQ ID NO: 505425 - RNA, 18 nt, Chlamydophila pneumoniae CWL029
ucuggauacguuuuuccc

SEQ ID NO: 505426 - RNA, 20 nt, Chlamydophila pneumoniae CWL029
ucuggauacguuuuucccuu

SEQ ID NO: 505427 - RNA, 13 nt, Chlamydophila pneumoniae CWL029
ucugcuugucuac

SEQ ID NO: 505428 - RNA, 23 nt, Chlamydophila pneumoniae CWL029
ucuggaugagaggauuugaaccu

SEQ ID NO: 505429 - RNA, 13 nt, Chlamydophila pneumoniae CWL029
ucuggauguagag

SEQ ID NO: 505430 - RNA, 20 nt, Chlamydophila pneumoniae CWL029
ucugcgauugccggcuauga

SEQ ID NO: 505431 - RNA, 15 nt, Chlamydophila pneumoniae CWL029
ucuuuagaauaagag

SEQ ID NO: 505432 - RNA, 20 nt, Chlamydophila pneumoniae CWL029
ucuuuagagucugcagcaga

SEQ ID NO: 505433 - RNA, 23 nt, Chlamydophila pneumoniae CWL029
ucuuuacuacaugaggauacacu

SEQ ID NO: 505434 - RNA, 17 nt, Chlamydophila pneumoniae CWL029
ucuuuagcaaacauuuu

SEQ ID NO: 505435 - RNA, 16 nt, Chlamydophila pneumoniae CWL029
ucuuuagcuacagaaa

SEQ ID NO: 505436 - RNA, 13 nt, Chlamydophila pneumoniae CWL029
ucuuuaggagcau

SEQ ID NO: 505437 - RNA, 19 nt, Chlamydophila pneumoniae CWL029
ucuuuaggguaaagaaaua

SEQ ID NO: 505438 - RNA, 22 nt, Chlamydophila pneumoniae CWL029
ucuuuaggauagaggccuuuua

SEQ ID NO: 505439 - RNA, 14 nt, Chlamydophila pneumoniae CWL029
ucuuuaaaaauaua

SEQ ID NO: 505440 - RNA, 16 nt, Chlamydophila pneumoniae CWL029
ucuuuaaaaucuucug

SEQ ID NO: 505441 - RNA, 13 nt, Chlamydophila pneumoniae CWL029
ucuuuaccagaaa

SEQ ID NO: 505442 - RNA, 17 nt, Chlamydophila pneumoniae CWL029
ucuuguacauccuuguc

SEQ ID NO: 505443 - RNA, 18 nt, Chlamydophila pneumoniae CWL029
ucuugguguauaguauuu

SEQ ID NO: 505444 - RNA, 14 nt, Chlamydophila pneumoniae CWL029
ucuugauuccuuaa

SEQ ID NO: 505445 - RNA, 18 nt, Chlamydophila pneumoniae CWL029
ucuucuuugccaaugaga

SEQ ID NO: 505446 - RNA, 14 nt, Chlamydophila pneumoniae CWL029
ucuugaagaucucc

SEQ ID NO: 505447 - RNA, 23 nt, Chlamydophila pneumoniae CWL029
ucuugaaaguacaggcuccauca

SEQ ID NO: 505448 - RNA, 14 nt, Chlamydophila pneumoniae CWL029
ucuugaauucucaa

SEQ ID NO: 505449 - RNA, 20 nt, Chlamydophila pneumoniae CWL029
ucuugaagagauugauuucu

SEQ ID NO: 505450 - RNA, 15 nt, Chlamydophila pneumoniae CWL029
ucuugauccaucugc

SEQ ID NO: 505451 - RNA, 20 nt, Chlamydophila pneumoniae CWL029
ucuugauccaucugcucuuu

SEQ ID NO: 505452 - RNA, 18 nt, Chlamydophila pneumoniae CWL029
ucuugaugaccucuauac

SEQ ID NO: 505453 - RNA, 16 nt, Chlamydophila pneumoniae CWL029
ucuugaugaccucuau

SEQ ID NO: 505454 - RNA, 18 nt, Chlamydophila pneumoniae CWL029
ucuugagccacuuuuaau

SEQ ID NO: 505455 - RNA, 19 nt, Chlamydophila pneumoniae CWL029
ucuugagccacuuuuaauu

SEQ ID NO: 505456 - RNA, 17 nt, Chlamydophila pneumoniae CWL029
ucuugacuuguuucucc

SEQ ID NO: 505457 - RNA, 22 nt, Chlamydophila pneumoniae CWL029
ucuugacggcaggacucuuuaa

SEQ ID NO: 505458 - RNA, 19 nt, Chlamydophila pneumoniae CWL029
ucuucugauugaaguucag

SEQ ID NO: 505459 - RNA, 21 nt, Chlamydophila pneumoniae CWL029
ucuucugauacaucaucagaa

SEQ ID NO: 505460 - RNA, 21 nt, Chlamydophila pneumoniae CWL029
ucuucuguaauuuuuuucaaa

SEQ ID NO: 505461 - RNA, 17 nt, Chlamydophila pneumoniae CWL029
ucuucuguaauuuuuuu

SEQ ID NO: 505462 - RNA, 14 nt, Chlamydophila pneumoniae CWL029
ucuucuuagaaaca

SEQ ID NO: 505463 - RNA, 11 nt, Chlamydophila pneumoniae CWL029
ucuucugaaau

SEQ ID NO: 505464 - RNA, 14 nt, Chlamydophila pneumoniae CWL029
ucuucuucuggcug

SEQ ID NO: 505465 - RNA, 17 nt, Chlamydophila pneumoniae CWL029
ucuucuucaucuucuaa

SEQ ID NO: 505466 - RNA, 15 nt, Chlamydophila pneumoniae CWL029
ucuucuuagccaaaa

SEQ ID NO: 505467 - RNA, 18 nt, Chlamydophila pneumoniae CWL029
ucuucuuagccaaaauuu

SEQ ID NO: 505468 - RNA, 16 nt, Chlamydophila pneumoniae CWL029
ucuucuuuggaugcua

SEQ ID NO: 505469 - RNA, 18 nt, Chlamydophila pneumoniae CWL029
ucuucuuuggaugcuaau

SEQ ID NO: 505470 - RNA, 19 nt, Chlamydophila pneumoniae CWL029
ucuucuuggcuuucccccu

SEQ ID NO: 505471 - RNA, 20 nt, Chlamydophila pneumoniae CWL029
ucuucuuuaagauuuccuua

SEQ ID NO: 505472 - RNA, 21 nt, Chlamydophila pneumoniae CWL029
ucuucucgaacaggagagaga

SEQ ID NO: 505473 - RNA, 22 nt, Chlamydophila pneumoniae CWL029
ucuucucgaacaggagagagaa

SEQ ID NO: 505474 - RNA, 14 nt, Chlamydophila pneumoniae CWL029
ucuucuauuuuuuu

SEQ ID NO: 505475 - RNA, 21 nt, Chlamydophila pneumoniae CWL029
ucuucuagagcuucaaguuuc

SEQ ID NO: 505476 - RNA, 13 nt, Chlamydophila pneumoniae CWL029
ucuucuaccugua

SEQ ID NO: 505477 - RNA, 13 nt, Chlamydophila pneumoniae CWL029
ucuucuaaaacac

SEQ ID NO: 505478 - RNA, 16 nt, Chlamydophila pneumoniae CWL029
ucuucuaaaacuucag

SEQ ID NO: 505479 - RNA, 20 nt, Chlamydophila pneumoniae CWL029
ucuucuaaaacuucaguugu

SEQ ID NO: 505480 - RNA, 18 nt, Chlamydophila pneumoniae CWL029
ucuucguuucuuugaguu

SEQ ID NO: 505481 - RNA, 14 nt, Chlamydophila pneumoniae CWL029
ucuucgaauuuuug

SEQ ID NO: 505482 - RNA, 19 nt, Chlamydophila pneumoniae CWL029
ucuucgaggccuaaaauca

SEQ ID NO: 505483 - RNA, 13 nt, Chlamydophila pneumoniae CWL029
ucuucgcaaauau

SEQ ID NO: 505484 - RNA, 20 nt, Chlamydophila pneumoniae CWL029
ucuucgcaaauauaguuuuc

SEQ ID NO: 505485 - RNA, 20 nt, Chlamydophila pneumoniae CWL029
ucuucgcccauuaacuaaga

SEQ ID NO: 505486 - RNA, 23 nt, Chlamydophila pneumoniae CWL029
ucuucgcuggcauguuuaauauc

SEQ ID NO: 505487 - RNA, 15 nt, Chlamydophila pneumoniae CWL029
ucuucgcuggcaugu

SEQ ID NO: 505488 - RNA, 17 nt, Chlamydophila pneumoniae CWL029
ucuucggaucuguaaua

SEQ ID NO: 505489 - RNA, 23 nt, Chlamydophila pneumoniae CWL029
ucuucagcuuuaacaugccaaaa

SEQ ID NO: 505490 - RNA, 15 nt, Chlamydophila pneumoniae CWL029
ucuuaacuggcaauc

SEQ ID NO: 505491 - RNA, 16 nt, Chlamydophila pneumoniae CWL029
ucuuaagaauaaaaua

SEQ ID NO: 505492 - RNA, 22 nt, Chlamydophila pneumoniae CWL029
ucuuaagagaaaggcgcucuua

SEQ ID NO: 505493 - RNA, 15 nt, Chlamydophila pneumoniae CWL029
ucuuaagagcaaaca

SEQ ID NO: 505494 - RNA, 17 nt, Chlamydophila pneumoniae CWL029
ucuuaagagcaaacauc

SEQ ID NO: 505495 - RNA, 24 nt, Chlamydophila pneumoniae CWL029
ucuuaagcuaccauuaaggaaucc

SEQ ID NO: 505496 - RNA, 23 nt, Chlamydophila pneumoniae CWL029
ucuuaauauaaaagaagacgcuc

SEQ ID NO: 505497 - RNA, 13 nt, Chlamydophila pneumoniae CWL029
ucuuaauauaaaa

SEQ ID NO: 505498 - RNA, 23 nt, Chlamydophila pneumoniae CWL029
ucuuaaugcgaugcggucagaaa

SEQ ID NO: 505499 - RNA, 14 nt, Chlamydophila pneumoniae CWL029
ucuuccgauuaacu

SEQ ID NO: 505500 - RNA, 14 nt, Chlamydophila pneumoniae CWL029
ucuuccaacuucug

SEQ ID NO: 505501 - RNA, 17 nt, Chlamydophila pneumoniae CWL029
ucuucauuuucuuuuaa

SEQ ID NO: 505502 - RNA, 14 nt, Chlamydophila pneumoniae CWL029
ucuuccaaagacug

SEQ ID NO: 505503 - RNA, 17 nt, Chlamydophila pneumoniae CWL029
ucuuccaaagacugagc

SEQ ID NO: 505504 - RNA, 23 nt, Chlamydophila pneumoniae CWL029
uguaaagagcaacaguaauuauu

SEQ ID NO: 505505 - RNA, 21 nt, Chlamydophila pneumoniae CWL029
uguaaauacaaaacaaaagcc

SEQ ID NO: 505506 - RNA, 21 nt, Chlamydophila pneumoniae CWL029
uguaagaaaaugaggacacaa

SEQ ID NO: 505507 - RNA, 18 nt, Chlamydophila pneumoniae CWL029
uguaauaaaagaacauua

SEQ ID NO: 505508 - RNA, 20 nt, Chlamydophila pneumoniae CWL029
uguaacgggagcguuuuuug

SEQ ID NO: 505509 - RNA, 17 nt, Chlamydophila pneumoniae CWL029
uguaaauccggcuccuu

SEQ ID NO: 505510 - RNA, 21 nt, Chlamydophila pneumoniae CWL029
uguaacauugaccuaaaggaa

SEQ ID NO: 505511 - RNA, 21 nt, Chlamydophila pneumoniae CWL029
uguaaccaacaucaaagaauu

SEQ ID NO: 505512 - RNA, 11 nt, Chlamydophila pneumoniae CWL029
uguaaaaguua

SEQ ID NO: 505513 - RNA, 21 nt, Chlamydophila pneumoniae CWL029
uguaauaaaagaaagaaugac

SEQ ID NO: 505514 - RNA, 17 nt, Chlamydophila pneumoniae CWL029
uguaauagcaggaguuu

SEQ ID NO: 505515 - RNA, 16 nt, Chlamydophila pneumoniae CWL029
uguaauuuuuuucaaa

SEQ ID NO: 505516 - RNA, 19 nt, Chlamydophila pneumoniae CWL029
uguacaauuugcuccucca

SEQ ID NO: 505517 - RNA, 16 nt, Chlamydophila pneumoniae CWL029
uguacuuuuugccaca

SEQ ID NO: 505518 - RNA, 15 nt, Chlamydophila pneumoniae CWL029
uguaccguaaagaaa

SEQ ID NO: 505519 - RNA, 18 nt, Chlamydophila pneumoniae CWL029
uguaccugcauucauaaa

SEQ ID NO: 505520 - RNA, 21 nt, Chlamydophila pneumoniae CWL029
uguacgguaaauccauuuggg

SEQ ID NO: 505521 - RNA, 19 nt, Chlamydophila pneumoniae CWL029
uguauuugcagaagcauug

SEQ ID NO: 505522 - RNA, 15 nt, Chlamydophila pneumoniae CWL029
uguauuuucuucaac

SEQ ID NO: 505523 - RNA, 22 nt, Chlamydophila pneumoniae CWL029
uguauucgcuaagcuauaucuc

SEQ ID NO: 505524 - RNA, 17 nt, Chlamydophila pneumoniae CWL029
uguaucuagggacuucu

SEQ ID NO: 505525 - RNA, 18 nt, Chlamydophila pneumoniae CWL029
uguaucucuuaaaauauu

SEQ ID NO: 505526 - RNA, 19 nt, Chlamydophila pneumoniae CWL029
uguaucucuuaaaauauua

SEQ ID NO: 505527 - RNA, 16 nt, Chlamydophila pneumoniae CWL029
uguauuaaagaaucua

SEQ ID NO: 505528 - RNA, 19 nt, Chlamydophila pneumoniae CWL029
uguauagcuuacuuagaac

SEQ ID NO: 505529 - RNA, 23 nt, Chlamydophila pneumoniae CWL029
uguauauccacgaucuagaagau

SEQ ID NO: 505530 - RNA, 23 nt, Chlamydophila pneumoniae CWL029
uguauaacaucuaaaaaugcacu

SEQ ID NO: 505531 - RNA, 15 nt, Chlamydophila pneumoniae CWL029
uguauacauaucucc

SEQ ID NO: 505532 - RNA, 16 nt, Chlamydophila pneumoniae CWL029
uguauaugcuuggcaa

SEQ ID NO: 505533 - RNA, 13 nt, Chlamydophila pneumoniae CWL029
uguauauucugaa

SEQ ID NO: 505534 - RNA, 14 nt, Chlamydophila pneumoniae CWL029
uguauauucugaaa

SEQ ID NO: 505535 - RNA, 16 nt, Chlamydophila pneumoniae CWL029
uguauauucugaaauu

SEQ ID NO: 505536 - RNA, 19 nt, Chlamydophila pneumoniae CWL029
uguauauucugaaauuucu

SEQ ID NO: 505537 - RNA, 15 nt, Chlamydophila pneumoniae CWL029
uguauccagcucaag

SEQ ID NO: 505538 - RNA, 18 nt, Chlamydophila pneumoniae CWL029
uguauccagcucaaggca

SEQ ID NO: 505539 - RNA, 23 nt, Chlamydophila pneumoniae CWL029
uguauccguagugagguuugcaa

SEQ ID NO: 505540 - RNA, 18 nt, Chlamydophila pneumoniae CWL029
uguauccguagugagguu

SEQ ID NO: 505541 - RNA, 22 nt, Chlamydophila pneumoniae CWL029
uguaucgauaacgauuucuuga

SEQ ID NO: 505542 - RNA, 15 nt, Chlamydophila pneumoniae CWL029
uguagggaugaucac

SEQ ID NO: 505543 - RNA, 16 nt, Chlamydophila pneumoniae CWL029
uguaguaaauuccucu

SEQ ID NO: 505544 - RNA, 12 nt, Chlamydophila pneumoniae CWL029
uguaguucuuug

SEQ ID NO: 505545 - RNA, 21 nt, Chlamydophila pneumoniae CWL029
uguaguucuuugaauuuccaa

SEQ ID NO: 505546 - RNA, 13 nt, Chlamydophila pneumoniae CWL029
uguaguucuugcc

SEQ ID NO: 505547 - RNA, 20 nt, Chlamydophila pneumoniae CWL029
uguaguuucuaaaacagaaa

SEQ ID NO: 505548 - RNA, 16 nt, Chlamydophila pneumoniae CWL029
uguaguuuguucacuu

SEQ ID NO: 505549 - RNA, 22 nt, Chlamydophila pneumoniae CWL029
uguauaaacuccacgaauucuu

SEQ ID NO: 505550 - RNA, 23 nt, Chlamydophila pneumoniae CWL029
uguauaaacuccacgaauucuuu

SEQ ID NO: 505551 - RNA, 12 nt, Chlamydophila pneumoniae CWL029
uguauaaaguuu

SEQ ID NO: 505552 - RNA, 18 nt, Chlamydophila pneumoniae CWL029
uguauaaaguuuguaaaa

SEQ ID NO: 505553 - RNA, 12 nt, Chlamydophila pneumoniae CWL029
uguagauuuucc

SEQ ID NO: 505554 - RNA, 17 nt, Chlamydophila pneumoniae CWL029
uguagcagcaagaacau

SEQ ID NO: 505555 - RNA, 19 nt, Chlamydophila pneumoniae CWL029
uguagagguacuugggaga

SEQ ID NO: 505556 - RNA, 24 nt, Chlamydophila pneumoniae CWL029
uguagaggucacuauagaucucuu

SEQ ID NO: 505557 - RNA, 21 nt, Chlamydophila pneumoniae CWL029
uguagacaauaccagauaaag

SEQ ID NO: 505558 - RNA, 14 nt, Chlamydophila pneumoniae CWL029
uguagccuuucuuu

SEQ ID NO: 505559 - RNA, 17 nt, Chlamydophila pneumoniae CWL029
uguagccuuucuuuuua

SEQ ID NO: 505560 - RNA, 16 nt, Chlamydophila pneumoniae CWL029
ugguaucugauugcua

SEQ ID NO: 505561 - RNA, 12 nt, Chlamydophila pneumoniae CWL029
ugguaucccuga

SEQ ID NO: 505562 - RNA, 19 nt, Chlamydophila pneumoniae CWL029
ugguacggcuaaauaaacc

SEQ ID NO: 505563 - RNA, 13 nt, Chlamydophila pneumoniae CWL029
ugguaaaaauaua

SEQ ID NO: 505564 - RNA, 12 nt, Chlamydophila pneumoniae CWL029
uggguucuccac

SEQ ID NO: 505565 - RNA, 13 nt, Chlamydophila pneumoniae CWL029
uggguucacuccu

SEQ ID NO: 505566 - RNA, 15 nt, Chlamydophila pneumoniae CWL029
uggguucacuccuga

SEQ ID NO: 505567 - RNA, 17 nt, Chlamydophila pneumoniae CWL029
uggguucacuccugaag

SEQ ID NO: 505568 - RNA, 20 nt, Chlamydophila pneumoniae CWL029
ugguguauaguauuuuuaaa

SEQ ID NO: 505569 - RNA, 21 nt, Chlamydophila pneumoniae CWL029
ugguguauaguauuuuuaaau

SEQ ID NO: 505570 - RNA, 18 nt, Chlamydophila pneumoniae CWL029
uggggcaguagguaagaa

SEQ ID NO: 505571 - RNA, 17 nt, Chlamydophila pneumoniae CWL029
uggggcauaagaacucu

SEQ ID NO: 505572 - RNA, 21 nt, Chlamydophila pneumoniae CWL029
ugggcauuuaacaacaugcgc

SEQ ID NO: 505573 - RNA, 18 nt, Chlamydophila pneumoniae CWL029
uggguaaggcgaaaucuu

SEQ ID NO: 505574 - RNA, 15 nt, Chlamydophila pneumoniae CWL029
uggguaaguccacaa

SEQ ID NO: 505575 - RNA, 13 nt, Chlamydophila pneumoniae CWL029
uggguaaguccac

SEQ ID NO: 505576 - RNA, 21 nt, Chlamydophila pneumoniae CWL029
ugggcagcgauauaagacucc

SEQ ID NO: 505577 - RNA, 15 nt, Chlamydophila pneumoniae CWL029
ugggaugaucucuga

SEQ ID NO: 505578 - RNA, 22 nt, Chlamydophila pneumoniae CWL029
ugggcaaugaucaaaaaugaua

SEQ ID NO: 505579 - RNA, 23 nt, Chlamydophila pneumoniae CWL029
uggcuuuuuuugucccaacuaga

SEQ ID NO: 505580 - RNA, 15 nt, Chlamydophila pneumoniae CWL029
uggcaugaaagauaa

SEQ ID NO: 505581 - RNA, 13 nt, Chlamydophila pneumoniae CWL029
uggcauucuuuuu

SEQ ID NO: 505582 - RNA, 17 nt, Chlamydophila pneumoniae CWL029
uggcauugggaaggauc

SEQ ID NO: 505583 - RNA, 20 nt, Chlamydophila pneumoniae CWL029
uggccaacaguguagccuuu

SEQ ID NO: 505584 - RNA, 17 nt, Chlamydophila pneumoniae CWL029
uggccuagcuuucuugg

SEQ ID NO: 505585 - RNA, 12 nt, Chlamydophila pneumoniae CWL029
uggccucaacac

SEQ ID NO: 505586 - RNA, 21 nt, Chlamydophila pneumoniae CWL029
uggauuuuaaagcaaaaauuc

SEQ ID NO: 505587 - RNA, 13 nt, Chlamydophila pneumoniae CWL029
uggauuucuucug

SEQ ID NO: 505588 - RNA, 18 nt, Chlamydophila pneumoniae CWL029
uggauucgcacguaggca

SEQ ID NO: 505589 - RNA, 13 nt, Chlamydophila pneumoniae CWL029
uggauuucuccag

SEQ ID NO: 505590 - RNA, 22 nt, Chlamydophila pneumoniae CWL029
uggauuucuccagcagcuuccc

SEQ ID NO: 505591 - RNA, 15 nt, Chlamydophila pneumoniae CWL029
uggcaaucuaaaauc

SEQ ID NO: 505592 - RNA, 17 nt, Chlamydophila pneumoniae CWL029
uggcaaucuuuucuugu

SEQ ID NO: 505593 - RNA, 18 nt, Chlamydophila pneumoniae CWL029
uggcaaauaaaacaagcu

SEQ ID NO: 505594 - RNA, 16 nt, Chlamydophila pneumoniae CWL029
uggcauaauccugaau

SEQ ID NO: 505595 - RNA, 17 nt, Chlamydophila pneumoniae CWL029
uggcauagcgaaaguca

SEQ ID NO: 505596 - RNA, 20 nt, Chlamydophila pneumoniae CWL029
uggcagcuuggaugggaauc

SEQ ID NO: 505597 - RNA, 17 nt, Chlamydophila pneumoniae CWL029
uggcagcaggaauaauc

SEQ ID NO: 505598 - RNA, 23 nt, Chlamydophila pneumoniae CWL029
uggcagcaaauccuuuauguaua

SEQ ID NO: 505599 - RNA, 13 nt, Chlamydophila pneumoniae CWL029
uggcacaauccuc

SEQ ID NO: 505600 - RNA, 13 nt, Chlamydophila pneumoniae CWL029
uggaucauucuuu

SEQ ID NO: 505601 - RNA, 18 nt, Chlamydophila pneumoniae CWL029
uggaucacguaagcuuua

SEQ ID NO: 505602 - RNA, 20 nt, Chlamydophila pneumoniae CWL029
uggaucagaaaaaaugcguu

SEQ ID NO: 505603 - RNA, 21 nt, Chlamydophila pneumoniae CWL029
uggauccuucaucagcuuccc

SEQ ID NO: 505604 - RNA, 12 nt, Chlamydophila pneumoniae CWL029
uggaucuugaua

SEQ ID NO: 505605 - RNA, 16 nt, Chlamydophila pneumoniae CWL029
uggauacguuuuuccc

SEQ ID NO: 505606 - RNA, 22 nt, Chlamydophila pneumoniae CWL029
uggauacguuuuucccuuuaaa

SEQ ID NO: 505607 - RNA, 16 nt, Chlamydophila pneumoniae CWL029
uggauaccggcaaaua

SEQ ID NO: 505608 - RNA, 18 nt, Chlamydophila pneumoniae CWL029
uggauaucguagacaaca

SEQ ID NO: 505609 - RNA, 17 nt, Chlamydophila pneumoniae CWL029
uggauauugucaagagg

SEQ ID NO: 505610 - RNA, 16 nt, Chlamydophila pneumoniae CWL029
uggaggauaaaugagu

SEQ ID NO: 505611 - RNA, 14 nt, Chlamydophila pneumoniae CWL029
uggaggccaaagaa

SEQ ID NO: 505612 - RNA, 21 nt, Chlamydophila pneumoniae CWL029
uggaggccaaagaacagcacu

SEQ ID NO: 505613 - RNA, 21 nt, Chlamydophila pneumoniae CWL029
uggaggcgguggcaugccaua

SEQ ID NO: 505614 - RNA, 15 nt, Chlamydophila pneumoniae CWL029
uggagucuaaaaaau

SEQ ID NO: 505615 - RNA, 22 nt, Chlamydophila pneumoniae CWL029
uggaguaucuagcuuugucucu

SEQ ID NO: 505616 - RNA, 16 nt, Chlamydophila pneumoniae CWL029
uggagaagagguaaua

SEQ ID NO: 505617 - RNA, 21 nt, Chlamydophila pneumoniae CWL029
uggacugcugacaucuccaag

SEQ ID NO: 505618 - RNA, 15 nt, Chlamydophila pneumoniae CWL029
uggagagcgaaauag

SEQ ID NO: 505619 - RNA, 11 nt, Chlamydophila pneumoniae CWL029
uggagacacac

SEQ ID NO: 505620 - RNA, 20 nt, Chlamydophila pneumoniae CWL029
uggagacuaggguaaguccc

SEQ ID NO: 505621 - RNA, 16 nt, Chlamydophila pneumoniae CWL029
uggacucuagggucaa

SEQ ID NO: 505622 - RNA, 20 nt, Chlamydophila pneumoniae CWL029
uggacucuagggucaagaac

SEQ ID NO: 505623 - RNA, 12 nt, Chlamydophila pneumoniae CWL029
uggacuccaaga

SEQ ID NO: 505624 - RNA, 18 nt, Chlamydophila pneumoniae CWL029
uguuuagaaaaagaucua

SEQ ID NO: 505625 - RNA, 21 nt, Chlamydophila pneumoniae CWL029
uguuuagcauagagcucuaaa

SEQ ID NO: 505626 - RNA, 19 nt, Chlamydophila pneumoniae CWL029
uguuuaaguccuucuuccc

SEQ ID NO: 505627 - RNA, 22 nt, Chlamydophila pneumoniae CWL029
uguuucaacauaacaugagaaa

SEQ ID NO: 505628 - RNA, 15 nt, Chlamydophila pneumoniae CWL029
uguuuauuuagcauu

SEQ ID NO: 505629 - RNA, 16 nt, Chlamydophila pneumoniae CWL029
uguuuaugaaaaucug

SEQ ID NO: 505630 - RNA, 17 nt, Chlamydophila pneumoniae CWL029
uguuuaugaaaaucugc

SEQ ID NO: 505631 - RNA, 15 nt, Chlamydophila pneumoniae CWL029
uguuugcuauacaga

SEQ ID NO: 505632 - RNA, 16 nt, Chlamydophila pneumoniae CWL029
uguuugcaugcggcuc

SEQ ID NO: 505633 - RNA, 18 nt, Chlamydophila pneumoniae CWL029
uguuugcaugcggcuccu

SEQ ID NO: 505634 - RNA, 19 nt, Chlamydophila pneumoniae CWL029
uguuugaaaauauccuaaa

SEQ ID NO: 505635 - RNA, 14 nt, Chlamydophila pneumoniae CWL029
uguuucuucugaau

SEQ ID NO: 505636 - RNA, 14 nt, Chlamydophila pneumoniae CWL029
uguuucuccuauug

SEQ ID NO: 505637 - RNA, 17 nt, Chlamydophila pneumoniae CWL029
uguuucuuguagcuccc

SEQ ID NO: 505638 - RNA, 15 nt, Chlamydophila pneumoniae CWL029
uguuucuuuaucuaa

SEQ ID NO: 505639 - RNA, 22 nt, Chlamydophila pneumoniae CWL029
uguuucuuugacuuucauauga

SEQ ID NO: 505640 - RNA, 20 nt, Chlamydophila pneumoniae CWL029
uguuucuagaaaaucucuaa

SEQ ID NO: 505641 - RNA, 24 nt, Chlamydophila pneumoniae CWL029
uguuucuagaaaaucucuaagaau

SEQ ID NO: 505642 - RNA, 13 nt, Chlamydophila pneumoniae CWL029
uguuuucuaucag

SEQ ID NO: 505643 - RNA, 12 nt, Chlamydophila pneumoniae CWL029
uguuuucuucua

SEQ ID NO: 505644 - RNA, 15 nt, Chlamydophila pneumoniae CWL029
uguuuucuucuaccu

SEQ ID NO: 505645 - RNA, 12 nt, Chlamydophila pneumoniae CWL029
uguuuuccagaa

SEQ ID NO: 505646 - RNA, 22 nt, Chlamydophila pneumoniae CWL029
uuaaaaaacuuccuaacuaucu

SEQ ID NO: 505647 - RNA, 13 nt, Chlamydophila pneumoniae CWL029
uguuuuuugagau

SEQ ID NO: 505648 - RNA, 21 nt, Chlamydophila pneumoniae CWL029
uguuuugcuucuauuuuagaa

SEQ ID NO: 505649 - RNA, 11 nt, Chlamydophila pneumoniae CWL029
uguuuuuaaac

SEQ ID NO: 505650 - RNA, 13 nt, Chlamydophila pneumoniae CWL029
uguuuuuaggagu

SEQ ID NO: 505651 - RNA, 17 nt, Chlamydophila pneumoniae CWL029
uguuuuucuaaaaugcu

SEQ ID NO: 505652 - RNA, 18 nt, Chlamydophila pneumoniae CWL029
uguuuuucuuccacacaa

SEQ ID NO: 505653 - RNA, 19 nt, Chlamydophila pneumoniae CWL029
uuaaaaaauuaucuccaaa

SEQ ID NO: 505654 - RNA, 19 nt, Chlamydophila pneumoniae CWL029
uuaaaaauauaucuucaga

SEQ ID NO: 505655 - RNA, 14 nt, Chlamydophila pneumoniae CWL029
uuaaaacccauguu

SEQ ID NO: 505656 - RNA, 19 nt, Chlamydophila pneumoniae CWL029
uuaaaacccauguuucuuc

SEQ ID NO: 505657 - RNA, 22 nt, Chlamydophila pneumoniae CWL029
uuaaaagcauaguguauaucag

SEQ ID NO: 505658 - RNA, 18 nt, Chlamydophila pneumoniae CWL029
uuaaaaguuccaaaucuc

SEQ ID NO: 505659 - RNA, 18 nt, Chlamydophila pneumoniae CWL029
uuaaaauuucugggcuaa

SEQ ID NO: 505660 - RNA, 17 nt, Chlamydophila pneumoniae CWL029
uuaaagauuuucauaac

SEQ ID NO: 505661 - RNA, 23 nt, Chlamydophila pneumoniae CWL029
uuaaacuuucuucucuaggaaga

SEQ ID NO: 505662 - RNA, 24 nt, Chlamydophila pneumoniae CWL029
uuaaagagcauccuguagccacua

SEQ ID NO: 505663 - RNA, 16 nt, Chlamydophila pneumoniae CWL029
uuaaacuuacagccac

SEQ ID NO: 505664 - RNA, 23 nt, Chlamydophila pneumoniae CWL029
uuaaacuuacagccaccuuggcu

SEQ ID NO: 505665 - RNA, 15 nt, Chlamydophila pneumoniae CWL029
uuaaacuaagaauac

SEQ ID NO: 505666 - RNA, 21 nt, Chlamydophila pneumoniae CWL029
uuaaacucugacgucuccaac

SEQ ID NO: 505667 - RNA, 22 nt, Chlamydophila pneumoniae CWL029
uuaaacucugacgucuccaaca

SEQ ID NO: 505668 - RNA, 13 nt, Chlamydophila pneumoniae CWL029
uguugauuuccaa

SEQ ID NO: 505669 - RNA, 17 nt, Chlamydophila pneumoniae CWL029
uguuguauggcagccug

SEQ ID NO: 505670 - RNA, 13 nt, Chlamydophila pneumoniae CWL029
uguuguuuuugcu

SEQ ID NO: 505671 - RNA, 22 nt, Chlamydophila pneumoniae CWL029
uguuguaacgggagcguuuuuu

SEQ ID NO: 505672 - RNA, 16 nt, Chlamydophila pneumoniae CWL029
uguuguaauaaaauca

SEQ ID NO: 505673 - RNA, 13 nt, Chlamydophila pneumoniae CWL029
uguuccacuugcu

SEQ ID NO: 505674 - RNA, 16 nt, Chlamydophila pneumoniae CWL029
uguuccauaauuuuag

SEQ ID NO: 505675 - RNA, 23 nt, Chlamydophila pneumoniae CWL029
uguuccauaauuuuagcuucuuu

SEQ ID NO: 505676 - RNA, 20 nt, Chlamydophila pneumoniae CWL029
uguuccuuuuuuuuuucuuc

SEQ ID NO: 505677 - RNA, 14 nt, Chlamydophila pneumoniae CWL029
uguuauuguuucua

SEQ ID NO: 505678 - RNA, 22 nt, Chlamydophila pneumoniae CWL029
uguuaauaagcauauuuaaaua

SEQ ID NO: 505679 - RNA, 19 nt, Chlamydophila pneumoniae CWL029
uguuaacaagauucucagc

SEQ ID NO: 505680 - RNA, 23 nt, Chlamydophila pneumoniae CWL029
uguguuuuauccaccaagacuga

SEQ ID NO: 505681 - RNA, 18 nt, Chlamydophila pneumoniae CWL029
uguguaugaaucacaucu

SEQ ID NO: 505682 - RNA, 18 nt, Chlamydophila pneumoniae CWL029
ugugugacgacaaaucac

SEQ ID NO: 505683 - RNA, 21 nt, Chlamydophila pneumoniae CWL029
ugugugacgacaaaucacgac

SEQ ID NO: 505684 - RNA, 21 nt, Chlamydophila pneumoniae CWL029
uguggguaaugccaauauggu

SEQ ID NO: 505685 - RNA, 22 nt, Chlamydophila pneumoniae CWL029
ugugguaaaaauauaggcugca

SEQ ID NO: 505686 - RNA, 21 nt, Chlamydophila pneumoniae CWL029
ugugcucgacguauuugccaa

SEQ ID NO: 505687 - RNA, 17 nt, Chlamydophila pneumoniae CWL029
ugugcucaauacagaua

SEQ ID NO: 505688 - RNA, 17 nt, Chlamydophila pneumoniae CWL029
ugugcggcgagcucuag

SEQ ID NO: 505689 - RNA, 15 nt, Chlamydophila pneumoniae CWL029
ugugcaauaggaaaa

SEQ ID NO: 505690 - RNA, 20 nt, Chlamydophila pneumoniae CWL029
ugugcagaagguuccacaga

SEQ ID NO: 505691 - RNA, 20 nt, Chlamydophila pneumoniae CWL029
ugugcaucuauaauuaaucc

SEQ ID NO: 505692 - RNA, 22 nt, Chlamydophila pneumoniae CWL029
ugugcgcacaagggauucuugu

SEQ ID NO: 505693 - RNA, 15 nt, Chlamydophila pneumoniae CWL029
ugugacgacaaauca

SEQ ID NO: 505694 - RNA, 12 nt, Chlamydophila pneumoniae CWL029
ugucagaacaag

SEQ ID NO: 505695 - RNA, 19 nt, Chlamydophila pneumoniae CWL029
ugucacuaucuucuaaaac

SEQ ID NO: 505696 - RNA, 14 nt, Chlamydophila pneumoniae CWL029
ugucacggaagaac

SEQ ID NO: 505697 - RNA, 14 nt, Chlamydophila pneumoniae CWL029
uuaaucaagccuaa

SEQ ID NO: 505698 - RNA, 12 nt, Chlamydophila pneumoniae CWL029
uuaaucaauccu

SEQ ID NO: 505699 - RNA, 16 nt, Chlamydophila pneumoniae CWL029
uuaauauuugagaaga

SEQ ID NO: 505700 - RNA, 18 nt, Chlamydophila pneumoniae CWL029
uuaauacaaaaaauaaaa

SEQ ID NO: 505701 - RNA, 16 nt, Chlamydophila pneumoniae CWL029
uuaauauaaaagaaga

SEQ ID NO: 505702 - RNA, 14 nt, Chlamydophila pneumoniae CWL029
uuaagucacacuuu

SEQ ID NO: 505703 - RNA, 13 nt, Chlamydophila pneumoniae CWL029
uuaagguugcuuu

SEQ ID NO: 505704 - RNA, 17 nt, Chlamydophila pneumoniae CWL029
uuaagacaauauaagca

SEQ ID NO: 505705 - RNA, 21 nt, Chlamydophila pneumoniae CWL029
uuaagaagcacuucuuuagga

SEQ ID NO: 505706 - RNA, 14 nt, Chlamydophila pneumoniae CWL029
uuacacaacucuuu

SEQ ID NO: 505707 - RNA, 15 nt, Chlamydophila pneumoniae CWL029
uuacaggaaacucua

SEQ ID NO: 505708 - RNA, 16 nt, Chlamydophila pneumoniae CWL029
uuacaggaaacucuau

SEQ ID NO: 505709 - RNA, 19 nt, Chlamydophila pneumoniae CWL029
uuacaauuuaaaucugcaa

SEQ ID NO: 505710 - RNA, 17 nt, Chlamydophila pneumoniae CWL029
uuacauaacacuuuguu

SEQ ID NO: 505711 - RNA, 10 nt, Chlamydophila pneumoniae CWL029
uuaauucucu

SEQ ID NO: 505712 - RNA, 22 nt, Chlamydophila pneumoniae CWL029
uuaauccuugagggcuauccac

SEQ ID NO: 505713 - RNA, 16 nt, Chlamydophila pneumoniae CWL029
uuaauccuuucacaaa

SEQ ID NO: 505714 - RNA, 18 nt, Chlamydophila pneumoniae CWL029
uuaauuuuugcuaaacaa

SEQ ID NO: 505715 - RNA, 22 nt, Chlamydophila pneumoniae CWL029
uuaauuuuugcuaaacaaugca

SEQ ID NO: 505716 - RNA, 22 nt, Chlamydophila pneumoniae CWL029
uuaggaucccugauuccuuggc

SEQ ID NO: 505717 - RNA, 15 nt, Chlamydophila pneumoniae CWL029
uuagcauuaggaaag

SEQ ID NO: 505718 - RNA, 14 nt, Chlamydophila pneumoniae CWL029
uuagcaucaucucc

SEQ ID NO: 505719 - RNA, 18 nt, Chlamydophila pneumoniae CWL029
uuagccuggcuaaaggau

SEQ ID NO: 505720 - RNA, 23 nt, Chlamydophila pneumoniae CWL029
uuagcauagagcucuaaaaaaga

SEQ ID NO: 505721 - RNA, 18 nt, Chlamydophila pneumoniae CWL029
uuagacgaggagaagucg

SEQ ID NO: 505722 - RNA, 23 nt, Chlamydophila pneumoniae CWL029
uuagaacuucaaugaaagcugua

SEQ ID NO: 505723 - RNA, 21 nt, Chlamydophila pneumoniae CWL029
uuagacaagacaccgaaagaa

SEQ ID NO: 505724 - RNA, 21 nt, Chlamydophila pneumoniae CWL029
uuacgaacaagacgaaagcac

SEQ ID NO: 505725 - RNA, 16 nt, Chlamydophila pneumoniae CWL029
uuacuucaagaaaaac

SEQ ID NO: 505726 - RNA, 19 nt, Chlamydophila pneumoniae CWL029
uuacgaaaacaucuguaua

SEQ ID NO: 505727 - RNA, 22 nt, Chlamydophila pneumoniae CWL029
uuacuugcgauacaauaaacaa

SEQ ID NO: 505728 - RNA, 12 nt, Chlamydophila pneumoniae CWL029
uuagaaagcgca

SEQ ID NO: 505729 - RNA, 16 nt, Chlamydophila pneumoniae CWL029
uuacuucacguugcaa

SEQ ID NO: 505730 - RNA, 23 nt, Chlamydophila pneumoniae CWL029
uuauacccacaaagaucacugag

SEQ ID NO: 505731 - RNA, 18 nt, Chlamydophila pneumoniae CWL029
uuauaacaucaagaauuu

SEQ ID NO: 505732 - RNA, 13 nt, Chlamydophila pneumoniae CWL029
uuagugcuucaga

SEQ ID NO: 505733 - RNA, 19 nt, Chlamydophila pneumoniae CWL029
uuaguuuaccugaaaaaac

SEQ ID NO: 505734 - RNA, 19 nt, Chlamydophila pneumoniae CWL029
uuaguuuuucuagcuuccu

SEQ ID NO: 505735 - RNA, 14 nt, Chlamydophila pneumoniae CWL029
uuaguuuuuucuaa

SEQ ID NO: 505736 - RNA, 18 nt, Chlamydophila pneumoniae CWL029
uuaguagcuauucucaaa

SEQ ID NO: 505737 - RNA, 13 nt, Chlamydophila pneumoniae CWL029
uuaguagcuauuc

SEQ ID NO: 505738 - RNA, 19 nt, Chlamydophila pneumoniae CWL029
uuaguauacuaagacuguc

SEQ ID NO: 505739 - RNA, 19 nt, Chlamydophila pneumoniae CWL029
uuagggaagacgauaccgc

SEQ ID NO: 505740 - RNA, 14 nt, Chlamydophila pneumoniae CWL029
uuaggugaaauauu

SEQ ID NO: 505741 - RNA, 16 nt, Chlamydophila pneumoniae CWL029
uggaccagaugcuaaa

SEQ ID NO: 505742 - RNA, 15 nt, Chlamydophila pneumoniae CWL029
uggacaauauagaga

SEQ ID NO: 505743 - RNA, 19 nt, Chlamydophila pneumoniae CWL029
uggaauauagguuuagauu

SEQ ID NO: 505744 - RNA, 15 nt, Chlamydophila pneumoniae CWL029
uggaaucuaugaaua

SEQ ID NO: 505745 - RNA, 13 nt, Chlamydophila pneumoniae CWL029
uggaauugcauua

SEQ ID NO: 505746 - RNA, 16 nt, Chlamydophila pneumoniae CWL029
uggaauucaaacuccu

SEQ ID NO: 505747 - RNA, 18 nt, Chlamydophila pneumoniae CWL029
uggaauucaaacuccuuu

SEQ ID NO: 505748 - RNA, 23 nt, Chlamydophila pneumoniae CWL029
uggaauucaaacuccuuuuaaaa

SEQ ID NO: 505749 - RNA, 13 nt, Chlamydophila pneumoniae CWL029
uggaauuuuccug

SEQ ID NO: 505750 - RNA, 15 nt, Chlamydophila pneumoniae CWL029
uggaagagagcaaga

SEQ ID NO: 505751 - RNA, 17 nt, Chlamydophila pneumoniae CWL029
uggaagaauuucauaag

SEQ ID NO: 505752 - RNA, 19 nt, Chlamydophila pneumoniae CWL029
uggaaagcuucuggauuca

SEQ ID NO: 505753 - RNA, 15 nt, Chlamydophila pneumoniae CWL029
uggaaauagagaaac

SEQ ID NO: 505754 - RNA, 21 nt, Chlamydophila pneumoniae CWL029
uggaaauccguaaagguugua

SEQ ID NO: 505755 - RNA, 15 nt, Chlamydophila pneumoniae CWL029
uggaaauugugaaaa

SEQ ID NO: 505756 - RNA, 18 nt, Chlamydophila pneumoniae CWL029
uggaaauugugaaaaaaa

SEQ ID NO: 505757 - RNA, 15 nt, Chlamydophila pneumoniae CWL029
ugcuuuuugaaugau

SEQ ID NO: 505758 - RNA, 13 nt, Chlamydophila pneumoniae CWL029
ugcuuuucucuuc

SEQ ID NO: 505759 - RNA, 22 nt, Chlamydophila pneumoniae CWL029
ugcuuucuguacaacaaaauuu

SEQ ID NO: 505760 - RNA, 23 nt, Chlamydophila pneumoniae CWL029
ugcuuucaggaguucuugauucu

SEQ ID NO: 505761 - RNA, 17 nt, Chlamydophila pneumoniae CWL029
ugcuuguauaaaugcug

SEQ ID NO: 505762 - RNA, 20 nt, Chlamydophila pneumoniae CWL029
ugcuuguugguuaaaauaga

SEQ ID NO: 505763 - RNA, 17 nt, Chlamydophila pneumoniae CWL029
ugcuuggcaauagcuuu

SEQ ID NO: 505764 - RNA, 17 nt, Chlamydophila pneumoniae CWL029
ugcuucuuggcguucca

SEQ ID NO: 505765 - RNA, 14 nt, Chlamydophila pneumoniae CWL029
ugcuucuucagagu

SEQ ID NO: 505766 - RNA, 17 nt, Chlamydophila pneumoniae CWL029
ugcuucgggaacgugcu

SEQ ID NO: 505767 - RNA, 23 nt, Chlamydophila pneumoniae CWL029
ugcuucuccaaauaaagcaacug

SEQ ID NO: 505768 - RNA, 21 nt, Chlamydophila pneumoniae CWL029
ugcuuccaacggacauuuuca

SEQ ID NO: 505769 - RNA, 11 nt, Chlamydophila pneumoniae CWL029
ugcuuaaggaa

SEQ ID NO: 505770 - RNA, 13 nt, Chlamydophila pneumoniae CWL029
ugcugaauuccuc

SEQ ID NO: 505771 - RNA, 16 nt, Chlamydophila pneumoniae CWL029
ugcugacaucuccaag

SEQ ID NO: 505772 - RNA, 21 nt, Chlamydophila pneumoniae CWL029
ugcugacagcuccauuuaaau

SEQ ID NO: 505773 - RNA, 17 nt, Chlamydophila pneumoniae CWL029
ugcugcuaaacagggaa

SEQ ID NO: 505774 - RNA, 23 nt, Chlamydophila pneumoniae CWL029
ugcuggaguagcucaauuggcag

SEQ ID NO: 505775 - RNA, 15 nt, Chlamydophila pneumoniae CWL029
ugcugucagaacaag

SEQ ID NO: 505776 - RNA, 15 nt, Chlamydophila pneumoniae CWL029
ugcucggacagaaag

SEQ ID NO: 505777 - RNA, 16 nt, Chlamydophila pneumoniae CWL029
ugcucuagucuuucaa

SEQ ID NO: 505778 - RNA, 16 nt, Chlamydophila pneumoniae CWL029
ugcucuaccaacugag

SEQ ID NO: 505779 - RNA, 17 nt, Chlamydophila pneumoniae CWL029
ugcucuaccaacugagc

SEQ ID NO: 505780 - RNA, 19 nt, Chlamydophila pneumoniae CWL029
ugcucuccugcaaaaaguu

SEQ ID NO: 505781 - RNA, 17 nt, Chlamydophila pneumoniae CWL029
ugcucucuacuucugua

SEQ ID NO: 505782 - RNA, 15 nt, Chlamydophila pneumoniae CWL029
ugcucucuucuucuc

SEQ ID NO: 505783 - RNA, 15 nt, Chlamydophila pneumoniae CWL029
ugcucacuucuuugc

SEQ ID NO: 505784 - RNA, 18 nt, Chlamydophila pneumoniae CWL029
ugcucaggagauacaagc

SEQ ID NO: 505785 - RNA, 18 nt, Chlamydophila pneumoniae CWL029
ugcuccagaaacgcagcu

SEQ ID NO: 505786 - RNA, 15 nt, Chlamydophila pneumoniae CWL029
ugcuacaaacucuuc

SEQ ID NO: 505787 - RNA, 13 nt, Chlamydophila pneumoniae CWL029
ugcuacagcuucu

SEQ ID NO: 505788 - RNA, 17 nt, Chlamydophila pneumoniae CWL029
ugcuacagcuucuuuuc

SEQ ID NO: 505789 - RNA, 21 nt, Chlamydophila pneumoniae CWL029
ugcuacagcuucuuuuccagc

SEQ ID NO: 505790 - RNA, 17 nt, Chlamydophila pneumoniae CWL029
ugcuaagccaaauacca

SEQ ID NO: 505791 - RNA, 15 nt, Chlamydophila pneumoniae CWL029
ugcuaauaccucaaa

SEQ ID NO: 505792 - RNA, 17 nt, Chlamydophila pneumoniae CWL029
ugcuaagagcucuuucc

SEQ ID NO: 505793 - RNA, 17 nt, Chlamydophila pneumoniae CWL029
ugcuaagaucuuuagaa

SEQ ID NO: 505794 - RNA, 13 nt, Chlamydophila pneumoniae CWL029
ugcuaaauuuguc

SEQ ID NO: 505795 - RNA, 20 nt, Chlamydophila pneumoniae CWL029
ugcuaaacaaugcaaaauaa

SEQ ID NO: 505796 - RNA, 19 nt, Chlamydophila pneumoniae CWL029
ugcuaaagagucuuccuag

SEQ ID NO: 505797 - RNA, 21 nt, Chlamydophila pneumoniae CWL029
ugcuagaucuggagagggaag

SEQ ID NO: 505798 - RNA, 13 nt, Chlamydophila pneumoniae CWL029
ugcuauuuuucca

SEQ ID NO: 505799 - RNA, 13 nt, Chlamydophila pneumoniae CWL029
ugcuauuuuaaac

SEQ ID NO: 505800 - RNA, 15 nt, Chlamydophila pneumoniae CWL029
ugcuauuuuccucua

SEQ ID NO: 505801 - RNA, 18 nt, Chlamydophila pneumoniae CWL029
ugcggcuccuacaguccu

SEQ ID NO: 505802 - RNA, 21 nt, Chlamydophila pneumoniae CWL029
ugcggcaaguaucucaucacg

SEQ ID NO: 505803 - RNA, 15 nt, Chlamydophila pneumoniae CWL029
ugcggauuugcauua

SEQ ID NO: 505804 - RNA, 18 nt, Chlamydophila pneumoniae CWL029
ugcgcagcuucuggagaa

SEQ ID NO: 505805 - RNA, 23 nt, Chlamydophila pneumoniae CWL029
ugcgauuuccccuucagaggcua

SEQ ID NO: 505806 - RNA, 22 nt, Chlamydophila pneumoniae CWL029
ugcgcaaagaacucaacuuuuu

SEQ ID NO: 505807 - RNA, 19 nt, Chlamydophila pneumoniae CWL029
ugcgauaucuauaaaugua

SEQ ID NO: 505808 - RNA, 22 nt, Chlamydophila pneumoniae CWL029
ugcgagguaugaauaggaauga

SEQ ID NO: 505809 - RNA, 22 nt, Chlamydophila pneumoniae CWL029
ugcgaggaaaaaggaggauguu

SEQ ID NO: 505810 - RNA, 17 nt, Chlamydophila pneumoniae CWL029
ugcgacugcucuuucau

SEQ ID NO: 505811 - RNA, 21 nt, Chlamydophila pneumoniae CWL029
ugccuuuuucuugauuagaga

SEQ ID NO: 505812 - RNA, 18 nt, Chlamydophila pneumoniae CWL029
ugcgaacaguuccuauuu

SEQ ID NO: 505813 - RNA, 22 nt, Chlamydophila pneumoniae CWL029
ugccuugauccuuuccaagaag

SEQ ID NO: 505814 - RNA, 14 nt, Chlamydophila pneumoniae CWL029
ugccuuuagggaaa

SEQ ID NO: 505815 - RNA, 12 nt, Chlamydophila pneumoniae CWL029
ugccuuucucuu

SEQ ID NO: 505816 - RNA, 14 nt, Chlamydophila pneumoniae CWL029
ugccuguuuuauug

SEQ ID NO: 505817 - RNA, 18 nt, Chlamydophila pneumoniae CWL029
ugccugccaauccaaugg

SEQ ID NO: 505818 - RNA, 13 nt, Chlamydophila pneumoniae CWL029
ugccuuaggcuuu

SEQ ID NO: 505819 - RNA, 20 nt, Chlamydophila pneumoniae CWL029
ugccucauugccguggugag

SEQ ID NO: 505820 - RNA, 16 nt, Chlamydophila pneumoniae CWL029
ugccugaaauccuggg

SEQ ID NO: 505821 - RNA, 17 nt, Chlamydophila pneumoniae CWL029
ugccugaagauggcaag

SEQ ID NO: 505822 - RNA, 21 nt, Chlamydophila pneumoniae CWL029
ugcccuucguaacgcuuuucu

SEQ ID NO: 505823 - RNA, 15 nt, Chlamydophila pneumoniae CWL029
ugcccuguucuaugc

SEQ ID NO: 505824 - RNA, 22 nt, Chlamydophila pneumoniae CWL029
ugcccugucacuaucuucuaaa

SEQ ID NO: 505825 - RNA, 16 nt, Chlamydophila pneumoniae CWL029
ugcccacuucuaccaa

SEQ ID NO: 505826 - RNA, 17 nt, Chlamydophila pneumoniae CWL029
ugcccauuuuuggaaaa

SEQ ID NO: 505827 - RNA, 13 nt, Chlamydophila pneumoniae CWL029
ugcccaaggaaaa

SEQ ID NO: 505828 - RNA, 16 nt, Chlamydophila pneumoniae CWL029
ugcccaaggaaaaaca

SEQ ID NO: 505829 - RNA, 18 nt, Chlamydophila pneumoniae CWL029
ugccagugacauaaucac

SEQ ID NO: 505830 - RNA, 13 nt, Chlamydophila pneumoniae CWL029
ugccagcagaagu

SEQ ID NO: 505831 - RNA, 13 nt, Chlamydophila pneumoniae CWL029
ugccagcuugccc

SEQ ID NO: 505832 - RNA, 13 nt, Chlamydophila pneumoniae CWL029
ugccaagagcauc

SEQ ID NO: 505833 - RNA, 22 nt, Chlamydophila pneumoniae CWL029
ugcagucguauucagguucuga

SEQ ID NO: 505834 - RNA, 21 nt, Chlamydophila pneumoniae CWL029
ugcaggacugucuagcaguug

SEQ ID NO: 505835 - RNA, 16 nt, Chlamydophila pneumoniae CWL029
ugcaggagaacaauau

SEQ ID NO: 505836 - RNA, 16 nt, Chlamydophila pneumoniae CWL029
ugcaggccaggagacu

SEQ ID NO: 505837 - RNA, 19 nt, Chlamydophila pneumoniae CWL029
ugcagcuaacgaagccuca

SEQ ID NO: 505838 - RNA, 14 nt, Chlamydophila pneumoniae CWL029
ugcagcgcagcacc

SEQ ID NO: 505839 - RNA, 19 nt, Chlamydophila pneumoniae CWL029
ugcagcgaucaaaggcugc

SEQ ID NO: 505840 - RNA, 16 nt, Chlamydophila pneumoniae CWL029
ugcagcagccuuggcu

SEQ ID NO: 505841 - RNA, 22 nt, Chlamydophila pneumoniae CWL029
ugcagcagccuuggcucuagaa

SEQ ID NO: 505842 - RNA, 16 nt, Chlamydophila pneumoniae CWL029
ugcagcagaugaaacu

SEQ ID NO: 505843 - RNA, 18 nt, Chlamydophila pneumoniae CWL029
ugcagacggggaucuaaa

SEQ ID NO: 505844 - RNA, 15 nt, Chlamydophila pneumoniae CWL029
ugcagaaucuaugag

SEQ ID NO: 505845 - RNA, 13 nt, Chlamydophila pneumoniae CWL029
ugcagauacuaaa

SEQ ID NO: 505846 - RNA, 20 nt, Chlamydophila pneumoniae CWL029
ugcagauagcuuacagagaa

SEQ ID NO: 505847 - RNA, 13 nt, Chlamydophila pneumoniae CWL029
ugcagaucauauc

SEQ ID NO: 505848 - RNA, 15 nt, Chlamydophila pneumoniae CWL029
ugcacuuugaauaau

SEQ ID NO: 505849 - RNA, 22 nt, Chlamydophila pneumoniae CWL029
ugcacgaucgcgauaagaagcu

SEQ ID NO: 505850 - RNA, 14 nt, Chlamydophila pneumoniae CWL029
ugcacgagagccuc

SEQ ID NO: 505851 - RNA, 16 nt, Chlamydophila pneumoniae CWL029
ugcacaaucgcaucaa

SEQ ID NO: 505852 - RNA, 21 nt, Chlamydophila pneumoniae CWL029
ugcacaaucgcaucaaaaaau

SEQ ID NO: 505853 - RNA, 17 nt, Chlamydophila pneumoniae CWL029
ugcaaugguugucuuua

SEQ ID NO: 505854 - RNA, 17 nt, Chlamydophila pneumoniae CWL029
ugcaagugcuuucagga

SEQ ID NO: 505855 - RNA, 22 nt, Chlamydophila pneumoniae CWL029
ugcaagguucugcgaaacaacu

SEQ ID NO: 505856 - RNA, 16 nt, Chlamydophila pneumoniae CWL029
ugcaaguucacacgua

SEQ ID NO: 505857 - RNA, 11 nt, Chlamydophila pneumoniae CWL029
ugcaaaguacu

SEQ ID NO: 505858 - RNA, 17 nt, Chlamydophila pneumoniae CWL029
ugcaaaguacuacaaua

SEQ ID NO: 505859 - RNA, 19 nt, Chlamydophila pneumoniae CWL029
ugcaaagcccccuccccca

SEQ ID NO: 505860 - RNA, 12 nt, Chlamydophila pneumoniae CWL029
ugcaaagagaau

SEQ ID NO: 505861 - RNA, 13 nt, Chlamydophila pneumoniae CWL029
ugcaaggagcuuu

SEQ ID NO: 505862 - RNA, 19 nt, Chlamydophila pneumoniae CWL029
ugcaaggccuaaucuugua

SEQ ID NO: 505863 - RNA, 19 nt, Chlamydophila pneumoniae CWL029
ugcaagcauuguuuguccu

SEQ ID NO: 505864 - RNA, 22 nt, Chlamydophila pneumoniae CWL029
ugcaagcagauagagcuucuuu

SEQ ID NO: 505865 - RNA, 15 nt, Chlamydophila pneumoniae CWL029
ugauguguugauuuc

SEQ ID NO: 505866 - RNA, 15 nt, Chlamydophila pneumoniae CWL029
ugauggggauuaucc

SEQ ID NO: 505867 - RNA, 21 nt, Chlamydophila pneumoniae CWL029
ugauuccuuggcguacucuau

SEQ ID NO: 505868 - RNA, 19 nt, Chlamydophila pneumoniae CWL029
ugauuucgacgcauaguau

SEQ ID NO: 505869 - RNA, 17 nt, Chlamydophila pneumoniae CWL029
ugauuucgugaacaaaa

SEQ ID NO: 505870 - RNA, 15 nt, Chlamydophila pneumoniae CWL029
ugauuucuuuauucc

SEQ ID NO: 505871 - RNA, 23 nt, Chlamydophila pneumoniae CWL029
ugauuuggccaacaguguagccu

SEQ ID NO: 505872 - RNA, 13 nt, Chlamydophila pneumoniae CWL029
ugauuugggauga

SEQ ID NO: 505873 - RNA, 19 nt, Chlamydophila pneumoniae CWL029
ugauuuuuugaauccuguu

SEQ ID NO: 505874 - RNA, 22 nt, Chlamydophila pneumoniae CWL029
ugauuuuuuaugacaaacucua

SEQ ID NO: 505875 - RNA, 19 nt, Chlamydophila pneumoniae CWL029
ugauuuuugcuaagagcuc

SEQ ID NO: 505876 - RNA, 14 nt, Chlamydophila pneumoniae CWL029
ugauuuuaaaauga

SEQ ID NO: 505877 - RNA, 15 nt, Chlamydophila pneumoniae CWL029
ugcaaacgcaaugau

SEQ ID NO: 505878 - RNA, 15 nt, Chlamydophila pneumoniae CWL029
ugcaaaccaaaaaag

SEQ ID NO: 505879 - RNA, 21 nt, Chlamydophila pneumoniae CWL029
ugaugcaaugguugucuuuac

SEQ ID NO: 505880 - RNA, 12 nt, Chlamydophila pneumoniae CWL029
ugaugagaaaaa

SEQ ID NO: 505881 - RNA, 15 nt, Chlamydophila pneumoniae CWL029
ugaugcuucuuucaa

SEQ ID NO: 505882 - RNA, 16 nt, Chlamydophila pneumoniae CWL029
ugaugcuucuuucaaa

SEQ ID NO: 505883 - RNA, 14 nt, Chlamydophila pneumoniae CWL029
ugauccuucuuaug

SEQ ID NO: 505884 - RNA, 18 nt, Chlamydophila pneumoniae CWL029
ugaugaccucuauaccua

SEQ ID NO: 505885 - RNA, 17 nt, Chlamydophila pneumoniae CWL029
ugauauuugucuaguga

SEQ ID NO: 505886 - RNA, 22 nt, Chlamydophila pneumoniae CWL029
ugaucagaaaugaagccaaaag

SEQ ID NO: 505887 - RNA, 12 nt, Chlamydophila pneumoniae CWL029
ugaucagaaucu

SEQ ID NO: 505888 - RNA, 13 nt, Chlamydophila pneumoniae CWL029
ugaucagaaucua

SEQ ID NO: 505889 - RNA, 17 nt, Chlamydophila pneumoniae CWL029
ugauccagcccccaggc

SEQ ID NO: 505890 - RNA, 13 nt, Chlamydophila pneumoniae CWL029
ugauccagcucca

SEQ ID NO: 505891 - RNA, 18 nt, Chlamydophila pneumoniae CWL029
ugauccgaaaacucuuag

SEQ ID NO: 505892 - RNA, 19 nt, Chlamydophila pneumoniae CWL029
ugauccgaaaacucuuaga

SEQ ID NO: 505893 - RNA, 15 nt, Chlamydophila pneumoniae CWL029
ugauccgaaaacucu

SEQ ID NO: 505894 - RNA, 19 nt, Chlamydophila pneumoniae CWL029
ugauccucggcaucuuugg

SEQ ID NO: 505895 - RNA, 17 nt, Chlamydophila pneumoniae CWL029
ugagugucccauggcug

SEQ ID NO: 505896 - RNA, 17 nt, Chlamydophila pneumoniae CWL029
ugagguuugugcugcuu

SEQ ID NO: 505897 - RNA, 14 nt, Chlamydophila pneumoniae CWL029
ugaggcaagucuca

SEQ ID NO: 505898 - RNA, 16 nt, Chlamydophila pneumoniae CWL029
ugaggcacauguagga

SEQ ID NO: 505899 - RNA, 14 nt, Chlamydophila pneumoniae CWL029
ugaggcuauagaau

SEQ ID NO: 505900 - RNA, 17 nt, Chlamydophila pneumoniae CWL029
ugaggacacaacucuuu

SEQ ID NO: 505901 - RNA, 20 nt, Chlamydophila pneumoniae CWL029
ugaggacacaacucuuuaau

SEQ ID NO: 505902 - RNA, 16 nt, Chlamydophila pneumoniae CWL029
ugaggaccuuccuuau

SEQ ID NO: 505903 - RNA, 22 nt, Chlamydophila pneumoniae CWL029
ugagcuuugguuucguacaguu

SEQ ID NO: 505904 - RNA, 14 nt, Chlamydophila pneumoniae CWL029
ugaggaaaauuccc

SEQ ID NO: 505905 - RNA, 15 nt, Chlamydophila pneumoniae CWL029
ugaggaaaggagggc

SEQ ID NO: 505906 - RNA, 18 nt, Chlamydophila pneumoniae CWL029
ugaggauacgaauaaguu

SEQ ID NO: 505907 - RNA, 19 nt, Chlamydophila pneumoniae CWL029
ugaggauaaguucuuccaa

SEQ ID NO: 505908 - RNA, 16 nt, Chlamydophila pneumoniae CWL029
ugagcuugccuaccca

SEQ ID NO: 505909 - RNA, 20 nt, Chlamydophila pneumoniae CWL029
ugagcuucacaucuuucucu

SEQ ID NO: 505910 - RNA, 21 nt, Chlamydophila pneumoniae CWL029
ugagcugcugguccuaaaaaa

SEQ ID NO: 505911 - RNA, 18 nt, Chlamydophila pneumoniae CWL029
ugagcgucguguuuucac

SEQ ID NO: 505912 - RNA, 17 nt, Chlamydophila pneumoniae CWL029
ugagcuccaaaauaauc

SEQ ID NO: 505913 - RNA, 17 nt, Chlamydophila pneumoniae CWL029
ugagccccuugcaaaag

SEQ ID NO: 505914 - RNA, 15 nt, Chlamydophila pneumoniae CWL029
ugagcagcaaaaauu

SEQ ID NO: 505915 - RNA, 17 nt, Chlamydophila pneumoniae CWL029
ugagcagcuuuaucagg

SEQ ID NO: 505916 - RNA, 18 nt, Chlamydophila pneumoniae CWL029
ugagauacggaggauuau

SEQ ID NO: 505917 - RNA, 13 nt, Chlamydophila pneumoniae CWL029
ugagauagucuug

SEQ ID NO: 505918 - RNA, 14 nt, Chlamydophila pneumoniae CWL029
ugagaauaaaacuu

SEQ ID NO: 505919 - RNA, 16 nt, Chlamydophila pneumoniae CWL029
ugagaauaaaacuuuc

SEQ ID NO: 505920 - RNA, 21 nt, Chlamydophila pneumoniae CWL029
ugagaauaaaacuuucuuuuu

SEQ ID NO: 505921 - RNA, 20 nt, Chlamydophila pneumoniae CWL029
ugagaauacaacccuuuaua

SEQ ID NO: 505922 - RNA, 15 nt, Chlamydophila pneumoniae CWL029
ugagauggucgagaa

SEQ ID NO: 505923 - RNA, 13 nt, Chlamydophila pneumoniae CWL029
ugagaucugcaaa

SEQ ID NO: 505924 - RNA, 22 nt, Chlamydophila pneumoniae CWL029
ugagauccaaagccugaaaaau

SEQ ID NO: 505925 - RNA, 14 nt, Chlamydophila pneumoniae CWL029
ugacuuguuucucc

SEQ ID NO: 505926 - RNA, 18 nt, Chlamydophila pneumoniae CWL029
ugacuuuagaaauuccaa

SEQ ID NO: 505927 - RNA, 19 nt, Chlamydophila pneumoniae CWL029
ugacuuuggucuucuguaa

SEQ ID NO: 505928 - RNA, 12 nt, Chlamydophila pneumoniae CWL029
ugacuuuucuuc

SEQ ID NO: 505929 - RNA, 15 nt, Chlamydophila pneumoniae CWL029
ugacuuuucuucuuc

SEQ ID NO: 505930 - RNA, 19 nt, Chlamydophila pneumoniae CWL029
ugagaaaaagaaucucuga

SEQ ID NO: 505931 - RNA, 23 nt, Chlamydophila pneumoniae CWL029
ugacuuuuucaagguucucuaug

SEQ ID NO: 505932 - RNA, 22 nt, Chlamydophila pneumoniae CWL029
ugagaaaaguugccuaaagaga

SEQ ID NO: 505933 - RNA, 15 nt, Chlamydophila pneumoniae CWL029
ugagaaaaucugcag

SEQ ID NO: 505934 - RNA, 17 nt, Chlamydophila pneumoniae CWL029
ugagaaaaucugcagca

SEQ ID NO: 505935 - RNA, 18 nt, Chlamydophila pneumoniae CWL029
ugagaaccuucacaagaa

SEQ ID NO: 505936 - RNA, 18 nt, Chlamydophila pneumoniae CWL029
ugacgcuuuuccaaagca

SEQ ID NO: 505937 - RNA, 17 nt, Chlamydophila pneumoniae CWL029
ugacuccagaaggugug

SEQ ID NO: 505938 - RNA, 15 nt, Chlamydophila pneumoniae CWL029
ugacggcaggacucu

SEQ ID NO: 505939 - RNA, 17 nt, Chlamydophila pneumoniae CWL029
ugacucuaauucagaaa

SEQ ID NO: 505940 - RNA, 14 nt, Chlamydophila pneumoniae CWL029
ugacucuagaguac

SEQ ID NO: 505941 - RNA, 13 nt, Chlamydophila pneumoniae CWL029
ugacugcagagaa

SEQ ID NO: 505942 - RNA, 19 nt, Chlamydophila pneumoniae CWL029
ugacugcagauugcacuug

SEQ ID NO: 505943 - RNA, 23 nt, Chlamydophila pneumoniae CWL029
ugacuggcgacuugccaaucuuc

SEQ ID NO: 505944 - RNA, 21 nt, Chlamydophila pneumoniae CWL029
ugaccaucaaugagaucugca

SEQ ID NO: 505945 - RNA, 23 nt, Chlamydophila pneumoniae CWL029
ugaccaucaaugagaucugcaaa

SEQ ID NO: 505946 - RNA, 18 nt, Chlamydophila pneumoniae CWL029
ugacauaagcacucuuaa

SEQ ID NO: 505947 - RNA, 20 nt, Chlamydophila pneumoniae CWL029
ugaccaucaaugagaucugc

SEQ ID NO: 505948 - RNA, 13 nt, Chlamydophila pneumoniae CWL029
ugaccaguggcag

SEQ ID NO: 505949 - RNA, 21 nt, Chlamydophila pneumoniae CWL029
ugacagcuccauuuaaaugga

SEQ ID NO: 505950 - RNA, 15 nt, Chlamydophila pneumoniae CWL029
ugacagcugagaaau

SEQ ID NO: 505951 - RNA, 22 nt, Chlamydophila pneumoniae CWL029
ugacagggaaagaacagcagaa

SEQ ID NO: 505952 - RNA, 18 nt, Chlamydophila pneumoniae CWL029
ugacagaccuugcauuag

SEQ ID NO: 505953 - RNA, 23 nt, Chlamydophila pneumoniae CWL029
ugacagaccuugcauuagauuca

SEQ ID NO: 505954 - RNA, 23 nt, Chlamydophila pneumoniae CWL029
ugacacucuaucauaucuucaaa

SEQ ID NO: 505955 - RNA, 14 nt, Chlamydophila pneumoniae CWL029
ugaauaccaaaauu

SEQ ID NO: 505956 - RNA, 22 nt, Chlamydophila pneumoniae CWL029
ucuuucaaccuccgcucuaagc

SEQ ID NO: 505957 - RNA, 15 nt, Chlamydophila pneumoniae CWL029
ucuuucaaggaacau

SEQ ID NO: 505958 - RNA, 12 nt, Chlamydophila pneumoniae CWL029
ucuuucaaaaga

SEQ ID NO: 505959 - RNA, 19 nt, Chlamydophila pneumoniae CWL029
ugaaugagcuucacaucuu

SEQ ID NO: 505960 - RNA, 15 nt, Chlamydophila pneumoniae CWL029
ugaaucucuucugua

SEQ ID NO: 505961 - RNA, 17 nt, Chlamydophila pneumoniae CWL029
ugaauaucaucacuaag

SEQ ID NO: 505962 - RNA, 12 nt, Chlamydophila pneumoniae CWL029
ugaauauguacu

SEQ ID NO: 505963 - RNA, 14 nt, Chlamydophila pneumoniae CWL029
ugaauuuaugggug

SEQ ID NO: 505964 - RNA, 22 nt, Chlamydophila pneumoniae CWL029
ugaauucucaaggaucuuauau

SEQ ID NO: 505965 - RNA, 19 nt, Chlamydophila pneumoniae CWL029
ugaaugcagcacggaacaa

SEQ ID NO: 505966 - RNA, 15 nt, Chlamydophila pneumoniae CWL029
ugaaugauuuccaua

SEQ ID NO: 505967 - RNA, 22 nt, Chlamydophila pneumoniae CWL029
ugacaaauaaguccuguuugaa

SEQ ID NO: 505968 - RNA, 16 nt, Chlamydophila pneumoniae CWL029
ugacaaauaaacugac

SEQ ID NO: 505969 - RNA, 16 nt, Chlamydophila pneumoniae CWL029
ugacaaauaaguccug

SEQ ID NO: 505970 - RNA, 15 nt, Chlamydophila pneumoniae CWL029
ugacaacagagacaa

SEQ ID NO: 505971 - RNA, 16 nt, Chlamydophila pneumoniae CWL029
ugacaauaacaugcgc

SEQ ID NO: 505972 - RNA, 17 nt, Chlamydophila pneumoniae CWL029
ugacaaguguguuucaa

SEQ ID NO: 505973 - RNA, 22 nt, Chlamydophila pneumoniae CWL029
gaauuuuuguuuuaacucuaga

SEQ ID NO: 505974 - RNA, 13 nt, Chlamydophila pneumoniae CWL029
gaauuuuucuagu

SEQ ID NO: 505975 - RNA, 22 nt, Chlamydophila pneumoniae CWL029
gaauuuucucauagcuuccugu

SEQ ID NO: 505976 - RNA, 14 nt, Chlamydophila pneumoniae CWL029
gaauuuuaucagaa

SEQ ID NO: 505977 - RNA, 19 nt, Chlamydophila pneumoniae CWL029
gacaaaaaaucugaucuuc

SEQ ID NO: 505978 - RNA, 17 nt, Chlamydophila pneumoniae CWL029
gacaaaggguuucuuuc

SEQ ID NO: 505979 - RNA, 16 nt, Chlamydophila pneumoniae CWL029
gacaacaccucccacc

SEQ ID NO: 505980 - RNA, 19 nt, Chlamydophila pneumoniae CWL029
gacaaggagucgugcagga

SEQ ID NO: 505981 - RNA, 21 nt, Chlamydophila pneumoniae CWL029
gacaaggagucgugcaggaga

SEQ ID NO: 505982 - RNA, 15 nt, Chlamydophila pneumoniae CWL029
gacaagacaaugacu

SEQ ID NO: 505983 - RNA, 20 nt, Chlamydophila pneumoniae CWL029
gacaagauggugagauuucu

SEQ ID NO: 505984 - RNA, 15 nt, Chlamydophila pneumoniae CWL029
gacaagcaaggaaaa

SEQ ID NO: 505985 - RNA, 17 nt, Chlamydophila pneumoniae CWL029
gacaagcaaggaaaaaa

SEQ ID NO: 505986 - RNA, 21 nt, Chlamydophila pneumoniae CWL029
gacaauaccagauaaagcaaa

SEQ ID NO: 505987 - RNA, 15 nt, Chlamydophila pneumoniae CWL029
gacaauaaaaaagag

SEQ ID NO: 505988 - RNA, 16 nt, Chlamydophila pneumoniae CWL029
gacaauaaaauagccc

SEQ ID NO: 505989 - RNA, 19 nt, Chlamydophila pneumoniae CWL029
gacaaucgcuguaaauuca

SEQ ID NO: 505990 - RNA, 23 nt, Chlamydophila pneumoniae CWL029
gacaaugcaaccuguaaagacca

SEQ ID NO: 505991 - RNA, 17 nt, Chlamydophila pneumoniae CWL029
gacaauggaaauagaga

SEQ ID NO: 505992 - RNA, 23 nt, Chlamydophila pneumoniae CWL029
gacacuugcuuaaggaaacagug

SEQ ID NO: 505993 - RNA, 19 nt, Chlamydophila pneumoniae CWL029
gacagacagucugugagaa

SEQ ID NO: 505994 - RNA, 21 nt, Chlamydophila pneumoniae CWL029
gacagcugagaaauuccuaaa

SEQ ID NO: 505995 - RNA, 14 nt, Chlamydophila pneumoniae CWL029
gacaggagcuacug

SEQ ID NO: 505996 - RNA, 17 nt, Chlamydophila pneumoniae CWL029
gacagcguauaggaaac

SEQ ID NO: 505997 - RNA, 18 nt, Chlamydophila pneumoniae CWL029
gacaccaacaacaauaau

SEQ ID NO: 505998 - RNA, 12 nt, Chlamydophila pneumoniae CWL029
gacacaacucuu

SEQ ID NO: 505999 - RNA, 22 nt, Chlamydophila pneumoniae CWL029
gacacacuuucuuuaaagaaua

SEQ ID NO: 506000 - RNA, 12 nt, Chlamydophila pneumoniae CWL029
gacacagagaac

SEQ ID NO: 506001 - RNA, 19 nt, Chlamydophila pneumoniae CWL029
gacacagcuaaucaaucca

SEQ ID NO: 506002 - RNA, 19 nt, Chlamydophila pneumoniae CWL029
gacacuauguguuuccuuu

SEQ ID NO: 506003 - RNA, 20 nt, Chlamydophila pneumoniae CWL029
gacacgccuccuucaaagau

SEQ ID NO: 506004 - RNA, 19 nt, Chlamydophila pneumoniae CWL029
gacacgaauuccaagaucu

SEQ ID NO: 506005 - RNA, 23 nt, Chlamydophila pneumoniae CWL029
gaccagaugauuuuuugaauccu

SEQ ID NO: 506006 - RNA, 17 nt, Chlamydophila pneumoniae CWL029
gaccaguggcaggaaug

SEQ ID NO: 506007 - RNA, 23 nt, Chlamydophila pneumoniae CWL029
gaccaaaaauaaacauauucucc

SEQ ID NO: 506008 - RNA, 13 nt, Chlamydophila pneumoniae CWL029
gaccaaauagaga

SEQ ID NO: 506009 - RNA, 14 nt, Chlamydophila pneumoniae CWL029
gacauuccuuaauu

SEQ ID NO: 506010 - RNA, 20 nt, Chlamydophila pneumoniae CWL029
gacauugaauccagcaccuu

SEQ ID NO: 506011 - RNA, 19 nt, Chlamydophila pneumoniae CWL029
gacauuuccccaugaaaau

SEQ ID NO: 506012 - RNA, 23 nt, Chlamydophila pneumoniae CWL029
gacaugccuugguacuuaagcac

SEQ ID NO: 506013 - RNA, 18 nt, Chlamydophila pneumoniae CWL029
gacauacucgucaaauuc

SEQ ID NO: 506014 - RNA, 22 nt, Chlamydophila pneumoniae CWL029
gacauacucgucaaauucauua

SEQ ID NO: 506015 - RNA, 18 nt, Chlamydophila pneumoniae CWL029
gacauacaucaaaaugcu

SEQ ID NO: 506016 - RNA, 13 nt, Chlamydophila pneumoniae CWL029
gacagggaaagaa

SEQ ID NO: 506017 - RNA, 14 nt, Chlamydophila pneumoniae CWL029
gacagucugugaga

SEQ ID NO: 506018 - RNA, 12 nt, Chlamydophila pneumoniae CWL029
gacggauaaaug

SEQ ID NO: 506019 - RNA, 20 nt, Chlamydophila pneumoniae CWL029
gacgcucuaaacucucuucc

SEQ ID NO: 506020 - RNA, 15 nt, Chlamydophila pneumoniae CWL029
gacgcuuuuaucugu

SEQ ID NO: 506021 - RNA, 15 nt, Chlamydophila pneumoniae CWL029
gacgcacauuuagaa

SEQ ID NO: 506022 - RNA, 18 nt, Chlamydophila pneumoniae CWL029
gacgauauuuagagagaa

SEQ ID NO: 506023 - RNA, 18 nt, Chlamydophila pneumoniae CWL029
gacgaguugaaguuuugc

SEQ ID NO: 506024 - RNA, 23 nt, Chlamydophila pneumoniae CWL029
gacgaguugaaguuuugcucucu

SEQ ID NO: 506025 - RNA, 23 nt, Chlamydophila pneumoniae CWL029
gacgacguuuugcuguggaauuu

SEQ ID NO: 506026 - RNA, 14 nt, Chlamydophila pneumoniae CWL029
gacgacaaaucacg

SEQ ID NO: 506027 - RNA, 15 nt, Chlamydophila pneumoniae CWL029
gacgacaaggagucg

SEQ ID NO: 506028 - RNA, 22 nt, Chlamydophila pneumoniae CWL029
gacgaccuacacguuacgaaug

SEQ ID NO: 506029 - RNA, 22 nt, Chlamydophila pneumoniae CWL029
gacgaacaugccugaaaacaag

SEQ ID NO: 506030 - RNA, 23 nt, Chlamydophila pneumoniae CWL029
gacgaaagcacauaagaugaagu

SEQ ID NO: 506031 - RNA, 20 nt, Chlamydophila pneumoniae CWL029
gaccuuccuuaucuucagaa

SEQ ID NO: 506032 - RNA, 19 nt, Chlamydophila pneumoniae CWL029
gaccuucucaagaucuuca

SEQ ID NO: 506033 - RNA, 13 nt, Chlamydophila pneumoniae CWL029
gaccuguuuucuu

SEQ ID NO: 506034 - RNA, 15 nt, Chlamydophila pneumoniae CWL029
gaccuacguuuucuc

SEQ ID NO: 506035 - RNA, 19 nt, Chlamydophila pneumoniae CWL029
gaccuaagggcucuccuaa

SEQ ID NO: 506036 - RNA, 15 nt, Chlamydophila pneumoniae CWL029
gaccucaucagaagu

SEQ ID NO: 506037 - RNA, 21 nt, Chlamydophila pneumoniae CWL029
gaccuguuuucuuuucugaag

SEQ ID NO: 506038 - RNA, 15 nt, Chlamydophila pneumoniae CWL029
gaccuguaguaaaau

SEQ ID NO: 506039 - RNA, 16 nt, Chlamydophila pneumoniae CWL029
gaccugcuuuuuuucu

SEQ ID NO: 506040 - RNA, 18 nt, Chlamydophila pneumoniae CWL029
gaccugcuuuuuuucuag

SEQ ID NO: 506041 - RNA, 21 nt, Chlamydophila pneumoniae CWL029
gaccucuguagguuuuuccaa

SEQ ID NO: 506042 - RNA, 19 nt, Chlamydophila pneumoniae CWL029
gaccgcgagugugacugca

SEQ ID NO: 506043 - RNA, 19 nt, Chlamydophila pneumoniae CWL029
gaccgagaagcuucaauga

SEQ ID NO: 506044 - RNA, 21 nt, Chlamydophila pneumoniae CWL029
gaccgcaaggagucacuggca

SEQ ID NO: 506045 - RNA, 15 nt, Chlamydophila pneumoniae CWL029
gaccauccuguagcu

SEQ ID NO: 506046 - RNA, 16 nt, Chlamydophila pneumoniae CWL029
gaccaucgagcuacgu

SEQ ID NO: 506047 - RNA, 14 nt, Chlamydophila pneumoniae CWL029
gaccauaacagcac

SEQ ID NO: 506048 - RNA, 18 nt, Chlamydophila pneumoniae CWL029
gagagaaggaauuaaaau

SEQ ID NO: 506049 - RNA, 13 nt, Chlamydophila pneumoniae CWL029
gagagagcuggac

SEQ ID NO: 506050 - RNA, 13 nt, Chlamydophila pneumoniae CWL029
gagagagacccgu

SEQ ID NO: 506051 - RNA, 19 nt, Chlamydophila pneumoniae CWL029
gagagagucggcuuuagaa

SEQ ID NO: 506052 - RNA, 21 nt, Chlamydophila pneumoniae CWL029
gagaggaaaucccgagauaug

SEQ ID NO: 506053 - RNA, 22 nt, Chlamydophila pneumoniae CWL029
gagagcuugguuuucuccuucu

SEQ ID NO: 506054 - RNA, 14 nt, Chlamydophila pneumoniae CWL029
gagagguucccuca

SEQ ID NO: 506055 - RNA, 22 nt, Chlamydophila pneumoniae CWL029
gagagguaaccagagagcuuuu

SEQ ID NO: 506056 - RNA, 15 nt, Chlamydophila pneumoniae CWL029
gagagguaggcagug

SEQ ID NO: 506057 - RNA, 13 nt, Chlamydophila pneumoniae CWL029
gagacguuguugc

SEQ ID NO: 506058 - RNA, 22 nt, Chlamydophila pneumoniae CWL029
gagacuguguuuuuaggaguug

SEQ ID NO: 506059 - RNA, 13 nt, Chlamydophila pneumoniae CWL029
gagacuuccucuu

SEQ ID NO: 506060 - RNA, 17 nt, Chlamydophila pneumoniae CWL029
gagacugcaaaggaagg

SEQ ID NO: 506061 - RNA, 13 nt, Chlamydophila pneumoniae CWL029
gagagaacuuuug

SEQ ID NO: 506062 - RNA, 13 nt, Chlamydophila pneumoniae CWL029
gagaccuucucuu

SEQ ID NO: 506063 - RNA, 23 nt, Chlamydophila pneumoniae CWL029
gagacaguuuuggauucaagugc

SEQ ID NO: 506064 - RNA, 15 nt, Chlamydophila pneumoniae CWL029
gagacauuucuugau

SEQ ID NO: 506065 - RNA, 16 nt, Chlamydophila pneumoniae CWL029
gagacaaagccacagc

SEQ ID NO: 506066 - RNA, 17 nt, Chlamydophila pneumoniae CWL029
gagacaaagccacagcc

SEQ ID NO: 506067 - RNA, 14 nt, Chlamydophila pneumoniae CWL029
gagacaagaaaaua

SEQ ID NO: 506068 - RNA, 22 nt, Chlamydophila pneumoniae CWL029
gagacagacagucugugagaaa

SEQ ID NO: 506069 - RNA, 12 nt, Chlamydophila pneumoniae CWL029
gagaaugcugua

SEQ ID NO: 506070 - RNA, 22 nt, Chlamydophila pneumoniae CWL029
gagaauugaaaauugcccauug

SEQ ID NO: 506071 - RNA, 22 nt, Chlamydophila pneumoniae CWL029
gagaauguucccaaauagaaaa

SEQ ID NO: 506072 - RNA, 17 nt, Chlamydophila pneumoniae CWL029
gagaauguuccuguaaa

SEQ ID NO: 506073 - RNA, 12 nt, Chlamydophila pneumoniae CWL029
gagaauuuucau

SEQ ID NO: 506074 - RNA, 15 nt, Chlamydophila pneumoniae CWL029
gagaaugacuuuaga

SEQ ID NO: 506075 - RNA, 16 nt, Chlamydophila pneumoniae CWL029
gagaaugcccuguucu

SEQ ID NO: 506076 - RNA, 13 nt, Chlamydophila pneumoniae CWL029
gagaauaaaacuu

SEQ ID NO: 506077 - RNA, 18 nt, Chlamydophila pneumoniae CWL029
gagaauacagagucugug

SEQ ID NO: 506078 - RNA, 22 nt, Chlamydophila pneumoniae CWL029
gagaacuuuaacgaagaaggga

SEQ ID NO: 506079 - RNA, 15 nt, Chlamydophila pneumoniae CWL029
gagaacuuccugauu

SEQ ID NO: 506080 - RNA, 22 nt, Chlamydophila pneumoniae CWL029
gagaaccuucacaagaaaacaa

SEQ ID NO: 506081 - RNA, 16 nt, Chlamydophila pneumoniae CWL029
gagaaaaucugcagca

SEQ ID NO: 506082 - RNA, 13 nt, Chlamydophila pneumoniae CWL029
gagaaaaucaacu

SEQ ID NO: 506083 - RNA, 17 nt, Chlamydophila pneumoniae CWL029
gagaaagcuucuaugaa

SEQ ID NO: 506084 - RNA, 21 nt, Chlamydophila pneumoniae CWL029
gagaaauuuuuaauuuuucua

SEQ ID NO: 506085 - RNA, 15 nt, Chlamydophila pneumoniae CWL029
gacuuuuuuaagagu

SEQ ID NO: 506086 - RNA, 17 nt, Chlamydophila pneumoniae CWL029
gacuuuggucuucugua

SEQ ID NO: 506087 - RNA, 12 nt, Chlamydophila pneumoniae CWL029
gacuuuccucuc

SEQ ID NO: 506088 - RNA, 13 nt, Chlamydophila pneumoniae CWL029
gacuuguucuuca

SEQ ID NO: 506089 - RNA, 14 nt, Chlamydophila pneumoniae CWL029
gacuuguuucuccu

SEQ ID NO: 506090 - RNA, 23 nt, Chlamydophila pneumoniae CWL029
gacuuuagaaauuccaauuuuug

SEQ ID NO: 506091 - RNA, 14 nt, Chlamydophila pneumoniae CWL029
gacuguuuguuuau

SEQ ID NO: 506092 - RNA, 16 nt, Chlamydophila pneumoniae CWL029
gacugucuaugaucca

SEQ ID NO: 506093 - RNA, 19 nt, Chlamydophila pneumoniae CWL029
gacugugauugcguauaga

SEQ ID NO: 506094 - RNA, 15 nt, Chlamydophila pneumoniae CWL029
gacuguacaaaugca

SEQ ID NO: 506095 - RNA, 18 nt, Chlamydophila pneumoniae CWL029
gacuggcgacuugccaau

SEQ ID NO: 506096 - RNA, 20 nt, Chlamydophila pneumoniae CWL029
gacuugcaagcuucuuguuu

SEQ ID NO: 506097 - RNA, 16 nt, Chlamydophila pneumoniae CWL029
gacuugcaagcuucuu

SEQ ID NO: 506098 - RNA, 22 nt, Chlamydophila pneumoniae CWL029
gacuuccucuucaauuucuuca

SEQ ID NO: 506099 - RNA, 15 nt, Chlamydophila pneumoniae CWL029
gacuucgcaaauuuu

SEQ ID NO: 506100 - RNA, 21 nt, Chlamydophila pneumoniae CWL029
gacucugccaugucuaaagga

SEQ ID NO: 506101 - RNA, 23 nt, Chlamydophila pneumoniae CWL029
gacucucaucagcaaaacucccg

SEQ ID NO: 506102 - RNA, 14 nt, Chlamydophila pneumoniae CWL029
gacucuagaguacc

SEQ ID NO: 506103 - RNA, 23 nt, Chlamydophila pneumoniae CWL029
gacugaaaagaucguuaucaaaa

SEQ ID NO: 506104 - RNA, 11 nt, Chlamydophila pneumoniae CWL029
gacugaaacuc

SEQ ID NO: 506105 - RNA, 14 nt, Chlamydophila pneumoniae CWL029
gacugcuagagucc

SEQ ID NO: 506106 - RNA, 14 nt, Chlamydophila pneumoniae CWL029
gacugcaaaggaag

SEQ ID NO: 506107 - RNA, 21 nt, Chlamydophila pneumoniae CWL029
gacucaugaaauaguguuucu

SEQ ID NO: 506108 - RNA, 18 nt, Chlamydophila pneumoniae CWL029
gacucagagaaaaucaac

SEQ ID NO: 506109 - RNA, 21 nt, Chlamydophila pneumoniae CWL029
gacucgccgaaaguaucuuca

SEQ ID NO: 506110 - RNA, 22 nt, Chlamydophila pneumoniae CWL029
gacucgccgaaaguaucuucag

SEQ ID NO: 506111 - RNA, 11 nt, Chlamydophila pneumoniae CWL029
gacucccaagg

SEQ ID NO: 506112 - RNA, 12 nt, Chlamydophila pneumoniae CWL029
gacuauuuucau

SEQ ID NO: 506113 - RNA, 21 nt, Chlamydophila pneumoniae CWL029
gacuauuuuggaaagcucuuu

SEQ ID NO: 506114 - RNA, 16 nt, Chlamydophila pneumoniae CWL029
gacucaaucaaauuca

SEQ ID NO: 506115 - RNA, 14 nt, Chlamydophila pneumoniae CWL029
gacuauagaugcca

SEQ ID NO: 506116 - RNA, 16 nt, Chlamydophila pneumoniae CWL029
gacuaauaccuuucua

SEQ ID NO: 506117 - RNA, 21 nt, Chlamydophila pneumoniae CWL029
gacuauagggagacucuugag

SEQ ID NO: 506118 - RNA, 13 nt, Chlamydophila pneumoniae CWL029
gacuauaaaaugc

SEQ ID NO: 506119 - RNA, 16 nt, Chlamydophila pneumoniae CWL029
gacguuugaucuucuc

SEQ ID NO: 506120 - RNA, 14 nt, Chlamydophila pneumoniae CWL029
gacuaaaaaagaga

SEQ ID NO: 506121 - RNA, 14 nt, Chlamydophila pneumoniae CWL029
gacuaaaagaauaa

SEQ ID NO: 506122 - RNA, 23 nt, Chlamydophila pneumoniae CWL029
gacguucgacaacaacauaaaga

SEQ ID NO: 506123 - RNA, 22 nt, Chlamydophila pneumoniae CWL029
gacguuaauaaagaggcuccca

SEQ ID NO: 506124 - RNA, 20 nt, Chlamydophila pneumoniae CWL029
gacguugcgaacagcuccug

SEQ ID NO: 506125 - RNA, 21 nt, Chlamydophila pneumoniae CWL029
gacguuguugcaauucuucau

SEQ ID NO: 506126 - RNA, 17 nt, Chlamydophila pneumoniae CWL029
gacgugggagacauucc

SEQ ID NO: 506127 - RNA, 16 nt, Chlamydophila pneumoniae CWL029
gacgucuccaacaguc

SEQ ID NO: 506128 - RNA, 20 nt, Chlamydophila pneumoniae CWL029
gacgucuucuuagaagagaa

SEQ ID NO: 506129 - RNA, 21 nt, Chlamydophila pneumoniae CWL029
gacgucuucuuagaagagaaa

SEQ ID NO: 506130 - RNA, 21 nt, Chlamydophila pneumoniae CWL029
gacgucaucauaggaaacgcc

SEQ ID NO: 506131 - RNA, 16 nt, Chlamydophila pneumoniae CWL029
gaggauucuuuuugau

SEQ ID NO: 506132 - RNA, 16 nt, Chlamydophila pneumoniae CWL029
gaggcacauguaggau

SEQ ID NO: 506133 - RNA, 19 nt, Chlamydophila pneumoniae CWL029
gaggauaaaugaguggguu

SEQ ID NO: 506134 - RNA, 19 nt, Chlamydophila pneumoniae CWL029
gaggaguccuucuagguau

SEQ ID NO: 506135 - RNA, 15 nt, Chlamydophila pneumoniae CWL029
gaggagggaaacacc

SEQ ID NO: 506136 - RNA, 13 nt, Chlamydophila pneumoniae CWL029
gaggaacaauacu

SEQ ID NO: 506137 - RNA, 22 nt, Chlamydophila pneumoniae CWL029
gaggaaucauaaccaaaagaau

SEQ ID NO: 506138 - RNA, 13 nt, Chlamydophila pneumoniae CWL029
gaggaaucuaaga

SEQ ID NO: 506139 - RNA, 21 nt, Chlamydophila pneumoniae CWL029
gaggaaucugaaucucauaag

SEQ ID NO: 506140 - RNA, 12 nt, Chlamydophila pneumoniae CWL029
gaggaaugaaga

SEQ ID NO: 506141 - RNA, 16 nt, Chlamydophila pneumoniae CWL029
gaggaauucuggaaca

SEQ ID NO: 506142 - RNA, 12 nt, Chlamydophila pneumoniae CWL029
gaggaaugaucc

SEQ ID NO: 506143 - RNA, 13 nt, Chlamydophila pneumoniae CWL029
gaggagauaaaga

SEQ ID NO: 506144 - RNA, 18 nt, Chlamydophila pneumoniae CWL029
gaggagcgauagcucagc

SEQ ID NO: 506145 - RNA, 19 nt, Chlamydophila pneumoniae CWL029
gaggagcgauagcucagcu

SEQ ID NO: 506146 - RNA, 23 nt, Chlamydophila pneumoniae CWL029
gaggagcuauuaaauuaucagag

SEQ ID NO: 506147 - RNA, 18 nt, Chlamydophila pneumoniae CWL029
gaggagcucccucuagag

SEQ ID NO: 506148 - RNA, 21 nt, Chlamydophila pneumoniae CWL029
gaggagcuuggggguggucua

SEQ ID NO: 506149 - RNA, 11 nt, Chlamydophila pneumoniae CWL029
gaggaggagca

SEQ ID NO: 506150 - RNA, 22 nt, Chlamydophila pneumoniae CWL029
gagcugcugguccuaaaaaaag

SEQ ID NO: 506151 - RNA, 15 nt, Chlamydophila pneumoniae CWL029
gagcuuuuacaaacc

SEQ ID NO: 506152 - RNA, 15 nt, Chlamydophila pneumoniae CWL029
gagcuuuuaguaggu

SEQ ID NO: 506153 - RNA, 18 nt, Chlamydophila pneumoniae CWL029
gagcuugucuaggagcuu

SEQ ID NO: 506154 - RNA, 13 nt, Chlamydophila pneumoniae CWL029
gagcuugucuucc

SEQ ID NO: 506155 - RNA, 14 nt, Chlamydophila pneumoniae CWL029
gagcuugucuucca

SEQ ID NO: 506156 - RNA, 22 nt, Chlamydophila pneumoniae CWL029
gagcuuguucuguaacacuucc

SEQ ID NO: 506157 - RNA, 17 nt, Chlamydophila pneumoniae CWL029
gagcuucuuuaucuagc

SEQ ID NO: 506158 - RNA, 15 nt, Chlamydophila pneumoniae CWL029
gagcuuccauagcuu

SEQ ID NO: 506159 - RNA, 23 nt, Chlamydophila pneumoniae CWL029
gagcucuaaaaaagauaaagcua

SEQ ID NO: 506160 - RNA, 20 nt, Chlamydophila pneumoniae CWL029
gagcucguaauccuucuuuc

SEQ ID NO: 506161 - RNA, 16 nt, Chlamydophila pneumoniae CWL029
gagcuauuuaggcaug

SEQ ID NO: 506162 - RNA, 23 nt, Chlamydophila pneumoniae CWL029
gagcuccgcuagaggaucuucaa

SEQ ID NO: 506163 - RNA, 16 nt, Chlamydophila pneumoniae CWL029
gagcuagaaugucuug

SEQ ID NO: 506164 - RNA, 12 nt, Chlamydophila pneumoniae CWL029
gagcuaucuuca

SEQ ID NO: 506165 - RNA, 23 nt, Chlamydophila pneumoniae CWL029
gagcuaugaugagaacguccuca

SEQ ID NO: 506166 - RNA, 18 nt, Chlamydophila pneumoniae CWL029
gagcuacaagaacugaag

SEQ ID NO: 506167 - RNA, 15 nt, Chlamydophila pneumoniae CWL029
gagcgggagaaucaa

SEQ ID NO: 506168 - RNA, 21 nt, Chlamydophila pneumoniae CWL029
gagcgaucgcaaucagcaaca

SEQ ID NO: 506169 - RNA, 14 nt, Chlamydophila pneumoniae CWL029
gagccuccauaaug

SEQ ID NO: 506170 - RNA, 17 nt, Chlamydophila pneumoniae CWL029
gagccgucuacuuuugu

SEQ ID NO: 506171 - RNA, 13 nt, Chlamydophila pneumoniae CWL029
gagcgccuccacc

SEQ ID NO: 506172 - RNA, 19 nt, Chlamydophila pneumoniae CWL029
gagcgcguuucaaauagga

SEQ ID NO: 506173 - RNA, 16 nt, Chlamydophila pneumoniae CWL029
gagccggaacuucagg

SEQ ID NO: 506174 - RNA, 19 nt, Chlamydophila pneumoniae CWL029
gagcauugacuugggauuc

SEQ ID NO: 506175 - RNA, 21 nt, Chlamydophila pneumoniae CWL029
gagccaacagguucacuucau

SEQ ID NO: 506176 - RNA, 14 nt, Chlamydophila pneumoniae CWL029
gagcaucuuuucaa

SEQ ID NO: 506177 - RNA, 23 nt, Chlamydophila pneumoniae CWL029
gagcagcuuuaucaggaucuuga

SEQ ID NO: 506178 - RNA, 17 nt, Chlamydophila pneumoniae CWL029
gagcagcuguagugaua

SEQ ID NO: 506179 - RNA, 18 nt, Chlamydophila pneumoniae CWL029
gagcagaaacuccaaaau

SEQ ID NO: 506180 - RNA, 17 nt, Chlamydophila pneumoniae CWL029
gagauuuuuucauacuu

SEQ ID NO: 506181 - RNA, 20 nt, Chlamydophila pneumoniae CWL029
gagcaagauaaucauuaaga

SEQ ID NO: 506182 - RNA, 15 nt, Chlamydophila pneumoniae CWL029
gagcacauuuuucua

SEQ ID NO: 506183 - RNA, 16 nt, Chlamydophila pneumoniae CWL029
gagcacauagaaacag

SEQ ID NO: 506184 - RNA, 15 nt, Chlamydophila pneumoniae CWL029
gagcacaaggagaga

SEQ ID NO: 506185 - RNA, 17 nt, Chlamydophila pneumoniae CWL029
gagcaauuaagaaacua

SEQ ID NO: 506186 - RNA, 22 nt, Chlamydophila pneumoniae CWL029
gagaucuuauagacagguacau

SEQ ID NO: 506187 - RNA, 13 nt, Chlamydophila pneumoniae CWL029
gagaucuuugaga

SEQ ID NO: 506188 - RNA, 21 nt, Chlamydophila pneumoniae CWL029
gagaugaaaggcucguagaua

SEQ ID NO: 506189 - RNA, 17 nt, Chlamydophila pneumoniae CWL029
gagaugcuucuaaacaa

SEQ ID NO: 506190 - RNA, 17 nt, Chlamydophila pneumoniae CWL029
gagauuaccgaagagcc

SEQ ID NO: 506191 - RNA, 15 nt, Chlamydophila pneumoniae CWL029
gagauugccaggaga

SEQ ID NO: 506192 - RNA, 15 nt, Chlamydophila pneumoniae CWL029
gagauucauaaaacu

SEQ ID NO: 506193 - RNA, 22 nt, Chlamydophila pneumoniae CWL029
gagauuccuaaaccuaaaaugg

SEQ ID NO: 506194 - RNA, 15 nt, Chlamydophila pneumoniae CWL029
gagauucgaaagaac

SEQ ID NO: 506195 - RNA, 21 nt, Chlamydophila pneumoniae CWL029
gagauaucaucaaaagauaug

SEQ ID NO: 506196 - RNA, 20 nt, Chlamydophila pneumoniae CWL029
gagauauugugaggggauga

SEQ ID NO: 506197 - RNA, 18 nt, Chlamydophila pneumoniae CWL029
gagauauugugaggggau

SEQ ID NO: 506198 - RNA, 22 nt, Chlamydophila pneumoniae CWL029
gagaguucuuguaauaaaagaa

SEQ ID NO: 506199 - RNA, 18 nt, Chlamydophila pneumoniae CWL029
gagaguagugaacacucu

SEQ ID NO: 506200 - RNA, 21 nt, Chlamydophila pneumoniae CWL029
gagaguccugggguucucuaa

SEQ ID NO: 506201 - RNA, 19 nt, Chlamydophila pneumoniae CWL029
gagauaaucgcacuucuau

SEQ ID NO: 506202 - RNA, 19 nt, Chlamydophila pneumoniae CWL029
gagucugcgucguuuuuga

SEQ ID NO: 506203 - RNA, 13 nt, Chlamydophila pneumoniae CWL029
gagucgauuuccc

SEQ ID NO: 506204 - RNA, 14 nt, Chlamydophila pneumoniae CWL029
gagugacaccaaca

SEQ ID NO: 506205 - RNA, 23 nt, Chlamydophila pneumoniae CWL029
gaguccuuuuuguucaaagauug

SEQ ID NO: 506206 - RNA, 19 nt, Chlamydophila pneumoniae CWL029
gagucccuugucaacaaaa

SEQ ID NO: 506207 - RNA, 19 nt, Chlamydophila pneumoniae CWL029
gaguccuaaaauuucuagg

SEQ ID NO: 506208 - RNA, 19 nt, Chlamydophila pneumoniae CWL029
gaguaggguguauucugaa

SEQ ID NO: 506209 - RNA, 16 nt, Chlamydophila pneumoniae CWL029
gaguagcucaucuaga

SEQ ID NO: 506210 - RNA, 19 nt, Chlamydophila pneumoniae CWL029
gaguagccagacuggucua

SEQ ID NO: 506211 - RNA, 12 nt, Chlamydophila pneumoniae CWL029
gaguguuuucug

SEQ ID NO: 506212 - RNA, 22 nt, Chlamydophila pneumoniae CWL029
gaguugccaggaaacguucuuu

SEQ ID NO: 506213 - RNA, 19 nt, Chlamydophila pneumoniae CWL029
gaguuggagaauugaaaau

SEQ ID NO: 506214 - RNA, 15 nt, Chlamydophila pneumoniae CWL029
gauaagauaaagaau

SEQ ID NO: 506215 - RNA, 15 nt, Chlamydophila pneumoniae CWL029
gauaagaucucuccg

SEQ ID NO: 506216 - RNA, 23 nt, Chlamydophila pneumoniae CWL029
gauaaauacccucggagacucag

SEQ ID NO: 506217 - RNA, 21 nt, Chlamydophila pneumoniae CWL029
gauaaagaaguuuacaaauaa

SEQ ID NO: 506218 - RNA, 15 nt, Chlamydophila pneumoniae CWL029
gauaaauccccacca

SEQ ID NO: 506219 - RNA, 12 nt, Chlamydophila pneumoniae CWL029
gauaaacagcac

SEQ ID NO: 506220 - RNA, 17 nt, Chlamydophila pneumoniae CWL029
gauaaacauuaagugau

SEQ ID NO: 506221 - RNA, 21 nt, Chlamydophila pneumoniae CWL029
gaguuuuaaacugcuacuuua

SEQ ID NO: 506222 - RNA, 13 nt, Chlamydophila pneumoniae CWL029
gaguuuucaaacu

SEQ ID NO: 506223 - RNA, 19 nt, Chlamydophila pneumoniae CWL029
gaguaaggaacaauguaaa

SEQ ID NO: 506224 - RNA, 15 nt, Chlamydophila pneumoniae CWL029
gagguugagcaagaa

SEQ ID NO: 506225 - RNA, 22 nt, Chlamydophila pneumoniae CWL029
gagguucgcagaacuucuccaa

SEQ ID NO: 506226 - RNA, 18 nt, Chlamydophila pneumoniae CWL029
gaggucuuugaguagcca

SEQ ID NO: 506227 - RNA, 16 nt, Chlamydophila pneumoniae CWL029
gagguaugaauaggaa

SEQ ID NO: 506228 - RNA, 16 nt, Chlamydophila pneumoniae CWL029
gaggguuccaagagcu

SEQ ID NO: 506229 - RNA, 13 nt, Chlamydophila pneumoniae CWL029
gagggucucagca

SEQ ID NO: 506230 - RNA, 23 nt, Chlamydophila pneumoniae CWL029
gagggguaaaccaauugagcucu

SEQ ID NO: 506231 - RNA, 22 nt, Chlamydophila pneumoniae CWL029
gaggggccuaaagcuccgagaa

SEQ ID NO: 506232 - RNA, 11 nt, Chlamydophila pneumoniae CWL029
gagggauuugu

SEQ ID NO: 506233 - RNA, 21 nt, Chlamydophila pneumoniae CWL029
gaggcuagaaaaucauacgcc

SEQ ID NO: 506234 - RNA, 21 nt, Chlamydophila pneumoniae CWL029
gaggcggagguacguaucuuc

SEQ ID NO: 506235 - RNA, 22 nt, Chlamydophila pneumoniae CWL029
gauaguauuuuugaaaccaagg

SEQ ID NO: 506236 - RNA, 16 nt, Chlamydophila pneumoniae CWL029
gauaguaucguaagcc

SEQ ID NO: 506237 - RNA, 17 nt, Chlamydophila pneumoniae CWL029
gauaggguaagauugca

SEQ ID NO: 506238 - RNA, 13 nt, Chlamydophila pneumoniae CWL029
gauaggaaccacu

SEQ ID NO: 506239 - RNA, 21 nt, Chlamydophila pneumoniae CWL029
gauaggaaccacuuuagaauu

SEQ ID NO: 506240 - RNA, 20 nt, Chlamydophila pneumoniae CWL029
gauaggaucuucuauuuuuu

SEQ ID NO: 506241 - RNA, 13 nt, Chlamydophila pneumoniae CWL029
gauagccauuaga

SEQ ID NO: 506242 - RNA, 15 nt, Chlamydophila pneumoniae CWL029
gauagcugaugcuga

SEQ ID NO: 506243 - RNA, 22 nt, Chlamydophila pneumoniae CWL029
gauaguguucgagcaucucaag

SEQ ID NO: 506244 - RNA, 21 nt, Chlamydophila pneumoniae CWL029
gauaguucacaagugcauuau

SEQ ID NO: 506245 - RNA, 17 nt, Chlamydophila pneumoniae CWL029
gauauaacccaggacau

SEQ ID NO: 506246 - RNA, 19 nt, Chlamydophila pneumoniae CWL029
gauauaagacuccaaguca

SEQ ID NO: 506247 - RNA, 18 nt, Chlamydophila pneumoniae CWL029
gauacucugaacaggaau

SEQ ID NO: 506248 - RNA, 21 nt, Chlamydophila pneumoniae CWL029
gauaccucuccgucauauuua

SEQ ID NO: 506249 - RNA, 20 nt, Chlamydophila pneumoniae CWL029
gauacgugcagugaauccuu

SEQ ID NO: 506250 - RNA, 23 nt, Chlamydophila pneumoniae CWL029
gauacgugcagugaauccuucca

SEQ ID NO: 506251 - RNA, 13 nt, Chlamydophila pneumoniae CWL029
gauacguggaacu

SEQ ID NO: 506252 - RNA, 16 nt, Chlamydophila pneumoniae CWL029
gauaaguuacuuucug

SEQ ID NO: 506253 - RNA, 14 nt, Chlamydophila pneumoniae CWL029
gauaaguucuucca

SEQ ID NO: 506254 - RNA, 15 nt, Chlamydophila pneumoniae CWL029
gauaaguucuuccaa

SEQ ID NO: 506255 - RNA, 16 nt, Chlamydophila pneumoniae CWL029
gauaccggcaaauaaa

SEQ ID NO: 506256 - RNA, 22 nt, Chlamydophila pneumoniae CWL029
gauaccgcuguuuuauagcauc

SEQ ID NO: 506257 - RNA, 13 nt, Chlamydophila pneumoniae CWL029
gauaaggaccagg

SEQ ID NO: 506258 - RNA, 13 nt, Chlamydophila pneumoniae CWL029
gauccaucugcuc

SEQ ID NO: 506259 - RNA, 16 nt, Chlamydophila pneumoniae CWL029
gaucauaccgacaagc

SEQ ID NO: 506260 - RNA, 23 nt, Chlamydophila pneumoniae CWL029
gaucauaucggcagcagcauaag

SEQ ID NO: 506261 - RNA, 19 nt, Chlamydophila pneumoniae CWL029
gaucauaucuuaugccuuu

SEQ ID NO: 506262 - RNA, 21 nt, Chlamydophila pneumoniae CWL029
gaucauaugcaccgauuggcu

SEQ ID NO: 506263 - RNA, 11 nt, Chlamydophila pneumoniae CWL029
gaucacugaga

SEQ ID NO: 506264 - RNA, 19 nt, Chlamydophila pneumoniae CWL029
gauauuuuuauuuaaaauu

SEQ ID NO: 506265 - RNA, 20 nt, Chlamydophila pneumoniae CWL029
gauauugauaaaucccgaac

SEQ ID NO: 506266 - RNA, 18 nt, Chlamydophila pneumoniae CWL029
gauauagauucaugaaau

SEQ ID NO: 506267 - RNA, 20 nt, Chlamydophila pneumoniae CWL029
gauauagcguacaggaaguc

SEQ ID NO: 506268 - RNA, 11 nt, Chlamydophila pneumoniae CWL029
gauauauagag

SEQ ID NO: 506269 - RNA, 17 nt, Chlamydophila pneumoniae CWL029
gaucaaagaacaauaaa

SEQ ID NO: 506270 - RNA, 16 nt, Chlamydophila pneumoniae CWL029
gaucacaagaaagaau

SEQ ID NO: 506271 - RNA, 17 nt, Chlamydophila pneumoniae CWL029
gaucacauagaaaacau

SEQ ID NO: 506272 - RNA, 14 nt, Chlamydophila pneumoniae CWL029
gaugcuauuuuucc

SEQ ID NO: 506273 - RNA, 15 nt, Chlamydophila pneumoniae CWL029
gaugcuauuuuucca

SEQ ID NO: 506274 - RNA, 20 nt, Chlamydophila pneumoniae CWL029
gaugcuccgggaaacaucag

SEQ ID NO: 506275 - RNA, 23 nt, Chlamydophila pneumoniae CWL029
gaugcucuagaaaacgcucuccu

SEQ ID NO: 506276 - RNA, 14 nt, Chlamydophila pneumoniae CWL029
gaugcaccauaaua

SEQ ID NO: 506277 - RNA, 16 nt, Chlamydophila pneumoniae CWL029
gaugcaccauaauaua

SEQ ID NO: 506278 - RNA, 18 nt, Chlamydophila pneumoniae CWL029
gaugcaaauccuguagaa

SEQ ID NO: 506279 - RNA, 19 nt, Chlamydophila pneumoniae CWL029
gaugcaaauccuguagaaa

SEQ ID NO: 506280 - RNA, 22 nt, Chlamydophila pneumoniae CWL029
gaugcaaauccuguagaaacau

SEQ ID NO: 506281 - RNA, 16 nt, Chlamydophila pneumoniae CWL029
gaugcaaugguugucu

SEQ ID NO: 506282 - RNA, 19 nt, Chlamydophila pneumoniae CWL029
gaugcaaauuccagaaaaa

SEQ ID NO: 506283 - RNA, 23 nt, Chlamydophila pneumoniae CWL029
gaugcagcauuuguaagaaucau

SEQ ID NO: 506284 - RNA, 12 nt, Chlamydophila pneumoniae CWL029
gaugcagaucau

SEQ ID NO: 506285 - RNA, 19 nt, Chlamydophila pneumoniae CWL029
gaugaggucuuuagcaaaa

SEQ ID NO: 506286 - RNA, 18 nt, Chlamydophila pneumoniae CWL029
gaugagguugagcaagaa

SEQ ID NO: 506287 - RNA, 13 nt, Chlamydophila pneumoniae CWL029
gaugaagauaaaa

SEQ ID NO: 506288 - RNA, 19 nt, Chlamydophila pneumoniae CWL029
gaugaagauaaaaucuuca

SEQ ID NO: 506289 - RNA, 23 nt, Chlamydophila pneumoniae CWL029
gaugaacguauagggaaccuuga

SEQ ID NO: 506290 - RNA, 16 nt, Chlamydophila pneumoniae CWL029
gaucuucuaaaacacc

SEQ ID NO: 506291 - RNA, 17 nt, Chlamydophila pneumoniae CWL029
gaucuucuaaaacaccu

SEQ ID NO: 506292 - RNA, 16 nt, Chlamydophila pneumoniae CWL029
gaucuucuagaugugu

SEQ ID NO: 506293 - RNA, 17 nt, Chlamydophila pneumoniae CWL029
gaucuucugaaaucaaa

SEQ ID NO: 506294 - RNA, 20 nt, Chlamydophila pneumoniae CWL029
gaucuugaacagagacuucc

SEQ ID NO: 506295 - RNA, 22 nt, Chlamydophila pneumoniae CWL029
gaucuucaauuggaggauaaau

SEQ ID NO: 506296 - RNA, 12 nt, Chlamydophila pneumoniae CWL029
gaucuucauccc

SEQ ID NO: 506297 - RNA, 14 nt, Chlamydophila pneumoniae CWL029
gaucuucauaacca

SEQ ID NO: 506298 - RNA, 21 nt, Chlamydophila pneumoniae CWL029
gaucuucauaaccaaguaaau

SEQ ID NO: 506299 - RNA, 16 nt, Chlamydophila pneumoniae CWL029
gaucuuauauaaaacu

SEQ ID NO: 506300 - RNA, 22 nt, Chlamydophila pneumoniae CWL029
gaucuggaugagaggauuugaa

SEQ ID NO: 506301 - RNA, 23 nt, Chlamydophila pneumoniae CWL029
gaucuuuugauaacuuugcauga

SEQ ID NO: 506302 - RNA, 14 nt, Chlamydophila pneumoniae CWL029
gaucuuuucuuucu

SEQ ID NO: 506303 - RNA, 15 nt, Chlamydophila pneumoniae CWL029
gaucuuuagaauaag

SEQ ID NO: 506304 - RNA, 15 nt, Chlamydophila pneumoniae CWL029
gaugaacauaauucg

SEQ ID NO: 506305 - RNA, 19 nt, Chlamydophila pneumoniae CWL029
gaucucucuuccugcugcu

SEQ ID NO: 506306 - RNA, 19 nt, Chlamydophila pneumoniae CWL029
gaucugaaguugaaaugag

SEQ ID NO: 506307 - RNA, 22 nt, Chlamydophila pneumoniae CWL029
gaucugcaaacgcaaugauuuc

SEQ ID NO: 506308 - RNA, 20 nt, Chlamydophila pneumoniae CWL029
gaucccaucaucgagcugau

SEQ ID NO: 506309 - RNA, 15 nt, Chlamydophila pneumoniae CWL029
gauccccuucauucu

SEQ ID NO: 506310 - RNA, 20 nt, Chlamydophila pneumoniae CWL029
gaucuaaaagcacuuaaaaa

SEQ ID NO: 506311 - RNA, 23 nt, Chlamydophila pneumoniae CWL029
gaucuaaaagcacuuaaaaaacu

SEQ ID NO: 506312 - RNA, 15 nt, Chlamydophila pneumoniae CWL029
gaucuaaagcaucac

SEQ ID NO: 506313 - RNA, 21 nt, Chlamydophila pneumoniae CWL029
gaucuacagauaggguaagau

SEQ ID NO: 506314 - RNA, 21 nt, Chlamydophila pneumoniae CWL029
gaucuaacuucaccauauaau

SEQ ID NO: 506315 - RNA, 17 nt, Chlamydophila pneumoniae CWL029
gaucuacaaaaacuaga

SEQ ID NO: 506316 - RNA, 14 nt, Chlamydophila pneumoniae CWL029
gaucucccgugagc

SEQ ID NO: 506317 - RNA, 22 nt, Chlamydophila pneumoniae CWL029
gaucucaguaggagcagcggca

SEQ ID NO: 506318 - RNA, 17 nt, Chlamydophila pneumoniae CWL029
gauuuccccuucagagg

SEQ ID NO: 506319 - RNA, 23 nt, Chlamydophila pneumoniae CWL029
gauuuccaauccauucugagaaa

SEQ ID NO: 506320 - RNA, 22 nt, Chlamydophila pneumoniae CWL029
gauuuuggagacacacuuucuu

SEQ ID NO: 506321 - RNA, 14 nt, Chlamydophila pneumoniae CWL029
gauuuuucuuuuag

SEQ ID NO: 506322 - RNA, 13 nt, Chlamydophila pneumoniae CWL029
gauuuuaaagccu

SEQ ID NO: 506323 - RNA, 12 nt, Chlamydophila pneumoniae CWL029
gauuuuccauua

SEQ ID NO: 506324 - RNA, 11 nt, Chlamydophila pneumoniae CWL029
gauuuucucua

SEQ ID NO: 506325 - RNA, 21 nt, Chlamydophila pneumoniae CWL029
gauuuuuuaaccucuuuucuu

SEQ ID NO: 506326 - RNA, 19 nt, Chlamydophila pneumoniae CWL029
gauuuuuuugguugcuucu

SEQ ID NO: 506327 - RNA, 14 nt, Chlamydophila pneumoniae CWL029
gauucguuauccuc

SEQ ID NO: 506328 - RNA, 22 nt, Chlamydophila pneumoniae CWL029
gauucguuauccucgucuucaa

SEQ ID NO: 506329 - RNA, 13 nt, Chlamydophila pneumoniae CWL029
gauucuaaaagag

SEQ ID NO: 506330 - RNA, 14 nt, Chlamydophila pneumoniae CWL029
gauucuaaaagagc

SEQ ID NO: 506331 - RNA, 22 nt, Chlamydophila pneumoniae CWL029
gauucucauaaaggcucuuuua

SEQ ID NO: 506332 - RNA, 23 nt, Chlamydophila pneumoniae CWL029
gauucucauaaaggcucuuuuag

SEQ ID NO: 506333 - RNA, 21 nt, Chlamydophila pneumoniae CWL029
gauugcaguugcuguggcaua

SEQ ID NO: 506334 - RNA, 17 nt, Chlamydophila pneumoniae CWL029
gauugguaaggagaguc

SEQ ID NO: 506335 - RNA, 17 nt, Chlamydophila pneumoniae CWL029
gauuguauagcuuacuu

SEQ ID NO: 506336 - RNA, 20 nt, Chlamydophila pneumoniae CWL029
gauuuagaaucuuuucuaga

SEQ ID NO: 506337 - RNA, 15 nt, Chlamydophila pneumoniae CWL029
gauuuagauuaaaga

SEQ ID NO: 506338 - RNA, 16 nt, Chlamydophila pneumoniae CWL029
gauuuagggaagaguu

SEQ ID NO: 506339 - RNA, 22 nt, Chlamydophila pneumoniae CWL029
gauucgaaaaacgguaaauauc

SEQ ID NO: 506340 - RNA, 13 nt, Chlamydophila pneumoniae CWL029
gauuccugaggcu

SEQ ID NO: 506341 - RNA, 19 nt, Chlamydophila pneumoniae CWL029
gauuccaguagagccucua

SEQ ID NO: 506342 - RNA, 14 nt, Chlamydophila pneumoniae CWL029
gauuaguaacuaaa

SEQ ID NO: 506343 - RNA, 19 nt, Chlamydophila pneumoniae CWL029
gauucagauccaaagacgu

SEQ ID NO: 506344 - RNA, 19 nt, Chlamydophila pneumoniae CWL029
gauucacaucuuaaaaacu

SEQ ID NO: 506345 - RNA, 21 nt, Chlamydophila pneumoniae CWL029
gauucacaucuuaaaaacuac

SEQ ID NO: 506346 - RNA, 15 nt, Chlamydophila pneumoniae CWL029
gauguuuaauacaaa

SEQ ID NO: 506347 - RNA, 16 nt, Chlamydophila pneumoniae CWL029
gauguuuaauacaaaa

SEQ ID NO: 506348 - RNA, 22 nt, Chlamydophila pneumoniae CWL029
gauuacagcaucuauagaauuu

SEQ ID NO: 506349 - RNA, 21 nt, Chlamydophila pneumoniae CWL029
gauguucucgcaaugcuucuu

SEQ ID NO: 506350 - RNA, 17 nt, Chlamydophila pneumoniae CWL029
gauguuguggaucagaa

SEQ ID NO: 506351 - RNA, 15 nt, Chlamydophila pneumoniae CWL029
gaugucgcuuuugcu

SEQ ID NO: 506352 - RNA, 21 nt, Chlamydophila pneumoniae CWL029
gcaguugcuguggcauacucu

SEQ ID NO: 506353 - RNA, 17 nt, Chlamydophila pneumoniae CWL029
gcauaacuuuaucauag

SEQ ID NO: 506354 - RNA, 21 nt, Chlamydophila pneumoniae CWL029
gcauaacugugcuccauagca

SEQ ID NO: 506355 - RNA, 14 nt, Chlamydophila pneumoniae CWL029
gcagugugcugauu

SEQ ID NO: 506356 - RNA, 15 nt, Chlamydophila pneumoniae CWL029
gcaguggcuuauaga

SEQ ID NO: 506357 - RNA, 20 nt, Chlamydophila pneumoniae CWL029
gcaguggcuuauagagagaa

SEQ ID NO: 506358 - RNA, 21 nt, Chlamydophila pneumoniae CWL029
gcaguggcuuauagagagaau

SEQ ID NO: 506359 - RNA, 16 nt, Chlamydophila pneumoniae CWL029
gcaguaaugccaauau

SEQ ID NO: 506360 - RNA, 22 nt, Chlamydophila pneumoniae CWL029
gcagucguauucagguucugaa

SEQ ID NO: 506361 - RNA, 20 nt, Chlamydophila pneumoniae CWL029
gcagucgugauauccaccuu

SEQ ID NO: 506362 - RNA, 14 nt, Chlamydophila pneumoniae CWL029
gcagguucuugaau

SEQ ID NO: 506363 - RNA, 15 nt, Chlamydophila pneumoniae CWL029
gcagggggccugcca

SEQ ID NO: 506364 - RNA, 17 nt, Chlamydophila pneumoniae CWL029
gcagggggccugccaug

SEQ ID NO: 506365 - RNA, 15 nt, Chlamydophila pneumoniae CWL029
gcaggaguuuucaag

SEQ ID NO: 506366 - RNA, 13 nt, Chlamydophila pneumoniae CWL029
gcaggagaacaau

SEQ ID NO: 506367 - RNA, 17 nt, Chlamydophila pneumoniae CWL029
gcagcucggauggacua

SEQ ID NO: 506368 - RNA, 18 nt, Chlamydophila pneumoniae CWL029
gcagcuucccaagcagaa

SEQ ID NO: 506369 - RNA, 19 nt, Chlamydophila pneumoniae CWL029
gcaggaauaaucaaccaaa

SEQ ID NO: 506370 - RNA, 21 nt, Chlamydophila pneumoniae CWL029
gcaggaauaaucaaccaaaau

SEQ ID NO: 506371 - RNA, 22 nt, Chlamydophila pneumoniae CWL029
gcaggaagucaccuuacaucca

SEQ ID NO: 506372 - RNA, 15 nt, Chlamydophila pneumoniae CWL029
gcagccucuucucua

SEQ ID NO: 506373 - RNA, 13 nt, Chlamydophila pneumoniae CWL029
gcagaucuuuuau

SEQ ID NO: 506374 - RNA, 22 nt, Chlamydophila pneumoniae CWL029
gcagaucccgggagucuucagc

SEQ ID NO: 506375 - RNA, 15 nt, Chlamydophila pneumoniae CWL029
gcagauacuaaacuc

SEQ ID NO: 506376 - RNA, 17 nt, Chlamydophila pneumoniae CWL029
gcagauagacaaccuag

SEQ ID NO: 506377 - RNA, 19 nt, Chlamydophila pneumoniae CWL029
gcagauagacaaccuagaa

SEQ ID NO: 506378 - RNA, 16 nt, Chlamydophila pneumoniae CWL029
gcagauagcuuacaga

SEQ ID NO: 506379 - RNA, 19 nt, Chlamydophila pneumoniae CWL029
gcagaguccuucuuuuccg

SEQ ID NO: 506380 - RNA, 13 nt, Chlamydophila pneumoniae CWL029
gcagagucuauau

SEQ ID NO: 506381 - RNA, 19 nt, Chlamydophila pneumoniae CWL029
gcagaguuuuucccucgcu

SEQ ID NO: 506382 - RNA, 22 nt, Chlamydophila pneumoniae CWL029
gcagagaacuuucgucuuugcu

SEQ ID NO: 506383 - RNA, 18 nt, Chlamydophila pneumoniae CWL029
gcagagaugcuaacaacu

SEQ ID NO: 506384 - RNA, 14 nt, Chlamydophila pneumoniae CWL029
gcagaaacacugaa

SEQ ID NO: 506385 - RNA, 20 nt, Chlamydophila pneumoniae CWL029
gcagaaguccuaucaaagca

SEQ ID NO: 506386 - RNA, 21 nt, Chlamydophila pneumoniae CWL029
gcagaaguccuaucaaagcaa

SEQ ID NO: 506387 - RNA, 17 nt, Chlamydophila pneumoniae CWL029
gcagaaguuccuucagg

SEQ ID NO: 506388 - RNA, 14 nt, Chlamydophila pneumoniae CWL029
gcacuuuuauuaug

SEQ ID NO: 506389 - RNA, 10 nt, Chlamydophila pneumoniae CWL029
gcacuuuccg

SEQ ID NO: 506390 - RNA, 13 nt, Chlamydophila pneumoniae CWL029
gcacuuucuuuuu

SEQ ID NO: 506391 - RNA, 21 nt, Chlamydophila pneumoniae CWL029
gcacuugcucuuuaauaaggc

SEQ ID NO: 506392 - RNA, 13 nt, Chlamydophila pneumoniae CWL029
gcaccgccugacc

SEQ ID NO: 506393 - RNA, 16 nt, Chlamydophila pneumoniae CWL029
gcaccuaauaaagaag

SEQ ID NO: 506394 - RNA, 14 nt, Chlamydophila pneumoniae CWL029
gcacgcaacaucuc

SEQ ID NO: 506395 - RNA, 23 nt, Chlamydophila pneumoniae CWL029
gcacaucgcguauagaugcagca

SEQ ID NO: 506396 - RNA, 18 nt, Chlamydophila pneumoniae CWL029
gcaccaauugcagucacu

SEQ ID NO: 506397 - RNA, 15 nt, Chlamydophila pneumoniae CWL029
gcaaugauauccuca

SEQ ID NO: 506398 - RNA, 17 nt, Chlamydophila pneumoniae CWL029
gcaauccaguagaucuu

SEQ ID NO: 506399 - RNA, 17 nt, Chlamydophila pneumoniae CWL029
gcaauccaggaauagaa

SEQ ID NO: 506400 - RNA, 18 nt, Chlamydophila pneumoniae CWL029
gcaauccaggaauagaaa

SEQ ID NO: 506401 - RNA, 14 nt, Chlamydophila pneumoniae CWL029
gcaaucagcaacau

SEQ ID NO: 506402 - RNA, 21 nt, Chlamydophila pneumoniae CWL029
gcaaucagugcugccaugaca

SEQ ID NO: 506403 - RNA, 15 nt, Chlamydophila pneumoniae CWL029
gcaauacuaagaagc

SEQ ID NO: 506404 - RNA, 21 nt, Chlamydophila pneumoniae CWL029
gcaauacaccaagggaugcca

SEQ ID NO: 506405 - RNA, 18 nt, Chlamydophila pneumoniae CWL029
gcaagaaguguauuuaaa

SEQ ID NO: 506406 - RNA, 12 nt, Chlamydophila pneumoniae CWL029
gcaagagcuccg

SEQ ID NO: 506407 - RNA, 17 nt, Chlamydophila pneumoniae CWL029
gcaagagcucuugagaa

SEQ ID NO: 506408 - RNA, 20 nt, Chlamydophila pneumoniae CWL029
gcaagagcucuugagaaagc

SEQ ID NO: 506409 - RNA, 18 nt, Chlamydophila pneumoniae CWL029
gcaagcucgcguauuuuc

SEQ ID NO: 506410 - RNA, 21 nt, Chlamydophila pneumoniae CWL029
gcaagcucuggauugaaagag

SEQ ID NO: 506411 - RNA, 13 nt, Chlamydophila pneumoniae CWL029
gcaaggcaaugau

SEQ ID NO: 506412 - RNA, 14 nt, Chlamydophila pneumoniae CWL029
gcaaggcaaugaua

SEQ ID NO: 506413 - RNA, 21 nt, Chlamydophila pneumoniae CWL029
gcaaggaaaaaaaaucugcua

SEQ ID NO: 506414 - RNA, 21 nt, Chlamydophila pneumoniae CWL029
gcaacucuuuaggucuugucu

SEQ ID NO: 506415 - RNA, 22 nt, Chlamydophila pneumoniae CWL029
gcaacuaaacugggaagaccac

SEQ ID NO: 506416 - RNA, 19 nt, Chlamydophila pneumoniae CWL029
gcaaccucugcauguugca

SEQ ID NO: 506417 - RNA, 16 nt, Chlamydophila pneumoniae CWL029
gcaacgcgauuuucaa

SEQ ID NO: 506418 - RNA, 19 nt, Chlamydophila pneumoniae CWL029
gcaacaacgccuacaugga

SEQ ID NO: 506419 - RNA, 15 nt, Chlamydophila pneumoniae CWL029
gcaacaaucuuucuu

SEQ ID NO: 506420 - RNA, 22 nt, Chlamydophila pneumoniae CWL029
gcaacaucucacagauaccauc

SEQ ID NO: 506421 - RNA, 17 nt, Chlamydophila pneumoniae CWL029
gcuccuacaguccuggg

SEQ ID NO: 506422 - RNA, 14 nt, Chlamydophila pneumoniae CWL029
gcuccugaauaugc

SEQ ID NO: 506423 - RNA, 13 nt, Chlamydophila pneumoniae CWL029
gcuccuaaagcau

SEQ ID NO: 506424 - RNA, 22 nt, Chlamydophila pneumoniae CWL029
gcucccuccuccucgucuaaag

SEQ ID NO: 506425 - RNA, 16 nt, Chlamydophila pneumoniae CWL029
gcucaguaaauauuuu

SEQ ID NO: 506426 - RNA, 17 nt, Chlamydophila pneumoniae CWL029
gcucaucggaucuuuuc

SEQ ID NO: 506427 - RNA, 15 nt, Chlamydophila pneumoniae CWL029
gcucacucuuuaaaa

SEQ ID NO: 506428 - RNA, 16 nt, Chlamydophila pneumoniae CWL029
gcucacuuacgaaucu

SEQ ID NO: 506429 - RNA, 15 nt, Chlamydophila pneumoniae CWL029
gcuaggaagaugaau

SEQ ID NO: 506430 - RNA, 17 nt, Chlamydophila pneumoniae CWL029
gcuacuucuucuuuucg

SEQ ID NO: 506431 - RNA, 16 nt, Chlamydophila pneumoniae CWL029
gcuagugcgaugggaa

SEQ ID NO: 506432 - RNA, 12 nt, Chlamydophila pneumoniae CWL029
gcuagucuuucu

SEQ ID NO: 506433 - RNA, 17 nt, Chlamydophila pneumoniae CWL029
gcuaaucaauccaagaa

SEQ ID NO: 506434 - RNA, 21 nt, Chlamydophila pneumoniae CWL029
gcuaauaauuccugagguugg

SEQ ID NO: 506435 - RNA, 23 nt, Chlamydophila pneumoniae CWL029
gcuaauacaucaccacugcucca

SEQ ID NO: 506436 - RNA, 16 nt, Chlamydophila pneumoniae CWL029
gcuaagaucuuuagaa

SEQ ID NO: 506437 - RNA, 21 nt, Chlamydophila pneumoniae CWL029
gcuaagaucuuuagaauaaga

SEQ ID NO: 506438 - RNA, 19 nt, Chlamydophila pneumoniae CWL029
gcuaagcauuuuacgaauu

SEQ ID NO: 506439 - RNA, 12 nt, Chlamydophila pneumoniae CWL029
gcuaaggauucc

SEQ ID NO: 506440 - RNA, 15 nt, Chlamydophila pneumoniae CWL029
gcuaacgaagccuca

SEQ ID NO: 506441 - RNA, 15 nt, Chlamydophila pneumoniae CWL029
gcuaacgacauugaa

SEQ ID NO: 506442 - RNA, 18 nt, Chlamydophila pneumoniae CWL029
gcuaaaggaucauuaaag

SEQ ID NO: 506443 - RNA, 21 nt, Chlamydophila pneumoniae CWL029
gcuaaaggaucauuaaagucc

SEQ ID NO: 506444 - RNA, 24 nt, Chlamydophila pneumoniae CWL029
gcuaaagugaugccuggacugcug

SEQ ID NO: 506445 - RNA, 15 nt, Chlamydophila pneumoniae CWL029
gcuaaauuugucauc

SEQ ID NO: 506446 - RNA, 21 nt, Chlamydophila pneumoniae CWL029
gcuacauaguuuuuauuuuua

SEQ ID NO: 506447 - RNA, 15 nt, Chlamydophila pneumoniae CWL029
gcuacauaguuuuua

SEQ ID NO: 506448 - RNA, 17 nt, Chlamydophila pneumoniae CWL029
gcuacaaggucuuuucc

SEQ ID NO: 506449 - RNA, 19 nt, Chlamydophila pneumoniae CWL029
gcuacaaggucuuuuccug

SEQ ID NO: 506450 - RNA, 17 nt, Chlamydophila pneumoniae CWL029
gcuacaaaauuauuaaa

SEQ ID NO: 506451 - RNA, 16 nt, Chlamydophila pneumoniae CWL029
gcuacaaacucuucca

SEQ ID NO: 506452 - RNA, 19 nt, Chlamydophila pneumoniae CWL029
gcuaauuuaaaugccuuaa

SEQ ID NO: 506453 - RNA, 20 nt, Chlamydophila pneumoniae CWL029
gcuaccuuaguuuuuucuaa

SEQ ID NO: 506454 - RNA, 21 nt, Chlamydophila pneumoniae CWL029
gcuacgacuacaucuuguucu

SEQ ID NO: 506455 - RNA, 14 nt, Chlamydophila pneumoniae CWL029
gcuaccuagggucu

SEQ ID NO: 506456 - RNA, 18 nt, Chlamydophila pneumoniae CWL029
gcguuuuuugaaaauuuu

SEQ ID NO: 506457 - RNA, 21 nt, Chlamydophila pneumoniae CWL029
gcguuucgacgagaaggaaga

SEQ ID NO: 506458 - RNA, 22 nt, Chlamydophila pneumoniae CWL029
gcguugauuccaaugacgggag

SEQ ID NO: 506459 - RNA, 21 nt, Chlamydophila pneumoniae CWL029
gcguacucuauuaaggauucc

SEQ ID NO: 506460 - RNA, 23 nt, Chlamydophila pneumoniae CWL029
gcguacucuucuuuggaugcuaa

SEQ ID NO: 506461 - RNA, 14 nt, Chlamydophila pneumoniae CWL029
gcguacguuuucuc

SEQ ID NO: 506462 - RNA, 21 nt, Chlamydophila pneumoniae CWL029
gcggcauggacaauauagaaa

SEQ ID NO: 506463 - RNA, 14 nt, Chlamydophila pneumoniae CWL029
gcgcucuacaaaug

SEQ ID NO: 506464 - RNA, 18 nt, Chlamydophila pneumoniae CWL029
gcgcucuaagagcccuug

SEQ ID NO: 506465 - RNA, 14 nt, Chlamydophila pneumoniae CWL029
gcgcuaucaucauu

SEQ ID NO: 506466 - RNA, 13 nt, Chlamydophila pneumoniae CWL029
gcgcuacagugac

SEQ ID NO: 506467 - RNA, 23 nt, Chlamydophila pneumoniae CWL029
gcgcccgaaucuuucaaaagaaa

SEQ ID NO: 506468 - RNA, 14 nt, Chlamydophila pneumoniae CWL029
gcgauguuccuuuu

SEQ ID NO: 506469 - RNA, 23 nt, Chlamydophila pneumoniae CWL029
gcgauguuccuuuuuuuuuucuu

SEQ ID NO: 506470 - RNA, 11 nt, Chlamydophila pneumoniae CWL029
gcgcaaagaac

SEQ ID NO: 506471 - RNA, 22 nt, Chlamydophila pneumoniae CWL029
gcgcaaaucuuacauaaaccuu

SEQ ID NO: 506472 - RNA, 11 nt, Chlamydophila pneumoniae CWL029
gcgcagcuucu

SEQ ID NO: 506473 - RNA, 16 nt, Chlamydophila pneumoniae CWL029
gcgauaguaaacagaa

SEQ ID NO: 506474 - RNA, 16 nt, Chlamydophila pneumoniae CWL029
gcgauacaauaaacaa

SEQ ID NO: 506475 - RNA, 18 nt, Chlamydophila pneumoniae CWL029
gcgagaggggaaccaagg

SEQ ID NO: 506476 - RNA, 15 nt, Chlamydophila pneumoniae CWL029
gcgaagggaggagaa

SEQ ID NO: 506477 - RNA, 16 nt, Chlamydophila pneumoniae CWL029
gcgaagggaggagaac

SEQ ID NO: 506478 - RNA, 14 nt, Chlamydophila pneumoniae CWL029
gcgacaagacaaug

SEQ ID NO: 506479 - RNA, 16 nt, Chlamydophila pneumoniae CWL029
gcgacccauuugucuc

SEQ ID NO: 506480 - RNA, 13 nt, Chlamydophila pneumoniae CWL029
gccuuuuuuucua

SEQ ID NO: 506481 - RNA, 11 nt, Chlamydophila pneumoniae CWL029
gccuuuuucuu

SEQ ID NO: 506482 - RNA, 16 nt, Chlamydophila pneumoniae CWL029
gcgaaagucaaagggc

SEQ ID NO: 506483 - RNA, 18 nt, Chlamydophila pneumoniae CWL029
gccuuuagggaaaaagua

SEQ ID NO: 506484 - RNA, 13 nt, Chlamydophila pneumoniae CWL029
gccuuuuccuaaa

SEQ ID NO: 506485 - RNA, 11 nt, Chlamydophila pneumoniae CWL029
gccuuucucuu

SEQ ID NO: 506486 - RNA, 20 nt, Chlamydophila pneumoniae CWL029
gccuugauccuuuccaagaa

SEQ ID NO: 506487 - RNA, 17 nt, Chlamydophila pneumoniae CWL029
gccuugauugaacaguc

SEQ ID NO: 506488 - RNA, 19 nt, Chlamydophila pneumoniae CWL029
gccuuggguuugucuccaa

SEQ ID NO: 506489 - RNA, 17 nt, Chlamydophila pneumoniae CWL029
gccuuagcagcacccau

SEQ ID NO: 506490 - RNA, 23 nt, Chlamydophila pneumoniae CWL029
gccuguuuucuucuaccuguagc

SEQ ID NO: 506491 - RNA, 15 nt, Chlamydophila pneumoniae CWL029
gccuuacggccccug

SEQ ID NO: 506492 - RNA, 23 nt, Chlamydophila pneumoniae CWL029
gccuuccauaucuagaaguuuaa

SEQ ID NO: 506493 - RNA, 20 nt, Chlamydophila pneumoniae CWL029
gccuucagcaacuaaagcau

SEQ ID NO: 506494 - RNA, 20 nt, Chlamydophila pneumoniae CWL029
gccuuccuuaacaacaucac

SEQ ID NO: 506495 - RNA, 21 nt, Chlamydophila pneumoniae CWL029
gccugucuuaucuaaagaaau

SEQ ID NO: 506496 - RNA, 18 nt, Chlamydophila pneumoniae CWL029
gccuguaaagaaggaggu

SEQ ID NO: 506497 - RNA, 22 nt, Chlamydophila pneumoniae CWL029
gccuggaggcgguggcaugcca

SEQ ID NO: 506498 - RNA, 17 nt, Chlamydophila pneumoniae CWL029
gccuggaaagcuucugg

SEQ ID NO: 506499 - RNA, 23 nt, Chlamydophila pneumoniae CWL029
gccugaaaacaaggcaaaaaguu

SEQ ID NO: 506500 - RNA, 19 nt, Chlamydophila pneumoniae CWL029
gccugaaauccugggcaau

SEQ ID NO: 506501 - RNA, 16 nt, Chlamydophila pneumoniae CWL029
gccucuacccucugag

SEQ ID NO: 506502 - RNA, 18 nt, Chlamydophila pneumoniae CWL029
gccugaugucuccauaca

SEQ ID NO: 506503 - RNA, 16 nt, Chlamydophila pneumoniae CWL029
gccucgagcagaaacu

SEQ ID NO: 506504 - RNA, 17 nt, Chlamydophila pneumoniae CWL029
gccuccucaagauaaau

SEQ ID NO: 506505 - RNA, 15 nt, Chlamydophila pneumoniae CWL029
gccuccuucauucac

SEQ ID NO: 506506 - RNA, 12 nt, Chlamydophila pneumoniae CWL029
gccucauugccg

SEQ ID NO: 506507 - RNA, 17 nt, Chlamydophila pneumoniae CWL029
gccuauagauuccccaa

SEQ ID NO: 506508 - RNA, 12 nt, Chlamydophila pneumoniae CWL029
gccucacagaau

SEQ ID NO: 506509 - RNA, 23 nt, Chlamydophila pneumoniae CWL029
gccuaugggaggaauuccucuca

SEQ ID NO: 506510 - RNA, 14 nt, Chlamydophila pneumoniae CWL029
gccuaaucuuguag

SEQ ID NO: 506511 - RNA, 20 nt, Chlamydophila pneumoniae CWL029
gccuacaggcaaggagagcu

SEQ ID NO: 506512 - RNA, 13 nt, Chlamydophila pneumoniae CWL029
gccuaccaaaguu

SEQ ID NO: 506513 - RNA, 14 nt, Chlamydophila pneumoniae CWL029
gccgcauuucuuca

SEQ ID NO: 506514 - RNA, 21 nt, Chlamydophila pneumoniae CWL029
gccccaugaaucacagcgcug

SEQ ID NO: 506515 - RNA, 14 nt, Chlamydophila pneumoniae CWL029
gcccccaggcugca

SEQ ID NO: 506516 - RNA, 17 nt, Chlamydophila pneumoniae CWL029
gcccccuugcaccccau

SEQ ID NO: 506517 - RNA, 16 nt, Chlamydophila pneumoniae CWL029
gcccccucccccacca

SEQ ID NO: 506518 - RNA, 16 nt, Chlamydophila pneumoniae CWL029
gcccauaaaggcgucg

SEQ ID NO: 506519 - RNA, 18 nt, Chlamydophila pneumoniae CWL029
gcccagauucugaagaga

SEQ ID NO: 506520 - RNA, 22 nt, Chlamydophila pneumoniae CWL029
gccccuuaaagagaaucuccuc

SEQ ID NO: 506521 - RNA, 24 nt, Chlamydophila pneumoniae CWL029
gcccgacucaucuaacgucagcug

SEQ ID NO: 506522 - RNA, 21 nt, Chlamydophila pneumoniae CWL029
gcccucauccccucagaaagg

SEQ ID NO: 506523 - RNA, 15 nt, Chlamydophila pneumoniae CWL029
gccaguucuugaaac

SEQ ID NO: 506524 - RNA, 21 nt, Chlamydophila pneumoniae CWL029
gccaguucuugaaacucuauc

SEQ ID NO: 506525 - RNA, 13 nt, Chlamydophila pneumoniae CWL029
gccauaacacuuu

SEQ ID NO: 506526 - RNA, 21 nt, Chlamydophila pneumoniae CWL029
gccagcgaucacauagaaaac

SEQ ID NO: 506527 - RNA, 22 nt, Chlamydophila pneumoniae CWL029
gccagaauguacauagaggaga

SEQ ID NO: 506528 - RNA, 21 nt, Chlamydophila pneumoniae CWL029
gccacuaaguuuaggcaggaa

SEQ ID NO: 506529 - RNA, 22 nt, Chlamydophila pneumoniae CWL029
gccacuaaguuuaggcaggaag

SEQ ID NO: 506530 - RNA, 23 nt, Chlamydophila pneumoniae CWL029
gccaccuuggcuucuaucuuuac

SEQ ID NO: 506531 - RNA, 18 nt, Chlamydophila pneumoniae CWL029
gcauagagcucuaaaaaa

SEQ ID NO: 506532 - RNA, 17 nt, Chlamydophila pneumoniae CWL029
gcauagauacaaacauc

SEQ ID NO: 506533 - RNA, 21 nt, Chlamydophila pneumoniae CWL029
gcauagcaacuacagagggcu

SEQ ID NO: 506534 - RNA, 16 nt, Chlamydophila pneumoniae CWL029
gcauaggccaaucccu

SEQ ID NO: 506535 - RNA, 22 nt, Chlamydophila pneumoniae CWL029
gcauagccuuccauaucuagaa

SEQ ID NO: 506536 - RNA, 24 nt, Chlamydophila pneumoniae CWL029
gccacaucaaagcaauuucuccua

SEQ ID NO: 506537 - RNA, 15 nt, Chlamydophila pneumoniae CWL029
gccacaugaaguccu

SEQ ID NO: 506538 - RNA, 12 nt, Chlamydophila pneumoniae CWL029
uagaagacauuc

SEQ ID NO: 506539 - RNA, 12 nt, Chlamydophila pneumoniae CWL029
uagaagcugcug

SEQ ID NO: 506540 - RNA, 14 nt, Chlamydophila pneumoniae CWL029
uagaagcccgcagu

SEQ ID NO: 506541 - RNA, 21 nt, Chlamydophila pneumoniae CWL029
uagaagcaugaagcagaaacu

SEQ ID NO: 506542 - RNA, 23 nt, Chlamydophila pneumoniae CWL029
uagaagcauucucaauucuguau

SEQ ID NO: 506543 - RNA, 14 nt, Chlamydophila pneumoniae CWL029
uagaauaaagauuu

SEQ ID NO: 506544 - RNA, 16 nt, Chlamydophila pneumoniae CWL029
uagaauacacagcuau

SEQ ID NO: 506545 - RNA, 14 nt, Chlamydophila pneumoniae CWL029
uagaauuuguccuu

SEQ ID NO: 506546 - RNA, 12 nt, Chlamydophila pneumoniae CWL029
uagaauuuucuu

SEQ ID NO: 506547 - RNA, 21 nt, Chlamydophila pneumoniae CWL029
uagacaacaagucuucccucu

SEQ ID NO: 506548 - RNA, 15 nt, Chlamydophila pneumoniae CWL029
uagaaucacauaaaa

SEQ ID NO: 506549 - RNA, 16 nt, Chlamydophila pneumoniae CWL029
uagaaucacauaaaau

SEQ ID NO: 506550 - RNA, 23 nt, Chlamydophila pneumoniae CWL029
uagaaucagagggacuccuguga

SEQ ID NO: 506551 - RNA, 15 nt, Chlamydophila pneumoniae CWL029
uagaauccaaagacu

SEQ ID NO: 506552 - RNA, 16 nt, Chlamydophila pneumoniae CWL029
uagaauccaaagacuu

SEQ ID NO: 506553 - RNA, 13 nt, Chlamydophila pneumoniae CWL029
uagaauccucgga

SEQ ID NO: 506554 - RNA, 22 nt, Chlamydophila pneumoniae CWL029
uagaauccucggaagauaaauc

SEQ ID NO: 506555 - RNA, 12 nt, Chlamydophila pneumoniae CWL029
uagaauccucua

SEQ ID NO: 506556 - RNA, 14 nt, Chlamydophila pneumoniae CWL029
uagaauccuucucc

SEQ ID NO: 506557 - RNA, 21 nt, Chlamydophila pneumoniae CWL029
uagaaucucugcccccuguuu

SEQ ID NO: 506558 - RNA, 16 nt, Chlamydophila pneumoniae CWL029
uagaaucucugugcca

SEQ ID NO: 506559 - RNA, 22 nt, Chlamydophila pneumoniae CWL029
uagaaucucugugccaucugua

SEQ ID NO: 506560 - RNA, 13 nt, Chlamydophila pneumoniae CWL029
uagaaugaugcaa

SEQ ID NO: 506561 - RNA, 16 nt, Chlamydophila pneumoniae CWL029
uagaacacucagagau

SEQ ID NO: 506562 - RNA, 20 nt, Chlamydophila pneumoniae CWL029
uagaacagcauggacuccaa

SEQ ID NO: 506563 - RNA, 20 nt, Chlamydophila pneumoniae CWL029
uagaacauacacgucuaaga

SEQ ID NO: 506564 - RNA, 19 nt, Chlamydophila pneumoniae CWL029
uagaaaugaaacgaaagca

SEQ ID NO: 506565 - RNA, 14 nt, Chlamydophila pneumoniae CWL029
uagaaauucuaaga

SEQ ID NO: 506566 - RNA, 12 nt, Chlamydophila pneumoniae CWL029
uagaaagaccau

SEQ ID NO: 506567 - RNA, 16 nt, Chlamydophila pneumoniae CWL029
uagaaagacaaaaaau

SEQ ID NO: 506568 - RNA, 20 nt, Chlamydophila pneumoniae CWL029
uagaaauaagcaucuagaau

SEQ ID NO: 506569 - RNA, 15 nt, Chlamydophila pneumoniae CWL029
uagaaauauacucuu

SEQ ID NO: 506570 - RNA, 22 nt, Chlamydophila pneumoniae CWL029
uagaaauauacucuugcuugcu

SEQ ID NO: 506571 - RNA, 19 nt, Chlamydophila pneumoniae CWL029
uagaaaccaugaugcaaug

SEQ ID NO: 506572 - RNA, 19 nt, Chlamydophila pneumoniae CWL029
uagaaacauuuaagucauu

SEQ ID NO: 506573 - RNA, 20 nt, Chlamydophila pneumoniae CWL029
uagaaacaacugaaaaacca

SEQ ID NO: 506574 - RNA, 12 nt, Chlamydophila pneumoniae CWL029
uacuaucgguuu

SEQ ID NO: 506575 - RNA, 18 nt, Chlamydophila pneumoniae CWL029
uagagccucuaagaaaau

SEQ ID NO: 506576 - RNA, 14 nt, Chlamydophila pneumoniae CWL029
uagagccuugcagc

SEQ ID NO: 506577 - RNA, 11 nt, Chlamydophila pneumoniae CWL029
uagagccuaga

SEQ ID NO: 506578 - RNA, 17 nt, Chlamydophila pneumoniae CWL029
uagagccucuaagaaaa

SEQ ID NO: 506579 - RNA, 17 nt, Chlamydophila pneumoniae CWL029
uagagcgaauguagcca

SEQ ID NO: 506580 - RNA, 12 nt, Chlamydophila pneumoniae CWL029
uagagcuagaau

SEQ ID NO: 506581 - RNA, 16 nt, Chlamydophila pneumoniae CWL029
uagaggccuuuuagag

SEQ ID NO: 506582 - RNA, 17 nt, Chlamydophila pneumoniae CWL029
uagaggguccagggucu

SEQ ID NO: 506583 - RNA, 18 nt, Chlamydophila pneumoniae CWL029
uagaggaaguguuucuuu

SEQ ID NO: 506584 - RNA, 19 nt, Chlamydophila pneumoniae CWL029
uagagcuucaaguuucuuu

SEQ ID NO: 506585 - RNA, 20 nt, Chlamydophila pneumoniae CWL029
uagagaucuuuuuauuaaaa

SEQ ID NO: 506586 - RNA, 18 nt, Chlamydophila pneumoniae CWL029
uagagauuguaauuuccu

SEQ ID NO: 506587 - RNA, 19 nt, Chlamydophila pneumoniae CWL029
uagagagaaggaauuaaaa

SEQ ID NO: 506588 - RNA, 23 nt, Chlamydophila pneumoniae CWL029
uagagagagucggcuuuagaaaa

SEQ ID NO: 506589 - RNA, 17 nt, Chlamydophila pneumoniae CWL029
uagagagcgcagagucu

SEQ ID NO: 506590 - RNA, 22 nt, Chlamydophila pneumoniae CWL029
uagagcaucauaaagugcgagg

SEQ ID NO: 506591 - RNA, 19 nt, Chlamydophila pneumoniae CWL029
uagagcaagauucuucaga

SEQ ID NO: 506592 - RNA, 13 nt, Chlamydophila pneumoniae CWL029
uagagauuuuucu

SEQ ID NO: 506593 - RNA, 19 nt, Chlamydophila pneumoniae CWL029
uagagauuuuucuaggaau

SEQ ID NO: 506594 - RNA, 17 nt, Chlamydophila pneumoniae CWL029
uagagcacauagaaaca

SEQ ID NO: 506595 - RNA, 18 nt, Chlamydophila pneumoniae CWL029
uagagcacauagaaacag

SEQ ID NO: 506596 - RNA, 16 nt, Chlamydophila pneumoniae CWL029
uagaguugcuuuaugg

SEQ ID NO: 506597 - RNA, 16 nt, Chlamydophila pneumoniae CWL029
uagagugacucaucag

SEQ ID NO: 506598 - RNA, 16 nt, Chlamydophila pneumoniae CWL029
uagagugucuuccuug

SEQ ID NO: 506599 - RNA, 14 nt, Chlamydophila pneumoniae CWL029
uagagucucuuuca

SEQ ID NO: 506600 - RNA, 15 nt, Chlamydophila pneumoniae CWL029
uagaguccacaguca

SEQ ID NO: 506601 - RNA, 16 nt, Chlamydophila pneumoniae CWL029
uagaguccacagucau

SEQ ID NO: 506602 - RNA, 19 nt, Chlamydophila pneumoniae CWL029
uagaguccacagucauaaa

SEQ ID NO: 506603 - RNA, 16 nt, Chlamydophila pneumoniae CWL029
uagagggauuuguagg

SEQ ID NO: 506604 - RNA, 18 nt, Chlamydophila pneumoniae CWL029
uagacaggauggaaucag

SEQ ID NO: 506605 - RNA, 12 nt, Chlamydophila pneumoniae CWL029
uagacaagacac

SEQ ID NO: 506606 - RNA, 14 nt, Chlamydophila pneumoniae CWL029
uagacaagagagag

SEQ ID NO: 506607 - RNA, 16 nt, Chlamydophila pneumoniae CWL029
uagacaagagagagcu

SEQ ID NO: 506608 - RNA, 18 nt, Chlamydophila pneumoniae CWL029
uagacaacgcaggaagaa

SEQ ID NO: 506609 - RNA, 19 nt, Chlamydophila pneumoniae CWL029
uagacaauaccagauaaag

SEQ ID NO: 506610 - RNA, 23 nt, Chlamydophila pneumoniae CWL029
uagacacgaccacuacuuaaagc

SEQ ID NO: 506611 - RNA, 22 nt, Chlamydophila pneumoniae CWL029
uagacacuugcuuaaggaaaca

SEQ ID NO: 506612 - RNA, 19 nt, Chlamydophila pneumoniae CWL029
uagaccaauaaauccaaaa

SEQ ID NO: 506613 - RNA, 20 nt, Chlamydophila pneumoniae CWL029
uagacaugcgaagggaggag

SEQ ID NO: 506614 - RNA, 18 nt, Chlamydophila pneumoniae CWL029
uagacucucacugagugu

SEQ ID NO: 506615 - RNA, 16 nt, Chlamydophila pneumoniae CWL029
uagagacagccuguuu

SEQ ID NO: 506616 - RNA, 13 nt, Chlamydophila pneumoniae CWL029
uagagacaucgua

SEQ ID NO: 506617 - RNA, 13 nt, Chlamydophila pneumoniae CWL029
uagagaagaggug

SEQ ID NO: 506618 - RNA, 22 nt, Chlamydophila pneumoniae CWL029
uagagaaauuuuuaauuuuucu

SEQ ID NO: 506619 - RNA, 18 nt, Chlamydophila pneumoniae CWL029
uagagaacgaacaguuca

SEQ ID NO: 506620 - RNA, 23 nt, Chlamydophila pneumoniae CWL029
uagagaaagagugccaagagcau

SEQ ID NO: 506621 - RNA, 16 nt, Chlamydophila pneumoniae CWL029
uagacuuguauucuug

SEQ ID NO: 506622 - RNA, 19 nt, Chlamydophila pneumoniae CWL029
uagacuuguauucuugaga

SEQ ID NO: 506623 - RNA, 21 nt, Chlamydophila pneumoniae CWL029
uagacuuguauucuugagagu

SEQ ID NO: 506624 - RNA, 18 nt, Chlamydophila pneumoniae CWL029
uaggguuugcaugccuau

SEQ ID NO: 506625 - RNA, 13 nt, Chlamydophila pneumoniae CWL029
uaggguucucaaa

SEQ ID NO: 506626 - RNA, 21 nt, Chlamydophila pneumoniae CWL029
uaggguuugcaugccuauuaa

SEQ ID NO: 506627 - RNA, 16 nt, Chlamydophila pneumoniae CWL029
uaggguagccauccac

SEQ ID NO: 506628 - RNA, 23 nt, Chlamydophila pneumoniae CWL029
uagggguagugaucugcagcaag

SEQ ID NO: 506629 - RNA, 16 nt, Chlamydophila pneumoniae CWL029
uaggguaaagaaauau

SEQ ID NO: 506630 - RNA, 23 nt, Chlamydophila pneumoniae CWL029
uaggggaauuaaacuuucuucuc

SEQ ID NO: 506631 - RNA, 18 nt, Chlamydophila pneumoniae CWL029
uagggcaggcggaaagga

SEQ ID NO: 506632 - RNA, 22 nt, Chlamydophila pneumoniae CWL029
uagggcaggcggaaaggaagga

SEQ ID NO: 506633 - RNA, 18 nt, Chlamydophila pneumoniae CWL029
uagggacuucucaaagac

SEQ ID NO: 506634 - RNA, 15 nt, Chlamydophila pneumoniae CWL029
uagggaauuucggac

SEQ ID NO: 506635 - RNA, 20 nt, Chlamydophila pneumoniae CWL029
uaggaucccugauuccuugg

SEQ ID NO: 506636 - RNA, 13 nt, Chlamydophila pneumoniae CWL029
uaggaucucucuu

SEQ ID NO: 506637 - RNA, 16 nt, Chlamydophila pneumoniae CWL029
uaggaucugacuuccc

SEQ ID NO: 506638 - RNA, 14 nt, Chlamydophila pneumoniae CWL029
uaggauccaggagu

SEQ ID NO: 506639 - RNA, 23 nt, Chlamydophila pneumoniae CWL029
uaggaagaugaauaccagaagca

SEQ ID NO: 506640 - RNA, 18 nt, Chlamydophila pneumoniae CWL029
uaggaagcucuucuacuu

SEQ ID NO: 506641 - RNA, 17 nt, Chlamydophila pneumoniae CWL029
uaggaacucacaaacaa

SEQ ID NO: 506642 - RNA, 16 nt, Chlamydophila pneumoniae CWL029
uaggaacaugccaaau

SEQ ID NO: 506643 - RNA, 16 nt, Chlamydophila pneumoniae CWL029
uaggagcauagacucu

SEQ ID NO: 506644 - RNA, 13 nt, Chlamydophila pneumoniae CWL029
uaggaaucuuuua

SEQ ID NO: 506645 - RNA, 16 nt, Chlamydophila pneumoniae CWL029
uaggaaucuuuuagag

SEQ ID NO: 506646 - RNA, 18 nt, Chlamydophila pneumoniae CWL029
uaggaaugauaaugcagg

SEQ ID NO: 506647 - RNA, 21 nt, Chlamydophila pneumoniae CWL029
uaggagggguaaaccaauuga

SEQ ID NO: 506648 - RNA, 17 nt, Chlamydophila pneumoniae CWL029
uaggauaagaaauuaaa

SEQ ID NO: 506649 - RNA, 21 nt, Chlamydophila pneumoniae CWL029
uaggauagaggccuuuuagag

SEQ ID NO: 506650 - RNA, 19 nt, Chlamydophila pneumoniae CWL029
uagcgacgacgacgccuag

SEQ ID NO: 506651 - RNA, 20 nt, Chlamydophila pneumoniae CWL029
uagcucaucuagaaagauuu

SEQ ID NO: 506652 - RNA, 22 nt, Chlamydophila pneumoniae CWL029
uagcucagcucuaauucuucua

SEQ ID NO: 506653 - RNA, 16 nt, Chlamydophila pneumoniae CWL029
uagcucaggaaaacuu

SEQ ID NO: 506654 - RNA, 20 nt, Chlamydophila pneumoniae CWL029
uagcucauuaucaagaaauu

SEQ ID NO: 506655 - RNA, 16 nt, Chlamydophila pneumoniae CWL029
uagcucccguuccuuu

SEQ ID NO: 506656 - RNA, 18 nt, Chlamydophila pneumoniae CWL029
uagcucaaaucucauucc

SEQ ID NO: 506657 - RNA, 13 nt, Chlamydophila pneumoniae CWL029
uagcuaagagcau

SEQ ID NO: 506658 - RNA, 20 nt, Chlamydophila pneumoniae CWL029
uagcucuuugggauaaaaag

SEQ ID NO: 506659 - RNA, 22 nt, Chlamydophila pneumoniae CWL029
uagcucuugcgaacuauccuaa

SEQ ID NO: 506660 - RNA, 19 nt, Chlamydophila pneumoniae CWL029
uagcucguuauauuuuucu

SEQ ID NO: 506661 - RNA, 15 nt, Chlamydophila pneumoniae CWL029
uagcucucuccugga

SEQ ID NO: 506662 - RNA, 12 nt, Chlamydophila pneumoniae CWL029
uagcugcucuuu

SEQ ID NO: 506663 - RNA, 18 nt, Chlamydophila pneumoniae CWL029
uagcugcucuuuuagaau

SEQ ID NO: 506664 - RNA, 18 nt, Chlamydophila pneumoniae CWL029
uagcuuuuaguuucccac

SEQ ID NO: 506665 - RNA, 20 nt, Chlamydophila pneumoniae CWL029
uagcaaugccuacaguagcu

SEQ ID NO: 506666 - RNA, 16 nt, Chlamydophila pneumoniae CWL029
uagcaaugauguuuuu

SEQ ID NO: 506667 - RNA, 17 nt, Chlamydophila pneumoniae CWL029
uagcaagcgcuagugca

SEQ ID NO: 506668 - RNA, 18 nt, Chlamydophila pneumoniae CWL029
uagaucccucaagcgauu

SEQ ID NO: 506669 - RNA, 16 nt, Chlamydophila pneumoniae CWL029
uagcaaguagcucucu

SEQ ID NO: 506670 - RNA, 13 nt, Chlamydophila pneumoniae CWL029
uagauaugccuca

SEQ ID NO: 506671 - RNA, 19 nt, Chlamydophila pneumoniae CWL029
uagauccuauaguaauuuc

SEQ ID NO: 506672 - RNA, 22 nt, Chlamydophila pneumoniae CWL029
uagauccuauaguaauuucucc

SEQ ID NO: 506673 - RNA, 13 nt, Chlamydophila pneumoniae CWL029
uagaucacaucaa

SEQ ID NO: 506674 - RNA, 15 nt, Chlamydophila pneumoniae CWL029
uagaucccagaagaa

SEQ ID NO: 506675 - RNA, 17 nt, Chlamydophila pneumoniae CWL029
uagauccccuucauucu

SEQ ID NO: 506676 - RNA, 21 nt, Chlamydophila pneumoniae CWL029
uagauccccuucauucuuucg

SEQ ID NO: 506677 - RNA, 13 nt, Chlamydophila pneumoniae CWL029
uagccaaagacuc

SEQ ID NO: 506678 - RNA, 20 nt, Chlamydophila pneumoniae CWL029
uagcauaaucuuuaacaaag

SEQ ID NO: 506679 - RNA, 13 nt, Chlamydophila pneumoniae CWL029
uagcauacaucgu

SEQ ID NO: 506680 - RNA, 19 nt, Chlamydophila pneumoniae CWL029
uagcauacgacaguaauga

SEQ ID NO: 506681 - RNA, 17 nt, Chlamydophila pneumoniae CWL029
uagcauaggcuaagacu

SEQ ID NO: 506682 - RNA, 15 nt, Chlamydophila pneumoniae CWL029
uagcaccuaauaaag

SEQ ID NO: 506683 - RNA, 22 nt, Chlamydophila pneumoniae CWL029
uagcagaaguccuaucaaagca

SEQ ID NO: 506684 - RNA, 14 nt, Chlamydophila pneumoniae CWL029
uagcaguauagaga

SEQ ID NO: 506685 - RNA, 22 nt, Chlamydophila pneumoniae CWL029
uagccguaggguagccauccac

SEQ ID NO: 506686 - RNA, 23 nt, Chlamydophila pneumoniae CWL029
uagccuuacggccccuggaauuu

SEQ ID NO: 506687 - RNA, 14 nt, Chlamydophila pneumoniae CWL029
uagcgaaagucaaa

SEQ ID NO: 506688 - RNA, 12 nt, Chlamydophila pneumoniae CWL029
uagccauagugu

SEQ ID NO: 506689 - RNA, 23 nt, Chlamydophila pneumoniae CWL029
uagccauggcaucuaagccagag

SEQ ID NO: 506690 - RNA, 19 nt, Chlamydophila pneumoniae CWL029
uagccauuagaaucucugc

SEQ ID NO: 506691 - RNA, 14 nt, Chlamydophila pneumoniae CWL029
uaucuguuaaaaac

SEQ ID NO: 506692 - RNA, 19 nt, Chlamydophila pneumoniae CWL029
uaucuguuaaaaacaagau

SEQ ID NO: 506693 - RNA, 19 nt, Chlamydophila pneumoniae CWL029
uaucuguauccuuccuuau

SEQ ID NO: 506694 - RNA, 22 nt, Chlamydophila pneumoniae CWL029
uaucuauccuuaggugaaauau

SEQ ID NO: 506695 - RNA, 21 nt, Chlamydophila pneumoniae CWL029
uaucucuguuuuuugaaaacu

SEQ ID NO: 506696 - RNA, 14 nt, Chlamydophila pneumoniae CWL029
uaucucuuaaaaua

SEQ ID NO: 506697 - RNA, 20 nt, Chlamydophila pneumoniae CWL029
uaucucuggcauaauccuga

SEQ ID NO: 506698 - RNA, 15 nt, Chlamydophila pneumoniae CWL029
uaucuacagcuauag

SEQ ID NO: 506699 - RNA, 17 nt, Chlamydophila pneumoniae CWL029
uaucuacacaguagccu

SEQ ID NO: 506700 - RNA, 13 nt, Chlamydophila pneumoniae CWL029
uaucuaauaaaau

SEQ ID NO: 506701 - RNA, 19 nt, Chlamydophila pneumoniae CWL029
uaucuagggacuucucaaa

SEQ ID NO: 506702 - RNA, 14 nt, Chlamydophila pneumoniae CWL029
uaucuaaagaaaug

SEQ ID NO: 506703 - RNA, 15 nt, Chlamydophila pneumoniae CWL029
uaucuaaagaaaugu

SEQ ID NO: 506704 - RNA, 18 nt, Chlamydophila pneumoniae CWL029
uaucgacuguacaaaugc

SEQ ID NO: 506705 - RNA, 21 nt, Chlamydophila pneumoniae CWL029
uaucaugcaauacuuuucucc

SEQ ID NO: 506706 - RNA, 23 nt, Chlamydophila pneumoniae CWL029
uauccagcucaaggcaucuagag

SEQ ID NO: 506707 - RNA, 16 nt, Chlamydophila pneumoniae CWL029
uaucauggacaagcaa

SEQ ID NO: 506708 - RNA, 14 nt, Chlamydophila pneumoniae CWL029
uaucaucaaaagau

SEQ ID NO: 506709 - RNA, 22 nt, Chlamydophila pneumoniae CWL029
uaucaucaaugguuaaaaccca

SEQ ID NO: 506710 - RNA, 18 nt, Chlamydophila pneumoniae CWL029
uauccuugaaauugcucu

SEQ ID NO: 506711 - RNA, 22 nt, Chlamydophila pneumoniae CWL029
uauccuugaaauugcucuugcu

SEQ ID NO: 506712 - RNA, 19 nt, Chlamydophila pneumoniae CWL029
uauccuugauuuuaaaaug

SEQ ID NO: 506713 - RNA, 16 nt, Chlamydophila pneumoniae CWL029
uaucgaccuuaaaauu

SEQ ID NO: 506714 - RNA, 14 nt, Chlamydophila pneumoniae CWL029
uauauagagcagac

SEQ ID NO: 506715 - RNA, 15 nt, Chlamydophila pneumoniae CWL029
uauauauaagaucuu

SEQ ID NO: 506716 - RNA, 20 nt, Chlamydophila pneumoniae CWL029
uauagguuaagccaaucccu

SEQ ID NO: 506717 - RNA, 17 nt, Chlamydophila pneumoniae CWL029
uauaggcugcacacauc

SEQ ID NO: 506718 - RNA, 19 nt, Chlamydophila pneumoniae CWL029
uauaggcgugugaaaucug

SEQ ID NO: 506719 - RNA, 16 nt, Chlamydophila pneumoniae CWL029
uauagcguacaggaag

SEQ ID NO: 506720 - RNA, 22 nt, Chlamydophila pneumoniae CWL029
uauaggaauaacaccaaaagaa

SEQ ID NO: 506721 - RNA, 12 nt, Chlamydophila pneumoniae CWL029
uauauugacaac

SEQ ID NO: 506722 - RNA, 11 nt, Chlamydophila pneumoniae CWL029
uaucaauaaug

SEQ ID NO: 506723 - RNA, 16 nt, Chlamydophila pneumoniae CWL029
uauauuggcuuucuac

SEQ ID NO: 506724 - RNA, 22 nt, Chlamydophila pneumoniae CWL029
uaucagggagcggaauuucuca

SEQ ID NO: 506725 - RNA, 19 nt, Chlamydophila pneumoniae CWL029
uaucaguauggcguuuuuu

SEQ ID NO: 506726 - RNA, 16 nt, Chlamydophila pneumoniae CWL029
uauacaucccauucaa

SEQ ID NO: 506727 - RNA, 21 nt, Chlamydophila pneumoniae CWL029
uauacaguuggcguuuucuag

SEQ ID NO: 506728 - RNA, 19 nt, Chlamydophila pneumoniae CWL029
uauacaaccacuuccugca

SEQ ID NO: 506729 - RNA, 16 nt, Chlamydophila pneumoniae CWL029
uauacaagcgaaagca

SEQ ID NO: 506730 - RNA, 18 nt, Chlamydophila pneumoniae CWL029
uauaauugacguagacga

SEQ ID NO: 506731 - RNA, 19 nt, Chlamydophila pneumoniae CWL029
uauacguaauccagauugu

SEQ ID NO: 506732 - RNA, 16 nt, Chlamydophila pneumoniae CWL029
uauacgucccacaaaa

SEQ ID NO: 506733 - RNA, 21 nt, Chlamydophila pneumoniae CWL029
uauaccaccccaaagcagauc

SEQ ID NO: 506734 - RNA, 15 nt, Chlamydophila pneumoniae CWL029
uauacuuauaccacc

SEQ ID NO: 506735 - RNA, 15 nt, Chlamydophila pneumoniae CWL029
uauacuguuuuucuu

SEQ ID NO: 506736 - RNA, 21 nt, Chlamydophila pneumoniae CWL029
uauacuguuuuucuuccacac

SEQ ID NO: 506737 - RNA, 18 nt, Chlamydophila pneumoniae CWL029
uauagagaauacauugcu

SEQ ID NO: 506738 - RNA, 13 nt, Chlamydophila pneumoniae CWL029
uauagacaaugca

SEQ ID NO: 506739 - RNA, 17 nt, Chlamydophila pneumoniae CWL029
uauagaagcugcugcua

SEQ ID NO: 506740 - RNA, 18 nt, Chlamydophila pneumoniae CWL029
uauagcauuauucccuaa

SEQ ID NO: 506741 - RNA, 22 nt, Chlamydophila pneumoniae CWL029
uauagauacguaguccuuauuu

SEQ ID NO: 506742 - RNA, 17 nt, Chlamydophila pneumoniae CWL029
uauagauaugccucagg

SEQ ID NO: 506743 - RNA, 14 nt, Chlamydophila pneumoniae CWL029
uauagaucuugaaa

SEQ ID NO: 506744 - RNA, 14 nt, Chlamydophila pneumoniae CWL029
uaguuacugaggaa

SEQ ID NO: 506745 - RNA, 12 nt, Chlamydophila pneumoniae CWL029
uaguuagagaag

SEQ ID NO: 506746 - RNA, 15 nt, Chlamydophila pneumoniae CWL029
uaguuagcauugcuu

SEQ ID NO: 506747 - RNA, 22 nt, Chlamydophila pneumoniae CWL029
uaguguuucuuuaucuaaccaa

SEQ ID NO: 506748 - RNA, 13 nt, Chlamydophila pneumoniae CWL029
uaguguugaauaa

SEQ ID NO: 506749 - RNA, 16 nt, Chlamydophila pneumoniae CWL029
uaguggucaauugcau

SEQ ID NO: 506750 - RNA, 16 nt, Chlamydophila pneumoniae CWL029
uaguguauaucagcaa

SEQ ID NO: 506751 - RNA, 15 nt, Chlamydophila pneumoniae CWL029
uagucuuucaaccuc

SEQ ID NO: 506752 - RNA, 14 nt, Chlamydophila pneumoniae CWL029
uagucuuucuaaga

SEQ ID NO: 506753 - RNA, 15 nt, Chlamydophila pneumoniae CWL029
uagucuuucuaagaa

SEQ ID NO: 506754 - RNA, 21 nt, Chlamydophila pneumoniae CWL029
uagugaacuuuuguacacaga

SEQ ID NO: 506755 - RNA, 21 nt, Chlamydophila pneumoniae CWL029
uagugaagcugcuucuucaga

SEQ ID NO: 506756 - RNA, 18 nt, Chlamydophila pneumoniae CWL029
uagucuggcauaagucac

SEQ ID NO: 506757 - RNA, 14 nt, Chlamydophila pneumoniae CWL029
uagucguuuucucg

SEQ ID NO: 506758 - RNA, 18 nt, Chlamydophila pneumoniae CWL029
uagucgucuuuuaaagag

SEQ ID NO: 506759 - RNA, 24 nt, Chlamydophila pneumoniae CWL029
uagguaaggaaacgauuucuucuu

SEQ ID NO: 506760 - RNA, 17 nt, Chlamydophila pneumoniae CWL029
uagguagauagaaauuc

SEQ ID NO: 506761 - RNA, 18 nt, Chlamydophila pneumoniae CWL029
uagguagguuguuguuga

SEQ ID NO: 506762 - RNA, 23 nt, Chlamydophila pneumoniae CWL029
uagguaucagcaagaucuaacuu

SEQ ID NO: 506763 - RNA, 17 nt, Chlamydophila pneumoniae CWL029
uauaaauaauuacaauu

SEQ ID NO: 506764 - RNA, 15 nt, Chlamydophila pneumoniae CWL029
uaguuuucuucuuua

SEQ ID NO: 506765 - RNA, 18 nt, Chlamydophila pneumoniae CWL029
uaguuuuuauuuuuaaau

SEQ ID NO: 506766 - RNA, 11 nt, Chlamydophila pneumoniae CWL029
uaguuuucaua

SEQ ID NO: 506767 - RNA, 14 nt, Chlamydophila pneumoniae CWL029
uaguuuguuuuaau

SEQ ID NO: 506768 - RNA, 14 nt, Chlamydophila pneumoniae CWL029
uaguuauuaauaaa

SEQ ID NO: 506769 - RNA, 16 nt, Chlamydophila pneumoniae CWL029
uaguuucacauaguuu

SEQ ID NO: 506770 - RNA, 18 nt, Chlamydophila pneumoniae CWL029
uaguuucccacuagcccu

SEQ ID NO: 506771 - RNA, 18 nt, Chlamydophila pneumoniae CWL029
uacgacgaaguuagcuaa

SEQ ID NO: 506772 - RNA, 19 nt, Chlamydophila pneumoniae CWL029
uaccuguacgguaaaucca

SEQ ID NO: 506773 - RNA, 14 nt, Chlamydophila pneumoniae CWL029
uaccuguagcuaca

SEQ ID NO: 506774 - RNA, 16 nt, Chlamydophila pneumoniae CWL029
uaccuguagcuacaga

SEQ ID NO: 506775 - RNA, 19 nt, Chlamydophila pneumoniae CWL029
uaccuuaguuuuuucuaag

SEQ ID NO: 506776 - RNA, 13 nt, Chlamydophila pneumoniae CWL029
uacgacagaagua

SEQ ID NO: 506777 - RNA, 19 nt, Chlamydophila pneumoniae CWL029
uacgaccaacuccucaaaa

SEQ ID NO: 506778 - RNA, 16 nt, Chlamydophila pneumoniae CWL029
uacgcaaguaaagaaa

SEQ ID NO: 506779 - RNA, 18 nt, Chlamydophila pneumoniae CWL029
uacgcaaguaaagaaauu

SEQ ID NO: 506780 - RNA, 20 nt, Chlamydophila pneumoniae CWL029
uacgcaaguaaagaaauucu

SEQ ID NO: 506781 - RNA, 15 nt, Chlamydophila pneumoniae CWL029
uacgcaaguaaagaa

SEQ ID NO: 506782 - RNA, 15 nt, Chlamydophila pneumoniae CWL029
uacgcaaaguacuaa

SEQ ID NO: 506783 - RNA, 13 nt, Chlamydophila pneumoniae CWL029
uacuacucucauc

SEQ ID NO: 506784 - RNA, 15 nt, Chlamydophila pneumoniae CWL029
uacuacuuacaagaa

SEQ ID NO: 506785 - RNA, 17 nt, Chlamydophila pneumoniae CWL029
uacuacuuacaagaaca

SEQ ID NO: 506786 - RNA, 19 nt, Chlamydophila pneumoniae CWL029
uacuaaauuaguaaaugcc

SEQ ID NO: 506787 - RNA, 22 nt, Chlamydophila pneumoniae CWL029
uacuaaagaaagagucucacuc

SEQ ID NO: 506788 - RNA, 16 nt, Chlamydophila pneumoniae CWL029
uacuaaaggugaaagu

SEQ ID NO: 506789 - RNA, 17 nt, Chlamydophila pneumoniae CWL029
uacguuggacugcaaga

SEQ ID NO: 506790 - RNA, 22 nt, Chlamydophila pneumoniae CWL029
uacguugguucaaauccagcca

SEQ ID NO: 506791 - RNA, 15 nt, Chlamydophila pneumoniae CWL029
uacgugaucaaaauu

SEQ ID NO: 506792 - RNA, 14 nt, Chlamydophila pneumoniae CWL029
uacgcuuuuuacug

SEQ ID NO: 506793 - RNA, 16 nt, Chlamydophila pneumoniae CWL029
uacgcuuuucuucuuu

SEQ ID NO: 506794 - RNA, 12 nt, Chlamydophila pneumoniae CWL029
uacgcucuccau

SEQ ID NO: 506795 - RNA, 17 nt, Chlamydophila pneumoniae CWL029
uaccaucgucuccaaaa

SEQ ID NO: 506796 - RNA, 21 nt, Chlamydophila pneumoniae CWL029
uaccacagcuguacagaacaa

SEQ ID NO: 506797 - RNA, 23 nt, Chlamydophila pneumoniae CWL029
uaccucuccgucauauuuaaaag

SEQ ID NO: 506798 - RNA, 20 nt, Chlamydophila pneumoniae CWL029
uaccugcauucauaaaaaug

SEQ ID NO: 506799 - RNA, 21 nt, Chlamydophila pneumoniae CWL029
uaccucaucucuggaauacau

SEQ ID NO: 506800 - RNA, 17 nt, Chlamydophila pneumoniae CWL029
uaccgacaagcaucauu

SEQ ID NO: 506801 - RNA, 14 nt, Chlamydophila pneumoniae CWL029
uacaggcaaggaga

SEQ ID NO: 506802 - RNA, 15 nt, Chlamydophila pneumoniae CWL029
uacaucagacugaag

SEQ ID NO: 506803 - RNA, 15 nt, Chlamydophila pneumoniae CWL029
uacaucaaaaugcug

SEQ ID NO: 506804 - RNA, 22 nt, Chlamydophila pneumoniae CWL029
uacauagggaaaguucaguaaa

SEQ ID NO: 506805 - RNA, 21 nt, Chlamydophila pneumoniae CWL029
uacauaguuuuuauuuuuaaa

SEQ ID NO: 506806 - RNA, 21 nt, Chlamydophila pneumoniae CWL029
uacaucguauccaaauugcaa

SEQ ID NO: 506807 - RNA, 13 nt, Chlamydophila pneumoniae CWL029
uacaucuaacucu

SEQ ID NO: 506808 - RNA, 18 nt, Chlamydophila pneumoniae CWL029
uacauccucacuagagau

SEQ ID NO: 506809 - RNA, 19 nt, Chlamydophila pneumoniae CWL029
uacaucaucagaagcuccu

SEQ ID NO: 506810 - RNA, 17 nt, Chlamydophila pneumoniae CWL029
uacaucuucuuggcuuu

SEQ ID NO: 506811 - RNA, 19 nt, Chlamydophila pneumoniae CWL029
uacaucuucuuggcuuucc

SEQ ID NO: 506812 - RNA, 17 nt, Chlamydophila pneumoniae CWL029
uacaucuuaagagcaaa

SEQ ID NO: 506813 - RNA, 21 nt, Chlamydophila pneumoniae CWL029
uaccaaccuucgauuccaggc

SEQ ID NO: 506814 - RNA, 21 nt, Chlamydophila pneumoniae CWL029
uaccaagaugaagaaacuugu

SEQ ID NO: 506815 - RNA, 15 nt, Chlamydophila pneumoniae CWL029
uacauucgcaagaau

SEQ ID NO: 506816 - RNA, 23 nt, Chlamydophila pneumoniae CWL029
uacauucgcaagaaugaugcaua

SEQ ID NO: 506817 - RNA, 14 nt, Chlamydophila pneumoniae CWL029
uacauuugcuauuu

SEQ ID NO: 506818 - RNA, 22 nt, Chlamydophila pneumoniae CWL029
uacauuugauucauaaagagga

SEQ ID NO: 506819 - RNA, 20 nt, Chlamydophila pneumoniae CWL029
uacagacaagcaaggaaaaa

SEQ ID NO: 506820 - RNA, 23 nt, Chlamydophila pneumoniae CWL029
uacagacaagcaaggaaaaaaaa

SEQ ID NO: 506821 - RNA, 21 nt, Chlamydophila pneumoniae CWL029
uacagaaagagcuaaagaaac

SEQ ID NO: 506822 - RNA, 22 nt, Chlamydophila pneumoniae CWL029
uacagaaagagcuaaagaaacu

SEQ ID NO: 506823 - RNA, 21 nt, Chlamydophila pneumoniae CWL029
uacagaaaggaccuccucaca

SEQ ID NO: 506824 - RNA, 15 nt, Chlamydophila pneumoniae CWL029
uacacagcacaagaa

SEQ ID NO: 506825 - RNA, 20 nt, Chlamydophila pneumoniae CWL029
uacacacacgccaaugggaa

SEQ ID NO: 506826 - RNA, 12 nt, Chlamydophila pneumoniae CWL029
uacaauuugcuc

SEQ ID NO: 506827 - RNA, 17 nt, Chlamydophila pneumoniae CWL029
uacaauuugcuccucca

SEQ ID NO: 506828 - RNA, 21 nt, Chlamydophila pneumoniae CWL029
uacaauuugcuccuccaaaag

SEQ ID NO: 506829 - RNA, 22 nt, Chlamydophila pneumoniae CWL029
uacagagggaauuucauguccu

SEQ ID NO: 506830 - RNA, 18 nt, Chlamydophila pneumoniae CWL029
uacagaccguccucccca

SEQ ID NO: 506831 - RNA, 22 nt, Chlamydophila pneumoniae CWL029
uacagacugaagucguuuagau

SEQ ID NO: 506832 - RNA, 22 nt, Chlamydophila pneumoniae CWL029
uacagagagaaacuuaguuuug

SEQ ID NO: 506833 - RNA, 14 nt, Chlamydophila pneumoniae CWL029
uacagauaucaaag

SEQ ID NO: 506834 - RNA, 20 nt, Chlamydophila pneumoniae CWL029
uacagaucaggauucuaaaa

SEQ ID NO: 506835 - RNA, 21 nt, Chlamydophila pneumoniae CWL029
uacagaucaggauucuaaaaa

SEQ ID NO: 506836 - RNA, 23 nt, Chlamydophila pneumoniae CWL029
uacagaucaggauucuaaaaaga

SEQ ID NO: 506837 - RNA, 15 nt, Chlamydophila pneumoniae CWL029
uacagaucugcauaa

SEQ ID NO: 506838 - RNA, 18 nt, Chlamydophila pneumoniae CWL029
uacagauuucuucuucag

SEQ ID NO: 506839 - RNA, 19 nt, Chlamydophila pneumoniae CWL029
uacagauucaccaagaaca

SEQ ID NO: 506840 - RNA, 19 nt, Chlamydophila pneumoniae CWL029
uacagagggcuucauuccu

SEQ ID NO: 506841 - RNA, 20 nt, Chlamydophila pneumoniae CWL029
uacaaugaagucuucuuucc

SEQ ID NO: 506842 - RNA, 18 nt, Chlamydophila pneumoniae CWL029
uacaaucucgcuauucca

SEQ ID NO: 506843 - RNA, 17 nt, Chlamydophila pneumoniae CWL029
uacaaucucuagggaua

SEQ ID NO: 506844 - RNA, 22 nt, Chlamydophila pneumoniae CWL029
uacaaucucuagggauaauuaa

SEQ ID NO: 506845 - RNA, 18 nt, Chlamydophila pneumoniae CWL029
uacaaucccgaguccuaa

SEQ ID NO: 506846 - RNA, 12 nt, Chlamydophila pneumoniae CWL029
uacaacccuuua

SEQ ID NO: 506847 - RNA, 23 nt, Chlamydophila pneumoniae CWL029
uacaauaaccaggggcuuuccuu

SEQ ID NO: 506848 - RNA, 13 nt, Chlamydophila pneumoniae CWL029
uacaauacuggag

SEQ ID NO: 506849 - RNA, 16 nt, Chlamydophila pneumoniae CWL029
uacaauacuggagagg

SEQ ID NO: 506850 - RNA, 15 nt, Chlamydophila pneumoniae CWL029
uaauuguagagagaa

SEQ ID NO: 506851 - RNA, 16 nt, Chlamydophila pneumoniae CWL029
uaauugugcucucuaa

SEQ ID NO: 506852 - RNA, 24 nt, Chlamydophila pneumoniae CWL029
uacaaauggcaugaaagauaaugu

SEQ ID NO: 506853 - RNA, 24 nt, Chlamydophila pneumoniae CWL029
uacaaauuaccuugagacaaagaa

SEQ ID NO: 506854 - RNA, 14 nt, Chlamydophila pneumoniae CWL029
uaauacaaaaaaua

SEQ ID NO: 506855 - RNA, 21 nt, Chlamydophila pneumoniae CWL029
uaauacaaaaaauaaaaucaa

SEQ ID NO: 506856 - RNA, 17 nt, Chlamydophila pneumoniae CWL029
uaauaacuauaauauaa

SEQ ID NO: 506857 - RNA, 20 nt, Chlamydophila pneumoniae CWL029
uaauaagcauauuuaaauau

SEQ ID NO: 506858 - RNA, 22 nt, Chlamydophila pneumoniae CWL029
uaauaaagguugcuaagaucuu

SEQ ID NO: 506859 - RNA, 18 nt, Chlamydophila pneumoniae CWL029
uaaguuuguagcagcaag

SEQ ID NO: 506860 - RNA, 20 nt, Chlamydophila pneumoniae CWL029
uaaguuuguagcagcaagaa

SEQ ID NO: 506861 - RNA, 16 nt, Chlamydophila pneumoniae CWL029
uaaguuuguagcagca

SEQ ID NO: 506862 - RNA, 18 nt, Chlamydophila pneumoniae CWL029
uaaguuacggaacucauu

SEQ ID NO: 506863 - RNA, 20 nt, Chlamydophila pneumoniae CWL029
uaaguuacggaacucauuaa

SEQ ID NO: 506864 - RNA, 17 nt, Chlamydophila pneumoniae CWL029
uaaguuacuuucugauu

SEQ ID NO: 506865 - RNA, 21 nt, Chlamydophila pneumoniae CWL029
uaaguuagagacacagaagga

SEQ ID NO: 506866 - RNA, 18 nt, Chlamydophila pneumoniae CWL029
uaagugacuuuucuucuu

SEQ ID NO: 506867 - RNA, 19 nt, Chlamydophila pneumoniae CWL029
uaaguccaacaucagcugu

SEQ ID NO: 506868 - RNA, 15 nt, Chlamydophila pneumoniae CWL029
uaaguccuguuugaa

SEQ ID NO: 506869 - RNA, 17 nt, Chlamydophila pneumoniae CWL029
uaagucgaauucauuaa

SEQ ID NO: 506870 - RNA, 20 nt, Chlamydophila pneumoniae CWL029
uaagucuccauaauucugca

SEQ ID NO: 506871 - RNA, 18 nt, Chlamydophila pneumoniae CWL029
uaaggugcuauuuuaaac

SEQ ID NO: 506872 - RNA, 19 nt, Chlamydophila pneumoniae CWL029
uaaguacacauugucucuu

SEQ ID NO: 506873 - RNA, 22 nt, Chlamydophila pneumoniae CWL029
uaaguacacauugucucuuuua

SEQ ID NO: 506874 - RNA, 16 nt, Chlamydophila pneumoniae CWL029
uaaggauguuguggau

SEQ ID NO: 506875 - RNA, 22 nt, Chlamydophila pneumoniae CWL029
uaaggagagggguucccucucc

SEQ ID NO: 506876 - RNA, 19 nt, Chlamydophila pneumoniae CWL029
uaaggacaaaucucccaaa

SEQ ID NO: 506877 - RNA, 18 nt, Chlamydophila pneumoniae CWL029
uaaggacaaaucucccaa

SEQ ID NO: 506878 - RNA, 22 nt, Chlamydophila pneumoniae CWL029
uaagggggaucuucagagagaa

SEQ ID NO: 506879 - RNA, 12 nt, Chlamydophila pneumoniae CWL029
uaagggcucuag

SEQ ID NO: 506880 - RNA, 16 nt, Chlamydophila pneumoniae CWL029
uaagggcucuagauau

SEQ ID NO: 506881 - RNA, 15 nt, Chlamydophila pneumoniae CWL029
uaaggcuuugccuuu

SEQ ID NO: 506882 - RNA, 18 nt, Chlamydophila pneumoniae CWL029
uaaggcuuuucugcuccu

SEQ ID NO: 506883 - RNA, 13 nt, Chlamydophila pneumoniae CWL029
uaaggcuccagca

SEQ ID NO: 506884 - RNA, 21 nt, Chlamydophila pneumoniae CWL029
uaauugcuggaggccaaagaa

SEQ ID NO: 506885 - RNA, 22 nt, Chlamydophila pneumoniae CWL029
uaauugacguagacgauuuucu

SEQ ID NO: 506886 - RNA, 14 nt, Chlamydophila pneumoniae CWL029
uaauuccuuggauu

SEQ ID NO: 506887 - RNA, 16 nt, Chlamydophila pneumoniae CWL029
uaauuccaucuggaau

SEQ ID NO: 506888 - RNA, 22 nt, Chlamydophila pneumoniae CWL029
uaauucauauuuacgaaaacau

SEQ ID NO: 506889 - RNA, 17 nt, Chlamydophila pneumoniae CWL029
uaauuaacguuucuucg

SEQ ID NO: 506890 - RNA, 14 nt, Chlamydophila pneumoniae CWL029
uaaugucuccaucg

SEQ ID NO: 506891 - RNA, 23 nt, Chlamydophila pneumoniae CWL029
uaaugucuccaucggaauuugcc

SEQ ID NO: 506892 - RNA, 21 nt, Chlamydophila pneumoniae CWL029
uaauggaccagaugcuaaaga

SEQ ID NO: 506893 - RNA, 20 nt, Chlamydophila pneumoniae CWL029
uaauggagagcuuucgcucc

SEQ ID NO: 506894 - RNA, 21 nt, Chlamydophila pneumoniae CWL029
uaaucuugaucagcaaucaca

SEQ ID NO: 506895 - RNA, 17 nt, Chlamydophila pneumoniae CWL029
uaaucaagccuaaaucu

SEQ ID NO: 506896 - RNA, 12 nt, Chlamydophila pneumoniae CWL029
uaaucaaccaaa

SEQ ID NO: 506897 - RNA, 17 nt, Chlamydophila pneumoniae CWL029
uaauagcgacaugagaa

SEQ ID NO: 506898 - RNA, 21 nt, Chlamydophila pneumoniae CWL029
uaauagcgacaugagaaaucu

SEQ ID NO: 506899 - RNA, 22 nt, Chlamydophila pneumoniae CWL029
uaauagcgacaugagaaaucuu

SEQ ID NO: 506900 - RNA, 14 nt, Chlamydophila pneumoniae CWL029
uaaucucaccagaa

SEQ ID NO: 506901 - RNA, 23 nt, Chlamydophila pneumoniae CWL029
uaauccagauuguucaaaaauag

SEQ ID NO: 506902 - RNA, 20 nt, Chlamydophila pneumoniae CWL029
uaauccagcaacaaccaaaa

SEQ ID NO: 506903 - RNA, 15 nt, Chlamydophila pneumoniae CWL029
uaaucgcacuucuau

SEQ ID NO: 506904 - RNA, 21 nt, Chlamydophila pneumoniae CWL029
uaagcgauuucgacagcagca

SEQ ID NO: 506905 - RNA, 21 nt, Chlamydophila pneumoniae CWL029
uaagcuaauaagauccaaaaa

SEQ ID NO: 506906 - RNA, 20 nt, Chlamydophila pneumoniae CWL029
uaagcuuuuacccucgccaa

SEQ ID NO: 506907 - RNA, 22 nt, Chlamydophila pneumoniae CWL029
uaagcuuuucuuccaaagacug

SEQ ID NO: 506908 - RNA, 15 nt, Chlamydophila pneumoniae CWL029
uaagcuuuucuucca

SEQ ID NO: 506909 - RNA, 14 nt, Chlamydophila pneumoniae CWL029
uaaggacaaaucuc

SEQ ID NO: 506910 - RNA, 15 nt, Chlamydophila pneumoniae CWL029
uaaggacaaaucucc

SEQ ID NO: 506911 - RNA, 17 nt, Chlamydophila pneumoniae CWL029
uaagcugugcauuuucu

SEQ ID NO: 506912 - RNA, 15 nt, Chlamydophila pneumoniae CWL029
uaagcugaaagaaca

SEQ ID NO: 506913 - RNA, 17 nt, Chlamydophila pneumoniae CWL029
uaagcugcaaucucaaa

SEQ ID NO: 506914 - RNA, 14 nt, Chlamydophila pneumoniae CWL029
uaagcuauaucuca

SEQ ID NO: 506915 - RNA, 17 nt, Chlamydophila pneumoniae CWL029
uaagcucauaagaaauu

SEQ ID NO: 506916 - RNA, 14 nt, Chlamydophila pneumoniae CWL029
uaagcucuaagucc

SEQ ID NO: 506917 - RNA, 21 nt, Chlamydophila pneumoniae CWL029
uaagcauagcccgaaauucau

SEQ ID NO: 506918 - RNA, 22 nt, Chlamydophila pneumoniae CWL029
uaagcauagcccgaaauucauu

SEQ ID NO: 506919 - RNA, 18 nt, Chlamydophila pneumoniae CWL029
uaagcauauuuaaauaua

SEQ ID NO: 506920 - RNA, 19 nt, Chlamydophila pneumoniae CWL029
uaagcaggaaaagcaaaau

SEQ ID NO: 506921 - RNA, 13 nt, Chlamydophila pneumoniae CWL029
uaagcaucuagaa

SEQ ID NO: 506922 - RNA, 21 nt, Chlamydophila pneumoniae CWL029
uaagcaagagcuccgcuagag

SEQ ID NO: 506923 - RNA, 18 nt, Chlamydophila pneumoniae CWL029
uaagcaaagcggcucuua

SEQ ID NO: 506924 - RNA, 12 nt, Chlamydophila pneumoniae CWL029
uaagauuuugaa

SEQ ID NO: 506925 - RNA, 15 nt, Chlamydophila pneumoniae CWL029
uaagauuuuuagaau

SEQ ID NO: 506926 - RNA, 12 nt, Chlamydophila pneumoniae CWL029
uaagauuccuaa

SEQ ID NO: 506927 - RNA, 18 nt, Chlamydophila pneumoniae CWL029
uaagaucuuuagaauaag

SEQ ID NO: 506928 - RNA, 22 nt, Chlamydophila pneumoniae CWL029
uaagaucuuuagaauaagagcu

SEQ ID NO: 506929 - RNA, 19 nt, Chlamydophila pneumoniae CWL029
uaagauccuuuaaagauuc

SEQ ID NO: 506930 - RNA, 22 nt, Chlamydophila pneumoniae CWL029
uaagauccugagaccauacaca

SEQ ID NO: 506931 - RNA, 17 nt, Chlamydophila pneumoniae CWL029
uaagauccuuuaaagau

SEQ ID NO: 506932 - RNA, 20 nt, Chlamydophila pneumoniae CWL029
uaagauguggucuuccguau

SEQ ID NO: 506933 - RNA, 18 nt, Chlamydophila pneumoniae CWL029
uaagaucaauauagagaa

SEQ ID NO: 506934 - RNA, 14 nt, Chlamydophila pneumoniae CWL029
uaagauccaaaaau

SEQ ID NO: 506935 - RNA, 20 nt, Chlamydophila pneumoniae CWL029
uaagauacuucuccacagcu

SEQ ID NO: 506936 - RNA, 15 nt, Chlamydophila pneumoniae CWL029
uaagauacuucucca

SEQ ID NO: 506937 - RNA, 14 nt, Chlamydophila pneumoniae CWL029
uaagauaaacagca

SEQ ID NO: 506938 - RNA, 15 nt, Chlamydophila pneumoniae CWL029
uaagauaaacagcac

SEQ ID NO: 506939 - RNA, 21 nt, Chlamydophila pneumoniae CWL029
uaagauaaacauuaagugaug

SEQ ID NO: 506940 - RNA, 13 nt, Chlamydophila pneumoniae CWL029
uaagauaaacauu

SEQ ID NO: 506941 - RNA, 13 nt, Chlamydophila pneumoniae CWL029
uaagauaauagag

SEQ ID NO: 506942 - RNA, 18 nt, Chlamydophila pneumoniae CWL029
uaagauaauagagaagaa

SEQ ID NO: 506943 - RNA, 20 nt, Chlamydophila pneumoniae CWL029
uaagagcuacaaucccgagu

SEQ ID NO: 506944 - RNA, 12 nt, Chlamydophila pneumoniae CWL029
uaagaggaaagc

SEQ ID NO: 506945 - RNA, 18 nt, Chlamydophila pneumoniae CWL029
uaagagcaaacaucaaag

SEQ ID NO: 506946 - RNA, 15 nt, Chlamydophila pneumoniae CWL029
uaagagcaaacauca

SEQ ID NO: 506947 - RNA, 21 nt, Chlamydophila pneumoniae CWL029
uaagagaauuauuauuaguua

SEQ ID NO: 506948 - RNA, 15 nt, Chlamydophila pneumoniae CWL029
uaagagaaaggcgcu

SEQ ID NO: 506949 - RNA, 18 nt, Chlamydophila pneumoniae CWL029
uaagacugucuaugaucc

SEQ ID NO: 506950 - RNA, 13 nt, Chlamydophila pneumoniae CWL029
uaagacuaaaaaa

SEQ ID NO: 506951 - RNA, 15 nt, Chlamydophila pneumoniae CWL029
uaagacuaaaaaaga

SEQ ID NO: 506952 - RNA, 12 nt, Chlamydophila pneumoniae CWL029
uaagaccagaaa

SEQ ID NO: 506953 - RNA, 18 nt, Chlamydophila pneumoniae CWL029
uaagacgcagaaacacug

SEQ ID NO: 506954 - RNA, 19 nt, Chlamydophila pneumoniae CWL029
uaagacaauaaaauagccc

SEQ ID NO: 506955 - RNA, 19 nt, Chlamydophila pneumoniae CWL029
uaagacaauauaagcacca

SEQ ID NO: 506956 - RNA, 18 nt, Chlamydophila pneumoniae CWL029
uaagaccaaacuuucuuu

SEQ ID NO: 506957 - RNA, 20 nt, Chlamydophila pneumoniae CWL029
uaagaauguagcuguuccaa

SEQ ID NO: 506958 - RNA, 22 nt, Chlamydophila pneumoniae CWL029
uaagacaagguggguagccagg

SEQ ID NO: 506959 - RNA, 19 nt, Chlamydophila pneumoniae CWL029
uaagaagacuagcuuuuca

SEQ ID NO: 506960 - RNA, 19 nt, Chlamydophila pneumoniae CWL029
uaagaagcucacucuuuaa

SEQ ID NO: 506961 - RNA, 20 nt, Chlamydophila pneumoniae CWL029
uaagaagguuuauuagaagu

SEQ ID NO: 506962 - RNA, 21 nt, Chlamydophila pneumoniae CWL029
uaagaacuuuagggaagaaau

SEQ ID NO: 506963 - RNA, 14 nt, Chlamydophila pneumoniae CWL029
uaagaaaucccagu

SEQ ID NO: 506964 - RNA, 22 nt, Chlamydophila pneumoniae CWL029
uaagaaaggcacuccaaaacuc

SEQ ID NO: 506965 - RNA, 18 nt, Chlamydophila pneumoniae CWL029
uaagaaaaugaggacaca

SEQ ID NO: 506966 - RNA, 15 nt, Chlamydophila pneumoniae CWL029
uaacuuuaucauaga

SEQ ID NO: 506967 - RNA, 22 nt, Chlamydophila pneumoniae CWL029
uaacuucuaaaagcaaguuguu

SEQ ID NO: 506968 - RNA, 17 nt, Chlamydophila pneumoniae CWL029
uaacuugaagaaguaca

SEQ ID NO: 506969 - RNA, 21 nt, Chlamydophila pneumoniae CWL029
uaacuugcauuuuuuggaaua

SEQ ID NO: 506970 - RNA, 18 nt, Chlamydophila pneumoniae CWL029
uaacuuggugagcagcuu

SEQ ID NO: 506971 - RNA, 21 nt, Chlamydophila pneumoniae CWL029
uaacuuggugagcagcuuuau

SEQ ID NO: 506972 - RNA, 17 nt, Chlamydophila pneumoniae CWL029
uaacucuuaagaauaaa

SEQ ID NO: 506973 - RNA, 20 nt, Chlamydophila pneumoniae CWL029
uaacucuuaagaauaaaaua

SEQ ID NO: 506974 - RNA, 16 nt, Chlamydophila pneumoniae CWL029
uaacugaggcaaagau

SEQ ID NO: 506975 - RNA, 16 nt, Chlamydophila pneumoniae CWL029
uaacugcaaagagaau

SEQ ID NO: 506976 - RNA, 21 nt, Chlamydophila pneumoniae CWL029
uaacuccaggggauaaaacua

SEQ ID NO: 506977 - RNA, 22 nt, Chlamydophila pneumoniae CWL029
uaacuccaggggauaaaacuau

SEQ ID NO: 506978 - RNA, 20 nt, Chlamydophila pneumoniae CWL029
uaacuccucggcaacuacug

SEQ ID NO: 506979 - RNA, 17 nt, Chlamydophila pneumoniae CWL029
uaacucggaaaaaauag

SEQ ID NO: 506980 - RNA, 18 nt, Chlamydophila pneumoniae CWL029
uaacucagagauugccag

SEQ ID NO: 506981 - RNA, 14 nt, Chlamydophila pneumoniae CWL029
uaacuccagcgagg

SEQ ID NO: 506982 - RNA, 13 nt, Chlamydophila pneumoniae CWL029
uaacuaguaacuu

SEQ ID NO: 506983 - RNA, 14 nt, Chlamydophila pneumoniae CWL029
uaacuaagauaugu

SEQ ID NO: 506984 - RNA, 22 nt, Chlamydophila pneumoniae CWL029
uaacuaucucuguuuuuugaaa

SEQ ID NO: 506985 - RNA, 19 nt, Chlamydophila pneumoniae CWL029
uaacguagucaaaaauucu

SEQ ID NO: 506986 - RNA, 17 nt, Chlamydophila pneumoniae CWL029
uaacguagucaaaaauu

SEQ ID NO: 506987 - RNA, 21 nt, Chlamydophila pneumoniae CWL029
uaacguuucaggucagcaagg

SEQ ID NO: 506988 - RNA, 18 nt, Chlamydophila pneumoniae CWL029
uaacuaaauucuuaacaa

SEQ ID NO: 506989 - RNA, 20 nt, Chlamydophila pneumoniae CWL029
uaacuaaauucuuaacaaua

SEQ ID NO: 506990 - RNA, 13 nt, Chlamydophila pneumoniae CWL029
uaacccaccagaa

SEQ ID NO: 506991 - RNA, 14 nt, Chlamydophila pneumoniae CWL029
uaaccucuuuucuu

SEQ ID NO: 506992 - RNA, 22 nt, Chlamydophila pneumoniae CWL029
uaacacuuccuacggcaagaau

SEQ ID NO: 506993 - RNA, 18 nt, Chlamydophila pneumoniae CWL029
uaacacuucuuucuugcu

SEQ ID NO: 506994 - RNA, 15 nt, Chlamydophila pneumoniae CWL029
uaacaauauaugcua

SEQ ID NO: 506995 - RNA, 17 nt, Chlamydophila pneumoniae CWL029
uaacaaguaccaagaaa

SEQ ID NO: 506996 - RNA, 19 nt, Chlamydophila pneumoniae CWL029
uaacaaguaccaagaaaau

SEQ ID NO: 506997 - RNA, 15 nt, Chlamydophila pneumoniae CWL029
uaacaagauucucag

SEQ ID NO: 506998 - RNA, 20 nt, Chlamydophila pneumoniae CWL029
uaaauguauaggcauuaaua

SEQ ID NO: 506999 - RNA, 15 nt, Chlamydophila pneumoniae CWL029
uaaauguauugcaaa

SEQ ID NO: 507000 - RNA, 22 nt, Chlamydophila pneumoniae CWL029
uaaauguauaggcauuaauaac

SEQ ID NO: 507001 - RNA, 17 nt, Chlamydophila pneumoniae CWL029
uaaaugugaaaucguau

SEQ ID NO: 507002 - RNA, 14 nt, Chlamydophila pneumoniae CWL029
uaaccaaaagaauu

SEQ ID NO: 507003 - RNA, 14 nt, Chlamydophila pneumoniae CWL029
uaacaucuaaaaau

SEQ ID NO: 507004 - RNA, 19 nt, Chlamydophila pneumoniae CWL029
uaacaucuaaaaaugcacu

SEQ ID NO: 507005 - RNA, 15 nt, Chlamydophila pneumoniae CWL029
uaaccaaguaaauca

SEQ ID NO: 507006 - RNA, 20 nt, Chlamydophila pneumoniae CWL029
uaaccacagugauuuagaaa

SEQ ID NO: 507007 - RNA, 13 nt, Chlamydophila pneumoniae CWL029
uaaccagaagacu

SEQ ID NO: 507008 - RNA, 13 nt, Chlamydophila pneumoniae CWL029
uaacauagauaag

SEQ ID NO: 507009 - RNA, 13 nt, Chlamydophila pneumoniae CWL029
uaacauaaaguca

SEQ ID NO: 507010 - RNA, 20 nt, Chlamydophila pneumoniae CWL029
uaacauaaagucaaacauca

SEQ ID NO: 507011 - RNA, 22 nt, Chlamydophila pneumoniae CWL029
uaaauaccuagagcucugaaau

SEQ ID NO: 507012 - RNA, 14 nt, Chlamydophila pneumoniae CWL029
uaaauaggcucuac

SEQ ID NO: 507013 - RNA, 14 nt, Chlamydophila pneumoniae CWL029
uaaaggcucuuuua

SEQ ID NO: 507014 - RNA, 17 nt, Chlamydophila pneumoniae CWL029
uaaaguagaauccuucu

SEQ ID NO: 507015 - RNA, 19 nt, Chlamydophila pneumoniae CWL029
uaaagugucauacgcagca

SEQ ID NO: 507016 - RNA, 17 nt, Chlamydophila pneumoniae CWL029
uaaaguguguaaauguu

SEQ ID NO: 507017 - RNA, 20 nt, Chlamydophila pneumoniae CWL029
uaaaucccacuaucuguaau

SEQ ID NO: 507018 - RNA, 22 nt, Chlamydophila pneumoniae CWL029
uaaauccgcagagucuauaucu

SEQ ID NO: 507019 - RNA, 14 nt, Chlamydophila pneumoniae CWL029
uaaauccaaaaaau

SEQ ID NO: 507020 - RNA, 20 nt, Chlamydophila pneumoniae CWL029
uaaauauagaaaaucauuca

SEQ ID NO: 507021 - RNA, 14 nt, Chlamydophila pneumoniae CWL029
uaaagaaauucugg

SEQ ID NO: 507022 - RNA, 18 nt, Chlamydophila pneumoniae CWL029
uaaacuuacagccaccuu

SEQ ID NO: 507023 - RNA, 23 nt, Chlamydophila pneumoniae CWL029
uaaagaguuuguucacauuuuca

SEQ ID NO: 507024 - RNA, 22 nt, Chlamydophila pneumoniae CWL029
uaaagauaaucuguaagaaaau

SEQ ID NO: 507025 - RNA, 15 nt, Chlamydophila pneumoniae CWL029
uaaagauaaucugua

SEQ ID NO: 507026 - RNA, 14 nt, Chlamydophila pneumoniae CWL029
uaaagaucuucaua

SEQ ID NO: 507027 - RNA, 15 nt, Chlamydophila pneumoniae CWL029
uaaagaucuucauaa

SEQ ID NO: 507028 - RNA, 18 nt, Chlamydophila pneumoniae CWL029
uaaagaucgugaucaaag

SEQ ID NO: 507029 - RNA, 23 nt, Chlamydophila pneumoniae CWL029
uaaagaucgggucuacaacaguu

SEQ ID NO: 507030 - RNA, 19 nt, Chlamydophila pneumoniae CWL029
uaaagauacuuaucuuuaa

SEQ ID NO: 507031 - RNA, 17 nt, Chlamydophila pneumoniae CWL029
uaaagauacuuaucuuu

SEQ ID NO: 507032 - RNA, 15 nt, Chlamydophila pneumoniae CWL029
uaaagauuuucauaa

SEQ ID NO: 507033 - RNA, 21 nt, Chlamydophila pneumoniae CWL029
uaaagcaaagauaaagaaguu

SEQ ID NO: 507034 - RNA, 15 nt, Chlamydophila pneumoniae CWL029
uaaagcuauuguuuu

SEQ ID NO: 507035 - RNA, 18 nt, Chlamydophila pneumoniae CWL029
uaaaggaccuguuuucuu

SEQ ID NO: 507036 - RNA, 13 nt, Chlamydophila pneumoniae CWL029
uaaagcuuuuccg

SEQ ID NO: 507037 - RNA, 22 nt, Chlamydophila pneumoniae CWL029
uaaagcuguaaccaacaucaaa

SEQ ID NO: 507038 - RNA, 14 nt, Chlamydophila pneumoniae CWL029
uaaagcuccgagaa

SEQ ID NO: 507039 - RNA, 17 nt, Chlamydophila pneumoniae CWL029
uaaacccucagaacacg

SEQ ID NO: 507040 - RNA, 17 nt, Chlamydophila pneumoniae CWL029
uaaaccaucacuuccug

SEQ ID NO: 507041 - RNA, 16 nt, Chlamydophila pneumoniae CWL029
uaaacagaucuuuauc

SEQ ID NO: 507042 - RNA, 12 nt, Chlamydophila pneumoniae CWL029
uaaacagcacag

SEQ ID NO: 507043 - RNA, 22 nt, Chlamydophila pneumoniae CWL029
uaaacagcaguguuauuuggac

SEQ ID NO: 507044 - RNA, 14 nt, Chlamydophila pneumoniae CWL029
uaaacauaaagacc

SEQ ID NO: 507045 - RNA, 17 nt, Chlamydophila pneumoniae CWL029
uaaacucuuguugucua

SEQ ID NO: 507046 - RNA, 23 nt, Chlamydophila pneumoniae CWL029
uaaacucucuuccuucuccugua

SEQ ID NO: 507047 - RNA, 21 nt, Chlamydophila pneumoniae CWL029
uaaacucucuuccuucuccug

SEQ ID NO: 507048 - RNA, 17 nt, Chlamydophila pneumoniae CWL029
uaaacugcuacuuuaaa

SEQ ID NO: 507049 - RNA, 21 nt, Chlamydophila pneumoniae CWL029
uaaacugggaagaccacgaaa

SEQ ID NO: 507050 - RNA, 21 nt, Chlamydophila pneumoniae CWL029
uaaacuccauuguuguugcau

SEQ ID NO: 507051 - RNA, 14 nt, Chlamydophila pneumoniae CWL029
uaaacucuccaaaa

SEQ ID NO: 507052 - RNA, 18 nt, Chlamydophila pneumoniae CWL029
uaaacucuccaaaagcuc

SEQ ID NO: 507053 - RNA, 17 nt, Chlamydophila pneumoniae CWL029
uaaacggacgcuagaga

SEQ ID NO: 507054 - RNA, 16 nt, Chlamydophila pneumoniae CWL029
uaaacggacgcuagag

SEQ ID NO: 507055 - RNA, 20 nt, Chlamydophila pneumoniae CWL029
uaaaagcuuaucccauaaau

SEQ ID NO: 507056 - RNA, 14 nt, Chlamydophila pneumoniae CWL029
uaaaagauuccuua

SEQ ID NO: 507057 - RNA, 16 nt, Chlamydophila pneumoniae CWL029
uaaaagagcucaaaaa

SEQ ID NO: 507058 - RNA, 14 nt, Chlamydophila pneumoniae CWL029
uaaaagaauaauag

SEQ ID NO: 507059 - RNA, 21 nt, Chlamydophila pneumoniae CWL029
uaaaacccauguuucuuccug

SEQ ID NO: 507060 - RNA, 13 nt, Chlamydophila pneumoniae CWL029
uaaaaauuuaaaa

SEQ ID NO: 507061 - RNA, 19 nt, Chlamydophila pneumoniae CWL029
uaaaaauuucaugaggagc

SEQ ID NO: 507062 - RNA, 20 nt, Chlamydophila pneumoniae CWL029
uaaaaauagaaauaagcauc

SEQ ID NO: 507063 - RNA, 16 nt, Chlamydophila pneumoniae CWL029
uaaaaauaggagaagc

SEQ ID NO: 507064 - RNA, 20 nt, Chlamydophila pneumoniae CWL029
uaaaaaguuuuuguucaucc

SEQ ID NO: 507065 - RNA, 12 nt, Chlamydophila pneumoniae CWL029
uaaaaagaaaag

SEQ ID NO: 507066 - RNA, 22 nt, Chlamydophila pneumoniae CWL029
uaaaaacccuaguucauuagcu

SEQ ID NO: 507067 - RNA, 15 nt, Chlamydophila pneumoniae CWL029
uaaaauuucuguagu

SEQ ID NO: 507068 - RNA, 22 nt, Chlamydophila pneumoniae CWL029
uaaaauuguuuguaucaaagaa

SEQ ID NO: 507069 - RNA, 15 nt, Chlamydophila pneumoniae CWL029
uaaaauuuaaaaaaa

SEQ ID NO: 507070 - RNA, 20 nt, Chlamydophila pneumoniae CWL029
uaaaauucugaagauauauu

SEQ ID NO: 507071 - RNA, 15 nt, Chlamydophila pneumoniae CWL029
uaaaauugaaaucuu

SEQ ID NO: 507072 - RNA, 18 nt, Chlamydophila pneumoniae CWL029
uaaaauucaaaucccuga

SEQ ID NO: 507073 - RNA, 19 nt, Chlamydophila pneumoniae CWL029
uaaaaugggaucagaaaau

SEQ ID NO: 507074 - RNA, 23 nt, Chlamydophila pneumoniae CWL029
uaaaauggguuugcuuuucauuu

SEQ ID NO: 507075 - RNA, 21 nt, Chlamydophila pneumoniae CWL029
uaaaauggugaagaauaauag

SEQ ID NO: 507076 - RNA, 18 nt, Chlamydophila pneumoniae CWL029
uaaaaugugucuugcuga

SEQ ID NO: 507077 - RNA, 21 nt, Chlamydophila pneumoniae CWL029
uaaaaugcgcacggauucuaa

SEQ ID NO: 507078 - RNA, 20 nt, Chlamydophila pneumoniae CWL029
uaaaaugcgguaauagguuu

SEQ ID NO: 507079 - RNA, 21 nt, Chlamydophila pneumoniae CWL029
uaaaauaaccccuccaaaauc

SEQ ID NO: 507080 - RNA, 12 nt, Chlamydophila pneumoniae CWL029
uaaaauaagaaa

SEQ ID NO: 507081 - RNA, 16 nt, Chlamydophila pneumoniae CWL029
uaaaauaauuuuauua

SEQ ID NO: 507082 - RNA, 23 nt, Chlamydophila pneumoniae CWL029
uaaaauaugcucgugcgacugcu

SEQ ID NO: 507083 - RNA, 20 nt, Chlamydophila pneumoniae CWL029
uaaaauauuaaauucaaaau

SEQ ID NO: 507084 - RNA, 22 nt, Chlamydophila pneumoniae CWL029
guuuagcauagagcucuaaaaa

SEQ ID NO: 507085 - RNA, 21 nt, Chlamydophila pneumoniae CWL029
guuuacagaugcaugauccua

SEQ ID NO: 507086 - RNA, 16 nt, Chlamydophila pneumoniae CWL029
guuuaccugaaaaaac

SEQ ID NO: 507087 - RNA, 17 nt, Chlamydophila pneumoniae CWL029
guuuaccugaaaaaaca

SEQ ID NO: 507088 - RNA, 12 nt, Chlamydophila pneumoniae CWL029
guuguacuuuua

SEQ ID NO: 507089 - RNA, 22 nt, Chlamydophila pneumoniae CWL029
guugucacuaagauaucuccag

SEQ ID NO: 507090 - RNA, 15 nt, Chlamydophila pneumoniae CWL029
guuguuuuugcugaa

SEQ ID NO: 507091 - RNA, 13 nt, Chlamydophila pneumoniae CWL029
guuucuagguucu

SEQ ID NO: 507092 - RNA, 21 nt, Chlamydophila pneumoniae CWL029
guuucgcuuugauaauagucu

SEQ ID NO: 507093 - RNA, 21 nt, Chlamydophila pneumoniae CWL029
guuucuuuugauugaaacuuu

SEQ ID NO: 507094 - RNA, 14 nt, Chlamydophila pneumoniae CWL029
guuucuuuugcaaa

SEQ ID NO: 507095 - RNA, 15 nt, Chlamydophila pneumoniae CWL029
guuugagaaagacca

SEQ ID NO: 507096 - RNA, 20 nt, Chlamydophila pneumoniae CWL029
guuucgauaauuuucacgag

SEQ ID NO: 507097 - RNA, 14 nt, Chlamydophila pneumoniae CWL029
guuucccccauaaa

SEQ ID NO: 507098 - RNA, 14 nt, Chlamydophila pneumoniae CWL029
guuguaauaaaaga

SEQ ID NO: 507099 - RNA, 16 nt, Chlamydophila pneumoniae CWL029
guugggcucauaaccc

SEQ ID NO: 507100 - RNA, 23 nt, Chlamydophila pneumoniae CWL029
guuggauccaucggcauuucucc

SEQ ID NO: 507101 - RNA, 20 nt, Chlamydophila pneumoniae CWL029
guuggauccaucggcauuuc

SEQ ID NO: 507102 - RNA, 14 nt, Chlamydophila pneumoniae CWL029
guuggacugcaaga

SEQ ID NO: 507103 - RNA, 20 nt, Chlamydophila pneumoniae CWL029
guugcuaagaucuuuagaau

SEQ ID NO: 507104 - RNA, 16 nt, Chlamydophila pneumoniae CWL029
guugcuaagaucuuua

SEQ ID NO: 507105 - RNA, 19 nt, Chlamydophila pneumoniae CWL029
guugcgcaguggacgggga

SEQ ID NO: 507106 - RNA, 21 nt, Chlamydophila pneumoniae CWL029
guugcauuacgguuucuggga

SEQ ID NO: 507107 - RNA, 16 nt, Chlamydophila pneumoniae CWL029
guugccaaucuuucau

SEQ ID NO: 507108 - RNA, 20 nt, Chlamydophila pneumoniae CWL029
guugcacucgauuauuucuu

SEQ ID NO: 507109 - RNA, 23 nt, Chlamydophila pneumoniae CWL029
guugcaucgccuuaagcucuaag

SEQ ID NO: 507110 - RNA, 18 nt, Chlamydophila pneumoniae CWL029
guucuucuuuacucaagu

SEQ ID NO: 507111 - RNA, 16 nt, Chlamydophila pneumoniae CWL029
guucuuuacuacauga

SEQ ID NO: 507112 - RNA, 17 nt, Chlamydophila pneumoniae CWL029
guucuuguaauaaaaga

SEQ ID NO: 507113 - RNA, 15 nt, Chlamydophila pneumoniae CWL029
guucuuucaauaaca

SEQ ID NO: 507114 - RNA, 21 nt, Chlamydophila pneumoniae CWL029
guucuuucuagaaugaugcaa

SEQ ID NO: 507115 - RNA, 13 nt, Chlamydophila pneumoniae CWL029
guucuaagaaauc

SEQ ID NO: 507116 - RNA, 16 nt, Chlamydophila pneumoniae CWL029
guuagaaaccaugaug

SEQ ID NO: 507117 - RNA, 19 nt, Chlamydophila pneumoniae CWL029
guuagaaaccaugaugcaa

SEQ ID NO: 507118 - RNA, 14 nt, Chlamydophila pneumoniae CWL029
guucauaauccaag

SEQ ID NO: 507119 - RNA, 16 nt, Chlamydophila pneumoniae CWL029
guucauaauccaagau

SEQ ID NO: 507120 - RNA, 20 nt, Chlamydophila pneumoniae CWL029
guucauaauccaagauacca

SEQ ID NO: 507121 - RNA, 19 nt, Chlamydophila pneumoniae CWL029
guucauuagcuaaaucaaa

SEQ ID NO: 507122 - RNA, 13 nt, Chlamydophila pneumoniae CWL029
guucagcuagagc

SEQ ID NO: 507123 - RNA, 23 nt, Chlamydophila pneumoniae CWL029
guuccugaucccuuagaaauucu

SEQ ID NO: 507124 - RNA, 20 nt, Chlamydophila pneumoniae CWL029
guuccugcuugauuuccuga

SEQ ID NO: 507125 - RNA, 18 nt, Chlamydophila pneumoniae CWL029
guucgcggaucuucuucu

SEQ ID NO: 507126 - RNA, 19 nt, Chlamydophila pneumoniae CWL029
guuccuacaggcaggccac

SEQ ID NO: 507127 - RNA, 20 nt, Chlamydophila pneumoniae CWL029
guuccuacuucugcaggacu

SEQ ID NO: 507128 - RNA, 19 nt, Chlamydophila pneumoniae CWL029
guuccuauaugaaugauuu

SEQ ID NO: 507129 - RNA, 19 nt, Chlamydophila pneumoniae CWL029
guucccaucacauaaauca

SEQ ID NO: 507130 - RNA, 12 nt, Chlamydophila pneumoniae CWL029
guguuuucuagu

SEQ ID NO: 507131 - RNA, 12 nt, Chlamydophila pneumoniae CWL029
guguuuccuucg

SEQ ID NO: 507132 - RNA, 23 nt, Chlamydophila pneumoniae CWL029
guguuaaguucauaaccugggca

SEQ ID NO: 507133 - RNA, 16 nt, Chlamydophila pneumoniae CWL029
gugugugguaaaaaua

SEQ ID NO: 507134 - RNA, 14 nt, Chlamydophila pneumoniae CWL029
guguaaaaguuagg

SEQ ID NO: 507135 - RNA, 20 nt, Chlamydophila pneumoniae CWL029
guguaccucucaucaaagca

SEQ ID NO: 507136 - RNA, 17 nt, Chlamydophila pneumoniae CWL029
guuacaagcaauacuaa

SEQ ID NO: 507137 - RNA, 17 nt, Chlamydophila pneumoniae CWL029
guuacagcguugcuaag

SEQ ID NO: 507138 - RNA, 21 nt, Chlamydophila pneumoniae CWL029
guuacggaacucauuaagaag

SEQ ID NO: 507139 - RNA, 16 nt, Chlamydophila pneumoniae CWL029
guuacgugagaacuca

SEQ ID NO: 507140 - RNA, 16 nt, Chlamydophila pneumoniae CWL029
gugguuggauccaucg

SEQ ID NO: 507141 - RNA, 23 nt, Chlamydophila pneumoniae CWL029
gugguaaaaauauaggcugcaca

SEQ ID NO: 507142 - RNA, 16 nt, Chlamydophila pneumoniae CWL029
guggguagccaggaug

SEQ ID NO: 507143 - RNA, 20 nt, Chlamydophila pneumoniae CWL029
gugcuaggcucucgacacua

SEQ ID NO: 507144 - RNA, 13 nt, Chlamydophila pneumoniae CWL029
gugcugccaugac

SEQ ID NO: 507145 - RNA, 13 nt, Chlamydophila pneumoniae CWL029
gugcucuguauug

SEQ ID NO: 507146 - RNA, 15 nt, Chlamydophila pneumoniae CWL029
gugcucucuucuucu

SEQ ID NO: 507147 - RNA, 13 nt, Chlamydophila pneumoniae CWL029
gugcucuacccca

SEQ ID NO: 507148 - RNA, 18 nt, Chlamydophila pneumoniae CWL029
gugcgaaagcccaugaga

SEQ ID NO: 507149 - RNA, 19 nt, Chlamydophila pneumoniae CWL029
gugauuuagaaaucucacu

SEQ ID NO: 507150 - RNA, 17 nt, Chlamydophila pneumoniae CWL029
gugcaaguucacacgua

SEQ ID NO: 507151 - RNA, 19 nt, Chlamydophila pneumoniae CWL029
gugcauuaucuaagaauau

SEQ ID NO: 507152 - RNA, 15 nt, Chlamydophila pneumoniae CWL029
gugccaaaaaauuuu

SEQ ID NO: 507153 - RNA, 19 nt, Chlamydophila pneumoniae CWL029
gugccacccuuggcagagc

SEQ ID NO: 507154 - RNA, 15 nt, Chlamydophila pneumoniae CWL029
gucgcaucaaugacu

SEQ ID NO: 507155 - RNA, 15 nt, Chlamydophila pneumoniae CWL029
gucgauaaaaacucc

SEQ ID NO: 507156 - RNA, 22 nt, Chlamydophila pneumoniae CWL029
guccugggggaaauaccccauc

SEQ ID NO: 507157 - RNA, 22 nt, Chlamydophila pneumoniae CWL029
guccugggguucucuaauggac

SEQ ID NO: 507158 - RNA, 12 nt, Chlamydophila pneumoniae CWL029
guccuucuuccc

SEQ ID NO: 507159 - RNA, 19 nt, Chlamydophila pneumoniae CWL029
guccuugcagcccugcaua

SEQ ID NO: 507160 - RNA, 11 nt, Chlamydophila pneumoniae CWL029
guccucucccu

SEQ ID NO: 507161 - RNA, 16 nt, Chlamydophila pneumoniae CWL029
guccuaauuuuccucc

SEQ ID NO: 507162 - RNA, 16 nt, Chlamydophila pneumoniae CWL029
guccuagcagagaaau

SEQ ID NO: 507163 - RNA, 17 nt, Chlamydophila pneumoniae CWL029
guccuaucaaagcaaaa

SEQ ID NO: 507164 - RNA, 14 nt, Chlamydophila pneumoniae CWL029
guccuaggagagcu

SEQ ID NO: 507165 - RNA, 19 nt, Chlamydophila pneumoniae CWL029
guccugcaggcuucaccau

SEQ ID NO: 507166 - RNA, 21 nt, Chlamydophila pneumoniae CWL029
gucauugccuugcugcauacu

SEQ ID NO: 507167 - RNA, 22 nt, Chlamydophila pneumoniae CWL029
gucauucuauggucucccucac

SEQ ID NO: 507168 - RNA, 21 nt, Chlamydophila pneumoniae CWL029
gucauucugcaaggcaaugau

SEQ ID NO: 507169 - RNA, 18 nt, Chlamydophila pneumoniae CWL029
guccauaauuucuuucac

SEQ ID NO: 507170 - RNA, 16 nt, Chlamydophila pneumoniae CWL029
gucauaaaaauuucau

SEQ ID NO: 507171 - RNA, 15 nt, Chlamydophila pneumoniae CWL029
gucaugauuuuucaa

SEQ ID NO: 507172 - RNA, 16 nt, Chlamydophila pneumoniae CWL029
gucaugauuuuucaau

SEQ ID NO: 507173 - RNA, 12 nt, Chlamydophila pneumoniae CWL029
gucauuaaaaau

SEQ ID NO: 507174 - RNA, 19 nt, Chlamydophila pneumoniae CWL029
gucaggaggugguggagcu

SEQ ID NO: 507175 - RNA, 21 nt, Chlamydophila pneumoniae CWL029
gucaaaauaucauucacuauu

SEQ ID NO: 507176 - RNA, 11 nt, Chlamydophila pneumoniae CWL029
gucaaaauauc

SEQ ID NO: 507177 - RNA, 22 nt, Chlamydophila pneumoniae CWL029
guauaauuggcguaauaauucc

SEQ ID NO: 507178 - RNA, 20 nt, Chlamydophila pneumoniae CWL029
guauaauuggcguaauaauu

SEQ ID NO: 507179 - RNA, 20 nt, Chlamydophila pneumoniae CWL029
guauaccauguuaucaagac

SEQ ID NO: 507180 - RNA, 19 nt, Chlamydophila pneumoniae CWL029
guauauaagauaauagaga

SEQ ID NO: 507181 - RNA, 18 nt, Chlamydophila pneumoniae CWL029
guauauccacgaucuaga

SEQ ID NO: 507182 - RNA, 21 nt, Chlamydophila pneumoniae CWL029
guaggucucccuggucuguau

SEQ ID NO: 507183 - RNA, 18 nt, Chlamydophila pneumoniae CWL029
guagucaaaaauucuucg

SEQ ID NO: 507184 - RNA, 21 nt, Chlamydophila pneumoniae CWL029
guaguaaggagagacuguguu

SEQ ID NO: 507185 - RNA, 15 nt, Chlamydophila pneumoniae CWL029
guagucaugauuuuu

SEQ ID NO: 507186 - RNA, 18 nt, Chlamydophila pneumoniae CWL029
guagugagauacggagga

SEQ ID NO: 507187 - RNA, 19 nt, Chlamydophila pneumoniae CWL029
guauaauagugagcucccu

SEQ ID NO: 507188 - RNA, 13 nt, Chlamydophila pneumoniae CWL029
guauaacaucuaa

SEQ ID NO: 507189 - RNA, 20 nt, Chlamydophila pneumoniae CWL029
guauaacaucuaaaaaugca

SEQ ID NO: 507190 - RNA, 14 nt, Chlamydophila pneumoniae CWL029
guaguuugccuucu

SEQ ID NO: 507191 - RNA, 19 nt, Chlamydophila pneumoniae CWL029
guaguuucuaaaacagaaa

SEQ ID NO: 507192 - RNA, 24 nt, Chlamydophila pneumoniae CWL029
guagccuggaggcgguggcaugcc

SEQ ID NO: 507193 - RNA, 18 nt, Chlamydophila pneumoniae CWL029
guagcgacguuugaucuu

SEQ ID NO: 507194 - RNA, 18 nt, Chlamydophila pneumoniae CWL029
guagaucauaaacagcag

SEQ ID NO: 507195 - RNA, 21 nt, Chlamydophila pneumoniae CWL029
guagagucggccguauaacuu

SEQ ID NO: 507196 - RNA, 20 nt, Chlamydophila pneumoniae CWL029
guaggcacaucauuaucaua

SEQ ID NO: 507197 - RNA, 21 nt, Chlamydophila pneumoniae CWL029
guaggcauacaguagaaacau

SEQ ID NO: 507198 - RNA, 14 nt, Chlamydophila pneumoniae CWL029
guacuucuuacccu

SEQ ID NO: 507199 - RNA, 12 nt, Chlamydophila pneumoniae CWL029
guagagcaagau

SEQ ID NO: 507200 - RNA, 19 nt, Chlamydophila pneumoniae CWL029
guacuaauuacagaauccc

SEQ ID NO: 507201 - RNA, 13 nt, Chlamydophila pneumoniae CWL029
guacuaagauacg

SEQ ID NO: 507202 - RNA, 13 nt, Chlamydophila pneumoniae CWL029
guaccuaggaucu

SEQ ID NO: 507203 - RNA, 14 nt, Chlamydophila pneumoniae CWL029
guaccaagaaaaua

SEQ ID NO: 507204 - RNA, 12 nt, Chlamydophila pneumoniae CWL029
guaccaagaaaa

SEQ ID NO: 507205 - RNA, 12 nt, Chlamydophila pneumoniae CWL029
guaaucuaagaa

SEQ ID NO: 507206 - RNA, 15 nt, Chlamydophila pneumoniae CWL029
guaaucuaagaaucu

SEQ ID NO: 507207 - RNA, 18 nt, Chlamydophila pneumoniae CWL029
guaaucgagagaagaaau

SEQ ID NO: 507208 - RNA, 21 nt, Chlamydophila pneumoniae CWL029
guaaaucauuggaaccauagg

SEQ ID NO: 507209 - RNA, 13 nt, Chlamydophila pneumoniae CWL029
guaaauaauaacc

SEQ ID NO: 507210 - RNA, 14 nt, Chlamydophila pneumoniae CWL029
guaaaguaugcaua

SEQ ID NO: 507211 - RNA, 20 nt, Chlamydophila pneumoniae CWL029
guaaaguaugcauagccucg

SEQ ID NO: 507212 - RNA, 18 nt, Chlamydophila pneumoniae CWL029
guaaagccacauucuucu

SEQ ID NO: 507213 - RNA, 19 nt, Chlamydophila pneumoniae CWL029
guaaauuuuuccuucaaca

SEQ ID NO: 507214 - RNA, 20 nt, Chlamydophila pneumoniae CWL029
guaaauuuuuccuucaacac

SEQ ID NO: 507215 - RNA, 17 nt, Chlamydophila pneumoniae CWL029
guaaaugaggcuccucc

SEQ ID NO: 507216 - RNA, 20 nt, Chlamydophila pneumoniae CWL029
guaaaccaauugagcucucu

SEQ ID NO: 507217 - RNA, 20 nt, Chlamydophila pneumoniae CWL029
guaaagaguagccccagcaa

SEQ ID NO: 507218 - RNA, 14 nt, Chlamydophila pneumoniae CWL029
guaaagauucuauu

SEQ ID NO: 507219 - RNA, 15 nt, Chlamydophila pneumoniae CWL029
guaaagaaaagcaau

SEQ ID NO: 507220 - RNA, 16 nt, Chlamydophila pneumoniae CWL029
guaacauccauagaga

SEQ ID NO: 507221 - RNA, 18 nt, Chlamydophila pneumoniae CWL029
guaaccaacaucaaagaa

SEQ ID NO: 507222 - RNA, 19 nt, Chlamydophila pneumoniae CWL029
guaaccaacaucaaagaau

SEQ ID NO: 507223 - RNA, 14 nt, Chlamydophila pneumoniae CWL029
guaaccacaggauc

SEQ ID NO: 507224 - RNA, 17 nt, Chlamydophila pneumoniae CWL029
guaacgcugcuaauguu

SEQ ID NO: 507225 - RNA, 19 nt, Chlamydophila pneumoniae CWL029
guaacuaauaaucauaucu

SEQ ID NO: 507226 - RNA, 17 nt, Chlamydophila pneumoniae CWL029
guaacucuuaagaauaa

SEQ ID NO: 507227 - RNA, 22 nt, Chlamydophila pneumoniae CWL029
guaagaacguauacgucccaca

SEQ ID NO: 507228 - RNA, 18 nt, Chlamydophila pneumoniae CWL029
guaagaaggcagagaacu

SEQ ID NO: 507229 - RNA, 18 nt, Chlamydophila pneumoniae CWL029
guaagacuaaaaaagaga

SEQ ID NO: 507230 - RNA, 15 nt, Chlamydophila pneumoniae CWL029
guaagagaauuauua

SEQ ID NO: 507231 - RNA, 17 nt, Chlamydophila pneumoniae CWL029
guaagguuaucuuuuug

SEQ ID NO: 507232 - RNA, 15 nt, Chlamydophila pneumoniae CWL029
guaaguacacauugu

SEQ ID NO: 507233 - RNA, 21 nt, Chlamydophila pneumoniae CWL029
guaagcagugugcugauuuua

SEQ ID NO: 507234 - RNA, 22 nt, Chlamydophila pneumoniae CWL029
guaagcagugugcugauuuuaa

SEQ ID NO: 507235 - RNA, 22 nt, Chlamydophila pneumoniae CWL029
guaauaacuauaauauaacugc

SEQ ID NO: 507236 - RNA, 18 nt, Chlamydophila pneumoniae CWL029
guaauagguuucaauaga

SEQ ID NO: 507237 - RNA, 21 nt, Chlamydophila pneumoniae CWL029
guaauagguuucaauagaagc

SEQ ID NO: 507238 - RNA, 14 nt, Chlamydophila pneumoniae CWL029
guaauccuucuuuc

SEQ ID NO: 507239 - RNA, 18 nt, Chlamydophila pneumoniae CWL029
guaauccuucuuucugcu

SEQ ID NO: 507240 - RNA, 23 nt, Chlamydophila pneumoniae CWL029
guaauccuucuuucugcucuucu

SEQ ID NO: 507241 - RNA, 18 nt, Chlamydophila pneumoniae CWL029
ggugggaagccuggaaau

SEQ ID NO: 507242 - RNA, 15 nt, Chlamydophila pneumoniae CWL029
ggugaacuaaaucuc

SEQ ID NO: 507243 - RNA, 16 nt, Chlamydophila pneumoniae CWL029
ggugaaaguacaggag

SEQ ID NO: 507244 - RNA, 22 nt, Chlamydophila pneumoniae CWL029
ggucgauugagauugaggauaa

SEQ ID NO: 507245 - RNA, 18 nt, Chlamydophila pneumoniae CWL029
ggucgauaucccacagaa

SEQ ID NO: 507246 - RNA, 19 nt, Chlamydophila pneumoniae CWL029
ggucgauaucccacagaaa

SEQ ID NO: 507247 - RNA, 16 nt, Chlamydophila pneumoniae CWL029
ggucgaucaagguguu

SEQ ID NO: 507248 - RNA, 14 nt, Chlamydophila pneumoniae CWL029
gguaauacccucaa

SEQ ID NO: 507249 - RNA, 19 nt, Chlamydophila pneumoniae CWL029
gguacgcuuuuucuugaaa

SEQ ID NO: 507250 - RNA, 18 nt, Chlamydophila pneumoniae CWL029
gguagcagaguuuuuccc

SEQ ID NO: 507251 - RNA, 19 nt, Chlamydophila pneumoniae CWL029
gguagauccuauaguaauu

SEQ ID NO: 507252 - RNA, 14 nt, Chlamydophila pneumoniae CWL029
gguagcuuaagaau

SEQ ID NO: 507253 - RNA, 20 nt, Chlamydophila pneumoniae CWL029
gguagucccuuucuauuuca

SEQ ID NO: 507254 - RNA, 12 nt, Chlamydophila pneumoniae CWL029
gguagugaucug

SEQ ID NO: 507255 - RNA, 12 nt, Chlamydophila pneumoniae CWL029
gguaaggaggaa

SEQ ID NO: 507256 - RNA, 15 nt, Chlamydophila pneumoniae CWL029
gguaaauuuuuaaaa

SEQ ID NO: 507257 - RNA, 12 nt, Chlamydophila pneumoniae CWL029
ggguuucccugu

SEQ ID NO: 507258 - RNA, 21 nt, Chlamydophila pneumoniae CWL029
ggguuguauuuccuucuuuua

SEQ ID NO: 507259 - RNA, 15 nt, Chlamydophila pneumoniae CWL029
gggcaggggauaggc

SEQ ID NO: 507260 - RNA, 19 nt, Chlamydophila pneumoniae CWL029
gggauaggcaagauuauga

SEQ ID NO: 507261 - RNA, 17 nt, Chlamydophila pneumoniae CWL029
gggaucuccuugagaga

SEQ ID NO: 507262 - RNA, 11 nt, Chlamydophila pneumoniae CWL029
gggaaagaaac

SEQ ID NO: 507263 - RNA, 13 nt, Chlamydophila pneumoniae CWL029
gggaaagaaacua

SEQ ID NO: 507264 - RNA, 16 nt, Chlamydophila pneumoniae CWL029
gggaaagacucaucuu

SEQ ID NO: 507265 - RNA, 10 nt, Chlamydophila pneumoniae CWL029
gggagcuucc

SEQ ID NO: 507266 - RNA, 13 nt, Chlamydophila pneumoniae CWL029
gggaaaagaaaag

SEQ ID NO: 507267 - RNA, 19 nt, Chlamydophila pneumoniae CWL029
ggcuuuaaguguuucuuca

SEQ ID NO: 507268 - RNA, 14 nt, Chlamydophila pneumoniae CWL029
ggcuuuuuccaaaa

SEQ ID NO: 507269 - RNA, 22 nt, Chlamydophila pneumoniae CWL029
ggcugcuuuuguuguuuuugcu

SEQ ID NO: 507270 - RNA, 18 nt, Chlamydophila pneumoniae CWL029
ggcucuccuaaaccauca

SEQ ID NO: 507271 - RNA, 21 nt, Chlamydophila pneumoniae CWL029
ggcucucaaggucacagcauu

SEQ ID NO: 507272 - RNA, 22 nt, Chlamydophila pneumoniae CWL029
ggcucuaggacccguagccccu

SEQ ID NO: 507273 - RNA, 15 nt, Chlamydophila pneumoniae CWL029
ggcucuauaggggau

SEQ ID NO: 507274 - RNA, 24 nt, Chlamydophila pneumoniae CWL029
ggcugauucucccaauauccagaa

SEQ ID NO: 507275 - RNA, 11 nt, Chlamydophila pneumoniae CWL029
ggcucaaagaa

SEQ ID NO: 507276 - RNA, 12 nt, Chlamydophila pneumoniae CWL029
ggcucaaagaaa

SEQ ID NO: 507277 - RNA, 14 nt, Chlamydophila pneumoniae CWL029
ggcuauagaauaca

SEQ ID NO: 507278 - RNA, 18 nt, Chlamydophila pneumoniae CWL029
ggcuauagaauacacagc

SEQ ID NO: 507279 - RNA, 24 nt, Chlamydophila pneumoniae CWL029
ggcuauaauuaacguuucuucgca

SEQ ID NO: 507280 - RNA, 16 nt, Chlamydophila pneumoniae CWL029
ggcuacuuuaagaccu

SEQ ID NO: 507281 - RNA, 14 nt, Chlamydophila pneumoniae CWL029
ggcuaaauaaacca

SEQ ID NO: 507282 - RNA, 19 nt, Chlamydophila pneumoniae CWL029
ggcuaaauaaaccacgaau

SEQ ID NO: 507283 - RNA, 21 nt, Chlamydophila pneumoniae CWL029
ggcguuccagcuccuuuugaa

SEQ ID NO: 507284 - RNA, 20 nt, Chlamydophila pneumoniae CWL029
ggcggagaauaucaucuucc

SEQ ID NO: 507285 - RNA, 18 nt, Chlamydophila pneumoniae CWL029
ggccugagaccauaaaau

SEQ ID NO: 507286 - RNA, 14 nt, Chlamydophila pneumoniae CWL029
ggccucaacacgcu

SEQ ID NO: 507287 - RNA, 16 nt, Chlamydophila pneumoniae CWL029
ggcaugaaagauaaug

SEQ ID NO: 507288 - RNA, 12 nt, Chlamydophila pneumoniae CWL029
ggcaucuuuuac

SEQ ID NO: 507289 - RNA, 21 nt, Chlamydophila pneumoniae CWL029
ggccaagagcuugucuuccac

SEQ ID NO: 507290 - RNA, 20 nt, Chlamydophila pneumoniae CWL029
ggccaagauucucacucuau

SEQ ID NO: 507291 - RNA, 17 nt, Chlamydophila pneumoniae CWL029
ggcauaaaaaaguccua

SEQ ID NO: 507292 - RNA, 17 nt, Chlamydophila pneumoniae CWL029
ggcagguaguaggacaa

SEQ ID NO: 507293 - RNA, 14 nt, Chlamydophila pneumoniae CWL029
ggcacuggcaugga

SEQ ID NO: 507294 - RNA, 22 nt, Chlamydophila pneumoniae CWL029
ggcaccucaauaaaucuauucc

SEQ ID NO: 507295 - RNA, 15 nt, Chlamydophila pneumoniae CWL029
ggcaauagcuuugaa

SEQ ID NO: 507296 - RNA, 22 nt, Chlamydophila pneumoniae CWL029
ggcaacaagagcgcauuuuaca

SEQ ID NO: 507297 - RNA, 16 nt, Chlamydophila pneumoniae CWL029
ggauuucuucuucuaa

SEQ ID NO: 507298 - RNA, 15 nt, Chlamydophila pneumoniae CWL029
ggauuaguaacuaaa

SEQ ID NO: 507299 - RNA, 22 nt, Chlamydophila pneumoniae CWL029
ggauuaucccaaacuucuucuc

SEQ ID NO: 507300 - RNA, 15 nt, Chlamydophila pneumoniae CWL029
ggauucacaucuuaa

SEQ ID NO: 507301 - RNA, 20 nt, Chlamydophila pneumoniae CWL029
ggaucucaucauaaauaggc

SEQ ID NO: 507302 - RNA, 23 nt, Chlamydophila pneumoniae CWL029
ggaugcagaucauaucggcagca

SEQ ID NO: 507303 - RNA, 22 nt, Chlamydophila pneumoniae CWL029
ggaucucucuuuccuuagcauu

SEQ ID NO: 507304 - RNA, 18 nt, Chlamydophila pneumoniae CWL029
ggaucuucagagagaaca

SEQ ID NO: 507305 - RNA, 17 nt, Chlamydophila pneumoniae CWL029
ggaugaggucuuuagca

SEQ ID NO: 507306 - RNA, 13 nt, Chlamydophila pneumoniae CWL029
ggagucuuggaua

SEQ ID NO: 507307 - RNA, 20 nt, Chlamydophila pneumoniae CWL029
ggagugaggaaucauaacca

SEQ ID NO: 507308 - RNA, 18 nt, Chlamydophila pneumoniae CWL029
ggaguucuugauucucuu

SEQ ID NO: 507309 - RNA, 14 nt, Chlamydophila pneumoniae CWL029
ggagucgugcagga

SEQ ID NO: 507310 - RNA, 17 nt, Chlamydophila pneumoniae CWL029
ggauaggcaagauuaug

SEQ ID NO: 507311 - RNA, 20 nt, Chlamydophila pneumoniae CWL029
ggauacucugaacaggaaua

SEQ ID NO: 507312 - RNA, 12 nt, Chlamydophila pneumoniae CWL029
ggauacuuagca

SEQ ID NO: 507313 - RNA, 18 nt, Chlamydophila pneumoniae CWL029
ggaguacuucuuacccua

SEQ ID NO: 507314 - RNA, 13 nt, Chlamydophila pneumoniae CWL029
ggaggaggcagua

SEQ ID NO: 507315 - RNA, 21 nt, Chlamydophila pneumoniae CWL029
ggacgagaaccaaagcagugu

SEQ ID NO: 507316 - RNA, 17 nt, Chlamydophila pneumoniae CWL029
ggaccuuaagaugaggu

SEQ ID NO: 507317 - RNA, 23 nt, Chlamydophila pneumoniae CWL029
ggaccuuauacccacaaagauca

SEQ ID NO: 507318 - RNA, 18 nt, Chlamydophila pneumoniae CWL029
ggaccuuccuuaucuuca

SEQ ID NO: 507319 - RNA, 23 nt, Chlamydophila pneumoniae CWL029
ggaccagguguagguuccugcuu

SEQ ID NO: 507320 - RNA, 13 nt, Chlamydophila pneumoniae CWL029
ggacaugccuuag

SEQ ID NO: 507321 - RNA, 22 nt, Chlamydophila pneumoniae CWL029
ggaccacaauuccuaaaacaag

SEQ ID NO: 507322 - RNA, 19 nt, Chlamydophila pneumoniae CWL029
ggacagcacauagagugug

SEQ ID NO: 507323 - RNA, 19 nt, Chlamydophila pneumoniae CWL029
ggaauaacaccaaaagaau

SEQ ID NO: 507324 - RNA, 10 nt, Chlamydophila pneumoniae CWL029
ggaaguguag

SEQ ID NO: 507325 - RNA, 20 nt, Chlamydophila pneumoniae CWL029
ggaaguccauguacagaaaa

SEQ ID NO: 507326 - RNA, 21 nt, Chlamydophila pneumoniae CWL029
gcucgguacgucuuucaccaa

SEQ ID NO: 507327 - RNA, 22 nt, Chlamydophila pneumoniae CWL029
ggaauccuuuggaagcuaucau

SEQ ID NO: 507328 - RNA, 15 nt, Chlamydophila pneumoniae CWL029
ggaauacauuccuag

SEQ ID NO: 507329 - RNA, 20 nt, Chlamydophila pneumoniae CWL029
ggaauacgaucugcuuugca

SEQ ID NO: 507330 - RNA, 14 nt, Chlamydophila pneumoniae CWL029
ggacaaaucuccca

SEQ ID NO: 507331 - RNA, 13 nt, Chlamydophila pneumoniae CWL029
ggacaacagcaac

SEQ ID NO: 507332 - RNA, 17 nt, Chlamydophila pneumoniae CWL029
ggaaucucgggagaaca

SEQ ID NO: 507333 - RNA, 18 nt, Chlamydophila pneumoniae CWL029
ggaaugcauuucaugaau

SEQ ID NO: 507334 - RNA, 17 nt, Chlamydophila pneumoniae CWL029
cugcagguaagggaugc

SEQ ID NO: 507335 - RNA, 13 nt, Chlamydophila pneumoniae CWL029
cugcaugaauaua

SEQ ID NO: 507336 - RNA, 11 nt, Chlamydophila pneumoniae CWL029
cugcauggcuu

SEQ ID NO: 507337 - RNA, 18 nt, Chlamydophila pneumoniae CWL029
cugcauggcuuugugagc

SEQ ID NO: 507338 - RNA, 13 nt, Chlamydophila pneumoniae CWL029
cugcauuccagga

SEQ ID NO: 507339 - RNA, 23 nt, Chlamydophila pneumoniae CWL029
cugcccauuuuuggaaaaccaug

SEQ ID NO: 507340 - RNA, 19 nt, Chlamydophila pneumoniae CWL029
cugccagugacauaaucac

SEQ ID NO: 507341 - RNA, 21 nt, Chlamydophila pneumoniae CWL029
cugccagagauucuucacaau

SEQ ID NO: 507342 - RNA, 16 nt, Chlamydophila pneumoniae CWL029
cugcgcaaagaacuca

SEQ ID NO: 507343 - RNA, 15 nt, Chlamydophila pneumoniae CWL029
cugccuuaugcucau

SEQ ID NO: 507344 - RNA, 15 nt, Chlamydophila pneumoniae CWL029
cugcgccaugcacaa

SEQ ID NO: 507345 - RNA, 19 nt, Chlamydophila pneumoniae CWL029
cuggauuucuucuguuuuc

SEQ ID NO: 507346 - RNA, 16 nt, Chlamydophila pneumoniae CWL029
cuggauuuuaaagcaa

SEQ ID NO: 507347 - RNA, 18 nt, Chlamydophila pneumoniae CWL029
cugcuggaguagcucaau

SEQ ID NO: 507348 - RNA, 14 nt, Chlamydophila pneumoniae CWL029
cugcugcuuugaca

SEQ ID NO: 507349 - RNA, 24 nt, Chlamydophila pneumoniae CWL029
cugcuuugacgacucugccauguc

SEQ ID NO: 507350 - RNA, 15 nt, Chlamydophila pneumoniae CWL029
cugcuucaaaacaua

SEQ ID NO: 507351 - RNA, 22 nt, Chlamydophila pneumoniae CWL029
cugcuucaaaacauaaccuccu

SEQ ID NO: 507352 - RNA, 15 nt, Chlamydophila pneumoniae CWL029
cugcuuuuuuucuag

SEQ ID NO: 507353 - RNA, 19 nt, Chlamydophila pneumoniae CWL029
cugcuuuuuugaucugaag

SEQ ID NO: 507354 - RNA, 12 nt, Chlamydophila pneumoniae CWL029
cuggaaagccaa

SEQ ID NO: 507355 - RNA, 14 nt, Chlamydophila pneumoniae CWL029
cugcuuuuguuguu

SEQ ID NO: 507356 - RNA, 21 nt, Chlamydophila pneumoniae CWL029
cugcuuuuguuguuuuugcug

SEQ ID NO: 507357 - RNA, 22 nt, Chlamydophila pneumoniae CWL029
cuggaaaugaauauaauuccaa

SEQ ID NO: 507358 - RNA, 17 nt, Chlamydophila pneumoniae CWL029
cugcugccaugcagccu

SEQ ID NO: 507359 - RNA, 16 nt, Chlamydophila pneumoniae CWL029
aaacucaaucucuuug

SEQ ID NO: 507360 - RNA, 17 nt, Chlamydophila pneumoniae CWL029
cugcucccuccuccucg

SEQ ID NO: 507361 - RNA, 15 nt, Chlamydophila pneumoniae CWL029
cugcuccugaagcug

SEQ ID NO: 507362 - RNA, 21 nt, Chlamydophila pneumoniae CWL029
cugcucuauauauccugagug

SEQ ID NO: 507363 - RNA, 22 nt, Chlamydophila pneumoniae CWL029
cugcucuauauauccugaguga

SEQ ID NO: 507364 - RNA, 20 nt, Chlamydophila pneumoniae CWL029
cugcucucugaagcuaaaaa

SEQ ID NO: 507365 - RNA, 15 nt, Chlamydophila pneumoniae CWL029
cugcuauaaccaacu

SEQ ID NO: 507366 - RNA, 19 nt, Chlamydophila pneumoniae CWL029
cugcuauaaccaacuuccu

SEQ ID NO: 507367 - RNA, 19 nt, Chlamydophila pneumoniae CWL029
cugcuauacaaccacuucc

SEQ ID NO: 507368 - RNA, 18 nt, Chlamydophila pneumoniae CWL029
cugcuaaacuuuuuuuca

SEQ ID NO: 507369 - RNA, 15 nt, Chlamydophila pneumoniae CWL029
cugcguuucuuucug

SEQ ID NO: 507370 - RNA, 17 nt, Chlamydophila pneumoniae CWL029
cugcguuaaacccuuca

SEQ ID NO: 507371 - RNA, 20 nt, Chlamydophila pneumoniae CWL029
cugcguuaaacccuucaagc

SEQ ID NO: 507372 - RNA, 17 nt, Chlamydophila pneumoniae CWL029
cugcgucaauaagcuug

SEQ ID NO: 507373 - RNA, 20 nt, Chlamydophila pneumoniae CWL029
cugcgucaauaagcuugcca

SEQ ID NO: 507374 - RNA, 13 nt, Chlamydophila pneumoniae CWL029
cugcgucaauaag

SEQ ID NO: 507375 - RNA, 17 nt, Chlamydophila pneumoniae CWL029
cugcgcuagcuccagca

SEQ ID NO: 507376 - RNA, 16 nt, Chlamydophila pneumoniae CWL029
cugcgcuaucaucauu

SEQ ID NO: 507377 - RNA, 18 nt, Chlamydophila pneumoniae CWL029
cugcgcuaucaucauuuc

SEQ ID NO: 507378 - RNA, 21 nt, Chlamydophila pneumoniae CWL029
cugcaaagcccccucccccac

SEQ ID NO: 507379 - RNA, 14 nt, Chlamydophila pneumoniae CWL029
cugaugccaagaaa

SEQ ID NO: 507380 - RNA, 13 nt, Chlamydophila pneumoniae CWL029
cugauucucccaa

SEQ ID NO: 507381 - RNA, 18 nt, Chlamydophila pneumoniae CWL029
cugauugagaauaaaacu

SEQ ID NO: 507382 - RNA, 19 nt, Chlamydophila pneumoniae CWL029
cugcaaaaaguuucaaucu

SEQ ID NO: 507383 - RNA, 14 nt, Chlamydophila pneumoniae CWL029
cugauccagcucca

SEQ ID NO: 507384 - RNA, 16 nt, Chlamydophila pneumoniae CWL029
cugaucccucaaaauc

SEQ ID NO: 507385 - RNA, 15 nt, Chlamydophila pneumoniae CWL029
cugaucccuuagaaa

SEQ ID NO: 507386 - RNA, 16 nt, Chlamydophila pneumoniae CWL029
cugagugauguuugac

SEQ ID NO: 507387 - RNA, 21 nt, Chlamydophila pneumoniae CWL029
cugagucauaagcucuauuuc

SEQ ID NO: 507388 - RNA, 19 nt, Chlamydophila pneumoniae CWL029
cugauacgcagcuagaggc

SEQ ID NO: 507389 - RNA, 18 nt, Chlamydophila pneumoniae CWL029
cugagagaagcagaaucu

SEQ ID NO: 507390 - RNA, 17 nt, Chlamydophila pneumoniae CWL029
cugagagauuuuuucau

SEQ ID NO: 507391 - RNA, 23 nt, Chlamydophila pneumoniae CWL029
cugagaguguuguuggagcagaa

SEQ ID NO: 507392 - RNA, 18 nt, Chlamydophila pneumoniae CWL029
cugagaccauaaaaucaa

SEQ ID NO: 507393 - RNA, 16 nt, Chlamydophila pneumoniae CWL029
cugagaccauaaaauc

SEQ ID NO: 507394 - RNA, 17 nt, Chlamydophila pneumoniae CWL029
cugagaccauacacaaa

SEQ ID NO: 507395 - RNA, 15 nt, Chlamydophila pneumoniae CWL029
cugagaaagaagucc

SEQ ID NO: 507396 - RNA, 15 nt, Chlamydophila pneumoniae CWL029
cugagaaguuaagac

SEQ ID NO: 507397 - RNA, 17 nt, Chlamydophila pneumoniae CWL029
cugagaauacaacccuu

SEQ ID NO: 507398 - RNA, 21 nt, Chlamydophila pneumoniae CWL029
cugagaauacaacccuuuaua

SEQ ID NO: 507399 - RNA, 23 nt, Chlamydophila pneumoniae CWL029
cugagaauacaacccuuuauacu

SEQ ID NO: 507400 - RNA, 13 nt, Chlamydophila pneumoniae CWL029
cugagcagcuucg

SEQ ID NO: 507401 - RNA, 15 nt, Chlamydophila pneumoniae CWL029
cugacuauaaaaugc

SEQ ID NO: 507402 - RNA, 17 nt, Chlamydophila pneumoniae CWL029
cugacacuccucagaau

SEQ ID NO: 507403 - RNA, 18 nt, Chlamydophila pneumoniae CWL029
cugacacucagcucccau

SEQ ID NO: 507404 - RNA, 15 nt, Chlamydophila pneumoniae CWL029
cugacacuccucaga

SEQ ID NO: 507405 - RNA, 12 nt, Chlamydophila pneumoniae CWL029
cugaagcugcaa

SEQ ID NO: 507406 - RNA, 15 nt, Chlamydophila pneumoniae CWL029
cugaagcugcaaacu

SEQ ID NO: 507407 - RNA, 18 nt, Chlamydophila pneumoniae CWL029
cugaccaucaaugagauc

SEQ ID NO: 507408 - RNA, 20 nt, Chlamydophila pneumoniae CWL029
cugaccaucaaugagaucug

SEQ ID NO: 507409 - RNA, 16 nt, Chlamydophila pneumoniae CWL029
cugaagccaugacaaa

SEQ ID NO: 507410 - RNA, 10 nt, Chlamydophila pneumoniae CWL029
cugaagauuu

SEQ ID NO: 507411 - RNA, 20 nt, Chlamydophila pneumoniae CWL029
cugaagaucccugagccugu

SEQ ID NO: 507412 - RNA, 19 nt, Chlamydophila pneumoniae CWL029
cugaagauggcaaggaaaa

SEQ ID NO: 507413 - RNA, 16 nt, Chlamydophila pneumoniae CWL029
cugaacuugauuuguu

SEQ ID NO: 507414 - RNA, 19 nt, Chlamydophila pneumoniae CWL029
cugaagagcaauuaagaaa

SEQ ID NO: 507415 - RNA, 15 nt, Chlamydophila pneumoniae CWL029
cugaagaggccugca

SEQ ID NO: 507416 - RNA, 20 nt, Chlamydophila pneumoniae CWL029
cugaagauauauuuuuaaag

SEQ ID NO: 507417 - RNA, 17 nt, Chlamydophila pneumoniae CWL029
cugaacgccaucuccac

SEQ ID NO: 507418 - RNA, 23 nt, Chlamydophila pneumoniae CWL029
cugaaccgcaaaaagcuucuuuc

SEQ ID NO: 507419 - RNA, 15 nt, Chlamydophila pneumoniae CWL029
cugaaaucaaaaaaa

SEQ ID NO: 507420 - RNA, 16 nt, Chlamydophila pneumoniae CWL029
cugaaauuaagucaca

SEQ ID NO: 507421 - RNA, 12 nt, Chlamydophila pneumoniae CWL029
cucuuugaggau

SEQ ID NO: 507422 - RNA, 15 nt, Chlamydophila pneumoniae CWL029
cucuuuuaaagugag

SEQ ID NO: 507423 - RNA, 18 nt, Chlamydophila pneumoniae CWL029
cucuuuuagagccuuuuc

SEQ ID NO: 507424 - RNA, 21 nt, Chlamydophila pneumoniae CWL029
cucuuucuauagcuccuuggc

SEQ ID NO: 507425 - RNA, 20 nt, Chlamydophila pneumoniae CWL029
cucuuucauacuaaaaucuu

SEQ ID NO: 507426 - RNA, 22 nt, Chlamydophila pneumoniae CWL029
cugaaaaugauucauaacauug

SEQ ID NO: 507427 - RNA, 18 nt, Chlamydophila pneumoniae CWL029
cucuuuaaauguugggau

SEQ ID NO: 507428 - RNA, 20 nt, Chlamydophila pneumoniae CWL029
cucuuuaaaaauagaaauaa

SEQ ID NO: 507429 - RNA, 21 nt, Chlamydophila pneumoniae CWL029
cucuuuaacuucuaaaagcaa

SEQ ID NO: 507430 - RNA, 13 nt, Chlamydophila pneumoniae CWL029
cucuuuaaaaaau

SEQ ID NO: 507431 - RNA, 13 nt, Chlamydophila pneumoniae CWL029
cucuuuaaaaggg

SEQ ID NO: 507432 - RNA, 22 nt, Chlamydophila pneumoniae CWL029
cucuuuaaaagggcgcuucccu

SEQ ID NO: 507433 - RNA, 16 nt, Chlamydophila pneumoniae CWL029
cucuugcucuagucuu

SEQ ID NO: 507434 - RNA, 14 nt, Chlamydophila pneumoniae CWL029
cucuugaggaccuu

SEQ ID NO: 507435 - RNA, 20 nt, Chlamydophila pneumoniae CWL029
cucuugcgucacauuuguug

SEQ ID NO: 507436 - RNA, 22 nt, Chlamydophila pneumoniae CWL029
cucuugcgucacauuuguuguc

SEQ ID NO: 507437 - RNA, 13 nt, Chlamydophila pneumoniae CWL029
cucuucucuauaa

SEQ ID NO: 507438 - RNA, 16 nt, Chlamydophila pneumoniae CWL029
cucuucucuauaaaaa

SEQ ID NO: 507439 - RNA, 14 nt, Chlamydophila pneumoniae CWL029
cucuucauuuucuu

SEQ ID NO: 507440 - RNA, 13 nt, Chlamydophila pneumoniae CWL029
cucuuccaaaagu

SEQ ID NO: 507441 - RNA, 15 nt, Chlamydophila pneumoniae CWL029
cucuucccuuguuau

SEQ ID NO: 507442 - RNA, 13 nt, Chlamydophila pneumoniae CWL029
cucuuccuucucc

SEQ ID NO: 507443 - RNA, 15 nt, Chlamydophila pneumoniae CWL029
cucugggaauuguuc

SEQ ID NO: 507444 - RNA, 15 nt, Chlamydophila pneumoniae CWL029
cucuggaauacauuc

SEQ ID NO: 507445 - RNA, 22 nt, Chlamydophila pneumoniae CWL029
cucuguaauauucaacauguua

SEQ ID NO: 507446 - RNA, 23 nt, Chlamydophila pneumoniae CWL029
cucuguagguuuuuccaacuuca

SEQ ID NO: 507447 - RNA, 11 nt, Chlamydophila pneumoniae CWL029
cucuguaguaa

SEQ ID NO: 507448 - RNA, 18 nt, Chlamydophila pneumoniae CWL029
cucuguauuggaaaguau

SEQ ID NO: 507449 - RNA, 16 nt, Chlamydophila pneumoniae CWL029
cucugugguuccugga

SEQ ID NO: 507450 - RNA, 17 nt, Chlamydophila pneumoniae CWL029
cucugugguuccuggau

SEQ ID NO: 507451 - RNA, 20 nt, Chlamydophila pneumoniae CWL029
cucuguguuuugaggaacuu

SEQ ID NO: 507452 - RNA, 23 nt, Chlamydophila pneumoniae CWL029
cucuuaucgugacucuuaucugg

SEQ ID NO: 507453 - RNA, 21 nt, Chlamydophila pneumoniae CWL029
cucuuaucuggagaugcgcuc

SEQ ID NO: 507454 - RNA, 15 nt, Chlamydophila pneumoniae CWL029
cucuuauguuaaaaa

SEQ ID NO: 507455 - RNA, 16 nt, Chlamydophila pneumoniae CWL029
cucuuauugcagaauc

SEQ ID NO: 507456 - RNA, 17 nt, Chlamydophila pneumoniae CWL029
cucuucaaagacaggcu

SEQ ID NO: 507457 - RNA, 14 nt, Chlamydophila pneumoniae CWL029
cucuuaagaauaaa

SEQ ID NO: 507458 - RNA, 20 nt, Chlamydophila pneumoniae CWL029
cucuuaaaugugaaaucgua

SEQ ID NO: 507459 - RNA, 14 nt, Chlamydophila pneumoniae CWL029
cucuuaauuaaaaa

SEQ ID NO: 507460 - RNA, 20 nt, Chlamydophila pneumoniae CWL029
cucuguugggagcuuccucc

SEQ ID NO: 507461 - RNA, 22 nt, Chlamydophila pneumoniae CWL029
cucuguugggagcuuccuccaa

SEQ ID NO: 507462 - RNA, 14 nt, Chlamydophila pneumoniae CWL029
cucuguuuccuugu

SEQ ID NO: 507463 - RNA, 14 nt, Chlamydophila pneumoniae CWL029
cucuuaaaauauua

SEQ ID NO: 507464 - RNA, 17 nt, Chlamydophila pneumoniae CWL029
cucuuaaaauauuaaau

SEQ ID NO: 507465 - RNA, 14 nt, Chlamydophila pneumoniae CWL029
cucuucaagagcuu

SEQ ID NO: 507466 - RNA, 22 nt, Chlamydophila pneumoniae CWL029
cucuucacuauuaggcuuuuuu

SEQ ID NO: 507467 - RNA, 19 nt, Chlamydophila pneumoniae CWL029
cucuucacuuauaagcugc

SEQ ID NO: 507468 - RNA, 20 nt, Chlamydophila pneumoniae CWL029
cucuucauugcaaaaaugaa

SEQ ID NO: 507469 - RNA, 12 nt, Chlamydophila pneumoniae CWL029
cucugcagggaa

SEQ ID NO: 507470 - RNA, 14 nt, Chlamydophila pneumoniae CWL029
cucugcagggaauc

SEQ ID NO: 507471 - RNA, 20 nt, Chlamydophila pneumoniae CWL029
cucugacacuccucagaauc

SEQ ID NO: 507472 - RNA, 14 nt, Chlamydophila pneumoniae CWL029
cucugaccaucaau

SEQ ID NO: 507473 - RNA, 22 nt, Chlamydophila pneumoniae CWL029
cucugaccaucaaugagaucug

SEQ ID NO: 507474 - RNA, 15 nt, Chlamydophila pneumoniae CWL029
cucugagcagcuucg

SEQ ID NO: 507475 - RNA, 13 nt, Chlamydophila pneumoniae CWL029
cucugcauauaaa

SEQ ID NO: 507476 - RNA, 23 nt, Chlamydophila pneumoniae CWL029
cucugccuaccaaaguuuguagc

SEQ ID NO: 507477 - RNA, 20 nt, Chlamydophila pneumoniae CWL029
cucugccaugucuaaaggag

SEQ ID NO: 507478 - RNA, 21 nt, Chlamydophila pneumoniae CWL029
cucugccaugucuaaaggagu

SEQ ID NO: 507479 - RNA, 13 nt, Chlamydophila pneumoniae CWL029
cucugaacaggaa

SEQ ID NO: 507480 - RNA, 23 nt, Chlamydophila pneumoniae CWL029
cucugaagaccccucuugcuuuu

SEQ ID NO: 507481 - RNA, 23 nt, Chlamydophila pneumoniae CWL029
cucucuuuaaaaauauaucuuca

SEQ ID NO: 507482 - RNA, 21 nt, Chlamydophila pneumoniae CWL029
cucucuuuaaaccuggcauug

SEQ ID NO: 507483 - RNA, 14 nt, Chlamydophila pneumoniae CWL029
cucucuuaaauuua

SEQ ID NO: 507484 - RNA, 14 nt, Chlamydophila pneumoniae CWL029
cucucuuccaaaag

SEQ ID NO: 507485 - RNA, 19 nt, Chlamydophila pneumoniae CWL029
cucucuuccugcugcuuug

SEQ ID NO: 507486 - RNA, 14 nt, Chlamydophila pneumoniae CWL029
cucucuuccuucuc

SEQ ID NO: 507487 - RNA, 11 nt, Chlamydophila pneumoniae CWL029
cucucuucuuc

SEQ ID NO: 507488 - RNA, 20 nt, Chlamydophila pneumoniae CWL029
cucucuaucuacacacauga

SEQ ID NO: 507489 - RNA, 12 nt, Chlamydophila pneumoniae CWL029
cucucucugcag

SEQ ID NO: 507490 - RNA, 18 nt, Chlamydophila pneumoniae CWL029
cucucugaagcuaaaaaa

SEQ ID NO: 507491 - RNA, 15 nt, Chlamydophila pneumoniae CWL029
cucucugccuaccaa

SEQ ID NO: 507492 - RNA, 16 nt, Chlamydophila pneumoniae CWL029
cucucugccuaccaaa

SEQ ID NO: 507493 - RNA, 21 nt, Chlamydophila pneumoniae CWL029
cucuccguccaguucuucauu

SEQ ID NO: 507494 - RNA, 16 nt, Chlamydophila pneumoniae CWL029
cucuccuaaaccauca

SEQ ID NO: 507495 - RNA, 14 nt, Chlamydophila pneumoniae CWL029
cucuccuaaaccau

SEQ ID NO: 507496 - RNA, 14 nt, Chlamydophila pneumoniae CWL029
cucuccuccccacu

SEQ ID NO: 507497 - RNA, 15 nt, Chlamydophila pneumoniae CWL029
cucuccugcaaaaag

SEQ ID NO: 507498 - RNA, 11 nt, Chlamydophila pneumoniae CWL029
cucuccaaaag

SEQ ID NO: 507499 - RNA, 20 nt, Chlamydophila pneumoniae CWL029
cucuccagcuguggugguga

SEQ ID NO: 507500 - RNA, 16 nt, Chlamydophila pneumoniae CWL029
cucuccagcuugauca

SEQ ID NO: 507501 - RNA, 13 nt, Chlamydophila pneumoniae CWL029
cucuccauggcuu

SEQ ID NO: 507502 - RNA, 15 nt, Chlamydophila pneumoniae CWL029
cucucccauguagua

SEQ ID NO: 507503 - RNA, 19 nt, Chlamydophila pneumoniae CWL029
cucucaguuaaagagcauc

SEQ ID NO: 507504 - RNA, 22 nt, Chlamydophila pneumoniae CWL029
cucucaggagauaauccuuuag

SEQ ID NO: 507505 - RNA, 16 nt, Chlamydophila pneumoniae CWL029
cucucaagucuauuug

SEQ ID NO: 507506 - RNA, 12 nt, Chlamydophila pneumoniae CWL029
cucuauauuuuu

SEQ ID NO: 507507 - RNA, 21 nt, Chlamydophila pneumoniae CWL029
cucuaugguuuucauugcagu

SEQ ID NO: 507508 - RNA, 21 nt, Chlamydophila pneumoniae CWL029
cucuaggaacucuuuaaaagg

SEQ ID NO: 507509 - RNA, 19 nt, Chlamydophila pneumoniae CWL029
cucuagucuuucaaccucc

SEQ ID NO: 507510 - RNA, 13 nt, Chlamydophila pneumoniae CWL029
cucuaguuuuucu

SEQ ID NO: 507511 - RNA, 13 nt, Chlamydophila pneumoniae CWL029
cucuauaaaaaaa

SEQ ID NO: 507512 - RNA, 13 nt, Chlamydophila pneumoniae CWL029
cucuauagcauua

SEQ ID NO: 507513 - RNA, 16 nt, Chlamydophila pneumoniae CWL029
cucguacguggaaagu

SEQ ID NO: 507514 - RNA, 13 nt, Chlamydophila pneumoniae CWL029
cucgggagaacau

SEQ ID NO: 507515 - RNA, 22 nt, Chlamydophila pneumoniae CWL029
cucggauggacuacugaaacac

SEQ ID NO: 507516 - RNA, 22 nt, Chlamydophila pneumoniae CWL029
cucgcuaaaguagaauccuucu

SEQ ID NO: 507517 - RNA, 23 nt, Chlamydophila pneumoniae CWL029
cucgcuaaaguagaauccuucuc

SEQ ID NO: 507518 - RNA, 22 nt, Chlamydophila pneumoniae CWL029
cucgagauuuuuuauuuuuacu

SEQ ID NO: 507519 - RNA, 20 nt, Chlamydophila pneumoniae CWL029
cuccuugacuaaauccacca

SEQ ID NO: 507520 - RNA, 16 nt, Chlamydophila pneumoniae CWL029
cuccuugauaaaacgc

SEQ ID NO: 507521 - RNA, 15 nt, Chlamydophila pneumoniae CWL029
cuccuucaaagauau

SEQ ID NO: 507522 - RNA, 13 nt, Chlamydophila pneumoniae CWL029
cuccuucagaguu

SEQ ID NO: 507523 - RNA, 14 nt, Chlamydophila pneumoniae CWL029
cuccuuucaagagc

SEQ ID NO: 507524 - RNA, 23 nt, Chlamydophila pneumoniae CWL029
cucgaauuguguguuuucauaaa

SEQ ID NO: 507525 - RNA, 16 nt, Chlamydophila pneumoniae CWL029
cuccugcaaaaaacca

SEQ ID NO: 507526 - RNA, 20 nt, Chlamydophila pneumoniae CWL029
cuccugaagggacaaguacg

SEQ ID NO: 507527 - RNA, 18 nt, Chlamydophila pneumoniae CWL029
cuccugaagccaugacaa

SEQ ID NO: 507528 - RNA, 21 nt, Chlamydophila pneumoniae CWL029
cuccugaagcugagaauacaa

SEQ ID NO: 507529 - RNA, 18 nt, Chlamydophila pneumoniae CWL029
cuccugacucuuauugca

SEQ ID NO: 507530 - RNA, 23 nt, Chlamydophila pneumoniae CWL029
cuccugcagggggcauucccuga

SEQ ID NO: 507531 - RNA, 22 nt, Chlamydophila pneumoniae CWL029
cuccuggaagaauuucauaaga

SEQ ID NO: 507532 - RNA, 19 nt, Chlamydophila pneumoniae CWL029
cuccucgucuaaagaagau

SEQ ID NO: 507533 - RNA, 17 nt, Chlamydophila pneumoniae CWL029
cuccucuaacuucauua

SEQ ID NO: 507534 - RNA, 17 nt, Chlamydophila pneumoniae CWL029
cuccucucucaauaaga

SEQ ID NO: 507535 - RNA, 12 nt, Chlamydophila pneumoniae CWL029
cuccucugcuaa

SEQ ID NO: 507536 - RNA, 15 nt, Chlamydophila pneumoniae CWL029
cuccucugcuaagca

SEQ ID NO: 507537 - RNA, 16 nt, Chlamydophila pneumoniae CWL029
cuccuccuucugcaau

SEQ ID NO: 507538 - RNA, 15 nt, Chlamydophila pneumoniae CWL029
cuccuccuuugacac

SEQ ID NO: 507539 - RNA, 15 nt, Chlamydophila pneumoniae CWL029
cuccgaagacuacca

SEQ ID NO: 507540 - RNA, 16 nt, Chlamydophila pneumoniae CWL029
cucccaagacgagaac

SEQ ID NO: 507541 - RNA, 16 nt, Chlamydophila pneumoniae CWL029
cucccaccaaggggcg

SEQ ID NO: 507542 - RNA, 18 nt, Chlamydophila pneumoniae CWL029
cucccaaauuggagguca

SEQ ID NO: 507543 - RNA, 13 nt, Chlamydophila pneumoniae CWL029
cuccauacagcgc

SEQ ID NO: 507544 - RNA, 16 nt, Chlamydophila pneumoniae CWL029
cuccauccucagucuc

SEQ ID NO: 507545 - RNA, 22 nt, Chlamydophila pneumoniae CWL029
cuccauagaauccucggaagau

SEQ ID NO: 507546 - RNA, 15 nt, Chlamydophila pneumoniae CWL029
cucauggauuacuga

SEQ ID NO: 507547 - RNA, 20 nt, Chlamydophila pneumoniae CWL029
cucauggauuacugaagauc

SEQ ID NO: 507548 - RNA, 20 nt, Chlamydophila pneumoniae CWL029
cucaugcggacuuuauucuc

SEQ ID NO: 507549 - RNA, 17 nt, Chlamydophila pneumoniae CWL029
cucaugaaauuuucuaa

SEQ ID NO: 507550 - RNA, 13 nt, Chlamydophila pneumoniae CWL029
cucaugaagaauu

SEQ ID NO: 507551 - RNA, 21 nt, Chlamydophila pneumoniae CWL029
cucaugaagaauuaccgcgag

SEQ ID NO: 507552 - RNA, 21 nt, Chlamydophila pneumoniae CWL029
cucaucuaacgucagcugucc

SEQ ID NO: 507553 - RNA, 23 nt, Chlamydophila pneumoniae CWL029
cucaucgaaucuugauauugaaa

SEQ ID NO: 507554 - RNA, 16 nt, Chlamydophila pneumoniae CWL029
cucauccucaucauca

SEQ ID NO: 507555 - RNA, 16 nt, Chlamydophila pneumoniae CWL029
cucauccccucagaaa

SEQ ID NO: 507556 - RNA, 16 nt, Chlamydophila pneumoniae CWL029
cucaucggaucuuuuc

SEQ ID NO: 507557 - RNA, 18 nt, Chlamydophila pneumoniae CWL029
cucaucggaucuuuucuu

SEQ ID NO: 507558 - RNA, 19 nt, Chlamydophila pneumoniae CWL029
cucaucggaucuuuucuuu

SEQ ID NO: 507559 - RNA, 20 nt, Chlamydophila pneumoniae CWL029
cucaucggaucuuuucuuuc

SEQ ID NO: 507560 - RNA, 18 nt, Chlamydophila pneumoniae CWL029
cucaucacaauuuuaaaa

SEQ ID NO: 507561 - RNA, 19 nt, Chlamydophila pneumoniae CWL029
cucaucacaauuuuaaaau

SEQ ID NO: 507562 - RNA, 14 nt, Chlamydophila pneumoniae CWL029
cucauagcuuccug

SEQ ID NO: 507563 - RNA, 13 nt, Chlamydophila pneumoniae CWL029
cucaucauccuca

SEQ ID NO: 507564 - RNA, 20 nt, Chlamydophila pneumoniae CWL029
cucaucauccucaggaccua

SEQ ID NO: 507565 - RNA, 16 nt, Chlamydophila pneumoniae CWL029
cucauccagacaagac

SEQ ID NO: 507566 - RNA, 17 nt, Chlamydophila pneumoniae CWL029
cucauccagacaagaca

SEQ ID NO: 507567 - RNA, 18 nt, Chlamydophila pneumoniae CWL029
cucaucacguaagguguc

SEQ ID NO: 507568 - RNA, 23 nt, Chlamydophila pneumoniae CWL029
cucaucagaaguggccuugccag

SEQ ID NO: 507569 - RNA, 17 nt, Chlamydophila pneumoniae CWL029
cucaucagcaaaacucc

SEQ ID NO: 507570 - RNA, 20 nt, Chlamydophila pneumoniae CWL029
cucaucagcaaaacucccga

SEQ ID NO: 507571 - RNA, 21 nt, Chlamydophila pneumoniae CWL029
cucaucaguaaaagacugaaa

SEQ ID NO: 507572 - RNA, 14 nt, Chlamydophila pneumoniae CWL029
cucaucaucagaaa

SEQ ID NO: 507573 - RNA, 15 nt, Chlamydophila pneumoniae CWL029
cucaggcuuuaagug

SEQ ID NO: 507574 - RNA, 20 nt, Chlamydophila pneumoniae CWL029
cucagaauccauuuugccca

SEQ ID NO: 507575 - RNA, 22 nt, Chlamydophila pneumoniae CWL029
cucagcaaagacauccaagccu

SEQ ID NO: 507576 - RNA, 17 nt, Chlamydophila pneumoniae CWL029
cucagaauccauuuugc

SEQ ID NO: 507577 - RNA, 15 nt, Chlamydophila pneumoniae CWL029
cucagagaaaaucaa

SEQ ID NO: 507578 - RNA, 23 nt, Chlamydophila pneumoniae CWL029
cucaaauuggaauucgcauuuuu

SEQ ID NO: 507579 - RNA, 19 nt, Chlamydophila pneumoniae CWL029
cucaaaucucauuccagca

SEQ ID NO: 507580 - RNA, 17 nt, Chlamydophila pneumoniae CWL029
cucaaaucuuucaagga

SEQ ID NO: 507581 - RNA, 18 nt, Chlamydophila pneumoniae CWL029
cuauuaaggauuccuuga

SEQ ID NO: 507582 - RNA, 15 nt, Chlamydophila pneumoniae CWL029
cuauuaauacuuugc

SEQ ID NO: 507583 - RNA, 20 nt, Chlamydophila pneumoniae CWL029
cucaagaauaugaacugccu

SEQ ID NO: 507584 - RNA, 21 nt, Chlamydophila pneumoniae CWL029
cucaagagcaugcuugaggaa

SEQ ID NO: 507585 - RNA, 22 nt, Chlamydophila pneumoniae CWL029
cucaagcgauuucgaaaaagcc

SEQ ID NO: 507586 - RNA, 23 nt, Chlamydophila pneumoniae CWL029
cucaagauaaaucccacuaucug

SEQ ID NO: 507587 - RNA, 16 nt, Chlamydophila pneumoniae CWL029
cucaaggaucuuauau

SEQ ID NO: 507588 - RNA, 15 nt, Chlamydophila pneumoniae CWL029
cucaaggucacagca

SEQ ID NO: 507589 - RNA, 22 nt, Chlamydophila pneumoniae CWL029
cucaaggucacagcauuuucuc

SEQ ID NO: 507590 - RNA, 17 nt, Chlamydophila pneumoniae CWL029
cucaaggucacagcauu

SEQ ID NO: 507591 - RNA, 20 nt, Chlamydophila pneumoniae CWL029
cucaagucuauuugaaaaga

SEQ ID NO: 507592 - RNA, 21 nt, Chlamydophila pneumoniae CWL029
cucaagucuauuugaaaagaa

SEQ ID NO: 507593 - RNA, 15 nt, Chlamydophila pneumoniae CWL029
cucacaucuccuuuc

SEQ ID NO: 507594 - RNA, 24 nt, Chlamydophila pneumoniae CWL029
cucacaucuccuuucaagagcagu

SEQ ID NO: 507595 - RNA, 15 nt, Chlamydophila pneumoniae CWL029
cucaaucaaauucaa

SEQ ID NO: 507596 - RNA, 18 nt, Chlamydophila pneumoniae CWL029
cucacacgaauaauuaaa

SEQ ID NO: 507597 - RNA, 20 nt, Chlamydophila pneumoniae CWL029
cucacacgaauaauuaaauc

SEQ ID NO: 507598 - RNA, 19 nt, Chlamydophila pneumoniae CWL029
cucaauaguguaacauuga

SEQ ID NO: 507599 - RNA, 15 nt, Chlamydophila pneumoniae CWL029
cucaauacuucagga

SEQ ID NO: 507600 - RNA, 14 nt, Chlamydophila pneumoniae CWL029
cucacuagagauuc

SEQ ID NO: 507601 - RNA, 16 nt, Chlamydophila pneumoniae CWL029
cucacucuaugagaac

SEQ ID NO: 507602 - RNA, 13 nt, Chlamydophila pneumoniae CWL029
cucacucuuuucu

SEQ ID NO: 507603 - RNA, 14 nt, Chlamydophila pneumoniae CWL029
cucacucuuuucua

SEQ ID NO: 507604 - RNA, 12 nt, Chlamydophila pneumoniae CWL029
cucacugagugu

SEQ ID NO: 507605 - RNA, 18 nt, Chlamydophila pneumoniae CWL029
cucacugagugucccaug

SEQ ID NO: 507606 - RNA, 16 nt, Chlamydophila pneumoniae CWL029
cuauaucauuaagaag

SEQ ID NO: 507607 - RNA, 16 nt, Chlamydophila pneumoniae CWL029
cuauauccacaaucuc

SEQ ID NO: 507608 - RNA, 21 nt, Chlamydophila pneumoniae CWL029
cuauaucgccguuaaagacuu

SEQ ID NO: 507609 - RNA, 23 nt, Chlamydophila pneumoniae CWL029
cuauagucuguuuuggaaagaag

SEQ ID NO: 507610 - RNA, 20 nt, Chlamydophila pneumoniae CWL029
cuaguaagaaacccgcaacu

SEQ ID NO: 507611 - RNA, 14 nt, Chlamydophila pneumoniae CWL029
cuagguucuuuucg

SEQ ID NO: 507612 - RNA, 23 nt, Chlamydophila pneumoniae CWL029
cuaggcugagacauauugaagau

SEQ ID NO: 507613 - RNA, 19 nt, Chlamydophila pneumoniae CWL029
cuagggaucccaaaaaaug

SEQ ID NO: 507614 - RNA, 21 nt, Chlamydophila pneumoniae CWL029
cuauaccaucuuuaaaaggcc

SEQ ID NO: 507615 - RNA, 18 nt, Chlamydophila pneumoniae CWL029
cuauaggaagcucuucua

SEQ ID NO: 507616 - RNA, 12 nt, Chlamydophila pneumoniae CWL029
cuauaguagaag

SEQ ID NO: 507617 - RNA, 22 nt, Chlamydophila pneumoniae CWL029
cuauaguauaauagugagcucc

SEQ ID NO: 507618 - RNA, 15 nt, Chlamydophila pneumoniae CWL029
cuauguguucucgaa

SEQ ID NO: 507619 - RNA, 14 nt, Chlamydophila pneumoniae CWL029
cuauguuuaaagca

SEQ ID NO: 507620 - RNA, 15 nt, Chlamydophila pneumoniae CWL029
cuauguguuuccuuu

SEQ ID NO: 507621 - RNA, 16 nt, Chlamydophila pneumoniae CWL029
cuaugcacaaaauaaa

SEQ ID NO: 507622 - RNA, 17 nt, Chlamydophila pneumoniae CWL029
cuaugcacaaaauaaaa

SEQ ID NO: 507623 - RNA, 21 nt, Chlamydophila pneumoniae CWL029
cuaugaucgggguuucagaag

SEQ ID NO: 507624 - RNA, 16 nt, Chlamydophila pneumoniae CWL029
cuaucauaucuucaaa

SEQ ID NO: 507625 - RNA, 13 nt, Chlamydophila pneumoniae CWL029
cuauccaucaucg

SEQ ID NO: 507626 - RNA, 17 nt, Chlamydophila pneumoniae CWL029
cuaucccacuaacaaga

SEQ ID NO: 507627 - RNA, 13 nt, Chlamydophila pneumoniae CWL029
cuauccuauuuua

SEQ ID NO: 507628 - RNA, 22 nt, Chlamydophila pneumoniae CWL029
cuauccuucgaccuauuugcaa

SEQ ID NO: 507629 - RNA, 13 nt, Chlamydophila pneumoniae CWL029
cuaucgaagagcc

SEQ ID NO: 507630 - RNA, 15 nt, Chlamydophila pneumoniae CWL029
cuagauuucuacaaa

SEQ ID NO: 507631 - RNA, 16 nt, Chlamydophila pneumoniae CWL029
cuagaucaaaacuccg

SEQ ID NO: 507632 - RNA, 13 nt, Chlamydophila pneumoniae CWL029
cuagaucacaaga

SEQ ID NO: 507633 - RNA, 17 nt, Chlamydophila pneumoniae CWL029
cuagaucacaagaaaga

SEQ ID NO: 507634 - RNA, 13 nt, Chlamydophila pneumoniae CWL029
cuagaguccaagg

SEQ ID NO: 507635 - RNA, 21 nt, Chlamydophila pneumoniae CWL029
cuagaguccaagguucuggga

SEQ ID NO: 507636 - RNA, 17 nt, Chlamydophila pneumoniae CWL029
cuagaggaucuucaagg

SEQ ID NO: 507637 - RNA, 14 nt, Chlamydophila pneumoniae CWL029
cuagaguucauuuu

SEQ ID NO: 507638 - RNA, 21 nt, Chlamydophila pneumoniae CWL029
cuagaguugcuuuauggcuca

SEQ ID NO: 507639 - RNA, 20 nt, Chlamydophila pneumoniae CWL029
cuagagcauuccgagcugca

SEQ ID NO: 507640 - RNA, 18 nt, Chlamydophila pneumoniae CWL029
cuagagcucugaaauaaa

SEQ ID NO: 507641 - RNA, 21 nt, Chlamydophila pneumoniae CWL029
cuagagcuuucagaaaagaaa

SEQ ID NO: 507642 - RNA, 19 nt, Chlamydophila pneumoniae CWL029
cuacuucaggaaauaauuu

SEQ ID NO: 507643 - RNA, 15 nt, Chlamydophila pneumoniae CWL029
cuacuucuucuuuuc

SEQ ID NO: 507644 - RNA, 12 nt, Chlamydophila pneumoniae CWL029
cuacuuuaaagu

SEQ ID NO: 507645 - RNA, 20 nt, Chlamydophila pneumoniae CWL029
cuaggccgggauuuuaauuc

SEQ ID NO: 507646 - RNA, 14 nt, Chlamydophila pneumoniae CWL029
cuagcagagaaauu

SEQ ID NO: 507647 - RNA, 22 nt, Chlamydophila pneumoniae CWL029
cuacucuacaguaguaaauaau

SEQ ID NO: 507648 - RNA, 18 nt, Chlamydophila pneumoniae CWL029
cuacuuaaauccuaagca

SEQ ID NO: 507649 - RNA, 19 nt, Chlamydophila pneumoniae CWL029
cuacuuaaauccuaagcau

SEQ ID NO: 507650 - RNA, 15 nt, Chlamydophila pneumoniae CWL029
cuacgaauccaaaaa

SEQ ID NO: 507651 - RNA, 16 nt, Chlamydophila pneumoniae CWL029
cuacgacuacaucuug

SEQ ID NO: 507652 - RNA, 21 nt, Chlamydophila pneumoniae CWL029
cuacgacuacaucuuguucug

SEQ ID NO: 507653 - RNA, 16 nt, Chlamydophila pneumoniae CWL029
cuacgagcgcuuucuu

SEQ ID NO: 507654 - RNA, 18 nt, Chlamydophila pneumoniae CWL029
cuaaagagaucacaggga

SEQ ID NO: 507655 - RNA, 21 nt, Chlamydophila pneumoniae CWL029
cuaaagauacuuaucuuuaaa

SEQ ID NO: 507656 - RNA, 20 nt, Chlamydophila pneumoniae CWL029
cuaaagaauuuguaacucuu

SEQ ID NO: 507657 - RNA, 23 nt, Chlamydophila pneumoniae CWL029
cuaaagacgaagggaguuucccg

SEQ ID NO: 507658 - RNA, 21 nt, Chlamydophila pneumoniae CWL029
cuaaacugggaagaccacgaa

SEQ ID NO: 507659 - RNA, 16 nt, Chlamydophila pneumoniae CWL029
cuaaacucucuuccuu

SEQ ID NO: 507660 - RNA, 20 nt, Chlamydophila pneumoniae CWL029
cuaaacucuccaaaagcucu

SEQ ID NO: 507661 - RNA, 12 nt, Chlamydophila pneumoniae CWL029
cuaaacucucuu

SEQ ID NO: 507662 - RNA, 17 nt, Chlamydophila pneumoniae CWL029
cuaaacucucuuccuuc

SEQ ID NO: 507663 - RNA, 20 nt, Chlamydophila pneumoniae CWL029
cuaaacucucuuccuucucc

SEQ ID NO: 507664 - RNA, 21 nt, Chlamydophila pneumoniae CWL029
cuaaaaucuuucaauguaauu

SEQ ID NO: 507665 - RNA, 20 nt, Chlamydophila pneumoniae CWL029
cuaaaaugcuuguauaaaug

SEQ ID NO: 507666 - RNA, 23 nt, Chlamydophila pneumoniae CWL029
cuaaaauaugcucgugcgacugc

SEQ ID NO: 507667 - RNA, 17 nt, Chlamydophila pneumoniae CWL029
cuaaaaacuucccaucu

SEQ ID NO: 507668 - RNA, 13 nt, Chlamydophila pneumoniae CWL029
cuaaaaacucuuc

SEQ ID NO: 507669 - RNA, 18 nt, Chlamydophila pneumoniae CWL029
cguuucagaagucacaaa

SEQ ID NO: 507670 - RNA, 23 nt, Chlamydophila pneumoniae CWL029
cuaaauacuuaggaauuuuucua

SEQ ID NO: 507671 - RNA, 16 nt, Chlamydophila pneumoniae CWL029
cuaaauagaaaacaua

SEQ ID NO: 507672 - RNA, 21 nt, Chlamydophila pneumoniae CWL029
cuaaauagaaaacauagagau

SEQ ID NO: 507673 - RNA, 18 nt, Chlamydophila pneumoniae CWL029
cuaaauagagcggaacua

SEQ ID NO: 507674 - RNA, 23 nt, Chlamydophila pneumoniae CWL029
cuaaaucaacuacaucuccaagc

SEQ ID NO: 507675 - RNA, 18 nt, Chlamydophila pneumoniae CWL029
cuaaaguaggaauuuuca

SEQ ID NO: 507676 - RNA, 13 nt, Chlamydophila pneumoniae CWL029
cuaaagugucaua

SEQ ID NO: 507677 - RNA, 18 nt, Chlamydophila pneumoniae CWL029
cuaaaguaacgauaagaa

SEQ ID NO: 507678 - RNA, 19 nt, Chlamydophila pneumoniae CWL029
cuaaaguagaauccuucuc

SEQ ID NO: 507679 - RNA, 15 nt, Chlamydophila pneumoniae CWL029
cuaaagguuuuaaau

SEQ ID NO: 507680 - RNA, 19 nt, Chlamydophila pneumoniae CWL029
cuaaaggaacugugccaua

SEQ ID NO: 507681 - RNA, 17 nt, Chlamydophila pneumoniae CWL029
cuaaaggaaucucggga

SEQ ID NO: 507682 - RNA, 20 nt, Chlamydophila pneumoniae CWL029
cuaaauuaguaaaugccucu

SEQ ID NO: 507683 - RNA, 22 nt, Chlamydophila pneumoniae CWL029
cuaaaucugcuuuuaucucaau

SEQ ID NO: 507684 - RNA, 13 nt, Chlamydophila pneumoniae CWL029
cguuuagcuauuu

SEQ ID NO: 507685 - RNA, 18 nt, Chlamydophila pneumoniae CWL029
cguuuaauuccuuggauu

SEQ ID NO: 507686 - RNA, 18 nt, Chlamydophila pneumoniae CWL029
cguuuauaacaucaagaa

SEQ ID NO: 507687 - RNA, 11 nt, Chlamydophila pneumoniae CWL029
cguugccuguu

SEQ ID NO: 507688 - RNA, 18 nt, Chlamydophila pneumoniae CWL029
cguucuuucaauaacaga

SEQ ID NO: 507689 - RNA, 14 nt, Chlamydophila pneumoniae CWL029
cguuaaaaacuauc

SEQ ID NO: 507690 - RNA, 19 nt, Chlamydophila pneumoniae CWL029
cguggagugcucuacccca

SEQ ID NO: 507691 - RNA, 18 nt, Chlamydophila pneumoniae CWL029
cgugguaucccugagcac

SEQ ID NO: 507692 - RNA, 13 nt, Chlamydophila pneumoniae CWL029
cguguaaaagcuu

SEQ ID NO: 507693 - RNA, 15 nt, Chlamydophila pneumoniae CWL029
cgugcaaguucacac

SEQ ID NO: 507694 - RNA, 15 nt, Chlamydophila pneumoniae CWL029
cgugaacaaaaacug

SEQ ID NO: 507695 - RNA, 17 nt, Chlamydophila pneumoniae CWL029
cgucuucaauagaacga

SEQ ID NO: 507696 - RNA, 13 nt, Chlamydophila pneumoniae CWL029
cgugaacaaaaac

SEQ ID NO: 507697 - RNA, 13 nt, Chlamydophila pneumoniae CWL029
cgugacgugguuu

SEQ ID NO: 507698 - RNA, 22 nt, Chlamydophila pneumoniae CWL029
cgucaguaaaacacaaauagca

SEQ ID NO: 507699 - RNA, 18 nt, Chlamydophila pneumoniae CWL029
cgucaauaagcuugccag

SEQ ID NO: 507700 - RNA, 18 nt, Chlamydophila pneumoniae CWL029
cgucaaauucauuaagaa

SEQ ID NO: 507701 - RNA, 19 nt, Chlamydophila pneumoniae CWL029
cgucaaauucauuaagaac

SEQ ID NO: 507702 - RNA, 15 nt, Chlamydophila pneumoniae CWL029
cgucaaauucauuaa

SEQ ID NO: 507703 - RNA, 17 nt, Chlamydophila pneumoniae CWL029
cguaagcugcaaucuca

SEQ ID NO: 507704 - RNA, 23 nt, Chlamydophila pneumoniae CWL029
cguaauagcgacaugagaaaucu

SEQ ID NO: 507705 - RNA, 23 nt, Chlamydophila pneumoniae CWL029
cguagcuacaaaauuauuaaacu

SEQ ID NO: 507706 - RNA, 13 nt, Chlamydophila pneumoniae CWL029
cguauucccaggu

SEQ ID NO: 507707 - RNA, 20 nt, Chlamydophila pneumoniae CWL029
cguauggauuucuccagcag

SEQ ID NO: 507708 - RNA, 16 nt, Chlamydophila pneumoniae CWL029
cguauaaggauguugu

SEQ ID NO: 507709 - RNA, 17 nt, Chlamydophila pneumoniae CWL029
cguauacgucccacaaa

SEQ ID NO: 507710 - RNA, 14 nt, Chlamydophila pneumoniae CWL029
cguauagaauagaa

SEQ ID NO: 507711 - RNA, 19 nt, Chlamydophila pneumoniae CWL029
cguccagccugcaccagac

SEQ ID NO: 507712 - RNA, 14 nt, Chlamydophila pneumoniae CWL029
cgucauauuuaaaa

SEQ ID NO: 507713 - RNA, 17 nt, Chlamydophila pneumoniae CWL029
cguccaguucuucauuc

SEQ ID NO: 507714 - RNA, 18 nt, Chlamydophila pneumoniae CWL029
cguccaguucuucauucc

SEQ ID NO: 507715 - RNA, 20 nt, Chlamydophila pneumoniae CWL029
cguccaguucuucauuccag

SEQ ID NO: 507716 - RNA, 16 nt, Chlamydophila pneumoniae CWL029
cguaagagaauuauua

SEQ ID NO: 507717 - RNA, 13 nt, Chlamydophila pneumoniae CWL029
cguaacugaggca

SEQ ID NO: 507718 - RNA, 14 nt, Chlamydophila pneumoniae CWL029
cguaaaaagaaaga

SEQ ID NO: 507719 - RNA, 12 nt, Chlamydophila pneumoniae CWL029
cguaaagaaaag

SEQ ID NO: 507720 - RNA, 14 nt, Chlamydophila pneumoniae CWL029
cguaaagaaaagca

SEQ ID NO: 507721 - RNA, 15 nt, Chlamydophila pneumoniae CWL029
cguaaagaaaagcaa

SEQ ID NO: 507722 - RNA, 21 nt, Chlamydophila pneumoniae CWL029
cggucgucuuagaauccucua

SEQ ID NO: 507723 - RNA, 11 nt, Chlamydophila pneumoniae CWL029
cggucuuucuu

SEQ ID NO: 507724 - RNA, 12 nt, Chlamydophila pneumoniae CWL029
cggucucuucuc

SEQ ID NO: 507725 - RNA, 18 nt, Chlamydophila pneumoniae CWL029
aaacuaguucuucuuuac

SEQ ID NO: 507726 - RNA, 22 nt, Chlamydophila pneumoniae CWL029
aaacuaaaucaacuacaucucc

SEQ ID NO: 507727 - RNA, 15 nt, Chlamydophila pneumoniae CWL029
aaacuaagaauaccu

SEQ ID NO: 507728 - RNA, 23 nt, Chlamydophila pneumoniae CWL029
aaacuagagaucuuuuuauuaaa

SEQ ID NO: 507729 - RNA, 20 nt, Chlamydophila pneumoniae CWL029
aaacuagauuucuacaaaca

SEQ ID NO: 507730 - RNA, 16 nt, Chlamydophila pneumoniae CWL029
aaacuaggaaaagcau

SEQ ID NO: 507731 - RNA, 15 nt, Chlamydophila pneumoniae CWL029
cggucacuucaauua

SEQ ID NO: 507732 - RNA, 16 nt, Chlamydophila pneumoniae CWL029
cgguaaugccagcagc

SEQ ID NO: 507733 - RNA, 16 nt, Chlamydophila pneumoniae CWL029
cgguaaccugugaaaa

SEQ ID NO: 507734 - RNA, 17 nt, Chlamydophila pneumoniae CWL029
cggguguggcaaaggac

SEQ ID NO: 507735 - RNA, 19 nt, Chlamydophila pneumoniae CWL029
cggggucggagauuguuuc

SEQ ID NO: 507736 - RNA, 12 nt, Chlamydophila pneumoniae CWL029
cggcuuuuccag

SEQ ID NO: 507737 - RNA, 13 nt, Chlamydophila pneumoniae CWL029
cggcuuuagaaaa

SEQ ID NO: 507738 - RNA, 14 nt, Chlamydophila pneumoniae CWL029
cggcucucuucauu

SEQ ID NO: 507739 - RNA, 21 nt, Chlamydophila pneumoniae CWL029
cggcugcgguagccuggaggc

SEQ ID NO: 507740 - RNA, 21 nt, Chlamydophila pneumoniae CWL029
cgggaauaauaggauaagaaa

SEQ ID NO: 507741 - RNA, 19 nt, Chlamydophila pneumoniae CWL029
cgggaucguagcaggcauc

SEQ ID NO: 507742 - RNA, 18 nt, Chlamydophila pneumoniae CWL029
cuucaaaauguuuaucga

SEQ ID NO: 507743 - RNA, 23 nt, Chlamydophila pneumoniae CWL029
cuucaaaagaccgccuucuaauu

SEQ ID NO: 507744 - RNA, 18 nt, Chlamydophila pneumoniae CWL029
cuucaauccccugcaucu

SEQ ID NO: 507745 - RNA, 21 nt, Chlamydophila pneumoniae CWL029
cuucacuauuaggcuuuuuuc

SEQ ID NO: 507746 - RNA, 19 nt, Chlamydophila pneumoniae CWL029
cuucacucguugccaaucu

SEQ ID NO: 507747 - RNA, 18 nt, Chlamydophila pneumoniae CWL029
cuucaaugacuucuggau

SEQ ID NO: 507748 - RNA, 15 nt, Chlamydophila pneumoniae CWL029
cuucaaugauguguu

SEQ ID NO: 507749 - RNA, 17 nt, Chlamydophila pneumoniae CWL029
cuucaaugauuucuuua

SEQ ID NO: 507750 - RNA, 21 nt, Chlamydophila pneumoniae CWL029
cuucaucagaagguaaauuuu

SEQ ID NO: 507751 - RNA, 15 nt, Chlamydophila pneumoniae CWL029
cuucaucauaacuag

SEQ ID NO: 507752 - RNA, 15 nt, Chlamydophila pneumoniae CWL029
cuucaguuguugcuu

SEQ ID NO: 507753 - RNA, 11 nt, Chlamydophila pneumoniae CWL029
cuucauccccg

SEQ ID NO: 507754 - RNA, 14 nt, Chlamydophila pneumoniae CWL029
cuucauuaucuucg

SEQ ID NO: 507755 - RNA, 14 nt, Chlamydophila pneumoniae CWL029
cuucauuccaugag

SEQ ID NO: 507756 - RNA, 20 nt, Chlamydophila pneumoniae CWL029
cuucagauccgauauacuua

SEQ ID NO: 507757 - RNA, 20 nt, Chlamydophila pneumoniae CWL029
cuucaggauuacggaaaaua

SEQ ID NO: 507758 - RNA, 18 nt, Chlamydophila pneumoniae CWL029
cuucaggacgcacauuua

SEQ ID NO: 507759 - RNA, 13 nt, Chlamydophila pneumoniae CWL029
cuucagcuuuuuc

SEQ ID NO: 507760 - RNA, 14 nt, Chlamydophila pneumoniae CWL029
cuucaggaacagca

SEQ ID NO: 507761 - RNA, 15 nt, Chlamydophila pneumoniae CWL029
cuucaggacaugccu

SEQ ID NO: 507762 - RNA, 18 nt, Chlamydophila pneumoniae CWL029
cuucgacuucaccuugaa

SEQ ID NO: 507763 - RNA, 18 nt, Chlamydophila pneumoniae CWL029
cuucgaccuauuugcaac

SEQ ID NO: 507764 - RNA, 16 nt, Chlamydophila pneumoniae CWL029
cuucgaauuuuuguuu

SEQ ID NO: 507765 - RNA, 17 nt, Chlamydophila pneumoniae CWL029
cuuccuuaaccuccuca

SEQ ID NO: 507766 - RNA, 16 nt, Chlamydophila pneumoniae CWL029
cuuccugcuccucuuc

SEQ ID NO: 507767 - RNA, 13 nt, Chlamydophila pneumoniae CWL029
cuuccuccaaaau

SEQ ID NO: 507768 - RNA, 21 nt, Chlamydophila pneumoniae CWL029
cuuccuacggcaagaaucgcc

SEQ ID NO: 507769 - RNA, 14 nt, Chlamydophila pneumoniae CWL029
cuuccgucugaaug

SEQ ID NO: 507770 - RNA, 13 nt, Chlamydophila pneumoniae CWL029
cuuccagcuucuc

SEQ ID NO: 507771 - RNA, 23 nt, Chlamydophila pneumoniae CWL029
aaacuucuagacaacaaauugau

SEQ ID NO: 507772 - RNA, 12 nt, Chlamydophila pneumoniae CWL029
aaacuucucuag

SEQ ID NO: 507773 - RNA, 23 nt, Chlamydophila pneumoniae CWL029
cuuccaacggacauuuucaagcu

SEQ ID NO: 507774 - RNA, 13 nt, Chlamydophila pneumoniae CWL029
aaacuucaaaagu

SEQ ID NO: 507775 - RNA, 16 nt, Chlamydophila pneumoniae CWL029
aaacuucaguuguugc

SEQ ID NO: 507776 - RNA, 19 nt, Chlamydophila pneumoniae CWL029
aaacuucccaucuuguucu

SEQ ID NO: 507777 - RNA, 20 nt, Chlamydophila pneumoniae CWL029
cuuaggaggaggcaguagua

SEQ ID NO: 507778 - RNA, 13 nt, Chlamydophila pneumoniae CWL029
cuuagccccucca

SEQ ID NO: 507779 - RNA, 16 nt, Chlamydophila pneumoniae CWL029
cuuaggauucuuauca

SEQ ID NO: 507780 - RNA, 18 nt, Chlamydophila pneumoniae CWL029
cuuaggaauuuuucuagu

SEQ ID NO: 507781 - RNA, 14 nt, Chlamydophila pneumoniae CWL029
cuuauauaaaacuu

SEQ ID NO: 507782 - RNA, 19 nt, Chlamydophila pneumoniae CWL029
cuuauauuggcuuucuaca

SEQ ID NO: 507783 - RNA, 22 nt, Chlamydophila pneumoniae CWL029
cuuaugguuuuucaguuguuuc

SEQ ID NO: 507784 - RNA, 16 nt, Chlamydophila pneumoniae CWL029
cuuauguuaaaaauac

SEQ ID NO: 507785 - RNA, 13 nt, Chlamydophila pneumoniae CWL029
cuuauuucaaaga

SEQ ID NO: 507786 - RNA, 23 nt, Chlamydophila pneumoniae CWL029
cuuaucgggggugccaaaaaauu

SEQ ID NO: 507787 - RNA, 19 nt, Chlamydophila pneumoniae CWL029
cuuacauuggcuuguaccg

SEQ ID NO: 507788 - RNA, 20 nt, Chlamydophila pneumoniae CWL029
cuuaaugguagcuuaagaau

SEQ ID NO: 507789 - RNA, 12 nt, Chlamydophila pneumoniae CWL029
cuuagagaauug

SEQ ID NO: 507790 - RNA, 17 nt, Chlamydophila pneumoniae CWL029
cuuagcauuaggaaagu

SEQ ID NO: 507791 - RNA, 14 nt, Chlamydophila pneumoniae CWL029
cuuagaucuuuucu

SEQ ID NO: 507792 - RNA, 16 nt, Chlamydophila pneumoniae CWL029
cuuagcaaucaguaaa

SEQ ID NO: 507793 - RNA, 23 nt, Chlamydophila pneumoniae CWL029
cuguuucaacauaacaugagaaa

SEQ ID NO: 507794 - RNA, 13 nt, Chlamydophila pneumoniae CWL029
cuguuuacagaug

SEQ ID NO: 507795 - RNA, 23 nt, Chlamydophila pneumoniae CWL029
cuuaaagguaaagcuucuuucuc

SEQ ID NO: 507796 - RNA, 12 nt, Chlamydophila pneumoniae CWL029
cuuaaauccuaa

SEQ ID NO: 507797 - RNA, 17 nt, Chlamydophila pneumoniae CWL029
cuguuuuucuuccacac

SEQ ID NO: 507798 - RNA, 21 nt, Chlamydophila pneumoniae CWL029
cuguuuuucuuccacacaacu

SEQ ID NO: 507799 - RNA, 15 nt, Chlamydophila pneumoniae CWL029
cuguuuuuugaaaac

SEQ ID NO: 507800 - RNA, 17 nt, Chlamydophila pneumoniae CWL029
aaacuggcggauugcuu

SEQ ID NO: 507801 - RNA, 19 nt, Chlamydophila pneumoniae CWL029
cuuaacaaccgccuuuaua

SEQ ID NO: 507802 - RNA, 17 nt, Chlamydophila pneumoniae CWL029
cuuaaccuccucaagaa

SEQ ID NO: 507803 - RNA, 16 nt, Chlamydophila pneumoniae CWL029
cuuaacgcuuagagaa

SEQ ID NO: 507804 - RNA, 22 nt, Chlamydophila pneumoniae CWL029
cuuaauagggccauuagcaauc

SEQ ID NO: 507805 - RNA, 18 nt, Chlamydophila pneumoniae CWL029
cuuaauauaaaagaagac

SEQ ID NO: 507806 - RNA, 17 nt, Chlamydophila pneumoniae CWL029
cuugcucugaagcucgg

SEQ ID NO: 507807 - RNA, 17 nt, Chlamydophila pneumoniae CWL029
cuugcugauuucuuuuu

SEQ ID NO: 507808 - RNA, 20 nt, Chlamydophila pneumoniae CWL029
cuugcugauuuuugcuaaga

SEQ ID NO: 507809 - RNA, 21 nt, Chlamydophila pneumoniae CWL029
cuugcuuugugaguucuuccu

SEQ ID NO: 507810 - RNA, 21 nt, Chlamydophila pneumoniae CWL029
cuugcugcccaaauugagaaa

SEQ ID NO: 507811 - RNA, 13 nt, Chlamydophila pneumoniae CWL029
cuugcgcagcuuc

SEQ ID NO: 507812 - RNA, 23 nt, Chlamydophila pneumoniae CWL029
aaacuuguuaggaaaauucuuaa

SEQ ID NO: 507813 - RNA, 15 nt, Chlamydophila pneumoniae CWL029
aaacuuuaaaagcau

SEQ ID NO: 507814 - RNA, 14 nt, Chlamydophila pneumoniae CWL029
aaacuuucuucucu

SEQ ID NO: 507815 - RNA, 23 nt, Chlamydophila pneumoniae CWL029
cuugcgauacaauaaacaacgau

SEQ ID NO: 507816 - RNA, 18 nt, Chlamydophila pneumoniae CWL029
cuugcauuuuuuggaaua

SEQ ID NO: 507817 - RNA, 15 nt, Chlamydophila pneumoniae CWL029
cuugccaaucuuccu

SEQ ID NO: 507818 - RNA, 18 nt, Chlamydophila pneumoniae CWL029
cuugcagcgacaacacgc

SEQ ID NO: 507819 - RNA, 14 nt, Chlamydophila pneumoniae CWL029
cuugauuugggaug

SEQ ID NO: 507820 - RNA, 18 nt, Chlamydophila pneumoniae CWL029
cuugauuuguuuagcaua

SEQ ID NO: 507821 - RNA, 16 nt, Chlamydophila pneumoniae CWL029
cuugcaaucuuugaag

SEQ ID NO: 507822 - RNA, 19 nt, Chlamydophila pneumoniae CWL029
cuugauuaagaucuucguc

SEQ ID NO: 507823 - RNA, 15 nt, Chlamydophila pneumoniae CWL029
cuugauuccuuaagu

SEQ ID NO: 507824 - RNA, 17 nt, Chlamydophila pneumoniae CWL029
cuugauccuuuccaaga

SEQ ID NO: 507825 - RNA, 18 nt, Chlamydophila pneumoniae CWL029
cuugauccuuuccaagaa

SEQ ID NO: 507826 - RNA, 12 nt, Chlamydophila pneumoniae CWL029
cuugaucaggau

SEQ ID NO: 507827 - RNA, 17 nt, Chlamydophila pneumoniae CWL029
cuugauauuguucuucc

SEQ ID NO: 507828 - RNA, 18 nt, Chlamydophila pneumoniae CWL029
cuugauauuguucuucca

SEQ ID NO: 507829 - RNA, 15 nt, Chlamydophila pneumoniae CWL029
cuugauauuguucuu

SEQ ID NO: 507830 - RNA, 15 nt, Chlamydophila pneumoniae CWL029
cuugaggaauucuuu

SEQ ID NO: 507831 - RNA, 23 nt, Chlamydophila pneumoniae CWL029
cuugaggaccuuccuuaucuuca

SEQ ID NO: 507832 - RNA, 17 nt, Chlamydophila pneumoniae CWL029
cuugagaaaagaacagg

SEQ ID NO: 507833 - RNA, 14 nt, Chlamydophila pneumoniae CWL029
cuugacucuaauuc

SEQ ID NO: 507834 - RNA, 21 nt, Chlamydophila pneumoniae CWL029
cuugagagauauagcguacag

SEQ ID NO: 507835 - RNA, 15 nt, Chlamydophila pneumoniae CWL029
cuugagcauccaaaa

SEQ ID NO: 507836 - RNA, 18 nt, Chlamydophila pneumoniae CWL029
cuugagcauccaaaaugu

SEQ ID NO: 507837 - RNA, 22 nt, Chlamydophila pneumoniae CWL029
cuugacuaaauccaccaaugau

SEQ ID NO: 507838 - RNA, 23 nt, Chlamydophila pneumoniae CWL029
cuugaccucaucagaaguggccu

SEQ ID NO: 507839 - RNA, 16 nt, Chlamydophila pneumoniae CWL029
cuugaaguuuugguuu

SEQ ID NO: 507840 - RNA, 14 nt, Chlamydophila pneumoniae CWL029
cuugaaguuuuuuc

SEQ ID NO: 507841 - RNA, 15 nt, Chlamydophila pneumoniae CWL029
cuugaaguucucaaa

SEQ ID NO: 507842 - RNA, 22 nt, Chlamydophila pneumoniae CWL029
cuucuuuuagacgugcucucuu

SEQ ID NO: 507843 - RNA, 14 nt, Chlamydophila pneumoniae CWL029
cuucuuucuugcuc

SEQ ID NO: 507844 - RNA, 15 nt, Chlamydophila pneumoniae CWL029
cuucuuuccauagau

SEQ ID NO: 507845 - RNA, 20 nt, Chlamydophila pneumoniae CWL029
cuucuuuccauagaucccua

SEQ ID NO: 507846 - RNA, 14 nt, Chlamydophila pneumoniae CWL029
cuucuuucugcucu

SEQ ID NO: 507847 - RNA, 22 nt, Chlamydophila pneumoniae CWL029
cuucuuuaggguaaagaaauau

SEQ ID NO: 507848 - RNA, 19 nt, Chlamydophila pneumoniae CWL029
cuucuuuaucuagcucuuc

SEQ ID NO: 507849 - RNA, 18 nt, Chlamydophila pneumoniae CWL029
cuucuuucaauagcuucc

SEQ ID NO: 507850 - RNA, 12 nt, Chlamydophila pneumoniae CWL029
cuucuuucaaag

SEQ ID NO: 507851 - RNA, 13 nt, Chlamydophila pneumoniae CWL029
cuucuuucaaagc

SEQ ID NO: 507852 - RNA, 17 nt, Chlamydophila pneumoniae CWL029
cuucuuuuuuuuucuua

SEQ ID NO: 507853 - RNA, 11 nt, Chlamydophila pneumoniae CWL029
cuugaacagag

SEQ ID NO: 507854 - RNA, 14 nt, Chlamydophila pneumoniae CWL029
cuugaacagagacu

SEQ ID NO: 507855 - RNA, 15 nt, Chlamydophila pneumoniae CWL029
cuugaaauugcucuu

SEQ ID NO: 507856 - RNA, 17 nt, Chlamydophila pneumoniae CWL029
cuucuucgccuacaagu

SEQ ID NO: 507857 - RNA, 20 nt, Chlamydophila pneumoniae CWL029
cuucuucguaagcugcaauc

SEQ ID NO: 507858 - RNA, 15 nt, Chlamydophila pneumoniae CWL029
cuucuucggaucugu

SEQ ID NO: 507859 - RNA, 15 nt, Chlamydophila pneumoniae CWL029
cuucuucuuguucuu

SEQ ID NO: 507860 - RNA, 20 nt, Chlamydophila pneumoniae CWL029
cuucuucuggcugagagaag

SEQ ID NO: 507861 - RNA, 13 nt, Chlamydophila pneumoniae CWL029
cuucuucuucaaa

SEQ ID NO: 507862 - RNA, 15 nt, Chlamydophila pneumoniae CWL029
cuucuucuauagaau

SEQ ID NO: 507863 - RNA, 23 nt, Chlamydophila pneumoniae CWL029
cuucuucuaaagcugcuuuuucu

SEQ ID NO: 507864 - RNA, 17 nt, Chlamydophila pneumoniae CWL029
cuucuugcaaucuuuga

SEQ ID NO: 507865 - RNA, 15 nt, Chlamydophila pneumoniae CWL029
cuucuugugauccuu

SEQ ID NO: 507866 - RNA, 21 nt, Chlamydophila pneumoniae CWL029
cuucuuguguuagugcuucag

SEQ ID NO: 507867 - RNA, 22 nt, Chlamydophila pneumoniae CWL029
cuucuuagaaacacaguuugag

SEQ ID NO: 507868 - RNA, 13 nt, Chlamydophila pneumoniae CWL029
cuucuucagcuuu

SEQ ID NO: 507869 - RNA, 15 nt, Chlamydophila pneumoniae CWL029
cuucuucagcuuuuu

SEQ ID NO: 507870 - RNA, 22 nt, Chlamydophila pneumoniae CWL029
cuucuucagcuuuuucaauagc

SEQ ID NO: 507871 - RNA, 19 nt, Chlamydophila pneumoniae CWL029
cuucuguaucgacuguaca

SEQ ID NO: 507872 - RNA, 14 nt, Chlamydophila pneumoniae CWL029
cuucugucuguauu

SEQ ID NO: 507873 - RNA, 20 nt, Chlamydophila pneumoniae CWL029
cuucuguaguuuguucacuu

SEQ ID NO: 507874 - RNA, 20 nt, Chlamydophila pneumoniae CWL029
cuucuguaauuuuuuucaaa

SEQ ID NO: 507875 - RNA, 10 nt, Chlamydophila pneumoniae CWL029
cuucuguaaa

SEQ ID NO: 507876 - RNA, 17 nt, Chlamydophila pneumoniae CWL029
cuucguggaacuuucug

SEQ ID NO: 507877 - RNA, 16 nt, Chlamydophila pneumoniae CWL029
cuucguuagaaaccau

SEQ ID NO: 507878 - RNA, 20 nt, Chlamydophila pneumoniae CWL029
cuucuaaagcugcuuuuucu

SEQ ID NO: 507879 - RNA, 19 nt, Chlamydophila pneumoniae CWL029
cuucuaaaaacucuucauc

SEQ ID NO: 507880 - RNA, 17 nt, Chlamydophila pneumoniae CWL029
cuucguaucuucgaggc

SEQ ID NO: 507881 - RNA, 12 nt, Chlamydophila pneumoniae CWL029
cuucuacaccau

SEQ ID NO: 507882 - RNA, 12 nt, Chlamydophila pneumoniae CWL029
cuucuaaacaau

SEQ ID NO: 507883 - RNA, 16 nt, Chlamydophila pneumoniae CWL029
cuucuaugguaaucac

SEQ ID NO: 507884 - RNA, 22 nt, Chlamydophila pneumoniae CWL029
cuucuaugguaaucaccuuaga

SEQ ID NO: 507885 - RNA, 15 nt, Chlamydophila pneumoniae CWL029
cuucuauuucuauua

SEQ ID NO: 507886 - RNA, 18 nt, Chlamydophila pneumoniae CWL029
cuucucaagaucuucauc

SEQ ID NO: 507887 - RNA, 19 nt, Chlamydophila pneumoniae CWL029
cuucuagguauuuguuuca

SEQ ID NO: 507888 - RNA, 18 nt, Chlamydophila pneumoniae CWL029
cuucuggauacguuuuuc

SEQ ID NO: 507889 - RNA, 21 nt, Chlamydophila pneumoniae CWL029
cuucuggauacguuuuucccu

SEQ ID NO: 507890 - RNA, 13 nt, Chlamydophila pneumoniae CWL029
cuucucuguaucg

SEQ ID NO: 507891 - RNA, 19 nt, Chlamydophila pneumoniae CWL029
cuucucuguugggagcuuc

SEQ ID NO: 507892 - RNA, 20 nt, Chlamydophila pneumoniae CWL029
cuucucuguugggagcuucc

SEQ ID NO: 507893 - RNA, 16 nt, Chlamydophila pneumoniae CWL029
cuucugaaaucaaaaa

SEQ ID NO: 507894 - RNA, 19 nt, Chlamydophila pneumoniae CWL029
cuucugaaaucaaaaaaaa

SEQ ID NO: 507895 - RNA, 15 nt, Chlamydophila pneumoniae CWL029
cuucugaauagcucu

SEQ ID NO: 507896 - RNA, 14 nt, Chlamydophila pneumoniae CWL029
cuucucuaagaaau

SEQ ID NO: 507897 - RNA, 18 nt, Chlamydophila pneumoniae CWL029
cuucucuaagaaauuuuc

SEQ ID NO: 507898 - RNA, 19 nt, Chlamydophila pneumoniae CWL029
cuucucuaagaaauuuucu

SEQ ID NO: 507899 - RNA, 11 nt, Chlamydophila pneumoniae CWL029
cuucuccugaa

SEQ ID NO: 507900 - RNA, 23 nt, Chlamydophila pneumoniae CWL029
cuucuccugaaccgcaaaaagcu

SEQ ID NO: 507901 - RNA, 16 nt, Chlamydophila pneumoniae CWL029
cuucucccgcuaauua

SEQ ID NO: 507902 - RNA, 19 nt, Chlamydophila pneumoniae CWL029
cuucucccucuaaacauaa

SEQ ID NO: 507903 - RNA, 15 nt, Chlamydophila pneumoniae CWL029
cuucuccaaauaaag

SEQ ID NO: 507904 - RNA, 14 nt, Chlamydophila pneumoniae CWL029
cuucuccagagcaa

SEQ ID NO: 507905 - RNA, 14 nt, Chlamydophila pneumoniae CWL029
cuucucaaagacaa

SEQ ID NO: 507906 - RNA, 20 nt, Chlamydophila pneumoniae CWL029
cuuuccacguacgagaucag

SEQ ID NO: 507907 - RNA, 12 nt, Chlamydophila pneumoniae CWL029
cuuucacuuccc

SEQ ID NO: 507908 - RNA, 13 nt, Chlamydophila pneumoniae CWL029
cuuucagaaagaa

SEQ ID NO: 507909 - RNA, 22 nt, Chlamydophila pneumoniae CWL029
cuuucaaaagaaaucaaacauu

SEQ ID NO: 507910 - RNA, 16 nt, Chlamydophila pneumoniae CWL029
cuuucaaaccacggau

SEQ ID NO: 507911 - RNA, 15 nt, Chlamydophila pneumoniae CWL029
cuuuaggucacuacc

SEQ ID NO: 507912 - RNA, 17 nt, Chlamydophila pneumoniae CWL029
cuuuaguuaacuccuuc

SEQ ID NO: 507913 - RNA, 21 nt, Chlamydophila pneumoniae CWL029
cuuuacuucggaugagaucca

SEQ ID NO: 507914 - RNA, 16 nt, Chlamydophila pneumoniae CWL029
cuuuaguuaacuccuu

SEQ ID NO: 507915 - RNA, 17 nt, Chlamydophila pneumoniae CWL029
cuuuauacuguuuuucu

SEQ ID NO: 507916 - RNA, 20 nt, Chlamydophila pneumoniae CWL029
cuuuauacuguuuuucuucc

SEQ ID NO: 507917 - RNA, 15 nt, Chlamydophila pneumoniae CWL029
cuuuauagaaaguac

SEQ ID NO: 507918 - RNA, 16 nt, Chlamydophila pneumoniae CWL029
cuuuauagaaaguaca

SEQ ID NO: 507919 - RNA, 13 nt, Chlamydophila pneumoniae CWL029
cuuuauagauaug

SEQ ID NO: 507920 - RNA, 22 nt, Chlamydophila pneumoniae CWL029
cuuuauagauaugccucagguc

SEQ ID NO: 507921 - RNA, 19 nt, Chlamydophila pneumoniae CWL029
cuuuaugaucucccgugag

SEQ ID NO: 507922 - RNA, 23 nt, Chlamydophila pneumoniae CWL029
cuuuaucuagcucuucaagguac

SEQ ID NO: 507923 - RNA, 15 nt, Chlamydophila pneumoniae CWL029
cuuuauguauaacau

SEQ ID NO: 507924 - RNA, 16 nt, Chlamydophila pneumoniae CWL029
cuuuauguauaacauc

SEQ ID NO: 507925 - RNA, 18 nt, Chlamydophila pneumoniae CWL029
cuuuauggcucaacuuaa

SEQ ID NO: 507926 - RNA, 20 nt, Chlamydophila pneumoniae CWL029
cuuuauggcucaacuuaagu

SEQ ID NO: 507927 - RNA, 16 nt, Chlamydophila pneumoniae CWL029
cuuuauguuuuguccu

SEQ ID NO: 507928 - RNA, 14 nt, Chlamydophila pneumoniae CWL029
cuuuaccagaaaug

SEQ ID NO: 507929 - RNA, 12 nt, Chlamydophila pneumoniae CWL029
cuuuacuacaug

SEQ ID NO: 507930 - RNA, 19 nt, Chlamydophila pneumoniae CWL029
cuuuaagguugcuuuucua

SEQ ID NO: 507931 - RNA, 16 nt, Chlamydophila pneumoniae CWL029
cuuuaacuucuaaaag

SEQ ID NO: 507932 - RNA, 20 nt, Chlamydophila pneumoniae CWL029
cuuuaagaagcacuucuuua

SEQ ID NO: 507933 - RNA, 21 nt, Chlamydophila pneumoniae CWL029
aaagaauagccgacaugcuuu

SEQ ID NO: 507934 - RNA, 13 nt, Chlamydophila pneumoniae CWL029
aaagaaguuauaa

SEQ ID NO: 507935 - RNA, 23 nt, Chlamydophila pneumoniae CWL029
aaagaaguuuacaaauaaaauga

SEQ ID NO: 507936 - RNA, 18 nt, Chlamydophila pneumoniae CWL029
aaagaauaaaaauaccag

SEQ ID NO: 507937 - RNA, 14 nt, Chlamydophila pneumoniae CWL029
aaagaagauucaag

SEQ ID NO: 507938 - RNA, 22 nt, Chlamydophila pneumoniae CWL029
aaagaagauucaagcaaugccu

SEQ ID NO: 507939 - RNA, 15 nt, Chlamydophila pneumoniae CWL029
aaagaagguccaugu

SEQ ID NO: 507940 - RNA, 21 nt, Chlamydophila pneumoniae CWL029
aaagaaggucuuccaucucuu

SEQ ID NO: 507941 - RNA, 22 nt, Chlamydophila pneumoniae CWL029
aaagaagguugagacguaacca

SEQ ID NO: 507942 - RNA, 13 nt, Chlamydophila pneumoniae CWL029
aaagaaugccauu

SEQ ID NO: 507943 - RNA, 21 nt, Chlamydophila pneumoniae CWL029
aaagaauuccuaaaacgagca

SEQ ID NO: 507944 - RNA, 21 nt, Chlamydophila pneumoniae CWL029
aaagaauuguaguucuuugaa

SEQ ID NO: 507945 - RNA, 17 nt, Chlamydophila pneumoniae CWL029
aaagaauuaagaagaag

SEQ ID NO: 507946 - RNA, 19 nt, Chlamydophila pneumoniae CWL029
aaagaauucagagaaagcc

SEQ ID NO: 507947 - RNA, 16 nt, Chlamydophila pneumoniae CWL029
cuuuuaauguguucuu

SEQ ID NO: 507948 - RNA, 19 nt, Chlamydophila pneumoniae CWL029
cuuuuaauguguucuuauc

SEQ ID NO: 507949 - RNA, 14 nt, Chlamydophila pneumoniae CWL029
cuuuuaagacaaua

SEQ ID NO: 507950 - RNA, 17 nt, Chlamydophila pneumoniae CWL029
cuuugaucgcuugugca

SEQ ID NO: 507951 - RNA, 16 nt, Chlamydophila pneumoniae CWL029
cuuugccaacagcugg

SEQ ID NO: 507952 - RNA, 17 nt, Chlamydophila pneumoniae CWL029
cuuugccaacagcuggg

SEQ ID NO: 507953 - RNA, 20 nt, Chlamydophila pneumoniae CWL029
cuuugccaacagcugggauc

SEQ ID NO: 507954 - RNA, 15 nt, Chlamydophila pneumoniae CWL029
cuuugccaaggaccu

SEQ ID NO: 507955 - RNA, 14 nt, Chlamydophila pneumoniae CWL029
cuuugagucuuuuu

SEQ ID NO: 507956 - RNA, 14 nt, Chlamydophila pneumoniae CWL029
cuuugaguagccag

SEQ ID NO: 507957 - RNA, 19 nt, Chlamydophila pneumoniae CWL029
cuuugaguaggguguauuc

SEQ ID NO: 507958 - RNA, 16 nt, Chlamydophila pneumoniae CWL029
cuuugagucuuuuuca

SEQ ID NO: 507959 - RNA, 20 nt, Chlamydophila pneumoniae CWL029
cuuugaggauacgaauaagu

SEQ ID NO: 507960 - RNA, 23 nt, Chlamydophila pneumoniae CWL029
cuuugcuuauuuccccgaacaaa

SEQ ID NO: 507961 - RNA, 14 nt, Chlamydophila pneumoniae CWL029
cuuugcuuauuucc

SEQ ID NO: 507962 - RNA, 16 nt, Chlamydophila pneumoniae CWL029
cuuugcuuauuucccc

SEQ ID NO: 507963 - RNA, 15 nt, Chlamydophila pneumoniae CWL029
cuuugaauaaugcau

SEQ ID NO: 507964 - RNA, 19 nt, Chlamydophila pneumoniae CWL029
cuuugaagcucgaccucua

SEQ ID NO: 507965 - RNA, 17 nt, Chlamydophila pneumoniae CWL029
cuuucuuauuacagaaa

SEQ ID NO: 507966 - RNA, 16 nt, Chlamydophila pneumoniae CWL029
cuuucugcuugucuac

SEQ ID NO: 507967 - RNA, 14 nt, Chlamydophila pneumoniae CWL029
cuuucugcuugucu

SEQ ID NO: 507968 - RNA, 16 nt, Chlamydophila pneumoniae CWL029
cuuucugcucuucuau

SEQ ID NO: 507969 - RNA, 19 nt, Chlamydophila pneumoniae CWL029
cuuucugauuuaaaagguu

SEQ ID NO: 507970 - RNA, 17 nt, Chlamydophila pneumoniae CWL029
cuuucgucccucuaauc

SEQ ID NO: 507971 - RNA, 16 nt, Chlamydophila pneumoniae CWL029
cuuucugauugagaau

SEQ ID NO: 507972 - RNA, 19 nt, Chlamydophila pneumoniae CWL029
cuuucugauugagaauaaa

SEQ ID NO: 507973 - RNA, 16 nt, Chlamydophila pneumoniae CWL029
cuuuccguugaugaca

SEQ ID NO: 507974 - RNA, 16 nt, Chlamydophila pneumoniae CWL029
cuuuccuaaaauaauu

SEQ ID NO: 507975 - RNA, 21 nt, Chlamydophila pneumoniae CWL029
cuuuccggguaaguacacauu

SEQ ID NO: 507976 - RNA, 21 nt, Chlamydophila pneumoniae CWL029
cuuuccucucuuuauauuuuu

SEQ ID NO: 507977 - RNA, 14 nt, Chlamydophila pneumoniae CWL029
cuuuccuuagcauu

SEQ ID NO: 507978 - RNA, 18 nt, Chlamydophila pneumoniae CWL029
cuugugguuagaggaagc

SEQ ID NO: 507979 - RNA, 23 nt, Chlamydophila pneumoniae CWL029
cuugugguuuuucuccucuuucu

SEQ ID NO: 507980 - RNA, 19 nt, Chlamydophila pneumoniae CWL029
cuugugcuaaagcaggagc

SEQ ID NO: 507981 - RNA, 13 nt, Chlamydophila pneumoniae CWL029
aaagaaagaagcc

SEQ ID NO: 507982 - RNA, 19 nt, Chlamydophila pneumoniae CWL029
aaagaaagugaaaccauuu

SEQ ID NO: 507983 - RNA, 17 nt, Chlamydophila pneumoniae CWL029
aaacuuuuuuucuucuc

SEQ ID NO: 507984 - RNA, 15 nt, Chlamydophila pneumoniae CWL029
cuugucuaggagcuu

SEQ ID NO: 507985 - RNA, 18 nt, Chlamydophila pneumoniae CWL029
cuugucgcgacaagacaa

SEQ ID NO: 507986 - RNA, 13 nt, Chlamydophila pneumoniae CWL029
cuuuaaaaaccca

SEQ ID NO: 507987 - RNA, 18 nt, Chlamydophila pneumoniae CWL029
cuuguuuuccuguguggu

SEQ ID NO: 507988 - RNA, 18 nt, Chlamydophila pneumoniae CWL029
cuuguugguuaaaauaga

SEQ ID NO: 507989 - RNA, 21 nt, Chlamydophila pneumoniae CWL029
cuuuaaaaauauaucuucaga

SEQ ID NO: 507990 - RNA, 17 nt, Chlamydophila pneumoniae CWL029
cuuuaaaagcauagugu

SEQ ID NO: 507991 - RNA, 17 nt, Chlamydophila pneumoniae CWL029
cuuuaaagauuccccau

SEQ ID NO: 507992 - RNA, 14 nt, Chlamydophila pneumoniae CWL029
cuuuaaauaaaauc

SEQ ID NO: 507993 - RNA, 22 nt, Chlamydophila pneumoniae CWL029
aaagaagacgcucuuagccuag

SEQ ID NO: 507994 - RNA, 16 nt, Chlamydophila pneumoniae CWL029
cuuguuggcauagcga

SEQ ID NO: 507995 - RNA, 22 nt, Chlamydophila pneumoniae CWL029
cuuguuggcauagcgagaacac

SEQ ID NO: 507996 - RNA, 19 nt, Chlamydophila pneumoniae CWL029
aaagaacuuaaaauucaaa

SEQ ID NO: 507997 - RNA, 20 nt, Chlamydophila pneumoniae CWL029
aaagaacgauaaaauugaaa

SEQ ID NO: 507998 - RNA, 12 nt, Chlamydophila pneumoniae CWL029
aaagaacacucc

SEQ ID NO: 507999 - RNA, 23 nt, Chlamydophila pneumoniae CWL029
aaagaaauauuaacccaccagaa

SEQ ID NO: 508000 - RNA, 16 nt, Chlamydophila pneumoniae CWL029
aaagaaaucaaacauu

SEQ ID NO: 508001 - RNA, 15 nt, Chlamydophila pneumoniae CWL029
aaagaaauauuaacc

SEQ ID NO: 508002 - RNA, 16 nt, Chlamydophila pneumoniae CWL029
cuuguucuaaaaugaa

SEQ ID NO: 508003 - RNA, 18 nt, Chlamydophila pneumoniae CWL029
cuuguucuaaaaugaaau

SEQ ID NO: 508004 - RNA, 13 nt, Chlamydophila pneumoniae CWL029
cuuguucuguaac

SEQ ID NO: 508005 - RNA, 18 nt, Chlamydophila pneumoniae CWL029
cuuguucuucuugauuaa

SEQ ID NO: 508006 - RNA, 22 nt, Chlamydophila pneumoniae CWL029
cuuguucuucuugauuaagauc

SEQ ID NO: 508007 - RNA, 13 nt, Chlamydophila pneumoniae CWL029
cuuggucgcaagg

SEQ ID NO: 508008 - RNA, 18 nt, Chlamydophila pneumoniae CWL029
cuugguguauaguauuuu

SEQ ID NO: 508009 - RNA, 23 nt, Chlamydophila pneumoniae CWL029
cuugguguauaguauuuuuaaau

SEQ ID NO: 508010 - RNA, 14 nt, Chlamydophila pneumoniae CWL029
cuuguauuguacuu

SEQ ID NO: 508011 - RNA, 13 nt, Chlamydophila pneumoniae CWL029
cuuguagcaauua

SEQ ID NO: 508012 - RNA, 14 nt, Chlamydophila pneumoniae CWL029
cuuguacauccuug

SEQ ID NO: 508013 - RNA, 18 nt, Chlamydophila pneumoniae CWL029
cuuguaccguaaagaaaa

SEQ ID NO: 508014 - RNA, 14 nt, Chlamydophila pneumoniae CWL029
cuuggcguacucua

SEQ ID NO: 508015 - RNA, 20 nt, Chlamydophila pneumoniae CWL029
cuuggcguacucuauuaagg

SEQ ID NO: 508016 - RNA, 19 nt, Chlamydophila pneumoniae CWL029
cuuggaugggaaucuugaa

SEQ ID NO: 508017 - RNA, 16 nt, Chlamydophila pneumoniae CWL029
cuuggauuucuucuuc

SEQ ID NO: 508018 - RNA, 19 nt, Chlamydophila pneumoniae CWL029
cuuggauuucuucuucuaa

SEQ ID NO: 508019 - RNA, 15 nt, Chlamydophila pneumoniae CWL029
cuuggaaaucagaau

SEQ ID NO: 508020 - RNA, 13 nt, Chlamydophila pneumoniae CWL029
cuuuuguauuaaa

SEQ ID NO: 508021 - RNA, 16 nt, Chlamydophila pneumoniae CWL029
cuuuuagguagagaau

SEQ ID NO: 508022 - RNA, 23 nt, Chlamydophila pneumoniae CWL029
cuuuuagagccuuuucagauuuu

SEQ ID NO: 508023 - RNA, 16 nt, Chlamydophila pneumoniae CWL029
cuuuuauauuaagaau

SEQ ID NO: 508024 - RNA, 17 nt, Chlamydophila pneumoniae CWL029
cuuuugaagauccugag

SEQ ID NO: 508025 - RNA, 19 nt, Chlamydophila pneumoniae CWL029
cuuuugaagauccugagua

SEQ ID NO: 508026 - RNA, 17 nt, Chlamydophila pneumoniae CWL029
cuuuugacaauaagaaa

SEQ ID NO: 508027 - RNA, 22 nt, Chlamydophila pneumoniae CWL029
cuuuuugcauagccuuccuguu

SEQ ID NO: 508028 - RNA, 15 nt, Chlamydophila pneumoniae CWL029
cuuuuugccacaacu

SEQ ID NO: 508029 - RNA, 16 nt, Chlamydophila pneumoniae CWL029
cuuuuucaauagcagu

SEQ ID NO: 508030 - RNA, 19 nt, Chlamydophila pneumoniae CWL029
cuuuuucagcuucuacagc

SEQ ID NO: 508031 - RNA, 15 nt, Chlamydophila pneumoniae CWL029
cuuuuuuucuagagu

SEQ ID NO: 508032 - RNA, 21 nt, Chlamydophila pneumoniae CWL029
cuuuuuuucuucucuaagaaa

SEQ ID NO: 508033 - RNA, 18 nt, Chlamydophila pneumoniae CWL029
cuuuuuuuauauaaagau

SEQ ID NO: 508034 - RNA, 14 nt, Chlamydophila pneumoniae CWL029
gaaaaaagaauaaa

SEQ ID NO: 508035 - RNA, 15 nt, Chlamydophila pneumoniae CWL029
gaaaaaauagauccu

SEQ ID NO: 508036 - RNA, 16 nt, Chlamydophila pneumoniae CWL029
gaaaaagaaucucuga

SEQ ID NO: 508037 - RNA, 16 nt, Chlamydophila pneumoniae CWL029
gaaaaaccuucuccaa

SEQ ID NO: 508038 - RNA, 16 nt, Chlamydophila pneumoniae CWL029
gaaaccuucagaucga

SEQ ID NO: 508039 - RNA, 17 nt, Chlamydophila pneumoniae CWL029
gaaaccuucucucuuaa

SEQ ID NO: 508040 - RNA, 20 nt, Chlamydophila pneumoniae CWL029
gaaaccggacugacuucuau

SEQ ID NO: 508041 - RNA, 22 nt, Chlamydophila pneumoniae CWL029
gaaacccauaaugguacaauac

SEQ ID NO: 508042 - RNA, 23 nt, Chlamydophila pneumoniae CWL029
gaaaccauuuaccccaggaauca

SEQ ID NO: 508043 - RNA, 15 nt, Chlamydophila pneumoniae CWL029
gaaaccaugaugcaa

SEQ ID NO: 508044 - RNA, 19 nt, Chlamydophila pneumoniae CWL029
gaaaccauauugcaaagca

SEQ ID NO: 508045 - RNA, 17 nt, Chlamydophila pneumoniae CWL029
gaaacccgcaacucuuu

SEQ ID NO: 508046 - RNA, 23 nt, Chlamydophila pneumoniae CWL029
gaaacauggcgguguuuccuucg

SEQ ID NO: 508047 - RNA, 13 nt, Chlamydophila pneumoniae CWL029
gaaacacucauga

SEQ ID NO: 508048 - RNA, 24 nt, Chlamydophila pneumoniae CWL029
gaaacacuuuggauaggauaggag

SEQ ID NO: 508049 - RNA, 17 nt, Chlamydophila pneumoniae CWL029
gaaacaugaaguuguug

SEQ ID NO: 508050 - RNA, 12 nt, Chlamydophila pneumoniae CWL029
gaaacaacugaa

SEQ ID NO: 508051 - RNA, 13 nt, Chlamydophila pneumoniae CWL029
gaaaaaucccugu

SEQ ID NO: 508052 - RNA, 16 nt, Chlamydophila pneumoniae CWL029
gaaaaaucccuguucu

SEQ ID NO: 508053 - RNA, 11 nt, Chlamydophila pneumoniae CWL029
gaaaaauccug

SEQ ID NO: 508054 - RNA, 20 nt, Chlamydophila pneumoniae CWL029
gaaaaggauugcacucaucu

SEQ ID NO: 508055 - RNA, 21 nt, Chlamydophila pneumoniae CWL029
gaaaaggcccccuacagcaga

SEQ ID NO: 508056 - RNA, 22 nt, Chlamydophila pneumoniae CWL029
gaaaaggcccccuacagcagaa

SEQ ID NO: 508057 - RNA, 23 nt, Chlamydophila pneumoniae CWL029
gaaaaucaacucuccauccucag

SEQ ID NO: 508058 - RNA, 11 nt, Chlamydophila pneumoniae CWL029
gaaaaucacac

SEQ ID NO: 508059 - RNA, 19 nt, Chlamydophila pneumoniae CWL029
gaaaauucaguauaagaug

SEQ ID NO: 508060 - RNA, 23 nt, Chlamydophila pneumoniae CWL029
gaaaauaucaccuacaucagacu

SEQ ID NO: 508061 - RNA, 21 nt, Chlamydophila pneumoniae CWL029
gaaagccuuugcucacuguuu

SEQ ID NO: 508062 - RNA, 18 nt, Chlamydophila pneumoniae CWL029
gaaagagugccaagagca

SEQ ID NO: 508063 - RNA, 20 nt, Chlamydophila pneumoniae CWL029
gaaagauaucccaaagcuag

SEQ ID NO: 508064 - RNA, 23 nt, Chlamydophila pneumoniae CWL029
gaaagaucagaggaaucuaagaa

SEQ ID NO: 508065 - RNA, 16 nt, Chlamydophila pneumoniae CWL029
gaaagcccaugagaug

SEQ ID NO: 508066 - RNA, 19 nt, Chlamydophila pneumoniae CWL029
gaaagaagggaauacgauc

SEQ ID NO: 508067 - RNA, 23 nt, Chlamydophila pneumoniae CWL029
gaaagaaguccuagggagugagg

SEQ ID NO: 508068 - RNA, 17 nt, Chlamydophila pneumoniae CWL029
gaaagaacuacuuaaau

SEQ ID NO: 508069 - RNA, 15 nt, Chlamydophila pneumoniae CWL029
gaaagagucccugau

SEQ ID NO: 508070 - RNA, 16 nt, Chlamydophila pneumoniae CWL029
gaaagagucccugauu

SEQ ID NO: 508071 - RNA, 17 nt, Chlamydophila pneumoniae CWL029
gaaagagcuaaagaaac

SEQ ID NO: 508072 - RNA, 18 nt, Chlamydophila pneumoniae CWL029
gaaagagcuaaagaaacu

SEQ ID NO: 508073 - RNA, 23 nt, Chlamydophila pneumoniae CWL029
gaaacuuuugucgcaauaacaaa

SEQ ID NO: 508074 - RNA, 22 nt, Chlamydophila pneumoniae CWL029
gaaacgcccuucaggacaugcc

SEQ ID NO: 508075 - RNA, 13 nt, Chlamydophila pneumoniae CWL029
gaaacgaaagcag

SEQ ID NO: 508076 - RNA, 18 nt, Chlamydophila pneumoniae CWL029
gaaaggcugauaagauca

SEQ ID NO: 508077 - RNA, 16 nt, Chlamydophila pneumoniae CWL029
gaaagguaguuuucuu

SEQ ID NO: 508078 - RNA, 17 nt, Chlamydophila pneumoniae CWL029
gaaagcuucuggauuca

SEQ ID NO: 508079 - RNA, 16 nt, Chlamydophila pneumoniae CWL029
gaaauauaacucucua

SEQ ID NO: 508080 - RNA, 14 nt, Chlamydophila pneumoniae CWL029
gaaauauacugcca

SEQ ID NO: 508081 - RNA, 19 nt, Chlamydophila pneumoniae CWL029
gaaauauuaacccaccaga

SEQ ID NO: 508082 - RNA, 18 nt, Chlamydophila pneumoniae CWL029
gaacaguauaaucagaag

SEQ ID NO: 508083 - RNA, 21 nt, Chlamydophila pneumoniae CWL029
gaacaguauaaucagaaguga

SEQ ID NO: 508084 - RNA, 18 nt, Chlamydophila pneumoniae CWL029
gaacaguuccuauuuuuu

SEQ ID NO: 508085 - RNA, 15 nt, Chlamydophila pneumoniae CWL029
gaacauccuucacuc

SEQ ID NO: 508086 - RNA, 18 nt, Chlamydophila pneumoniae CWL029
gaacagccucugugguuu

SEQ ID NO: 508087 - RNA, 23 nt, Chlamydophila pneumoniae CWL029
gaacagccucugugguuuuuauu

SEQ ID NO: 508088 - RNA, 19 nt, Chlamydophila pneumoniae CWL029
gaacaacgcugcuucucua

SEQ ID NO: 508089 - RNA, 13 nt, Chlamydophila pneumoniae CWL029
gaacagagaugca

SEQ ID NO: 508090 - RNA, 22 nt, Chlamydophila pneumoniae CWL029
gaacacccccgcagcuucucua

SEQ ID NO: 508091 - RNA, 16 nt, Chlamydophila pneumoniae CWL029
gaacaccauaaaacaa

SEQ ID NO: 508092 - RNA, 16 nt, Chlamydophila pneumoniae CWL029
gaaaucugcucuacuu

SEQ ID NO: 508093 - RNA, 18 nt, Chlamydophila pneumoniae CWL029
gaaaucguaucuuuuugc

SEQ ID NO: 508094 - RNA, 20 nt, Chlamydophila pneumoniae CWL029
gaaaucguaucuuuuugcag

SEQ ID NO: 508095 - RNA, 22 nt, Chlamydophila pneumoniae CWL029
gaaauguaagaaggcagagaac

SEQ ID NO: 508096 - RNA, 23 nt, Chlamydophila pneumoniae CWL029
gaaauuauagaugaucacaggcu

SEQ ID NO: 508097 - RNA, 17 nt, Chlamydophila pneumoniae CWL029
gaacaaagcucuccuuc

SEQ ID NO: 508098 - RNA, 20 nt, Chlamydophila pneumoniae CWL029
aaagagcucaaaaaguucca

SEQ ID NO: 508099 - RNA, 12 nt, Chlamydophila pneumoniae CWL029
aaagagcuaaag

SEQ ID NO: 508100 - RNA, 17 nt, Chlamydophila pneumoniae CWL029
gaaauguuuuuaaaccu

SEQ ID NO: 508101 - RNA, 13 nt, Chlamydophila pneumoniae CWL029
gaaauuaaagcua

SEQ ID NO: 508102 - RNA, 19 nt, Chlamydophila pneumoniae CWL029
gaaauuaaagcuaacaacu

SEQ ID NO: 508103 - RNA, 21 nt, Chlamydophila pneumoniae CWL029
gaaauuaacagagcgccucca

SEQ ID NO: 508104 - RNA, 16 nt, Chlamydophila pneumoniae CWL029
gauaucccacagaaau

SEQ ID NO: 508105 - RNA, 22 nt, Chlamydophila pneumoniae CWL029
gauaucaugcaauacuuuucuc

SEQ ID NO: 508106 - RNA, 19 nt, Chlamydophila pneumoniae CWL029
gauaucccacagaaauguc

SEQ ID NO: 508107 - RNA, 17 nt, Chlamydophila pneumoniae CWL029
gauaucuauaaauguag

SEQ ID NO: 508108 - RNA, 17 nt, Chlamydophila pneumoniae CWL029
gaucaaagauuccuaag

SEQ ID NO: 508109 - RNA, 17 nt, Chlamydophila pneumoniae CWL029
gaucaaauuccuucuca

SEQ ID NO: 508110 - RNA, 19 nt, Chlamydophila pneumoniae CWL029
gaucaaauuccuucucaga

SEQ ID NO: 508111 - RNA, 22 nt, Chlamydophila pneumoniae CWL029
gaucaauauagagaacuccauu

SEQ ID NO: 508112 - RNA, 23 nt, Chlamydophila pneumoniae CWL029
gauauucugauucuccguccccc

SEQ ID NO: 508113 - RNA, 13 nt, Chlamydophila pneumoniae CWL029
gauauugucaaga

SEQ ID NO: 508114 - RNA, 15 nt, Chlamydophila pneumoniae CWL029
gauauuguucuucca

SEQ ID NO: 508115 - RNA, 24 nt, Chlamydophila pneumoniae CWL029
gauagcauugucgaguauaauuga

SEQ ID NO: 508116 - RNA, 19 nt, Chlamydophila pneumoniae CWL029
gauagccaucauaaaacgu

SEQ ID NO: 508117 - RNA, 15 nt, Chlamydophila pneumoniae CWL029
gauauauuuuuaaag

SEQ ID NO: 508118 - RNA, 19 nt, Chlamydophila pneumoniae CWL029
gauaguuuuugcuguuucu

SEQ ID NO: 508119 - RNA, 18 nt, Chlamydophila pneumoniae CWL029
gauagcuaaaccuucaga

SEQ ID NO: 508120 - RNA, 19 nt, Chlamydophila pneumoniae CWL029
gauagcuaaaccuucagau

SEQ ID NO: 508121 - RNA, 23 nt, Chlamydophila pneumoniae CWL029
gauagcgucuguuaacucagaga

SEQ ID NO: 508122 - RNA, 22 nt, Chlamydophila pneumoniae CWL029
aaagcagugugccaauuuuugu

SEQ ID NO: 508123 - RNA, 22 nt, Chlamydophila pneumoniae CWL029
aaagcauagucgucuuuuaaag

SEQ ID NO: 508124 - RNA, 14 nt, Chlamydophila pneumoniae CWL029
aaagcauaguguau

SEQ ID NO: 508125 - RNA, 20 nt, Chlamydophila pneumoniae CWL029
aaagcaucacggacuccguc

SEQ ID NO: 508126 - RNA, 12 nt, Chlamydophila pneumoniae CWL029
aaagccacagcc

SEQ ID NO: 508127 - RNA, 21 nt, Chlamydophila pneumoniae CWL029
aaagccacauucuucugauac

SEQ ID NO: 508128 - RNA, 18 nt, Chlamydophila pneumoniae CWL029
aaagcaucuuguauugcu

SEQ ID NO: 508129 - RNA, 19 nt, Chlamydophila pneumoniae CWL029
aaagcaucuuucaucaaug

SEQ ID NO: 508130 - RNA, 20 nt, Chlamydophila pneumoniae CWL029
gauaccaagaugaagaaacu

SEQ ID NO: 508131 - RNA, 15 nt, Chlamydophila pneumoniae CWL029
gauacaucaucagaa

SEQ ID NO: 508132 - RNA, 19 nt, Chlamydophila pneumoniae CWL029
gauacauccucacuagaga

SEQ ID NO: 508133 - RNA, 16 nt, Chlamydophila pneumoniae CWL029
gauaccaaaauaccau

SEQ ID NO: 508134 - RNA, 16 nt, Chlamydophila pneumoniae CWL029
gauaccaccuaaaaug

SEQ ID NO: 508135 - RNA, 23 nt, Chlamydophila pneumoniae CWL029
gauaccacgcaucuuaagagaaa

SEQ ID NO: 508136 - RNA, 14 nt, Chlamydophila pneumoniae CWL029
gauacccaucuaga

SEQ ID NO: 508137 - RNA, 16 nt, Chlamydophila pneumoniae CWL029
gauacccaucuagaaa

SEQ ID NO: 508138 - RNA, 14 nt, Chlamydophila pneumoniae CWL029
gauaacacuucuuu

SEQ ID NO: 508139 - RNA, 18 nt, Chlamydophila pneumoniae CWL029
gauaaccacuauacccuc

SEQ ID NO: 508140 - RNA, 19 nt, Chlamydophila pneumoniae CWL029
gauaaccacuauacccucu

SEQ ID NO: 508141 - RNA, 12 nt, Chlamydophila pneumoniae CWL029
gauaauagagaa

SEQ ID NO: 508142 - RNA, 19 nt, Chlamydophila pneumoniae CWL029
gauaaucuguaagaaaaug

SEQ ID NO: 508143 - RNA, 19 nt, Chlamydophila pneumoniae CWL029
gauaaucagaggagccucc

SEQ ID NO: 508144 - RNA, 20 nt, Chlamydophila pneumoniae CWL029
gauaaugaaguuugcaugca

SEQ ID NO: 508145 - RNA, 17 nt, Chlamydophila pneumoniae CWL029
gauaaugauuccuagaa

SEQ ID NO: 508146 - RNA, 19 nt, Chlamydophila pneumoniae CWL029
gauaaugucuccaucggaa

SEQ ID NO: 508147 - RNA, 13 nt, Chlamydophila pneumoniae CWL029
gaguuagcuuuug

SEQ ID NO: 508148 - RNA, 22 nt, Chlamydophila pneumoniae CWL029
gagugcguacucuucuuuggau

SEQ ID NO: 508149 - RNA, 14 nt, Chlamydophila pneumoniae CWL029
gaguucuugauucu

SEQ ID NO: 508150 - RNA, 17 nt, Chlamydophila pneumoniae CWL029
gaguucuuguaauaaaa

SEQ ID NO: 508151 - RNA, 18 nt, Chlamydophila pneumoniae CWL029
gaguucuuguaauaaaag

SEQ ID NO: 508152 - RNA, 16 nt, Chlamydophila pneumoniae CWL029
gaguucuuuuguuugu

SEQ ID NO: 508153 - RNA, 15 nt, Chlamydophila pneumoniae CWL029
gaguugccaggaaac

SEQ ID NO: 508154 - RNA, 12 nt, Chlamydophila pneumoniae CWL029
gaguuuuccuaa

SEQ ID NO: 508155 - RNA, 14 nt, Chlamydophila pneumoniae CWL029
gauaaauccgcaga

SEQ ID NO: 508156 - RNA, 15 nt, Chlamydophila pneumoniae CWL029
gauaaaucccgaaca

SEQ ID NO: 508157 - RNA, 23 nt, Chlamydophila pneumoniae CWL029
gaguuuuuguguuugacugaaac

SEQ ID NO: 508158 - RNA, 13 nt, Chlamydophila pneumoniae CWL029
gaguuuuuuucuu

SEQ ID NO: 508159 - RNA, 22 nt, Chlamydophila pneumoniae CWL029
gaguuuuuuucuuauagggaau

SEQ ID NO: 508160 - RNA, 16 nt, Chlamydophila pneumoniae CWL029
gauaaagccugcacga

SEQ ID NO: 508161 - RNA, 16 nt, Chlamydophila pneumoniae CWL029
gagucgugcaggagaa

SEQ ID NO: 508162 - RNA, 15 nt, Chlamydophila pneumoniae CWL029
gaguaucuagcuuug

SEQ ID NO: 508163 - RNA, 20 nt, Chlamydophila pneumoniae CWL029
gaguaucuagcuuugucucu

SEQ ID NO: 508164 - RNA, 16 nt, Chlamydophila pneumoniae CWL029
gagucaggaagaugcu

SEQ ID NO: 508165 - RNA, 17 nt, Chlamydophila pneumoniae CWL029
gagucaggaagaugcug

SEQ ID NO: 508166 - RNA, 21 nt, Chlamydophila pneumoniae CWL029
gagucucacucuuuucuagaa

SEQ ID NO: 508167 - RNA, 14 nt, Chlamydophila pneumoniae CWL029
gagucucuugauuc

SEQ ID NO: 508168 - RNA, 13 nt, Chlamydophila pneumoniae CWL029
gagucucuuucag

SEQ ID NO: 508169 - RNA, 19 nt, Chlamydophila pneumoniae CWL029
gagucucuuucagcucaag

SEQ ID NO: 508170 - RNA, 21 nt, Chlamydophila pneumoniae CWL029
gagucugcagcagaugaaacu

SEQ ID NO: 508171 - RNA, 21 nt, Chlamydophila pneumoniae CWL029
gagucuucagcuuguuuuugc

SEQ ID NO: 508172 - RNA, 21 nt, Chlamydophila pneumoniae CWL029
gagugccaagagcaucacaaa

SEQ ID NO: 508173 - RNA, 13 nt, Chlamydophila pneumoniae CWL029
gaguagccccagc

SEQ ID NO: 508174 - RNA, 21 nt, Chlamydophila pneumoniae CWL029
gagguuucccgguaugaucaa

SEQ ID NO: 508175 - RNA, 23 nt, Chlamydophila pneumoniae CWL029
gagguuucgaagcguuaacaacu

SEQ ID NO: 508176 - RNA, 16 nt, Chlamydophila pneumoniae CWL029
gagguucgcagaacuu

SEQ ID NO: 508177 - RNA, 20 nt, Chlamydophila pneumoniae CWL029
gagguucgcagaacuucucc

SEQ ID NO: 508178 - RNA, 13 nt, Chlamydophila pneumoniae CWL029
gagguuauguacu

SEQ ID NO: 508179 - RNA, 23 nt, Chlamydophila pneumoniae CWL029
gagguccuuggcauucaggagca

SEQ ID NO: 508180 - RNA, 19 nt, Chlamydophila pneumoniae CWL029
gagggaucuucucuaugaa

SEQ ID NO: 508181 - RNA, 19 nt, Chlamydophila pneumoniae CWL029
gaggcuucugagcuugccu

SEQ ID NO: 508182 - RNA, 22 nt, Chlamydophila pneumoniae CWL029
gaggcuucugagcuugccuacc

SEQ ID NO: 508183 - RNA, 21 nt, Chlamydophila pneumoniae CWL029
gagggaucauguagcagagcc

SEQ ID NO: 508184 - RNA, 15 nt, Chlamydophila pneumoniae CWL029
gaggcaagucucaaa

SEQ ID NO: 508185 - RNA, 14 nt, Chlamydophila pneumoniae CWL029
gaggcuagaaaauc

SEQ ID NO: 508186 - RNA, 11 nt, Chlamydophila pneumoniae CWL029
gaggcaaagau

SEQ ID NO: 508187 - RNA, 13 nt, Chlamydophila pneumoniae CWL029
gaggaaugaagag

SEQ ID NO: 508188 - RNA, 14 nt, Chlamydophila pneumoniae CWL029
gaggaauucuggaa

SEQ ID NO: 508189 - RNA, 15 nt, Chlamydophila pneumoniae CWL029
gaggacgcagagaug

SEQ ID NO: 508190 - RNA, 14 nt, Chlamydophila pneumoniae CWL029
gaggacgaaucaau

SEQ ID NO: 508191 - RNA, 16 nt, Chlamydophila pneumoniae CWL029
gagcuucuaagaucuu

SEQ ID NO: 508192 - RNA, 13 nt, Chlamydophila pneumoniae CWL029
gagcuucuaucuu

SEQ ID NO: 508193 - RNA, 15 nt, Chlamydophila pneumoniae CWL029
gagcuugucuuccac

SEQ ID NO: 508194 - RNA, 18 nt, Chlamydophila pneumoniae CWL029
gagcuucacaucuuucuc

SEQ ID NO: 508195 - RNA, 14 nt, Chlamydophila pneumoniae CWL029
gagcugcugguccu

SEQ ID NO: 508196 - RNA, 23 nt, Chlamydophila pneumoniae CWL029
gagcuggaagacuugcucugaag

SEQ ID NO: 508197 - RNA, 17 nt, Chlamydophila pneumoniae CWL029
gagcuggacuucugguu

SEQ ID NO: 508198 - RNA, 16 nt, Chlamydophila pneumoniae CWL029
gagcaucauuaauucc

SEQ ID NO: 508199 - RNA, 14 nt, Chlamydophila pneumoniae CWL029
gagcauccaaaaug

SEQ ID NO: 508200 - RNA, 21 nt, Chlamydophila pneumoniae CWL029
gagcauccuguagccacuaag

SEQ ID NO: 508201 - RNA, 20 nt, Chlamydophila pneumoniae CWL029
gagcaucuuuucaaaagaaa

SEQ ID NO: 508202 - RNA, 22 nt, Chlamydophila pneumoniae CWL029
gagcaucuuuucaaaagaaaag

SEQ ID NO: 508203 - RNA, 17 nt, Chlamydophila pneumoniae CWL029
aaagcaggagcaucauu

SEQ ID NO: 508204 - RNA, 16 nt, Chlamydophila pneumoniae CWL029
gagcauagacucuucc

SEQ ID NO: 508205 - RNA, 15 nt, Chlamydophila pneumoniae CWL029
gagcagaaacuccag

SEQ ID NO: 508206 - RNA, 21 nt, Chlamydophila pneumoniae CWL029
gagaugccauaagcaagcaac

SEQ ID NO: 508207 - RNA, 14 nt, Chlamydophila pneumoniae CWL029
gagaugcuaacaac

SEQ ID NO: 508208 - RNA, 19 nt, Chlamydophila pneumoniae CWL029
gagauacguuccagccugu

SEQ ID NO: 508209 - RNA, 15 nt, Chlamydophila pneumoniae CWL029
gagaucauuagcauc

SEQ ID NO: 508210 - RNA, 23 nt, Chlamydophila pneumoniae CWL029
gagaucauuagcaucaucuccug

SEQ ID NO: 508211 - RNA, 21 nt, Chlamydophila pneumoniae CWL029
gagaucuuuuugccaguucuu

SEQ ID NO: 508212 - RNA, 15 nt, Chlamydophila pneumoniae CWL029
gagaucacagggaca

SEQ ID NO: 508213 - RNA, 17 nt, Chlamydophila pneumoniae CWL029
gagagacuguguuuuua

SEQ ID NO: 508214 - RNA, 22 nt, Chlamydophila pneumoniae CWL029
gagagaaacaucggagaacuuc

SEQ ID NO: 508215 - RNA, 13 nt, Chlamydophila pneumoniae CWL029
gagagaagaaauu

SEQ ID NO: 508216 - RNA, 21 nt, Chlamydophila pneumoniae CWL029
gagagaagcagaaucugugag

SEQ ID NO: 508217 - RNA, 14 nt, Chlamydophila pneumoniae CWL029
gagagaaucgagaa

SEQ ID NO: 508218 - RNA, 15 nt, Chlamydophila pneumoniae CWL029
gagacuuccucuuca

SEQ ID NO: 508219 - RNA, 19 nt, Chlamydophila pneumoniae CWL029
gagacuugaucuacaaaaa

SEQ ID NO: 508220 - RNA, 17 nt, Chlamydophila pneumoniae CWL029
gagacucagagaaaauc

SEQ ID NO: 508221 - RNA, 16 nt, Chlamydophila pneumoniae CWL029
gagacucuaguuuuuc

SEQ ID NO: 508222 - RNA, 18 nt, Chlamydophila pneumoniae CWL029
gagacucuaguuuuucuu

SEQ ID NO: 508223 - RNA, 19 nt, Chlamydophila pneumoniae CWL029
gagacucuaguuuuucuuu

SEQ ID NO: 508224 - RNA, 16 nt, Chlamydophila pneumoniae CWL029
gagacugcaaaggaag

SEQ ID NO: 508225 - RNA, 14 nt, Chlamydophila pneumoniae CWL029
gagagcaagauaau

SEQ ID NO: 508226 - RNA, 13 nt, Chlamydophila pneumoniae CWL029
gagagagcucuuc

SEQ ID NO: 508227 - RNA, 19 nt, Chlamydophila pneumoniae CWL029
gagagaucuggaugagagg

SEQ ID NO: 508228 - RNA, 14 nt, Chlamydophila pneumoniae CWL029
gagagccuuuccua

SEQ ID NO: 508229 - RNA, 14 nt, Chlamydophila pneumoniae CWL029
gagaauuucuccag

SEQ ID NO: 508230 - RNA, 19 nt, Chlamydophila pneumoniae CWL029
gagacaaguucaucaaaua

SEQ ID NO: 508231 - RNA, 20 nt, Chlamydophila pneumoniae CWL029
gagacccaacaguucuuucu

SEQ ID NO: 508232 - RNA, 21 nt, Chlamydophila pneumoniae CWL029
gagaccuacuuauuguucuug

SEQ ID NO: 508233 - RNA, 14 nt, Chlamydophila pneumoniae CWL029
gagaaguuugauaa

SEQ ID NO: 508234 - RNA, 21 nt, Chlamydophila pneumoniae CWL029
gagaauacucuagguuuucuc

SEQ ID NO: 508235 - RNA, 23 nt, Chlamydophila pneumoniae CWL029
gagaauauggccuagcuuucuug

SEQ ID NO: 508236 - RNA, 19 nt, Chlamydophila pneumoniae CWL029
gagaaugacuuuagaaauu

SEQ ID NO: 508237 - RNA, 16 nt, Chlamydophila pneumoniae CWL029
gagaaucuccucauca

SEQ ID NO: 508238 - RNA, 23 nt, Chlamydophila pneumoniae CWL029
gagaagcaucuucgauuucuagu

SEQ ID NO: 508239 - RNA, 22 nt, Chlamydophila pneumoniae CWL029
gagaacuuuugaauuaaaaguu

SEQ ID NO: 508240 - RNA, 19 nt, Chlamydophila pneumoniae CWL029
gagaagcucaucagcaacc

SEQ ID NO: 508241 - RNA, 17 nt, Chlamydophila pneumoniae CWL029
gagaagagguaauaaua

SEQ ID NO: 508242 - RNA, 12 nt, Chlamydophila pneumoniae CWL029
gagaacuucaac

SEQ ID NO: 508243 - RNA, 17 nt, Chlamydophila pneumoniae CWL029
gagaacuucaacaaagg

SEQ ID NO: 508244 - RNA, 17 nt, Chlamydophila pneumoniae CWL029
gagaacguagcagaggc

SEQ ID NO: 508245 - RNA, 14 nt, Chlamydophila pneumoniae CWL029
aaagcaaaaauucu

SEQ ID NO: 508246 - RNA, 15 nt, Chlamydophila pneumoniae CWL029
aaagauuucugcugu

SEQ ID NO: 508247 - RNA, 11 nt, Chlamydophila pneumoniae CWL029
aaagcaaagag

SEQ ID NO: 508248 - RNA, 21 nt, Chlamydophila pneumoniae CWL029
aaagcaaagauaaagaaguuu

SEQ ID NO: 508249 - RNA, 14 nt, Chlamydophila pneumoniae CWL029
aaagcaaccuuaaa

SEQ ID NO: 508250 - RNA, 14 nt, Chlamydophila pneumoniae CWL029
gagaacauguuucu

SEQ ID NO: 508251 - RNA, 21 nt, Chlamydophila pneumoniae CWL029
gagaacaugcccccacaaaac

SEQ ID NO: 508252 - RNA, 18 nt, Chlamydophila pneumoniae CWL029
gagaaccuccaccaggag

SEQ ID NO: 508253 - RNA, 13 nt, Chlamydophila pneumoniae CWL029
gagaaaucacacu

SEQ ID NO: 508254 - RNA, 20 nt, Chlamydophila pneumoniae CWL029
aaagauuugcgaaucuaaga

SEQ ID NO: 508255 - RNA, 18 nt, Chlamydophila pneumoniae CWL029
gagaaaugcucuucugca

SEQ ID NO: 508256 - RNA, 20 nt, Chlamydophila pneumoniae CWL029
gagaaaguagagacaucgua

SEQ ID NO: 508257 - RNA, 16 nt, Chlamydophila pneumoniae CWL029
gagaaagagugccaag

SEQ ID NO: 508258 - RNA, 23 nt, Chlamydophila pneumoniae CWL029
gagaaacuuaguuuugaaaagau

SEQ ID NO: 508259 - RNA, 19 nt, Chlamydophila pneumoniae CWL029
gagaaaggcgcucuuaccu

SEQ ID NO: 508260 - RNA, 19 nt, Chlamydophila pneumoniae CWL029
gagaaagucgauuuccuuu

SEQ ID NO: 508261 - RNA, 19 nt, Chlamydophila pneumoniae CWL029
gagaaaagguaacauugga

SEQ ID NO: 508262 - RNA, 23 nt, Chlamydophila pneumoniae CWL029
gagaaacacaaauucaccaacca

SEQ ID NO: 508263 - RNA, 12 nt, Chlamydophila pneumoniae CWL029
gacuuuccucaa

SEQ ID NO: 508264 - RNA, 17 nt, Chlamydophila pneumoniae CWL029
gacuuucauaugaauga

SEQ ID NO: 508265 - RNA, 20 nt, Chlamydophila pneumoniae CWL029
gacuugccaaucuuccuuaa

SEQ ID NO: 508266 - RNA, 20 nt, Chlamydophila pneumoniae CWL029
gacuucuuguccuguuaaga

SEQ ID NO: 508267 - RNA, 13 nt, Chlamydophila pneumoniae CWL029
gacuucucaaaga

SEQ ID NO: 508268 - RNA, 18 nt, Chlamydophila pneumoniae CWL029
gacuucuggaagcuguug

SEQ ID NO: 508269 - RNA, 22 nt, Chlamydophila pneumoniae CWL029
gacuucuggaagcuguuguucu

SEQ ID NO: 508270 - RNA, 20 nt, Chlamydophila pneumoniae CWL029
gacuucaccuugaaguuuuu

SEQ ID NO: 508271 - RNA, 21 nt, Chlamydophila pneumoniae CWL029
gacuucaccuugaaguuuuuu

SEQ ID NO: 508272 - RNA, 23 nt, Chlamydophila pneumoniae CWL029
gacuucaccuugaaguuuuuucu

SEQ ID NO: 508273 - RNA, 16 nt, Chlamydophila pneumoniae CWL029
gacuuccuccaaaauu

SEQ ID NO: 508274 - RNA, 19 nt, Chlamydophila pneumoniae CWL029
gacuucgaugucuuuccag

SEQ ID NO: 508275 - RNA, 15 nt, Chlamydophila pneumoniae CWL029
gacugcucuuucauu

SEQ ID NO: 508276 - RNA, 17 nt, Chlamydophila pneumoniae CWL029
gacugcucuuucauuuc

SEQ ID NO: 508277 - RNA, 18 nt, Chlamydophila pneumoniae CWL029
gacugcugacaucuccaa

SEQ ID NO: 508278 - RNA, 17 nt, Chlamydophila pneumoniae CWL029
gacugcagauugcacuu

SEQ ID NO: 508279 - RNA, 16 nt, Chlamydophila pneumoniae CWL029
gacucuaauucagaaa

SEQ ID NO: 508280 - RNA, 22 nt, Chlamydophila pneumoniae CWL029
gacucuaguuuuucuuuagaga

SEQ ID NO: 508281 - RNA, 16 nt, Chlamydophila pneumoniae CWL029
gacucgcgucaugcau

SEQ ID NO: 508282 - RNA, 19 nt, Chlamydophila pneumoniae CWL029
gacucucacugaguguccc

SEQ ID NO: 508283 - RNA, 10 nt, Chlamydophila pneumoniae CWL029
gacugaaacu

SEQ ID NO: 508284 - RNA, 17 nt, Chlamydophila pneumoniae CWL029
gacggauaaauggagga

SEQ ID NO: 508285 - RNA, 13 nt, Chlamydophila pneumoniae CWL029
gacggauaggauc

SEQ ID NO: 508286 - RNA, 14 nt, Chlamydophila pneumoniae CWL029
gacggauccuagaa

SEQ ID NO: 508287 - RNA, 21 nt, Chlamydophila pneumoniae CWL029
gacgcgcuucuucaagaaaug

SEQ ID NO: 508288 - RNA, 22 nt, Chlamydophila pneumoniae CWL029
gacgcggaacucucuuccccca

SEQ ID NO: 508289 - RNA, 16 nt, Chlamydophila pneumoniae CWL029
gacgcggaacucucuu

SEQ ID NO: 508290 - RNA, 18 nt, Chlamydophila pneumoniae CWL029
gacgcaagagacaagaaa

SEQ ID NO: 508291 - RNA, 15 nt, Chlamydophila pneumoniae CWL029
gacguaaaaagaaag

SEQ ID NO: 508292 - RNA, 21 nt, Chlamydophila pneumoniae CWL029
gacgagcaugcuaagcaucag

SEQ ID NO: 508293 - RNA, 22 nt, Chlamydophila pneumoniae CWL029
gacgagcccuagauagcaaauc

SEQ ID NO: 508294 - RNA, 12 nt, Chlamydophila pneumoniae CWL029
gacgacaaauca

SEQ ID NO: 508295 - RNA, 20 nt, Chlamydophila pneumoniae CWL029
gaccuucucaagaucuucau

SEQ ID NO: 508296 - RNA, 17 nt, Chlamydophila pneumoniae CWL029
gaccuuccuuaucuuca

SEQ ID NO: 508297 - RNA, 19 nt, Chlamydophila pneumoniae CWL029
gaccucuagcucaaaucuc

SEQ ID NO: 508298 - RNA, 17 nt, Chlamydophila pneumoniae CWL029
gaccuacuuauuguucu

SEQ ID NO: 508299 - RNA, 20 nt, Chlamydophila pneumoniae CWL029
gaccguccuccccauacaua

SEQ ID NO: 508300 - RNA, 20 nt, Chlamydophila pneumoniae CWL029
gaccgcaaggagucacuggc

SEQ ID NO: 508301 - RNA, 17 nt, Chlamydophila pneumoniae CWL029
gaccagaugauuuuuug

SEQ ID NO: 508302 - RNA, 22 nt, Chlamydophila pneumoniae CWL029
gaccagaugcuaaagagucuuc

SEQ ID NO: 508303 - RNA, 16 nt, Chlamydophila pneumoniae CWL029
gaccaaauaauuaaau

SEQ ID NO: 508304 - RNA, 18 nt, Chlamydophila pneumoniae CWL029
gaccaacuccucaaaaga

SEQ ID NO: 508305 - RNA, 20 nt, Chlamydophila pneumoniae CWL029
gaccaacagauaggauggag

SEQ ID NO: 508306 - RNA, 22 nt, Chlamydophila pneumoniae CWL029
gaccacuacuuaaagcuugaga

SEQ ID NO: 508307 - RNA, 22 nt, Chlamydophila pneumoniae CWL029
gacccuagguagcucgagauuu

SEQ ID NO: 508308 - RNA, 18 nt, Chlamydophila pneumoniae CWL029
gacauuauagaggucuuu

SEQ ID NO: 508309 - RNA, 14 nt, Chlamydophila pneumoniae CWL029
gacaucuaauuuua

SEQ ID NO: 508310 - RNA, 15 nt, Chlamydophila pneumoniae CWL029
gacaucuaauuuuaa

SEQ ID NO: 508311 - RNA, 15 nt, Chlamydophila pneumoniae CWL029
gacaucuccaagaua

SEQ ID NO: 508312 - RNA, 17 nt, Chlamydophila pneumoniae CWL029
gacaucuccaagauaau

SEQ ID NO: 508313 - RNA, 19 nt, Chlamydophila pneumoniae CWL029
gacauacucgucaaauuca

SEQ ID NO: 508314 - RNA, 20 nt, Chlamydophila pneumoniae CWL029
gacauauccaaugagagaga

SEQ ID NO: 508315 - RNA, 15 nt, Chlamydophila pneumoniae CWL029
gacagcagcauuuuc

SEQ ID NO: 508316 - RNA, 17 nt, Chlamydophila pneumoniae CWL029
gacagcagcauuuucua

SEQ ID NO: 508317 - RNA, 20 nt, Chlamydophila pneumoniae CWL029
gacagccggagcuucuaaga

SEQ ID NO: 508318 - RNA, 15 nt, Chlamydophila pneumoniae CWL029
gacacuccucagaau

SEQ ID NO: 508319 - RNA, 19 nt, Chlamydophila pneumoniae CWL029
gacacuugcuuaaggaaac

SEQ ID NO: 508320 - RNA, 11 nt, Chlamydophila pneumoniae CWL029
gacacuaugug

SEQ ID NO: 508321 - RNA, 23 nt, Chlamydophila pneumoniae CWL029
gacacuauguguuuccuuuucuc

SEQ ID NO: 508322 - RNA, 17 nt, Chlamydophila pneumoniae CWL029
gacacucagcucccaug

SEQ ID NO: 508323 - RNA, 14 nt, Chlamydophila pneumoniae CWL029
gacacgcuuuccua

SEQ ID NO: 508324 - RNA, 15 nt, Chlamydophila pneumoniae CWL029
gacacgccuccuuca

SEQ ID NO: 508325 - RNA, 23 nt, Chlamydophila pneumoniae CWL029
gacacgccuccuucaaagauaua

SEQ ID NO: 508326 - RNA, 20 nt, Chlamydophila pneumoniae CWL029
gacacgaccacuacuuaaag

SEQ ID NO: 508327 - RNA, 19 nt, Chlamydophila pneumoniae CWL029
gacacgaacuuugaccaga

SEQ ID NO: 508328 - RNA, 18 nt, Chlamydophila pneumoniae CWL029
gaauuuguccuuugcuaa

SEQ ID NO: 508329 - RNA, 20 nt, Chlamydophila pneumoniae CWL029
gaauuugauuuuucaaauuc

SEQ ID NO: 508330 - RNA, 17 nt, Chlamydophila pneumoniae CWL029
gaauuugccugaaaucc

SEQ ID NO: 508331 - RNA, 18 nt, Chlamydophila pneumoniae CWL029
gaauuugccugaaauccu

SEQ ID NO: 508332 - RNA, 21 nt, Chlamydophila pneumoniae CWL029
gaauuucuccaguaucuucuc

SEQ ID NO: 508333 - RNA, 15 nt, Chlamydophila pneumoniae CWL029
gaauucuuugccaag

SEQ ID NO: 508334 - RNA, 15 nt, Chlamydophila pneumoniae CWL029
gaauucuuuuccugc

SEQ ID NO: 508335 - RNA, 10 nt, Chlamydophila pneumoniae CWL029
gaauuccucu

SEQ ID NO: 508336 - RNA, 20 nt, Chlamydophila pneumoniae CWL029
gaauuccucccagcccuaua

SEQ ID NO: 508337 - RNA, 20 nt, Chlamydophila pneumoniae CWL029
gaauucauccagauuagaaa

SEQ ID NO: 508338 - RNA, 23 nt, Chlamydophila pneumoniae CWL029
gaauucaaacuccuuuuaaaauu

SEQ ID NO: 508339 - RNA, 19 nt, Chlamydophila pneumoniae CWL029
gaauggucucgaaauccua

SEQ ID NO: 508340 - RNA, 14 nt, Chlamydophila pneumoniae CWL029
gaauggauguugcg

SEQ ID NO: 508341 - RNA, 20 nt, Chlamydophila pneumoniae CWL029
gacaacagagacaagaccgu

SEQ ID NO: 508342 - RNA, 17 nt, Chlamydophila pneumoniae CWL029
gacaacaagucuucccu

SEQ ID NO: 508343 - RNA, 21 nt, Chlamydophila pneumoniae CWL029
gacaacaaauugaugauuuuu

SEQ ID NO: 508344 - RNA, 18 nt, Chlamydophila pneumoniae CWL029
gacaacaacauaaagaag

SEQ ID NO: 508345 - RNA, 20 nt, Chlamydophila pneumoniae CWL029
gacaaaucacgacgucauca

SEQ ID NO: 508346 - RNA, 19 nt, Chlamydophila pneumoniae CWL029
gaauuuucagccugucuau

SEQ ID NO: 508347 - RNA, 12 nt, Chlamydophila pneumoniae CWL029
gaauuuuccuga

SEQ ID NO: 508348 - RNA, 16 nt, Chlamydophila pneumoniae CWL029
gaauuuucuuuugcag

SEQ ID NO: 508349 - RNA, 14 nt, Chlamydophila pneumoniae CWL029
gacaaauaaguccu

SEQ ID NO: 508350 - RNA, 15 nt, Chlamydophila pneumoniae CWL029
gacaaauagaaagga

SEQ ID NO: 508351 - RNA, 16 nt, Chlamydophila pneumoniae CWL029
gacaauauaagcacca

SEQ ID NO: 508352 - RNA, 22 nt, Chlamydophila pneumoniae CWL029
gacaauauagaaaucgacaggg

SEQ ID NO: 508353 - RNA, 23 nt, Chlamydophila pneumoniae CWL029
gacaagcaaggaaaaaaaaucug

SEQ ID NO: 508354 - RNA, 21 nt, Chlamydophila pneumoniae CWL029
gacacagagaacaauaaacga

SEQ ID NO: 508355 - RNA, 15 nt, Chlamydophila pneumoniae CWL029
gacacagagcuucua

SEQ ID NO: 508356 - RNA, 14 nt, Chlamydophila pneumoniae CWL029
gacaauauagagau

SEQ ID NO: 508357 - RNA, 18 nt, Chlamydophila pneumoniae CWL029
gacaaucaacauucuucu

SEQ ID NO: 508358 - RNA, 17 nt, Chlamydophila pneumoniae CWL029
gaauccgaucauaauua

SEQ ID NO: 508359 - RNA, 22 nt, Chlamydophila pneumoniae CWL029
gaaucacuguaucagcaagccc

SEQ ID NO: 508360 - RNA, 14 nt, Chlamydophila pneumoniae CWL029
gaaucagauuagag

SEQ ID NO: 508361 - RNA, 15 nt, Chlamydophila pneumoniae CWL029
gaaucagauuagagu

SEQ ID NO: 508362 - RNA, 21 nt, Chlamydophila pneumoniae CWL029
gaaucuccucgucugauagag

SEQ ID NO: 508363 - RNA, 15 nt, Chlamydophila pneumoniae CWL029
gaaucuccucaucag

SEQ ID NO: 508364 - RNA, 12 nt, Chlamydophila pneumoniae CWL029
gaaucuaagaug

SEQ ID NO: 508365 - RNA, 18 nt, Chlamydophila pneumoniae CWL029
gaaucucauaaguauaga

SEQ ID NO: 508366 - RNA, 21 nt, Chlamydophila pneumoniae CWL029
gaaucucauaaguauagagag

SEQ ID NO: 508367 - RNA, 19 nt, Chlamydophila pneumoniae CWL029
gaaucuauccauagcgaua

SEQ ID NO: 508368 - RNA, 12 nt, Chlamydophila pneumoniae CWL029
gaaucucuucug

SEQ ID NO: 508369 - RNA, 12 nt, Chlamydophila pneumoniae CWL029
gaauauaauucc

SEQ ID NO: 508370 - RNA, 21 nt, Chlamydophila pneumoniae CWL029
gaauacucuagguuuucucuu

SEQ ID NO: 508371 - RNA, 19 nt, Chlamydophila pneumoniae CWL029
gaauagcuucugacucugu

SEQ ID NO: 508372 - RNA, 12 nt, Chlamydophila pneumoniae CWL029
gaauagcucugg

SEQ ID NO: 508373 - RNA, 15 nt, Chlamydophila pneumoniae CWL029
gaauagcucuuuuca

SEQ ID NO: 508374 - RNA, 19 nt, Chlamydophila pneumoniae CWL029
aaagaucguuagagaccca

SEQ ID NO: 508375 - RNA, 18 nt, Chlamydophila pneumoniae CWL029
aaagaucgugaucaaaga

SEQ ID NO: 508376 - RNA, 17 nt, Chlamydophila pneumoniae CWL029
gaauaucuuuugaaucu

SEQ ID NO: 508377 - RNA, 22 nt, Chlamydophila pneumoniae CWL029
gaauaucgaguucuuuuugcag

SEQ ID NO: 508378 - RNA, 16 nt, Chlamydophila pneumoniae CWL029
gaauauguacugaugu

SEQ ID NO: 508379 - RNA, 16 nt, Chlamydophila pneumoniae CWL029
gaaucacguucccacg

SEQ ID NO: 508380 - RNA, 18 nt, Chlamydophila pneumoniae CWL029
gaaucacguccacaagcu

SEQ ID NO: 508381 - RNA, 15 nt, Chlamydophila pneumoniae CWL029
gaagucagugcuucu

SEQ ID NO: 508382 - RNA, 18 nt, Chlamydophila pneumoniae CWL029
gaagucacaaauuuuugc

SEQ ID NO: 508383 - RNA, 22 nt, Chlamydophila pneumoniae CWL029
gaaguccuagggagugaggaau

SEQ ID NO: 508384 - RNA, 18 nt, Chlamydophila pneumoniae CWL029
gaagugaggagaauagca

SEQ ID NO: 508385 - RNA, 21 nt, Chlamydophila pneumoniae CWL029
gaaguccauguacagaaaaua

SEQ ID NO: 508386 - RNA, 23 nt, Chlamydophila pneumoniae CWL029
gaagugaucuugagaaaagaaca

SEQ ID NO: 508387 - RNA, 21 nt, Chlamydophila pneumoniae CWL029
gaagguguuuuggcugcuuuu

SEQ ID NO: 508388 - RNA, 15 nt, Chlamydophila pneumoniae CWL029
gaagguuuauuagaa

SEQ ID NO: 508389 - RNA, 20 nt, Chlamydophila pneumoniae CWL029
gaagggauguuuaauacaaa

SEQ ID NO: 508390 - RNA, 19 nt, Chlamydophila pneumoniae CWL029
gaagcuccucacaucuccu

SEQ ID NO: 508391 - RNA, 20 nt, Chlamydophila pneumoniae CWL029
gaagcugagaauacaacccu

SEQ ID NO: 508392 - RNA, 21 nt, Chlamydophila pneumoniae CWL029
gaagcuguaaaugaggcuccu

SEQ ID NO: 508393 - RNA, 12 nt, Chlamydophila pneumoniae CWL029
gaagcugcuucu

SEQ ID NO: 508394 - RNA, 16 nt, Chlamydophila pneumoniae CWL029
gaagcugcuucuucag

SEQ ID NO: 508395 - RNA, 15 nt, Chlamydophila pneumoniae CWL029
gaauaauuaaaucgu

SEQ ID NO: 508396 - RNA, 19 nt, Chlamydophila pneumoniae CWL029
gaauaaaggacauagacuu

SEQ ID NO: 508397 - RNA, 17 nt, Chlamydophila pneumoniae CWL029
gaauaacaccaaaagaa

SEQ ID NO: 508398 - RNA, 21 nt, Chlamydophila pneumoniae CWL029
gaaguugaaaugagugagaau

SEQ ID NO: 508399 - RNA, 19 nt, Chlamydophila pneumoniae CWL029
gaaguugaaaugagugaga

SEQ ID NO: 508400 - RNA, 23 nt, Chlamydophila pneumoniae CWL029
gaaguugaaaugagugagaaugc

SEQ ID NO: 508401 - RNA, 15 nt, Chlamydophila pneumoniae CWL029
gaaguuuaaacgucu

SEQ ID NO: 508402 - RNA, 13 nt, Chlamydophila pneumoniae CWL029
gaaguguuucuuu

SEQ ID NO: 508403 - RNA, 16 nt, Chlamydophila pneumoniae CWL029
aaagauaguuauuaau

SEQ ID NO: 508404 - RNA, 22 nt, Chlamydophila pneumoniae CWL029
aaagauaaucuguaagaaaaug

SEQ ID NO: 508405 - RNA, 22 nt, Chlamydophila pneumoniae CWL029
gaagcuauuccacggcggagaa

SEQ ID NO: 508406 - RNA, 22 nt, Chlamydophila pneumoniae CWL029
gaagcucacucuuuaaaaaccc

SEQ ID NO: 508407 - RNA, 16 nt, Chlamydophila pneumoniae CWL029
gaagccuucauuccau

SEQ ID NO: 508408 - RNA, 14 nt, Chlamydophila pneumoniae CWL029
gaagccaccaucug

SEQ ID NO: 508409 - RNA, 13 nt, Chlamydophila pneumoniae CWL029
gaagauucuuuaa

SEQ ID NO: 508410 - RNA, 14 nt, Chlamydophila pneumoniae CWL029
gaagauucaaagaa

SEQ ID NO: 508411 - RNA, 13 nt, Chlamydophila pneumoniae CWL029
gaagaugauugga

SEQ ID NO: 508412 - RNA, 17 nt, Chlamydophila pneumoniae CWL029
gaagauggcaaggaaaa

SEQ ID NO: 508413 - RNA, 15 nt, Chlamydophila pneumoniae CWL029
gaagcaaagaaaauu

SEQ ID NO: 508414 - RNA, 18 nt, Chlamydophila pneumoniae CWL029
gaagagcauuuaaaacgg

SEQ ID NO: 508415 - RNA, 20 nt, Chlamydophila pneumoniae CWL029
gaagagcaauuaagaaacua

SEQ ID NO: 508416 - RNA, 18 nt, Chlamydophila pneumoniae CWL029
gaagacccucgaaccacu

SEQ ID NO: 508417 - RNA, 22 nt, Chlamydophila pneumoniae CWL029
gaagaccccucuugcuuuuccg

SEQ ID NO: 508418 - RNA, 16 nt, Chlamydophila pneumoniae CWL029
gaagaucccugagccu

SEQ ID NO: 508419 - RNA, 16 nt, Chlamydophila pneumoniae CWL029
gaagauccuagagaau

SEQ ID NO: 508420 - RNA, 13 nt, Chlamydophila pneumoniae CWL029
gaagagcuuccau

SEQ ID NO: 508421 - RNA, 13 nt, Chlamydophila pneumoniae CWL029
gaagaggaaugcc

SEQ ID NO: 508422 - RNA, 20 nt, Chlamydophila pneumoniae CWL029
gaagauccugaguauuuugc

SEQ ID NO: 508423 - RNA, 18 nt, Chlamydophila pneumoniae CWL029
gaagaucuugaacagaga

SEQ ID NO: 508424 - RNA, 14 nt, Chlamydophila pneumoniae CWL029
gaagaugauauucu

SEQ ID NO: 508425 - RNA, 16 nt, Chlamydophila pneumoniae CWL029
gaacaucuucccaccc

SEQ ID NO: 508426 - RNA, 23 nt, Chlamydophila pneumoniae CWL029
gaacaugcccccacaaaaccugg

SEQ ID NO: 508427 - RNA, 14 nt, Chlamydophila pneumoniae CWL029
gaagacacagggga

SEQ ID NO: 508428 - RNA, 17 nt, Chlamydophila pneumoniae CWL029
gaagacaggagcuacug

SEQ ID NO: 508429 - RNA, 17 nt, Chlamydophila pneumoniae CWL029
gaagaauuucauaagag

SEQ ID NO: 508430 - RNA, 20 nt, Chlamydophila pneumoniae CWL029
gaagaauuucauaagagaac

SEQ ID NO: 508431 - RNA, 16 nt, Chlamydophila pneumoniae CWL029
gaagaaggacaacuag

SEQ ID NO: 508432 - RNA, 13 nt, Chlamydophila pneumoniae CWL029
ggcuauagauacu

SEQ ID NO: 508433 - RNA, 13 nt, Chlamydophila pneumoniae CWL029
ggcuaaagaaaag

SEQ ID NO: 508434 - RNA, 18 nt, Chlamydophila pneumoniae CWL029
ggcuaaaggaucauuaaa

SEQ ID NO: 508435 - RNA, 12 nt, Chlamydophila pneumoniae CWL029
ggcguuuuugca

SEQ ID NO: 508436 - RNA, 20 nt, Chlamydophila pneumoniae CWL029
aaauacuuaggaauuuuucu

SEQ ID NO: 508437 - RNA, 19 nt, Chlamydophila pneumoniae CWL029
ggcgccuucagcaacuaaa

SEQ ID NO: 508438 - RNA, 12 nt, Chlamydophila pneumoniae CWL029
aaauacagauuc

SEQ ID NO: 508439 - RNA, 16 nt, Chlamydophila pneumoniae CWL029
aaauacagccagcaga

SEQ ID NO: 508440 - RNA, 23 nt, Chlamydophila pneumoniae CWL029
aaauacguccagccugcaccaga

SEQ ID NO: 508441 - RNA, 23 nt, Chlamydophila pneumoniae CWL029
aaauacgugcuugaauauuucca

SEQ ID NO: 508442 - RNA, 17 nt, Chlamydophila pneumoniae CWL029
aaauaaaguccuccaug

SEQ ID NO: 508443 - RNA, 19 nt, Chlamydophila pneumoniae CWL029
ggccuugccaguauugaua

SEQ ID NO: 508444 - RNA, 12 nt, Chlamydophila pneumoniae CWL029
aaauaaaaccac

SEQ ID NO: 508445 - RNA, 16 nt, Chlamydophila pneumoniae CWL029
aaauaaaaucaagcca

SEQ ID NO: 508446 - RNA, 18 nt, Chlamydophila pneumoniae CWL029
ggccuauagcaaagaaca

SEQ ID NO: 508447 - RNA, 13 nt, Chlamydophila pneumoniae CWL029
ggccucuucccaa

SEQ ID NO: 508448 - RNA, 18 nt, Chlamydophila pneumoniae CWL029
aaaguuuguuauaaggau

SEQ ID NO: 508449 - RNA, 22 nt, Chlamydophila pneumoniae CWL029
aaaguuuugaggauuucuugca

SEQ ID NO: 508450 - RNA, 20 nt, Chlamydophila pneumoniae CWL029
aaaguuuguagcauuucuuu

SEQ ID NO: 508451 - RNA, 17 nt, Chlamydophila pneumoniae CWL029
aaaguugaggaaaggag

SEQ ID NO: 508452 - RNA, 18 nt, Chlamydophila pneumoniae CWL029
aaaguugaggaaaggagg

SEQ ID NO: 508453 - RNA, 19 nt, Chlamydophila pneumoniae CWL029
aaaguuucaaucucuccuu

SEQ ID NO: 508454 - RNA, 18 nt, Chlamydophila pneumoniae CWL029
aaaguucagcaaagaagu

SEQ ID NO: 508455 - RNA, 17 nt, Chlamydophila pneumoniae CWL029
aaaguucaguaaaaggu

SEQ ID NO: 508456 - RNA, 14 nt, Chlamydophila pneumoniae CWL029
aaagugugaggaga

SEQ ID NO: 508457 - RNA, 19 nt, Chlamydophila pneumoniae CWL029
aaaguuaaugcaagcaacu

SEQ ID NO: 508458 - RNA, 18 nt, Chlamydophila pneumoniae CWL029
ggcauaaaaaaguccuac

SEQ ID NO: 508459 - RNA, 19 nt, Chlamydophila pneumoniae CWL029
ggcauacaguagaaacaug

SEQ ID NO: 508460 - RNA, 23 nt, Chlamydophila pneumoniae CWL029
ggcauaguggcucaguguauugu

SEQ ID NO: 508461 - RNA, 15 nt, Chlamydophila pneumoniae CWL029
ggcauacucuuugca

SEQ ID NO: 508462 - RNA, 21 nt, Chlamydophila pneumoniae CWL029
ggcagugugggcaaugcuugu

SEQ ID NO: 508463 - RNA, 16 nt, Chlamydophila pneumoniae CWL029
ggcauuucuccacaug

SEQ ID NO: 508464 - RNA, 13 nt, Chlamydophila pneumoniae CWL029
ggccacauuaagc

SEQ ID NO: 508465 - RNA, 15 nt, Chlamydophila pneumoniae CWL029
ggccagcgcauuaac

SEQ ID NO: 508466 - RNA, 17 nt, Chlamydophila pneumoniae CWL029
ggccaucauuaaguacu

SEQ ID NO: 508467 - RNA, 23 nt, Chlamydophila pneumoniae CWL029
ggccaguuacugucugcaaagag

SEQ ID NO: 508468 - RNA, 19 nt, Chlamydophila pneumoniae CWL029
ggcaccaacacuuuuaaag

SEQ ID NO: 508469 - RNA, 15 nt, Chlamydophila pneumoniae CWL029
ggcaaucuaaaauca

SEQ ID NO: 508470 - RNA, 13 nt, Chlamydophila pneumoniae CWL029
ggcaaugauaggg

SEQ ID NO: 508471 - RNA, 17 nt, Chlamydophila pneumoniae CWL029
ggcaaugaucaaaaaug

SEQ ID NO: 508472 - RNA, 20 nt, Chlamydophila pneumoniae CWL029
ggcaauagcuuugaagagca

SEQ ID NO: 508473 - RNA, 16 nt, Chlamydophila pneumoniae CWL029
ggcaauagcagcagcg

SEQ ID NO: 508474 - RNA, 13 nt, Chlamydophila pneumoniae CWL029
ggcaauagcuuug

SEQ ID NO: 508475 - RNA, 20 nt, Chlamydophila pneumoniae CWL029
ggaucgcucucuccaugagc

SEQ ID NO: 508476 - RNA, 20 nt, Chlamydophila pneumoniae CWL029
ggcaacaacgccuacaugga

SEQ ID NO: 508477 - RNA, 15 nt, Chlamydophila pneumoniae CWL029
ggcaacaagagcgca

SEQ ID NO: 508478 - RNA, 17 nt, Chlamydophila pneumoniae CWL029
ggaucacagucuuaaau

SEQ ID NO: 508479 - RNA, 24 nt, Chlamydophila pneumoniae CWL029
ggauaucugagcauaacuugaaga

SEQ ID NO: 508480 - RNA, 18 nt, Chlamydophila pneumoniae CWL029
ggauauacaauccagaau

SEQ ID NO: 508481 - RNA, 13 nt, Chlamydophila pneumoniae CWL029
ggaucccaucauc

SEQ ID NO: 508482 - RNA, 17 nt, Chlamydophila pneumoniae CWL029
ggauccuagaauaggaa

SEQ ID NO: 508483 - RNA, 15 nt, Chlamydophila pneumoniae CWL029
ggaucccguaaaaga

SEQ ID NO: 508484 - RNA, 14 nt, Chlamydophila pneumoniae CWL029
ggagucacuggcau

SEQ ID NO: 508485 - RNA, 20 nt, Chlamydophila pneumoniae CWL029
ggaguccuucuugcaaagau

SEQ ID NO: 508486 - RNA, 18 nt, Chlamydophila pneumoniae CWL029
ggauagcauacgacagua

SEQ ID NO: 508487 - RNA, 17 nt, Chlamydophila pneumoniae CWL029
ggagcuugucuaggagc

SEQ ID NO: 508488 - RNA, 12 nt, Chlamydophila pneumoniae CWL029
ggagcuucuaag

SEQ ID NO: 508489 - RNA, 17 nt, Chlamydophila pneumoniae CWL029
ggagcucuuucuuggau

SEQ ID NO: 508490 - RNA, 16 nt, Chlamydophila pneumoniae CWL029
ggagcuacugaaagau

SEQ ID NO: 508491 - RNA, 11 nt, Chlamydophila pneumoniae CWL029
ggagggaaaca

SEQ ID NO: 508492 - RNA, 13 nt, Chlamydophila pneumoniae CWL029
ggagggaaacacc

SEQ ID NO: 508493 - RNA, 20 nt, Chlamydophila pneumoniae CWL029
ggagacacacuuucuuuaaa

SEQ ID NO: 508494 - RNA, 22 nt, Chlamydophila pneumoniae CWL029
ggagacacacuuucuuuaaaga

SEQ ID NO: 508495 - RNA, 22 nt, Chlamydophila pneumoniae CWL029
ggagaagcuaagggaaauccac

SEQ ID NO: 508496 - RNA, 13 nt, Chlamydophila pneumoniae CWL029
ggagaauugaaaa

SEQ ID NO: 508497 - RNA, 22 nt, Chlamydophila pneumoniae CWL029
ggagauaaagauguagaauaac

SEQ ID NO: 508498 - RNA, 13 nt, Chlamydophila pneumoniae CWL029
ggagauacaagca

SEQ ID NO: 508499 - RNA, 22 nt, Chlamydophila pneumoniae CWL029
ggagaugcuauuuacugaaaca

SEQ ID NO: 508500 - RNA, 13 nt, Chlamydophila pneumoniae CWL029
aaagguuuuaaaa

SEQ ID NO: 508501 - RNA, 14 nt, Chlamydophila pneumoniae CWL029
aaagguuuuaaauu

SEQ ID NO: 508502 - RNA, 14 nt, Chlamydophila pneumoniae CWL029
aaagguuuuauaaa

SEQ ID NO: 508503 - RNA, 16 nt, Chlamydophila pneumoniae CWL029
aaagguuuugaagcuc

SEQ ID NO: 508504 - RNA, 14 nt, Chlamydophila pneumoniae CWL029
aaaguaaaaaauac

SEQ ID NO: 508505 - RNA, 12 nt, Chlamydophila pneumoniae CWL029
aaagguugcuaa

SEQ ID NO: 508506 - RNA, 14 nt, Chlamydophila pneumoniae CWL029
ggacuacugaaaca

SEQ ID NO: 508507 - RNA, 23 nt, Chlamydophila pneumoniae CWL029
ggagaacaauaucagcagcuucu

SEQ ID NO: 508508 - RNA, 18 nt, Chlamydophila pneumoniae CWL029
ggagaagucgaaagauca

SEQ ID NO: 508509 - RNA, 14 nt, Chlamydophila pneumoniae CWL029
ggagaauagcaagc

SEQ ID NO: 508510 - RNA, 21 nt, Chlamydophila pneumoniae CWL029
ggagaacaccucuucucuaua

SEQ ID NO: 508511 - RNA, 23 nt, Chlamydophila pneumoniae CWL029
ggaccuccucacauguuucacuu

SEQ ID NO: 508512 - RNA, 15 nt, Chlamydophila pneumoniae CWL029
ggacgcacauuuaga

SEQ ID NO: 508513 - RNA, 16 nt, Chlamydophila pneumoniae CWL029
ggacuaaacaagaaaa

SEQ ID NO: 508514 - RNA, 14 nt, Chlamydophila pneumoniae CWL029
ggacuaaacaagaa

SEQ ID NO: 508515 - RNA, 20 nt, Chlamydophila pneumoniae CWL029
ggaaucuaagaacuagaaaa

SEQ ID NO: 508516 - RNA, 20 nt, Chlamydophila pneumoniae CWL029
ggaaucucgggagaacaugc

SEQ ID NO: 508517 - RNA, 20 nt, Chlamydophila pneumoniae CWL029
ggaauccccaauguuuuccu

SEQ ID NO: 508518 - RNA, 22 nt, Chlamydophila pneumoniae CWL029
ggaaucccugcacucuuucaga

SEQ ID NO: 508519 - RNA, 17 nt, Chlamydophila pneumoniae CWL029
ggaccacaauuccuaaa

SEQ ID NO: 508520 - RNA, 18 nt, Chlamydophila pneumoniae CWL029
ggaauaggcucuuuagca

SEQ ID NO: 508521 - RNA, 19 nt, Chlamydophila pneumoniae CWL029
ggaagcuguacuugauauu

SEQ ID NO: 508522 - RNA, 21 nt, Chlamydophila pneumoniae CWL029
ggaagcuuaucaagaagcuga

SEQ ID NO: 508523 - RNA, 14 nt, Chlamydophila pneumoniae CWL029
ggaagcaaagaaaa

SEQ ID NO: 508524 - RNA, 21 nt, Chlamydophila pneumoniae CWL029
ggaagaugaauaccagaagca

SEQ ID NO: 508525 - RNA, 17 nt, Chlamydophila pneumoniae CWL029
ggaagaaauuaacaaca

SEQ ID NO: 508526 - RNA, 15 nt, Chlamydophila pneumoniae CWL029
ggaagauaaauccgc

SEQ ID NO: 508527 - RNA, 21 nt, Chlamydophila pneumoniae CWL029
ggaagaauuucauaagagaac

SEQ ID NO: 508528 - RNA, 13 nt, Chlamydophila pneumoniae CWL029
ggaagacucucau

SEQ ID NO: 508529 - RNA, 16 nt, Chlamydophila pneumoniae CWL029
ggaaaguucacaagca

SEQ ID NO: 508530 - RNA, 23 nt, Chlamydophila pneumoniae CWL029
ggaaaguugcaacucucuuuaaa

SEQ ID NO: 508531 - RNA, 17 nt, Chlamydophila pneumoniae CWL029
ggaaagccaagaagaug

SEQ ID NO: 508532 - RNA, 14 nt, Chlamydophila pneumoniae CWL029
ggaaagcacauaca

SEQ ID NO: 508533 - RNA, 15 nt, Chlamydophila pneumoniae CWL029
ggaaagcucuuucau

SEQ ID NO: 508534 - RNA, 23 nt, Chlamydophila pneumoniae CWL029
ggaaauuagguaguggccacaua

SEQ ID NO: 508535 - RNA, 22 nt, Chlamydophila pneumoniae CWL029
ggaaaauucaguauaagaugcu

SEQ ID NO: 508536 - RNA, 22 nt, Chlamydophila pneumoniae CWL029
ggaaacagugguaugcuuuucc

SEQ ID NO: 508537 - RNA, 13 nt, Chlamydophila pneumoniae CWL029
ggaaaauaaucuu

SEQ ID NO: 508538 - RNA, 17 nt, Chlamydophila pneumoniae CWL029
ggaaaauaaucuucaaa

SEQ ID NO: 508539 - RNA, 10 nt, Chlamydophila pneumoniae CWL029
gcuuuuugcu

SEQ ID NO: 508540 - RNA, 22 nt, Chlamydophila pneumoniae CWL029
gcuuuuuuaaaguguguaaaug

SEQ ID NO: 508541 - RNA, 18 nt, Chlamydophila pneumoniae CWL029
gcuuuuuugaaagcugga

SEQ ID NO: 508542 - RNA, 15 nt, Chlamydophila pneumoniae CWL029
gcuuuuuuucuagag

SEQ ID NO: 508543 - RNA, 12 nt, Chlamydophila pneumoniae CWL029
ggaaaaaauaga

SEQ ID NO: 508544 - RNA, 21 nt, Chlamydophila pneumoniae CWL029
gcuuuucucuucaaaagaccg

SEQ ID NO: 508545 - RNA, 13 nt, Chlamydophila pneumoniae CWL029
gcuuuuccuucug

SEQ ID NO: 508546 - RNA, 14 nt, Chlamydophila pneumoniae CWL029
gcuuuucauuuuua

SEQ ID NO: 508547 - RNA, 20 nt, Chlamydophila pneumoniae CWL029
gcuuuucauuuuuaggaucu

SEQ ID NO: 508548 - RNA, 15 nt, Chlamydophila pneumoniae CWL029
gcuuuucuucuuuag

SEQ ID NO: 508549 - RNA, 17 nt, Chlamydophila pneumoniae CWL029
gcuuuugugauaccucc

SEQ ID NO: 508550 - RNA, 18 nt, Chlamydophila pneumoniae CWL029
gcuuuuguuuuguauuua

SEQ ID NO: 508551 - RNA, 15 nt, Chlamydophila pneumoniae CWL029
gcuuucuagcugcuc

SEQ ID NO: 508552 - RNA, 21 nt, Chlamydophila pneumoniae CWL029
gcuuuuaauguguucuuaucg

SEQ ID NO: 508553 - RNA, 15 nt, Chlamydophila pneumoniae CWL029
gcuuugcuuaaaaag

SEQ ID NO: 508554 - RNA, 23 nt, Chlamydophila pneumoniae CWL029
gcuuugggcaucucucuuuaaaa

SEQ ID NO: 508555 - RNA, 17 nt, Chlamydophila pneumoniae CWL029
gcugucuugaccaauac

SEQ ID NO: 508556 - RNA, 20 nt, Chlamydophila pneumoniae CWL029
gcuguacagaacaaugguuu

SEQ ID NO: 508557 - RNA, 23 nt, Chlamydophila pneumoniae CWL029
aaagcuuguuccacuugcucuuu

SEQ ID NO: 508558 - RNA, 15 nt, Chlamydophila pneumoniae CWL029
aaaggaaaauaaucu

SEQ ID NO: 508559 - RNA, 19 nt, Chlamydophila pneumoniae CWL029
aaagcuuuuuucucuugcu

SEQ ID NO: 508560 - RNA, 14 nt, Chlamydophila pneumoniae CWL029
aaaggaaaauaauc

SEQ ID NO: 508561 - RNA, 16 nt, Chlamydophila pneumoniae CWL029
aaagcuuuuuucucuu

SEQ ID NO: 508562 - RNA, 21 nt, Chlamydophila pneumoniae CWL029
aaagcugugguaucgauguaa

SEQ ID NO: 508563 - RNA, 13 nt, Chlamydophila pneumoniae CWL029
gcugcuucagaaa

SEQ ID NO: 508564 - RNA, 21 nt, Chlamydophila pneumoniae CWL029
gcucuuuaauaaggcuuuucu

SEQ ID NO: 508565 - RNA, 21 nt, Chlamydophila pneumoniae CWL029
gcucuuuagcaaacauuuuua

SEQ ID NO: 508566 - RNA, 17 nt, Chlamydophila pneumoniae CWL029
gcucuuuaggauagagg

SEQ ID NO: 508567 - RNA, 19 nt, Chlamydophila pneumoniae CWL029
gcucuucuauguguucucg

SEQ ID NO: 508568 - RNA, 15 nt, Chlamydophila pneumoniae CWL029
gcucuuacuucuggu

SEQ ID NO: 508569 - RNA, 14 nt, Chlamydophila pneumoniae CWL029
gcucuuaauuucug

SEQ ID NO: 508570 - RNA, 12 nt, Chlamydophila pneumoniae CWL029
gcucuggagauu

SEQ ID NO: 508571 - RNA, 15 nt, Chlamydophila pneumoniae CWL029
gcucuggagauugcu

SEQ ID NO: 508572 - RNA, 12 nt, Chlamydophila pneumoniae CWL029
gcucuccauggc

SEQ ID NO: 508573 - RNA, 19 nt, Chlamydophila pneumoniae CWL029
gcucucaaggucacagcau

SEQ ID NO: 508574 - RNA, 15 nt, Chlamydophila pneumoniae CWL029
gcucuaagagcccuu

SEQ ID NO: 508575 - RNA, 18 nt, Chlamydophila pneumoniae CWL029
gcucuaagcugugcauuu

SEQ ID NO: 508576 - RNA, 21 nt, Chlamydophila pneumoniae CWL029
gcucuaaacucucuuccuucu

SEQ ID NO: 508577 - RNA, 20 nt, Chlamydophila pneumoniae CWL029
gcucuaaacucucuuccuuc

SEQ ID NO: 508578 - RNA, 15 nt, Chlamydophila pneumoniae CWL029
gcucguauugauauu

SEQ ID NO: 508579 - RNA, 19 nt, Chlamydophila pneumoniae CWL029
gcucguacuguuccuacag

SEQ ID NO: 508580 - RNA, 16 nt, Chlamydophila pneumoniae CWL029
gcucggaaaucaggga

SEQ ID NO: 508581 - RNA, 17 nt, Chlamydophila pneumoniae CWL029
gcucaguguauuguuug

SEQ ID NO: 508582 - RNA, 18 nt, Chlamydophila pneumoniae CWL029
gcuccagaaacgcagcuu

SEQ ID NO: 508583 - RNA, 21 nt, Chlamydophila pneumoniae CWL029
gcuccagaaacgcagcuuucc

SEQ ID NO: 508584 - RNA, 21 nt, Chlamydophila pneumoniae CWL029
gcucccaugugcugaagacca

SEQ ID NO: 508585 - RNA, 13 nt, Chlamydophila pneumoniae CWL029
gcucaggaaaacu

SEQ ID NO: 508586 - RNA, 22 nt, Chlamydophila pneumoniae CWL029
gcucagcuaauuuaaaugccuu

SEQ ID NO: 508587 - RNA, 19 nt, Chlamydophila pneumoniae CWL029
gcucagaaaauguaaaaaa

SEQ ID NO: 508588 - RNA, 20 nt, Chlamydophila pneumoniae CWL029
gcucaaaucucauuccagca

SEQ ID NO: 508589 - RNA, 13 nt, Chlamydophila pneumoniae CWL029
gcuauuuuuaaaa

SEQ ID NO: 508590 - RNA, 13 nt, Chlamydophila pneumoniae CWL029
gcuaugaugagaa

SEQ ID NO: 508591 - RNA, 23 nt, Chlamydophila pneumoniae CWL029
gcuaugaggaacugggcauagug

SEQ ID NO: 508592 - RNA, 13 nt, Chlamydophila pneumoniae CWL029
gcuaucuccagaa

SEQ ID NO: 508593 - RNA, 16 nt, Chlamydophila pneumoniae CWL029
gcuaugucuguuccca

SEQ ID NO: 508594 - RNA, 15 nt, Chlamydophila pneumoniae CWL029
gcuagaaaaucauac

SEQ ID NO: 508595 - RNA, 14 nt, Chlamydophila pneumoniae CWL029
gcuacuuuaagacc

SEQ ID NO: 508596 - RNA, 12 nt, Chlamydophila pneumoniae CWL029
gcuagaugaaga

SEQ ID NO: 508597 - RNA, 19 nt, Chlamydophila pneumoniae CWL029
gcuagagcacauagaaaca

SEQ ID NO: 508598 - RNA, 14 nt, Chlamydophila pneumoniae CWL029
gcuagucuucuuag

SEQ ID NO: 508599 - RNA, 12 nt, Chlamydophila pneumoniae CWL029
gcuagguagugu

SEQ ID NO: 508600 - RNA, 22 nt, Chlamydophila pneumoniae CWL029
gcuaucaacaucccccgggaag

SEQ ID NO: 508601 - RNA, 18 nt, Chlamydophila pneumoniae CWL029
gcuauagauacuuugcaa

SEQ ID NO: 508602 - RNA, 18 nt, Chlamydophila pneumoniae CWL029
gcuaucccacuaacaaga

SEQ ID NO: 508603 - RNA, 20 nt, Chlamydophila pneumoniae CWL029
gcuaucagcuggguaagucc

SEQ ID NO: 508604 - RNA, 22 nt, Chlamydophila pneumoniae CWL029
gcuaucagcuggguaaguccac

SEQ ID NO: 508605 - RNA, 19 nt, Chlamydophila pneumoniae CWL029
gcuaucaaccauaaagaau

SEQ ID NO: 508606 - RNA, 16 nt, Chlamydophila pneumoniae CWL029
gcuacaaaauuauuaa

SEQ ID NO: 508607 - RNA, 17 nt, Chlamydophila pneumoniae CWL029
gcuacagauucuuguau

SEQ ID NO: 508608 - RNA, 19 nt, Chlamydophila pneumoniae CWL029
gcuaauguugucucauggg

SEQ ID NO: 508609 - RNA, 17 nt, Chlamydophila pneumoniae CWL029
gcuacauaaaaugagcu

SEQ ID NO: 508610 - RNA, 17 nt, Chlamydophila pneumoniae CWL029
gcuacagcuucuuuucc

SEQ ID NO: 508611 - RNA, 22 nt, Chlamydophila pneumoniae CWL029
gcuaccauuaaggaaucccaag

SEQ ID NO: 508612 - RNA, 19 nt, Chlamydophila pneumoniae CWL029
gcuacgugaucaaaauuau

SEQ ID NO: 508613 - RNA, 16 nt, Chlamydophila pneumoniae CWL029
gcuacguacaauuaaa

SEQ ID NO: 508614 - RNA, 14 nt, Chlamydophila pneumoniae CWL029
gcuaaucauuagag

SEQ ID NO: 508615 - RNA, 19 nt, Chlamydophila pneumoniae CWL029
gcuaaucauagccaucaua

SEQ ID NO: 508616 - RNA, 15 nt, Chlamydophila pneumoniae CWL029
gcuaaggauucccgg

SEQ ID NO: 508617 - RNA, 18 nt, Chlamydophila pneumoniae CWL029
gcuaaucaauccaagaau

SEQ ID NO: 508618 - RNA, 17 nt, Chlamydophila pneumoniae CWL029
gcuaagagcaucuuugg

SEQ ID NO: 508619 - RNA, 21 nt, Chlamydophila pneumoniae CWL029
gcuaacgcagcuuuagcuuuu

SEQ ID NO: 508620 - RNA, 22 nt, Chlamydophila pneumoniae CWL029
gcuaacagaaucugguuuaaua

SEQ ID NO: 508621 - RNA, 17 nt, Chlamydophila pneumoniae CWL029
gcuaaaguagaauccuu

SEQ ID NO: 508622 - RNA, 19 nt, Chlamydophila pneumoniae CWL029
gcuaaaguagaauccuucu

SEQ ID NO: 508623 - RNA, 22 nt, Chlamydophila pneumoniae CWL029
gcuaaaguagaauccuucuccc

SEQ ID NO: 508624 - RNA, 17 nt, Chlamydophila pneumoniae CWL029
gcuaaaggaucauuaaa

SEQ ID NO: 508625 - RNA, 22 nt, Chlamydophila pneumoniae CWL029
gcuaaagcaggagcaucauuaa

SEQ ID NO: 508626 - RNA, 18 nt, Chlamydophila pneumoniae CWL029
gcuaaagcaggagcauca

SEQ ID NO: 508627 - RNA, 19 nt, Chlamydophila pneumoniae CWL029
gcuaaacuuuuuuucaaau

SEQ ID NO: 508628 - RNA, 13 nt, Chlamydophila pneumoniae CWL029
gcguuucuuucug

SEQ ID NO: 508629 - RNA, 22 nt, Chlamydophila pneumoniae CWL029
gcguuuuuuuugauuucagaag

SEQ ID NO: 508630 - RNA, 18 nt, Chlamydophila pneumoniae CWL029
gcguucuugaaucuucaa

SEQ ID NO: 508631 - RNA, 17 nt, Chlamydophila pneumoniae CWL029
gcgucaugcauagaaua

SEQ ID NO: 508632 - RNA, 19 nt, Chlamydophila pneumoniae CWL029
gcgucaauaagcuugccag

SEQ ID NO: 508633 - RNA, 22 nt, Chlamydophila pneumoniae CWL029
gcgucaauaagcuugccagcag

SEQ ID NO: 508634 - RNA, 17 nt, Chlamydophila pneumoniae CWL029
gcgucguaaucuuuuuu

SEQ ID NO: 508635 - RNA, 19 nt, Chlamydophila pneumoniae CWL029
gcgucuccuugauuuggga

SEQ ID NO: 508636 - RNA, 17 nt, Chlamydophila pneumoniae CWL029
gcgucugcccuuucugc

SEQ ID NO: 508637 - RNA, 13 nt, Chlamydophila pneumoniae CWL029
gcgugccuuuuuu

SEQ ID NO: 508638 - RNA, 16 nt, Chlamydophila pneumoniae CWL029
gcgguuuuggauagaa

SEQ ID NO: 508639 - RNA, 17 nt, Chlamydophila pneumoniae CWL029
gcggucucauguaacug

SEQ ID NO: 508640 - RNA, 23 nt, Chlamydophila pneumoniae CWL029
gcgguggaaaaggaggaggagca

SEQ ID NO: 508641 - RNA, 21 nt, Chlamydophila pneumoniae CWL029
gcgguagcgucuagcuagugu

SEQ ID NO: 508642 - RNA, 15 nt, Chlamydophila pneumoniae CWL029
gcggaucuucuucug

SEQ ID NO: 508643 - RNA, 20 nt, Chlamydophila pneumoniae CWL029
gcggagaauaucaucuuccu

SEQ ID NO: 508644 - RNA, 21 nt, Chlamydophila pneumoniae CWL029
gcggagaauaucaucuuccuc

SEQ ID NO: 508645 - RNA, 15 nt, Chlamydophila pneumoniae CWL029
gcggacuuuagcgcu

SEQ ID NO: 508646 - RNA, 15 nt, Chlamydophila pneumoniae CWL029
gcgcuauguuguucc

SEQ ID NO: 508647 - RNA, 21 nt, Chlamydophila pneumoniae CWL029
gcgcuaccuuaguuuuuucua

SEQ ID NO: 508648 - RNA, 14 nt, Chlamydophila pneumoniae CWL029
gcgcuagcuccagc

SEQ ID NO: 508649 - RNA, 13 nt, Chlamydophila pneumoniae CWL029
gccuuuagggaaa

SEQ ID NO: 508650 - RNA, 13 nt, Chlamydophila pneumoniae CWL029
gccuuuauauaaa

SEQ ID NO: 508651 - RNA, 13 nt, Chlamydophila pneumoniae CWL029
gccuugcugcaua

SEQ ID NO: 508652 - RNA, 17 nt, Chlamydophila pneumoniae CWL029
gccuuccauaucuagaa

SEQ ID NO: 508653 - RNA, 12 nt, Chlamydophila pneumoniae CWL029
gccuucauucca

SEQ ID NO: 508654 - RNA, 20 nt, Chlamydophila pneumoniae CWL029
gccuguaauugauguuccuu

SEQ ID NO: 508655 - RNA, 15 nt, Chlamydophila pneumoniae CWL029
gccugugauaguaga

SEQ ID NO: 508656 - RNA, 13 nt, Chlamydophila pneumoniae CWL029
gccugaaauccug

SEQ ID NO: 508657 - RNA, 18 nt, Chlamydophila pneumoniae CWL029
gccugagaccauaaaauc

SEQ ID NO: 508658 - RNA, 22 nt, Chlamydophila pneumoniae CWL029
gccugacgauaguacuuauccu

SEQ ID NO: 508659 - RNA, 15 nt, Chlamydophila pneumoniae CWL029
gccugcacgucugca

SEQ ID NO: 508660 - RNA, 21 nt, Chlamydophila pneumoniae CWL029
gccugccaauccaauggcuga

SEQ ID NO: 508661 - RNA, 18 nt, Chlamydophila pneumoniae CWL029
gcgaauccagaauuuucu

SEQ ID NO: 508662 - RNA, 16 nt, Chlamydophila pneumoniae CWL029
gcgacaugagaaaucu

SEQ ID NO: 508663 - RNA, 14 nt, Chlamydophila pneumoniae CWL029
gcgaccugcaaaug

SEQ ID NO: 508664 - RNA, 15 nt, Chlamydophila pneumoniae CWL029
gcgaccuaggagaaa

SEQ ID NO: 508665 - RNA, 20 nt, Chlamydophila pneumoniae CWL029
gcgacuugccaaucuuccuu

SEQ ID NO: 508666 - RNA, 17 nt, Chlamydophila pneumoniae CWL029
gcgauacaauaaacaac

SEQ ID NO: 508667 - RNA, 16 nt, Chlamydophila pneumoniae CWL029
gcgaguaccucaucuc

SEQ ID NO: 508668 - RNA, 20 nt, Chlamydophila pneumoniae CWL029
gccuaaagcuccgagaaaca

SEQ ID NO: 508669 - RNA, 22 nt, Chlamydophila pneumoniae CWL029
gccuaaagcuccgagaaacaac

SEQ ID NO: 508670 - RNA, 21 nt, Chlamydophila pneumoniae CWL029
gccgugccuauagaaauuaga

SEQ ID NO: 508671 - RNA, 20 nt, Chlamydophila pneumoniae CWL029
aaagcuagucuucuuagaaa

SEQ ID NO: 508672 - RNA, 18 nt, Chlamydophila pneumoniae CWL029
aaagcugcuuuuucuacu

SEQ ID NO: 508673 - RNA, 14 nt, Chlamydophila pneumoniae CWL029
aaagcuauuucucu

SEQ ID NO: 508674 - RNA, 21 nt, Chlamydophila pneumoniae CWL029
aaagcguuucgauaauuuuca

SEQ ID NO: 508675 - RNA, 23 nt, Chlamydophila pneumoniae CWL029
gcccucgguuauuuuuccagaaa

SEQ ID NO: 508676 - RNA, 12 nt, Chlamydophila pneumoniae CWL029
gcccucuucacu

SEQ ID NO: 508677 - RNA, 14 nt, Chlamydophila pneumoniae CWL029
gcccuguucuaugc

SEQ ID NO: 508678 - RNA, 15 nt, Chlamydophila pneumoniae CWL029
gcccuacgaauccaa

SEQ ID NO: 508679 - RNA, 21 nt, Chlamydophila pneumoniae CWL029
gcccuauaguauaauagugag

SEQ ID NO: 508680 - RNA, 23 nt, Chlamydophila pneumoniae CWL029
gcccgaaucuuucaaaagaaauc

SEQ ID NO: 508681 - RNA, 18 nt, Chlamydophila pneumoniae CWL029
gccccuggaauuucucca

SEQ ID NO: 508682 - RNA, 15 nt, Chlamydophila pneumoniae CWL029
gcccaaggaaaaaca

SEQ ID NO: 508683 - RNA, 23 nt, Chlamydophila pneumoniae CWL029
gcccaaguuguagugaaugagcu

SEQ ID NO: 508684 - RNA, 17 nt, Chlamydophila pneumoniae CWL029
gccaugucuaaaggagu

SEQ ID NO: 508685 - RNA, 20 nt, Chlamydophila pneumoniae CWL029
gccauuccauggauauggaa

SEQ ID NO: 508686 - RNA, 15 nt, Chlamydophila pneumoniae CWL029
gccauuuucuaagag

SEQ ID NO: 508687 - RNA, 16 nt, Chlamydophila pneumoniae CWL029
gccauuuucuaagaga

SEQ ID NO: 508688 - RNA, 13 nt, Chlamydophila pneumoniae CWL029
gccauaauaaagg

SEQ ID NO: 508689 - RNA, 18 nt, Chlamydophila pneumoniae CWL029
gccauaaauacaggccug

SEQ ID NO: 508690 - RNA, 18 nt, Chlamydophila pneumoniae CWL029
gccaguucuugaaacucu

SEQ ID NO: 508691 - RNA, 22 nt, Chlamydophila pneumoniae CWL029
gccaguuacugucugcaaagag

SEQ ID NO: 508692 - RNA, 16 nt, Chlamydophila pneumoniae CWL029
gccacccccacuucuu

SEQ ID NO: 508693 - RNA, 19 nt, Chlamydophila pneumoniae CWL029
gccacccccacuucuuuuu

SEQ ID NO: 508694 - RNA, 18 nt, Chlamydophila pneumoniae CWL029
gccacccuuggcagagcc

SEQ ID NO: 508695 - RNA, 17 nt, Chlamydophila pneumoniae CWL029
gccaaucuuccuuaacc

SEQ ID NO: 508696 - RNA, 12 nt, Chlamydophila pneumoniae CWL029
gccaaggucuuc

SEQ ID NO: 508697 - RNA, 19 nt, Chlamydophila pneumoniae CWL029
gccaagggcuuggcuccug

SEQ ID NO: 508698 - RNA, 22 nt, Chlamydophila pneumoniae CWL029
gccaaaaguuuugaggauuucu

SEQ ID NO: 508699 - RNA, 19 nt, Chlamydophila pneumoniae CWL029
gccaaaccaugaggcugcu

SEQ ID NO: 508700 - RNA, 15 nt, Chlamydophila pneumoniae CWL029
gccaagaagauguag

SEQ ID NO: 508701 - RNA, 13 nt, Chlamydophila pneumoniae CWL029
gccaagaaauaua

SEQ ID NO: 508702 - RNA, 20 nt, Chlamydophila pneumoniae CWL029
gccaagauacuacuuacaag

SEQ ID NO: 508703 - RNA, 12 nt, Chlamydophila pneumoniae CWL029
gccaacucucua

SEQ ID NO: 508704 - RNA, 15 nt, Chlamydophila pneumoniae CWL029
gcauugggaaggauc

SEQ ID NO: 508705 - RNA, 16 nt, Chlamydophila pneumoniae CWL029
gcauucuguaauuuug

SEQ ID NO: 508706 - RNA, 22 nt, Chlamydophila pneumoniae CWL029
gcauugaauccuucuauagcaa

SEQ ID NO: 508707 - RNA, 21 nt, Chlamydophila pneumoniae CWL029
gcauuguuuguccuaggagag

SEQ ID NO: 508708 - RNA, 13 nt, Chlamydophila pneumoniae CWL029
gcauuuaaaacgg

SEQ ID NO: 508709 - RNA, 16 nt, Chlamydophila pneumoniae CWL029
gcauuuaaacuaagaa

SEQ ID NO: 508710 - RNA, 22 nt, Chlamydophila pneumoniae CWL029
gcauuuaaacuaagaauaccua

SEQ ID NO: 508711 - RNA, 16 nt, Chlamydophila pneumoniae CWL029
gcauuaucuaagaaua

SEQ ID NO: 508712 - RNA, 13 nt, Chlamydophila pneumoniae CWL029
gcauuaacgucau

SEQ ID NO: 508713 - RNA, 21 nt, Chlamydophila pneumoniae CWL029
gcaugacgcuuuuccaaagca

SEQ ID NO: 508714 - RNA, 15 nt, Chlamydophila pneumoniae CWL029
gcaugaaucucuucu

SEQ ID NO: 508715 - RNA, 23 nt, Chlamydophila pneumoniae CWL029
gcauggcguaaugcuccacggaa

SEQ ID NO: 508716 - RNA, 23 nt, Chlamydophila pneumoniae CWL029
gcaugccuacaggcaaggagagc

SEQ ID NO: 508717 - RNA, 21 nt, Chlamydophila pneumoniae CWL029
gcaucccccgcgccacaucaa

SEQ ID NO: 508718 - RNA, 19 nt, Chlamydophila pneumoniae CWL029
gcaucccuucuucuuuuag

SEQ ID NO: 508719 - RNA, 16 nt, Chlamydophila pneumoniae CWL029
gcaucgccuuaagcuc

SEQ ID NO: 508720 - RNA, 16 nt, Chlamydophila pneumoniae CWL029
gcauaggcuaagacua

SEQ ID NO: 508721 - RNA, 22 nt, Chlamydophila pneumoniae CWL029
gcauaguggcucaguguauugu

SEQ ID NO: 508722 - RNA, 14 nt, Chlamydophila pneumoniae CWL029
gcauauaaagacuc

SEQ ID NO: 508723 - RNA, 23 nt, Chlamydophila pneumoniae CWL029
gcauauaaagacucucuuccaaa

SEQ ID NO: 508724 - RNA, 15 nt, Chlamydophila pneumoniae CWL029
gcaucagaaucguuc

SEQ ID NO: 508725 - RNA, 17 nt, Chlamydophila pneumoniae CWL029
gcaucacgaaaaggaga

SEQ ID NO: 508726 - RNA, 18 nt, Chlamydophila pneumoniae CWL029
gcauacccuucuucuuca

SEQ ID NO: 508727 - RNA, 19 nt, Chlamydophila pneumoniae CWL029
gcaguaauuccaaaauaaa

SEQ ID NO: 508728 - RNA, 13 nt, Chlamydophila pneumoniae CWL029
gcauaauuuuucu

SEQ ID NO: 508729 - RNA, 18 nt, Chlamydophila pneumoniae CWL029
gcagggaauccuguaaca

SEQ ID NO: 508730 - RNA, 14 nt, Chlamydophila pneumoniae CWL029
gcagggaaaaugcg

SEQ ID NO: 508731 - RNA, 14 nt, Chlamydophila pneumoniae CWL029
gcaggccaggagac

SEQ ID NO: 508732 - RNA, 15 nt, Chlamydophila pneumoniae CWL029
gcaggccaggagacu

SEQ ID NO: 508733 - RNA, 14 nt, Chlamydophila pneumoniae CWL029
gcaggccaacucuc

SEQ ID NO: 508734 - RNA, 22 nt, Chlamydophila pneumoniae CWL029
gcagcgugaauaucaucacuaa

SEQ ID NO: 508735 - RNA, 21 nt, Chlamydophila pneumoniae CWL029
gcagcauaaguuagccuggcu

SEQ ID NO: 508736 - RNA, 14 nt, Chlamydophila pneumoniae CWL029
gcagccacagcccu

SEQ ID NO: 508737 - RNA, 17 nt, Chlamydophila pneumoniae CWL029
gcagcacucuuuuucua

SEQ ID NO: 508738 - RNA, 16 nt, Chlamydophila pneumoniae CWL029
gcagcaaauacuccag

SEQ ID NO: 508739 - RNA, 23 nt, Chlamydophila pneumoniae CWL029
gcagcaaauccuuuauguauaac

SEQ ID NO: 508740 - RNA, 21 nt, Chlamydophila pneumoniae CWL029
gcagaucauaucggcagcagc

SEQ ID NO: 508741 - RNA, 19 nt, Chlamydophila pneumoniae CWL029
gcagagccgucuacuuuug

SEQ ID NO: 508742 - RNA, 18 nt, Chlamydophila pneumoniae CWL029
gcagaguccuucuuuucc

SEQ ID NO: 508743 - RNA, 22 nt, Chlamydophila pneumoniae CWL029
gcagaguuuuucccucgcuaaa

SEQ ID NO: 508744 - RNA, 14 nt, Chlamydophila pneumoniae CWL029
gcagaguccuucuu

SEQ ID NO: 508745 - RNA, 23 nt, Chlamydophila pneumoniae CWL029
gcagagucucaguugagaaccuu

SEQ ID NO: 508746 - RNA, 20 nt, Chlamydophila pneumoniae CWL029
gcagagaaauuaacagagcg

SEQ ID NO: 508747 - RNA, 21 nt, Chlamydophila pneumoniae CWL029
gcagacggggaucuaaagcau

SEQ ID NO: 508748 - RNA, 17 nt, Chlamydophila pneumoniae CWL029
gcagaaacuuuaaaagc

SEQ ID NO: 508749 - RNA, 19 nt, Chlamydophila pneumoniae CWL029
gcagaagguuccacagaga

SEQ ID NO: 508750 - RNA, 17 nt, Chlamydophila pneumoniae CWL029
gcagaaguaaccgccug

SEQ ID NO: 508751 - RNA, 17 nt, Chlamydophila pneumoniae CWL029
gcagaaguccuaucaaa

SEQ ID NO: 508752 - RNA, 12 nt, Chlamydophila pneumoniae CWL029
gcagaaguuccu

SEQ ID NO: 508753 - RNA, 15 nt, Chlamydophila pneumoniae CWL029
gcagaaguuccuuca

SEQ ID NO: 508754 - RNA, 20 nt, Chlamydophila pneumoniae CWL029
gcacuuaucucuuucuugaa

SEQ ID NO: 508755 - RNA, 22 nt, Chlamydophila pneumoniae CWL029
gcacuggcauggaaugccaaau

SEQ ID NO: 508756 - RNA, 14 nt, Chlamydophila pneumoniae CWL029
gcacuuguuuuuuc

SEQ ID NO: 508757 - RNA, 23 nt, Chlamydophila pneumoniae CWL029
gcacuuucuuuuuuaaucuagaa

SEQ ID NO: 508758 - RNA, 22 nt, Chlamydophila pneumoniae CWL029
gcacugacuuuaugaucucccg

SEQ ID NO: 508759 - RNA, 17 nt, Chlamydophila pneumoniae CWL029
gcacucucugcagggaa

SEQ ID NO: 508760 - RNA, 15 nt, Chlamydophila pneumoniae CWL029
gcacuaaaagggaag

SEQ ID NO: 508761 - RNA, 17 nt, Chlamydophila pneumoniae CWL029
gcaccuuuaggaagcug

SEQ ID NO: 508762 - RNA, 18 nt, Chlamydophila pneumoniae CWL029
gcaccuuuaggaagcugu

SEQ ID NO: 508763 - RNA, 15 nt, Chlamydophila pneumoniae CWL029
gcacgcuuucgucua

SEQ ID NO: 508764 - RNA, 23 nt, Chlamydophila pneumoniae CWL029
gcaccaacacuuuuaaagauaag

SEQ ID NO: 508765 - RNA, 13 nt, Chlamydophila pneumoniae CWL029
gcaccauaauaua

SEQ ID NO: 508766 - RNA, 17 nt, Chlamydophila pneumoniae CWL029
gcaccauaauggauacc

SEQ ID NO: 508767 - RNA, 23 nt, Chlamydophila pneumoniae CWL029
gcacccaaacugaugccaagaaa

SEQ ID NO: 508768 - RNA, 17 nt, Chlamydophila pneumoniae CWL029
gcaccaaagaugcgcuc

SEQ ID NO: 508769 - RNA, 21 nt, Chlamydophila pneumoniae CWL029
gcacaagaaccuguuuuucua

SEQ ID NO: 508770 - RNA, 12 nt, Chlamydophila pneumoniae CWL029
gcacaaaauaaa

SEQ ID NO: 508771 - RNA, 16 nt, Chlamydophila pneumoniae CWL029
gcacaaaauaaaaccc

SEQ ID NO: 508772 - RNA, 18 nt, Chlamydophila pneumoniae CWL029
gcaauuucuccuaggucu

SEQ ID NO: 508773 - RNA, 19 nt, Chlamydophila pneumoniae CWL029
gcaauuucuccuaggucua

SEQ ID NO: 508774 - RNA, 16 nt, Chlamydophila pneumoniae CWL029
gcaauuguuaaaagaa

SEQ ID NO: 508775 - RNA, 18 nt, Chlamydophila pneumoniae CWL029
gcaauuguuaaaagaagg

SEQ ID NO: 508776 - RNA, 20 nt, Chlamydophila pneumoniae CWL029
gcaauucgguagagcuagaa

SEQ ID NO: 508777 - RNA, 16 nt, Chlamydophila pneumoniae CWL029
gcaauuccgaagaaga

SEQ ID NO: 508778 - RNA, 16 nt, Chlamydophila pneumoniae CWL029
gcaaugcuucuucagc

SEQ ID NO: 508779 - RNA, 21 nt, Chlamydophila pneumoniae CWL029
gcaaugauagauaaaucccca

SEQ ID NO: 508780 - RNA, 18 nt, Chlamydophila pneumoniae CWL029
gcaaucuuugaagcucga

SEQ ID NO: 508781 - RNA, 22 nt, Chlamydophila pneumoniae CWL029
gcaaucuuugaucgcuugugca

SEQ ID NO: 508782 - RNA, 23 nt, Chlamydophila pneumoniae CWL029
gcaaucguguuuuccugagcuuu

SEQ ID NO: 508783 - RNA, 16 nt, Chlamydophila pneumoniae CWL029
gcaaucugaaugccug

SEQ ID NO: 508784 - RNA, 23 nt, Chlamydophila pneumoniae CWL029
gcaaucugcagguaagggaugcu

SEQ ID NO: 508785 - RNA, 23 nt, Chlamydophila pneumoniae CWL029
gcaauccauaguccuagcagaga

SEQ ID NO: 508786 - RNA, 23 nt, Chlamydophila pneumoniae CWL029
gcaauauuuugacguaaugcaga

SEQ ID NO: 508787 - RNA, 15 nt, Chlamydophila pneumoniae CWL029
gcaauaucuauagaa

SEQ ID NO: 508788 - RNA, 21 nt, Chlamydophila pneumoniae CWL029
gcaauaggacucgaugaaacu

SEQ ID NO: 508789 - RNA, 19 nt, Chlamydophila pneumoniae CWL029
gcaauagacacuugcuuaa

SEQ ID NO: 508790 - RNA, 22 nt, Chlamydophila pneumoniae CWL029
gcaaguaaucaugauaaaaauu

SEQ ID NO: 508791 - RNA, 13 nt, Chlamydophila pneumoniae CWL029
gcaaguaaagaaa

SEQ ID NO: 508792 - RNA, 18 nt, Chlamydophila pneumoniae CWL029
gcaaguaaucaugauaaa

SEQ ID NO: 508793 - RNA, 22 nt, Chlamydophila pneumoniae CWL029
gcaaguuguugauaauuacaga

SEQ ID NO: 508794 - RNA, 21 nt, Chlamydophila pneumoniae CWL029
gcaagguaacauccauagaga

SEQ ID NO: 508795 - RNA, 10 nt, Chlamydophila pneumoniae CWL029
gcaaggaaaa

SEQ ID NO: 508796 - RNA, 11 nt, Chlamydophila pneumoniae CWL029
gcaaggaaaaa

SEQ ID NO: 508797 - RNA, 19 nt, Chlamydophila pneumoniae CWL029
gcaagcuucuuguuuuugu

SEQ ID NO: 508798 - RNA, 19 nt, Chlamydophila pneumoniae CWL029
gcaagcuguggcgauuuua

SEQ ID NO: 508799 - RNA, 14 nt, Chlamydophila pneumoniae CWL029
gcaaggagcucccu

SEQ ID NO: 508800 - RNA, 13 nt, Chlamydophila pneumoniae CWL029
gcaaggagcuuuu

SEQ ID NO: 508801 - RNA, 23 nt, Chlamydophila pneumoniae CWL029
gcaagcccuccaguuuuacgaac

SEQ ID NO: 508802 - RNA, 17 nt, Chlamydophila pneumoniae CWL029
gcaagcgcuagugcaag

SEQ ID NO: 508803 - RNA, 18 nt, Chlamydophila pneumoniae CWL029
gcaagaucuaacuucacc

SEQ ID NO: 508804 - RNA, 18 nt, Chlamydophila pneumoniae CWL029
gcaagcacuuguuuuuuc

SEQ ID NO: 508805 - RNA, 18 nt, Chlamydophila pneumoniae CWL029
gcaacucuuuaggucuug

SEQ ID NO: 508806 - RNA, 13 nt, Chlamydophila pneumoniae CWL029
gcaacucuucagc

SEQ ID NO: 508807 - RNA, 16 nt, Chlamydophila pneumoniae CWL029
gcaacucuuuaggucu

SEQ ID NO: 508808 - RNA, 16 nt, Chlamydophila pneumoniae CWL029
gcaacuaaacucucca

SEQ ID NO: 508809 - RNA, 21 nt, Chlamydophila pneumoniae CWL029
aaagcgcaaaucuuacauaaa

SEQ ID NO: 508810 - RNA, 21 nt, Chlamydophila pneumoniae CWL029
gcaaccuguaaagaccaaaua

SEQ ID NO: 508811 - RNA, 13 nt, Chlamydophila pneumoniae CWL029
gaucacagggaca

SEQ ID NO: 508812 - RNA, 16 nt, Chlamydophila pneumoniae CWL029
gaucacauagaaaaca

SEQ ID NO: 508813 - RNA, 17 nt, Chlamydophila pneumoniae CWL029
guaaauauuuuaccauu

SEQ ID NO: 508814 - RNA, 21 nt, Chlamydophila pneumoniae CWL029
guaaauauuuuaccauugaga

SEQ ID NO: 508815 - RNA, 12 nt, Chlamydophila pneumoniae CWL029
guaaauaucuua

SEQ ID NO: 508816 - RNA, 21 nt, Chlamydophila pneumoniae CWL029
guaaauacaaaacaaaagcca

SEQ ID NO: 508817 - RNA, 17 nt, Chlamydophila pneumoniae CWL029
guaaauaguauacaagc

SEQ ID NO: 508818 - RNA, 16 nt, Chlamydophila pneumoniae CWL029
guaaaugaggcuccuc

SEQ ID NO: 508819 - RNA, 21 nt, Chlamydophila pneumoniae CWL029
guaaaugccucuuucauacua

SEQ ID NO: 508820 - RNA, 17 nt, Chlamydophila pneumoniae CWL029
guaaauguuuugcgaua

SEQ ID NO: 508821 - RNA, 17 nt, Chlamydophila pneumoniae CWL029
guaaccacagugauuua

SEQ ID NO: 508822 - RNA, 19 nt, Chlamydophila pneumoniae CWL029
guaaccaauacagcauaaa

SEQ ID NO: 508823 - RNA, 19 nt, Chlamydophila pneumoniae CWL029
guaacauugaccuaaagga

SEQ ID NO: 508824 - RNA, 20 nt, Chlamydophila pneumoniae CWL029
guaacauugaccuaaaggaa

SEQ ID NO: 508825 - RNA, 12 nt, Chlamydophila pneumoniae CWL029
guaaagaaucac

SEQ ID NO: 508826 - RNA, 12 nt, Chlamydophila pneumoniae CWL029
guaaagaaaagc

SEQ ID NO: 508827 - RNA, 17 nt, Chlamydophila pneumoniae CWL029
guaaagguuguaaggac

SEQ ID NO: 508828 - RNA, 19 nt, Chlamydophila pneumoniae CWL029
guaaagguuguaaggacga

SEQ ID NO: 508829 - RNA, 18 nt, Chlamydophila pneumoniae CWL029
guaaaguaggcacaucau

SEQ ID NO: 508830 - RNA, 14 nt, Chlamydophila pneumoniae CWL029
guaaagagcuucuu

SEQ ID NO: 508831 - RNA, 19 nt, Chlamydophila pneumoniae CWL029
guaaagcauuggacaacgc

SEQ ID NO: 508832 - RNA, 11 nt, Chlamydophila pneumoniae CWL029
guaaacaacaa

SEQ ID NO: 508833 - RNA, 17 nt, Chlamydophila pneumoniae CWL029
guaaacagcaaaguaau

SEQ ID NO: 508834 - RNA, 12 nt, Chlamydophila pneumoniae CWL029
guaagggaugcu

SEQ ID NO: 508835 - RNA, 22 nt, Chlamydophila pneumoniae CWL029
guaaguaaccaauacagcauaa

SEQ ID NO: 508836 - RNA, 22 nt, Chlamydophila pneumoniae CWL029
guaaguacacauugucucuuuu

SEQ ID NO: 508837 - RNA, 18 nt, Chlamydophila pneumoniae CWL029
guaagcugcaaucucaaa

SEQ ID NO: 508838 - RNA, 17 nt, Chlamydophila pneumoniae CWL029
guaaggcgaaaucuuca

SEQ ID NO: 508839 - RNA, 19 nt, Chlamydophila pneumoniae CWL029
guaauagcaggaguuuuca

SEQ ID NO: 508840 - RNA, 17 nt, Chlamydophila pneumoniae CWL029
guaagaauccuugcuaa

SEQ ID NO: 508841 - RNA, 15 nt, Chlamydophila pneumoniae CWL029
guaagacuaaaaaag

SEQ ID NO: 508842 - RNA, 16 nt, Chlamydophila pneumoniae CWL029
guaagacuaaaaaaga

SEQ ID NO: 508843 - RNA, 20 nt, Chlamydophila pneumoniae CWL029
guaagacuaaaaaagagacc

SEQ ID NO: 508844 - RNA, 12 nt, Chlamydophila pneumoniae CWL029
guaacuaauaau

SEQ ID NO: 508845 - RNA, 14 nt, Chlamydophila pneumoniae CWL029
guaaccugaaagcg

SEQ ID NO: 508846 - RNA, 13 nt, Chlamydophila pneumoniae CWL029
guaaccagagagc

SEQ ID NO: 508847 - RNA, 18 nt, Chlamydophila pneumoniae CWL029
guacaauuugcuccucca

SEQ ID NO: 508848 - RNA, 17 nt, Chlamydophila pneumoniae CWL029
guacaagcuucaucaaa

SEQ ID NO: 508849 - RNA, 19 nt, Chlamydophila pneumoniae CWL029
guacaagcuucaucaaaac

SEQ ID NO: 508850 - RNA, 14 nt, Chlamydophila pneumoniae CWL029
guaaugccagcagc

SEQ ID NO: 508851 - RNA, 15 nt, Chlamydophila pneumoniae CWL029
guaaugcuuagccau

SEQ ID NO: 508852 - RNA, 19 nt, Chlamydophila pneumoniae CWL029
guaaugcuuagccauggca

SEQ ID NO: 508853 - RNA, 14 nt, Chlamydophila pneumoniae CWL029
guaaucuguauaug

SEQ ID NO: 508854 - RNA, 19 nt, Chlamydophila pneumoniae CWL029
guaaucuuuuuuaaagcua

SEQ ID NO: 508855 - RNA, 12 nt, Chlamydophila pneumoniae CWL029
aaauagaagcca

SEQ ID NO: 508856 - RNA, 15 nt, Chlamydophila pneumoniae CWL029
aaauagaaggccagu

SEQ ID NO: 508857 - RNA, 15 nt, Chlamydophila pneumoniae CWL029
aaauagagaaacuuu

SEQ ID NO: 508858 - RNA, 24 nt, Chlamydophila pneumoniae CWL029
aaauagauaagucgaaucuaaaaa

SEQ ID NO: 508859 - RNA, 22 nt, Chlamydophila pneumoniae CWL029
guaauccuaauuccuucaaagc

SEQ ID NO: 508860 - RNA, 19 nt, Chlamydophila pneumoniae CWL029
guaauccuucuuucugcuc

SEQ ID NO: 508861 - RNA, 23 nt, Chlamydophila pneumoniae CWL029
guacaguugcgcgcccucuucua

SEQ ID NO: 508862 - RNA, 16 nt, Chlamydophila pneumoniae CWL029
guacaguuuuuuucua

SEQ ID NO: 508863 - RNA, 15 nt, Chlamydophila pneumoniae CWL029
guacauagaggagau

SEQ ID NO: 508864 - RNA, 13 nt, Chlamydophila pneumoniae CWL029
guaccaagaaaau

SEQ ID NO: 508865 - RNA, 16 nt, Chlamydophila pneumoniae CWL029
guaccacauacucuuc

SEQ ID NO: 508866 - RNA, 17 nt, Chlamydophila pneumoniae CWL029
guaccacauacucuuca

SEQ ID NO: 508867 - RNA, 21 nt, Chlamydophila pneumoniae CWL029
guaccuucucgucauucugca

SEQ ID NO: 508868 - RNA, 18 nt, Chlamydophila pneumoniae CWL029
guacgcaaguaaagaaau

SEQ ID NO: 508869 - RNA, 19 nt, Chlamydophila pneumoniae CWL029
guacgcaaguaaagaaauu

SEQ ID NO: 508870 - RNA, 14 nt, Chlamydophila pneumoniae CWL029
guacggcuaaauaa

SEQ ID NO: 508871 - RNA, 20 nt, Chlamydophila pneumoniae CWL029
guaccguaaagaaaagcaau

SEQ ID NO: 508872 - RNA, 23 nt, Chlamydophila pneumoniae CWL029
guaccguagcguacguuuucucu

SEQ ID NO: 508873 - RNA, 12 nt, Chlamydophila pneumoniae CWL029
guaaaaauauag

SEQ ID NO: 508874 - RNA, 16 nt, Chlamydophila pneumoniae CWL029
guaaaaagccuaugau

SEQ ID NO: 508875 - RNA, 11 nt, Chlamydophila pneumoniae CWL029
guaaaacacaa

SEQ ID NO: 508876 - RNA, 15 nt, Chlamydophila pneumoniae CWL029
guaaaacacaaauag

SEQ ID NO: 508877 - RNA, 13 nt, Chlamydophila pneumoniae CWL029
gguuuuuccaacu

SEQ ID NO: 508878 - RNA, 18 nt, Chlamydophila pneumoniae CWL029
guaaaaaauacaggaauc

SEQ ID NO: 508879 - RNA, 15 nt, Chlamydophila pneumoniae CWL029
gguuuucuccuucuc

SEQ ID NO: 508880 - RNA, 22 nt, Chlamydophila pneumoniae CWL029
gguuguacuuuuacugaaauua

SEQ ID NO: 508881 - RNA, 18 nt, Chlamydophila pneumoniae CWL029
gguuggcagcaaauccuu

SEQ ID NO: 508882 - RNA, 21 nt, Chlamydophila pneumoniae CWL029
gguucugaaauugucuucagu

SEQ ID NO: 508883 - RNA, 13 nt, Chlamydophila pneumoniae CWL029
gguucuuucuaga

SEQ ID NO: 508884 - RNA, 23 nt, Chlamydophila pneumoniae CWL029
gguuaaaacccauguuucuuccu

SEQ ID NO: 508885 - RNA, 13 nt, Chlamydophila pneumoniae CWL029
gguuaaaauagac

SEQ ID NO: 508886 - RNA, 13 nt, Chlamydophila pneumoniae CWL029
gguuauagauacg

SEQ ID NO: 508887 - RNA, 12 nt, Chlamydophila pneumoniae CWL029
gguuaucuuuuu

SEQ ID NO: 508888 - RNA, 20 nt, Chlamydophila pneumoniae CWL029
gguuccucuuccuuuuugca

SEQ ID NO: 508889 - RNA, 19 nt, Chlamydophila pneumoniae CWL029
gguuccuggauuuaggaug

SEQ ID NO: 508890 - RNA, 22 nt, Chlamydophila pneumoniae CWL029
gguucuccacaugcccaaacau

SEQ ID NO: 508891 - RNA, 16 nt, Chlamydophila pneumoniae CWL029
gguggaacuauccugu

SEQ ID NO: 508892 - RNA, 17 nt, Chlamydophila pneumoniae CWL029
ggugccuaggcuaagag

SEQ ID NO: 508893 - RNA, 12 nt, Chlamydophila pneumoniae CWL029
ggugcuauuuua

SEQ ID NO: 508894 - RNA, 14 nt, Chlamydophila pneumoniae CWL029
ggugcaucauuuuc

SEQ ID NO: 508895 - RNA, 18 nt, Chlamydophila pneumoniae CWL029
ggugagaucgaaaaauac

SEQ ID NO: 508896 - RNA, 21 nt, Chlamydophila pneumoniae CWL029
gucuaaagauuggaauauaau

SEQ ID NO: 508897 - RNA, 13 nt, Chlamydophila pneumoniae CWL029
gucuaaagaagau

SEQ ID NO: 508898 - RNA, 18 nt, Chlamydophila pneumoniae CWL029
gucuaagaaucguucuua

SEQ ID NO: 508899 - RNA, 21 nt, Chlamydophila pneumoniae CWL029
gucuacagaggaaucuauccu

SEQ ID NO: 508900 - RNA, 22 nt, Chlamydophila pneumoniae CWL029
gucuacagaggaaucuauccuu

SEQ ID NO: 508901 - RNA, 16 nt, Chlamydophila pneumoniae CWL029
gucggagauuguuuca

SEQ ID NO: 508902 - RNA, 13 nt, Chlamydophila pneumoniae CWL029
gucggaguuuuuu

SEQ ID NO: 508903 - RNA, 14 nt, Chlamydophila pneumoniae CWL029
gucgagaaccucca

SEQ ID NO: 508904 - RNA, 17 nt, Chlamydophila pneumoniae CWL029
gucgcaguaaugccaau

SEQ ID NO: 508905 - RNA, 17 nt, Chlamydophila pneumoniae CWL029
gucgcauaguggucaau

SEQ ID NO: 508906 - RNA, 15 nt, Chlamydophila pneumoniae CWL029
guccucuaugguuuu

SEQ ID NO: 508907 - RNA, 15 nt, Chlamydophila pneumoniae CWL029
guccuguuaagaugu

SEQ ID NO: 508908 - RNA, 13 nt, Chlamydophila pneumoniae CWL029
guccuuauuucaa

SEQ ID NO: 508909 - RNA, 14 nt, Chlamydophila pneumoniae CWL029
gucgaaagaucaga

SEQ ID NO: 508910 - RNA, 17 nt, Chlamydophila pneumoniae CWL029
guccgucaggaacccug

SEQ ID NO: 508911 - RNA, 13 nt, Chlamydophila pneumoniae CWL029
gucccuuucagua

SEQ ID NO: 508912 - RNA, 12 nt, Chlamydophila pneumoniae CWL029
gucccaaucaag

SEQ ID NO: 508913 - RNA, 15 nt, Chlamydophila pneumoniae CWL029
gucccacaaaugaua

SEQ ID NO: 508914 - RNA, 17 nt, Chlamydophila pneumoniae CWL029
gucauacuacucucauc

SEQ ID NO: 508915 - RNA, 16 nt, Chlamydophila pneumoniae CWL029
gucauuaccugcuaaa

SEQ ID NO: 508916 - RNA, 17 nt, Chlamydophila pneumoniae CWL029
gucaugcauagaauaaa

SEQ ID NO: 508917 - RNA, 13 nt, Chlamydophila pneumoniae CWL029
gucaguaaaacac

SEQ ID NO: 508918 - RNA, 18 nt, Chlamydophila pneumoniae CWL029
gucaggaacccuggauga

SEQ ID NO: 508919 - RNA, 15 nt, Chlamydophila pneumoniae CWL029
gucaggagguggugg

SEQ ID NO: 508920 - RNA, 16 nt, Chlamydophila pneumoniae CWL029
gucaggagguggugga

SEQ ID NO: 508921 - RNA, 14 nt, Chlamydophila pneumoniae CWL029
gucacaaugaucuu

SEQ ID NO: 508922 - RNA, 19 nt, Chlamydophila pneumoniae CWL029
gucaccuuaauggcuccua

SEQ ID NO: 508923 - RNA, 19 nt, Chlamydophila pneumoniae CWL029
gucacuguuuuccagaaau

SEQ ID NO: 508924 - RNA, 11 nt, Chlamydophila pneumoniae CWL029
gucacuucaau

SEQ ID NO: 508925 - RNA, 21 nt, Chlamydophila pneumoniae CWL029
guauggauuucuccagcagcu

SEQ ID NO: 508926 - RNA, 19 nt, Chlamydophila pneumoniae CWL029
guauggaauucaaacuccu

SEQ ID NO: 508927 - RNA, 19 nt, Chlamydophila pneumoniae CWL029
guaugagcuccaaaauaau

SEQ ID NO: 508928 - RNA, 16 nt, Chlamydophila pneumoniae CWL029
guaugaucaagaggag

SEQ ID NO: 508929 - RNA, 15 nt, Chlamydophila pneumoniae CWL029
guauuccuuggauuu

SEQ ID NO: 508930 - RNA, 14 nt, Chlamydophila pneumoniae CWL029
guauucugaagcug

SEQ ID NO: 508931 - RNA, 22 nt, Chlamydophila pneumoniae CWL029
guauugcaaauacguccuguga

SEQ ID NO: 508932 - RNA, 19 nt, Chlamydophila pneumoniae CWL029
guauucaacacggacacua

SEQ ID NO: 508933 - RNA, 14 nt, Chlamydophila pneumoniae CWL029
guauuuaaauucug

SEQ ID NO: 508934 - RNA, 21 nt, Chlamydophila pneumoniae CWL029
gucaaacuuauacacuccaau

SEQ ID NO: 508935 - RNA, 16 nt, Chlamydophila pneumoniae CWL029
guauuuugcaaaugaa

SEQ ID NO: 508936 - RNA, 13 nt, Chlamydophila pneumoniae CWL029
guauuuucuucaa

SEQ ID NO: 508937 - RNA, 20 nt, Chlamydophila pneumoniae CWL029
guaucagcaagcccuccagu

SEQ ID NO: 508938 - RNA, 16 nt, Chlamydophila pneumoniae CWL029
guaucuguauccuucc

SEQ ID NO: 508939 - RNA, 15 nt, Chlamydophila pneumoniae CWL029
guaucucuuaaaaua

SEQ ID NO: 508940 - RNA, 12 nt, Chlamydophila pneumoniae CWL029
guaucuucagua

SEQ ID NO: 508941 - RNA, 17 nt, Chlamydophila pneumoniae CWL029
guaucuagcuuugucuc

SEQ ID NO: 508942 - RNA, 23 nt, Chlamydophila pneumoniae CWL029
guauccuucuacaaugauauaaa

SEQ ID NO: 508943 - RNA, 23 nt, Chlamydophila pneumoniae CWL029
guaucgacuuuuuuaagaguguc

SEQ ID NO: 508944 - RNA, 15 nt, Chlamydophila pneumoniae CWL029
guauacauaucuccu

SEQ ID NO: 508945 - RNA, 15 nt, Chlamydophila pneumoniae CWL029
guauacaucccauuc

SEQ ID NO: 508946 - RNA, 22 nt, Chlamydophila pneumoniae CWL029
guauaacaucuaaaaaugcacu

SEQ ID NO: 508947 - RNA, 13 nt, Chlamydophila pneumoniae CWL029
guaguucuugcca

SEQ ID NO: 508948 - RNA, 17 nt, Chlamydophila pneumoniae CWL029
guaguuucuaaaacaga

SEQ ID NO: 508949 - RNA, 17 nt, Chlamydophila pneumoniae CWL029
guaguuugccuucuuau

SEQ ID NO: 508950 - RNA, 22 nt, Chlamydophila pneumoniae CWL029
guauaaaguuuguaaaaacugu

SEQ ID NO: 508951 - RNA, 17 nt, Chlamydophila pneumoniae CWL029
guauagcuggcaaugau

SEQ ID NO: 508952 - RNA, 18 nt, Chlamydophila pneumoniae CWL029
guauagcuggcaaugaua

SEQ ID NO: 508953 - RNA, 21 nt, Chlamydophila pneumoniae CWL029
guauagacuccuuaacaaccg

SEQ ID NO: 508954 - RNA, 15 nt, Chlamydophila pneumoniae CWL029
guauagagaagauuu

SEQ ID NO: 508955 - RNA, 19 nt, Chlamydophila pneumoniae CWL029
guauagagcgguucuuucu

SEQ ID NO: 508956 - RNA, 14 nt, Chlamydophila pneumoniae CWL029
guauagauuuuccg

SEQ ID NO: 508957 - RNA, 16 nt, Chlamydophila pneumoniae CWL029
guauacgguaaugcca

SEQ ID NO: 508958 - RNA, 15 nt, Chlamydophila pneumoniae CWL029
guauacuaagacugu

SEQ ID NO: 508959 - RNA, 13 nt, Chlamydophila pneumoniae CWL029
guauagaaacacc

SEQ ID NO: 508960 - RNA, 13 nt, Chlamydophila pneumoniae CWL029
guauaguauuuuu

SEQ ID NO: 508961 - RNA, 14 nt, Chlamydophila pneumoniae CWL029
guauaguauuuuua

SEQ ID NO: 508962 - RNA, 21 nt, Chlamydophila pneumoniae CWL029
guauauaaaagaggaagauga

SEQ ID NO: 508963 - RNA, 23 nt, Chlamydophila pneumoniae CWL029
guauauaagauaauagagaagaa

SEQ ID NO: 508964 - RNA, 21 nt, Chlamydophila pneumoniae CWL029
guauaucagcaaaaaacugca

SEQ ID NO: 508965 - RNA, 21 nt, Chlamydophila pneumoniae CWL029
guauauccacgaucuagaaga

SEQ ID NO: 508966 - RNA, 18 nt, Chlamydophila pneumoniae CWL029
guauauucugaaauuucu

SEQ ID NO: 508967 - RNA, 16 nt, Chlamydophila pneumoniae CWL029
guaguaggcacuuauc

SEQ ID NO: 508968 - RNA, 22 nt, Chlamydophila pneumoniae CWL029
guagucaugauuuuucaaucaa

SEQ ID NO: 508969 - RNA, 17 nt, Chlamydophila pneumoniae CWL029
guaguggugaacuaaau

SEQ ID NO: 508970 - RNA, 16 nt, Chlamydophila pneumoniae CWL029
guagugcuaucauaac

SEQ ID NO: 508971 - RNA, 14 nt, Chlamydophila pneumoniae CWL029
guagguuuuuccaa

SEQ ID NO: 508972 - RNA, 22 nt, Chlamydophila pneumoniae CWL029
guagcuacaaaauuauuaaacu

SEQ ID NO: 508973 - RNA, 22 nt, Chlamydophila pneumoniae CWL029
guagcuacggagagguuaugua

SEQ ID NO: 508974 - RNA, 19 nt, Chlamydophila pneumoniae CWL029
guagcgucucuucuuccuc

SEQ ID NO: 508975 - RNA, 21 nt, Chlamydophila pneumoniae CWL029
guagcucaauuggcagagcau

SEQ ID NO: 508976 - RNA, 15 nt, Chlamydophila pneumoniae CWL029
guagcuauucucaaa

SEQ ID NO: 508977 - RNA, 17 nt, Chlamydophila pneumoniae CWL029
guagcuauuuuugagga

SEQ ID NO: 508978 - RNA, 18 nt, Chlamydophila pneumoniae CWL029
guagcucaggaaaacuua

SEQ ID NO: 508979 - RNA, 18 nt, Chlamydophila pneumoniae CWL029
guaggaugugaaggauca

SEQ ID NO: 508980 - RNA, 19 nt, Chlamydophila pneumoniae CWL029
guaggaacaugccaaauau

SEQ ID NO: 508981 - RNA, 23 nt, Chlamydophila pneumoniae CWL029
guagccgaggcgauuuucaugga

SEQ ID NO: 508982 - RNA, 21 nt, Chlamydophila pneumoniae CWL029
guagccguaggguagccaucc

SEQ ID NO: 508983 - RNA, 19 nt, Chlamydophila pneumoniae CWL029
guagcgcuuccagcuucuc

SEQ ID NO: 508984 - RNA, 12 nt, Chlamydophila pneumoniae CWL029
guagauccauga

SEQ ID NO: 508985 - RNA, 19 nt, Chlamydophila pneumoniae CWL029
guagaucuucugaaaucaa

SEQ ID NO: 508986 - RNA, 20 nt, Chlamydophila pneumoniae CWL029
guagaucuucugaaaucaaa

SEQ ID NO: 508987 - RNA, 16 nt, Chlamydophila pneumoniae CWL029
guagcagagccucacu

SEQ ID NO: 508988 - RNA, 18 nt, Chlamydophila pneumoniae CWL029
guagcauuucuuucucuu

SEQ ID NO: 508989 - RNA, 15 nt, Chlamydophila pneumoniae CWL029
guagccccagcaacc

SEQ ID NO: 508990 - RNA, 20 nt, Chlamydophila pneumoniae CWL029
guagauagaaauucuguaga

SEQ ID NO: 508991 - RNA, 14 nt, Chlamydophila pneumoniae CWL029
guagaguccacagu

SEQ ID NO: 508992 - RNA, 16 nt, Chlamydophila pneumoniae CWL029
guagagcaagauucuu

SEQ ID NO: 508993 - RNA, 14 nt, Chlamydophila pneumoniae CWL029
guagagaauguucc

SEQ ID NO: 508994 - RNA, 17 nt, Chlamydophila pneumoniae CWL029
guagaggacgugcuccc

SEQ ID NO: 508995 - RNA, 19 nt, Chlamydophila pneumoniae CWL029
guagagccucuaagaaaau

SEQ ID NO: 508996 - RNA, 18 nt, Chlamydophila pneumoniae CWL029
guagacaacaagucuucc

SEQ ID NO: 508997 - RNA, 20 nt, Chlamydophila pneumoniae CWL029
guagacaacaagucuucccu

SEQ ID NO: 508998 - RNA, 19 nt, Chlamydophila pneumoniae CWL029
guagacaauaccagauaaa

SEQ ID NO: 508999 - RNA, 20 nt, Chlamydophila pneumoniae CWL029
guacuaucgguuuaaacaga

SEQ ID NO: 509000 - RNA, 21 nt, Chlamydophila pneumoniae CWL029
guacuuaagcacugaugaaaa

SEQ ID NO: 509001 - RNA, 19 nt, Chlamydophila pneumoniae CWL029
guacuuccccaaacaugga

SEQ ID NO: 509002 - RNA, 21 nt, Chlamydophila pneumoniae CWL029
guacuucccucaugaagaauu

SEQ ID NO: 509003 - RNA, 17 nt, Chlamydophila pneumoniae CWL029
guagaacuucucaagaa

SEQ ID NO: 509004 - RNA, 19 nt, Chlamydophila pneumoniae CWL029
guagaaggggguucuaaga

SEQ ID NO: 509005 - RNA, 22 nt, Chlamydophila pneumoniae CWL029
guagaauccuucucccucuaaa

SEQ ID NO: 509006 - RNA, 18 nt, Chlamydophila pneumoniae CWL029
guagaauccuucucccuc

SEQ ID NO: 509007 - RNA, 19 nt, Chlamydophila pneumoniae CWL029
guagaauccuucucccucu

SEQ ID NO: 509008 - RNA, 18 nt, Chlamydophila pneumoniae CWL029
uaaaauaucggauuuuac

SEQ ID NO: 509009 - RNA, 20 nt, Chlamydophila pneumoniae CWL029
uaaaaucaagccacagagaa

SEQ ID NO: 509010 - RNA, 19 nt, Chlamydophila pneumoniae CWL029
uaaaauggugaagaauaau

SEQ ID NO: 509011 - RNA, 22 nt, Chlamydophila pneumoniae CWL029
uaaaaugauuuggccaacagug

SEQ ID NO: 509012 - RNA, 18 nt, Chlamydophila pneumoniae CWL029
uaaaaucuccucucucaa

SEQ ID NO: 509013 - RNA, 10 nt, Chlamydophila pneumoniae CWL029
uaaaaucuuc

SEQ ID NO: 509014 - RNA, 13 nt, Chlamydophila pneumoniae CWL029
uaaaaucuucauc

SEQ ID NO: 509015 - RNA, 13 nt, Chlamydophila pneumoniae CWL029
uaaaauagcccua

SEQ ID NO: 509016 - RNA, 13 nt, Chlamydophila pneumoniae CWL029
uaaaauagacauu

SEQ ID NO: 509017 - RNA, 15 nt, Chlamydophila pneumoniae CWL029
uaaaauagcccuaga

SEQ ID NO: 509018 - RNA, 22 nt, Chlamydophila pneumoniae CWL029
uaaaauaaccccuccaaaauca

SEQ ID NO: 509019 - RNA, 14 nt, Chlamydophila pneumoniae CWL029
uaaaauaagaaauc

SEQ ID NO: 509020 - RNA, 17 nt, Chlamydophila pneumoniae CWL029
uaaaaguagcauccugu

SEQ ID NO: 509021 - RNA, 23 nt, Chlamydophila pneumoniae CWL029
uaaaaguuagguagauagaaauu

SEQ ID NO: 509022 - RNA, 15 nt, Chlamydophila pneumoniae CWL029
uaaaaguucagcaaa

SEQ ID NO: 509023 - RNA, 16 nt, Chlamydophila pneumoniae CWL029
uaaaaguuuuuuauuu

SEQ ID NO: 509024 - RNA, 19 nt, Chlamydophila pneumoniae CWL029
uaaaagguauuucucucca

SEQ ID NO: 509025 - RNA, 16 nt, Chlamydophila pneumoniae CWL029
uaaaaguacgaccaac

SEQ ID NO: 509026 - RNA, 22 nt, Chlamydophila pneumoniae CWL029
uaaaaauggcacuugagcacau

SEQ ID NO: 509027 - RNA, 23 nt, Chlamydophila pneumoniae CWL029
uaaaaauggcacuugagcacauu

SEQ ID NO: 509028 - RNA, 19 nt, Chlamydophila pneumoniae CWL029
uaaaaauuaaagugaaagc

SEQ ID NO: 509029 - RNA, 18 nt, Chlamydophila pneumoniae CWL029
uaaaaauaggagaagccc

SEQ ID NO: 509030 - RNA, 19 nt, Chlamydophila pneumoniae CWL029
uaaaacacaaauagcaaga

SEQ ID NO: 509031 - RNA, 20 nt, Chlamydophila pneumoniae CWL029
uaaaacacaaauagcaagag

SEQ ID NO: 509032 - RNA, 21 nt, Chlamydophila pneumoniae CWL029
uaaaacaagaagaucaaagau

SEQ ID NO: 509033 - RNA, 13 nt, Chlamydophila pneumoniae CWL029
uaaaacagaaauu

SEQ ID NO: 509034 - RNA, 16 nt, Chlamydophila pneumoniae CWL029
uaaaacaauuuccugc

SEQ ID NO: 509035 - RNA, 23 nt, Chlamydophila pneumoniae CWL029
uaaaaccacagaaugauaagaaa

SEQ ID NO: 509036 - RNA, 20 nt, Chlamydophila pneumoniae CWL029
uaaaacaucagcaacauaaa

SEQ ID NO: 509037 - RNA, 18 nt, Chlamydophila pneumoniae CWL029
uaaaagcacuuaaaaaac

SEQ ID NO: 509038 - RNA, 23 nt, Chlamydophila pneumoniae CWL029
uaaaagcauuuuugggaaaagaa

SEQ ID NO: 509039 - RNA, 13 nt, Chlamydophila pneumoniae CWL029
uaaaagacugaaa

SEQ ID NO: 509040 - RNA, 12 nt, Chlamydophila pneumoniae CWL029
uaaaagaaagaa

SEQ ID NO: 509041 - RNA, 21 nt, Chlamydophila pneumoniae CWL029
uaaaagaacauuaagaggaaa

SEQ ID NO: 509042 - RNA, 24 nt, Chlamydophila pneumoniae CWL029
uaaaagaaagaaugacacagagaa

SEQ ID NO: 509043 - RNA, 23 nt, Chlamydophila pneumoniae CWL029
uaaaacuucaguuguugcuuucu

SEQ ID NO: 509044 - RNA, 17 nt, Chlamydophila pneumoniae CWL029
uaaaacuacaggaaaac

SEQ ID NO: 509045 - RNA, 13 nt, Chlamydophila pneumoniae CWL029
uaaaacuccacgc

SEQ ID NO: 509046 - RNA, 21 nt, Chlamydophila pneumoniae CWL029
uaaaacuccacgccaaaguac

SEQ ID NO: 509047 - RNA, 20 nt, Chlamydophila pneumoniae CWL029
uaaaacgagcaggguaauuu

SEQ ID NO: 509048 - RNA, 13 nt, Chlamydophila pneumoniae CWL029
uaaaaccuagacu

SEQ ID NO: 509049 - RNA, 21 nt, Chlamydophila pneumoniae CWL029
aaaucauguccuucaaaaugu

SEQ ID NO: 509050 - RNA, 20 nt, Chlamydophila pneumoniae CWL029
aaaucaucgcaaucaaagag

SEQ ID NO: 509051 - RNA, 22 nt, Chlamydophila pneumoniae CWL029
guuuuauccaccaagacugaau

SEQ ID NO: 509052 - RNA, 21 nt, Chlamydophila pneumoniae CWL029
guuuuaucuuuagagucugca

SEQ ID NO: 509053 - RNA, 15 nt, Chlamydophila pneumoniae CWL029
guuuuguuucaucuu

SEQ ID NO: 509054 - RNA, 21 nt, Chlamydophila pneumoniae CWL029
guuuucuguugcacuuuccgu

SEQ ID NO: 509055 - RNA, 12 nt, Chlamydophila pneumoniae CWL029
guuuucuuaucc

SEQ ID NO: 509056 - RNA, 21 nt, Chlamydophila pneumoniae CWL029
guuuucggggucggagauugu

SEQ ID NO: 509057 - RNA, 15 nt, Chlamydophila pneumoniae CWL029
guuuucuaugauccg

SEQ ID NO: 509058 - RNA, 15 nt, Chlamydophila pneumoniae CWL029
guuugaucuucucua

SEQ ID NO: 509059 - RNA, 22 nt, Chlamydophila pneumoniae CWL029
guuucuuuugauugaaacuuuu

SEQ ID NO: 509060 - RNA, 21 nt, Chlamydophila pneumoniae CWL029
guuucuucugugcaucaguca

SEQ ID NO: 509061 - RNA, 16 nt, Chlamydophila pneumoniae CWL029
guuuuaauuguagaga

SEQ ID NO: 509062 - RNA, 21 nt, Chlamydophila pneumoniae CWL029
guuuuaauagcuaaagugaug

SEQ ID NO: 509063 - RNA, 18 nt, Chlamydophila pneumoniae CWL029
guuuuucuccucuuucuu

SEQ ID NO: 509064 - RNA, 20 nt, Chlamydophila pneumoniae CWL029
guuuuucgaaucguuuuugg

SEQ ID NO: 509065 - RNA, 20 nt, Chlamydophila pneumoniae CWL029
guuuuuacauguaaacaaaa

SEQ ID NO: 509066 - RNA, 14 nt, Chlamydophila pneumoniae CWL029
guuuuuucaauccu

SEQ ID NO: 509067 - RNA, 23 nt, Chlamydophila pneumoniae CWL029
uaaaaaagggaugaagauaaaau

SEQ ID NO: 509068 - RNA, 11 nt, Chlamydophila pneumoniae CWL029
uaaaaaagaga

SEQ ID NO: 509069 - RNA, 16 nt, Chlamydophila pneumoniae CWL029
uaaaaaaacccucaaa

SEQ ID NO: 509070 - RNA, 18 nt, Chlamydophila pneumoniae CWL029
uaaaaacccuaguucauu

SEQ ID NO: 509071 - RNA, 15 nt, Chlamydophila pneumoniae CWL029
uaaaaaauuaucucc

SEQ ID NO: 509072 - RNA, 16 nt, Chlamydophila pneumoniae CWL029
uaaaaaauuaucucca

SEQ ID NO: 509073 - RNA, 21 nt, Chlamydophila pneumoniae CWL029
uaaaaaauuaucuccaaagau

SEQ ID NO: 509074 - RNA, 15 nt, Chlamydophila pneumoniae CWL029
uaaaaacuucccauc

SEQ ID NO: 509075 - RNA, 19 nt, Chlamydophila pneumoniae CWL029
uaaaaacuucccaucuugu

SEQ ID NO: 509076 - RNA, 18 nt, Chlamydophila pneumoniae CWL029
uaaaaauagaaauaagca

SEQ ID NO: 509077 - RNA, 21 nt, Chlamydophila pneumoniae CWL029
uaaaaauaccaagaugucucc

SEQ ID NO: 509078 - RNA, 13 nt, Chlamydophila pneumoniae CWL029
uaaccucuuuucu

SEQ ID NO: 509079 - RNA, 16 nt, Chlamydophila pneumoniae CWL029
uaaccuccucaagaau

SEQ ID NO: 509080 - RNA, 19 nt, Chlamydophila pneumoniae CWL029
uaacgaauugcuuuccccc

SEQ ID NO: 509081 - RNA, 19 nt, Chlamydophila pneumoniae CWL029
uaacgaagugaggagaaua

SEQ ID NO: 509082 - RNA, 21 nt, Chlamydophila pneumoniae CWL029
uaaccuuugacaacaccacag

SEQ ID NO: 509083 - RNA, 17 nt, Chlamydophila pneumoniae CWL029
uaaccaacaucaaagaa

SEQ ID NO: 509084 - RNA, 16 nt, Chlamydophila pneumoniae CWL029
uaaccaaguuauuaua

SEQ ID NO: 509085 - RNA, 14 nt, Chlamydophila pneumoniae CWL029
uaaccaauaaacuu

SEQ ID NO: 509086 - RNA, 20 nt, Chlamydophila pneumoniae CWL029
uaaccaaaagaauuaagaag

SEQ ID NO: 509087 - RNA, 23 nt, Chlamydophila pneumoniae CWL029
uaaccaaaagaauuaagaagaag

SEQ ID NO: 509088 - RNA, 19 nt, Chlamydophila pneumoniae CWL029
uaacauuucguuuuuucuu

SEQ ID NO: 509089 - RNA, 13 nt, Chlamydophila pneumoniae CWL029
uaacaucaagaau

SEQ ID NO: 509090 - RNA, 14 nt, Chlamydophila pneumoniae CWL029
uaacaucaagaauu

SEQ ID NO: 509091 - RNA, 17 nt, Chlamydophila pneumoniae CWL029
uaaaucuauacccaguu

SEQ ID NO: 509092 - RNA, 21 nt, Chlamydophila pneumoniae CWL029
uaaaucuauacccaguuguau

SEQ ID NO: 509093 - RNA, 14 nt, Chlamydophila pneumoniae CWL029
uaaaucuauaucca

SEQ ID NO: 509094 - RNA, 22 nt, Chlamydophila pneumoniae CWL029
uaaaucaaaauuuuuaguaauu

SEQ ID NO: 509095 - RNA, 20 nt, Chlamydophila pneumoniae CWL029
uaaaucaacuacaucuccaa

SEQ ID NO: 509096 - RNA, 16 nt, Chlamydophila pneumoniae CWL029
uaaaugccucuuucau

SEQ ID NO: 509097 - RNA, 16 nt, Chlamydophila pneumoniae CWL029
uaaaugacgcacacga

SEQ ID NO: 509098 - RNA, 23 nt, Chlamydophila pneumoniae CWL029
uaaauuguauggaauucaaacuc

SEQ ID NO: 509099 - RNA, 14 nt, Chlamydophila pneumoniae CWL029
uaaauuuaagucac

SEQ ID NO: 509100 - RNA, 20 nt, Chlamydophila pneumoniae CWL029
uaacaaccgccuuuauauaa

SEQ ID NO: 509101 - RNA, 14 nt, Chlamydophila pneumoniae CWL029
uaacaaaguuuaug

SEQ ID NO: 509102 - RNA, 16 nt, Chlamydophila pneumoniae CWL029
uaaauuucauuugaaa

SEQ ID NO: 509103 - RNA, 12 nt, Chlamydophila pneumoniae CWL029
uaaauuugucau

SEQ ID NO: 509104 - RNA, 16 nt, Chlamydophila pneumoniae CWL029
uaaauuugucaucaca

SEQ ID NO: 509105 - RNA, 14 nt, Chlamydophila pneumoniae CWL029
uaaauauuuuacca

SEQ ID NO: 509106 - RNA, 14 nt, Chlamydophila pneumoniae CWL029
uaaauagcucaguu

SEQ ID NO: 509107 - RNA, 18 nt, Chlamydophila pneumoniae CWL029
uaaauagaaaacauagag

SEQ ID NO: 509108 - RNA, 18 nt, Chlamydophila pneumoniae CWL029
uaaauagcaucccuucuu

SEQ ID NO: 509109 - RNA, 18 nt, Chlamydophila pneumoniae CWL029
uaaauacaggagaaucca

SEQ ID NO: 509110 - RNA, 13 nt, Chlamydophila pneumoniae CWL029
uaaagguuuuaaa

SEQ ID NO: 509111 - RNA, 14 nt, Chlamydophila pneumoniae CWL029
uaaagguuuuaaau

SEQ ID NO: 509112 - RNA, 16 nt, Chlamydophila pneumoniae CWL029
uaaagguuuuaaauuu

SEQ ID NO: 509113 - RNA, 14 nt, Chlamydophila pneumoniae CWL029
uaaaguaaaaaaua

SEQ ID NO: 509114 - RNA, 20 nt, Chlamydophila pneumoniae CWL029
uaaauaaaaccacuucucug

SEQ ID NO: 509115 - RNA, 15 nt, Chlamydophila pneumoniae CWL029
uaaaggacauagacu

SEQ ID NO: 509116 - RNA, 19 nt, Chlamydophila pneumoniae CWL029
uaaaggaaucucgggagaa

SEQ ID NO: 509117 - RNA, 13 nt, Chlamydophila pneumoniae CWL029
uaaaggacauaga

SEQ ID NO: 509118 - RNA, 22 nt, Chlamydophila pneumoniae CWL029
uaaaggaccuguuuucuuuucu

SEQ ID NO: 509119 - RNA, 15 nt, Chlamydophila pneumoniae CWL029
uaaagguugcuaaga

SEQ ID NO: 509120 - RNA, 12 nt, Chlamydophila pneumoniae CWL029
uaaagguuuuaa

SEQ ID NO: 509121 - RNA, 18 nt, Chlamydophila pneumoniae CWL029
uaaaggcauaacugugcu

SEQ ID NO: 509122 - RNA, 23 nt, Chlamydophila pneumoniae CWL029
uaaaggcauagauacaaacaucg

SEQ ID NO: 509123 - RNA, 13 nt, Chlamydophila pneumoniae CWL029
uaaagagcauccu

SEQ ID NO: 509124 - RNA, 15 nt, Chlamydophila pneumoniae CWL029
uaaagagcauccugu

SEQ ID NO: 509125 - RNA, 21 nt, Chlamydophila pneumoniae CWL029
uaaagagcugauccagcucca

SEQ ID NO: 509126 - RNA, 15 nt, Chlamydophila pneumoniae CWL029
uaaagaguagcccca

SEQ ID NO: 509127 - RNA, 17 nt, Chlamydophila pneumoniae CWL029
uaaagcaaagauaaaga

SEQ ID NO: 509128 - RNA, 20 nt, Chlamydophila pneumoniae CWL029
uaaagcaaagauaaagaagu

SEQ ID NO: 509129 - RNA, 14 nt, Chlamydophila pneumoniae CWL029
uaaagcaaaugccu

SEQ ID NO: 509130 - RNA, 20 nt, Chlamydophila pneumoniae CWL029
uaaagauuucguauagcugg

SEQ ID NO: 509131 - RNA, 19 nt, Chlamydophila pneumoniae CWL029
uaaagcaaagauaaagaag

SEQ ID NO: 509132 - RNA, 20 nt, Chlamydophila pneumoniae CWL029
uaaacauacaugcuaaucca

SEQ ID NO: 509133 - RNA, 17 nt, Chlamydophila pneumoniae CWL029
uaaacaucgcagcagga

SEQ ID NO: 509134 - RNA, 14 nt, Chlamydophila pneumoniae CWL029
uaaacaauuucaau

SEQ ID NO: 509135 - RNA, 13 nt, Chlamydophila pneumoniae CWL029
uaaacaauaagag

SEQ ID NO: 509136 - RNA, 12 nt, Chlamydophila pneumoniae CWL029
uaaaauuucuag

SEQ ID NO: 509137 - RNA, 14 nt, Chlamydophila pneumoniae CWL029
uaaaauuucuagga

SEQ ID NO: 509138 - RNA, 23 nt, Chlamydophila pneumoniae CWL029
uaaaauuucuaggacagcacaua

SEQ ID NO: 509139 - RNA, 12 nt, Chlamydophila pneumoniae CWL029
uaaaauugaaau

SEQ ID NO: 509140 - RNA, 16 nt, Chlamydophila pneumoniae CWL029
uaaaauuuaaaaaaau

SEQ ID NO: 509141 - RNA, 18 nt, Chlamydophila pneumoniae CWL029
uaaaauuuaaaaaaaucu

SEQ ID NO: 509142 - RNA, 21 nt, Chlamydophila pneumoniae CWL029
uaaagaaggagguccuuggca

SEQ ID NO: 509143 - RNA, 18 nt, Chlamydophila pneumoniae CWL029
uaaagaaagagucucacu

SEQ ID NO: 509144 - RNA, 15 nt, Chlamydophila pneumoniae CWL029
uaaagaaacuucuga

SEQ ID NO: 509145 - RNA, 16 nt, Chlamydophila pneumoniae CWL029
uaaagaaacuucugac

SEQ ID NO: 509146 - RNA, 19 nt, Chlamydophila pneumoniae CWL029
uaaacuuuuuuucaaauca

SEQ ID NO: 509147 - RNA, 20 nt, Chlamydophila pneumoniae CWL029
uaaacuuuuuuucaaaucau

SEQ ID NO: 509148 - RNA, 15 nt, Chlamydophila pneumoniae CWL029
uaaagaaaagcaauc

SEQ ID NO: 509149 - RNA, 15 nt, Chlamydophila pneumoniae CWL029
uaaacuuucuucucu

SEQ ID NO: 509150 - RNA, 17 nt, Chlamydophila pneumoniae CWL029
uaaacuuucuucucuag

SEQ ID NO: 509151 - RNA, 22 nt, Chlamydophila pneumoniae CWL029
uaaacccuguccaacuaaaaca

SEQ ID NO: 509152 - RNA, 16 nt, Chlamydophila pneumoniae CWL029
uaaacccuucaagcaa

SEQ ID NO: 509153 - RNA, 18 nt, Chlamydophila pneumoniae CWL029
uaaacccuucaagcaaau

SEQ ID NO: 509154 - RNA, 13 nt, Chlamydophila pneumoniae CWL029
uaaacgagacugc

SEQ ID NO: 509155 - RNA, 15 nt, Chlamydophila pneumoniae CWL029
uaaaccuucaaugau

SEQ ID NO: 509156 - RNA, 12 nt, Chlamydophila pneumoniae CWL029
guuuagguaggc

SEQ ID NO: 509157 - RNA, 13 nt, Chlamydophila pneumoniae CWL029
guuuaauuccuug

SEQ ID NO: 509158 - RNA, 15 nt, Chlamydophila pneumoniae CWL029
guuguuggagcagaa

SEQ ID NO: 509159 - RNA, 14 nt, Chlamydophila pneumoniae CWL029
guuguuuuuugaga

SEQ ID NO: 509160 - RNA, 18 nt, Chlamydophila pneumoniae CWL029
guuguugcaauucuucau

SEQ ID NO: 509161 - RNA, 14 nt, Chlamydophila pneumoniae CWL029
guuguauccagcuc

SEQ ID NO: 509162 - RNA, 16 nt, Chlamydophila pneumoniae CWL029
guuguauccagcucaa

SEQ ID NO: 509163 - RNA, 21 nt, Chlamydophila pneumoniae CWL029
guuguagcuacaagucccccu

SEQ ID NO: 509164 - RNA, 18 nt, Chlamydophila pneumoniae CWL029
guuguagugaaugagcuu

SEQ ID NO: 509165 - RNA, 15 nt, Chlamydophila pneumoniae CWL029
guuggaggaacaaua

SEQ ID NO: 509166 - RNA, 22 nt, Chlamydophila pneumoniae CWL029
guugcaugcuugaaguucucaa

SEQ ID NO: 509167 - RNA, 19 nt, Chlamydophila pneumoniae CWL029
guugcaacucucuuuaaac

SEQ ID NO: 509168 - RNA, 19 nt, Chlamydophila pneumoniae CWL029
guugagaaccuucacaaga

SEQ ID NO: 509169 - RNA, 15 nt, Chlamydophila pneumoniae CWL029
guugaccuuuuucau

SEQ ID NO: 509170 - RNA, 12 nt, Chlamydophila pneumoniae CWL029
guucuucauucc

SEQ ID NO: 509171 - RNA, 22 nt, Chlamydophila pneumoniae CWL029
guucuuaucgggggugccaaaa

SEQ ID NO: 509172 - RNA, 16 nt, Chlamydophila pneumoniae CWL029
guucuugaaguucuuc

SEQ ID NO: 509173 - RNA, 14 nt, Chlamydophila pneumoniae CWL029
guucuuguaauaaa

SEQ ID NO: 509174 - RNA, 17 nt, Chlamydophila pneumoniae CWL029
guugaaaugagugagaa

SEQ ID NO: 509175 - RNA, 10 nt, Chlamydophila pneumoniae CWL029
guucuuucug

SEQ ID NO: 509176 - RNA, 13 nt, Chlamydophila pneumoniae CWL029
guucuuucuuucu

SEQ ID NO: 509177 - RNA, 17 nt, Chlamydophila pneumoniae CWL029
guucuuugaauuuccaa

SEQ ID NO: 509178 - RNA, 17 nt, Chlamydophila pneumoniae CWL029
guucuuuuguuugucuu

SEQ ID NO: 509179 - RNA, 20 nt, Chlamydophila pneumoniae CWL029
guucuuuuguuugucuucca

SEQ ID NO: 509180 - RNA, 12 nt, Chlamydophila pneumoniae CWL029
guucuuuuugca

SEQ ID NO: 509181 - RNA, 19 nt, Chlamydophila pneumoniae CWL029
guucucuaugacuucuugu

SEQ ID NO: 509182 - RNA, 18 nt, Chlamydophila pneumoniae CWL029
guucucuccagcuguggu

SEQ ID NO: 509183 - RNA, 20 nt, Chlamydophila pneumoniae CWL029
guuccugaaaagcauucugc

SEQ ID NO: 509184 - RNA, 17 nt, Chlamydophila pneumoniae CWL029
guucccuggaugaacuc

SEQ ID NO: 509185 - RNA, 17 nt, Chlamydophila pneumoniae CWL029
guuccuauuuuuuguga

SEQ ID NO: 509186 - RNA, 12 nt, Chlamydophila pneumoniae CWL029
guuccucauccu

SEQ ID NO: 509187 - RNA, 14 nt, Chlamydophila pneumoniae CWL029
guuccucauccuca

SEQ ID NO: 509188 - RNA, 18 nt, Chlamydophila pneumoniae CWL029
guuccucauccucaucau

SEQ ID NO: 509189 - RNA, 19 nt, Chlamydophila pneumoniae CWL029
guucacuucaucgacagua

SEQ ID NO: 509190 - RNA, 15 nt, Chlamydophila pneumoniae CWL029
guucacuucaucgac

SEQ ID NO: 509191 - RNA, 22 nt, Chlamydophila pneumoniae CWL029
guucaacuuuguuaauagaaga

SEQ ID NO: 509192 - RNA, 13 nt, Chlamydophila pneumoniae CWL029
guguuuccuuuuc

SEQ ID NO: 509193 - RNA, 21 nt, Chlamydophila pneumoniae CWL029
guguuuccuuuucuccuucug

SEQ ID NO: 509194 - RNA, 21 nt, Chlamydophila pneumoniae CWL029
guuacagcguugcuaagcaua

SEQ ID NO: 509195 - RNA, 22 nt, Chlamydophila pneumoniae CWL029
guuacagcguugcuaagcauag

SEQ ID NO: 509196 - RNA, 15 nt, Chlamydophila pneumoniae CWL029
guuaccaaaaacugg

SEQ ID NO: 509197 - RNA, 11 nt, Chlamydophila pneumoniae CWL029
guuaauaagaa

SEQ ID NO: 509198 - RNA, 15 nt, Chlamydophila pneumoniae CWL029
guuauaaggauauca

SEQ ID NO: 509199 - RNA, 13 nt, Chlamydophila pneumoniae CWL029
guuauaagugacu

SEQ ID NO: 509200 - RNA, 20 nt, Chlamydophila pneumoniae CWL029
guuauaagugacuuuucuuc

SEQ ID NO: 509201 - RNA, 13 nt, Chlamydophila pneumoniae CWL029
guuagagaagagg

SEQ ID NO: 509202 - RNA, 23 nt, Chlamydophila pneumoniae CWL029
guuacgcucguagguaugagcuc

SEQ ID NO: 509203 - RNA, 22 nt, Chlamydophila pneumoniae CWL029
guuacggaacucauuaagaaga

SEQ ID NO: 509204 - RNA, 20 nt, Chlamydophila pneumoniae CWL029
guuauuaauaaauuuaucug

SEQ ID NO: 509205 - RNA, 13 nt, Chlamydophila pneumoniae CWL029
guggucggcagaa

SEQ ID NO: 509206 - RNA, 12 nt, Chlamydophila pneumoniae CWL029
guggucuagaga

SEQ ID NO: 509207 - RNA, 15 nt, Chlamydophila pneumoniae CWL029
gugcucggcacuuac

SEQ ID NO: 509208 - RNA, 12 nt, Chlamydophila pneumoniae CWL029
gugcucucuaaa

SEQ ID NO: 509209 - RNA, 19 nt, Chlamydophila pneumoniae CWL029
gugcucaguaaauauuuua

SEQ ID NO: 509210 - RNA, 20 nt, Chlamydophila pneumoniae CWL029
gugcgcgucuccuugauuug

SEQ ID NO: 509211 - RNA, 14 nt, Chlamydophila pneumoniae CWL029
gugauacuuuagaa

SEQ ID NO: 509212 - RNA, 19 nt, Chlamydophila pneumoniae CWL029
gugaucaaaauuauccaga

SEQ ID NO: 509213 - RNA, 16 nt, Chlamydophila pneumoniae CWL029
gugauauccaccuuac

SEQ ID NO: 509214 - RNA, 20 nt, Chlamydophila pneumoniae CWL029
gucuagaaaagacaucucug

SEQ ID NO: 509215 - RNA, 16 nt, Chlamydophila pneumoniae CWL029
gucuagaacacucaga

SEQ ID NO: 509216 - RNA, 15 nt, Chlamydophila pneumoniae CWL029
gugcagugaauccuu

SEQ ID NO: 509217 - RNA, 15 nt, Chlamydophila pneumoniae CWL029
aaauauagaaaauca

SEQ ID NO: 509218 - RNA, 13 nt, Chlamydophila pneumoniae CWL029
gugcaugcaucuu

SEQ ID NO: 509219 - RNA, 14 nt, Chlamydophila pneumoniae CWL029
gugcaugcaucuua

SEQ ID NO: 509220 - RNA, 14 nt, Chlamydophila pneumoniae CWL029
gugcauuuucuucu

SEQ ID NO: 509221 - RNA, 14 nt, Chlamydophila pneumoniae CWL029
gugccaucuguaga

SEQ ID NO: 509222 - RNA, 23 nt, Chlamydophila pneumoniae CWL029
gugccuucuucaaagcuacuaau

SEQ ID NO: 509223 - RNA, 13 nt, Chlamydophila pneumoniae CWL029
gugccuguaauug

SEQ ID NO: 509224 - RNA, 21 nt, Chlamydophila pneumoniae CWL029
uacacuuauguucuaugagau

SEQ ID NO: 509225 - RNA, 21 nt, Chlamydophila pneumoniae CWL029
uacacugguagcuaaauuuag

SEQ ID NO: 509226 - RNA, 19 nt, Chlamydophila pneumoniae CWL029
uacacuguuguaauaaaau

SEQ ID NO: 509227 - RNA, 15 nt, Chlamydophila pneumoniae CWL029
uacacuucuaauaca

SEQ ID NO: 509228 - RNA, 22 nt, Chlamydophila pneumoniae CWL029
uacagaaaauaagaagcagcac

SEQ ID NO: 509229 - RNA, 14 nt, Chlamydophila pneumoniae CWL029
uacagaacaauggu

SEQ ID NO: 509230 - RNA, 23 nt, Chlamydophila pneumoniae CWL029
uacagaaagagcuaaagaaacuu

SEQ ID NO: 509231 - RNA, 20 nt, Chlamydophila pneumoniae CWL029
uacagaaaggaccuccucac

SEQ ID NO: 509232 - RNA, 18 nt, Chlamydophila pneumoniae CWL029
uacagaaaggcuuuucuu

SEQ ID NO: 509233 - RNA, 18 nt, Chlamydophila pneumoniae CWL029
uacagaggaaucuauccu

SEQ ID NO: 509234 - RNA, 17 nt, Chlamydophila pneumoniae CWL029
uacagagggaauuucau

SEQ ID NO: 509235 - RNA, 21 nt, Chlamydophila pneumoniae CWL029
uacagagucuguguagccgua

SEQ ID NO: 509236 - RNA, 23 nt, Chlamydophila pneumoniae CWL029
uacagagggcuucauuccuacau

SEQ ID NO: 509237 - RNA, 18 nt, Chlamydophila pneumoniae CWL029
uacagacaagcaaggaaa

SEQ ID NO: 509238 - RNA, 19 nt, Chlamydophila pneumoniae CWL029
uacagacaagcaaggaaaa

SEQ ID NO: 509239 - RNA, 19 nt, Chlamydophila pneumoniae CWL029
uacaccuacagaucaggau

SEQ ID NO: 509240 - RNA, 17 nt, Chlamydophila pneumoniae CWL029
uacacccgcaagcacuu

SEQ ID NO: 509241 - RNA, 15 nt, Chlamydophila pneumoniae CWL029
uacaccauagaacug

SEQ ID NO: 509242 - RNA, 16 nt, Chlamydophila pneumoniae CWL029
uacacuauaagacauu

SEQ ID NO: 509243 - RNA, 13 nt, Chlamydophila pneumoniae CWL029
uacaauaaacaac

SEQ ID NO: 509244 - RNA, 13 nt, Chlamydophila pneumoniae CWL029
uaauuuuagcuuc

SEQ ID NO: 509245 - RNA, 19 nt, Chlamydophila pneumoniae CWL029
uaauuuuagaacuucaaug

SEQ ID NO: 509246 - RNA, 19 nt, Chlamydophila pneumoniae CWL029
uaauuuucccaauauccuc

SEQ ID NO: 509247 - RNA, 17 nt, Chlamydophila pneumoniae CWL029
uacaaugauauaaaagc

SEQ ID NO: 509248 - RNA, 21 nt, Chlamydophila pneumoniae CWL029
uacaaugaagucuucuuuccc

SEQ ID NO: 509249 - RNA, 23 nt, Chlamydophila pneumoniae CWL029
uacaaugaagucuucuuucccca

SEQ ID NO: 509250 - RNA, 22 nt, Chlamydophila pneumoniae CWL029
uacaauuagagauucauaaaac

SEQ ID NO: 509251 - RNA, 20 nt, Chlamydophila pneumoniae CWL029
uacaaucccgaguccuaaaa

SEQ ID NO: 509252 - RNA, 19 nt, Chlamydophila pneumoniae CWL029
uacacauugucucuuuuaa

SEQ ID NO: 509253 - RNA, 20 nt, Chlamydophila pneumoniae CWL029
uacaauuagagauucauaaa

SEQ ID NO: 509254 - RNA, 14 nt, Chlamydophila pneumoniae CWL029
uacagauuucagau

SEQ ID NO: 509255 - RNA, 17 nt, Chlamydophila pneumoniae CWL029
uacagauaucaaagcau

SEQ ID NO: 509256 - RNA, 19 nt, Chlamydophila pneumoniae CWL029
uacagauguaaaugcuccu

SEQ ID NO: 509257 - RNA, 13 nt, Chlamydophila pneumoniae CWL029
uacagauguuuuc

SEQ ID NO: 509258 - RNA, 14 nt, Chlamydophila pneumoniae CWL029
uacagcauaaaaau

SEQ ID NO: 509259 - RNA, 23 nt, Chlamydophila pneumoniae CWL029
uacagcgcuuucgggaauaauag

SEQ ID NO: 509260 - RNA, 18 nt, Chlamydophila pneumoniae CWL029
uacagcaucggcaaccag

SEQ ID NO: 509261 - RNA, 20 nt, Chlamydophila pneumoniae CWL029
uacagcguugcuaagcauag

SEQ ID NO: 509262 - RNA, 17 nt, Chlamydophila pneumoniae CWL029
uacagcuucauuaucuu

SEQ ID NO: 509263 - RNA, 17 nt, Chlamydophila pneumoniae CWL029
uacagcuucuuuuccag

SEQ ID NO: 509264 - RNA, 16 nt, Chlamydophila pneumoniae CWL029
uacaggaaaacgcccu

SEQ ID NO: 509265 - RNA, 14 nt, Chlamydophila pneumoniae CWL029
uacaggaauucuca

SEQ ID NO: 509266 - RNA, 15 nt, Chlamydophila pneumoniae CWL029
uacaggacuguuugu

SEQ ID NO: 509267 - RNA, 19 nt, Chlamydophila pneumoniae CWL029
uacaggacuguuuguuuau

SEQ ID NO: 509268 - RNA, 17 nt, Chlamydophila pneumoniae CWL029
uacaggagaagcggaag

SEQ ID NO: 509269 - RNA, 13 nt, Chlamydophila pneumoniae CWL029
uacaggagaaucc

SEQ ID NO: 509270 - RNA, 13 nt, Chlamydophila pneumoniae CWL029
uacaggccugaug

SEQ ID NO: 509271 - RNA, 22 nt, Chlamydophila pneumoniae CWL029
uacaguuggcguuuucuagaaa

SEQ ID NO: 509272 - RNA, 23 nt, Chlamydophila pneumoniae CWL029
uaccaaagucgauacccaaagag

SEQ ID NO: 509273 - RNA, 20 nt, Chlamydophila pneumoniae CWL029
uaccaagacaauggaaauag

SEQ ID NO: 509274 - RNA, 20 nt, Chlamydophila pneumoniae CWL029
uaccaaggcagguaucuccu

SEQ ID NO: 509275 - RNA, 13 nt, Chlamydophila pneumoniae CWL029
uaccaaaauacca

SEQ ID NO: 509276 - RNA, 20 nt, Chlamydophila pneumoniae CWL029
uacauuugcuauuuucccuu

SEQ ID NO: 509277 - RNA, 15 nt, Chlamydophila pneumoniae CWL029
uacaugcucaagaag

SEQ ID NO: 509278 - RNA, 11 nt, Chlamydophila pneumoniae CWL029
uacauguaaac

SEQ ID NO: 509279 - RNA, 13 nt, Chlamydophila pneumoniae CWL029
uacauguaaacaa

SEQ ID NO: 509280 - RNA, 13 nt, Chlamydophila pneumoniae CWL029
uacauaguuuuua

SEQ ID NO: 509281 - RNA, 16 nt, Chlamydophila pneumoniae CWL029
uacaguuuuuuucuaa

SEQ ID NO: 509282 - RNA, 18 nt, Chlamydophila pneumoniae CWL029
uacauaacacuuuguuuu

SEQ ID NO: 509283 - RNA, 14 nt, Chlamydophila pneumoniae CWL029
uaauuccaaaauaa

SEQ ID NO: 509284 - RNA, 17 nt, Chlamydophila pneumoniae CWL029
uaauucagaaagacgau

SEQ ID NO: 509285 - RNA, 20 nt, Chlamydophila pneumoniae CWL029
uaauggugucuuacaaaccc

SEQ ID NO: 509286 - RNA, 12 nt, Chlamydophila pneumoniae CWL029
uaauuaaauaua

SEQ ID NO: 509287 - RNA, 15 nt, Chlamydophila pneumoniae CWL029
uaauuaacguuucuu

SEQ ID NO: 509288 - RNA, 22 nt, Chlamydophila pneumoniae CWL029
uaauuucuaaauagaaaacaua

SEQ ID NO: 509289 - RNA, 19 nt, Chlamydophila pneumoniae CWL029
uaauuucuccgucaagaac

SEQ ID NO: 509290 - RNA, 21 nt, Chlamydophila pneumoniae CWL029
uaauuuccuucaggauuuucc

SEQ ID NO: 509291 - RNA, 22 nt, Chlamydophila pneumoniae CWL029
uaauuuccuucaggauuuucca

SEQ ID NO: 509292 - RNA, 22 nt, Chlamydophila pneumoniae CWL029
uaauuuaaaugccuuaaaugua

SEQ ID NO: 509293 - RNA, 12 nt, Chlamydophila pneumoniae CWL029
uaauccuccaaa

SEQ ID NO: 509294 - RNA, 21 nt, Chlamydophila pneumoniae CWL029
uaauccuguugucacuaagau

SEQ ID NO: 509295 - RNA, 14 nt, Chlamydophila pneumoniae CWL029
uaauccuucuuucu

SEQ ID NO: 509296 - RNA, 19 nt, Chlamydophila pneumoniae CWL029
uaaucuauaggauuugcau

SEQ ID NO: 509297 - RNA, 12 nt, Chlamydophila pneumoniae CWL029
uaaucucaccag

SEQ ID NO: 509298 - RNA, 22 nt, Chlamydophila pneumoniae CWL029
uaaucuccaaacauuuuuaagg

SEQ ID NO: 509299 - RNA, 18 nt, Chlamydophila pneumoniae CWL029
uaaugaaguuugcaugca

SEQ ID NO: 509300 - RNA, 15 nt, Chlamydophila pneumoniae CWL029
uaaugacagugucca

SEQ ID NO: 509301 - RNA, 13 nt, Chlamydophila pneumoniae CWL029
uaaugaacucagg

SEQ ID NO: 509302 - RNA, 12 nt, Chlamydophila pneumoniae CWL029
uaaucuguauau

SEQ ID NO: 509303 - RNA, 23 nt, Chlamydophila pneumoniae CWL029
uaaugccgagaauacagagucug

SEQ ID NO: 509304 - RNA, 13 nt, Chlamydophila pneumoniae CWL029
uagaaaucucacu

SEQ ID NO: 509305 - RNA, 16 nt, Chlamydophila pneumoniae CWL029
uagaaauauacucuug

SEQ ID NO: 509306 - RNA, 21 nt, Chlamydophila pneumoniae CWL029
uagaaauauacucuugcuugc

SEQ ID NO: 509307 - RNA, 23 nt, Chlamydophila pneumoniae CWL029
uagaaauauacucuugcuugcua

SEQ ID NO: 509308 - RNA, 13 nt, Chlamydophila pneumoniae CWL029
uagaaaggaaucc

SEQ ID NO: 509309 - RNA, 21 nt, Chlamydophila pneumoniae CWL029
uagaaagauuuauuuugucuu

SEQ ID NO: 509310 - RNA, 14 nt, Chlamydophila pneumoniae CWL029
uagaaagaguccuu

SEQ ID NO: 509311 - RNA, 13 nt, Chlamydophila pneumoniae CWL029
uagaaagacaaaa

SEQ ID NO: 509312 - RNA, 14 nt, Chlamydophila pneumoniae CWL029
uagaaagacaaaaa

SEQ ID NO: 509313 - RNA, 20 nt, Chlamydophila pneumoniae CWL029
uagaaagacauccuucuuua

SEQ ID NO: 509314 - RNA, 23 nt, Chlamydophila pneumoniae CWL029
uagaaagacauccuucuuuaccu

SEQ ID NO: 509315 - RNA, 18 nt, Chlamydophila pneumoniae CWL029
uagaaaccaugaugcaau

SEQ ID NO: 509316 - RNA, 14 nt, Chlamydophila pneumoniae CWL029
uagaaacugcuccu

SEQ ID NO: 509317 - RNA, 20 nt, Chlamydophila pneumoniae CWL029
uagaaaaucauucaaauaua

SEQ ID NO: 509318 - RNA, 18 nt, Chlamydophila pneumoniae CWL029
uagaaacaacugaaaaac

SEQ ID NO: 509319 - RNA, 15 nt, Chlamydophila pneumoniae CWL029
uagaaaagacaucuc

SEQ ID NO: 509320 - RNA, 18 nt, Chlamydophila pneumoniae CWL029
uagaaaagauaaaacauu

SEQ ID NO: 509321 - RNA, 21 nt, Chlamydophila pneumoniae CWL029
uagaaaagauucuaaaucaac

SEQ ID NO: 509322 - RNA, 21 nt, Chlamydophila pneumoniae CWL029
uagaaaagguauuaggaagua

SEQ ID NO: 509323 - RNA, 18 nt, Chlamydophila pneumoniae CWL029
uagaaaacgccaacugua

SEQ ID NO: 509324 - RNA, 23 nt, Chlamydophila pneumoniae CWL029
uacuuacuaaaggugaaaguaca

SEQ ID NO: 509325 - RNA, 18 nt, Chlamydophila pneumoniae CWL029
uacuuaggaauuuuucua

SEQ ID NO: 509326 - RNA, 16 nt, Chlamydophila pneumoniae CWL029
uacuccgagcauuuua

SEQ ID NO: 509327 - RNA, 24 nt, Chlamydophila pneumoniae CWL029
uacuucuccacagcuucuucguaa

SEQ ID NO: 509328 - RNA, 22 nt, Chlamydophila pneumoniae CWL029
uacuuucugauugagaauaaaa

SEQ ID NO: 509329 - RNA, 16 nt, Chlamydophila pneumoniae CWL029
uacuugggagaugcua

SEQ ID NO: 509330 - RNA, 14 nt, Chlamydophila pneumoniae CWL029
uacuuuaagaccua

SEQ ID NO: 509331 - RNA, 16 nt, Chlamydophila pneumoniae CWL029
uacuuuaaucaagccu

SEQ ID NO: 509332 - RNA, 22 nt, Chlamydophila pneumoniae CWL029
uagacaacgcaggaagaacaag

SEQ ID NO: 509333 - RNA, 17 nt, Chlamydophila pneumoniae CWL029
uagacaagacaccgaaa

SEQ ID NO: 509334 - RNA, 21 nt, Chlamydophila pneumoniae CWL029
uagacaauaccagauaaagca

SEQ ID NO: 509335 - RNA, 20 nt, Chlamydophila pneumoniae CWL029
uagaccccccauuccaaagc

SEQ ID NO: 509336 - RNA, 22 nt, Chlamydophila pneumoniae CWL029
uagaccggaucccguaaaagaa

SEQ ID NO: 509337 - RNA, 17 nt, Chlamydophila pneumoniae CWL029
uagacaugcgaagggag

SEQ ID NO: 509338 - RNA, 17 nt, Chlamydophila pneumoniae CWL029
uagacgucguccuacag

SEQ ID NO: 509339 - RNA, 18 nt, Chlamydophila pneumoniae CWL029
uagacgugcucucuucuu

SEQ ID NO: 509340 - RNA, 17 nt, Chlamydophila pneumoniae CWL029
uagacgaggagaagucg

SEQ ID NO: 509341 - RNA, 13 nt, Chlamydophila pneumoniae CWL029
uagacgauuuucu

SEQ ID NO: 509342 - RNA, 21 nt, Chlamydophila pneumoniae CWL029
uagagacgaacgaagaaaacg

SEQ ID NO: 509343 - RNA, 15 nt, Chlamydophila pneumoniae CWL029
uagagagaaacaucg

SEQ ID NO: 509344 - RNA, 20 nt, Chlamydophila pneumoniae CWL029
uagagacagccuguuuucuu

SEQ ID NO: 509345 - RNA, 16 nt, Chlamydophila pneumoniae CWL029
uagagaagauuucuau

SEQ ID NO: 509346 - RNA, 15 nt, Chlamydophila pneumoniae CWL029
uagagaagaagcaaa

SEQ ID NO: 509347 - RNA, 12 nt, Chlamydophila pneumoniae CWL029
uagagaaauuuu

SEQ ID NO: 509348 - RNA, 14 nt, Chlamydophila pneumoniae CWL029
uagagaaacuuuug

SEQ ID NO: 509349 - RNA, 18 nt, Chlamydophila pneumoniae CWL029
uagaagguguuuuggcug

SEQ ID NO: 509350 - RNA, 21 nt, Chlamydophila pneumoniae CWL029
uagaagguguuuuggcugcuu

SEQ ID NO: 509351 - RNA, 15 nt, Chlamydophila pneumoniae CWL029
uagaagcugcugcua

SEQ ID NO: 509352 - RNA, 18 nt, Chlamydophila pneumoniae CWL029
uagaaggggguucuaaga

SEQ ID NO: 509353 - RNA, 11 nt, Chlamydophila pneumoniae CWL029
uagaauagaag

SEQ ID NO: 509354 - RNA, 16 nt, Chlamydophila pneumoniae CWL029
uagaauccugaucugu

SEQ ID NO: 509355 - RNA, 18 nt, Chlamydophila pneumoniae CWL029
uagaauccuucucccucu

SEQ ID NO: 509356 - RNA, 12 nt, Chlamydophila pneumoniae CWL029
uagaaucaccaa

SEQ ID NO: 509357 - RNA, 16 nt, Chlamydophila pneumoniae CWL029
uagaaucaccaauuuu

SEQ ID NO: 509358 - RNA, 14 nt, Chlamydophila pneumoniae CWL029
uagaauccaaagac

SEQ ID NO: 509359 - RNA, 22 nt, Chlamydophila pneumoniae CWL029
uagaaucagagggacuccugug

SEQ ID NO: 509360 - RNA, 15 nt, Chlamydophila pneumoniae CWL029
uagaaugaugcaagc

SEQ ID NO: 509361 - RNA, 12 nt, Chlamydophila pneumoniae CWL029
uagaagagaaag

SEQ ID NO: 509362 - RNA, 19 nt, Chlamydophila pneumoniae CWL029
uagaacuugggaugcuacu

SEQ ID NO: 509363 - RNA, 23 nt, Chlamydophila pneumoniae CWL029
uagaacugcgaaggguuguugcc

SEQ ID NO: 509364 - RNA, 15 nt, Chlamydophila pneumoniae CWL029
uagaacuugggaugc

SEQ ID NO: 509365 - RNA, 22 nt, Chlamydophila pneumoniae CWL029
uagaagauccucaaagaguuuu

SEQ ID NO: 509366 - RNA, 18 nt, Chlamydophila pneumoniae CWL029
uagaagccaccaucuguu

SEQ ID NO: 509367 - RNA, 15 nt, Chlamydophila pneumoniae CWL029
uagaacacucagaga

SEQ ID NO: 509368 - RNA, 14 nt, Chlamydophila pneumoniae CWL029
uagaaauuccaauu

SEQ ID NO: 509369 - RNA, 21 nt, Chlamydophila pneumoniae CWL029
uagaaauuccaauuuuugcau

SEQ ID NO: 509370 - RNA, 22 nt, Chlamydophila pneumoniae CWL029
uagaacagcauggacuccaaga

SEQ ID NO: 509371 - RNA, 20 nt, Chlamydophila pneumoniae CWL029
uagaacaggauugauaaaua

SEQ ID NO: 509372 - RNA, 23 nt, Chlamydophila pneumoniae CWL029
uacguuuuucccuuuaaaaguac

SEQ ID NO: 509373 - RNA, 14 nt, Chlamydophila pneumoniae CWL029
uacguuuuucccuu

SEQ ID NO: 509374 - RNA, 14 nt, Chlamydophila pneumoniae CWL029
uacguucuuucuuu

SEQ ID NO: 509375 - RNA, 16 nt, Chlamydophila pneumoniae CWL029
uacguucuuucuuucu

SEQ ID NO: 509376 - RNA, 20 nt, Chlamydophila pneumoniae CWL029
uacguuggacugcaagagcc

SEQ ID NO: 509377 - RNA, 21 nt, Chlamydophila pneumoniae CWL029
uacguugguucaaauccagcc

SEQ ID NO: 509378 - RNA, 13 nt, Chlamydophila pneumoniae CWL029
uacucauauuuug

SEQ ID NO: 509379 - RNA, 17 nt, Chlamydophila pneumoniae CWL029
uacgaucugcuuugcau

SEQ ID NO: 509380 - RNA, 17 nt, Chlamydophila pneumoniae CWL029
uacgaauccaaaaaaga

SEQ ID NO: 509381 - RNA, 22 nt, Chlamydophila pneumoniae CWL029
uacgaugagguugagcaagaau

SEQ ID NO: 509382 - RNA, 13 nt, Chlamydophila pneumoniae CWL029
uacgauguuuucu

SEQ ID NO: 509383 - RNA, 14 nt, Chlamydophila pneumoniae CWL029
uacgauguuuucuu

SEQ ID NO: 509384 - RNA, 23 nt, Chlamydophila pneumoniae CWL029
uacggaaaauacagccagcagaa

SEQ ID NO: 509385 - RNA, 18 nt, Chlamydophila pneumoniae CWL029
uacggauacguugguuca

SEQ ID NO: 509386 - RNA, 21 nt, Chlamydophila pneumoniae CWL029
uacggaugggcacucuuccac

SEQ ID NO: 509387 - RNA, 14 nt, Chlamydophila pneumoniae CWL029
uacgguuucuggga

SEQ ID NO: 509388 - RNA, 15 nt, Chlamydophila pneumoniae CWL029
uacgguuucugggau

SEQ ID NO: 509389 - RNA, 18 nt, Chlamydophila pneumoniae CWL029
uacggguaaccugaaagc

SEQ ID NO: 509390 - RNA, 18 nt, Chlamydophila pneumoniae CWL029
uacguaaacuauacucuc

SEQ ID NO: 509391 - RNA, 13 nt, Chlamydophila pneumoniae CWL029
uacguggcuucca

SEQ ID NO: 509392 - RNA, 14 nt, Chlamydophila pneumoniae CWL029
uaccaauaugcucu

SEQ ID NO: 509393 - RNA, 14 nt, Chlamydophila pneumoniae CWL029
uaccaauucucucu

SEQ ID NO: 509394 - RNA, 14 nt, Chlamydophila pneumoniae CWL029
uaccaccuaaaaug

SEQ ID NO: 509395 - RNA, 16 nt, Chlamydophila pneumoniae CWL029
uaccaccuaaaaugca

SEQ ID NO: 509396 - RNA, 18 nt, Chlamydophila pneumoniae CWL029
uaccuauugugcuuuucu

SEQ ID NO: 509397 - RNA, 21 nt, Chlamydophila pneumoniae CWL029
uaccuauauuuuuuacauaac

SEQ ID NO: 509398 - RNA, 14 nt, Chlamydophila pneumoniae CWL029
uaccguuuccuccu

SEQ ID NO: 509399 - RNA, 15 nt, Chlamydophila pneumoniae CWL029
uaccguuuccuccuc

SEQ ID NO: 509400 - RNA, 15 nt, Chlamydophila pneumoniae CWL029
uaccugcuaaacuuu

SEQ ID NO: 509401 - RNA, 20 nt, Chlamydophila pneumoniae CWL029
uaccuuaguuuuuucuaagg

SEQ ID NO: 509402 - RNA, 19 nt, Chlamydophila pneumoniae CWL029
uaccugcauucauaaaaau

SEQ ID NO: 509403 - RNA, 15 nt, Chlamydophila pneumoniae CWL029
uacgaacuaaaggaa

SEQ ID NO: 509404 - RNA, 13 nt, Chlamydophila pneumoniae CWL029
uacgaaaacaucu

SEQ ID NO: 509405 - RNA, 14 nt, Chlamydophila pneumoniae CWL029
uaccuuguuuuccu

SEQ ID NO: 509406 - RNA, 16 nt, Chlamydophila pneumoniae CWL029
uaccuucgacuauaag

SEQ ID NO: 509407 - RNA, 14 nt, Chlamydophila pneumoniae CWL029
uaccuuaucgccaa

SEQ ID NO: 509408 - RNA, 19 nt, Chlamydophila pneumoniae CWL029
uaccuuaucgccaacggca

SEQ ID NO: 509409 - RNA, 14 nt, Chlamydophila pneumoniae CWL029
uagauuaggaagau

SEQ ID NO: 509410 - RNA, 13 nt, Chlamydophila pneumoniae CWL029
uagauuaaagaga

SEQ ID NO: 509411 - RNA, 21 nt, Chlamydophila pneumoniae CWL029
uagauguuaugaguuuuuaau

SEQ ID NO: 509412 - RNA, 18 nt, Chlamydophila pneumoniae CWL029
uagauucaugaaaugcuu

SEQ ID NO: 509413 - RNA, 21 nt, Chlamydophila pneumoniae CWL029
uagauucguuauccucgucuu

SEQ ID NO: 509414 - RNA, 24 nt, Chlamydophila pneumoniae CWL029
uagauugccuuugaucaggagucu

SEQ ID NO: 509415 - RNA, 23 nt, Chlamydophila pneumoniae CWL029
uagaucuuuucuacuucaggaaa

SEQ ID NO: 509416 - RNA, 19 nt, Chlamydophila pneumoniae CWL029
uagauguaaucauaaaaaa

SEQ ID NO: 509417 - RNA, 14 nt, Chlamydophila pneumoniae CWL029
uagaugaucacagg

SEQ ID NO: 509418 - RNA, 15 nt, Chlamydophila pneumoniae CWL029
uagaucuucugaaau

SEQ ID NO: 509419 - RNA, 22 nt, Chlamydophila pneumoniae CWL029
uagaucuucugaaaucaaaaaa

SEQ ID NO: 509420 - RNA, 14 nt, Chlamydophila pneumoniae CWL029
uagaucuugaaaag

SEQ ID NO: 509421 - RNA, 20 nt, Chlamydophila pneumoniae CWL029
uagaucgucaagcucugaga

SEQ ID NO: 509422 - RNA, 17 nt, Chlamydophila pneumoniae CWL029
uagaucccgaagcaauc

SEQ ID NO: 509423 - RNA, 18 nt, Chlamydophila pneumoniae CWL029
uagaucauaaacagcagu

SEQ ID NO: 509424 - RNA, 13 nt, Chlamydophila pneumoniae CWL029
uagaucacaagaa

SEQ ID NO: 509425 - RNA, 14 nt, Chlamydophila pneumoniae CWL029
uagaucacaagaaa

SEQ ID NO: 509426 - RNA, 17 nt, Chlamydophila pneumoniae CWL029
uagaucacaagaaagaa

SEQ ID NO: 509427 - RNA, 18 nt, Chlamydophila pneumoniae CWL029
uagauaugccucaggucu

SEQ ID NO: 509428 - RNA, 13 nt, Chlamydophila pneumoniae CWL029
uagagagaaugcc

SEQ ID NO: 509429 - RNA, 22 nt, Chlamydophila pneumoniae CWL029
uagagagagucggcuuuagaaa

SEQ ID NO: 509430 - RNA, 15 nt, Chlamydophila pneumoniae CWL029
uagagagccuuuccu

SEQ ID NO: 509431 - RNA, 16 nt, Chlamydophila pneumoniae CWL029
uagagauaucaucaaa

SEQ ID NO: 509432 - RNA, 18 nt, Chlamydophila pneumoniae CWL029
uagagauaucaucaaaag

SEQ ID NO: 509433 - RNA, 17 nt, Chlamydophila pneumoniae CWL029
uagagauccaaugacaa

SEQ ID NO: 509434 - RNA, 20 nt, Chlamydophila pneumoniae CWL029
uagagauuaccgaagagccc

SEQ ID NO: 509435 - RNA, 22 nt, Chlamydophila pneumoniae CWL029
uagagauucauaaaacuguaau

SEQ ID NO: 509436 - RNA, 18 nt, Chlamydophila pneumoniae CWL029
uagagauucuacaaauua

SEQ ID NO: 509437 - RNA, 23 nt, Chlamydophila pneumoniae CWL029
uagagauuuuucuaggaaucuuu

SEQ ID NO: 509438 - RNA, 23 nt, Chlamydophila pneumoniae CWL029
uagagcaagauucuucagaaucu

SEQ ID NO: 509439 - RNA, 19 nt, Chlamydophila pneumoniae CWL029
uagagcacauagaaacagu

SEQ ID NO: 509440 - RNA, 23 nt, Chlamydophila pneumoniae CWL029
uagaggagacucuaguuuuucuu

SEQ ID NO: 509441 - RNA, 19 nt, Chlamydophila pneumoniae CWL029
uagagcuuucagaaaagaa

SEQ ID NO: 509442 - RNA, 23 nt, Chlamydophila pneumoniae CWL029
uagaggacucccucaaaauuuaa

SEQ ID NO: 509443 - RNA, 15 nt, Chlamydophila pneumoniae CWL029
uagagcuucuuuauc

SEQ ID NO: 509444 - RNA, 21 nt, Chlamydophila pneumoniae CWL029
uagagcgcccgaaucuuucaa

SEQ ID NO: 509445 - RNA, 14 nt, Chlamydophila pneumoniae CWL029
uagaggaucuucaa

SEQ ID NO: 509446 - RNA, 20 nt, Chlamydophila pneumoniae CWL029
uagaguacacagcacaagaa

SEQ ID NO: 509447 - RNA, 21 nt, Chlamydophila pneumoniae CWL029
uagaguauuagcgaguacuuu

SEQ ID NO: 509448 - RNA, 16 nt, Chlamydophila pneumoniae CWL029
uagaguccaagguucu

SEQ ID NO: 509449 - RNA, 20 nt, Chlamydophila pneumoniae CWL029
uagaguccaagguucuggga

SEQ ID NO: 509450 - RNA, 21 nt, Chlamydophila pneumoniae CWL029
uagauacuuugcaauacacca

SEQ ID NO: 509451 - RNA, 13 nt, Chlamydophila pneumoniae CWL029
uagauaagaucuc

SEQ ID NO: 509452 - RNA, 14 nt, Chlamydophila pneumoniae CWL029
uagauaagaucucu

SEQ ID NO: 509453 - RNA, 14 nt, Chlamydophila pneumoniae CWL029
uagagucugcagca

SEQ ID NO: 509454 - RNA, 21 nt, Chlamydophila pneumoniae CWL029
uagagucuucgacaaggaagc

SEQ ID NO: 509455 - RNA, 22 nt, Chlamydophila pneumoniae CWL029
uagagucuucgacaaggaagcc

SEQ ID NO: 509456 - RNA, 21 nt, Chlamydophila pneumoniae CWL029
uagagucucuuucagcucaag

SEQ ID NO: 509457 - RNA, 16 nt, Chlamydophila pneumoniae CWL029
uagaguucauuuuagu

SEQ ID NO: 509458 - RNA, 20 nt, Chlamydophila pneumoniae CWL029
uagaguucgcacuaauuucc

SEQ ID NO: 509459 - RNA, 16 nt, Chlamydophila pneumoniae CWL029
uagaguugacaauagg

SEQ ID NO: 509460 - RNA, 17 nt, Chlamydophila pneumoniae CWL029
uagcaucccuucuucuu

SEQ ID NO: 509461 - RNA, 20 nt, Chlamydophila pneumoniae CWL029
uagcaucccuucuucuuuua

SEQ ID NO: 509462 - RNA, 23 nt, Chlamydophila pneumoniae CWL029
uagcaucccuucuucuuuuagac

SEQ ID NO: 509463 - RNA, 21 nt, Chlamydophila pneumoniae CWL029
uagcaucaucuccugaagcca

SEQ ID NO: 509464 - RNA, 16 nt, Chlamydophila pneumoniae CWL029
uagcaucccaaguucu

SEQ ID NO: 509465 - RNA, 23 nt, Chlamydophila pneumoniae CWL029
uagccaauauagaagcugcugcu

SEQ ID NO: 509466 - RNA, 19 nt, Chlamydophila pneumoniae CWL029
uagccaauauagaagcugc

SEQ ID NO: 509467 - RNA, 20 nt, Chlamydophila pneumoniae CWL029
uagccaauauagaagcugcu

SEQ ID NO: 509468 - RNA, 13 nt, Chlamydophila pneumoniae CWL029
uagcauugcuugc

SEQ ID NO: 509469 - RNA, 19 nt, Chlamydophila pneumoniae CWL029
uagcauugcuugcgcagcu

SEQ ID NO: 509470 - RNA, 20 nt, Chlamydophila pneumoniae CWL029
uagcauugcuugcgcagcuu

SEQ ID NO: 509471 - RNA, 17 nt, Chlamydophila pneumoniae CWL029
uagcauuucuuucucuu

SEQ ID NO: 509472 - RNA, 18 nt, Chlamydophila pneumoniae CWL029
uagccaaagacucuugaa

SEQ ID NO: 509473 - RNA, 18 nt, Chlamydophila pneumoniae CWL029
uagcagaguuuuucccuc

SEQ ID NO: 509474 - RNA, 13 nt, Chlamydophila pneumoniae CWL029
uagcagcaagaac

SEQ ID NO: 509475 - RNA, 22 nt, Chlamydophila pneumoniae CWL029
uagcagggggccugccaugaau

SEQ ID NO: 509476 - RNA, 16 nt, Chlamydophila pneumoniae CWL029
uagcaggaguuuucaa

SEQ ID NO: 509477 - RNA, 23 nt, Chlamydophila pneumoniae CWL029
uagcaguauagagaagauuucua

SEQ ID NO: 509478 - RNA, 14 nt, Chlamydophila pneumoniae CWL029
uagcauacaucgua

SEQ ID NO: 509479 - RNA, 18 nt, Chlamydophila pneumoniae CWL029
uagcauagagcucuaaaa

SEQ ID NO: 509480 - RNA, 20 nt, Chlamydophila pneumoniae CWL029
uagcauagccuuccauaucu

SEQ ID NO: 509481 - RNA, 16 nt, Chlamydophila pneumoniae CWL029
uagcauaggcuaagac

SEQ ID NO: 509482 - RNA, 18 nt, Chlamydophila pneumoniae CWL029
uagcaauucgguagagcu

SEQ ID NO: 509483 - RNA, 22 nt, Chlamydophila pneumoniae CWL029
uagcaauucgguagagcuagaa

SEQ ID NO: 509484 - RNA, 20 nt, Chlamydophila pneumoniae CWL029
uagcaaucucuuucacaaag

SEQ ID NO: 509485 - RNA, 16 nt, Chlamydophila pneumoniae CWL029
uagcaagcgcuagugc

SEQ ID NO: 509486 - RNA, 14 nt, Chlamydophila pneumoniae CWL029
uagcaaagacaucu

SEQ ID NO: 509487 - RNA, 23 nt, Chlamydophila pneumoniae CWL029
uagcaaagcgauggcuauagaua

SEQ ID NO: 509488 - RNA, 11 nt, Chlamydophila pneumoniae CWL029
uagcaaaggca

SEQ ID NO: 509489 - RNA, 14 nt, Chlamydophila pneumoniae CWL029
uagauuuuccgcaa

SEQ ID NO: 509490 - RNA, 17 nt, Chlamydophila pneumoniae CWL029
uagcaaacggaacuaaa

SEQ ID NO: 509491 - RNA, 14 nt, Chlamydophila pneumoniae CWL029
uagauuuucccuaa

SEQ ID NO: 509492 - RNA, 13 nt, Chlamydophila pneumoniae CWL029
uagauuuuuacuu

SEQ ID NO: 509493 - RNA, 11 nt, Chlamydophila pneumoniae CWL029
uagauuucuac

SEQ ID NO: 509494 - RNA, 14 nt, Chlamydophila pneumoniae CWL029
uagauuguuaguga

SEQ ID NO: 509495 - RNA, 14 nt, Chlamydophila pneumoniae CWL029
uagauuuaaaugca

SEQ ID NO: 509496 - RNA, 14 nt, Chlamydophila pneumoniae CWL029
uaggaagaugaaua

SEQ ID NO: 509497 - RNA, 14 nt, Chlamydophila pneumoniae CWL029
uaggaacaaagcca

SEQ ID NO: 509498 - RNA, 16 nt, Chlamydophila pneumoniae CWL029
uaggaacaaagcucuc

SEQ ID NO: 509499 - RNA, 23 nt, Chlamydophila pneumoniae CWL029
uaggaacaaagcucuccuucaga

SEQ ID NO: 509500 - RNA, 20 nt, Chlamydophila pneumoniae CWL029
uaggaacaugccaaauaucu

SEQ ID NO: 509501 - RNA, 15 nt, Chlamydophila pneumoniae CWL029
uaggaagcucuucua

SEQ ID NO: 509502 - RNA, 17 nt, Chlamydophila pneumoniae CWL029
uaggaaggucagaguau

SEQ ID NO: 509503 - RNA, 20 nt, Chlamydophila pneumoniae CWL029
uaggaauaacaccaaaagaa

SEQ ID NO: 509504 - RNA, 17 nt, Chlamydophila pneumoniae CWL029
uaggaagcuuaucaaga

SEQ ID NO: 509505 - RNA, 17 nt, Chlamydophila pneumoniae CWL029
uaggaauugcuguucca

SEQ ID NO: 509506 - RNA, 15 nt, Chlamydophila pneumoniae CWL029
uagcuuuagaagccc

SEQ ID NO: 509507 - RNA, 16 nt, Chlamydophila pneumoniae CWL029
uagcuuuuuuuaugau

SEQ ID NO: 509508 - RNA, 22 nt, Chlamydophila pneumoniae CWL029
uaggaaaagcauagucgucuuu

SEQ ID NO: 509509 - RNA, 14 nt, Chlamydophila pneumoniae CWL029
uaggauaagaaauu

SEQ ID NO: 509510 - RNA, 13 nt, Chlamydophila pneumoniae CWL029
uaggagaagcccc

SEQ ID NO: 509511 - RNA, 18 nt, Chlamydophila pneumoniae CWL029
uaggacccguagccccuu

SEQ ID NO: 509512 - RNA, 19 nt, Chlamydophila pneumoniae CWL029
uaggauucaguuccucauc

SEQ ID NO: 509513 - RNA, 22 nt, Chlamydophila pneumoniae CWL029
uaggcaagauuaugaugccuca

SEQ ID NO: 509514 - RNA, 12 nt, Chlamydophila pneumoniae CWL029
uaggaucccuga

SEQ ID NO: 509515 - RNA, 17 nt, Chlamydophila pneumoniae CWL029
uagcuaugaguugcuug

SEQ ID NO: 509516 - RNA, 15 nt, Chlamydophila pneumoniae CWL029
uagcuacuucuucuu

SEQ ID NO: 509517 - RNA, 22 nt, Chlamydophila pneumoniae CWL029
uagcuagcguuuguaucacccg

SEQ ID NO: 509518 - RNA, 16 nt, Chlamydophila pneumoniae CWL029
uagcuacagauucuug

SEQ ID NO: 509519 - RNA, 22 nt, Chlamydophila pneumoniae CWL029
uagcuacggagagguuauguac

SEQ ID NO: 509520 - RNA, 15 nt, Chlamydophila pneumoniae CWL029
uagcuauucucaaau

SEQ ID NO: 509521 - RNA, 19 nt, Chlamydophila pneumoniae CWL029
uagcucaggaaaacuuaau

SEQ ID NO: 509522 - RNA, 19 nt, Chlamydophila pneumoniae CWL029
uagcucaggugguuagagc

SEQ ID NO: 509523 - RNA, 18 nt, Chlamydophila pneumoniae CWL029
uagcucauuaucaagaaa

SEQ ID NO: 509524 - RNA, 18 nt, Chlamydophila pneumoniae CWL029
uagcuaacucggaaaaaa

SEQ ID NO: 509525 - RNA, 20 nt, Chlamydophila pneumoniae CWL029
uagcgucucuucuuccucua

SEQ ID NO: 509526 - RNA, 15 nt, Chlamydophila pneumoniae CWL029
uagcuuacuuucuuu

SEQ ID NO: 509527 - RNA, 20 nt, Chlamydophila pneumoniae CWL029
uagcugagagauuuuuucau

SEQ ID NO: 509528 - RNA, 17 nt, Chlamydophila pneumoniae CWL029
uagcgcuuuuuuaaagu

SEQ ID NO: 509529 - RNA, 20 nt, Chlamydophila pneumoniae CWL029
uagcgcuuccagcuucuccc

SEQ ID NO: 509530 - RNA, 16 nt, Chlamydophila pneumoniae CWL029
uagcgcggucacuuca

SEQ ID NO: 509531 - RNA, 14 nt, Chlamydophila pneumoniae CWL029
uagccuuucuuuuu

SEQ ID NO: 509532 - RNA, 17 nt, Chlamydophila pneumoniae CWL029
uagcgacaugagaaauc

SEQ ID NO: 509533 - RNA, 14 nt, Chlamydophila pneumoniae CWL029
uagcgacaugagaa

SEQ ID NO: 509534 - RNA, 23 nt, Chlamydophila pneumoniae CWL029
uagcgaucucucuuccugcugcu

SEQ ID NO: 509535 - RNA, 19 nt, Chlamydophila pneumoniae CWL029
uagccgacaugcuuuccuu

SEQ ID NO: 509536 - RNA, 18 nt, Chlamydophila pneumoniae CWL029
uagccaucauagcaaacg

SEQ ID NO: 509537 - RNA, 23 nt, Chlamydophila pneumoniae CWL029
uagcccuagaguaaagaguagcc

SEQ ID NO: 509538 - RNA, 20 nt, Chlamydophila pneumoniae CWL029
uauccaaguccgugagagga

SEQ ID NO: 509539 - RNA, 21 nt, Chlamydophila pneumoniae CWL029
uauccacaaucucuuuaaaaa

SEQ ID NO: 509540 - RNA, 18 nt, Chlamydophila pneumoniae CWL029
uauccaccaagacugaau

SEQ ID NO: 509541 - RNA, 15 nt, Chlamydophila pneumoniae CWL029
uauccaaugagagag

SEQ ID NO: 509542 - RNA, 18 nt, Chlamydophila pneumoniae CWL029
uaucauuaagaagauucu

SEQ ID NO: 509543 - RNA, 16 nt, Chlamydophila pneumoniae CWL029
uauauuuuuuacauaa

SEQ ID NO: 509544 - RNA, 14 nt, Chlamydophila pneumoniae CWL029
uauauuuuuuccca

SEQ ID NO: 509545 - RNA, 21 nt, Chlamydophila pneumoniae CWL029
uaucaaaaggaucguuuugug

SEQ ID NO: 509546 - RNA, 18 nt, Chlamydophila pneumoniae CWL029
uauaucagcaaaaaacug

SEQ ID NO: 509547 - RNA, 14 nt, Chlamydophila pneumoniae CWL029
uauaucauuaagaa

SEQ ID NO: 509548 - RNA, 17 nt, Chlamydophila pneumoniae CWL029
uauaucauuaagaagau

SEQ ID NO: 509549 - RNA, 19 nt, Chlamydophila pneumoniae CWL029
uaucaaagacucaugaaau

SEQ ID NO: 509550 - RNA, 15 nt, Chlamydophila pneumoniae CWL029
uaucaaagcauugca

SEQ ID NO: 509551 - RNA, 19 nt, Chlamydophila pneumoniae CWL029
uaucaaaagguuuuauaaa

SEQ ID NO: 509552 - RNA, 15 nt, Chlamydophila pneumoniae CWL029
uaucaaaagguuuua

SEQ ID NO: 509553 - RNA, 22 nt, Chlamydophila pneumoniae CWL029
uauacuguuuuucuuccacaca

SEQ ID NO: 509554 - RNA, 18 nt, Chlamydophila pneumoniae CWL029
uauacuguuuuucuucca

SEQ ID NO: 509555 - RNA, 19 nt, Chlamydophila pneumoniae CWL029
uauacuguuuuucuuccac

SEQ ID NO: 509556 - RNA, 13 nt, Chlamydophila pneumoniae CWL029
uauacucucugua

SEQ ID NO: 509557 - RNA, 16 nt, Chlamydophila pneumoniae CWL029
uauacuguuuuucuuc

SEQ ID NO: 509558 - RNA, 15 nt, Chlamydophila pneumoniae CWL029
uauacgcuuaacaug

SEQ ID NO: 509559 - RNA, 14 nt, Chlamydophila pneumoniae CWL029
uauacuaagacugu

SEQ ID NO: 509560 - RNA, 23 nt, Chlamydophila pneumoniae CWL029
uauacuaagacugucuaugaucc

SEQ ID NO: 509561 - RNA, 15 nt, Chlamydophila pneumoniae CWL029
uauacccucugcuua

SEQ ID NO: 509562 - RNA, 17 nt, Chlamydophila pneumoniae CWL029
uauaccacuacugagcu

SEQ ID NO: 509563 - RNA, 20 nt, Chlamydophila pneumoniae CWL029
uauaacuacaaaauccacau

SEQ ID NO: 509564 - RNA, 21 nt, Chlamydophila pneumoniae CWL029
uauaacuccaggggauaaaac

SEQ ID NO: 509565 - RNA, 13 nt, Chlamydophila pneumoniae CWL029
uauaacucucuag

SEQ ID NO: 509566 - RNA, 17 nt, Chlamydophila pneumoniae CWL029
uauaacucucuagagga

SEQ ID NO: 509567 - RNA, 14 nt, Chlamydophila pneumoniae CWL029
uauagcauuauucc

SEQ ID NO: 509568 - RNA, 16 nt, Chlamydophila pneumoniae CWL029
uauagauuuugugagg

SEQ ID NO: 509569 - RNA, 21 nt, Chlamydophila pneumoniae CWL029
uauagauuuaagagucuugca

SEQ ID NO: 509570 - RNA, 15 nt, Chlamydophila pneumoniae CWL029
uauagcccucuccaa

SEQ ID NO: 509571 - RNA, 14 nt, Chlamydophila pneumoniae CWL029
uauagagaagauuu

SEQ ID NO: 509572 - RNA, 21 nt, Chlamydophila pneumoniae CWL029
uauaguagcgaauccagaauu

SEQ ID NO: 509573 - RNA, 13 nt, Chlamydophila pneumoniae CWL029
uauaguauuuuua

SEQ ID NO: 509574 - RNA, 14 nt, Chlamydophila pneumoniae CWL029
uauaguauuuuuaa

SEQ ID NO: 509575 - RNA, 16 nt, Chlamydophila pneumoniae CWL029
uauaguauuuuuaaau

SEQ ID NO: 509576 - RNA, 18 nt, Chlamydophila pneumoniae CWL029
uauaguauuuuuaaauac

SEQ ID NO: 509577 - RNA, 19 nt, Chlamydophila pneumoniae CWL029
uauauaagauaauagagaa

SEQ ID NO: 509578 - RNA, 14 nt, Chlamydophila pneumoniae CWL029
uauauauuuuacaa

SEQ ID NO: 509579 - RNA, 21 nt, Chlamydophila pneumoniae CWL029
uauaaauucaagacuauagaa

SEQ ID NO: 509580 - RNA, 22 nt, Chlamydophila pneumoniae CWL029
uauaaauucaagacuauagaaa

SEQ ID NO: 509581 - RNA, 15 nt, Chlamydophila pneumoniae CWL029
uauaacaacauugca

SEQ ID NO: 509582 - RNA, 20 nt, Chlamydophila pneumoniae CWL029
uauaaaacuuauaacuauug

SEQ ID NO: 509583 - RNA, 21 nt, Chlamydophila pneumoniae CWL029
uauaaacuucaaugaagaaaa

SEQ ID NO: 509584 - RNA, 23 nt, Chlamydophila pneumoniae CWL029
uaguuucacauaguuuaauaaau

SEQ ID NO: 509585 - RNA, 22 nt, Chlamydophila pneumoniae CWL029
uaguuugccuucuuaucuucua

SEQ ID NO: 509586 - RNA, 15 nt, Chlamydophila pneumoniae CWL029
uaguuuuuacaugua

SEQ ID NO: 509587 - RNA, 20 nt, Chlamydophila pneumoniae CWL029
uaguuuuuauuuuuaaauaa

SEQ ID NO: 509588 - RNA, 17 nt, Chlamydophila pneumoniae CWL029
uaguuuuuauuuuuaaa

SEQ ID NO: 509589 - RNA, 21 nt, Chlamydophila pneumoniae CWL029
uaguuuuugcuguuucuucug

SEQ ID NO: 509590 - RNA, 11 nt, Chlamydophila pneumoniae CWL029
uauaaaaaagg

SEQ ID NO: 509591 - RNA, 22 nt, Chlamydophila pneumoniae CWL029
uauaaaaaagggaugaagauaa

SEQ ID NO: 509592 - RNA, 14 nt, Chlamydophila pneumoniae CWL029
uaguccaucccugc

SEQ ID NO: 509593 - RNA, 12 nt, Chlamydophila pneumoniae CWL029
uagucaaaaauu

SEQ ID NO: 509594 - RNA, 16 nt, Chlamydophila pneumoniae CWL029
uagucaauguauucuc

SEQ ID NO: 509595 - RNA, 21 nt, Chlamydophila pneumoniae CWL029
uagugucaucggcuucuccaa

SEQ ID NO: 509596 - RNA, 15 nt, Chlamydophila pneumoniae CWL029
uagugcuagaugaag

SEQ ID NO: 509597 - RNA, 21 nt, Chlamydophila pneumoniae CWL029
uaguguucgagcaucucaaga

SEQ ID NO: 509598 - RNA, 16 nt, Chlamydophila pneumoniae CWL029
uaguuguccuuuauaa

SEQ ID NO: 509599 - RNA, 21 nt, Chlamydophila pneumoniae CWL029
uaguucauuagcuaaaucaaa

SEQ ID NO: 509600 - RNA, 18 nt, Chlamydophila pneumoniae CWL029
uaguugugagacuuucug

SEQ ID NO: 509601 - RNA, 22 nt, Chlamydophila pneumoniae CWL029
uaguaaagcauuggacaacgcu

SEQ ID NO: 509602 - RNA, 16 nt, Chlamydophila pneumoniae CWL029
uaguauuuuuaaauac

SEQ ID NO: 509603 - RNA, 20 nt, Chlamydophila pneumoniae CWL029
uaguauuuuuaaauacagau

SEQ ID NO: 509604 - RNA, 22 nt, Chlamydophila pneumoniae CWL029
uaguaucgagcucuuuaagaac

SEQ ID NO: 509605 - RNA, 21 nt, Chlamydophila pneumoniae CWL029
uaguauggcauucuuuuucua

SEQ ID NO: 509606 - RNA, 23 nt, Chlamydophila pneumoniae CWL029
uaguauggcauucuuuuucuauu

SEQ ID NO: 509607 - RNA, 21 nt, Chlamydophila pneumoniae CWL029
uaggucuaauccccaauuaua

SEQ ID NO: 509608 - RNA, 12 nt, Chlamydophila pneumoniae CWL029
uaggucuugucu

SEQ ID NO: 509609 - RNA, 21 nt, Chlamydophila pneumoniae CWL029
uaggucuugucuauucucuuc

SEQ ID NO: 509610 - RNA, 16 nt, Chlamydophila pneumoniae CWL029
uaggugacccacgcau

SEQ ID NO: 509611 - RNA, 16 nt, Chlamydophila pneumoniae CWL029
uagguuucaauagaag

SEQ ID NO: 509612 - RNA, 19 nt, Chlamydophila pneumoniae CWL029
uagguaugagcuccaaaau

SEQ ID NO: 509613 - RNA, 17 nt, Chlamydophila pneumoniae CWL029
uagguacgcuuuuucuu

SEQ ID NO: 509614 - RNA, 14 nt, Chlamydophila pneumoniae CWL029
uagggguuucccug

SEQ ID NO: 509615 - RNA, 15 nt, Chlamydophila pneumoniae CWL029
uaggguaaagaaaua

SEQ ID NO: 509616 - RNA, 23 nt, Chlamydophila pneumoniae CWL029
uaggcuuuuuucuauuuucagga

SEQ ID NO: 509617 - RNA, 17 nt, Chlamydophila pneumoniae CWL029
uaggcuuaauaaacauc

SEQ ID NO: 509618 - RNA, 19 nt, Chlamydophila pneumoniae CWL029
uaggcucuuuagcaaacau

SEQ ID NO: 509619 - RNA, 16 nt, Chlamydophila pneumoniae CWL029
uagggagugaggaauc

SEQ ID NO: 509620 - RNA, 23 nt, Chlamydophila pneumoniae CWL029
uagggagugaggaaucauaacca

SEQ ID NO: 509621 - RNA, 21 nt, Chlamydophila pneumoniae CWL029
uagggaauuuuuucuguuccu

SEQ ID NO: 509622 - RNA, 22 nt, Chlamydophila pneumoniae CWL029
uagggaaagcaucuuucaucaa

SEQ ID NO: 509623 - RNA, 19 nt, Chlamydophila pneumoniae CWL029
uagggaacaaaaaagccaa

SEQ ID NO: 509624 - RNA, 16 nt, Chlamydophila pneumoniae CWL029
uagggaagaaauuaac

SEQ ID NO: 509625 - RNA, 21 nt, Chlamydophila pneumoniae CWL029
uagggcaggcggaaaggaagg

SEQ ID NO: 509626 - RNA, 16 nt, Chlamydophila pneumoniae CWL029
uagggcauucuguaau

SEQ ID NO: 509627 - RNA, 16 nt, Chlamydophila pneumoniae CWL029
uaggcagauagacaac

SEQ ID NO: 509628 - RNA, 13 nt, Chlamydophila pneumoniae CWL029
uaggcauuaauaa

SEQ ID NO: 509629 - RNA, 19 nt, Chlamydophila pneumoniae CWL029
uaggcgaugcaaauuccag

SEQ ID NO: 509630 - RNA, 17 nt, Chlamydophila pneumoniae CWL029
uaggccgggauuuuaau

SEQ ID NO: 509631 - RNA, 12 nt, Chlamydophila pneumoniae CWL029
uaggcccaagaa

SEQ ID NO: 509632 - RNA, 23 nt, Chlamydophila pneumoniae CWL029
ucacugucggaaguuucagagcc

SEQ ID NO: 509633 - RNA, 16 nt, Chlamydophila pneumoniae CWL029
ucacucuagaaaauau

SEQ ID NO: 509634 - RNA, 18 nt, Chlamydophila pneumoniae CWL029
ucacucuagaaaauauuc

SEQ ID NO: 509635 - RNA, 13 nt, Chlamydophila pneumoniae CWL029
ucacucuaugaga

SEQ ID NO: 509636 - RNA, 16 nt, Chlamydophila pneumoniae CWL029
ucagcccacuguuuug

SEQ ID NO: 509637 - RNA, 20 nt, Chlamydophila pneumoniae CWL029
ucagcccacuguuuugcuuc

SEQ ID NO: 509638 - RNA, 19 nt, Chlamydophila pneumoniae CWL029
ucagccugucuauaaaaua

SEQ ID NO: 509639 - RNA, 21 nt, Chlamydophila pneumoniae CWL029
ucaggaagaaaggauuggaug

SEQ ID NO: 509640 - RNA, 16 nt, Chlamydophila pneumoniae CWL029
ucaggaagaugcugga

SEQ ID NO: 509641 - RNA, 18 nt, Chlamydophila pneumoniae CWL029
ucaggaaaacuuaauaag

SEQ ID NO: 509642 - RNA, 20 nt, Chlamydophila pneumoniae CWL029
ucaggaaaacuuaauaagcg

SEQ ID NO: 509643 - RNA, 19 nt, Chlamydophila pneumoniae CWL029
ucaggaaagguaguuuucu

SEQ ID NO: 509644 - RNA, 16 nt, Chlamydophila pneumoniae CWL029
ucagcuggguaagucc

SEQ ID NO: 509645 - RNA, 15 nt, Chlamydophila pneumoniae CWL029
ucagcuuaucuauag

SEQ ID NO: 509646 - RNA, 18 nt, Chlamydophila pneumoniae CWL029
ucagcuucuacagcaucg

SEQ ID NO: 509647 - RNA, 19 nt, Chlamydophila pneumoniae CWL029
ucagcuucuugauguacag

SEQ ID NO: 509648 - RNA, 19 nt, Chlamydophila pneumoniae CWL029
ucagcuuugcuuaaaaagu

SEQ ID NO: 509649 - RNA, 19 nt, Chlamydophila pneumoniae CWL029
ucagcuagagcacauagaa

SEQ ID NO: 509650 - RNA, 16 nt, Chlamydophila pneumoniae CWL029
ucagcucaaguuggca

SEQ ID NO: 509651 - RNA, 14 nt, Chlamydophila pneumoniae CWL029
ucagcuguccuccg

SEQ ID NO: 509652 - RNA, 21 nt, Chlamydophila pneumoniae CWL029
ucaguuccucauccucaucau

SEQ ID NO: 509653 - RNA, 19 nt, Chlamydophila pneumoniae CWL029
ucauaaagaggaaugaaga

SEQ ID NO: 509654 - RNA, 15 nt, Chlamydophila pneumoniae CWL029
ucauaaacagcagug

SEQ ID NO: 509655 - RNA, 10 nt, Chlamydophila pneumoniae CWL029
ucauaaacaa

SEQ ID NO: 509656 - RNA, 15 nt, Chlamydophila pneumoniae CWL029
ucauaaaaauuucau

SEQ ID NO: 509657 - RNA, 19 nt, Chlamydophila pneumoniae CWL029
ucauaaaguauauugacaa

SEQ ID NO: 509658 - RNA, 20 nt, Chlamydophila pneumoniae CWL029
ucauaaauacgugcuugaau

SEQ ID NO: 509659 - RNA, 12 nt, Chlamydophila pneumoniae CWL029
ucauaagaaauu

SEQ ID NO: 509660 - RNA, 21 nt, Chlamydophila pneumoniae CWL029
ucauaagcucuauuucugccu

SEQ ID NO: 509661 - RNA, 13 nt, Chlamydophila pneumoniae CWL029
ucauaagaaauuc

SEQ ID NO: 509662 - RNA, 16 nt, Chlamydophila pneumoniae CWL029
ucauaagaguagacaa

SEQ ID NO: 509663 - RNA, 17 nt, Chlamydophila pneumoniae CWL029
ucauaagauagagcgac

SEQ ID NO: 509664 - RNA, 15 nt, Chlamydophila pneumoniae CWL029
ucauaaccaaaagaa

SEQ ID NO: 509665 - RNA, 16 nt, Chlamydophila pneumoniae CWL029
ucauaaccaaguaaau

SEQ ID NO: 509666 - RNA, 16 nt, Chlamydophila pneumoniae CWL029
ucagguaaagagcuuc

SEQ ID NO: 509667 - RNA, 20 nt, Chlamydophila pneumoniae CWL029
ucaguaaacccucagaacac

SEQ ID NO: 509668 - RNA, 19 nt, Chlamydophila pneumoniae CWL029
ucagggggaaagccaagaa

SEQ ID NO: 509669 - RNA, 22 nt, Chlamydophila pneumoniae CWL029
ucaggauucuaaaaagaaaaga

SEQ ID NO: 509670 - RNA, 18 nt, Chlamydophila pneumoniae CWL029
ucaggauuacggaaaaua

SEQ ID NO: 509671 - RNA, 15 nt, Chlamydophila pneumoniae CWL029
ucaggauuuuccauu

SEQ ID NO: 509672 - RNA, 21 nt, Chlamydophila pneumoniae CWL029
ucaucggaucuuuucuuucua

SEQ ID NO: 509673 - RNA, 13 nt, Chlamydophila pneumoniae CWL029
ucaucgauaggau

SEQ ID NO: 509674 - RNA, 18 nt, Chlamydophila pneumoniae CWL029
ucauccucaucaucagaa

SEQ ID NO: 509675 - RNA, 14 nt, Chlamydophila pneumoniae CWL029
ucauccucaucauc

SEQ ID NO: 509676 - RNA, 16 nt, Chlamydophila pneumoniae CWL029
ucauccucaucaucag

SEQ ID NO: 509677 - RNA, 15 nt, Chlamydophila pneumoniae CWL029
ucauccgaagacuca

SEQ ID NO: 509678 - RNA, 14 nt, Chlamydophila pneumoniae CWL029
ucauccccucagaa

SEQ ID NO: 509679 - RNA, 22 nt, Chlamydophila pneumoniae CWL029
ucaucccuacccucaucauccu

SEQ ID NO: 509680 - RNA, 17 nt, Chlamydophila pneumoniae CWL029
ucauccagauuagaaaa

SEQ ID NO: 509681 - RNA, 13 nt, Chlamydophila pneumoniae CWL029
ucaucauccucag

SEQ ID NO: 509682 - RNA, 16 nt, Chlamydophila pneumoniae CWL029
ucaucagcaaccuuuc

SEQ ID NO: 509683 - RNA, 13 nt, Chlamydophila pneumoniae CWL029
ucaucagaagcuc

SEQ ID NO: 509684 - RNA, 18 nt, Chlamydophila pneumoniae CWL029
ucaucagcaaaacucccg

SEQ ID NO: 509685 - RNA, 23 nt, Chlamydophila pneumoniae CWL029
ucauacgccgugccuauagaaau

SEQ ID NO: 509686 - RNA, 23 nt, Chlamydophila pneumoniae CWL029
ucauaggaaacgcccuucuuagu

SEQ ID NO: 509687 - RNA, 12 nt, Chlamydophila pneumoniae CWL029
ucauauuuaaaa

SEQ ID NO: 509688 - RNA, 15 nt, Chlamydophila pneumoniae CWL029
ucauauuuaaaaggc

SEQ ID NO: 509689 - RNA, 17 nt, Chlamydophila pneumoniae CWL029
ucauauuuuuguccugc

SEQ ID NO: 509690 - RNA, 20 nt, Chlamydophila pneumoniae CWL029
ucauaugaaugacugcagau

SEQ ID NO: 509691 - RNA, 15 nt, Chlamydophila pneumoniae CWL029
ucaucaaagcaaaga

SEQ ID NO: 509692 - RNA, 17 nt, Chlamydophila pneumoniae CWL029
ucaucaaugguuaaaac

SEQ ID NO: 509693 - RNA, 16 nt, Chlamydophila pneumoniae CWL029
ucaucacaucaguuaa

SEQ ID NO: 509694 - RNA, 18 nt, Chlamydophila pneumoniae CWL029
ucaucuacgauguuuucu

SEQ ID NO: 509695 - RNA, 23 nt, Chlamydophila pneumoniae CWL029
ucaucgucgcgacugaagucagu

SEQ ID NO: 509696 - RNA, 11 nt, Chlamydophila pneumoniae CWL029
ucaucuucuuu

SEQ ID NO: 509697 - RNA, 20 nt, Chlamydophila pneumoniae CWL029
ucaucuuguacgaaaaucua

SEQ ID NO: 509698 - RNA, 21 nt, Chlamydophila pneumoniae CWL029
ucaucuuguacgaaaaucuac

SEQ ID NO: 509699 - RNA, 20 nt, Chlamydophila pneumoniae CWL029
ucaugccgcauuucuucaau

SEQ ID NO: 509700 - RNA, 11 nt, Chlamydophila pneumoniae CWL029
ucaugaaagug

SEQ ID NO: 509701 - RNA, 23 nt, Chlamydophila pneumoniae CWL029
ucaugagccgauguugcagaaug

SEQ ID NO: 509702 - RNA, 20 nt, Chlamydophila pneumoniae CWL029
ucaugauauuuuuauuuaaa

SEQ ID NO: 509703 - RNA, 14 nt, Chlamydophila pneumoniae CWL029
ucaugauaaaaauu

SEQ ID NO: 509704 - RNA, 16 nt, Chlamydophila pneumoniae CWL029
ucaugauaaaaauuuu

SEQ ID NO: 509705 - RNA, 22 nt, Chlamydophila pneumoniae CWL029
ucaugauaaaaauuuucaggaa

SEQ ID NO: 509706 - RNA, 13 nt, Chlamydophila pneumoniae CWL029
ucauguccuucaa

SEQ ID NO: 509707 - RNA, 21 nt, Chlamydophila pneumoniae CWL029
ucauguccuccauggaaagaa

SEQ ID NO: 509708 - RNA, 16 nt, Chlamydophila pneumoniae CWL029
ucauuaagaacaucuu

SEQ ID NO: 509709 - RNA, 22 nt, Chlamydophila pneumoniae CWL029
ucauuaagauccuuuaaagauu

SEQ ID NO: 509710 - RNA, 16 nt, Chlamydophila pneumoniae CWL029
ucauguagcagagccu

SEQ ID NO: 509711 - RNA, 21 nt, Chlamydophila pneumoniae CWL029
ucauucaaauauaugaguuua

SEQ ID NO: 509712 - RNA, 11 nt, Chlamydophila pneumoniae CWL029
ucauuauuaaa

SEQ ID NO: 509713 - RNA, 16 nt, Chlamydophila pneumoniae CWL029
ucauuacggaggcaua

SEQ ID NO: 509714 - RNA, 12 nt, Chlamydophila pneumoniae CWL029
ucauuaccugcu

SEQ ID NO: 509715 - RNA, 19 nt, Chlamydophila pneumoniae CWL029
ucauuaccugcuaaacuuu

SEQ ID NO: 509716 - RNA, 17 nt, Chlamydophila pneumoniae CWL029
uccaaaagaccaaaaau

SEQ ID NO: 509717 - RNA, 17 nt, Chlamydophila pneumoniae CWL029
uccaaaauaaaaggagc

SEQ ID NO: 509718 - RNA, 14 nt, Chlamydophila pneumoniae CWL029
uccaaaaaagagcc

SEQ ID NO: 509719 - RNA, 15 nt, Chlamydophila pneumoniae CWL029
uccaaaaacuucuaa

SEQ ID NO: 509720 - RNA, 15 nt, Chlamydophila pneumoniae CWL029
ucauuuuaguuuuca

SEQ ID NO: 509721 - RNA, 19 nt, Chlamydophila pneumoniae CWL029
ucauuuaucugcguuucuu

SEQ ID NO: 509722 - RNA, 18 nt, Chlamydophila pneumoniae CWL029
ucauugcggcaccaaaga

SEQ ID NO: 509723 - RNA, 20 nt, Chlamydophila pneumoniae CWL029
ucauugcuauugaaaaaucc

SEQ ID NO: 509724 - RNA, 16 nt, Chlamydophila pneumoniae CWL029
uccaauuguaaaucau

SEQ ID NO: 509725 - RNA, 12 nt, Chlamydophila pneumoniae CWL029
uccaaauaaagc

SEQ ID NO: 509726 - RNA, 22 nt, Chlamydophila pneumoniae CWL029
uccaaauagagugaccauagca

SEQ ID NO: 509727 - RNA, 12 nt, Chlamydophila pneumoniae CWL029
uccaaaaucucu

SEQ ID NO: 509728 - RNA, 23 nt, Chlamydophila pneumoniae CWL029
uccaaaggaaaauaaucuucaaa

SEQ ID NO: 509729 - RNA, 17 nt, Chlamydophila pneumoniae CWL029
uccaaagcuauuucucu

SEQ ID NO: 509730 - RNA, 13 nt, Chlamydophila pneumoniae CWL029
uccacaugcccaa

SEQ ID NO: 509731 - RNA, 17 nt, Chlamydophila pneumoniae CWL029
uccacaucuugagcuuc

SEQ ID NO: 509732 - RNA, 14 nt, Chlamydophila pneumoniae CWL029
uccacaagccuccc

SEQ ID NO: 509733 - RNA, 15 nt, Chlamydophila pneumoniae CWL029
uccaccaagacugaa

SEQ ID NO: 509734 - RNA, 14 nt, Chlamydophila pneumoniae CWL029
uccacgaaggaauc

SEQ ID NO: 509735 - RNA, 15 nt, Chlamydophila pneumoniae CWL029
uccacgaaggaaucu

SEQ ID NO: 509736 - RNA, 18 nt, Chlamydophila pneumoniae CWL029
uccacgaaggaaucugau

SEQ ID NO: 509737 - RNA, 15 nt, Chlamydophila pneumoniae CWL029
uccacugcuuuaggc

SEQ ID NO: 509738 - RNA, 20 nt, Chlamydophila pneumoniae CWL029
uccagacuuuccucucuuua

SEQ ID NO: 509739 - RNA, 18 nt, Chlamydophila pneumoniae CWL029
uccagaucaaugccuugc

SEQ ID NO: 509740 - RNA, 16 nt, Chlamydophila pneumoniae CWL029
uccagauuagaaaaga

SEQ ID NO: 509741 - RNA, 15 nt, Chlamydophila pneumoniae CWL029
uccagcuucuuucua

SEQ ID NO: 509742 - RNA, 14 nt, Chlamydophila pneumoniae CWL029
uccagcuguggugg

SEQ ID NO: 509743 - RNA, 15 nt, Chlamydophila pneumoniae CWL029
uccaggaauagaaag

SEQ ID NO: 509744 - RNA, 17 nt, Chlamydophila pneumoniae CWL029
uccaggcucuaggaccc

SEQ ID NO: 509745 - RNA, 12 nt, Chlamydophila pneumoniae CWL029
uccauacaggcu

SEQ ID NO: 509746 - RNA, 13 nt, Chlamydophila pneumoniae CWL029
uccauaauuucuu

SEQ ID NO: 509747 - RNA, 16 nt, Chlamydophila pneumoniae CWL029
uccauaauuucuuuca

SEQ ID NO: 509748 - RNA, 18 nt, Chlamydophila pneumoniae CWL029
uccauaauuucuuucaca

SEQ ID NO: 509749 - RNA, 19 nt, Chlamydophila pneumoniae CWL029
uccauaagcuuuucuucca

SEQ ID NO: 509750 - RNA, 20 nt, Chlamydophila pneumoniae CWL029
uccauaagcuuuucuuccaa

SEQ ID NO: 509751 - RNA, 12 nt, Chlamydophila pneumoniae CWL029
uccauaaaaaug

SEQ ID NO: 509752 - RNA, 18 nt, Chlamydophila pneumoniae CWL029
uccauaacaguuuguucu

SEQ ID NO: 509753 - RNA, 22 nt, Chlamydophila pneumoniae CWL029
uccaguagaucuucugaaauca

SEQ ID NO: 509754 - RNA, 23 nt, Chlamydophila pneumoniae CWL029
uccaguagagccucuaagaaaau

SEQ ID NO: 509755 - RNA, 17 nt, Chlamydophila pneumoniae CWL029
uccaguaucuucucuua

SEQ ID NO: 509756 - RNA, 16 nt, Chlamydophila pneumoniae CWL029
uccaguaucuucucuu

SEQ ID NO: 509757 - RNA, 20 nt, Chlamydophila pneumoniae CWL029
uccaguuuguugaucucuaa

SEQ ID NO: 509758 - RNA, 22 nt, Chlamydophila pneumoniae CWL029
uccagcuccauaagcuuuucuu

SEQ ID NO: 509759 - RNA, 16 nt, Chlamydophila pneumoniae CWL029
uccagcaacaaccaaa

SEQ ID NO: 509760 - RNA, 13 nt, Chlamydophila pneumoniae CWL029
ucacuauuaauac

SEQ ID NO: 509761 - RNA, 13 nt, Chlamydophila pneumoniae CWL029
ucaccuuacaucc

SEQ ID NO: 509762 - RNA, 22 nt, Chlamydophila pneumoniae CWL029
ucaccuuacauccaauuuuguu

SEQ ID NO: 509763 - RNA, 15 nt, Chlamydophila pneumoniae CWL029
ucaccuuagagugac

SEQ ID NO: 509764 - RNA, 17 nt, Chlamydophila pneumoniae CWL029
ucacgaggagcuuuuac

SEQ ID NO: 509765 - RNA, 20 nt, Chlamydophila pneumoniae CWL029
ucacgagucccuucuuucaa

SEQ ID NO: 509766 - RNA, 13 nt, Chlamydophila pneumoniae CWL029
ucaccuugugaga

SEQ ID NO: 509767 - RNA, 22 nt, Chlamydophila pneumoniae CWL029
ucaccgcgcauagcaacuacag

SEQ ID NO: 509768 - RNA, 13 nt, Chlamydophila pneumoniae CWL029
ucaccauuaaauu

SEQ ID NO: 509769 - RNA, 21 nt, Chlamydophila pneumoniae CWL029
ucaccauuaagauaucugcuc

SEQ ID NO: 509770 - RNA, 16 nt, Chlamydophila pneumoniae CWL029
ucacacugcgagagaa

SEQ ID NO: 509771 - RNA, 18 nt, Chlamydophila pneumoniae CWL029
ucacacuacauucaggau

SEQ ID NO: 509772 - RNA, 13 nt, Chlamydophila pneumoniae CWL029
ucacauuuucaug

SEQ ID NO: 509773 - RNA, 13 nt, Chlamydophila pneumoniae CWL029
ucaccaacuccuc

SEQ ID NO: 509774 - RNA, 23 nt, Chlamydophila pneumoniae CWL029
ucacaaaucuuccccuaaaaauu

SEQ ID NO: 509775 - RNA, 19 nt, Chlamydophila pneumoniae CWL029
ucacaaagaauucagagaa

SEQ ID NO: 509776 - RNA, 21 nt, Chlamydophila pneumoniae CWL029
ucacaaagaauucagagaaag

SEQ ID NO: 509777 - RNA, 19 nt, Chlamydophila pneumoniae CWL029
ucaauuuuaccacuuccag

SEQ ID NO: 509778 - RNA, 19 nt, Chlamydophila pneumoniae CWL029
ucaauuucuucaucaauac

SEQ ID NO: 509779 - RNA, 22 nt, Chlamydophila pneumoniae CWL029
ucaauuugcguugcauguccau

SEQ ID NO: 509780 - RNA, 14 nt, Chlamydophila pneumoniae CWL029
ucacaagaaagaau

SEQ ID NO: 509781 - RNA, 17 nt, Chlamydophila pneumoniae CWL029
ucacaagcaguaacugc

SEQ ID NO: 509782 - RNA, 22 nt, Chlamydophila pneumoniae CWL029
ucacaagcugguagacuucuug

SEQ ID NO: 509783 - RNA, 16 nt, Chlamydophila pneumoniae CWL029
ucacaaguccugcguu

SEQ ID NO: 509784 - RNA, 22 nt, Chlamydophila pneumoniae CWL029
ucacaauaccaucucuuucuau

SEQ ID NO: 509785 - RNA, 17 nt, Chlamydophila pneumoniae CWL029
ucacaauauaaaugcua

SEQ ID NO: 509786 - RNA, 17 nt, Chlamydophila pneumoniae CWL029
ucacaaucuaaauaaga

SEQ ID NO: 509787 - RNA, 14 nt, Chlamydophila pneumoniae CWL029
ucacaaugaucuuu

SEQ ID NO: 509788 - RNA, 22 nt, Chlamydophila pneumoniae CWL029
ucacacgaauaauuaaaucgua

SEQ ID NO: 509789 - RNA, 18 nt, Chlamydophila pneumoniae CWL029
ucaagucgagaaacaaaa

SEQ ID NO: 509790 - RNA, 20 nt, Chlamydophila pneumoniae CWL029
ucaauccccugcaucucugc

SEQ ID NO: 509791 - RNA, 13 nt, Chlamydophila pneumoniae CWL029
ucaaucucuccuu

SEQ ID NO: 509792 - RNA, 14 nt, Chlamydophila pneumoniae CWL029
ucaagccacagaga

SEQ ID NO: 509793 - RNA, 15 nt, Chlamydophila pneumoniae CWL029
ucaagccacagagaa

SEQ ID NO: 509794 - RNA, 16 nt, Chlamydophila pneumoniae CWL029
ucaagccacagagaau

SEQ ID NO: 509795 - RNA, 15 nt, Chlamydophila pneumoniae CWL029
ucaagauaaauccca

SEQ ID NO: 509796 - RNA, 13 nt, Chlamydophila pneumoniae CWL029
ucaagaucuucau

SEQ ID NO: 509797 - RNA, 18 nt, Chlamydophila pneumoniae CWL029
ucaagaucuucaucacaa

SEQ ID NO: 509798 - RNA, 20 nt, Chlamydophila pneumoniae CWL029
ucaaggccuauagauuuugu

SEQ ID NO: 509799 - RNA, 15 nt, Chlamydophila pneumoniae CWL029
ucaaggaacauuuga

SEQ ID NO: 509800 - RNA, 19 nt, Chlamydophila pneumoniae CWL029
ucaaggaucuuauauaaaa

SEQ ID NO: 509801 - RNA, 19 nt, Chlamydophila pneumoniae CWL029
ucaagcuauagauuuugga

SEQ ID NO: 509802 - RNA, 21 nt, Chlamydophila pneumoniae CWL029
ucaagcuauagauuuuggaga

SEQ ID NO: 509803 - RNA, 15 nt, Chlamydophila pneumoniae CWL029
ucaagguacuuuaua

SEQ ID NO: 509804 - RNA, 21 nt, Chlamydophila pneumoniae CWL029
ucaagguacuuuauagaaagu

SEQ ID NO: 509805 - RNA, 14 nt, Chlamydophila pneumoniae CWL029
ucaaguaagaaguc

SEQ ID NO: 509806 - RNA, 22 nt, Chlamydophila pneumoniae CWL029
ucaaaucucauuccagcaucuu

SEQ ID NO: 509807 - RNA, 18 nt, Chlamydophila pneumoniae CWL029
ucaaaucuuucaaggaac

SEQ ID NO: 509808 - RNA, 22 nt, Chlamydophila pneumoniae CWL029
ucaaaucuuucaaggaacauuu

SEQ ID NO: 509809 - RNA, 21 nt, Chlamydophila pneumoniae CWL029
ucaagagauagagauaaguca

SEQ ID NO: 509810 - RNA, 17 nt, Chlamydophila pneumoniae CWL029
ucaagacgacacucaaa

SEQ ID NO: 509811 - RNA, 20 nt, Chlamydophila pneumoniae CWL029
ucaagacgacacucaaaucu

SEQ ID NO: 509812 - RNA, 15 nt, Chlamydophila pneumoniae CWL029
ucaagagcuuuuaca

SEQ ID NO: 509813 - RNA, 18 nt, Chlamydophila pneumoniae CWL029
ucaagaguaggcaauaca

SEQ ID NO: 509814 - RNA, 22 nt, Chlamydophila pneumoniae CWL029
ucaagaauuucuucuuuccaua

SEQ ID NO: 509815 - RNA, 17 nt, Chlamydophila pneumoniae CWL029
ucaagaauaugaacugc

SEQ ID NO: 509816 - RNA, 19 nt, Chlamydophila pneumoniae CWL029
ucaagaauaugaacugccu

SEQ ID NO: 509817 - RNA, 22 nt, Chlamydophila pneumoniae CWL029
ucaagaccuaagcucauaagaa

SEQ ID NO: 509818 - RNA, 23 nt, Chlamydophila pneumoniae CWL029
ucaagaccuaagcucauaagaaa

SEQ ID NO: 509819 - RNA, 14 nt, Chlamydophila pneumoniae CWL029
ucaagaaauucuuc

SEQ ID NO: 509820 - RNA, 13 nt, Chlamydophila pneumoniae CWL029
ucaagaacaagag

SEQ ID NO: 509821 - RNA, 18 nt, Chlamydophila pneumoniae CWL029
ucaagaacaguuugcucu

SEQ ID NO: 509822 - RNA, 15 nt, Chlamydophila pneumoniae CWL029
ucaagaacuccuuug

SEQ ID NO: 509823 - RNA, 12 nt, Chlamydophila pneumoniae CWL029
uauuucuuaauu

SEQ ID NO: 509824 - RNA, 12 nt, Chlamydophila pneumoniae CWL029
uauuucuaaaaa

SEQ ID NO: 509825 - RNA, 23 nt, Chlamydophila pneumoniae CWL029
uauuugcaacaaucuuucuucua

SEQ ID NO: 509826 - RNA, 19 nt, Chlamydophila pneumoniae CWL029
uauuugcaacaaucuuucu

SEQ ID NO: 509827 - RNA, 22 nt, Chlamydophila pneumoniae CWL029
uauuugcaacaaucuuucuucu

SEQ ID NO: 509828 - RNA, 20 nt, Chlamydophila pneumoniae CWL029
uauuugcagaagcauuguau

SEQ ID NO: 509829 - RNA, 14 nt, Chlamydophila pneumoniae CWL029
uauuuuaaagucac

SEQ ID NO: 509830 - RNA, 15 nt, Chlamydophila pneumoniae CWL029
uauuuugucuuuuua

SEQ ID NO: 509831 - RNA, 12 nt, Chlamydophila pneumoniae CWL029
uauuuuuaaaga

SEQ ID NO: 509832 - RNA, 11 nt, Chlamydophila pneumoniae CWL029
ucaaaaaguuc

SEQ ID NO: 509833 - RNA, 13 nt, Chlamydophila pneumoniae CWL029
ucaaaaauucuuc

SEQ ID NO: 509834 - RNA, 14 nt, Chlamydophila pneumoniae CWL029
ucaaaaagagagcc

SEQ ID NO: 509835 - RNA, 13 nt, Chlamydophila pneumoniae CWL029
ucaaaaagcuccc

SEQ ID NO: 509836 - RNA, 14 nt, Chlamydophila pneumoniae CWL029
ucaaagaagacacu

SEQ ID NO: 509837 - RNA, 11 nt, Chlamydophila pneumoniae CWL029
ucaaagaaguc

SEQ ID NO: 509838 - RNA, 14 nt, Chlamydophila pneumoniae CWL029
ucaaagaaagugaa

SEQ ID NO: 509839 - RNA, 11 nt, Chlamydophila pneumoniae CWL029
ucaaagaacaa

SEQ ID NO: 509840 - RNA, 19 nt, Chlamydophila pneumoniae CWL029
ucaaagaacaauaaaaggc

SEQ ID NO: 509841 - RNA, 15 nt, Chlamydophila pneumoniae CWL029
ucaaaaucacauuuu

SEQ ID NO: 509842 - RNA, 22 nt, Chlamydophila pneumoniae CWL029
ucaaaaucaaaguauauauuuu

SEQ ID NO: 509843 - RNA, 17 nt, Chlamydophila pneumoniae CWL029
ucaaaagguuuuauaaa

SEQ ID NO: 509844 - RNA, 22 nt, Chlamydophila pneumoniae CWL029
ucaaagucaaauacuucuccug

SEQ ID NO: 509845 - RNA, 19 nt, Chlamydophila pneumoniae CWL029
ucaaagacaggcucaugaa

SEQ ID NO: 509846 - RNA, 21 nt, Chlamydophila pneumoniae CWL029
ucaaagacucaugaaauagug

SEQ ID NO: 509847 - RNA, 12 nt, Chlamydophila pneumoniae CWL029
ucaaagauauaa

SEQ ID NO: 509848 - RNA, 16 nt, Chlamydophila pneumoniae CWL029
uauugaagucuucuug

SEQ ID NO: 509849 - RNA, 13 nt, Chlamydophila pneumoniae CWL029
uauugauagcuga

SEQ ID NO: 509850 - RNA, 13 nt, Chlamydophila pneumoniae CWL029
uauugcucuugua

SEQ ID NO: 509851 - RNA, 20 nt, Chlamydophila pneumoniae CWL029
uauugcgaacuuuugggccc

SEQ ID NO: 509852 - RNA, 16 nt, Chlamydophila pneumoniae CWL029
uauugguguaucucuu

SEQ ID NO: 509853 - RNA, 19 nt, Chlamydophila pneumoniae CWL029
uauuuaaauauaaauuuau

SEQ ID NO: 509854 - RNA, 16 nt, Chlamydophila pneumoniae CWL029
uauuuacgaaaacauc

SEQ ID NO: 509855 - RNA, 18 nt, Chlamydophila pneumoniae CWL029
uauuuagagagaaacauc

SEQ ID NO: 509856 - RNA, 17 nt, Chlamydophila pneumoniae CWL029
uauuuagcauuucucua

SEQ ID NO: 509857 - RNA, 21 nt, Chlamydophila pneumoniae CWL029
uauuucauauaaaguuuccaa

SEQ ID NO: 509858 - RNA, 18 nt, Chlamydophila pneumoniae CWL029
uauucucuucauuuucuu

SEQ ID NO: 509859 - RNA, 17 nt, Chlamydophila pneumoniae CWL029
uauucugauaaucagag

SEQ ID NO: 509860 - RNA, 17 nt, Chlamydophila pneumoniae CWL029
uauucucgaaaaauuug

SEQ ID NO: 509861 - RNA, 13 nt, Chlamydophila pneumoniae CWL029
uauucucaggaac

SEQ ID NO: 509862 - RNA, 22 nt, Chlamydophila pneumoniae CWL029
uauuccauaaaaauguaauuuu

SEQ ID NO: 509863 - RNA, 14 nt, Chlamydophila pneumoniae CWL029
uauuccaucacagu

SEQ ID NO: 509864 - RNA, 17 nt, Chlamydophila pneumoniae CWL029
uauuccuuggauuucuu

SEQ ID NO: 509865 - RNA, 19 nt, Chlamydophila pneumoniae CWL029
uauuccuuggauuucuucu

SEQ ID NO: 509866 - RNA, 17 nt, Chlamydophila pneumoniae CWL029
uauuccaucacaguuaa

SEQ ID NO: 509867 - RNA, 13 nt, Chlamydophila pneumoniae CWL029
uauuccucuuagg

SEQ ID NO: 509868 - RNA, 15 nt, Chlamydophila pneumoniae CWL029
uauuccaucacaguu

SEQ ID NO: 509869 - RNA, 22 nt, Chlamydophila pneumoniae CWL029
uauucagugucuugaagagauu

SEQ ID NO: 509870 - RNA, 22 nt, Chlamydophila pneumoniae CWL029
uauccauggaauggcuacuuua

SEQ ID NO: 509871 - RNA, 21 nt, Chlamydophila pneumoniae CWL029
uauccgacucuguuuccuugu

SEQ ID NO: 509872 - RNA, 20 nt, Chlamydophila pneumoniae CWL029
ucuacacuguuguaauaaaa

SEQ ID NO: 509873 - RNA, 18 nt, Chlamydophila pneumoniae CWL029
ucuacaccauagaacugc

SEQ ID NO: 509874 - RNA, 23 nt, Chlamydophila pneumoniae CWL029
ucuacaaugauauaaaagcugaa

SEQ ID NO: 509875 - RNA, 12 nt, Chlamydophila pneumoniae CWL029
ucuacaaaugcg

SEQ ID NO: 509876 - RNA, 19 nt, Chlamydophila pneumoniae CWL029
ucuacaaacagauuuuuca

SEQ ID NO: 509877 - RNA, 18 nt, Chlamydophila pneumoniae CWL029
ucuacaaaaacuagaaua

SEQ ID NO: 509878 - RNA, 18 nt, Chlamydophila pneumoniae CWL029
ucuacaugcucaagaaga

SEQ ID NO: 509879 - RNA, 15 nt, Chlamydophila pneumoniae CWL029
ucuaccaacugagcu

SEQ ID NO: 509880 - RNA, 17 nt, Chlamydophila pneumoniae CWL029
ucuacaucccaagggcc

SEQ ID NO: 509881 - RNA, 22 nt, Chlamydophila pneumoniae CWL029
ucuacagauaggguaagauugc

SEQ ID NO: 509882 - RNA, 16 nt, Chlamydophila pneumoniae CWL029
ucuacagcuauagaag

SEQ ID NO: 509883 - RNA, 20 nt, Chlamydophila pneumoniae CWL029
ucuacaggauauugcggaaa

SEQ ID NO: 509884 - RNA, 12 nt, Chlamydophila pneumoniae CWL029
ucuaauuucagg

SEQ ID NO: 509885 - RNA, 16 nt, Chlamydophila pneumoniae CWL029
ucuaaugguuucccac

SEQ ID NO: 509886 - RNA, 21 nt, Chlamydophila pneumoniae CWL029
ucuacccuucagaauucucaa

SEQ ID NO: 509887 - RNA, 12 nt, Chlamydophila pneumoniae CWL029
aaaugagagacg

SEQ ID NO: 509888 - RNA, 12 nt, Chlamydophila pneumoniae CWL029
aaaugagaggga

SEQ ID NO: 509889 - RNA, 18 nt, Chlamydophila pneumoniae CWL029
aaaugaggacacaacucu

SEQ ID NO: 509890 - RNA, 19 nt, Chlamydophila pneumoniae CWL029
aaaugaggacacaacucuu

SEQ ID NO: 509891 - RNA, 16 nt, Chlamydophila pneumoniae CWL029
ucuacucuuuaaaaau

SEQ ID NO: 509892 - RNA, 22 nt, Chlamydophila pneumoniae CWL029
ucuacugaaaccuucucucuua

SEQ ID NO: 509893 - RNA, 22 nt, Chlamydophila pneumoniae CWL029
ucuacuaggcgcauaugcucca

SEQ ID NO: 509894 - RNA, 24 nt, Chlamydophila pneumoniae CWL029
ucuacuaggcgcauaugcuccaga

SEQ ID NO: 509895 - RNA, 15 nt, Chlamydophila pneumoniae CWL029
ucuacgccaucccau

SEQ ID NO: 509896 - RNA, 17 nt, Chlamydophila pneumoniae CWL029
ucuacgcggagaaugcu

SEQ ID NO: 509897 - RNA, 16 nt, Chlamydophila pneumoniae CWL029
ucuacgauguuuucuu

SEQ ID NO: 509898 - RNA, 23 nt, Chlamydophila pneumoniae CWL029
ucuacgauguuuucuuauccuug

SEQ ID NO: 509899 - RNA, 19 nt, Chlamydophila pneumoniae CWL029
ucuaaacauaaagacccuu

SEQ ID NO: 509900 - RNA, 16 nt, Chlamydophila pneumoniae CWL029
ucuaaaaugaaauacu

SEQ ID NO: 509901 - RNA, 19 nt, Chlamydophila pneumoniae CWL029
ucuaaaacaucagcaacau

SEQ ID NO: 509902 - RNA, 20 nt, Chlamydophila pneumoniae CWL029
ucuaaaagcaaguuguugau

SEQ ID NO: 509903 - RNA, 19 nt, Chlamydophila pneumoniae CWL029
ucuaaaagcacuuaaaaaa

SEQ ID NO: 509904 - RNA, 17 nt, Chlamydophila pneumoniae CWL029
ucuaaaaaagauaaagc

SEQ ID NO: 509905 - RNA, 17 nt, Chlamydophila pneumoniae CWL029
ucuaaagguuuuaaauu

SEQ ID NO: 509906 - RNA, 16 nt, Chlamydophila pneumoniae CWL029
ucuaaauagaaaacau

SEQ ID NO: 509907 - RNA, 15 nt, Chlamydophila pneumoniae CWL029
ucuaaagaaauguaa

SEQ ID NO: 509908 - RNA, 13 nt, Chlamydophila pneumoniae CWL029
aaaugaagccaaa

SEQ ID NO: 509909 - RNA, 18 nt, Chlamydophila pneumoniae CWL029
aaaugaagagcuuccauu

SEQ ID NO: 509910 - RNA, 16 nt, Chlamydophila pneumoniae CWL029
aaaucuuucaauguaa

SEQ ID NO: 509911 - RNA, 19 nt, Chlamydophila pneumoniae CWL029
aaaucuuccccuaaaaauu

SEQ ID NO: 509912 - RNA, 16 nt, Chlamydophila pneumoniae CWL029
aaaucuuccccuaaaa

SEQ ID NO: 509913 - RNA, 17 nt, Chlamydophila pneumoniae CWL029
ucuaagcgcucuucaau

SEQ ID NO: 509914 - RNA, 16 nt, Chlamydophila pneumoniae CWL029
ucuaagcuuauuucug

SEQ ID NO: 509915 - RNA, 12 nt, Chlamydophila pneumoniae CWL029
ucuaaggaaauu

SEQ ID NO: 509916 - RNA, 20 nt, Chlamydophila pneumoniae CWL029
ucuaaggacaaaucucccaa

SEQ ID NO: 509917 - RNA, 19 nt, Chlamydophila pneumoniae CWL029
ucuaaggcauuggaaaucu

SEQ ID NO: 509918 - RNA, 16 nt, Chlamydophila pneumoniae CWL029
aaaucuuaguccauga

SEQ ID NO: 509919 - RNA, 14 nt, Chlamydophila pneumoniae CWL029
ucuaagaucuuuug

SEQ ID NO: 509920 - RNA, 22 nt, Chlamydophila pneumoniae CWL029
ucuaagaaacuuccaaaacgau

SEQ ID NO: 509921 - RNA, 19 nt, Chlamydophila pneumoniae CWL029
ucuaagagaucuacaaaca

SEQ ID NO: 509922 - RNA, 18 nt, Chlamydophila pneumoniae CWL029
ucuaagaaucguucuuag

SEQ ID NO: 509923 - RNA, 15 nt, Chlamydophila pneumoniae CWL029
ucuaagaaaaugaau

SEQ ID NO: 509924 - RNA, 21 nt, Chlamydophila pneumoniae CWL029
ucuaacgcuuuuucaaacugu

SEQ ID NO: 509925 - RNA, 21 nt, Chlamydophila pneumoniae CWL029
ucuaacucuaaucugauucaa

SEQ ID NO: 509926 - RNA, 14 nt, Chlamydophila pneumoniae CWL029
ucuaacucuuguag

SEQ ID NO: 509927 - RNA, 21 nt, Chlamydophila pneumoniae CWL029
aaaugccucuuucauacuaaa

SEQ ID NO: 509928 - RNA, 17 nt, Chlamydophila pneumoniae CWL029
aaaugccuuaaauguau

SEQ ID NO: 509929 - RNA, 19 nt, Chlamydophila pneumoniae CWL029
aaaugccuuaaauguauug

SEQ ID NO: 509930 - RNA, 12 nt, Chlamydophila pneumoniae CWL029
aaaugccuguac

SEQ ID NO: 509931 - RNA, 15 nt, Chlamydophila pneumoniae CWL029
ucucacucuuuucua

SEQ ID NO: 509932 - RNA, 11 nt, Chlamydophila pneumoniae CWL029
ucucacugagu

SEQ ID NO: 509933 - RNA, 16 nt, Chlamydophila pneumoniae CWL029
ucucacuggcuccuaa

SEQ ID NO: 509934 - RNA, 17 nt, Chlamydophila pneumoniae CWL029
ucucaguaggagcagcg

SEQ ID NO: 509935 - RNA, 17 nt, Chlamydophila pneumoniae CWL029
ucucaguuaaagagcau

SEQ ID NO: 509936 - RNA, 13 nt, Chlamydophila pneumoniae CWL029
ucucagaaagccu

SEQ ID NO: 509937 - RNA, 18 nt, Chlamydophila pneumoniae CWL029
ucucagaaagccuuugcu

SEQ ID NO: 509938 - RNA, 21 nt, Chlamydophila pneumoniae CWL029
ucucagaaagccuuugcucac

SEQ ID NO: 509939 - RNA, 20 nt, Chlamydophila pneumoniae CWL029
ucuauuucauauaaaguuuc

SEQ ID NO: 509940 - RNA, 14 nt, Chlamydophila pneumoniae CWL029
ucuauuuucaggag

SEQ ID NO: 509941 - RNA, 15 nt, Chlamydophila pneumoniae CWL029
ucucaacgcaauagg

SEQ ID NO: 509942 - RNA, 16 nt, Chlamydophila pneumoniae CWL029
ucucaacgcaauagga

SEQ ID NO: 509943 - RNA, 20 nt, Chlamydophila pneumoniae CWL029
ucucaagaguaggcaauaca

SEQ ID NO: 509944 - RNA, 22 nt, Chlamydophila pneumoniae CWL029
ucucaaggaucuuauauaaaac

SEQ ID NO: 509945 - RNA, 17 nt, Chlamydophila pneumoniae CWL029
ucucaaguaagaagucu

SEQ ID NO: 509946 - RNA, 13 nt, Chlamydophila pneumoniae CWL029
ucucaauaauaga

SEQ ID NO: 509947 - RNA, 21 nt, Chlamydophila pneumoniae CWL029
ucuauacgcuuaacaugaaaa

SEQ ID NO: 509948 - RNA, 12 nt, Chlamydophila pneumoniae CWL029
ucuauagaguag

SEQ ID NO: 509949 - RNA, 16 nt, Chlamydophila pneumoniae CWL029
ucuauagaguagcuca

SEQ ID NO: 509950 - RNA, 16 nt, Chlamydophila pneumoniae CWL029
ucuauagaucuugaaa

SEQ ID NO: 509951 - RNA, 13 nt, Chlamydophila pneumoniae CWL029
ucuauauauccug

SEQ ID NO: 509952 - RNA, 14 nt, Chlamydophila pneumoniae CWL029
ucuauauauccuga

SEQ ID NO: 509953 - RNA, 15 nt, Chlamydophila pneumoniae CWL029
ucuauauauccugag

SEQ ID NO: 509954 - RNA, 18 nt, Chlamydophila pneumoniae CWL029
ucuauauccacaaucucu

SEQ ID NO: 509955 - RNA, 15 nt, Chlamydophila pneumoniae CWL029
ucuauaaauguaggg

SEQ ID NO: 509956 - RNA, 13 nt, Chlamydophila pneumoniae CWL029
ucuauaaauucaa

SEQ ID NO: 509957 - RNA, 22 nt, Chlamydophila pneumoniae CWL029
ucuauacagacaagcaaggaaa

SEQ ID NO: 509958 - RNA, 18 nt, Chlamydophila pneumoniae CWL029
ucuauaauuaauccuuga

SEQ ID NO: 509959 - RNA, 16 nt, Chlamydophila pneumoniae CWL029
aaaugcauuugccccu

SEQ ID NO: 509960 - RNA, 19 nt, Chlamydophila pneumoniae CWL029
ucuaugagaguaaguuuuu

SEQ ID NO: 509961 - RNA, 22 nt, Chlamydophila pneumoniae CWL029
ucuaugauccaauagccaaaga

SEQ ID NO: 509962 - RNA, 22 nt, Chlamydophila pneumoniae CWL029
ucuaugauaucaccagguccuu

SEQ ID NO: 509963 - RNA, 19 nt, Chlamydophila pneumoniae CWL029
ucuaugccauaaauacagg

SEQ ID NO: 509964 - RNA, 14 nt, Chlamydophila pneumoniae CWL029
ucuauguguucucg

SEQ ID NO: 509965 - RNA, 22 nt, Chlamydophila pneumoniae CWL029
ucuauggucucccucacaagaa

SEQ ID NO: 509966 - RNA, 16 nt, Chlamydophila pneumoniae CWL029
ucuaucuuuauuuaaa

SEQ ID NO: 509967 - RNA, 13 nt, Chlamydophila pneumoniae CWL029
ucuauccaucauc

SEQ ID NO: 509968 - RNA, 23 nt, Chlamydophila pneumoniae CWL029
ucuagcauaguguuccaaaacag

SEQ ID NO: 509969 - RNA, 13 nt, Chlamydophila pneumoniae CWL029
ucuagauuuugag

SEQ ID NO: 509970 - RNA, 13 nt, Chlamydophila pneumoniae CWL029
ucuagcaaaucua

SEQ ID NO: 509971 - RNA, 13 nt, Chlamydophila pneumoniae CWL029
ucuagaucuucaa

SEQ ID NO: 509972 - RNA, 20 nt, Chlamydophila pneumoniae CWL029
ucuagauauucugauucucc

SEQ ID NO: 509973 - RNA, 15 nt, Chlamydophila pneumoniae CWL029
ucuagagauuuuucu

SEQ ID NO: 509974 - RNA, 16 nt, Chlamydophila pneumoniae CWL029
ucuagacaacaaauug

SEQ ID NO: 509975 - RNA, 12 nt, Chlamydophila pneumoniae CWL029
ucuagaagauga

SEQ ID NO: 509976 - RNA, 17 nt, Chlamydophila pneumoniae CWL029
ucuagaaugaugcaagc

SEQ ID NO: 509977 - RNA, 17 nt, Chlamydophila pneumoniae CWL029
ucuagaaagauuuauuu

SEQ ID NO: 509978 - RNA, 23 nt, Chlamydophila pneumoniae CWL029
ucuagaaacaacugaaaaaccau

SEQ ID NO: 509979 - RNA, 21 nt, Chlamydophila pneumoniae CWL029
ucuagaaaaauucuuuaggga

SEQ ID NO: 509980 - RNA, 18 nt, Chlamydophila pneumoniae CWL029
ucuagaaaagauucuaaa

SEQ ID NO: 509981 - RNA, 22 nt, Chlamydophila pneumoniae CWL029
ucuagaaaagauucuaaaucaa

SEQ ID NO: 509982 - RNA, 17 nt, Chlamydophila pneumoniae CWL029
ucuagguuucaggaaau

SEQ ID NO: 509983 - RNA, 15 nt, Chlamydophila pneumoniae CWL029
ucuagguuuucucuu

SEQ ID NO: 509984 - RNA, 14 nt, Chlamydophila pneumoniae CWL029
ucuaguucuagaaa

SEQ ID NO: 509985 - RNA, 18 nt, Chlamydophila pneumoniae CWL029
ucuagggacguuguaucc

SEQ ID NO: 509986 - RNA, 12 nt, Chlamydophila pneumoniae CWL029
ucuaggagcuuc

SEQ ID NO: 509987 - RNA, 15 nt, Chlamydophila pneumoniae CWL029
ucuagcuaauaauga

SEQ ID NO: 509988 - RNA, 21 nt, Chlamydophila pneumoniae CWL029
aaaugcaguucuuguuaaagu

SEQ ID NO: 509989 - RNA, 20 nt, Chlamydophila pneumoniae CWL029
ucugcagguaagggaugcuc

SEQ ID NO: 509990 - RNA, 21 nt, Chlamydophila pneumoniae CWL029
ucugcauauaaagacucucuu

SEQ ID NO: 509991 - RNA, 16 nt, Chlamydophila pneumoniae CWL029
ucugcauauugcucuu

SEQ ID NO: 509992 - RNA, 22 nt, Chlamydophila pneumoniae CWL029
ucugcuucuccaaauaaagcaa

SEQ ID NO: 509993 - RNA, 22 nt, Chlamydophila pneumoniae CWL029
ucugcuucuguaaagauucuau

SEQ ID NO: 509994 - RNA, 23 nt, Chlamydophila pneumoniae CWL029
ucugggaagacucucaucagcaa

SEQ ID NO: 509995 - RNA, 16 nt, Chlamydophila pneumoniae CWL029
ucugugcaucagucag

SEQ ID NO: 509996 - RNA, 20 nt, Chlamydophila pneumoniae CWL029
ucugugguuuuuauucuuaa

SEQ ID NO: 509997 - RNA, 12 nt, Chlamydophila pneumoniae CWL029
ucuguguagccg

SEQ ID NO: 509998 - RNA, 13 nt, Chlamydophila pneumoniae CWL029
ucugugagaaaua

SEQ ID NO: 509999 - RNA, 14 nt, Chlamydophila pneumoniae CWL029
ucugugagaaauag

SEQ ID NO: 510000 - RNA, 22 nt, Chlamydophila pneumoniae CWL029
ucugucauuaaaaauuuaaaag

SEQ ID NO: 510001 - RNA, 14 nt, Chlamydophila pneumoniae CWL029
ucugucacuagaga

SEQ ID NO: 510002 - RNA, 23 nt, Chlamydophila pneumoniae CWL029
ucuguauccuuccuuauugguaa

SEQ ID NO: 510003 - RNA, 23 nt, Chlamydophila pneumoniae CWL029
ucugguuuuucgauuuggaagau

SEQ ID NO: 510004 - RNA, 19 nt, Chlamydophila pneumoniae CWL029
ucuguaaagugaaauugaa

SEQ ID NO: 510005 - RNA, 20 nt, Chlamydophila pneumoniae CWL029
ucuguaagaaaaugaggaca

SEQ ID NO: 510006 - RNA, 18 nt, Chlamydophila pneumoniae CWL029
ucuguaauauucaacaug

SEQ ID NO: 510007 - RNA, 17 nt, Chlamydophila pneumoniae CWL029
ucuguaauuuuuuucaa

SEQ ID NO: 510008 - RNA, 16 nt, Chlamydophila pneumoniae CWL029
ucuuccaaagacugag

SEQ ID NO: 510009 - RNA, 18 nt, Chlamydophila pneumoniae CWL029
ucuuccaaagacugagcu

SEQ ID NO: 510010 - RNA, 16 nt, Chlamydophila pneumoniae CWL029
ucuucggaucuguaau

SEQ ID NO: 510011 - RNA, 17 nt, Chlamydophila pneumoniae CWL029
ucuuccuucuucuucaa

SEQ ID NO: 510012 - RNA, 14 nt, Chlamydophila pneumoniae CWL029
ucuuccugcugcuu

SEQ ID NO: 510013 - RNA, 20 nt, Chlamydophila pneumoniae CWL029
ucuuccugaaucagcuuauc

SEQ ID NO: 510014 - RNA, 17 nt, Chlamydophila pneumoniae CWL029
ucuucccagguaaacaa

SEQ ID NO: 510015 - RNA, 13 nt, Chlamydophila pneumoniae CWL029
ucuuccauaagau

SEQ ID NO: 510016 - RNA, 23 nt, Chlamydophila pneumoniae CWL029
ucuuaccuaguagagguugagug

SEQ ID NO: 510017 - RNA, 21 nt, Chlamydophila pneumoniae CWL029
ucuuaguaaagaaucacucuc

SEQ ID NO: 510018 - RNA, 17 nt, Chlamydophila pneumoniae CWL029
ucuguuaaaaacaagau

SEQ ID NO: 510019 - RNA, 16 nt, Chlamydophila pneumoniae CWL029
ucuucaauaucuugaa

SEQ ID NO: 510020 - RNA, 22 nt, Chlamydophila pneumoniae CWL029
ucuucaagguacugcucaauga

SEQ ID NO: 510021 - RNA, 11 nt, Chlamydophila pneumoniae CWL029
ucuucaagaaa

SEQ ID NO: 510022 - RNA, 13 nt, Chlamydophila pneumoniae CWL029
ucuucaagagcuu

SEQ ID NO: 510023 - RNA, 14 nt, Chlamydophila pneumoniae CWL029
ucuuaucuggagau

SEQ ID NO: 510024 - RNA, 18 nt, Chlamydophila pneumoniae CWL029
ucuuaugaaguccagacu

SEQ ID NO: 510025 - RNA, 14 nt, Chlamydophila pneumoniae CWL029
ucuuaugaccaaga

SEQ ID NO: 510026 - RNA, 17 nt, Chlamydophila pneumoniae CWL029
ucuuauagggaauuuuu

SEQ ID NO: 510027 - RNA, 21 nt, Chlamydophila pneumoniae CWL029
ucucuugccaaugcauuuguu

SEQ ID NO: 510028 - RNA, 20 nt, Chlamydophila pneumoniae CWL029
ucucuugaagcacuuugacu

SEQ ID NO: 510029 - RNA, 22 nt, Chlamydophila pneumoniae CWL029
ucucuugauuccuuaagucguc

SEQ ID NO: 510030 - RNA, 15 nt, Chlamydophila pneumoniae CWL029
ucucuucucuguugg

SEQ ID NO: 510031 - RNA, 19 nt, Chlamydophila pneumoniae CWL029
ucucuggcauaauccugaa

SEQ ID NO: 510032 - RNA, 16 nt, Chlamydophila pneumoniae CWL029
ucucugccuaccaaag

SEQ ID NO: 510033 - RNA, 19 nt, Chlamydophila pneumoniae CWL029
ucucugauucucauaaagg

SEQ ID NO: 510034 - RNA, 13 nt, Chlamydophila pneumoniae CWL029
ucucucuuuccuu

SEQ ID NO: 510035 - RNA, 14 nt, Chlamydophila pneumoniae CWL029
ucucucuuccugcu

SEQ ID NO: 510036 - RNA, 19 nt, Chlamydophila pneumoniae CWL029
ucucugaccaucaaugaga

SEQ ID NO: 510037 - RNA, 15 nt, Chlamydophila pneumoniae CWL029
ucucgugcauaauga

SEQ ID NO: 510038 - RNA, 11 nt, Chlamydophila pneumoniae CWL029
ucucuaagaaa

SEQ ID NO: 510039 - RNA, 20 nt, Chlamydophila pneumoniae CWL029
ucucuaugaacgauuucuuu

SEQ ID NO: 510040 - RNA, 17 nt, Chlamydophila pneumoniae CWL029
ucucuaugcacaaaaua

SEQ ID NO: 510041 - RNA, 18 nt, Chlamydophila pneumoniae CWL029
ucucuaugcacaaaauaa

SEQ ID NO: 510042 - RNA, 19 nt, Chlamydophila pneumoniae CWL029
ucucuaugcgcucuaagag

SEQ ID NO: 510043 - RNA, 14 nt, Chlamydophila pneumoniae CWL029
ucucucaauaagau

SEQ ID NO: 510044 - RNA, 17 nt, Chlamydophila pneumoniae CWL029
ucugauagaacaggauu

SEQ ID NO: 510045 - RNA, 18 nt, Chlamydophila pneumoniae CWL029
ucugcaacaaguugcauu

SEQ ID NO: 510046 - RNA, 14 nt, Chlamydophila pneumoniae CWL029
ucugagcuugccua

SEQ ID NO: 510047 - RNA, 18 nt, Chlamydophila pneumoniae CWL029
ucugagcuugccuaccca

SEQ ID NO: 510048 - RNA, 12 nt, Chlamydophila pneumoniae CWL029
ucugcagcagau

SEQ ID NO: 510049 - RNA, 17 nt, Chlamydophila pneumoniae CWL029
ucugcaggacugucuag

SEQ ID NO: 510050 - RNA, 15 nt, Chlamydophila pneumoniae CWL029
ucugcacggauauuc

SEQ ID NO: 510051 - RNA, 23 nt, Chlamydophila pneumoniae CWL029
ucugcaauuccgaagaagaaagg

SEQ ID NO: 510052 - RNA, 13 nt, Chlamydophila pneumoniae CWL029
ucugaaacauaag

SEQ ID NO: 510053 - RNA, 19 nt, Chlamydophila pneumoniae CWL029
ucucuuuaaaaauauaucu

SEQ ID NO: 510054 - RNA, 14 nt, Chlamydophila pneumoniae CWL029
ucucuuuaaaaauu

SEQ ID NO: 510055 - RNA, 19 nt, Chlamydophila pneumoniae CWL029
ucucuuuaacuucuaaaag

SEQ ID NO: 510056 - RNA, 17 nt, Chlamydophila pneumoniae CWL029
ucugacaauaacaugcg

SEQ ID NO: 510057 - RNA, 22 nt, Chlamydophila pneumoniae CWL029
ucugacaauaacaugcgcagaa

SEQ ID NO: 510058 - RNA, 22 nt, Chlamydophila pneumoniae CWL029
ucugacauuccuuaauuacucg

SEQ ID NO: 510059 - RNA, 17 nt, Chlamydophila pneumoniae CWL029
ucucgaaauccuaaaaa

SEQ ID NO: 510060 - RNA, 19 nt, Chlamydophila pneumoniae CWL029
ucucgaacucugaaguaca

SEQ ID NO: 510061 - RNA, 13 nt, Chlamydophila pneumoniae CWL029
ucucgaagaaaau

SEQ ID NO: 510062 - RNA, 19 nt, Chlamydophila pneumoniae CWL029
ucuccuucuggaugcccug

SEQ ID NO: 510063 - RNA, 12 nt, Chlamydophila pneumoniae CWL029
ucucgaagcuug

SEQ ID NO: 510064 - RNA, 21 nt, Chlamydophila pneumoniae CWL029
ucucgacacuauguguuuccu

SEQ ID NO: 510065 - RNA, 22 nt, Chlamydophila pneumoniae CWL029
ucucgacacuauguguuuccuu

SEQ ID NO: 510066 - RNA, 15 nt, Chlamydophila pneumoniae CWL029
ucuccuugauuuggg

SEQ ID NO: 510067 - RNA, 14 nt, Chlamydophila pneumoniae CWL029
ucuccuuaccaaua

SEQ ID NO: 510068 - RNA, 12 nt, Chlamydophila pneumoniae CWL029
ucuccugcaaaa

SEQ ID NO: 510069 - RNA, 23 nt, Chlamydophila pneumoniae CWL029
ucuccugcaaaaaguuucaaucu

SEQ ID NO: 510070 - RNA, 21 nt, Chlamydophila pneumoniae CWL029
ucuccuaggucuaauccccaa

SEQ ID NO: 510071 - RNA, 17 nt, Chlamydophila pneumoniae CWL029
ucuccuaaaccaucacu

SEQ ID NO: 510072 - RNA, 22 nt, Chlamydophila pneumoniae CWL029
ucuccgucccccggcucuguug

SEQ ID NO: 510073 - RNA, 19 nt, Chlamydophila pneumoniae CWL029
ucuccggaggucccucuaa

SEQ ID NO: 510074 - RNA, 17 nt, Chlamydophila pneumoniae CWL029
ucuccggaacgcagagu

SEQ ID NO: 510075 - RNA, 16 nt, Chlamydophila pneumoniae CWL029
ucuccauccucagucu

SEQ ID NO: 510076 - RNA, 17 nt, Chlamydophila pneumoniae CWL029
ucuccauccucagucuc

SEQ ID NO: 510077 - RNA, 14 nt, Chlamydophila pneumoniae CWL029
ucuccauccucagu

SEQ ID NO: 510078 - RNA, 16 nt, Chlamydophila pneumoniae CWL029
ucuccagguagcagag

SEQ ID NO: 510079 - RNA, 18 nt, Chlamydophila pneumoniae CWL029
ucuccaguaucuucucuu

SEQ ID NO: 510080 - RNA, 19 nt, Chlamydophila pneumoniae CWL029
ucucccucuaaacauaaag

SEQ ID NO: 510081 - RNA, 22 nt, Chlamydophila pneumoniae CWL029
ucucccuggucuguauuuucuu

SEQ ID NO: 510082 - RNA, 16 nt, Chlamydophila pneumoniae CWL029
ucucccuguauuaaag

SEQ ID NO: 510083 - RNA, 15 nt, Chlamydophila pneumoniae CWL029
ucucccuuaaggaaa

SEQ ID NO: 510084 - RNA, 21 nt, Chlamydophila pneumoniae CWL029
ucuccaaagagucucuugcuu

SEQ ID NO: 510085 - RNA, 16 nt, Chlamydophila pneumoniae CWL029
ucuccaaaagcucuac

SEQ ID NO: 510086 - RNA, 18 nt, Chlamydophila pneumoniae CWL029
ucuccaaaagcucuacaa

SEQ ID NO: 510087 - RNA, 17 nt, Chlamydophila pneumoniae CWL029
ucucauuccagcaucuu

SEQ ID NO: 510088 - RNA, 19 nt, Chlamydophila pneumoniae CWL029
ucucauuccagcaucuucu

SEQ ID NO: 510089 - RNA, 14 nt, Chlamydophila pneumoniae CWL029
ucucaugaaauuuu

SEQ ID NO: 510090 - RNA, 13 nt, Chlamydophila pneumoniae CWL029
ucguuauccucgu

SEQ ID NO: 510091 - RNA, 21 nt, Chlamydophila pneumoniae CWL029
ucguuauccucgucuucaaua

SEQ ID NO: 510092 - RNA, 13 nt, Chlamydophila pneumoniae CWL029
ucguucaucuguc

SEQ ID NO: 510093 - RNA, 20 nt, Chlamydophila pneumoniae CWL029
ucguuagaaaccaugaugca

SEQ ID NO: 510094 - RNA, 16 nt, Chlamydophila pneumoniae CWL029
ucguuagagaagaggu

SEQ ID NO: 510095 - RNA, 21 nt, Chlamydophila pneumoniae CWL029
ucguuuccgaucauuuuugcu

SEQ ID NO: 510096 - RNA, 23 nt, Chlamydophila pneumoniae CWL029
ucguuucgcuuugauaauagucu

SEQ ID NO: 510097 - RNA, 17 nt, Chlamydophila pneumoniae CWL029
ucguuucucuggcaaug

SEQ ID NO: 510098 - RNA, 23 nt, Chlamydophila pneumoniae CWL029
ucguuucuuugaguuaagcaaua

SEQ ID NO: 510099 - RNA, 20 nt, Chlamydophila pneumoniae CWL029
ucguugguucaaauccgacu

SEQ ID NO: 510100 - RNA, 13 nt, Chlamydophila pneumoniae CWL029
ucguuuauaacau

SEQ ID NO: 510101 - RNA, 22 nt, Chlamydophila pneumoniae CWL029
ucguugccaaucuuucauuccc

SEQ ID NO: 510102 - RNA, 19 nt, Chlamydophila pneumoniae CWL029
ucgugggaggaauccuacg

SEQ ID NO: 510103 - RNA, 21 nt, Chlamydophila pneumoniae CWL029
ucgugcuuagagccuucucau

SEQ ID NO: 510104 - RNA, 14 nt, Chlamydophila pneumoniae CWL029
ucgucuuggaaugc

SEQ ID NO: 510105 - RNA, 15 nt, Chlamydophila pneumoniae CWL029
ucgucuuuuaaagag

SEQ ID NO: 510106 - RNA, 18 nt, Chlamydophila pneumoniae CWL029
ucgucuuagaauccucua

SEQ ID NO: 510107 - RNA, 20 nt, Chlamydophila pneumoniae CWL029
ucgucuuagaauccucuauc

SEQ ID NO: 510108 - RNA, 16 nt, Chlamydophila pneumoniae CWL029
ucgucuaaagaagauu

SEQ ID NO: 510109 - RNA, 17 nt, Chlamydophila pneumoniae CWL029
ucguaaucuuuuuuaaa

SEQ ID NO: 510110 - RNA, 19 nt, Chlamydophila pneumoniae CWL029
ucguaauugcugaaaauga

SEQ ID NO: 510111 - RNA, 21 nt, Chlamydophila pneumoniae CWL029
ucguaauagcgacaugagaaa

SEQ ID NO: 510112 - RNA, 15 nt, Chlamydophila pneumoniae CWL029
ucguaauaacuauaa

SEQ ID NO: 510113 - RNA, 19 nt, Chlamydophila pneumoniae CWL029
ucguaauagcgacaugaga

SEQ ID NO: 510114 - RNA, 21 nt, Chlamydophila pneumoniae CWL029
ucguaacuuccuuuuucugcu

SEQ ID NO: 510115 - RNA, 18 nt, Chlamydophila pneumoniae CWL029
ucguaacgcuuuucuaau

SEQ ID NO: 510116 - RNA, 21 nt, Chlamydophila pneumoniae CWL029
ucguaaccacagugauuuaga

SEQ ID NO: 510117 - RNA, 16 nt, Chlamydophila pneumoniae CWL029
ucguaacgcuuuucua

SEQ ID NO: 510118 - RNA, 18 nt, Chlamydophila pneumoniae CWL029
ucguagacaacaagucuu

SEQ ID NO: 510119 - RNA, 20 nt, Chlamydophila pneumoniae CWL029
ucguagcaggcaucacuaau

SEQ ID NO: 510120 - RNA, 18 nt, Chlamydophila pneumoniae CWL029
ucguacaguuuuuuucua

SEQ ID NO: 510121 - RNA, 16 nt, Chlamydophila pneumoniae CWL029
ucguaccugcugcuuc

SEQ ID NO: 510122 - RNA, 17 nt, Chlamydophila pneumoniae CWL029
ucguacguggaaaguag

SEQ ID NO: 510123 - RNA, 15 nt, Chlamydophila pneumoniae CWL029
ucguaucuuuuugca

SEQ ID NO: 510124 - RNA, 13 nt, Chlamydophila pneumoniae CWL029
ucguauuuuccug

SEQ ID NO: 510125 - RNA, 20 nt, Chlamydophila pneumoniae CWL029
ucgucaagcucugagaaaga

SEQ ID NO: 510126 - RNA, 13 nt, Chlamydophila pneumoniae CWL029
ucgucauucugca

SEQ ID NO: 510127 - RNA, 18 nt, Chlamydophila pneumoniae CWL029
ucgguuauuuuuccagaa

SEQ ID NO: 510128 - RNA, 19 nt, Chlamydophila pneumoniae CWL029
ucgguuauuuuuccagaaa

SEQ ID NO: 510129 - RNA, 12 nt, Chlamydophila pneumoniae CWL029
ucggucuuuucu

SEQ ID NO: 510130 - RNA, 14 nt, Chlamydophila pneumoniae CWL029
ucgguagagcuaga

SEQ ID NO: 510131 - RNA, 13 nt, Chlamydophila pneumoniae CWL029
ucggggagaacac

SEQ ID NO: 510132 - RNA, 15 nt, Chlamydophila pneumoniae CWL029
ucggcuaaagaaaag

SEQ ID NO: 510133 - RNA, 22 nt, Chlamydophila pneumoniae CWL029
ucgggaauaauaggauaagaaa

SEQ ID NO: 510134 - RNA, 17 nt, Chlamydophila pneumoniae CWL029
ucggauuucaugauucc

SEQ ID NO: 510135 - RNA, 14 nt, Chlamydophila pneumoniae CWL029
ucggaugagaucca

SEQ ID NO: 510136 - RNA, 21 nt, Chlamydophila pneumoniae CWL029
ucggaucuuuucuuucuaaga

SEQ ID NO: 510137 - RNA, 19 nt, Chlamydophila pneumoniae CWL029
ucggacgauauuuagagag

SEQ ID NO: 510138 - RNA, 19 nt, Chlamydophila pneumoniae CWL029
ucggaccuacguuuucucu

SEQ ID NO: 510139 - RNA, 16 nt, Chlamydophila pneumoniae CWL029
ucggagguucgaaucc

SEQ ID NO: 510140 - RNA, 16 nt, Chlamydophila pneumoniae CWL029
ucggaguguuggggag

SEQ ID NO: 510141 - RNA, 17 nt, Chlamydophila pneumoniae CWL029
ucggagacucagagaaa

SEQ ID NO: 510142 - RNA, 21 nt, Chlamydophila pneumoniae CWL029
ucggaauuugccugaaauccu

SEQ ID NO: 510143 - RNA, 22 nt, Chlamydophila pneumoniae CWL029
ucggaaaaaauagauccugaaa

SEQ ID NO: 510144 - RNA, 18 nt, Chlamydophila pneumoniae CWL029
ucggaaaaaauagauccu

SEQ ID NO: 510145 - RNA, 21 nt, Chlamydophila pneumoniae CWL029
ucgcuaacgcagcuuuagcuu

SEQ ID NO: 510146 - RNA, 14 nt, Chlamydophila pneumoniae CWL029
ucgcuaagcaaagc

SEQ ID NO: 510147 - RNA, 16 nt, Chlamydophila pneumoniae CWL029
ucgcuacauaaaauga

SEQ ID NO: 510148 - RNA, 20 nt, Chlamydophila pneumoniae CWL029
ucgcucagaaaauguaaaaa

SEQ ID NO: 510149 - RNA, 23 nt, Chlamydophila pneumoniae CWL029
ucgcucagcuaauuuaaaugccu

SEQ ID NO: 510150 - RNA, 14 nt, Chlamydophila pneumoniae CWL029
ucgcugauaaaaua

SEQ ID NO: 510151 - RNA, 13 nt, Chlamydophila pneumoniae CWL029
ucgcucuccucuc

SEQ ID NO: 510152 - RNA, 15 nt, Chlamydophila pneumoniae CWL029
ucgcggaucuucuuc

SEQ ID NO: 510153 - RNA, 13 nt, Chlamydophila pneumoniae CWL029
ucgccucuuguca

SEQ ID NO: 510154 - RNA, 19 nt, Chlamydophila pneumoniae CWL029
ucgccuuccuuaacaacau

SEQ ID NO: 510155 - RNA, 23 nt, Chlamydophila pneumoniae CWL029
ucgccuuggguuugucuccaaau

SEQ ID NO: 510156 - RNA, 20 nt, Chlamydophila pneumoniae CWL029
ucgccuuggguuugucucca

SEQ ID NO: 510157 - RNA, 21 nt, Chlamydophila pneumoniae CWL029
uccauacccaaauuucuucug

SEQ ID NO: 510158 - RNA, 16 nt, Chlamydophila pneumoniae CWL029
ugaaguuugucguaau

SEQ ID NO: 510159 - RNA, 12 nt, Chlamydophila pneumoniae CWL029
ugaauaagauuu

SEQ ID NO: 510160 - RNA, 16 nt, Chlamydophila pneumoniae CWL029
ugaaguucucaaagac

SEQ ID NO: 510161 - RNA, 17 nt, Chlamydophila pneumoniae CWL029
ugaauaccagaagcaaa

SEQ ID NO: 510162 - RNA, 15 nt, Chlamydophila pneumoniae CWL029
ugaauaagauuuuga

SEQ ID NO: 510163 - RNA, 12 nt, Chlamydophila pneumoniae CWL029
ugaauaagcuuu

SEQ ID NO: 510164 - RNA, 20 nt, Chlamydophila pneumoniae CWL029
ugaauaagcuuuccucucca

SEQ ID NO: 510165 - RNA, 12 nt, Chlamydophila pneumoniae CWL029
ugaauaaugcau

SEQ ID NO: 510166 - RNA, 20 nt, Chlamydophila pneumoniae CWL029
ugaauaugauuuccacuugu

SEQ ID NO: 510167 - RNA, 17 nt, Chlamydophila pneumoniae CWL029
ugaauaugcuuuucaaa

SEQ ID NO: 510168 - RNA, 18 nt, Chlamydophila pneumoniae CWL029
ugaauauaguuuaaaugu

SEQ ID NO: 510169 - RNA, 20 nt, Chlamydophila pneumoniae CWL029
ugaauagcucuuuucaugau

SEQ ID NO: 510170 - RNA, 19 nt, Chlamydophila pneumoniae CWL029
ugaauaguagaguugacaa

SEQ ID NO: 510171 - RNA, 17 nt, Chlamydophila pneumoniae CWL029
ugaauaguagaguugac

SEQ ID NO: 510172 - RNA, 17 nt, Chlamydophila pneumoniae CWL029
ugaauaccguuucagga

SEQ ID NO: 510173 - RNA, 19 nt, Chlamydophila pneumoniae CWL029
ugaauaccguuucaggaaa

SEQ ID NO: 510174 - RNA, 21 nt, Chlamydophila pneumoniae CWL029
ugaauaccguuucaggaaacu

SEQ ID NO: 510175 - RNA, 23 nt, Chlamydophila pneumoniae CWL029
ugaaggggugacccagagaaugu

SEQ ID NO: 510176 - RNA, 17 nt, Chlamydophila pneumoniae CWL029
ugaagaucuccgaagac

SEQ ID NO: 510177 - RNA, 16 nt, Chlamydophila pneumoniae CWL029
ugaaccuuugguagaa

SEQ ID NO: 510178 - RNA, 22 nt, Chlamydophila pneumoniae CWL029
ugaagaacaaaaaaucaaucuu

SEQ ID NO: 510179 - RNA, 18 nt, Chlamydophila pneumoniae CWL029
ugaacuuuuguacacaga

SEQ ID NO: 510180 - RNA, 15 nt, Chlamydophila pneumoniae CWL029
ugaagagcauuuaaa

SEQ ID NO: 510181 - RNA, 17 nt, Chlamydophila pneumoniae CWL029
ugaagagucaaacuuau

SEQ ID NO: 510182 - RNA, 20 nt, Chlamydophila pneumoniae CWL029
ugaacaucgguuuccaagac

SEQ ID NO: 510183 - RNA, 19 nt, Chlamydophila pneumoniae CWL029
ugaacaaaaaggacucuuu

SEQ ID NO: 510184 - RNA, 14 nt, Chlamydophila pneumoniae CWL029
ugaaaucaaaaaaa

SEQ ID NO: 510185 - RNA, 17 nt, Chlamydophila pneumoniae CWL029
ugaaaucaaaaaaaacg

SEQ ID NO: 510186 - RNA, 12 nt, Chlamydophila pneumoniae CWL029
ugaaaucaaaaa

SEQ ID NO: 510187 - RNA, 23 nt, Chlamydophila pneumoniae CWL029
ugaaauugaauggucucgaaauc

SEQ ID NO: 510188 - RNA, 17 nt, Chlamydophila pneumoniae CWL029
ugaaauuucugaaacaa

SEQ ID NO: 510189 - RNA, 20 nt, Chlamydophila pneumoniae CWL029
ugaaauuucugaaacaaugc

SEQ ID NO: 510190 - RNA, 15 nt, Chlamydophila pneumoniae CWL029
ucuucguuuauaaca

SEQ ID NO: 510191 - RNA, 16 nt, Chlamydophila pneumoniae CWL029
ucuucguuuauaacau

SEQ ID NO: 510192 - RNA, 18 nt, Chlamydophila pneumoniae CWL029
ucuucguuuauaacauca

SEQ ID NO: 510193 - RNA, 20 nt, Chlamydophila pneumoniae CWL029
ugaaaccguaacugaggcaa

SEQ ID NO: 510194 - RNA, 21 nt, Chlamydophila pneumoniae CWL029
ucuucguaagcugcaaucuca

SEQ ID NO: 510195 - RNA, 17 nt, Chlamydophila pneumoniae CWL029
ucuucguuagagaagag

SEQ ID NO: 510196 - RNA, 19 nt, Chlamydophila pneumoniae CWL029
ugaaagaaugccauucuua

SEQ ID NO: 510197 - RNA, 22 nt, Chlamydophila pneumoniae CWL029
ugaaagauguguuuuaacaacu

SEQ ID NO: 510198 - RNA, 18 nt, Chlamydophila pneumoniae CWL029
ugaaacuuuuuuucuucu

SEQ ID NO: 510199 - RNA, 18 nt, Chlamydophila pneumoniae CWL029
ugaaaccuucucucuuaa

SEQ ID NO: 510200 - RNA, 13 nt, Chlamydophila pneumoniae CWL029
ugaaaguacagaa

SEQ ID NO: 510201 - RNA, 17 nt, Chlamydophila pneumoniae CWL029
ugaaaguacaggcucca

SEQ ID NO: 510202 - RNA, 16 nt, Chlamydophila pneumoniae CWL029
ugaaauaugagaucga

SEQ ID NO: 510203 - RNA, 16 nt, Chlamydophila pneumoniae CWL029
ugaccugcuuuuuuuc

SEQ ID NO: 510204 - RNA, 15 nt, Chlamydophila pneumoniae CWL029
ugaccaguggcagga

SEQ ID NO: 510205 - RNA, 13 nt, Chlamydophila pneumoniae CWL029
ugacaaacucuau

SEQ ID NO: 510206 - RNA, 13 nt, Chlamydophila pneumoniae CWL029
ugacaaauagaaa

SEQ ID NO: 510207 - RNA, 17 nt, Chlamydophila pneumoniae CWL029
ugacaaauagaaaggaa

SEQ ID NO: 510208 - RNA, 13 nt, Chlamydophila pneumoniae CWL029
ugacaaauuuauc

SEQ ID NO: 510209 - RNA, 14 nt, Chlamydophila pneumoniae CWL029
ugacaauaagaaaa

SEQ ID NO: 510210 - RNA, 16 nt, Chlamydophila pneumoniae CWL029
ugacaauccgcauauu

SEQ ID NO: 510211 - RNA, 18 nt, Chlamydophila pneumoniae CWL029
ugacaaucgcuguaaauu

SEQ ID NO: 510212 - RNA, 23 nt, Chlamydophila pneumoniae CWL029
ugacaaucgcuguaaauucagug

SEQ ID NO: 510213 - RNA, 21 nt, Chlamydophila pneumoniae CWL029
ugacacaacucuuaaaucgcu

SEQ ID NO: 510214 - RNA, 12 nt, Chlamydophila pneumoniae CWL029
ugacacagagaa

SEQ ID NO: 510215 - RNA, 13 nt, Chlamydophila pneumoniae CWL029
ugacacagagaac

SEQ ID NO: 510216 - RNA, 15 nt, Chlamydophila pneumoniae CWL029
ugacacggcguagag

SEQ ID NO: 510217 - RNA, 16 nt, Chlamydophila pneumoniae CWL029
ugacacucagcuccca

SEQ ID NO: 510218 - RNA, 17 nt, Chlamydophila pneumoniae CWL029
ugacacucagcucccau

SEQ ID NO: 510219 - RNA, 22 nt, Chlamydophila pneumoniae CWL029
ugacacucagcucccaugugcu

SEQ ID NO: 510220 - RNA, 15 nt, Chlamydophila pneumoniae CWL029
ugaaucacaucuaaa

SEQ ID NO: 510221 - RNA, 13 nt, Chlamydophila pneumoniae CWL029
ugaaucagcuuau

SEQ ID NO: 510222 - RNA, 13 nt, Chlamydophila pneumoniae CWL029
ugaauccuucuau

SEQ ID NO: 510223 - RNA, 23 nt, Chlamydophila pneumoniae CWL029
ugaauccaugggaucucaucaua

SEQ ID NO: 510224 - RNA, 14 nt, Chlamydophila pneumoniae CWL029
ugaaucccaucaaa

SEQ ID NO: 510225 - RNA, 20 nt, Chlamydophila pneumoniae CWL029
ugaaucucuucuguaggaac

SEQ ID NO: 510226 - RNA, 21 nt, Chlamydophila pneumoniae CWL029
ugaaucucuucuguaggaaca

SEQ ID NO: 510227 - RNA, 13 nt, Chlamydophila pneumoniae CWL029
ugaaucuucaaga

SEQ ID NO: 510228 - RNA, 22 nt, Chlamydophila pneumoniae CWL029
ugaaugaggguggaacuauccu

SEQ ID NO: 510229 - RNA, 10 nt, Chlamydophila pneumoniae CWL029
ugaaugaucc

SEQ ID NO: 510230 - RNA, 12 nt, Chlamydophila pneumoniae CWL029
ugaaugauuucc

SEQ ID NO: 510231 - RNA, 13 nt, Chlamydophila pneumoniae CWL029
ugaaugauuucca

SEQ ID NO: 510232 - RNA, 14 nt, Chlamydophila pneumoniae CWL029
ugaaugauuuccau

SEQ ID NO: 510233 - RNA, 18 nt, Chlamydophila pneumoniae CWL029
ugaaugcaacagagucag

SEQ ID NO: 510234 - RNA, 19 nt, Chlamydophila pneumoniae CWL029
ugaaugccugccaauccaa

SEQ ID NO: 510235 - RNA, 13 nt, Chlamydophila pneumoniae CWL029
ugaauuaaaaguu

SEQ ID NO: 510236 - RNA, 19 nt, Chlamydophila pneumoniae CWL029
ugaauuuuagcuccgaggc

SEQ ID NO: 510237 - RNA, 18 nt, Chlamydophila pneumoniae CWL029
ugaauuuccaaaggaaaa

SEQ ID NO: 510238 - RNA, 16 nt, Chlamydophila pneumoniae CWL029
ugauuaagaucuucgu

SEQ ID NO: 510239 - RNA, 20 nt, Chlamydophila pneumoniae CWL029
ugauguuugacuuuauguua

SEQ ID NO: 510240 - RNA, 20 nt, Chlamydophila pneumoniae CWL029
ugauguauaaaguuuguaaa

SEQ ID NO: 510241 - RNA, 18 nt, Chlamydophila pneumoniae CWL029
ugauuaguuuguuuuaau

SEQ ID NO: 510242 - RNA, 15 nt, Chlamydophila pneumoniae CWL029
ugauuagagaauccg

SEQ ID NO: 510243 - RNA, 16 nt, Chlamydophila pneumoniae CWL029
ugauuauuuaagacca

SEQ ID NO: 510244 - RNA, 21 nt, Chlamydophila pneumoniae CWL029
ugauucauaaagaggaaugaa

SEQ ID NO: 510245 - RNA, 19 nt, Chlamydophila pneumoniae CWL029
ugauuuccugacuauaaaa

SEQ ID NO: 510246 - RNA, 15 nt, Chlamydophila pneumoniae CWL029
ugauucuccgucccc

SEQ ID NO: 510247 - RNA, 13 nt, Chlamydophila pneumoniae CWL029
ugauucuguauaa

SEQ ID NO: 510248 - RNA, 21 nt, Chlamydophila pneumoniae CWL029
ugauugaaagucagcaaguca

SEQ ID NO: 510249 - RNA, 15 nt, Chlamydophila pneumoniae CWL029
ugauugcugucagaa

SEQ ID NO: 510250 - RNA, 19 nt, Chlamydophila pneumoniae CWL029
ugaugcuucuuucaaagcc

SEQ ID NO: 510251 - RNA, 18 nt, Chlamydophila pneumoniae CWL029
ugaugcccugacguuuug

SEQ ID NO: 510252 - RNA, 15 nt, Chlamydophila pneumoniae CWL029
ugaugccaagaaaua

SEQ ID NO: 510253 - RNA, 15 nt, Chlamydophila pneumoniae CWL029
ugaucuuuccucuca

SEQ ID NO: 510254 - RNA, 22 nt, Chlamydophila pneumoniae CWL029
ugaucuuuccucucaugaaauu

SEQ ID NO: 510255 - RNA, 19 nt, Chlamydophila pneumoniae CWL029
ugaucaaaauuauccagaa

SEQ ID NO: 510256 - RNA, 12 nt, Chlamydophila pneumoniae CWL029
ugauauuuucuu

SEQ ID NO: 510257 - RNA, 19 nt, Chlamydophila pneumoniae CWL029
ugauauuuuuauuuaaaau

SEQ ID NO: 510258 - RNA, 13 nt, Chlamydophila pneumoniae CWL029
ugauauuccuuga

SEQ ID NO: 510259 - RNA, 15 nt, Chlamydophila pneumoniae CWL029
ugaucagaaaugaag

SEQ ID NO: 510260 - RNA, 20 nt, Chlamydophila pneumoniae CWL029
ugaucacguggacagcggcc

SEQ ID NO: 510261 - RNA, 22 nt, Chlamydophila pneumoniae CWL029
ugauccaauagccaaagacucu

SEQ ID NO: 510262 - RNA, 21 nt, Chlamydophila pneumoniae CWL029
ugauccagcccccaggcugca

SEQ ID NO: 510263 - RNA, 16 nt, Chlamydophila pneumoniae CWL029
ugauccagcuccauaa

SEQ ID NO: 510264 - RNA, 17 nt, Chlamydophila pneumoniae CWL029
ugauccaucugcucuuu

SEQ ID NO: 510265 - RNA, 16 nt, Chlamydophila pneumoniae CWL029
ugaucucacgaacucu

SEQ ID NO: 510266 - RNA, 21 nt, Chlamydophila pneumoniae CWL029
ugaucuacaaaaacuagaaua

SEQ ID NO: 510267 - RNA, 13 nt, Chlamydophila pneumoniae CWL029
ugaucuacaaaaa

SEQ ID NO: 510268 - RNA, 16 nt, Chlamydophila pneumoniae CWL029
ugauaauuucauuaua

SEQ ID NO: 510269 - RNA, 18 nt, Chlamydophila pneumoniae CWL029
ugauaauuacagaaguuc

SEQ ID NO: 510270 - RNA, 18 nt, Chlamydophila pneumoniae CWL029
ugauaaugcaggggcuuu

SEQ ID NO: 510271 - RNA, 15 nt, Chlamydophila pneumoniae CWL029
ugagucgacaugcag

SEQ ID NO: 510272 - RNA, 22 nt, Chlamydophila pneumoniae CWL029
ugaguucuuuuguuugucuucc

SEQ ID NO: 510273 - RNA, 12 nt, Chlamydophila pneumoniae CWL029
ugaguucuuccu

SEQ ID NO: 510274 - RNA, 21 nt, Chlamydophila pneumoniae CWL029
ugaguucuuccuucuucuuca

SEQ ID NO: 510275 - RNA, 19 nt, Chlamydophila pneumoniae CWL029
ugagcuucacaucuuucuc

SEQ ID NO: 510276 - RNA, 13 nt, Chlamydophila pneumoniae CWL029
ugaggaaaggagg

SEQ ID NO: 510277 - RNA, 21 nt, Chlamydophila pneumoniae CWL029
ugaggcaaagauuuccaaucc

SEQ ID NO: 510278 - RNA, 20 nt, Chlamydophila pneumoniae CWL029
ugaggaacgcacgccaagag

SEQ ID NO: 510279 - RNA, 20 nt, Chlamydophila pneumoniae CWL029
ugaguaaaaucauaggcuau

SEQ ID NO: 510280 - RNA, 23 nt, Chlamydophila pneumoniae CWL029
ugaggcaaagauuuccaauccau

SEQ ID NO: 510281 - RNA, 20 nt, Chlamydophila pneumoniae CWL029
ugagcauccaaaaugucuuu

SEQ ID NO: 510282 - RNA, 22 nt, Chlamydophila pneumoniae CWL029
ugagcaguaauguuaacgaauu

SEQ ID NO: 510283 - RNA, 23 nt, Chlamydophila pneumoniae CWL029
ugagccaacagguucacuucauc

SEQ ID NO: 510284 - RNA, 16 nt, Chlamydophila pneumoniae CWL029
ugagcgacgacaagga

SEQ ID NO: 510285 - RNA, 22 nt, Chlamydophila pneumoniae CWL029
ugagauggucgagaaccuccac

SEQ ID NO: 510286 - RNA, 14 nt, Chlamydophila pneumoniae CWL029
ugagauugaggaua

SEQ ID NO: 510287 - RNA, 13 nt, Chlamydophila pneumoniae CWL029
ugagauucaaaag

SEQ ID NO: 510288 - RNA, 20 nt, Chlamydophila pneumoniae CWL029
ugagcagcaaaaauuguuuu

SEQ ID NO: 510289 - RNA, 20 nt, Chlamydophila pneumoniae CWL029
ugacuuuuguugcaauucca

SEQ ID NO: 510290 - RNA, 13 nt, Chlamydophila pneumoniae CWL029
ugagaaaaagaau

SEQ ID NO: 510291 - RNA, 15 nt, Chlamydophila pneumoniae CWL029
ugagaaaaguugccu

SEQ ID NO: 510292 - RNA, 20 nt, Chlamydophila pneumoniae CWL029
ugagaaaaucugcagcagau

SEQ ID NO: 510293 - RNA, 16 nt, Chlamydophila pneumoniae CWL029
ugagaaaagguaacau

SEQ ID NO: 510294 - RNA, 20 nt, Chlamydophila pneumoniae CWL029
ugagaauauggccuagcuuu

SEQ ID NO: 510295 - RNA, 22 nt, Chlamydophila pneumoniae CWL029
ugagacagacagucugugagaa

SEQ ID NO: 510296 - RNA, 14 nt, Chlamydophila pneumoniae CWL029
ugagaauuuucaug

SEQ ID NO: 510297 - RNA, 15 nt, Chlamydophila pneumoniae CWL029
ugacugcuagagucc

SEQ ID NO: 510298 - RNA, 17 nt, Chlamydophila pneumoniae CWL029
ugacuuuaugaucuccc

SEQ ID NO: 510299 - RNA, 18 nt, Chlamydophila pneumoniae CWL029
ugacuuguuucuccuauu

SEQ ID NO: 510300 - RNA, 16 nt, Chlamydophila pneumoniae CWL029
ugacuuggcuggcauc

SEQ ID NO: 510301 - RNA, 23 nt, Chlamydophila pneumoniae CWL029
ugacugcagagaaauucaugccu

SEQ ID NO: 510302 - RNA, 14 nt, Chlamydophila pneumoniae CWL029
ugaccuuuuucauu

SEQ ID NO: 510303 - RNA, 13 nt, Chlamydophila pneumoniae CWL029
ugaccuuuuucau

SEQ ID NO: 510304 - RNA, 13 nt, Chlamydophila pneumoniae CWL029
ugaccuucucaag

SEQ ID NO: 510305 - RNA, 23 nt, Chlamydophila pneumoniae CWL029
ugaccuuauaguccauaugggac

SEQ ID NO: 510306 - RNA, 21 nt, Chlamydophila pneumoniae CWL029
ugcguauagauccaagaauga

SEQ ID NO: 510307 - RNA, 16 nt, Chlamydophila pneumoniae CWL029
ugcgcucggauuucau

SEQ ID NO: 510308 - RNA, 14 nt, Chlamydophila pneumoniae CWL029
ugcgcuaucaucau

SEQ ID NO: 510309 - RNA, 17 nt, Chlamydophila pneumoniae CWL029
ugcggaccuuaagauga

SEQ ID NO: 510310 - RNA, 18 nt, Chlamydophila pneumoniae CWL029
ugcgcaguggacggggag

SEQ ID NO: 510311 - RNA, 18 nt, Chlamydophila pneumoniae CWL029
ugcgcagcucggauggac

SEQ ID NO: 510312 - RNA, 22 nt, Chlamydophila pneumoniae CWL029
ugcgcagcuucuggagaaaaaa

SEQ ID NO: 510313 - RNA, 23 nt, Chlamydophila pneumoniae CWL029
ugcgcagcuucuggagaaaaaau

SEQ ID NO: 510314 - RNA, 22 nt, Chlamydophila pneumoniae CWL029
ugcgauugccggcuaugaggaa

SEQ ID NO: 510315 - RNA, 18 nt, Chlamydophila pneumoniae CWL029
ugccucaggucugcugag

SEQ ID NO: 510316 - RNA, 15 nt, Chlamydophila pneumoniae CWL029
ugccgugcucuuaug

SEQ ID NO: 510317 - RNA, 15 nt, Chlamydophila pneumoniae CWL029
ugccgagaauacaga

SEQ ID NO: 510318 - RNA, 22 nt, Chlamydophila pneumoniae CWL029
ugcccuucguaacgcuuuucua

SEQ ID NO: 510319 - RNA, 18 nt, Chlamydophila pneumoniae CWL029
ugcccuacaauuuccuug

SEQ ID NO: 510320 - RNA, 21 nt, Chlamydophila pneumoniae CWL029
ugcccauugaccugcuuuuuu

SEQ ID NO: 510321 - RNA, 12 nt, Chlamydophila pneumoniae CWL029
ugcccacuucua

SEQ ID NO: 510322 - RNA, 20 nt, Chlamydophila pneumoniae CWL029
ugccaugcccacagaccaaa

SEQ ID NO: 510323 - RNA, 19 nt, Chlamydophila pneumoniae CWL029
ugccauucuuaucugcugg

SEQ ID NO: 510324 - RNA, 13 nt, Chlamydophila pneumoniae CWL029
ugcccaaacauca

SEQ ID NO: 510325 - RNA, 14 nt, Chlamydophila pneumoniae CWL029
ugcccaaggaaaaa

SEQ ID NO: 510326 - RNA, 19 nt, Chlamydophila pneumoniae CWL029
ugcccacacccuuuaaguu

SEQ ID NO: 510327 - RNA, 19 nt, Chlamydophila pneumoniae CWL029
ugccaggagagcuaacagc

SEQ ID NO: 510328 - RNA, 13 nt, Chlamydophila pneumoniae CWL029
ugccagcccaugu

SEQ ID NO: 510329 - RNA, 11 nt, Chlamydophila pneumoniae CWL029
ugccagcagaa

SEQ ID NO: 510330 - RNA, 15 nt, Chlamydophila pneumoniae CWL029
ugccagcagcgagga

SEQ ID NO: 510331 - RNA, 14 nt, Chlamydophila pneumoniae CWL029
ugccauaaauacag

SEQ ID NO: 510332 - RNA, 18 nt, Chlamydophila pneumoniae CWL029
ugccauaaguccaugcua

SEQ ID NO: 510333 - RNA, 13 nt, Chlamydophila pneumoniae CWL029
ugccaaauccucc

SEQ ID NO: 510334 - RNA, 15 nt, Chlamydophila pneumoniae CWL029
ugccagcagaaguuc

SEQ ID NO: 510335 - RNA, 22 nt, Chlamydophila pneumoniae CWL029
ugcauggauccuucaucagcuu

SEQ ID NO: 510336 - RNA, 21 nt, Chlamydophila pneumoniae CWL029
ugcaugccuggccaucaucac

SEQ ID NO: 510337 - RNA, 20 nt, Chlamydophila pneumoniae CWL029
ugcagaguuuuaaacugcua

SEQ ID NO: 510338 - RNA, 15 nt, Chlamydophila pneumoniae CWL029
ugcaggccaggagac

SEQ ID NO: 510339 - RNA, 18 nt, Chlamydophila pneumoniae CWL029
ugcacuuucuuuuuuaau

SEQ ID NO: 510340 - RNA, 16 nt, Chlamydophila pneumoniae CWL029
ugcacuuugaauaaug

SEQ ID NO: 510341 - RNA, 20 nt, Chlamydophila pneumoniae CWL029
ugcacgaucgcgauaagaag

SEQ ID NO: 510342 - RNA, 24 nt, Chlamydophila pneumoniae CWL029
ugcacccaaucgguaugauagaac

SEQ ID NO: 510343 - RNA, 13 nt, Chlamydophila pneumoniae CWL029
uguuguaauaaaa

SEQ ID NO: 510344 - RNA, 15 nt, Chlamydophila pneumoniae CWL029
uguuguggaucagaa

SEQ ID NO: 510345 - RNA, 13 nt, Chlamydophila pneumoniae CWL029
uguugucacuaag

SEQ ID NO: 510346 - RNA, 16 nt, Chlamydophila pneumoniae CWL029
uguugucagcuuugcu

SEQ ID NO: 510347 - RNA, 16 nt, Chlamydophila pneumoniae CWL029
uguuguaauaaaagaa

SEQ ID NO: 510348 - RNA, 20 nt, Chlamydophila pneumoniae CWL029
uguuggaauugcauuaagau

SEQ ID NO: 510349 - RNA, 13 nt, Chlamydophila pneumoniae CWL029
uguugggagcuuc

SEQ ID NO: 510350 - RNA, 12 nt, Chlamydophila pneumoniae CWL029
uguuggguugug

SEQ ID NO: 510351 - RNA, 22 nt, Chlamydophila pneumoniae CWL029
uguuuagaauuuguccuuugcu

SEQ ID NO: 510352 - RNA, 13 nt, Chlamydophila pneumoniae CWL029
uguuuacagaugc

SEQ ID NO: 510353 - RNA, 14 nt, Chlamydophila pneumoniae CWL029
uguuuaaguccuuc

SEQ ID NO: 510354 - RNA, 13 nt, Chlamydophila pneumoniae CWL029
uguugcuuucugu

SEQ ID NO: 510355 - RNA, 19 nt, Chlamydophila pneumoniae CWL029
uguugauccuucuuauggu

SEQ ID NO: 510356 - RNA, 21 nt, Chlamydophila pneumoniae CWL029
uguugcaauagcaauggcuuu

SEQ ID NO: 510357 - RNA, 14 nt, Chlamydophila pneumoniae CWL029
uguugaauaagauu

SEQ ID NO: 510358 - RNA, 20 nt, Chlamydophila pneumoniae CWL029
uguuauaagugacuuuucuu

SEQ ID NO: 510359 - RNA, 18 nt, Chlamydophila pneumoniae CWL029
uguuagaccagggagacc

SEQ ID NO: 510360 - RNA, 15 nt, Chlamydophila pneumoniae CWL029
uguuaugaguuuuua

SEQ ID NO: 510361 - RNA, 17 nt, Chlamydophila pneumoniae CWL029
uguuaugaguuuuuaau

SEQ ID NO: 510362 - RNA, 18 nt, Chlamydophila pneumoniae CWL029
uguuaugaguuuuuaauu

SEQ ID NO: 510363 - RNA, 14 nt, Chlamydophila pneumoniae CWL029
uguucaaaaauaga

SEQ ID NO: 510364 - RNA, 12 nt, Chlamydophila pneumoniae CWL029
uguucaaagauu

SEQ ID NO: 510365 - RNA, 13 nt, Chlamydophila pneumoniae CWL029
uguucagcuagag

SEQ ID NO: 510366 - RNA, 17 nt, Chlamydophila pneumoniae CWL029
uguucugcacguggcuu

SEQ ID NO: 510367 - RNA, 21 nt, Chlamydophila pneumoniae CWL029
uguucugcacguggcuuuugu

SEQ ID NO: 510368 - RNA, 15 nt, Chlamydophila pneumoniae CWL029
uguucucgcaaugcu

SEQ ID NO: 510369 - RNA, 17 nt, Chlamydophila pneumoniae CWL029
uguucuaaagcugcuuc

SEQ ID NO: 510370 - RNA, 15 nt, Chlamydophila pneumoniae CWL029
uguucgaguucuuua

SEQ ID NO: 510371 - RNA, 13 nt, Chlamydophila pneumoniae CWL029
uguucgauuuucu

SEQ ID NO: 510372 - RNA, 18 nt, Chlamydophila pneumoniae CWL029
uguucgcuccuaauggaa

SEQ ID NO: 510373 - RNA, 18 nt, Chlamydophila pneumoniae CWL029
uguucccucuucuuccaa

SEQ ID NO: 510374 - RNA, 13 nt, Chlamydophila pneumoniae CWL029
uguucauaaucag

SEQ ID NO: 510375 - RNA, 13 nt, Chlamydophila pneumoniae CWL029
uguuccaauagag

SEQ ID NO: 510376 - RNA, 14 nt, Chlamydophila pneumoniae CWL029
uuaaaaguucagca

SEQ ID NO: 510377 - RNA, 20 nt, Chlamydophila pneumoniae CWL029
uuaaaaguuccaaaucucaa

SEQ ID NO: 510378 - RNA, 14 nt, Chlamydophila pneumoniae CWL029
uuaaaauagacauu

SEQ ID NO: 510379 - RNA, 15 nt, Chlamydophila pneumoniae CWL029
uuaaaacccauguuu

SEQ ID NO: 510380 - RNA, 16 nt, Chlamydophila pneumoniae CWL029
uuaaaaagucugaauc

SEQ ID NO: 510381 - RNA, 13 nt, Chlamydophila pneumoniae CWL029
uuaaaaaacuucc

SEQ ID NO: 510382 - RNA, 14 nt, Chlamydophila pneumoniae CWL029
uguuuuuucuucug

SEQ ID NO: 510383 - RNA, 18 nt, Chlamydophila pneumoniae CWL029
uguuuuuugaaaacuuca

SEQ ID NO: 510384 - RNA, 17 nt, Chlamydophila pneumoniae CWL029
uuaaacagaucuuuauc

SEQ ID NO: 510385 - RNA, 20 nt, Chlamydophila pneumoniae CWL029
uuaaacccaauucuuaaaaa

SEQ ID NO: 510386 - RNA, 13 nt, Chlamydophila pneumoniae CWL029
uuaaacuaagaau

SEQ ID NO: 510387 - RNA, 11 nt, Chlamydophila pneumoniae CWL029
uuaaagagcau

SEQ ID NO: 510388 - RNA, 20 nt, Chlamydophila pneumoniae CWL029
uguuuccuucgaagcggagc

SEQ ID NO: 510389 - RNA, 15 nt, Chlamydophila pneumoniae CWL029
uguuucgaaaguugg

SEQ ID NO: 510390 - RNA, 12 nt, Chlamydophila pneumoniae CWL029
uguuucacuuaa

SEQ ID NO: 510391 - RNA, 17 nt, Chlamydophila pneumoniae CWL029
uguuuaucgacucuucc

SEQ ID NO: 510392 - RNA, 12 nt, Chlamydophila pneumoniae CWL029
uguuuauuuagc

SEQ ID NO: 510393 - RNA, 16 nt, Chlamydophila pneumoniae CWL029
uguuucaacaccucaa

SEQ ID NO: 510394 - RNA, 23 nt, Chlamydophila pneumoniae CWL029
uguuucuaugugaugucgcgaaa

SEQ ID NO: 510395 - RNA, 12 nt, Chlamydophila pneumoniae CWL029
uguuucuuguag

SEQ ID NO: 510396 - RNA, 19 nt, Chlamydophila pneumoniae CWL029
uguuucuucugaauagcuc

SEQ ID NO: 510397 - RNA, 18 nt, Chlamydophila pneumoniae CWL029
uguuucuuugacuuucau

SEQ ID NO: 510398 - RNA, 12 nt, Chlamydophila pneumoniae CWL029
uguuuuauagau

SEQ ID NO: 510399 - RNA, 21 nt, Chlamydophila pneumoniae CWL029
uguuuuagauggaucuauaag

SEQ ID NO: 510400 - RNA, 17 nt, Chlamydophila pneumoniae CWL029
uguuuuauccaccaaga

SEQ ID NO: 510401 - RNA, 22 nt, Chlamydophila pneumoniae CWL029
uguuuucacauggccaaaaauc

SEQ ID NO: 510402 - RNA, 13 nt, Chlamydophila pneumoniae CWL029
uguuuguccuagg

SEQ ID NO: 510403 - RNA, 21 nt, Chlamydophila pneumoniae CWL029
uguuuggccaacagcuaauac

SEQ ID NO: 510404 - RNA, 16 nt, Chlamydophila pneumoniae CWL029
uguuuucguaaauaug

SEQ ID NO: 510405 - RNA, 16 nt, Chlamydophila pneumoniae CWL029
uguuuuccagaaaucu

SEQ ID NO: 510406 - RNA, 12 nt, Chlamydophila pneumoniae CWL029
uguuuuccugag

SEQ ID NO: 510407 - RNA, 13 nt, Chlamydophila pneumoniae CWL029
uguuuuucaauuu

SEQ ID NO: 510408 - RNA, 13 nt, Chlamydophila pneumoniae CWL029
uguuuuucuucca

SEQ ID NO: 510409 - RNA, 16 nt, Chlamydophila pneumoniae CWL029
uguuuuugcugaagau

SEQ ID NO: 510410 - RNA, 17 nt, Chlamydophila pneumoniae CWL029
uuaauccaaaaacuucu

SEQ ID NO: 510411 - RNA, 22 nt, Chlamydophila pneumoniae CWL029
uuaauacaaaaaauaaaaucaa

SEQ ID NO: 510412 - RNA, 18 nt, Chlamydophila pneumoniae CWL029
uuaauaaauuuaucugcu

SEQ ID NO: 510413 - RNA, 14 nt, Chlamydophila pneumoniae CWL029
uuaauaauguuuua

SEQ ID NO: 510414 - RNA, 16 nt, Chlamydophila pneumoniae CWL029
uuaacgcuaagcucuu

SEQ ID NO: 510415 - RNA, 13 nt, Chlamydophila pneumoniae CWL029
uuaacagagcgcc

SEQ ID NO: 510416 - RNA, 21 nt, Chlamydophila pneumoniae CWL029
uuaacuguguaugaaucacau

SEQ ID NO: 510417 - RNA, 16 nt, Chlamydophila pneumoniae CWL029
uuaacuucuaaaagca

SEQ ID NO: 510418 - RNA, 13 nt, Chlamydophila pneumoniae CWL029
uuaagaacaucuu

SEQ ID NO: 510419 - RNA, 13 nt, Chlamydophila pneumoniae CWL029
uuaagaucucuuu

SEQ ID NO: 510420 - RNA, 15 nt, Chlamydophila pneumoniae CWL029
uuaagaagaagcuga

SEQ ID NO: 510421 - RNA, 13 nt, Chlamydophila pneumoniae CWL029
uuaacaacaugcg

SEQ ID NO: 510422 - RNA, 17 nt, Chlamydophila pneumoniae CWL029
uuaacaaguaccaagaa

SEQ ID NO: 510423 - RNA, 19 nt, Chlamydophila pneumoniae CWL029
uuaacaaguaccaagaaaa

SEQ ID NO: 510424 - RNA, 13 nt, Chlamydophila pneumoniae CWL029
uuaacaaacuugu

SEQ ID NO: 510425 - RNA, 17 nt, Chlamydophila pneumoniae CWL029
uuaaauuaucagagaca

SEQ ID NO: 510426 - RNA, 17 nt, Chlamydophila pneumoniae CWL029
uuaaauaucuaauaaaa

SEQ ID NO: 510427 - RNA, 12 nt, Chlamydophila pneumoniae CWL029
uuaaauacagau

SEQ ID NO: 510428 - RNA, 14 nt, Chlamydophila pneumoniae CWL029
uuaaauauagaaaa

SEQ ID NO: 510429 - RNA, 15 nt, Chlamydophila pneumoniae CWL029
uuaaauauagaaaau

SEQ ID NO: 510430 - RNA, 16 nt, Chlamydophila pneumoniae CWL029
uuaaauauauaaagaa

SEQ ID NO: 510431 - RNA, 19 nt, Chlamydophila pneumoniae CWL029
uuaaaguaaaaaauacagg

SEQ ID NO: 510432 - RNA, 15 nt, Chlamydophila pneumoniae CWL029
uuaaagguaaaacua

SEQ ID NO: 510433 - RNA, 17 nt, Chlamydophila pneumoniae CWL029
uuaaaguccaagaucaa

SEQ ID NO: 510434 - RNA, 17 nt, Chlamydophila pneumoniae CWL029
uuaaaguggcaaucuuu

SEQ ID NO: 510435 - RNA, 21 nt, Chlamydophila pneumoniae CWL029
uuaaaguuaaacaaaguagga

SEQ ID NO: 510436 - RNA, 14 nt, Chlamydophila pneumoniae CWL029
uuaaauaaaaccac

SEQ ID NO: 510437 - RNA, 21 nt, Chlamydophila pneumoniae CWL029
uuacugaagaaguaagcgauu

SEQ ID NO: 510438 - RNA, 15 nt, Chlamydophila pneumoniae CWL029
uuacgguuucuggga

SEQ ID NO: 510439 - RNA, 20 nt, Chlamydophila pneumoniae CWL029
uuagauacgcuuacaaauaa

SEQ ID NO: 510440 - RNA, 22 nt, Chlamydophila pneumoniae CWL029
uuagacaagacaccgaaagaaa

SEQ ID NO: 510441 - RNA, 12 nt, Chlamydophila pneumoniae CWL029
uuagaauccucu

SEQ ID NO: 510442 - RNA, 20 nt, Chlamydophila pneumoniae CWL029
uuagaaaagauaaaacauuc

SEQ ID NO: 510443 - RNA, 18 nt, Chlamydophila pneumoniae CWL029
uuagaaaccaugaugcaa

SEQ ID NO: 510444 - RNA, 19 nt, Chlamydophila pneumoniae CWL029
uuagaaauguuuuuaaacc

SEQ ID NO: 510445 - RNA, 22 nt, Chlamydophila pneumoniae CWL029
uuagaaucaaaagucaugagga

SEQ ID NO: 510446 - RNA, 16 nt, Chlamydophila pneumoniae CWL029
uuagcaaacauuuuua

SEQ ID NO: 510447 - RNA, 12 nt, Chlamydophila pneumoniae CWL029
uuagauuuccuc

SEQ ID NO: 510448 - RNA, 14 nt, Chlamydophila pneumoniae CWL029
uuagcaagagcucu

SEQ ID NO: 510449 - RNA, 14 nt, Chlamydophila pneumoniae CWL029
uuagcgaucucucu

SEQ ID NO: 510450 - RNA, 16 nt, Chlamydophila pneumoniae CWL029
uuaauuguagagagaa

SEQ ID NO: 510451 - RNA, 15 nt, Chlamydophila pneumoniae CWL029
uuacaagcuuccuug

SEQ ID NO: 510452 - RNA, 15 nt, Chlamydophila pneumoniae CWL029
uuacacaacucuuuc

SEQ ID NO: 510453 - RNA, 13 nt, Chlamydophila pneumoniae CWL029
uuacagaaaggcu

SEQ ID NO: 510454 - RNA, 15 nt, Chlamydophila pneumoniae CWL029
uuacaaauaaaauga

SEQ ID NO: 510455 - RNA, 17 nt, Chlamydophila pneumoniae CWL029
uuacaaauaaaaugauu

SEQ ID NO: 510456 - RNA, 22 nt, Chlamydophila pneumoniae CWL029
uuacaaauggcaugaaagauaa

SEQ ID NO: 510457 - RNA, 15 nt, Chlamydophila pneumoniae CWL029
uuacgaaaacaucug

SEQ ID NO: 510458 - RNA, 16 nt, Chlamydophila pneumoniae CWL029
uuaccguuuccuccuc

SEQ ID NO: 510459 - RNA, 23 nt, Chlamydophila pneumoniae CWL029
uuaccucauggagguucucaaug

SEQ ID NO: 510460 - RNA, 21 nt, Chlamydophila pneumoniae CWL029
uuaccaucgucuccaaaaauu

SEQ ID NO: 510461 - RNA, 20 nt, Chlamydophila pneumoniae CWL029
uuaccaucguuuucauaggg

SEQ ID NO: 510462 - RNA, 13 nt, Chlamydophila pneumoniae CWL029
uuacaucaaugau

SEQ ID NO: 510463 - RNA, 20 nt, Chlamydophila pneumoniae CWL029
uguguauuuaagaaaugcaa

SEQ ID NO: 510464 - RNA, 14 nt, Chlamydophila pneumoniae CWL029
uguguauuugcaga

SEQ ID NO: 510465 - RNA, 13 nt, Chlamydophila pneumoniae CWL029
uguguaaaaguua

SEQ ID NO: 510466 - RNA, 14 nt, Chlamydophila pneumoniae CWL029
uguggucuuccgua

SEQ ID NO: 510467 - RNA, 19 nt, Chlamydophila pneumoniae CWL029
uguggugaggagcuauuaa

SEQ ID NO: 510468 - RNA, 17 nt, Chlamydophila pneumoniae CWL029
ugugggauggucaggaa

SEQ ID NO: 510469 - RNA, 13 nt, Chlamydophila pneumoniae CWL029
uguuaaucuaauu

SEQ ID NO: 510470 - RNA, 21 nt, Chlamydophila pneumoniae CWL029
uguuaacaaguaccaagaaaa

SEQ ID NO: 510471 - RNA, 20 nt, Chlamydophila pneumoniae CWL029
uguuaaggcuuccaaugcua

SEQ ID NO: 510472 - RNA, 23 nt, Chlamydophila pneumoniae CWL029
uguuaaguucauaaccugggcaa

SEQ ID NO: 510473 - RNA, 20 nt, Chlamydophila pneumoniae CWL029
uguuaauagaagaucauuaa

SEQ ID NO: 510474 - RNA, 13 nt, Chlamydophila pneumoniae CWL029
ugugucuuaaagc

SEQ ID NO: 510475 - RNA, 18 nt, Chlamydophila pneumoniae CWL029
ugugaauuuuauuuauua

SEQ ID NO: 510476 - RNA, 15 nt, Chlamydophila pneumoniae CWL029
ugugcauuuucuucu

SEQ ID NO: 510477 - RNA, 12 nt, Chlamydophila pneumoniae CWL029
ugugcaucaguc

SEQ ID NO: 510478 - RNA, 13 nt, Chlamydophila pneumoniae CWL029
ugugcaugcaucu

SEQ ID NO: 510479 - RNA, 15 nt, Chlamydophila pneumoniae CWL029
ugugcaugcaucuua

SEQ ID NO: 510480 - RNA, 14 nt, Chlamydophila pneumoniae CWL029
ugugaguucuuccu

SEQ ID NO: 510481 - RNA, 15 nt, Chlamydophila pneumoniae CWL029
ugugaguucuuccuu

SEQ ID NO: 510482 - RNA, 15 nt, Chlamydophila pneumoniae CWL029
ugugccaauuuuugu

SEQ ID NO: 510483 - RNA, 15 nt, Chlamydophila pneumoniae CWL029
ugucguaauaacccc

SEQ ID NO: 510484 - RNA, 17 nt, Chlamydophila pneumoniae CWL029
ugucguaauugcugaaa

SEQ ID NO: 510485 - RNA, 22 nt, Chlamydophila pneumoniae CWL029
ugucuacagaggaaucuauccu

SEQ ID NO: 510486 - RNA, 20 nt, Chlamydophila pneumoniae CWL029
ugucuagugaagcugcuucu

SEQ ID NO: 510487 - RNA, 18 nt, Chlamydophila pneumoniae CWL029
ugucuaggagcuucgccu

SEQ ID NO: 510488 - RNA, 11 nt, Chlamydophila pneumoniae CWL029
uguccagagac

SEQ ID NO: 510489 - RNA, 13 nt, Chlamydophila pneumoniae CWL029
ugucauuaaaaau

SEQ ID NO: 510490 - RNA, 18 nt, Chlamydophila pneumoniae CWL029
ugucaucggcuucuccaa

SEQ ID NO: 510491 - RNA, 20 nt, Chlamydophila pneumoniae CWL029
ugucacuaagauaucuccag

SEQ ID NO: 510492 - RNA, 14 nt, Chlamydophila pneumoniae CWL029
ugucacuagagaaa

SEQ ID NO: 510493 - RNA, 17 nt, Chlamydophila pneumoniae CWL029
ugucacuaucuucuaaa

SEQ ID NO: 510494 - RNA, 19 nt, Chlamydophila pneumoniae CWL029
ugucacucuagaaaauauu

SEQ ID NO: 510495 - RNA, 21 nt, Chlamydophila pneumoniae CWL029
ugucacucuagaaaauauucc

SEQ ID NO: 510496 - RNA, 15 nt, Chlamydophila pneumoniae CWL029
uguauggcagccugg

SEQ ID NO: 510497 - RNA, 22 nt, Chlamydophila pneumoniae CWL029
uguauggugcgcgucuccuuga

SEQ ID NO: 510498 - RNA, 13 nt, Chlamydophila pneumoniae CWL029
uguaugugaaaga

SEQ ID NO: 510499 - RNA, 13 nt, Chlamydophila pneumoniae CWL029
uguauaaacucca

SEQ ID NO: 510500 - RNA, 23 nt, Chlamydophila pneumoniae CWL029
uguaguucuuugaauuuccaaag

SEQ ID NO: 510501 - RNA, 20 nt, Chlamydophila pneumoniae CWL029
uguaguuugggaugacuggc

SEQ ID NO: 510502 - RNA, 23 nt, Chlamydophila pneumoniae CWL029
uguauacauaucuccuuuaaaua

SEQ ID NO: 510503 - RNA, 14 nt, Chlamydophila pneumoniae CWL029
uguaguaaauuccu

SEQ ID NO: 510504 - RNA, 15 nt, Chlamydophila pneumoniae CWL029
uguaguaagauuuuc

SEQ ID NO: 510505 - RNA, 19 nt, Chlamydophila pneumoniae CWL029
uguagucaugauuuuucaa

SEQ ID NO: 510506 - RNA, 16 nt, Chlamydophila pneumoniae CWL029
uguagcuacagauucu

SEQ ID NO: 510507 - RNA, 21 nt, Chlamydophila pneumoniae CWL029
uguaggaacaugccaaauauc

SEQ ID NO: 510508 - RNA, 14 nt, Chlamydophila pneumoniae CWL029
uguaauuuuuucau

SEQ ID NO: 510509 - RNA, 15 nt, Chlamydophila pneumoniae CWL029
uguacaaaugcaucu

SEQ ID NO: 510510 - RNA, 21 nt, Chlamydophila pneumoniae CWL029
uguaauauucaacauguuaau

SEQ ID NO: 510511 - RNA, 20 nt, Chlamydophila pneumoniae CWL029
uguaaucauaaaaaaagcua

SEQ ID NO: 510512 - RNA, 22 nt, Chlamydophila pneumoniae CWL029
uguacuuccccaaacauggaca

SEQ ID NO: 510513 - RNA, 18 nt, Chlamydophila pneumoniae CWL029
uguacuugauauuguucu

SEQ ID NO: 510514 - RNA, 13 nt, Chlamydophila pneumoniae CWL029
uguacacagagau

SEQ ID NO: 510515 - RNA, 19 nt, Chlamydophila pneumoniae CWL029
uguacagaaaauaagaagc

SEQ ID NO: 510516 - RNA, 22 nt, Chlamydophila pneumoniae CWL029
uguacaagcuucaucaaaacau

SEQ ID NO: 510517 - RNA, 16 nt, Chlamydophila pneumoniae CWL029
uguacaauuugcuccu

SEQ ID NO: 510518 - RNA, 13 nt, Chlamydophila pneumoniae CWL029
uguacagaacaau

SEQ ID NO: 510519 - RNA, 14 nt, Chlamydophila pneumoniae CWL029
uguaaauuucauuu

SEQ ID NO: 510520 - RNA, 14 nt, Chlamydophila pneumoniae CWL029
uguaaaaguagcau

SEQ ID NO: 510521 - RNA, 19 nt, Chlamydophila pneumoniae CWL029
uguaaaaaauuauuuggau

SEQ ID NO: 510522 - RNA, 21 nt, Chlamydophila pneumoniae CWL029
ugguuuuucgauuuggaagau

SEQ ID NO: 510523 - RNA, 16 nt, Chlamydophila pneumoniae CWL029
ugguuuuucuccucuu

SEQ ID NO: 510524 - RNA, 21 nt, Chlamydophila pneumoniae CWL029
ugguuuuugcaaccacacagg

SEQ ID NO: 510525 - RNA, 18 nt, Chlamydophila pneumoniae CWL029
uggucuguauuuucuuca

SEQ ID NO: 510526 - RNA, 19 nt, Chlamydophila pneumoniae CWL029
uggucuguauuuucuucaa

SEQ ID NO: 510527 - RNA, 17 nt, Chlamydophila pneumoniae CWL029
uggugaagaauaauagc

SEQ ID NO: 510528 - RNA, 23 nt, Chlamydophila pneumoniae CWL029
ugguccauaauuucuuucacauc

SEQ ID NO: 510529 - RNA, 19 nt, Chlamydophila pneumoniae CWL029
ugguccauaauuucuuuca

SEQ ID NO: 510530 - RNA, 12 nt, Chlamydophila pneumoniae CWL029
uggucagucucg

SEQ ID NO: 510531 - RNA, 17 nt, Chlamydophila pneumoniae CWL029
ugguacggcuaaauaaa

SEQ ID NO: 510532 - RNA, 21 nt, Chlamydophila pneumoniae CWL029
ugguaggaugucgcuuuugcu

SEQ ID NO: 510533 - RNA, 20 nt, Chlamydophila pneumoniae CWL029
ugguaguuugccuucuuauc

SEQ ID NO: 510534 - RNA, 15 nt, Chlamydophila pneumoniae CWL029
ugguaucccaaucga

SEQ ID NO: 510535 - RNA, 13 nt, Chlamydophila pneumoniae CWL029
uggguuugucucc

SEQ ID NO: 510536 - RNA, 20 nt, Chlamydophila pneumoniae CWL029
uggggcaguagguaagaagc

SEQ ID NO: 510537 - RNA, 19 nt, Chlamydophila pneumoniae CWL029
uggggcauaagaacucuau

SEQ ID NO: 510538 - RNA, 15 nt, Chlamydophila pneumoniae CWL029
ugggcgucuucuucg

SEQ ID NO: 510539 - RNA, 14 nt, Chlamydophila pneumoniae CWL029
ugggcucacucuaa

SEQ ID NO: 510540 - RNA, 19 nt, Chlamydophila pneumoniae CWL029
ugggcuaggguuucuacag

SEQ ID NO: 510541 - RNA, 20 nt, Chlamydophila pneumoniae CWL029
ugggauauuggagacuaggg

SEQ ID NO: 510542 - RNA, 14 nt, Chlamydophila pneumoniae CWL029
ugggaaaagaaaag

SEQ ID NO: 510543 - RNA, 20 nt, Chlamydophila pneumoniae CWL029
ugggaaaagaaaagaaagaa

SEQ ID NO: 510544 - RNA, 16 nt, Chlamydophila pneumoniae CWL029
ugggaucggucuuuuc

SEQ ID NO: 510545 - RNA, 20 nt, Chlamydophila pneumoniae CWL029
uggcgucugcccuuucugca

SEQ ID NO: 510546 - RNA, 12 nt, Chlamydophila pneumoniae CWL029
uggcgauaaaug

SEQ ID NO: 510547 - RNA, 18 nt, Chlamydophila pneumoniae CWL029
uggcgaauccuagagaac

SEQ ID NO: 510548 - RNA, 11 nt, Chlamydophila pneumoniae CWL029
uggccaaaaau

SEQ ID NO: 510549 - RNA, 18 nt, Chlamydophila pneumoniae CWL029
uggccaucaucaccagaa

SEQ ID NO: 510550 - RNA, 17 nt, Chlamydophila pneumoniae CWL029
uggauugucgaugaggg

SEQ ID NO: 510551 - RNA, 15 nt, Chlamydophila pneumoniae CWL029
uucagaugauuuuau

SEQ ID NO: 510552 - RNA, 20 nt, Chlamydophila pneumoniae CWL029
uucagaugauuuuaucugcg

SEQ ID NO: 510553 - RNA, 18 nt, Chlamydophila pneumoniae CWL029
uucagcaaacggagagca

SEQ ID NO: 510554 - RNA, 21 nt, Chlamydophila pneumoniae CWL029
uucagcaaagaaguuauaauu

SEQ ID NO: 510555 - RNA, 17 nt, Chlamydophila pneumoniae CWL029
uucagaggcuagaaaau

SEQ ID NO: 510556 - RNA, 19 nt, Chlamydophila pneumoniae CWL029
uucagaguggucauugccu

SEQ ID NO: 510557 - RNA, 19 nt, Chlamydophila pneumoniae CWL029
uucacuugguagcgucucu

SEQ ID NO: 510558 - RNA, 22 nt, Chlamydophila pneumoniae CWL029
uucaccacaaaccucuaaaaac

SEQ ID NO: 510559 - RNA, 14 nt, Chlamydophila pneumoniae CWL029
uucaagucuguaag

SEQ ID NO: 510560 - RNA, 13 nt, Chlamydophila pneumoniae CWL029
uucaagucuguaa

SEQ ID NO: 510561 - RNA, 21 nt, Chlamydophila pneumoniae CWL029
uucaagguacugcucaaugac

SEQ ID NO: 510562 - RNA, 12 nt, Chlamydophila pneumoniae CWL029
uucaagcuuucg

SEQ ID NO: 510563 - RNA, 20 nt, Chlamydophila pneumoniae CWL029
uucaagguacuuuauagaaa

SEQ ID NO: 510564 - RNA, 19 nt, Chlamydophila pneumoniae CWL029
uucaagguacuuuauagaa

SEQ ID NO: 510565 - RNA, 14 nt, Chlamydophila pneumoniae CWL029
uucaauguaauugc

SEQ ID NO: 510566 - RNA, 23 nt, Chlamydophila pneumoniae CWL029
uucaaucucuccuugacaaauaa

SEQ ID NO: 510567 - RNA, 13 nt, Chlamydophila pneumoniae CWL029
uucaaucucuccu

SEQ ID NO: 510568 - RNA, 13 nt, Chlamydophila pneumoniae CWL029
uucaaugaaagcu

SEQ ID NO: 510569 - RNA, 20 nt, Chlamydophila pneumoniae CWL029
uucaaugacuucuggaucuu

SEQ ID NO: 510570 - RNA, 14 nt, Chlamydophila pneumoniae CWL029
uucaaugauguguu

SEQ ID NO: 510571 - RNA, 21 nt, Chlamydophila pneumoniae CWL029
uucaaugauuucuuuagcuuu

SEQ ID NO: 510572 - RNA, 23 nt, Chlamydophila pneumoniae CWL029
uucacaaaucuuccccuaaaaau

SEQ ID NO: 510573 - RNA, 16 nt, Chlamydophila pneumoniae CWL029
uucacaaucuaaauaa

SEQ ID NO: 510574 - RNA, 17 nt, Chlamydophila pneumoniae CWL029
uucaauuuggauuuaug

SEQ ID NO: 510575 - RNA, 22 nt, Chlamydophila pneumoniae CWL029
uucaauuacaggagcuagaaga

SEQ ID NO: 510576 - RNA, 20 nt, Chlamydophila pneumoniae CWL029
uucaauuccuuucuccagca

SEQ ID NO: 510577 - RNA, 17 nt, Chlamydophila pneumoniae CWL029
uucaauugagacaaaaa

SEQ ID NO: 510578 - RNA, 18 nt, Chlamydophila pneumoniae CWL029
uucaauugagacaaaaaa

SEQ ID NO: 510579 - RNA, 14 nt, Chlamydophila pneumoniae CWL029
uucaauuguaagca

SEQ ID NO: 510580 - RNA, 14 nt, Chlamydophila pneumoniae CWL029
uuaggcuuaauaaa

SEQ ID NO: 510581 - RNA, 20 nt, Chlamydophila pneumoniae CWL029
uuagggaugguuuccucuau

SEQ ID NO: 510582 - RNA, 15 nt, Chlamydophila pneumoniae CWL029
uuauuaucaaaguga

SEQ ID NO: 510583 - RNA, 20 nt, Chlamydophila pneumoniae CWL029
uuaggaggaguauagcauga

SEQ ID NO: 510584 - RNA, 16 nt, Chlamydophila pneumoniae CWL029
uuaggauucaguuccu

SEQ ID NO: 510585 - RNA, 19 nt, Chlamydophila pneumoniae CWL029
uuaggauuucgagauauug

SEQ ID NO: 510586 - RNA, 21 nt, Chlamydophila pneumoniae CWL029
uuauuucuaaaaaauagauaa

SEQ ID NO: 510587 - RNA, 17 nt, Chlamydophila pneumoniae CWL029
uuauugauaaugauucc

SEQ ID NO: 510588 - RNA, 12 nt, Chlamydophila pneumoniae CWL029
uucaaagauaua

SEQ ID NO: 510589 - RNA, 12 nt, Chlamydophila pneumoniae CWL029
uucaaagccauu

SEQ ID NO: 510590 - RNA, 14 nt, Chlamydophila pneumoniae CWL029
uucaaagucaaaua

SEQ ID NO: 510591 - RNA, 19 nt, Chlamydophila pneumoniae CWL029
uucaaaucaucaaaaagau

SEQ ID NO: 510592 - RNA, 13 nt, Chlamydophila pneumoniae CWL029
uuauuuuuaaaua

SEQ ID NO: 510593 - RNA, 14 nt, Chlamydophila pneumoniae CWL029
uuauuuuuaaauaa

SEQ ID NO: 510594 - RNA, 13 nt, Chlamydophila pneumoniae CWL029
uucaaacuccuuu

SEQ ID NO: 510595 - RNA, 15 nt, Chlamydophila pneumoniae CWL029
uuauuuucuacacug

SEQ ID NO: 510596 - RNA, 13 nt, Chlamydophila pneumoniae CWL029
uuauuuucuggug

SEQ ID NO: 510597 - RNA, 17 nt, Chlamydophila pneumoniae CWL029
uucaaauuugcucuccu

SEQ ID NO: 510598 - RNA, 21 nt, Chlamydophila pneumoniae CWL029
uucaaauuugcucuccugcaa

SEQ ID NO: 510599 - RNA, 19 nt, Chlamydophila pneumoniae CWL029
uucaacauaacaugagaaa

SEQ ID NO: 510600 - RNA, 20 nt, Chlamydophila pneumoniae CWL029
uucaacucuaucgaagagcc

SEQ ID NO: 510601 - RNA, 20 nt, Chlamydophila pneumoniae CWL029
uucaucuaggggagcuauua

SEQ ID NO: 510602 - RNA, 20 nt, Chlamydophila pneumoniae CWL029
uucaucugucauuaaaaauu

SEQ ID NO: 510603 - RNA, 19 nt, Chlamydophila pneumoniae CWL029
uucaugauuccgcaaguaa

SEQ ID NO: 510604 - RNA, 22 nt, Chlamydophila pneumoniae CWL029
uucaugauuccgcaaguaauca

SEQ ID NO: 510605 - RNA, 22 nt, Chlamydophila pneumoniae CWL029
uucauguccuccauggaaagaa

SEQ ID NO: 510606 - RNA, 16 nt, Chlamydophila pneumoniae CWL029
uucauuaagaacaucu

SEQ ID NO: 510607 - RNA, 22 nt, Chlamydophila pneumoniae CWL029
uucauuucgauaacacuucuuu

SEQ ID NO: 510608 - RNA, 13 nt, Chlamydophila pneumoniae CWL029
uucauugcaaaaa

SEQ ID NO: 510609 - RNA, 13 nt, Chlamydophila pneumoniae CWL029
uuccaacuucaac

SEQ ID NO: 510610 - RNA, 21 nt, Chlamydophila pneumoniae CWL029
uuccaagacaauaaaaaagag

SEQ ID NO: 510611 - RNA, 14 nt, Chlamydophila pneumoniae CWL029
uuccaaaggaaaau

SEQ ID NO: 510612 - RNA, 23 nt, Chlamydophila pneumoniae CWL029
uuccaaagcuaggcgauaguaaa

SEQ ID NO: 510613 - RNA, 13 nt, Chlamydophila pneumoniae CWL029
uuccaaagacuga

SEQ ID NO: 510614 - RNA, 18 nt, Chlamydophila pneumoniae CWL029
uuccaaaauaaaaggagc

SEQ ID NO: 510615 - RNA, 17 nt, Chlamydophila pneumoniae CWL029
uuccaaaauaaaaggag

SEQ ID NO: 510616 - RNA, 16 nt, Chlamydophila pneumoniae CWL029
uucauagcauguucga

SEQ ID NO: 510617 - RNA, 16 nt, Chlamydophila pneumoniae CWL029
uucauauaaaguuucc

SEQ ID NO: 510618 - RNA, 13 nt, Chlamydophila pneumoniae CWL029
uucauacguuuuu

SEQ ID NO: 510619 - RNA, 20 nt, Chlamydophila pneumoniae CWL029
uucauaugaaugacugcaga

SEQ ID NO: 510620 - RNA, 20 nt, Chlamydophila pneumoniae CWL029
uucaucgauaggaugacacu

SEQ ID NO: 510621 - RNA, 21 nt, Chlamydophila pneumoniae CWL029
uucaucacaaaauucaugcaa

SEQ ID NO: 510622 - RNA, 13 nt, Chlamydophila pneumoniae CWL029
uucagguucugaa

SEQ ID NO: 510623 - RNA, 20 nt, Chlamydophila pneumoniae CWL029
uucauaaccaaguaaaucag

SEQ ID NO: 510624 - RNA, 17 nt, Chlamydophila pneumoniae CWL029
uucauaaccaaguaaau

SEQ ID NO: 510625 - RNA, 19 nt, Chlamydophila pneumoniae CWL029
uucuucugaauagcucuuu

SEQ ID NO: 510626 - RNA, 12 nt, Chlamydophila pneumoniae CWL029
uucuucuucuaa

SEQ ID NO: 510627 - RNA, 17 nt, Chlamydophila pneumoniae CWL029
uucuucuauagaaucca

SEQ ID NO: 510628 - RNA, 11 nt, Chlamydophila pneumoniae CWL029
uucuucuaaag

SEQ ID NO: 510629 - RNA, 18 nt, Chlamydophila pneumoniae CWL029
uucuucguuagagaagag

SEQ ID NO: 510630 - RNA, 17 nt, Chlamydophila pneumoniae CWL029
uucuucgguguagaucu

SEQ ID NO: 510631 - RNA, 14 nt, Chlamydophila pneumoniae CWL029
uucuucccagguaa

SEQ ID NO: 510632 - RNA, 20 nt, Chlamydophila pneumoniae CWL029
uucuuccuguuccauaucaa

SEQ ID NO: 510633 - RNA, 12 nt, Chlamydophila pneumoniae CWL029
uucuuccuucuu

SEQ ID NO: 510634 - RNA, 14 nt, Chlamydophila pneumoniae CWL029
uucuucaacgagga

SEQ ID NO: 510635 - RNA, 16 nt, Chlamydophila pneumoniae CWL029
uucuucaagaaaugcc

SEQ ID NO: 510636 - RNA, 21 nt, Chlamydophila pneumoniae CWL029
uucuucaaagaacuuaaaauu

SEQ ID NO: 510637 - RNA, 17 nt, Chlamydophila pneumoniae CWL029
uucuucaaagcuacuaa

SEQ ID NO: 510638 - RNA, 14 nt, Chlamydophila pneumoniae CWL029
uucuuccaauaauu

SEQ ID NO: 510639 - RNA, 23 nt, Chlamydophila pneumoniae CWL029
uucuucauuauuaaacgaauacu

SEQ ID NO: 510640 - RNA, 23 nt, Chlamydophila pneumoniae CWL029
uucuuccaaagacugagcuucua

SEQ ID NO: 510641 - RNA, 18 nt, Chlamydophila pneumoniae CWL029
uucuuccaaagcuucuuu

SEQ ID NO: 510642 - RNA, 21 nt, Chlamydophila pneumoniae CWL029
uucuucagaguugucaaguaa

SEQ ID NO: 510643 - RNA, 11 nt, Chlamydophila pneumoniae CWL029
uucuuaucugc

SEQ ID NO: 510644 - RNA, 14 nt, Chlamydophila pneumoniae CWL029
uucuuauaaaaaag

SEQ ID NO: 510645 - RNA, 15 nt, Chlamydophila pneumoniae CWL029
uucuuagcgcaugua

SEQ ID NO: 510646 - RNA, 22 nt, Chlamydophila pneumoniae CWL029
uucuuagcgcauguauuguguu

SEQ ID NO: 510647 - RNA, 22 nt, Chlamydophila pneumoniae CWL029
uucuuagaagagaaaguagaga

SEQ ID NO: 510648 - RNA, 14 nt, Chlamydophila pneumoniae CWL029
uucuuaacaauaua

SEQ ID NO: 510649 - RNA, 16 nt, Chlamydophila pneumoniae CWL029
uucuuaauuuccuucu

SEQ ID NO: 510650 - RNA, 22 nt, Chlamydophila pneumoniae CWL029
uucuuacuaaagaaagagucuc

SEQ ID NO: 510651 - RNA, 21 nt, Chlamydophila pneumoniae CWL029
uucuguaauuuuuuucaaagg

SEQ ID NO: 510652 - RNA, 13 nt, Chlamydophila pneumoniae CWL029
uucuguaguucuu

SEQ ID NO: 510653 - RNA, 19 nt, Chlamydophila pneumoniae CWL029
uucuguaguuuguucacuu

SEQ ID NO: 510654 - RNA, 17 nt, Chlamydophila pneumoniae CWL029
uucuguaguucuugcca

SEQ ID NO: 510655 - RNA, 13 nt, Chlamydophila pneumoniae CWL029
uucuccaaauaaa

SEQ ID NO: 510656 - RNA, 20 nt, Chlamydophila pneumoniae CWL029
uucuccaaccucgagauccu

SEQ ID NO: 510657 - RNA, 14 nt, Chlamydophila pneumoniae CWL029
uucuccacaugccc

SEQ ID NO: 510658 - RNA, 14 nt, Chlamydophila pneumoniae CWL029
uucucaaagaucau

SEQ ID NO: 510659 - RNA, 19 nt, Chlamydophila pneumoniae CWL029
uucuauaucauuaagaaga

SEQ ID NO: 510660 - RNA, 17 nt, Chlamydophila pneumoniae CWL029
uucuaucuuacugaaga

SEQ ID NO: 510661 - RNA, 22 nt, Chlamydophila pneumoniae CWL029
uucuaugauaucaccagguccu

SEQ ID NO: 510662 - RNA, 14 nt, Chlamydophila pneumoniae CWL029
uucuauagcaagac

SEQ ID NO: 510663 - RNA, 16 nt, Chlamydophila pneumoniae CWL029
uucuagaaacugcucc

SEQ ID NO: 510664 - RNA, 21 nt, Chlamydophila pneumoniae CWL029
uucuagagcuucaaguuucuu

SEQ ID NO: 510665 - RNA, 12 nt, Chlamydophila pneumoniae CWL029
uucuaaacaauu

SEQ ID NO: 510666 - RNA, 22 nt, Chlamydophila pneumoniae CWL029
uucuaaaacagaaauugcuucu

SEQ ID NO: 510667 - RNA, 16 nt, Chlamydophila pneumoniae CWL029
uucuaaaagagcaaga

SEQ ID NO: 510668 - RNA, 14 nt, Chlamydophila pneumoniae CWL029
uucuggagaaaaaa

SEQ ID NO: 510669 - RNA, 19 nt, Chlamydophila pneumoniae CWL029
uucuggagaaaaaauaucu

SEQ ID NO: 510670 - RNA, 22 nt, Chlamydophila pneumoniae CWL029
uucuggauacguuuuucccuuu

SEQ ID NO: 510671 - RNA, 13 nt, Chlamydophila pneumoniae CWL029
uucuggauucaaa

SEQ ID NO: 510672 - RNA, 15 nt, Chlamydophila pneumoniae CWL029
uucugauacaucauc

SEQ ID NO: 510673 - RNA, 14 nt, Chlamydophila pneumoniae CWL029
uucugacaauaaca

SEQ ID NO: 510674 - RNA, 20 nt, Chlamydophila pneumoniae CWL029
uucugaaauuucugaaacaa

SEQ ID NO: 510675 - RNA, 16 nt, Chlamydophila pneumoniae CWL029
uucugaaaucaaaaaa

SEQ ID NO: 510676 - RNA, 20 nt, Chlamydophila pneumoniae CWL029
uucugaaauugucuucagug

SEQ ID NO: 510677 - RNA, 12 nt, Chlamydophila pneumoniae CWL029
uucucgaaaaau

SEQ ID NO: 510678 - RNA, 23 nt, Chlamydophila pneumoniae CWL029
uucucuuucgaugcuauuuuucc

SEQ ID NO: 510679 - RNA, 11 nt, Chlamydophila pneumoniae CWL029
uucuccuauug

SEQ ID NO: 510680 - RNA, 21 nt, Chlamydophila pneumoniae CWL029
uucuccucgcaauccaggaau

SEQ ID NO: 510681 - RNA, 17 nt, Chlamydophila pneumoniae CWL029
uucuccagcuucuuucu

SEQ ID NO: 510682 - RNA, 16 nt, Chlamydophila pneumoniae CWL029
uucucccauagcaaug

SEQ ID NO: 510683 - RNA, 22 nt, Chlamydophila pneumoniae CWL029
uucucccgcaaaguuaaaccuu

SEQ ID NO: 510684 - RNA, 18 nt, Chlamydophila pneumoniae CWL029
uucucccgugaacaaaaa

SEQ ID NO: 510685 - RNA, 13 nt, Chlamydophila pneumoniae CWL029
uucguuucgcuuu

SEQ ID NO: 510686 - RNA, 22 nt, Chlamydophila pneumoniae CWL029
uucguuuccgaucauuuuugcu

SEQ ID NO: 510687 - RNA, 15 nt, Chlamydophila pneumoniae CWL029
uucgugagagcguug

SEQ ID NO: 510688 - RNA, 13 nt, Chlamydophila pneumoniae CWL029
uucgucuucauaa

SEQ ID NO: 510689 - RNA, 20 nt, Chlamydophila pneumoniae CWL029
uucgucuaaaauaaccccuc

SEQ ID NO: 510690 - RNA, 23 nt, Chlamydophila pneumoniae CWL029
uucgcaaauauaguuuucauaau

SEQ ID NO: 510691 - RNA, 15 nt, Chlamydophila pneumoniae CWL029
uucgcaaauuuuucg

SEQ ID NO: 510692 - RNA, 22 nt, Chlamydophila pneumoniae CWL029
uucgauaucucuaccgaacaga

SEQ ID NO: 510693 - RNA, 21 nt, Chlamydophila pneumoniae CWL029
uucgauguuaaggcuuccaau

SEQ ID NO: 510694 - RNA, 19 nt, Chlamydophila pneumoniae CWL029
uucgacuauaagagguucu

SEQ ID NO: 510695 - RNA, 21 nt, Chlamydophila pneumoniae CWL029
uucgacaacaacauaaagaag

SEQ ID NO: 510696 - RNA, 18 nt, Chlamydophila pneumoniae CWL029
uucgacaaccaaaacaga

SEQ ID NO: 510697 - RNA, 18 nt, Chlamydophila pneumoniae CWL029
uuccuucaaagcuuguuc

SEQ ID NO: 510698 - RNA, 12 nt, Chlamydophila pneumoniae CWL029
uuccuucuccug

SEQ ID NO: 510699 - RNA, 16 nt, Chlamydophila pneumoniae CWL029
uuccuucgaagcggag

SEQ ID NO: 510700 - RNA, 15 nt, Chlamydophila pneumoniae CWL029
uuccuaaaucugcuu

SEQ ID NO: 510701 - RNA, 16 nt, Chlamydophila pneumoniae CWL029
uuccuaaaucugcuuu

SEQ ID NO: 510702 - RNA, 15 nt, Chlamydophila pneumoniae CWL029
uuccuaacuaucucu

SEQ ID NO: 510703 - RNA, 19 nt, Chlamydophila pneumoniae CWL029
uuccuaacuaucucuguuu

SEQ ID NO: 510704 - RNA, 21 nt, Chlamydophila pneumoniae CWL029
uuccuaacuaucucuguuuuu

SEQ ID NO: 510705 - RNA, 15 nt, Chlamydophila pneumoniae CWL029
uuccuaaguuagaga

SEQ ID NO: 510706 - RNA, 23 nt, Chlamydophila pneumoniae CWL029
uuccuuaucaggaaaugaagucc

SEQ ID NO: 510707 - RNA, 23 nt, Chlamydophila pneumoniae CWL029
uuccuuaaugagaguuucuaaug

SEQ ID NO: 510708 - RNA, 19 nt, Chlamydophila pneumoniae CWL029
uuccuuaaugguagcuuaa

SEQ ID NO: 510709 - RNA, 20 nt, Chlamydophila pneumoniae CWL029
uuccuuacaagcuuccuugg

SEQ ID NO: 510710 - RNA, 22 nt, Chlamydophila pneumoniae CWL029
uuccuuacaagcuuccuugguc

SEQ ID NO: 510711 - RNA, 18 nt, Chlamydophila pneumoniae CWL029
uuccugacuauaaaaugc

SEQ ID NO: 510712 - RNA, 24 nt, Chlamydophila pneumoniae CWL029
uuccucuucaauuucuucaucaau

SEQ ID NO: 510713 - RNA, 19 nt, Chlamydophila pneumoniae CWL029
uuccucuucaauuucuuca

SEQ ID NO: 510714 - RNA, 18 nt, Chlamydophila pneumoniae CWL029
uuccugaagcagcuucug

SEQ ID NO: 510715 - RNA, 21 nt, Chlamydophila pneumoniae CWL029
uucccuuguuaugaaaaucuu

SEQ ID NO: 510716 - RNA, 17 nt, Chlamydophila pneumoniae CWL029
uucccugacacagagcu

SEQ ID NO: 510717 - RNA, 14 nt, Chlamydophila pneumoniae CWL029
uucccucuucuucc

SEQ ID NO: 510718 - RNA, 18 nt, Chlamydophila pneumoniae CWL029
uucccuguccgcaauagu

SEQ ID NO: 510719 - RNA, 17 nt, Chlamydophila pneumoniae CWL029
uuccggguucauuucca

SEQ ID NO: 510720 - RNA, 21 nt, Chlamydophila pneumoniae CWL029
uuccccuucagaggcuagaaa

SEQ ID NO: 510721 - RNA, 17 nt, Chlamydophila pneumoniae CWL029
uucccuaagaguuccaa

SEQ ID NO: 510722 - RNA, 18 nt, Chlamydophila pneumoniae CWL029
uucccccgcguaauagca

SEQ ID NO: 510723 - RNA, 14 nt, Chlamydophila pneumoniae CWL029
uuccaagaaaaauu

SEQ ID NO: 510724 - RNA, 23 nt, Chlamydophila pneumoniae CWL029
uuccaauccauucugagaaagaa

SEQ ID NO: 510725 - RNA, 12 nt, Chlamydophila pneumoniae CWL029
uuccaagugauc

SEQ ID NO: 510726 - RNA, 17 nt, Chlamydophila pneumoniae CWL029
uuccaauacuaaaacua

SEQ ID NO: 510727 - RNA, 17 nt, Chlamydophila pneumoniae CWL029
uuccaauagagucucuu

SEQ ID NO: 510728 - RNA, 14 nt, Chlamydophila pneumoniae CWL029
uuguaauaaaauca

SEQ ID NO: 510729 - RNA, 20 nt, Chlamydophila pneumoniae CWL029
uuguaauuucuaaauagaaa

SEQ ID NO: 510730 - RNA, 22 nt, Chlamydophila pneumoniae CWL029
uuguaagcgugcaaguucacac

SEQ ID NO: 510731 - RNA, 18 nt, Chlamydophila pneumoniae CWL029
uuguagcagcaagaacau

SEQ ID NO: 510732 - RNA, 17 nt, Chlamydophila pneumoniae CWL029
uuguaguccacaucuug

SEQ ID NO: 510733 - RNA, 23 nt, Chlamydophila pneumoniae CWL029
uuguaguaaggagagacuguguu

SEQ ID NO: 510734 - RNA, 13 nt, Chlamydophila pneumoniae CWL029
uuguaguucuuug

SEQ ID NO: 510735 - RNA, 22 nt, Chlamydophila pneumoniae CWL029
uuguagagagaaucgagaacag

SEQ ID NO: 510736 - RNA, 21 nt, Chlamydophila pneumoniae CWL029
uuguagagacauagccuauau

SEQ ID NO: 510737 - RNA, 16 nt, Chlamydophila pneumoniae CWL029
uuguacuuuuugccac

SEQ ID NO: 510738 - RNA, 21 nt, Chlamydophila pneumoniae CWL029
uugucacacugcgagagaaag

SEQ ID NO: 510739 - RNA, 17 nt, Chlamydophila pneumoniae CWL029
uugucaacaaaagcuau

SEQ ID NO: 510740 - RNA, 23 nt, Chlamydophila pneumoniae CWL029
uugucagcuuugcuuauuucccc

SEQ ID NO: 510741 - RNA, 23 nt, Chlamydophila pneumoniae CWL029
uuguauggaauucaaacuccuuu

SEQ ID NO: 510742 - RNA, 11 nt, Chlamydophila pneumoniae CWL029
uuguauuaaag

SEQ ID NO: 510743 - RNA, 12 nt, Chlamydophila pneumoniae CWL029
uuguauucagug

SEQ ID NO: 510744 - RNA, 20 nt, Chlamydophila pneumoniae CWL029
uuguauuccuuggauuucuu

SEQ ID NO: 510745 - RNA, 18 nt, Chlamydophila pneumoniae CWL029
uuguccuaggagagcuag

SEQ ID NO: 510746 - RNA, 21 nt, Chlamydophila pneumoniae CWL029
uuguuaaaguaaaaaauacag

SEQ ID NO: 510747 - RNA, 19 nt, Chlamydophila pneumoniae CWL029
uuguuccaauagagucucu

SEQ ID NO: 510748 - RNA, 16 nt, Chlamydophila pneumoniae CWL029
uuguucagcuagagca

SEQ ID NO: 510749 - RNA, 17 nt, Chlamydophila pneumoniae CWL029
uuguguucccucuucuu

SEQ ID NO: 510750 - RNA, 16 nt, Chlamydophila pneumoniae CWL029
uuguggcuuuucuaaa

SEQ ID NO: 510751 - RNA, 14 nt, Chlamydophila pneumoniae CWL029
uuguucuaaaauga

SEQ ID NO: 510752 - RNA, 21 nt, Chlamydophila pneumoniae CWL029
uuguugaggaauuggcaggua

SEQ ID NO: 510753 - RNA, 22 nt, Chlamydophila pneumoniae CWL029
uuguucuuccaacuucuguauc

SEQ ID NO: 510754 - RNA, 17 nt, Chlamydophila pneumoniae CWL029
uuguucuugaaguucuu

SEQ ID NO: 510755 - RNA, 14 nt, Chlamydophila pneumoniae CWL029
uuguuuguaucaaa

SEQ ID NO: 510756 - RNA, 16 nt, Chlamydophila pneumoniae CWL029
uuuaaaaauagaaaua

SEQ ID NO: 510757 - RNA, 19 nt, Chlamydophila pneumoniae CWL029
uugugcuaaagcaggagca

SEQ ID NO: 510758 - RNA, 21 nt, Chlamydophila pneumoniae CWL029
uugugcuaggcucucgacacu

SEQ ID NO: 510759 - RNA, 19 nt, Chlamydophila pneumoniae CWL029
uugugcuagguaguguggu

SEQ ID NO: 510760 - RNA, 15 nt, Chlamydophila pneumoniae CWL029
uugugaguucuuccu

SEQ ID NO: 510761 - RNA, 17 nt, Chlamydophila pneumoniae CWL029
uugugauccuugcaaaa

SEQ ID NO: 510762 - RNA, 13 nt, Chlamydophila pneumoniae CWL029
uugugagcugcug

SEQ ID NO: 510763 - RNA, 22 nt, Chlamydophila pneumoniae CWL029
uugugaagauaagaccagaaag

SEQ ID NO: 510764 - RNA, 19 nt, Chlamydophila pneumoniae CWL029
uugucuacagaggaaucua

SEQ ID NO: 510765 - RNA, 22 nt, Chlamydophila pneumoniae CWL029
uugucugaggacaguauucccu

SEQ ID NO: 510766 - RNA, 23 nt, Chlamydophila pneumoniae CWL029
uugucugaggacaguauucccuc

SEQ ID NO: 510767 - RNA, 19 nt, Chlamydophila pneumoniae CWL029
uuuaucugcgacaaaaaug

SEQ ID NO: 510768 - RNA, 16 nt, Chlamydophila pneumoniae CWL029
uuuaucugcguuucuu

SEQ ID NO: 510769 - RNA, 22 nt, Chlamydophila pneumoniae CWL029
uuuaugaucucuucaugaaaaa

SEQ ID NO: 510770 - RNA, 14 nt, Chlamydophila pneumoniae CWL029
uuuaugauguauaa

SEQ ID NO: 510771 - RNA, 12 nt, Chlamydophila pneumoniae CWL029
uuuauuaaaauc

SEQ ID NO: 510772 - RNA, 21 nt, Chlamydophila pneumoniae CWL029
uuuauuuaaauaaaaccacuu

SEQ ID NO: 510773 - RNA, 16 nt, Chlamydophila pneumoniae CWL029
uuuauuuaaaauuucu

SEQ ID NO: 510774 - RNA, 14 nt, Chlamydophila pneumoniae CWL029
uuuaucauugcuau

SEQ ID NO: 510775 - RNA, 22 nt, Chlamydophila pneumoniae CWL029
uuuaucccagauaaagacaucu

SEQ ID NO: 510776 - RNA, 16 nt, Chlamydophila pneumoniae CWL029
uuuaucgacucuucca

SEQ ID NO: 510777 - RNA, 23 nt, Chlamydophila pneumoniae CWL029
uuuauauuuuuugagaaauauaa

SEQ ID NO: 510778 - RNA, 15 nt, Chlamydophila pneumoniae CWL029
uuuagagagaaacau

SEQ ID NO: 510779 - RNA, 13 nt, Chlamydophila pneumoniae CWL029
uuuagagaaaucu

SEQ ID NO: 510780 - RNA, 18 nt, Chlamydophila pneumoniae CWL029
uuuagcaugacuuuuuca

SEQ ID NO: 510781 - RNA, 18 nt, Chlamydophila pneumoniae CWL029
uuuauaacaucaagaauu

SEQ ID NO: 510782 - RNA, 14 nt, Chlamydophila pneumoniae CWL029
uuuauauuaagaau

SEQ ID NO: 510783 - RNA, 13 nt, Chlamydophila pneumoniae CWL029
uuuagaacuucaa

SEQ ID NO: 510784 - RNA, 13 nt, Chlamydophila pneumoniae CWL029
uuuagaauaagag

SEQ ID NO: 510785 - RNA, 14 nt, Chlamydophila pneumoniae CWL029
uuuagaauaagagc

SEQ ID NO: 510786 - RNA, 20 nt, Chlamydophila pneumoniae CWL029
uuuagaaucuuuucuagaaa

SEQ ID NO: 510787 - RNA, 16 nt, Chlamydophila pneumoniae CWL029
uuuagaauuuguccuu

SEQ ID NO: 510788 - RNA, 16 nt, Chlamydophila pneumoniae CWL029
uuuacuaacaaaauuu

SEQ ID NO: 510789 - RNA, 19 nt, Chlamydophila pneumoniae CWL029
uuuacuaacaaaauuucuu

SEQ ID NO: 510790 - RNA, 20 nt, Chlamydophila pneumoniae CWL029
uuuacacugcuucaaaacau

SEQ ID NO: 510791 - RNA, 17 nt, Chlamydophila pneumoniae CWL029
uuuaacuucuaaaagca

SEQ ID NO: 510792 - RNA, 12 nt, Chlamydophila pneumoniae CWL029
uuuaagauuuuu

SEQ ID NO: 510793 - RNA, 20 nt, Chlamydophila pneumoniae CWL029
uuuaagguucucugaacuug

SEQ ID NO: 510794 - RNA, 17 nt, Chlamydophila pneumoniae CWL029
uuuaagucacuaaagau

SEQ ID NO: 510795 - RNA, 13 nt, Chlamydophila pneumoniae CWL029
uuuaauaaaauuu

SEQ ID NO: 510796 - RNA, 18 nt, Chlamydophila pneumoniae CWL029
uuuaauaaaauuuaaaaa

SEQ ID NO: 510797 - RNA, 19 nt, Chlamydophila pneumoniae CWL029
uuuaauaaaauuuaaaaaa

SEQ ID NO: 510798 - RNA, 14 nt, Chlamydophila pneumoniae CWL029
uuuaauacaaaaaa

SEQ ID NO: 510799 - RNA, 16 nt, Chlamydophila pneumoniae CWL029
uuuaauacaaaaaaua

SEQ ID NO: 510800 - RNA, 13 nt, Chlamydophila pneumoniae CWL029
uuuaaucagagga

SEQ ID NO: 510801 - RNA, 21 nt, Chlamydophila pneumoniae CWL029
uuuaaucgauacgguuuuuau

SEQ ID NO: 510802 - RNA, 13 nt, Chlamydophila pneumoniae CWL029
uugguucaaaucc

SEQ ID NO: 510803 - RNA, 15 nt, Chlamydophila pneumoniae CWL029
uugggaaaagaaaag

SEQ ID NO: 510804 - RNA, 22 nt, Chlamydophila pneumoniae CWL029
uugggaaugcauuucaugaauu

SEQ ID NO: 510805 - RNA, 19 nt, Chlamydophila pneumoniae CWL029
uugggagaugcuauuuacu

SEQ ID NO: 510806 - RNA, 13 nt, Chlamydophila pneumoniae CWL029
uugggaggaggag

SEQ ID NO: 510807 - RNA, 16 nt, Chlamydophila pneumoniae CWL029
uugggauaaaaaguuu

SEQ ID NO: 510808 - RNA, 19 nt, Chlamydophila pneumoniae CWL029
uugggcaaauaggagagca

SEQ ID NO: 510809 - RNA, 17 nt, Chlamydophila pneumoniae CWL029
uuggaagauugaaggca

SEQ ID NO: 510810 - RNA, 15 nt, Chlamydophila pneumoniae CWL029
uuggaaaucagaauc

SEQ ID NO: 510811 - RNA, 19 nt, Chlamydophila pneumoniae CWL029
uuggacguacuaagauacg

SEQ ID NO: 510812 - RNA, 22 nt, Chlamydophila pneumoniae CWL029
uuggaggaacaauacucucugc

SEQ ID NO: 510813 - RNA, 18 nt, Chlamydophila pneumoniae CWL029
uuggacaacgcuucuuuu

SEQ ID NO: 510814 - RNA, 22 nt, Chlamydophila pneumoniae CWL029
uuggcagagcauucgauuugua

SEQ ID NO: 510815 - RNA, 16 nt, Chlamydophila pneumoniae CWL029
uuggcaguucacugag

SEQ ID NO: 510816 - RNA, 15 nt, Chlamydophila pneumoniae CWL029
uuggauuucuucuuc

SEQ ID NO: 510817 - RNA, 18 nt, Chlamydophila pneumoniae CWL029
uuggauuucuucuucuaa

SEQ ID NO: 510818 - RNA, 19 nt, Chlamydophila pneumoniae CWL029
uugcuguagcgcuuccagc

SEQ ID NO: 510819 - RNA, 15 nt, Chlamydophila pneumoniae CWL029
uugcuauugaaaaau

SEQ ID NO: 510820 - RNA, 20 nt, Chlamydophila pneumoniae CWL029
uugcuauugaaaaaucccug

SEQ ID NO: 510821 - RNA, 16 nt, Chlamydophila pneumoniae CWL029
uugcuauacagaaaag

SEQ ID NO: 510822 - RNA, 14 nt, Chlamydophila pneumoniae CWL029
uugcuacagcuucu

SEQ ID NO: 510823 - RNA, 18 nt, Chlamydophila pneumoniae CWL029
uugcuagaucuggagagg

SEQ ID NO: 510824 - RNA, 15 nt, Chlamydophila pneumoniae CWL029
uugcuaagcauuuua

SEQ ID NO: 510825 - RNA, 20 nt, Chlamydophila pneumoniae CWL029
uugcuaagcgaaccaaaguc

SEQ ID NO: 510826 - RNA, 12 nt, Chlamydophila pneumoniae CWL029
uugcuuccaacg

SEQ ID NO: 510827 - RNA, 20 nt, Chlamydophila pneumoniae CWL029
uugcuuauugucuuaaaauu

SEQ ID NO: 510828 - RNA, 19 nt, Chlamydophila pneumoniae CWL029
uugcuuaaaaagucugaau

SEQ ID NO: 510829 - RNA, 23 nt, Chlamydophila pneumoniae CWL029
uugcuguggcauacucuuugcag

SEQ ID NO: 510830 - RNA, 14 nt, Chlamydophila pneumoniae CWL029
uugcuguggaauuu

SEQ ID NO: 510831 - RNA, 11 nt, Chlamydophila pneumoniae CWL029
uugcuuucuag

SEQ ID NO: 510832 - RNA, 15 nt, Chlamydophila pneumoniae CWL029
uugcuuuucuaggau

SEQ ID NO: 510833 - RNA, 16 nt, Chlamydophila pneumoniae CWL029
uugcuugaaguuuguc

SEQ ID NO: 510834 - RNA, 22 nt, Chlamydophila pneumoniae CWL029
uugcuugcuauagggaucuccu

SEQ ID NO: 510835 - RNA, 14 nt, Chlamydophila pneumoniae CWL029
uugcgacauaacca

SEQ ID NO: 510836 - RNA, 16 nt, Chlamydophila pneumoniae CWL029
uugcggaaauugaaua

SEQ ID NO: 510837 - RNA, 17 nt, Chlamydophila pneumoniae CWL029
uugccguauagauuuuc

SEQ ID NO: 510838 - RNA, 18 nt, Chlamydophila pneumoniae CWL029
uugccgugaguugcaauu

SEQ ID NO: 510839 - RNA, 18 nt, Chlamydophila pneumoniae CWL029
uugcagauugaaucccau

SEQ ID NO: 510840 - RNA, 20 nt, Chlamydophila pneumoniae CWL029
uugcagaagcauuguauucc

SEQ ID NO: 510841 - RNA, 15 nt, Chlamydophila pneumoniae CWL029
uugauuuuaaaauga

SEQ ID NO: 510842 - RNA, 19 nt, Chlamydophila pneumoniae CWL029
uugcagcucggaaugcucu

SEQ ID NO: 510843 - RNA, 16 nt, Chlamydophila pneumoniae CWL029
uugcagcucggaaugc

SEQ ID NO: 510844 - RNA, 16 nt, Chlamydophila pneumoniae CWL029
uugcauagacaugcga

SEQ ID NO: 510845 - RNA, 13 nt, Chlamydophila pneumoniae CWL029
uugcaguggcuua

SEQ ID NO: 510846 - RNA, 13 nt, Chlamydophila pneumoniae CWL029
uugcaugaggaga

SEQ ID NO: 510847 - RNA, 18 nt, Chlamydophila pneumoniae CWL029
uugcaugaugcuguugau

SEQ ID NO: 510848 - RNA, 21 nt, Chlamydophila pneumoniae CWL029
uugcauuaaaucguacuucac

SEQ ID NO: 510849 - RNA, 21 nt, Chlamydophila pneumoniae CWL029
uugcauuagauacgcucucug

SEQ ID NO: 510850 - RNA, 12 nt, Chlamydophila pneumoniae CWL029
uugccagcagaa

SEQ ID NO: 510851 - RNA, 14 nt, Chlamydophila pneumoniae CWL029
uugauuauucccaa

SEQ ID NO: 510852 - RNA, 16 nt, Chlamydophila pneumoniae CWL029
uugauuuagaaucuuu

SEQ ID NO: 510853 - RNA, 12 nt, Chlamydophila pneumoniae CWL029
uugauuuuaaaa

SEQ ID NO: 510854 - RNA, 19 nt, Chlamydophila pneumoniae CWL029
uugauguacaguaaaguau

SEQ ID NO: 510855 - RNA, 17 nt, Chlamydophila pneumoniae CWL029
uugauaguguucgagca

SEQ ID NO: 510856 - RNA, 21 nt, Chlamydophila pneumoniae CWL029
uugauaguguucgagcaucuc

SEQ ID NO: 510857 - RNA, 16 nt, Chlamydophila pneumoniae CWL029
uugauaauuacagaag

SEQ ID NO: 510858 - RNA, 15 nt, Chlamydophila pneumoniae CWL029
uugaucgcuugugca

SEQ ID NO: 510859 - RNA, 14 nt, Chlamydophila pneumoniae CWL029
uugaucuacaaaaa

SEQ ID NO: 510860 - RNA, 17 nt, Chlamydophila pneumoniae CWL029
uugaucuacaaaaacua

SEQ ID NO: 510861 - RNA, 17 nt, Chlamydophila pneumoniae CWL029
uugaggguucaauuccu

SEQ ID NO: 510862 - RNA, 20 nt, Chlamydophila pneumoniae CWL029
uugaggauuucuugcaagga

SEQ ID NO: 510863 - RNA, 18 nt, Chlamydophila pneumoniae CWL029
uugaggaacgcacgccaa

SEQ ID NO: 510864 - RNA, 19 nt, Chlamydophila pneumoniae CWL029
uugaguuccgaauaggcau

SEQ ID NO: 510865 - RNA, 14 nt, Chlamydophila pneumoniae CWL029
uugauaauagucuu

SEQ ID NO: 510866 - RNA, 21 nt, Chlamydophila pneumoniae CWL029
uucuucuuuccauagaucccu

SEQ ID NO: 510867 - RNA, 22 nt, Chlamydophila pneumoniae CWL029
uucuuggucggaguuuuuuucu

SEQ ID NO: 510868 - RNA, 18 nt, Chlamydophila pneumoniae CWL029
uucuuguaauaaaagaac

SEQ ID NO: 510869 - RNA, 20 nt, Chlamydophila pneumoniae CWL029
uucuuguaauaaaagaacau

SEQ ID NO: 510870 - RNA, 21 nt, Chlamydophila pneumoniae CWL029
uucuugguaggaugucgcuuu

SEQ ID NO: 510871 - RNA, 14 nt, Chlamydophila pneumoniae CWL029
uucuuguagcuccc

SEQ ID NO: 510872 - RNA, 17 nt, Chlamydophila pneumoniae CWL029
uucuuguugcaauagca

SEQ ID NO: 510873 - RNA, 15 nt, Chlamydophila pneumoniae CWL029
uugagcaucacggag

SEQ ID NO: 510874 - RNA, 18 nt, Chlamydophila pneumoniae CWL029
aagcugagguagcaucuc

SEQ ID NO: 510875 - RNA, 18 nt, Chlamydophila pneumoniae CWL029
aagcuggauucugucuau

SEQ ID NO: 510876 - RNA, 19 nt, Chlamydophila pneumoniae CWL029
aagcuuaucccauaaaugu

SEQ ID NO: 510877 - RNA, 15 nt, Chlamydophila pneumoniae CWL029
aagcuguaaaugagg

SEQ ID NO: 510878 - RNA, 14 nt, Chlamydophila pneumoniae CWL029
aagcuguacuugau

SEQ ID NO: 510879 - RNA, 22 nt, Chlamydophila pneumoniae CWL029
aagcuguacuugauauuguucu

SEQ ID NO: 510880 - RNA, 23 nt, Chlamydophila pneumoniae CWL029
aagcuguacuugauauuguucuu

SEQ ID NO: 510881 - RNA, 19 nt, Chlamydophila pneumoniae CWL029
aagcuuauuucuguaguuc

SEQ ID NO: 510882 - RNA, 15 nt, Chlamydophila pneumoniae CWL029
aagcuucaaugaugu

SEQ ID NO: 510883 - RNA, 20 nt, Chlamydophila pneumoniae CWL029
aagcuuccaucguuagauuu

SEQ ID NO: 510884 - RNA, 23 nt, Chlamydophila pneumoniae CWL029
aagcuuccggcuuguaggaucug

SEQ ID NO: 510885 - RNA, 19 nt, Chlamydophila pneumoniae CWL029
aagcuggauucugucuaua

SEQ ID NO: 510886 - RNA, 14 nt, Chlamydophila pneumoniae CWL029
aaggaaaucacaga

SEQ ID NO: 510887 - RNA, 15 nt, Chlamydophila pneumoniae CWL029
aagcuugccagcaga

SEQ ID NO: 510888 - RNA, 14 nt, Chlamydophila pneumoniae CWL029
aaggaaaaacaaac

SEQ ID NO: 510889 - RNA, 20 nt, Chlamydophila pneumoniae CWL029
aagcuucuuuaauuccaacu

SEQ ID NO: 510890 - RNA, 14 nt, Chlamydophila pneumoniae CWL029
aagcuucuucugcg

SEQ ID NO: 510891 - RNA, 15 nt, Chlamydophila pneumoniae CWL029
aagcuugagaaaagg

SEQ ID NO: 510892 - RNA, 13 nt, Chlamydophila pneumoniae CWL029
aaggagagaaaau

SEQ ID NO: 510893 - RNA, 13 nt, Chlamydophila pneumoniae CWL029
aaggacucuuucu

SEQ ID NO: 510894 - RNA, 14 nt, Chlamydophila pneumoniae CWL029
aaggacucuuucua

SEQ ID NO: 510895 - RNA, 13 nt, Chlamydophila pneumoniae CWL029
aaggacauagacu

SEQ ID NO: 510896 - RNA, 14 nt, Chlamydophila pneumoniae CWL029
aaggaacugugcca

SEQ ID NO: 510897 - RNA, 18 nt, Chlamydophila pneumoniae CWL029
aaggaagaagaagaagga

SEQ ID NO: 510898 - RNA, 16 nt, Chlamydophila pneumoniae CWL029
aaggacaaucaacauu

SEQ ID NO: 510899 - RNA, 15 nt, Chlamydophila pneumoniae CWL029
aagcuauuguuuuuc

SEQ ID NO: 510900 - RNA, 18 nt, Chlamydophila pneumoniae CWL029
aagcucaagagcaugcuu

SEQ ID NO: 510901 - RNA, 21 nt, Chlamydophila pneumoniae CWL029
aagcuaacaacuucugacaau

SEQ ID NO: 510902 - RNA, 12 nt, Chlamydophila pneumoniae CWL029
aagcucaucagc

SEQ ID NO: 510903 - RNA, 19 nt, Chlamydophila pneumoniae CWL029
aagcucuucuacuuuaaga

SEQ ID NO: 510904 - RNA, 12 nt, Chlamydophila pneumoniae CWL029
aagcuaaaaaau

SEQ ID NO: 510905 - RNA, 15 nt, Chlamydophila pneumoniae CWL029
aagcuaaaaaauuuu

SEQ ID NO: 510906 - RNA, 22 nt, Chlamydophila pneumoniae CWL029
aagcguauagaauagaauguau

SEQ ID NO: 510907 - RNA, 15 nt, Chlamydophila pneumoniae CWL029
aagcgcgcuaaaaaa

SEQ ID NO: 510908 - RNA, 18 nt, Chlamydophila pneumoniae CWL029
aagcgauguuccuuuuuu

SEQ ID NO: 510909 - RNA, 18 nt, Chlamydophila pneumoniae CWL029
aagccugucuuaucuaaa

SEQ ID NO: 510910 - RNA, 23 nt, Chlamydophila pneumoniae CWL029
aagccugucuuaucuaaagaaau

SEQ ID NO: 510911 - RNA, 14 nt, Chlamydophila pneumoniae CWL029
aagccuucauucca

SEQ ID NO: 510912 - RNA, 13 nt, Chlamydophila pneumoniae CWL029
aagccuuccuugu

SEQ ID NO: 510913 - RNA, 18 nt, Chlamydophila pneumoniae CWL029
aagccuuccuuguuguau

SEQ ID NO: 510914 - RNA, 14 nt, Chlamydophila pneumoniae CWL029
aagccuuucuuauu

SEQ ID NO: 510915 - RNA, 15 nt, Chlamydophila pneumoniae CWL029
aagccucgaaauuuu

SEQ ID NO: 510916 - RNA, 23 nt, Chlamydophila pneumoniae CWL029
aagccuccucaagauaaauccca

SEQ ID NO: 510917 - RNA, 22 nt, Chlamydophila pneumoniae CWL029
aagccuaaaucuauacccaguu

SEQ ID NO: 510918 - RNA, 22 nt, Chlamydophila pneumoniae CWL029
aagccggcccacucaaaagaag

SEQ ID NO: 510919 - RNA, 15 nt, Chlamydophila pneumoniae CWL029
aagcccccuccccca

SEQ ID NO: 510920 - RNA, 20 nt, Chlamydophila pneumoniae CWL029
aagcccucauccccucagaa

SEQ ID NO: 510921 - RNA, 20 nt, Chlamydophila pneumoniae CWL029
aagccccacccacuccagaa

SEQ ID NO: 510922 - RNA, 14 nt, Chlamydophila pneumoniae CWL029
aagcccauuccugc

SEQ ID NO: 510923 - RNA, 16 nt, Chlamydophila pneumoniae CWL029
aagccgauacccaucu

SEQ ID NO: 510924 - RNA, 20 nt, Chlamydophila pneumoniae CWL029
aagccgauacccaucuagaa

SEQ ID NO: 510925 - RNA, 21 nt, Chlamydophila pneumoniae CWL029
aagaagguuuauuagaaguau

SEQ ID NO: 510926 - RNA, 13 nt, Chlamydophila pneumoniae CWL029
aagaagguugaga

SEQ ID NO: 510927 - RNA, 18 nt, Chlamydophila pneumoniae CWL029
aagccagucuucauaaga

SEQ ID NO: 510928 - RNA, 17 nt, Chlamydophila pneumoniae CWL029
aagccauuuucuaagag

SEQ ID NO: 510929 - RNA, 20 nt, Chlamydophila pneumoniae CWL029
aagccaugcaaugaaggcgu

SEQ ID NO: 510930 - RNA, 21 nt, Chlamydophila pneumoniae CWL029
aagccauuugguaguuuuuca

SEQ ID NO: 510931 - RNA, 23 nt, Chlamydophila pneumoniae CWL029
aagccauuuucuaagagaucuac

SEQ ID NO: 510932 - RNA, 22 nt, Chlamydophila pneumoniae CWL029
aaguacauuaucacagcaaucu

SEQ ID NO: 510933 - RNA, 22 nt, Chlamydophila pneumoniae CWL029
aaguacagaaaggaccuccuca

SEQ ID NO: 510934 - RNA, 14 nt, Chlamydophila pneumoniae CWL029
aaguacacauuguc

SEQ ID NO: 510935 - RNA, 22 nt, Chlamydophila pneumoniae CWL029
aaguaccuauugugcuuuucuc

SEQ ID NO: 510936 - RNA, 16 nt, Chlamydophila pneumoniae CWL029
aaguagaauccuucuc

SEQ ID NO: 510937 - RNA, 18 nt, Chlamydophila pneumoniae CWL029
aaguacuaauuacagaau

SEQ ID NO: 510938 - RNA, 13 nt, Chlamydophila pneumoniae CWL029
aaguacuacaaua

SEQ ID NO: 510939 - RNA, 21 nt, Chlamydophila pneumoniae CWL029
aaguaaaucagacuuaaagua

SEQ ID NO: 510940 - RNA, 16 nt, Chlamydophila pneumoniae CWL029
aaguaaaauuucugua

SEQ ID NO: 510941 - RNA, 15 nt, Chlamydophila pneumoniae CWL029
aaguaaagaaauucu

SEQ ID NO: 510942 - RNA, 14 nt, Chlamydophila pneumoniae CWL029
aaggucacagcauu

SEQ ID NO: 510943 - RNA, 19 nt, Chlamydophila pneumoniae CWL029
aagguauuucucuccacag

SEQ ID NO: 510944 - RNA, 15 nt, Chlamydophila pneumoniae CWL029
aaggguuguugccag

SEQ ID NO: 510945 - RNA, 13 nt, Chlamydophila pneumoniae CWL029
aagggaggagaac

SEQ ID NO: 510946 - RNA, 16 nt, Chlamydophila pneumoniae CWL029
aagggaggagaacuuc

SEQ ID NO: 510947 - RNA, 14 nt, Chlamydophila pneumoniae CWL029
aagggaucuccuuc

SEQ ID NO: 510948 - RNA, 17 nt, Chlamydophila pneumoniae CWL029
aagggaugcucuagaaa

SEQ ID NO: 510949 - RNA, 23 nt, Chlamydophila pneumoniae CWL029
aagggaugggaucggucuuuucu

SEQ ID NO: 510950 - RNA, 20 nt, Chlamydophila pneumoniae CWL029
aagggggaucuucagagaga

SEQ ID NO: 510951 - RNA, 23 nt, Chlamydophila pneumoniae CWL029
aaggcuuuucuuuuucuagggau

SEQ ID NO: 510952 - RNA, 14 nt, Chlamydophila pneumoniae CWL029
aagggaagagaaaa

SEQ ID NO: 510953 - RNA, 21 nt, Chlamydophila pneumoniae CWL029
aaggcguuuuuuaauucucug

SEQ ID NO: 510954 - RNA, 17 nt, Chlamydophila pneumoniae CWL029
aaggauucuaugaggac

SEQ ID NO: 510955 - RNA, 21 nt, Chlamydophila pneumoniae CWL029
aaggauucugagaaguuaaga

SEQ ID NO: 510956 - RNA, 15 nt, Chlamydophila pneumoniae CWL029
aaggaucauuaaagu

SEQ ID NO: 510957 - RNA, 14 nt, Chlamydophila pneumoniae CWL029
aaggagagcuucuu

SEQ ID NO: 510958 - RNA, 23 nt, Chlamydophila pneumoniae CWL029
aaggaucccaucaucgagcugau

SEQ ID NO: 510959 - RNA, 12 nt, Chlamydophila pneumoniae CWL029
aaggaucugaua

SEQ ID NO: 510960 - RNA, 24 nt, Chlamydophila pneumoniae CWL029
aaggaugcaucucuuaaaacauga

SEQ ID NO: 510961 - RNA, 17 nt, Chlamydophila pneumoniae CWL029
aaguauauauuuuacaa

SEQ ID NO: 510962 - RNA, 23 nt, Chlamydophila pneumoniae CWL029
aaguauauauuuuacaaugaagu

SEQ ID NO: 510963 - RNA, 15 nt, Chlamydophila pneumoniae CWL029
aaguaggauugauaa

SEQ ID NO: 510964 - RNA, 14 nt, Chlamydophila pneumoniae CWL029
aaguagcucucucc

SEQ ID NO: 510965 - RNA, 13 nt, Chlamydophila pneumoniae CWL029
aagucaugaggac

SEQ ID NO: 510966 - RNA, 22 nt, Chlamydophila pneumoniae CWL029
aaguccuggauuuuaaagcaaa

SEQ ID NO: 510967 - RNA, 22 nt, Chlamydophila pneumoniae CWL029
aagugcgagguaugaauaggaa

SEQ ID NO: 510968 - RNA, 14 nt, Chlamydophila pneumoniae CWL029
aagugaucagaaau

SEQ ID NO: 510969 - RNA, 18 nt, Chlamydophila pneumoniae CWL029
aagugaucuugagaaaag

SEQ ID NO: 510970 - RNA, 21 nt, Chlamydophila pneumoniae CWL029
aagucuucaaugacuucugga

SEQ ID NO: 510971 - RNA, 20 nt, Chlamydophila pneumoniae CWL029
aagugacuuccuccaaaauu

SEQ ID NO: 510972 - RNA, 16 nt, Chlamydophila pneumoniae CWL029
aaguuagguagauaga

SEQ ID NO: 510973 - RNA, 22 nt, Chlamydophila pneumoniae CWL029
aaguuauacggccgacucuaca

SEQ ID NO: 510974 - RNA, 16 nt, Chlamydophila pneumoniae CWL029
aauagccucuccuuga

SEQ ID NO: 510975 - RNA, 19 nt, Chlamydophila pneumoniae CWL029
aauagcgacaugagaaauc

SEQ ID NO: 510976 - RNA, 20 nt, Chlamydophila pneumoniae CWL029
aauagcgacaugagaaaucu

SEQ ID NO: 510977 - RNA, 23 nt, Chlamydophila pneumoniae CWL029
aauagcgacaugagaaaucuuuu

SEQ ID NO: 510978 - RNA, 17 nt, Chlamydophila pneumoniae CWL029
aauaggcucuuuagcaa

SEQ ID NO: 510979 - RNA, 20 nt, Chlamydophila pneumoniae CWL029
aauagucucuguaagaacgu

SEQ ID NO: 510980 - RNA, 21 nt, Chlamydophila pneumoniae CWL029
aauauaauuccaauugccaug

SEQ ID NO: 510981 - RNA, 16 nt, Chlamydophila pneumoniae CWL029
aauauacucuugcuug

SEQ ID NO: 510982 - RNA, 17 nt, Chlamydophila pneumoniae CWL029
aauauacucuugcuugc

SEQ ID NO: 510983 - RNA, 18 nt, Chlamydophila pneumoniae CWL029
aauauagagaacuccauu

SEQ ID NO: 510984 - RNA, 17 nt, Chlamydophila pneumoniae CWL029
aauauagagaucuagau

SEQ ID NO: 510985 - RNA, 12 nt, Chlamydophila pneumoniae CWL029
aauaucaucacu

SEQ ID NO: 510986 - RNA, 20 nt, Chlamydophila pneumoniae CWL029
aauauaguuuucauaaucca

SEQ ID NO: 510987 - RNA, 12 nt, Chlamydophila pneumoniae CWL029
aauauauaaaga

SEQ ID NO: 510988 - RNA, 17 nt, Chlamydophila pneumoniae CWL029
aauaucaggacaaugaa

SEQ ID NO: 510989 - RNA, 18 nt, Chlamydophila pneumoniae CWL029
aauaucuccgccauaaca

SEQ ID NO: 510990 - RNA, 22 nt, Chlamydophila pneumoniae CWL029
aauaucuccguuaccaaaaacu

SEQ ID NO: 510991 - RNA, 21 nt, Chlamydophila pneumoniae CWL029
aauaucucuggcauaauccug

SEQ ID NO: 510992 - RNA, 22 nt, Chlamydophila pneumoniae CWL029
aauaucuguggcguaagcaaua

SEQ ID NO: 510993 - RNA, 16 nt, Chlamydophila pneumoniae CWL029
aauauccuaaauauau

SEQ ID NO: 510994 - RNA, 15 nt, Chlamydophila pneumoniae CWL029
aauaugcucugccau

SEQ ID NO: 510995 - RNA, 23 nt, Chlamydophila pneumoniae CWL029
aauauggacagcguauaggaaac

SEQ ID NO: 510996 - RNA, 22 nt, Chlamydophila pneumoniae CWL029
aauaugguaguuugccuucuua

SEQ ID NO: 510997 - RNA, 12 nt, Chlamydophila pneumoniae CWL029
aauacucuguuu

SEQ ID NO: 510998 - RNA, 18 nt, Chlamydophila pneumoniae CWL029
aauacucuagguuuucuc

SEQ ID NO: 510999 - RNA, 21 nt, Chlamydophila pneumoniae CWL029
aauacucuagguuuucucuuc

SEQ ID NO: 511000 - RNA, 15 nt, Chlamydophila pneumoniae CWL029
aauacugcgcaggga

SEQ ID NO: 511001 - RNA, 18 nt, Chlamydophila pneumoniae CWL029
aauacuguucgauaagaa

SEQ ID NO: 511002 - RNA, 21 nt, Chlamydophila pneumoniae CWL029
aauagcaucccuucuucuuuu

SEQ ID NO: 511003 - RNA, 20 nt, Chlamydophila pneumoniae CWL029
aauagccauaauuagaacag

SEQ ID NO: 511004 - RNA, 17 nt, Chlamydophila pneumoniae CWL029
aauagcaguauagagaa

SEQ ID NO: 511005 - RNA, 14 nt, Chlamydophila pneumoniae CWL029
aauagcaauggcuu

SEQ ID NO: 511006 - RNA, 21 nt, Chlamydophila pneumoniae CWL029
aauagauccugaaaguacaga

SEQ ID NO: 511007 - RNA, 13 nt, Chlamydophila pneumoniae CWL029
aauagauucguua

SEQ ID NO: 511008 - RNA, 14 nt, Chlamydophila pneumoniae CWL029
aauagcaagcacuu

SEQ ID NO: 511009 - RNA, 20 nt, Chlamydophila pneumoniae CWL029
aauagcaagcgcuagugcaa

SEQ ID NO: 511010 - RNA, 15 nt, Chlamydophila pneumoniae CWL029
aauagcaaguagcuc

SEQ ID NO: 511011 - RNA, 16 nt, Chlamydophila pneumoniae CWL029
aauagcaaguagcucu

SEQ ID NO: 511012 - RNA, 17 nt, Chlamydophila pneumoniae CWL029
aauagcaaagauuucug

SEQ ID NO: 511013 - RNA, 21 nt, Chlamydophila pneumoniae CWL029
aauagauuuuuacuugcccaa

SEQ ID NO: 511014 - RNA, 18 nt, Chlamydophila pneumoniae CWL029
aauagauucguuauccuc

SEQ ID NO: 511015 - RNA, 15 nt, Chlamydophila pneumoniae CWL029
aauacgcuuuucuuc

SEQ ID NO: 511016 - RNA, 21 nt, Chlamydophila pneumoniae CWL029
aauaccuguacgguaaaucca

SEQ ID NO: 511017 - RNA, 22 nt, Chlamydophila pneumoniae CWL029
aauaccuguacgguaaauccau

SEQ ID NO: 511018 - RNA, 21 nt, Chlamydophila pneumoniae CWL029
aauaccuuucuaagaauucuu

SEQ ID NO: 511019 - RNA, 17 nt, Chlamydophila pneumoniae CWL029
aauaccguuuuaggaag

SEQ ID NO: 511020 - RNA, 21 nt, Chlamydophila pneumoniae CWL029
aauaccaauugggcuaggguu

SEQ ID NO: 511021 - RNA, 22 nt, Chlamydophila pneumoniae CWL029
aauaauuuguuuagaaaaagau

SEQ ID NO: 511022 - RNA, 12 nt, Chlamydophila pneumoniae CWL029
aauaauuuuccc

SEQ ID NO: 511023 - RNA, 12 nt, Chlamydophila pneumoniae CWL029
aauacaaaaaau

SEQ ID NO: 511024 - RNA, 14 nt, Chlamydophila pneumoniae CWL029
aauacaaaaaauaa

SEQ ID NO: 511025 - RNA, 20 nt, Chlamydophila pneumoniae CWL029
aauacaaaaaauaaaaucaa

SEQ ID NO: 511026 - RNA, 19 nt, Chlamydophila pneumoniae CWL029
aauacaaaacaaaagccau

SEQ ID NO: 511027 - RNA, 14 nt, Chlamydophila pneumoniae CWL029
aauaagauuuugaa

SEQ ID NO: 511028 - RNA, 15 nt, Chlamydophila pneumoniae CWL029
aauaagauuuugaaa

SEQ ID NO: 511029 - RNA, 22 nt, Chlamydophila pneumoniae CWL029
aauaaccgaaacuucucagaua

SEQ ID NO: 511030 - RNA, 17 nt, Chlamydophila pneumoniae CWL029
aauaacaccaaaagaau

SEQ ID NO: 511031 - RNA, 17 nt, Chlamydophila pneumoniae CWL029
aaguuccaaaucucaau

SEQ ID NO: 511032 - RNA, 18 nt, Chlamydophila pneumoniae CWL029
aaguuccauagaguaucu

SEQ ID NO: 511033 - RNA, 14 nt, Chlamydophila pneumoniae CWL029
aaguucauaaccug

SEQ ID NO: 511034 - RNA, 13 nt, Chlamydophila pneumoniae CWL029
aaguucaguaaaa

SEQ ID NO: 511035 - RNA, 15 nt, Chlamydophila pneumoniae CWL029
aaguucaucaaauaa

SEQ ID NO: 511036 - RNA, 13 nt, Chlamydophila pneumoniae CWL029
aaguugagagaga

SEQ ID NO: 511037 - RNA, 15 nt, Chlamydophila pneumoniae CWL029
aaguugaguugcgua

SEQ ID NO: 511038 - RNA, 20 nt, Chlamydophila pneumoniae CWL029
aaguugaguugcguacgaua

SEQ ID NO: 511039 - RNA, 15 nt, Chlamydophila pneumoniae CWL029
aauaaucaaccaaaa

SEQ ID NO: 511040 - RNA, 16 nt, Chlamydophila pneumoniae CWL029
aauaauacuuaauccu

SEQ ID NO: 511041 - RNA, 12 nt, Chlamydophila pneumoniae CWL029
aauaauagcaag

SEQ ID NO: 511042 - RNA, 17 nt, Chlamydophila pneumoniae CWL029
aauaauaggauaagaaa

SEQ ID NO: 511043 - RNA, 19 nt, Chlamydophila pneumoniae CWL029
aauaauaggauaagaaauu

SEQ ID NO: 511044 - RNA, 15 nt, Chlamydophila pneumoniae CWL029
aauaauaggauaaga

SEQ ID NO: 511045 - RNA, 14 nt, Chlamydophila pneumoniae CWL029
aauaaguccuguuu

SEQ ID NO: 511046 - RNA, 22 nt, Chlamydophila pneumoniae CWL029
aauaagcuugccagcagaaguu

SEQ ID NO: 511047 - RNA, 16 nt, Chlamydophila pneumoniae CWL029
aauaagcaggaaaagc

SEQ ID NO: 511048 - RNA, 17 nt, Chlamydophila pneumoniae CWL029
aauaagcauauuuaaau

SEQ ID NO: 511049 - RNA, 18 nt, Chlamydophila pneumoniae CWL029
aauaagcauauuuaaaua

SEQ ID NO: 511050 - RNA, 22 nt, Chlamydophila pneumoniae CWL029
aauaagcauauuuaaauauaaa

SEQ ID NO: 511051 - RNA, 20 nt, Chlamydophila pneumoniae CWL029
aauaaggcugcuaucaacau

SEQ ID NO: 511052 - RNA, 12 nt, Chlamydophila pneumoniae CWL029
aauaauuaaaua

SEQ ID NO: 511053 - RNA, 14 nt, Chlamydophila pneumoniae CWL029
aauaauuacuugga

SEQ ID NO: 511054 - RNA, 17 nt, Chlamydophila pneumoniae CWL029
aauuccuucucagaaag

SEQ ID NO: 511055 - RNA, 16 nt, Chlamydophila pneumoniae CWL029
aauuccuucucagaaa

SEQ ID NO: 511056 - RNA, 20 nt, Chlamydophila pneumoniae CWL029
aauuccuaaaacaagaagau

SEQ ID NO: 511057 - RNA, 16 nt, Chlamydophila pneumoniae CWL029
aauucggcagaaggcu

SEQ ID NO: 511058 - RNA, 19 nt, Chlamydophila pneumoniae CWL029
aauucggcagaaggcuugu

SEQ ID NO: 511059 - RNA, 23 nt, Chlamydophila pneumoniae CWL029
aauucgauguuaaggcuuccaau

SEQ ID NO: 511060 - RNA, 23 nt, Chlamydophila pneumoniae CWL029
aauucgcucagaaaauguaaaaa

SEQ ID NO: 511061 - RNA, 14 nt, Chlamydophila pneumoniae CWL029
aauucucagaaagc

SEQ ID NO: 511062 - RNA, 16 nt, Chlamydophila pneumoniae CWL029
aauucucaaggaucuu

SEQ ID NO: 511063 - RNA, 19 nt, Chlamydophila pneumoniae CWL029
aauucucgagcagcugcac

SEQ ID NO: 511064 - RNA, 23 nt, Chlamydophila pneumoniae CWL029
aauucuauuuauuuuauuaguuu

SEQ ID NO: 511065 - RNA, 19 nt, Chlamydophila pneumoniae CWL029
aauucucugacacuccuca

SEQ ID NO: 511066 - RNA, 21 nt, Chlamydophila pneumoniae CWL029
aauucauccagauuagaaaag

SEQ ID NO: 511067 - RNA, 15 nt, Chlamydophila pneumoniae CWL029
aauucauauuuacga

SEQ ID NO: 511068 - RNA, 20 nt, Chlamydophila pneumoniae CWL029
aauucaggacccuuuuccuc

SEQ ID NO: 511069 - RNA, 15 nt, Chlamydophila pneumoniae CWL029
aauuccagaaaaaga

SEQ ID NO: 511070 - RNA, 18 nt, Chlamydophila pneumoniae CWL029
aauuccaaaauaaaagga

SEQ ID NO: 511071 - RNA, 15 nt, Chlamydophila pneumoniae CWL029
aauuccaauuuuugc

SEQ ID NO: 511072 - RNA, 15 nt, Chlamydophila pneumoniae CWL029
aauucaugcaaaaca

SEQ ID NO: 511073 - RNA, 20 nt, Chlamydophila pneumoniae CWL029
aauucccguagguagagcug

SEQ ID NO: 511074 - RNA, 15 nt, Chlamydophila pneumoniae CWL029
aauuccgaagaagaa

SEQ ID NO: 511075 - RNA, 13 nt, Chlamydophila pneumoniae CWL029
aauuaacagagcg

SEQ ID NO: 511076 - RNA, 16 nt, Chlamydophila pneumoniae CWL029
aauguaagaaggcaga

SEQ ID NO: 511077 - RNA, 16 nt, Chlamydophila pneumoniae CWL029
aauguagucaugauuu

SEQ ID NO: 511078 - RNA, 14 nt, Chlamydophila pneumoniae CWL029
aauuaacaacacuu

SEQ ID NO: 511079 - RNA, 21 nt, Chlamydophila pneumoniae CWL029
aauuacgcucuccauggcuuc

SEQ ID NO: 511080 - RNA, 21 nt, Chlamydophila pneumoniae CWL029
aauuaugcccaaggaaaaaca

SEQ ID NO: 511081 - RNA, 13 nt, Chlamydophila pneumoniae CWL029
aauuauccagaaa

SEQ ID NO: 511082 - RNA, 12 nt, Chlamydophila pneumoniae CWL029
aauuauuuggau

SEQ ID NO: 511083 - RNA, 16 nt, Chlamydophila pneumoniae CWL029
aauucaaacuccuuuu

SEQ ID NO: 511084 - RNA, 13 nt, Chlamydophila pneumoniae CWL029
aauucaaaucccu

SEQ ID NO: 511085 - RNA, 16 nt, Chlamydophila pneumoniae CWL029
aauugagcucucuagc

SEQ ID NO: 511086 - RNA, 20 nt, Chlamydophila pneumoniae CWL029
aauugagcucucuagcuguu

SEQ ID NO: 511087 - RNA, 23 nt, Chlamydophila pneumoniae CWL029
aauugaacguagcuacaaaauua

SEQ ID NO: 511088 - RNA, 16 nt, Chlamydophila pneumoniae CWL029
aauucuuugccaagga

SEQ ID NO: 511089 - RNA, 23 nt, Chlamydophila pneumoniae CWL029
aauucuuuaugagagagcucuuc

SEQ ID NO: 511090 - RNA, 18 nt, Chlamydophila pneumoniae CWL029
aauugcauuaagauaaac

SEQ ID NO: 511091 - RNA, 15 nt, Chlamydophila pneumoniae CWL029
aauugcaaaguacua

SEQ ID NO: 511092 - RNA, 16 nt, Chlamydophila pneumoniae CWL029
aauugcucuugcucua

SEQ ID NO: 511093 - RNA, 16 nt, Chlamydophila pneumoniae CWL029
aauugcuguuccauaa

SEQ ID NO: 511094 - RNA, 22 nt, Chlamydophila pneumoniae CWL029
aauugcuguuccauaauuuuag

SEQ ID NO: 511095 - RNA, 22 nt, Chlamydophila pneumoniae CWL029
aauugcuugcgcaucagcagcu

SEQ ID NO: 511096 - RNA, 15 nt, Chlamydophila pneumoniae CWL029
aauugcuuucccccu

SEQ ID NO: 511097 - RNA, 18 nt, Chlamydophila pneumoniae CWL029
aauuuagaggagacucua

SEQ ID NO: 511098 - RNA, 11 nt, Chlamydophila pneumoniae CWL029
aauuuaaauau

SEQ ID NO: 511099 - RNA, 14 nt, Chlamydophila pneumoniae CWL029
aauuuaaaucugca

SEQ ID NO: 511100 - RNA, 16 nt, Chlamydophila pneumoniae CWL029
aauuuaaaucugcaag

SEQ ID NO: 511101 - RNA, 13 nt, Chlamydophila pneumoniae CWL029
aauuuaaaugccu

SEQ ID NO: 511102 - RNA, 16 nt, Chlamydophila pneumoniae CWL029
aauuguuggaauugca

SEQ ID NO: 511103 - RNA, 22 nt, Chlamydophila pneumoniae CWL029
aauugucugaggacaguauucc

SEQ ID NO: 511104 - RNA, 17 nt, Chlamydophila pneumoniae CWL029
aauuguguguuuucaua

SEQ ID NO: 511105 - RNA, 15 nt, Chlamydophila pneumoniae CWL029
aauugucaucucaua

SEQ ID NO: 511106 - RNA, 12 nt, Chlamydophila pneumoniae CWL029
aauuguagagag

SEQ ID NO: 511107 - RNA, 13 nt, Chlamydophila pneumoniae CWL029
aauugguggagcu

SEQ ID NO: 511108 - RNA, 23 nt, Chlamydophila pneumoniae CWL029
aaugcggaccuuaagaugaggua

SEQ ID NO: 511109 - RNA, 20 nt, Chlamydophila pneumoniae CWL029
aaugcaguucuuguuaaagu

SEQ ID NO: 511110 - RNA, 15 nt, Chlamydophila pneumoniae CWL029
aaugcaugaaucucu

SEQ ID NO: 511111 - RNA, 16 nt, Chlamydophila pneumoniae CWL029
aaugcccuuuagggaa

SEQ ID NO: 511112 - RNA, 23 nt, Chlamydophila pneumoniae CWL029
aaugcccuuuagggaauccccaa

SEQ ID NO: 511113 - RNA, 14 nt, Chlamydophila pneumoniae CWL029
aaugccaagggcuu

SEQ ID NO: 511114 - RNA, 16 nt, Chlamydophila pneumoniae CWL029
aaugccaauaugguag

SEQ ID NO: 511115 - RNA, 22 nt, Chlamydophila pneumoniae CWL029
aaugcgaugcggucagaaacau

SEQ ID NO: 511116 - RNA, 21 nt, Chlamydophila pneumoniae CWL029
aaugccuguacuaucuuuuuu

SEQ ID NO: 511117 - RNA, 21 nt, Chlamydophila pneumoniae CWL029
aaucuguauccgacucuguuu

SEQ ID NO: 511118 - RNA, 19 nt, Chlamydophila pneumoniae CWL029
aaucuggggcuuccagaaa

SEQ ID NO: 511119 - RNA, 14 nt, Chlamydophila pneumoniae CWL029
aaucuauuccccuc

SEQ ID NO: 511120 - RNA, 21 nt, Chlamydophila pneumoniae CWL029
aaucuaucugcacuuucuuuu

SEQ ID NO: 511121 - RNA, 13 nt, Chlamydophila pneumoniae CWL029
aaucuaugaauac

SEQ ID NO: 511122 - RNA, 11 nt, Chlamydophila pneumoniae CWL029
aaucuaugaga

SEQ ID NO: 511123 - RNA, 14 nt, Chlamydophila pneumoniae CWL029
aaucuauaaauuca

SEQ ID NO: 511124 - RNA, 15 nt, Chlamydophila pneumoniae CWL029
aaucuauagucuguu

SEQ ID NO: 511125 - RNA, 16 nt, Chlamydophila pneumoniae CWL029
aaucuauagucuguuu

SEQ ID NO: 511126 - RNA, 14 nt, Chlamydophila pneumoniae CWL029
aaucuuuucuugua

SEQ ID NO: 511127 - RNA, 19 nt, Chlamydophila pneumoniae CWL029
aaucuuugaucgcuugugc

SEQ ID NO: 511128 - RNA, 15 nt, Chlamydophila pneumoniae CWL029
aaucuuacauaaacc

SEQ ID NO: 511129 - RNA, 18 nt, Chlamydophila pneumoniae CWL029
aaugaaaagagacuguag

SEQ ID NO: 511130 - RNA, 21 nt, Chlamydophila pneumoniae CWL029
aaugaaaccuucagaucgaau

SEQ ID NO: 511131 - RNA, 21 nt, Chlamydophila pneumoniae CWL029
aaugaccgcaaggagucacug

SEQ ID NO: 511132 - RNA, 13 nt, Chlamydophila pneumoniae CWL029
aaugaaucgaaga

SEQ ID NO: 511133 - RNA, 16 nt, Chlamydophila pneumoniae CWL029
aaugacgggagcucuu

SEQ ID NO: 511134 - RNA, 13 nt, Chlamydophila pneumoniae CWL029
aaugagacagaca

SEQ ID NO: 511135 - RNA, 23 nt, Chlamydophila pneumoniae CWL029
aaugcaaaccaaaaaaguaacua

SEQ ID NO: 511136 - RNA, 13 nt, Chlamydophila pneumoniae CWL029
aaugauuucucua

SEQ ID NO: 511137 - RNA, 14 nt, Chlamydophila pneumoniae CWL029
aaugauuucucuaa

SEQ ID NO: 511138 - RNA, 12 nt, Chlamydophila pneumoniae CWL029
aauccuucuuuc

SEQ ID NO: 511139 - RNA, 19 nt, Chlamydophila pneumoniae CWL029
aauccuucuuucugcucuu

SEQ ID NO: 511140 - RNA, 21 nt, Chlamydophila pneumoniae CWL029
aauccuuccuuacaagcuucc

SEQ ID NO: 511141 - RNA, 12 nt, Chlamydophila pneumoniae CWL029
aauccuuccuua

SEQ ID NO: 511142 - RNA, 16 nt, Chlamydophila pneumoniae CWL029
aauccuucuauagcaa

SEQ ID NO: 511143 - RNA, 22 nt, Chlamydophila pneumoniae CWL029
aauccugggcaaugaucaaaaa

SEQ ID NO: 511144 - RNA, 21 nt, Chlamydophila pneumoniae CWL029
aauccuguagggaaagacuca

SEQ ID NO: 511145 - RNA, 20 nt, Chlamydophila pneumoniae CWL029
aauccugcauacccuucuuc

SEQ ID NO: 511146 - RNA, 20 nt, Chlamydophila pneumoniae CWL029
aauccuccuagguucuuuuu

SEQ ID NO: 511147 - RNA, 16 nt, Chlamydophila pneumoniae CWL029
aauccucggaagauaa

SEQ ID NO: 511148 - RNA, 22 nt, Chlamydophila pneumoniae CWL029
aaucccuguucuagcaaaucua

SEQ ID NO: 511149 - RNA, 23 nt, Chlamydophila pneumoniae CWL029
aaucccuguucuagcaaaucuaa

SEQ ID NO: 511150 - RNA, 16 nt, Chlamydophila pneumoniae CWL029
aaucccgugcuaggaa

SEQ ID NO: 511151 - RNA, 17 nt, Chlamydophila pneumoniae CWL029
aaucccgugcuaggaag

SEQ ID NO: 511152 - RNA, 15 nt, Chlamydophila pneumoniae CWL029
aaucccugcacucuu

SEQ ID NO: 511153 - RNA, 19 nt, Chlamydophila pneumoniae CWL029
aauccccgggauuguucuu

SEQ ID NO: 511154 - RNA, 22 nt, Chlamydophila pneumoniae CWL029
aauccccgggauuguucuuuac

SEQ ID NO: 511155 - RNA, 17 nt, Chlamydophila pneumoniae CWL029
aaucccccagcauucac

SEQ ID NO: 511156 - RNA, 22 nt, Chlamydophila pneumoniae CWL029
aaucccacuaucuguaauuccc

SEQ ID NO: 511157 - RNA, 15 nt, Chlamydophila pneumoniae CWL029
aauccccaauguuuu

SEQ ID NO: 511158 - RNA, 15 nt, Chlamydophila pneumoniae CWL029
aaucauucaaauaua

SEQ ID NO: 511159 - RNA, 19 nt, Chlamydophila pneumoniae CWL029
aaucauuagaguuugguuu

SEQ ID NO: 511160 - RNA, 12 nt, Chlamydophila pneumoniae CWL029
aaucauaucugc

SEQ ID NO: 511161 - RNA, 20 nt, Chlamydophila pneumoniae CWL029
aaucaugccgagauuuuuac

SEQ ID NO: 511162 - RNA, 18 nt, Chlamydophila pneumoniae CWL029
aauauuaaauucaaaauc

SEQ ID NO: 511163 - RNA, 18 nt, Chlamydophila pneumoniae CWL029
aauauggguguaaauuuu

SEQ ID NO: 511164 - RNA, 22 nt, Chlamydophila pneumoniae CWL029
aauccauucugagaaagaaguc

SEQ ID NO: 511165 - RNA, 20 nt, Chlamydophila pneumoniae CWL029
aauccauucugagaaagaag

SEQ ID NO: 511166 - RNA, 13 nt, Chlamydophila pneumoniae CWL029
aauccaguuuuuu

SEQ ID NO: 511167 - RNA, 21 nt, Chlamydophila pneumoniae CWL029
aauccagcaacaaccaaaaga

SEQ ID NO: 511168 - RNA, 18 nt, Chlamydophila pneumoniae CWL029
aauccagcaacaaccaaa

SEQ ID NO: 511169 - RNA, 14 nt, Chlamydophila pneumoniae CWL029
aauccaccaaugau

SEQ ID NO: 511170 - RNA, 14 nt, Chlamydophila pneumoniae CWL029
aauccacgcuccuc

SEQ ID NO: 511171 - RNA, 16 nt, Chlamydophila pneumoniae CWL029
aauccacgcuccucua

SEQ ID NO: 511172 - RNA, 17 nt, Chlamydophila pneumoniae CWL029
aauccaacaaagaugac

SEQ ID NO: 511173 - RNA, 13 nt, Chlamydophila pneumoniae CWL029
aauccaagaauag

SEQ ID NO: 511174 - RNA, 17 nt, Chlamydophila pneumoniae CWL029
aauccaaggggcuccca

SEQ ID NO: 511175 - RNA, 17 nt, Chlamydophila pneumoniae CWL029
aauccaaagacuuuuua

SEQ ID NO: 511176 - RNA, 14 nt, Chlamydophila pneumoniae CWL029
aauccaaaaaagag

SEQ ID NO: 511177 - RNA, 15 nt, Chlamydophila pneumoniae CWL029
aagaaaucucaguga

SEQ ID NO: 511178 - RNA, 18 nt, Chlamydophila pneumoniae CWL029
aagaaaugcaaaccaaaa

SEQ ID NO: 511179 - RNA, 22 nt, Chlamydophila pneumoniae CWL029
aagaaaugcaaaccaaaaaagu

SEQ ID NO: 511180 - RNA, 11 nt, Chlamydophila pneumoniae CWL029
aagaaaugccc

SEQ ID NO: 511181 - RNA, 23 nt, Chlamydophila pneumoniae CWL029
aagaaauauuaacccaccagaag

SEQ ID NO: 511182 - RNA, 13 nt, Chlamydophila pneumoniae CWL029
aagaaaucaaaca

SEQ ID NO: 511183 - RNA, 24 nt, Chlamydophila pneumoniae CWL029
aagaaaggauuggaugagaauuuc

SEQ ID NO: 511184 - RNA, 19 nt, Chlamydophila pneumoniae CWL029
aagaaagagucucacucuu

SEQ ID NO: 511185 - RNA, 19 nt, Chlamydophila pneumoniae CWL029
aagaaacuuccaaaacgau

SEQ ID NO: 511186 - RNA, 18 nt, Chlamydophila pneumoniae CWL029
aagaaacuuccaaaacga

SEQ ID NO: 511187 - RNA, 18 nt, Chlamydophila pneumoniae CWL029
aagaaacccgcaacucuu

SEQ ID NO: 511188 - RNA, 19 nt, Chlamydophila pneumoniae CWL029
aagaaaagugugaggagac

SEQ ID NO: 511189 - RNA, 19 nt, Chlamydophila pneumoniae CWL029
aagaaaauccuaacaaaag

SEQ ID NO: 511190 - RNA, 20 nt, Chlamydophila pneumoniae CWL029
aagaaaauccuaacaaaagg

SEQ ID NO: 511191 - RNA, 23 nt, Chlamydophila pneumoniae CWL029
aagaaaaugaggacacaacucuu

SEQ ID NO: 511192 - RNA, 12 nt, Chlamydophila pneumoniae CWL029
aagaaaagcaau

SEQ ID NO: 511193 - RNA, 14 nt, Chlamydophila pneumoniae CWL029
aagaaaauaaagau

SEQ ID NO: 511194 - RNA, 15 nt, Chlamydophila pneumoniae CWL029
aacuuuuuuucuucu

SEQ ID NO: 511195 - RNA, 22 nt, Chlamydophila pneumoniae CWL029
aacuuuuuuacuaucuccuaga

SEQ ID NO: 511196 - RNA, 15 nt, Chlamydophila pneumoniae CWL029
aagaaaaagcaucua

SEQ ID NO: 511197 - RNA, 21 nt, Chlamydophila pneumoniae CWL029
aagaaaaagcaucuaugggcu

SEQ ID NO: 511198 - RNA, 20 nt, Chlamydophila pneumoniae CWL029
aagaaaaaucuacauguaaa

SEQ ID NO: 511199 - RNA, 17 nt, Chlamydophila pneumoniae CWL029
aagaagccuuccuuguu

SEQ ID NO: 511200 - RNA, 19 nt, Chlamydophila pneumoniae CWL029
aagaagcucuaucuuuggu

SEQ ID NO: 511201 - RNA, 16 nt, Chlamydophila pneumoniae CWL029
aagaagcucacucuuu

SEQ ID NO: 511202 - RNA, 22 nt, Chlamydophila pneumoniae CWL029
aagaagcucacucuuuaaaaac

SEQ ID NO: 511203 - RNA, 19 nt, Chlamydophila pneumoniae CWL029
aagaacuuuagggaagaaa

SEQ ID NO: 511204 - RNA, 18 nt, Chlamydophila pneumoniae CWL029
aagaacuuaaaauucaaa

SEQ ID NO: 511205 - RNA, 20 nt, Chlamydophila pneumoniae CWL029
aagaacugcauaaucucacc

SEQ ID NO: 511206 - RNA, 15 nt, Chlamydophila pneumoniae CWL029
aagaagaaccucauu

SEQ ID NO: 511207 - RNA, 15 nt, Chlamydophila pneumoniae CWL029
aagaagagaaaagau

SEQ ID NO: 511208 - RNA, 19 nt, Chlamydophila pneumoniae CWL029
aagaagacuagcuuuucau

SEQ ID NO: 511209 - RNA, 22 nt, Chlamydophila pneumoniae CWL029
aagaagacuagcuuuucauguu

SEQ ID NO: 511210 - RNA, 12 nt, Chlamydophila pneumoniae CWL029
aagaaauucuga

SEQ ID NO: 511211 - RNA, 16 nt, Chlamydophila pneumoniae CWL029
aagaacagcacucucu

SEQ ID NO: 511212 - RNA, 14 nt, Chlamydophila pneumoniae CWL029
aagaacagaggauc

SEQ ID NO: 511213 - RNA, 14 nt, Chlamydophila pneumoniae CWL029
aagaacaucuuccc

SEQ ID NO: 511214 - RNA, 13 nt, Chlamydophila pneumoniae CWL029
aagaacauaaccu

SEQ ID NO: 511215 - RNA, 13 nt, Chlamydophila pneumoniae CWL029
aagaaccauagau

SEQ ID NO: 511216 - RNA, 13 nt, Chlamydophila pneumoniae CWL029
aagaacucaacuu

SEQ ID NO: 511217 - RNA, 13 nt, Chlamydophila pneumoniae CWL029
aagaacuccuuug

SEQ ID NO: 511218 - RNA, 16 nt, Chlamydophila pneumoniae CWL029
aagaacuccuuugagu

SEQ ID NO: 511219 - RNA, 15 nt, Chlamydophila pneumoniae CWL029
aagaacgucaccauu

SEQ ID NO: 511220 - RNA, 18 nt, Chlamydophila pneumoniae CWL029
aagaacuacuuaaauccu

SEQ ID NO: 511221 - RNA, 18 nt, Chlamydophila pneumoniae CWL029
aacuuaucgaaugcugca

SEQ ID NO: 511222 - RNA, 17 nt, Chlamydophila pneumoniae CWL029
aacuucaaugaagaaaa

SEQ ID NO: 511223 - RNA, 20 nt, Chlamydophila pneumoniae CWL029
aacuucuugugauccuugca

SEQ ID NO: 511224 - RNA, 17 nt, Chlamydophila pneumoniae CWL029
aacuucguuagaaacca

SEQ ID NO: 511225 - RNA, 20 nt, Chlamydophila pneumoniae CWL029
aacuucuaucuuacugaaga

SEQ ID NO: 511226 - RNA, 16 nt, Chlamydophila pneumoniae CWL029
aacuucucagauaaaa

SEQ ID NO: 511227 - RNA, 16 nt, Chlamydophila pneumoniae CWL029
aacuuccugauucugu

SEQ ID NO: 511228 - RNA, 17 nt, Chlamydophila pneumoniae CWL029
aacuugaagaaguacaa

SEQ ID NO: 511229 - RNA, 22 nt, Chlamydophila pneumoniae CWL029
aacuugaagaaguacaagugaa

SEQ ID NO: 511230 - RNA, 14 nt, Chlamydophila pneumoniae CWL029
aacuugaauaccaa

SEQ ID NO: 511231 - RNA, 21 nt, Chlamydophila pneumoniae CWL029
aacuuguuuucguaagagaau

SEQ ID NO: 511232 - RNA, 20 nt, Chlamydophila pneumoniae CWL029
aacuuuccggguaaguacac

SEQ ID NO: 511233 - RNA, 13 nt, Chlamydophila pneumoniae CWL029
aacuuucuucucu

SEQ ID NO: 511234 - RNA, 16 nt, Chlamydophila pneumoniae CWL029
aacuuugaggcaaguc

SEQ ID NO: 511235 - RNA, 18 nt, Chlamydophila pneumoniae CWL029
aacuuugaggcaagucuc

SEQ ID NO: 511236 - RNA, 13 nt, Chlamydophila pneumoniae CWL029
aacuuucuuuuug

SEQ ID NO: 511237 - RNA, 15 nt, Chlamydophila pneumoniae CWL029
aacuuuuccaaauuc

SEQ ID NO: 511238 - RNA, 16 nt, Chlamydophila pneumoniae CWL029
aacugugccauaacgc

SEQ ID NO: 511239 - RNA, 13 nt, Chlamydophila pneumoniae CWL029
aacuguguuuucu

SEQ ID NO: 511240 - RNA, 19 nt, Chlamydophila pneumoniae CWL029
aacuuaaagacuugcuucc

SEQ ID NO: 511241 - RNA, 18 nt, Chlamydophila pneumoniae CWL029
aacugcuuggucacacca

SEQ ID NO: 511242 - RNA, 20 nt, Chlamydophila pneumoniae CWL029
aacugcuuggucacaccaaa

SEQ ID NO: 511243 - RNA, 18 nt, Chlamydophila pneumoniae CWL029
aacuggcaaucuaaaauc

SEQ ID NO: 511244 - RNA, 19 nt, Chlamydophila pneumoniae CWL029
aacuggcaaucuaaaauca

SEQ ID NO: 511245 - RNA, 17 nt, Chlamydophila pneumoniae CWL029
aacuggcuauggaagau

SEQ ID NO: 511246 - RNA, 23 nt, Chlamydophila pneumoniae CWL029
aacugggcauaguggcucagugu

SEQ ID NO: 511247 - RNA, 15 nt, Chlamydophila pneumoniae CWL029
aacugcauaaucuca

SEQ ID NO: 511248 - RNA, 13 nt, Chlamydophila pneumoniae CWL029
aacugcaaaaaga

SEQ ID NO: 511249 - RNA, 22 nt, Chlamydophila pneumoniae CWL029
aacugcuccugaagcugagaau

SEQ ID NO: 511250 - RNA, 22 nt, Chlamydophila pneumoniae CWL029
aacugcuacuuuaaaguggcaa

SEQ ID NO: 511251 - RNA, 16 nt, Chlamydophila pneumoniae CWL029
aacugcuccugaagcu

SEQ ID NO: 511252 - RNA, 17 nt, Chlamydophila pneumoniae CWL029
aacugcuccugaagcug

SEQ ID NO: 511253 - RNA, 23 nt, Chlamydophila pneumoniae CWL029
aacugcgcuagcuccagcaucac

SEQ ID NO: 511254 - RNA, 18 nt, Chlamydophila pneumoniae CWL029
aacugcgcuaucaucauu

SEQ ID NO: 511255 - RNA, 18 nt, Chlamydophila pneumoniae CWL029
aacugcgauacucucagc

SEQ ID NO: 511256 - RNA, 22 nt, Chlamydophila pneumoniae CWL029
aacugagcaacuucuucguuag

SEQ ID NO: 511257 - RNA, 23 nt, Chlamydophila pneumoniae CWL029
aacugaggcaaagauuuccaauc

SEQ ID NO: 511258 - RNA, 15 nt, Chlamydophila pneumoniae CWL029
aacugaugccaagaa

SEQ ID NO: 511259 - RNA, 22 nt, Chlamydophila pneumoniae CWL029
aacugauuaguuuguuuuaauu

SEQ ID NO: 511260 - RNA, 15 nt, Chlamydophila pneumoniae CWL029
aacuccaaaauauuc

SEQ ID NO: 511261 - RNA, 20 nt, Chlamydophila pneumoniae CWL029
aacucaucacaauuuuaaaa

SEQ ID NO: 511262 - RNA, 22 nt, Chlamydophila pneumoniae CWL029
aacucaucacaauuuuaaaauc

SEQ ID NO: 511263 - RNA, 19 nt, Chlamydophila pneumoniae CWL029
aacucauccuaaauuaaau

SEQ ID NO: 511264 - RNA, 20 nt, Chlamydophila pneumoniae CWL029
aacucauccuaaauuaaaua

SEQ ID NO: 511265 - RNA, 14 nt, Chlamydophila pneumoniae CWL029
aacucaacuuuuuu

SEQ ID NO: 511266 - RNA, 22 nt, Chlamydophila pneumoniae CWL029
aacucaauuaugcccaaggaaa

SEQ ID NO: 511267 - RNA, 20 nt, Chlamydophila pneumoniae CWL029
aacuauaggaagcucuucua

SEQ ID NO: 511268 - RNA, 17 nt, Chlamydophila pneumoniae CWL029
aacuauguuauccauac

SEQ ID NO: 511269 - RNA, 21 nt, Chlamydophila pneumoniae CWL029
aacuccuaagucguuaacauc

SEQ ID NO: 511270 - RNA, 23 nt, Chlamydophila pneumoniae CWL029
aacuccgcacuugcucuuuaaua

SEQ ID NO: 511271 - RNA, 16 nt, Chlamydophila pneumoniae CWL029
aacuccaaaauauucu

SEQ ID NO: 511272 - RNA, 18 nt, Chlamydophila pneumoniae CWL029
aacuccacgaauucuuua

SEQ ID NO: 511273 - RNA, 23 nt, Chlamydophila pneumoniae CWL029
aacuccacgaauucuuuaaaauc

SEQ ID NO: 511274 - RNA, 14 nt, Chlamydophila pneumoniae CWL029
aacuccacgccaaa

SEQ ID NO: 511275 - RNA, 22 nt, Chlamydophila pneumoniae CWL029
aacuccaggggauaaaacuaua

SEQ ID NO: 511276 - RNA, 18 nt, Chlamydophila pneumoniae CWL029
aacuccccaguuuuccau

SEQ ID NO: 511277 - RNA, 14 nt, Chlamydophila pneumoniae CWL029
aacuccucaaaaga

SEQ ID NO: 511278 - RNA, 18 nt, Chlamydophila pneumoniae CWL029
aacucuaaucugauucaa

SEQ ID NO: 511279 - RNA, 15 nt, Chlamydophila pneumoniae CWL029
aacucuagaucuuca

SEQ ID NO: 511280 - RNA, 22 nt, Chlamydophila pneumoniae CWL029
aacucuauuuucauaucaaagu

SEQ ID NO: 511281 - RNA, 12 nt, Chlamydophila pneumoniae CWL029
aacucucuuccu

SEQ ID NO: 511282 - RNA, 14 nt, Chlamydophila pneumoniae CWL029
aacucucaguuaaa

SEQ ID NO: 511283 - RNA, 20 nt, Chlamydophila pneumoniae CWL029
aacucucccauguaguaaau

SEQ ID NO: 511284 - RNA, 19 nt, Chlamydophila pneumoniae CWL029
aacucuuaaagguaaagcu

SEQ ID NO: 511285 - RNA, 19 nt, Chlamydophila pneumoniae CWL029
aacucuuaagaauaaaaua

SEQ ID NO: 511286 - RNA, 14 nt, Chlamydophila pneumoniae CWL029
aacucuucaagagc

SEQ ID NO: 511287 - RNA, 19 nt, Chlamydophila pneumoniae CWL029
aacucuuuaauugugcucu

SEQ ID NO: 511288 - RNA, 18 nt, Chlamydophila pneumoniae CWL029
aacucuuuaggucuuguc

SEQ ID NO: 511289 - RNA, 14 nt, Chlamydophila pneumoniae CWL029
aacguggggaaauu

SEQ ID NO: 511290 - RNA, 15 nt, Chlamydophila pneumoniae CWL029
aacgugcugcgaauu

SEQ ID NO: 511291 - RNA, 18 nt, Chlamydophila pneumoniae CWL029
aacguagcuacaaaauua

SEQ ID NO: 511292 - RNA, 16 nt, Chlamydophila pneumoniae CWL029
aacguauccuugauuu

SEQ ID NO: 511293 - RNA, 19 nt, Chlamydophila pneumoniae CWL029
aacuaagaauaccuauagg

SEQ ID NO: 511294 - RNA, 20 nt, Chlamydophila pneumoniae CWL029
aacuaacuguaauuucaauu

SEQ ID NO: 511295 - RNA, 17 nt, Chlamydophila pneumoniae CWL029
aacuaaaucaacuacau

SEQ ID NO: 511296 - RNA, 15 nt, Chlamydophila pneumoniae CWL029
aacuaaauucuuaac

SEQ ID NO: 511297 - RNA, 14 nt, Chlamydophila pneumoniae CWL029
aacuaaaacagccu

SEQ ID NO: 511298 - RNA, 15 nt, Chlamydophila pneumoniae CWL029
aacuaaaacagccua

SEQ ID NO: 511299 - RNA, 15 nt, Chlamydophila pneumoniae CWL029
aacuaaaaguuuuuu

SEQ ID NO: 511300 - RNA, 22 nt, Chlamydophila pneumoniae CWL029
aacuagguuauuaucaaaguga

SEQ ID NO: 511301 - RNA, 17 nt, Chlamydophila pneumoniae CWL029
aacuaggaaaagcauag

SEQ ID NO: 511302 - RNA, 20 nt, Chlamydophila pneumoniae CWL029
aacuauacucucuguagcac

SEQ ID NO: 511303 - RNA, 17 nt, Chlamydophila pneumoniae CWL029
aacuagagaucuuuuua

SEQ ID NO: 511304 - RNA, 15 nt, Chlamydophila pneumoniae CWL029
aacuagaaucaccaa

SEQ ID NO: 511305 - RNA, 13 nt, Chlamydophila pneumoniae CWL029
aacuagaaaaaau

SEQ ID NO: 511306 - RNA, 14 nt, Chlamydophila pneumoniae CWL029
aacuaccagaugcc

SEQ ID NO: 511307 - RNA, 16 nt, Chlamydophila pneumoniae CWL029
aacuacauaauaagca

SEQ ID NO: 511308 - RNA, 22 nt, Chlamydophila pneumoniae CWL029
aacguaagcuuuuuaccaauaa

SEQ ID NO: 511309 - RNA, 22 nt, Chlamydophila pneumoniae CWL029
aacgguugucucgaaacucuuu

SEQ ID NO: 511310 - RNA, 13 nt, Chlamydophila pneumoniae CWL029
aacgguaaauauc

SEQ ID NO: 511311 - RNA, 14 nt, Chlamydophila pneumoniae CWL029
aacgguaaauaucu

SEQ ID NO: 511312 - RNA, 19 nt, Chlamydophila pneumoniae CWL029
aacgggagcguuuuuugaa

SEQ ID NO: 511313 - RNA, 23 nt, Chlamydophila pneumoniae CWL029
aacgggagcguuuuuugaaaauu

SEQ ID NO: 511314 - RNA, 21 nt, Chlamydophila pneumoniae CWL029
aacggacauuuucaagcuuuc

SEQ ID NO: 511315 - RNA, 15 nt, Chlamydophila pneumoniae CWL029
aacgcuuagagaauu

SEQ ID NO: 511316 - RNA, 20 nt, Chlamydophila pneumoniae CWL029
aacggauaagacggauaaau

SEQ ID NO: 511317 - RNA, 20 nt, Chlamydophila pneumoniae CWL029
aacggauuuuguuugcaugc

SEQ ID NO: 511318 - RNA, 22 nt, Chlamydophila pneumoniae CWL029
aacgcucucuagcaccuaauaa

SEQ ID NO: 511319 - RNA, 19 nt, Chlamydophila pneumoniae CWL029
aacgcucucuagcaccuaa

SEQ ID NO: 511320 - RNA, 14 nt, Chlamydophila pneumoniae CWL029
aacgccgcucuuga

SEQ ID NO: 511321 - RNA, 18 nt, Chlamydophila pneumoniae CWL029
aacgccaacacgcacaaa

SEQ ID NO: 511322 - RNA, 23 nt, Chlamydophila pneumoniae CWL029
aacgcaugacgcuuuuccaaagc

SEQ ID NO: 511323 - RNA, 17 nt, Chlamydophila pneumoniae CWL029
aacgcccuucuuaguaa

SEQ ID NO: 511324 - RNA, 20 nt, Chlamydophila pneumoniae CWL029
aacgcccuucuuaguaaaga

SEQ ID NO: 511325 - RNA, 17 nt, Chlamydophila pneumoniae CWL029
aacgauuucuugaagau

SEQ ID NO: 511326 - RNA, 16 nt, Chlamydophila pneumoniae CWL029
aacgcaacauccauuc

SEQ ID NO: 511327 - RNA, 23 nt, Chlamydophila pneumoniae CWL029
aacgauuguaauuucuagcuaau

SEQ ID NO: 511328 - RNA, 15 nt, Chlamydophila pneumoniae CWL029
aacgcacgccaagag

SEQ ID NO: 511329 - RNA, 22 nt, Chlamydophila pneumoniae CWL029
aacgcagcuuuccuuuugauaa

SEQ ID NO: 511330 - RNA, 21 nt, Chlamydophila pneumoniae CWL029
aacgcauaagagacauuucuu

SEQ ID NO: 511331 - RNA, 22 nt, Chlamydophila pneumoniae CWL029
aacgagacugcaaaggaaggga

SEQ ID NO: 511332 - RNA, 14 nt, Chlamydophila pneumoniae CWL029
aacgagcauuucca

SEQ ID NO: 511333 - RNA, 17 nt, Chlamydophila pneumoniae CWL029
aacgacguuuaauuccu

SEQ ID NO: 511334 - RNA, 22 nt, Chlamydophila pneumoniae CWL029
aaccuuugguagaaagacaaaa

SEQ ID NO: 511335 - RNA, 22 nt, Chlamydophila pneumoniae CWL029
aacgaagugaggagaauagcaa

SEQ ID NO: 511336 - RNA, 15 nt, Chlamydophila pneumoniae CWL029
aaccuuuuuuuaaaa

SEQ ID NO: 511337 - RNA, 17 nt, Chlamydophila pneumoniae CWL029
aacgaacaguucauguu

SEQ ID NO: 511338 - RNA, 13 nt, Chlamydophila pneumoniae CWL029
aacgaauuucaac

SEQ ID NO: 511339 - RNA, 21 nt, Chlamydophila pneumoniae CWL029
aaccgucacuguuuuccagaa

SEQ ID NO: 511340 - RNA, 22 nt, Chlamydophila pneumoniae CWL029
aaccgucacuguuuuccagaaa

SEQ ID NO: 511341 - RNA, 11 nt, Chlamydophila pneumoniae CWL029
aaccuccacca

SEQ ID NO: 511342 - RNA, 16 nt, Chlamydophila pneumoniae CWL029
aaccuccgcucuaagc

SEQ ID NO: 511343 - RNA, 21 nt, Chlamydophila pneumoniae CWL029
aaccuccuagaagcgcuuuau

SEQ ID NO: 511344 - RNA, 13 nt, Chlamydophila pneumoniae CWL029
aaccucuaaaaac

SEQ ID NO: 511345 - RNA, 23 nt, Chlamydophila pneumoniae CWL029
aaccuccaccaggagcuccuccu

SEQ ID NO: 511346 - RNA, 15 nt, Chlamydophila pneumoniae CWL029
aacccucaaagaaua

SEQ ID NO: 511347 - RNA, 14 nt, Chlamydophila pneumoniae CWL029
aacccucagaacac

SEQ ID NO: 511348 - RNA, 14 nt, Chlamydophila pneumoniae CWL029
aacccuuuaaugau

SEQ ID NO: 511349 - RNA, 22 nt, Chlamydophila pneumoniae CWL029
aacccuuuaaugaucacgugga

SEQ ID NO: 511350 - RNA, 17 nt, Chlamydophila pneumoniae CWL029
aaccgaaacuucucaga

SEQ ID NO: 511351 - RNA, 23 nt, Chlamydophila pneumoniae CWL029
aacccaauucuuaaaaagcuaaa

SEQ ID NO: 511352 - RNA, 23 nt, Chlamydophila pneumoniae CWL029
aacccauauuccuauaacaacau

SEQ ID NO: 511353 - RNA, 19 nt, Chlamydophila pneumoniae CWL029
aaccauucaucuaggggag

SEQ ID NO: 511354 - RNA, 13 nt, Chlamydophila pneumoniae CWL029
aaccauagauuua

SEQ ID NO: 511355 - RNA, 20 nt, Chlamydophila pneumoniae CWL029
aaccaucaaucacucuauga

SEQ ID NO: 511356 - RNA, 19 nt, Chlamydophila pneumoniae CWL029
aaccaucacuuccuguugu

SEQ ID NO: 511357 - RNA, 14 nt, Chlamydophila pneumoniae CWL029
aaccaugaugcaau

SEQ ID NO: 511358 - RNA, 19 nt, Chlamydophila pneumoniae CWL029
aaccagaagacucccaagg

SEQ ID NO: 511359 - RNA, 23 nt, Chlamydophila pneumoniae CWL029
aaccagguagagugucuuccuug

SEQ ID NO: 511360 - RNA, 19 nt, Chlamydophila pneumoniae CWL029
aaccacuguccaugcacga

SEQ ID NO: 511361 - RNA, 17 nt, Chlamydophila pneumoniae CWL029
aacauuuuuauuuccuu

SEQ ID NO: 511362 - RNA, 19 nt, Chlamydophila pneumoniae CWL029
aacauuggagucuaaaaaa

SEQ ID NO: 511363 - RNA, 20 nt, Chlamydophila pneumoniae CWL029
aacauuggagucuaaaaaau

SEQ ID NO: 511364 - RNA, 23 nt, Chlamydophila pneumoniae CWL029
aacauuggagucuaaaaaauacc

SEQ ID NO: 511365 - RNA, 20 nt, Chlamydophila pneumoniae CWL029
aaccaaaagaauuaagaaga

SEQ ID NO: 511366 - RNA, 13 nt, Chlamydophila pneumoniae CWL029
aaccaacaucaaa

SEQ ID NO: 511367 - RNA, 21 nt, Chlamydophila pneumoniae CWL029
aaccaaucuugagcauccaaa

SEQ ID NO: 511368 - RNA, 22 nt, Chlamydophila pneumoniae CWL029
aaccaaucuugagcauccaaaa

SEQ ID NO: 511369 - RNA, 11 nt, Chlamydophila pneumoniae CWL029
aacaugaggau

SEQ ID NO: 511370 - RNA, 17 nt, Chlamydophila pneumoniae CWL029
aacaugccugaaaacaa

SEQ ID NO: 511371 - RNA, 14 nt, Chlamydophila pneumoniae CWL029
aacaugcgcagaau

SEQ ID NO: 511372 - RNA, 15 nt, Chlamydophila pneumoniae CWL029
aacaugccugaaaac

SEQ ID NO: 511373 - RNA, 14 nt, Chlamydophila pneumoniae CWL029
aacauggacaauau

SEQ ID NO: 511374 - RNA, 17 nt, Chlamydophila pneumoniae CWL029
aacaugcgcagaauaaa

SEQ ID NO: 511375 - RNA, 15 nt, Chlamydophila pneumoniae CWL029
aacaucuccagcagc

SEQ ID NO: 511376 - RNA, 12 nt, Chlamydophila pneumoniae CWL029
aacaucuuugug

SEQ ID NO: 511377 - RNA, 14 nt, Chlamydophila pneumoniae CWL029
aacaugaaguuguu

SEQ ID NO: 511378 - RNA, 20 nt, Chlamydophila pneumoniae CWL029
aacaugaccuuuaggaacuu

SEQ ID NO: 511379 - RNA, 15 nt, Chlamydophila pneumoniae CWL029
aacaucgaaaccaca

SEQ ID NO: 511380 - RNA, 22 nt, Chlamydophila pneumoniae CWL029
aacaucggagaacuuccugauu

SEQ ID NO: 511381 - RNA, 15 nt, Chlamydophila pneumoniae CWL029
aacaucguuaauaua

SEQ ID NO: 511382 - RNA, 13 nt, Chlamydophila pneumoniae CWL029
aacauaaagaagg

SEQ ID NO: 511383 - RNA, 19 nt, Chlamydophila pneumoniae CWL029
aacauaaccuccucuucuu

SEQ ID NO: 511384 - RNA, 16 nt, Chlamydophila pneumoniae CWL029
aacauaaagaagguuu

SEQ ID NO: 511385 - RNA, 14 nt, Chlamydophila pneumoniae CWL029
aacaguuccuauuu

SEQ ID NO: 511386 - RNA, 15 nt, Chlamydophila pneumoniae CWL029
aacaguucuuucugc

SEQ ID NO: 511387 - RNA, 22 nt, Chlamydophila pneumoniae CWL029
aacagugguaugcuuuuccuuc

SEQ ID NO: 511388 - RNA, 16 nt, Chlamydophila pneumoniae CWL029
aacaggaauaggcucu

SEQ ID NO: 511389 - RNA, 14 nt, Chlamydophila pneumoniae CWL029
aacaggauugauaa

SEQ ID NO: 511390 - RNA, 19 nt, Chlamydophila pneumoniae CWL029
aacaggcacagcaaucaca

SEQ ID NO: 511391 - RNA, 12 nt, Chlamydophila pneumoniae CWL029
aacaucaagaau

SEQ ID NO: 511392 - RNA, 20 nt, Chlamydophila pneumoniae CWL029
aacauauucuccuuaccaau

SEQ ID NO: 511393 - RNA, 22 nt, Chlamydophila pneumoniae CWL029
aacauauucuccuuaccaauau

SEQ ID NO: 511394 - RNA, 16 nt, Chlamydophila pneumoniae CWL029
aacaucagagaacucu

SEQ ID NO: 511395 - RNA, 14 nt, Chlamydophila pneumoniae CWL029
aacaucagcuguug

SEQ ID NO: 511396 - RNA, 14 nt, Chlamydophila pneumoniae CWL029
aacaucaugaaaua

SEQ ID NO: 511397 - RNA, 15 nt, Chlamydophila pneumoniae CWL029
aacaucaugaaauac

SEQ ID NO: 511398 - RNA, 21 nt, Chlamydophila pneumoniae CWL029
aacaucccccgggaagcuguc

SEQ ID NO: 511399 - RNA, 18 nt, Chlamydophila pneumoniae CWL029
aacauacaccccaguuuc

SEQ ID NO: 511400 - RNA, 22 nt, Chlamydophila pneumoniae CWL029
aacauacaccccaguuucuuga

SEQ ID NO: 511401 - RNA, 16 nt, Chlamydophila pneumoniae CWL029
aacauagauaagguaa

SEQ ID NO: 511402 - RNA, 21 nt, Chlamydophila pneumoniae CWL029
aacauaaugauguaacuagua

SEQ ID NO: 511403 - RNA, 15 nt, Chlamydophila pneumoniae CWL029
aacauagauaaggua

SEQ ID NO: 511404 - RNA, 21 nt, Chlamydophila pneumoniae CWL029
aacagcgguugccuuucucuu

SEQ ID NO: 511405 - RNA, 19 nt, Chlamydophila pneumoniae CWL029
aacagccuagcaaaacugu

SEQ ID NO: 511406 - RNA, 15 nt, Chlamydophila pneumoniae CWL029
aacagcacucucugc

SEQ ID NO: 511407 - RNA, 14 nt, Chlamydophila pneumoniae CWL029
aacagcaacacucg

SEQ ID NO: 511408 - RNA, 23 nt, Chlamydophila pneumoniae CWL029
aacagauuuuucaagaacuccuu

SEQ ID NO: 511409 - RNA, 19 nt, Chlamydophila pneumoniae CWL029
aacagcauggacuccaaga

SEQ ID NO: 511410 - RNA, 22 nt, Chlamydophila pneumoniae CWL029
aacagaucuuuaucauugcuau

SEQ ID NO: 511411 - RNA, 20 nt, Chlamydophila pneumoniae CWL029
aacagauaagacaauaaaau

SEQ ID NO: 511412 - RNA, 15 nt, Chlamydophila pneumoniae CWL029
aacagagcgccucca

SEQ ID NO: 511413 - RNA, 16 nt, Chlamydophila pneumoniae CWL029
aacagagcgccuccac

SEQ ID NO: 511414 - RNA, 17 nt, Chlamydophila pneumoniae CWL029
aacacuuuguuuuucaa

SEQ ID NO: 511415 - RNA, 21 nt, Chlamydophila pneumoniae CWL029
aacacugaacgccaucuccac

SEQ ID NO: 511416 - RNA, 19 nt, Chlamydophila pneumoniae CWL029
aacacucucuaccaucaug

SEQ ID NO: 511417 - RNA, 22 nt, Chlamydophila pneumoniae CWL029
aacacugcgcaaagaacucaac

SEQ ID NO: 511418 - RNA, 16 nt, Chlamydophila pneumoniae CWL029
aacacgucgaacauga

SEQ ID NO: 511419 - RNA, 16 nt, Chlamydophila pneumoniae CWL029
aacacgcacaaacuaa

SEQ ID NO: 511420 - RNA, 20 nt, Chlamydophila pneumoniae CWL029
aacacgcccacggaaagcac

SEQ ID NO: 511421 - RNA, 19 nt, Chlamydophila pneumoniae CWL029
aacaccgaaggcacuggca

SEQ ID NO: 511422 - RNA, 15 nt, Chlamydophila pneumoniae CWL029
aacacccggcuuuuc

SEQ ID NO: 511423 - RNA, 21 nt, Chlamydophila pneumoniae CWL029
aacaccaucacauccuguagu

SEQ ID NO: 511424 - RNA, 17 nt, Chlamydophila pneumoniae CWL029
aacaccguuaauuuuug

SEQ ID NO: 511425 - RNA, 18 nt, Chlamydophila pneumoniae CWL029
aacaccguuaauuuuugc

SEQ ID NO: 511426 - RNA, 16 nt, Chlamydophila pneumoniae CWL029
aacacaguuugagaaa

SEQ ID NO: 511427 - RNA, 15 nt, Chlamydophila pneumoniae CWL029
aacaccauaaaacaa

SEQ ID NO: 511428 - RNA, 16 nt, Chlamydophila pneumoniae CWL029
aacaaucuuucuucua

SEQ ID NO: 511429 - RNA, 13 nt, Chlamydophila pneumoniae CWL029
aacaaucuuucuu

SEQ ID NO: 511430 - RNA, 15 nt, Chlamydophila pneumoniae CWL029
aacaauguaaauuga

SEQ ID NO: 511431 - RNA, 15 nt, Chlamydophila pneumoniae CWL029
aacacaaauagcaag

SEQ ID NO: 511432 - RNA, 20 nt, Chlamydophila pneumoniae CWL029
aacacaaauagcaagagcua

SEQ ID NO: 511433 - RNA, 17 nt, Chlamydophila pneumoniae CWL029
aaauuuucccauuacag

SEQ ID NO: 511434 - RNA, 21 nt, Chlamydophila pneumoniae CWL029
aaauuuucucgggauaaugcu

SEQ ID NO: 511435 - RNA, 19 nt, Chlamydophila pneumoniae CWL029
aaauuuucuugcgacauaa

SEQ ID NO: 511436 - RNA, 15 nt, Chlamydophila pneumoniae CWL029
aaauuuugcaacaaa

SEQ ID NO: 511437 - RNA, 20 nt, Chlamydophila pneumoniae CWL029
aaauuugcucuccugcaaaa

SEQ ID NO: 511438 - RNA, 13 nt, Chlamydophila pneumoniae CWL029
aaauuugucauca

SEQ ID NO: 511439 - RNA, 18 nt, Chlamydophila pneumoniae CWL029
aaauuucugaaacaaugc

SEQ ID NO: 511440 - RNA, 14 nt, Chlamydophila pneumoniae CWL029
aaauuucauuugaa

SEQ ID NO: 511441 - RNA, 23 nt, Chlamydophila pneumoniae CWL029
aaauuuccuaccuauauuuuuua

SEQ ID NO: 511442 - RNA, 15 nt, Chlamydophila pneumoniae CWL029
aaauuucauuuagac

SEQ ID NO: 511443 - RNA, 22 nt, Chlamydophila pneumoniae CWL029
aaauuuaucggcuaaagaaaag

SEQ ID NO: 511444 - RNA, 17 nt, Chlamydophila pneumoniae CWL029
aaauugaugauuuuuua

SEQ ID NO: 511445 - RNA, 16 nt, Chlamydophila pneumoniae CWL029
aaauuggcuuuugaga

SEQ ID NO: 511446 - RNA, 20 nt, Chlamydophila pneumoniae CWL029
aaauuguuaucaggaacuaa

SEQ ID NO: 511447 - RNA, 14 nt, Chlamydophila pneumoniae CWL029
aaauuguuggaauu

SEQ ID NO: 511448 - RNA, 11 nt, Chlamydophila pneumoniae CWL029
aaauuuaaaua

SEQ ID NO: 511449 - RNA, 13 nt, Chlamydophila pneumoniae CWL029
aaauuuaaauaua

SEQ ID NO: 511450 - RNA, 18 nt, Chlamydophila pneumoniae CWL029
aaauuuaaauauagaaaa

SEQ ID NO: 511451 - RNA, 22 nt, Chlamydophila pneumoniae CWL029
aaauuuaagauaucgaccuuaa

SEQ ID NO: 511452 - RNA, 18 nt, Chlamydophila pneumoniae CWL029
aacaaauugaugauuuuu

SEQ ID NO: 511453 - RNA, 21 nt, Chlamydophila pneumoniae CWL029
aacaaacuuguuuucguaaga

SEQ ID NO: 511454 - RNA, 17 nt, Chlamydophila pneumoniae CWL029
aacaaagguuauggaug

SEQ ID NO: 511455 - RNA, 18 nt, Chlamydophila pneumoniae CWL029
aacaaaaaggacucuuuc

SEQ ID NO: 511456 - RNA, 20 nt, Chlamydophila pneumoniae CWL029
aacaaaaaggacucuuucua

SEQ ID NO: 511457 - RNA, 17 nt, Chlamydophila pneumoniae CWL029
aaauuuuuuaggaucuu

SEQ ID NO: 511458 - RNA, 12 nt, Chlamydophila pneumoniae CWL029
aaauuuuuccuu

SEQ ID NO: 511459 - RNA, 19 nt, Chlamydophila pneumoniae CWL029
aacaaaaggcccaacucuu

SEQ ID NO: 511460 - RNA, 21 nt, Chlamydophila pneumoniae CWL029
aacaacgcugcuucucuacua

SEQ ID NO: 511461 - RNA, 17 nt, Chlamydophila pneumoniae CWL029
aacaacauaaagaaggu

SEQ ID NO: 511462 - RNA, 11 nt, Chlamydophila pneumoniae CWL029
aacaacaucac

SEQ ID NO: 511463 - RNA, 12 nt, Chlamydophila pneumoniae CWL029
aacaaccaaaag

SEQ ID NO: 511464 - RNA, 19 nt, Chlamydophila pneumoniae CWL029
aacaaccaaaagaauuccu

SEQ ID NO: 511465 - RNA, 23 nt, Chlamydophila pneumoniae CWL029
aacaacuuuccggguaaguacac

SEQ ID NO: 511466 - RNA, 11 nt, Chlamydophila pneumoniae CWL029
aacaacugaaa

SEQ ID NO: 511467 - RNA, 16 nt, Chlamydophila pneumoniae CWL029
aacaacugaaaaacca

SEQ ID NO: 511468 - RNA, 16 nt, Chlamydophila pneumoniae CWL029
aacaagggaaagaaac

SEQ ID NO: 511469 - RNA, 23 nt, Chlamydophila pneumoniae CWL029
aacaagcuuuuaauguguucuua

SEQ ID NO: 511470 - RNA, 14 nt, Chlamydophila pneumoniae CWL029
aacaaguaccaaga

SEQ ID NO: 511471 - RNA, 17 nt, Chlamydophila pneumoniae CWL029
aacaaguuuuuucaauc

SEQ ID NO: 511472 - RNA, 19 nt, Chlamydophila pneumoniae CWL029
aacaaguaccaagaaaaua

SEQ ID NO: 511473 - RNA, 22 nt, Chlamydophila pneumoniae CWL029
aacaagagcgcauuuuacagcg

SEQ ID NO: 511474 - RNA, 16 nt, Chlamydophila pneumoniae CWL029
aacaagauaaccugag

SEQ ID NO: 511475 - RNA, 14 nt, Chlamydophila pneumoniae CWL029
aacaagaagaucaa

SEQ ID NO: 511476 - RNA, 14 nt, Chlamydophila pneumoniae CWL029
aacaagacgaaagc

SEQ ID NO: 511477 - RNA, 16 nt, Chlamydophila pneumoniae CWL029
aacaagacgaaagcac

SEQ ID NO: 511478 - RNA, 23 nt, Chlamydophila pneumoniae CWL029
acaguagaggaauucuggaacau

SEQ ID NO: 511479 - RNA, 18 nt, Chlamydophila pneumoniae CWL029
acaguauuccaucacagu

SEQ ID NO: 511480 - RNA, 19 nt, Chlamydophila pneumoniae CWL029
acaggcuucaucacauuaa

SEQ ID NO: 511481 - RNA, 18 nt, Chlamydophila pneumoniae CWL029
acaggcuacauaguuuuu

SEQ ID NO: 511482 - RNA, 19 nt, Chlamydophila pneumoniae CWL029
acauaaagaagguuucuag

SEQ ID NO: 511483 - RNA, 13 nt, Chlamydophila pneumoniae CWL029
acauaaaguuaua

SEQ ID NO: 511484 - RNA, 21 nt, Chlamydophila pneumoniae CWL029
acaguugcgcgcccucuucua

SEQ ID NO: 511485 - RNA, 21 nt, Chlamydophila pneumoniae CWL029
acagugauuuagaaaucucac

SEQ ID NO: 511486 - RNA, 22 nt, Chlamydophila pneumoniae CWL029
acaguccucucccuuaaggaaa

SEQ ID NO: 511487 - RNA, 14 nt, Chlamydophila pneumoniae CWL029
acaugacaaauaaa

SEQ ID NO: 511488 - RNA, 16 nt, Chlamydophila pneumoniae CWL029
acaugacaaauaaacu

SEQ ID NO: 511489 - RNA, 17 nt, Chlamydophila pneumoniae CWL029
acaugacaaauaaacug

SEQ ID NO: 511490 - RNA, 19 nt, Chlamydophila pneumoniae CWL029
acaugacaaauaaacugac

SEQ ID NO: 511491 - RNA, 20 nt, Chlamydophila pneumoniae CWL029
acaugaggauucuuuuugau

SEQ ID NO: 511492 - RNA, 22 nt, Chlamydophila pneumoniae CWL029
acaugagggcaugccuaucuau

SEQ ID NO: 511493 - RNA, 12 nt, Chlamydophila pneumoniae CWL029
acaugaggauac

SEQ ID NO: 511494 - RNA, 13 nt, Chlamydophila pneumoniae CWL029
acaugagaaauac

SEQ ID NO: 511495 - RNA, 12 nt, Chlamydophila pneumoniae CWL029
acaugagauacg

SEQ ID NO: 511496 - RNA, 15 nt, Chlamydophila pneumoniae CWL029
acaucuguauauucu

SEQ ID NO: 511497 - RNA, 19 nt, Chlamydophila pneumoniae CWL029
acaucuguaguaggcacuu

SEQ ID NO: 511498 - RNA, 13 nt, Chlamydophila pneumoniae CWL029
acaucuuaaaaac

SEQ ID NO: 511499 - RNA, 22 nt, Chlamydophila pneumoniae CWL029
acaucuccaagccaugcaauga

SEQ ID NO: 511500 - RNA, 10 nt, Chlamydophila pneumoniae CWL029
acaucuccag

SEQ ID NO: 511501 - RNA, 14 nt, Chlamydophila pneumoniae CWL029
acaucuaacucuaa

SEQ ID NO: 511502 - RNA, 19 nt, Chlamydophila pneumoniae CWL029
acaucaaauaguucaucau

SEQ ID NO: 511503 - RNA, 19 nt, Chlamydophila pneumoniae CWL029
acaucacuuauauuuucua

SEQ ID NO: 511504 - RNA, 22 nt, Chlamydophila pneumoniae CWL029
acaucacuuauauuuucuauuc

SEQ ID NO: 511505 - RNA, 18 nt, Chlamydophila pneumoniae CWL029
acaucagcaacauaaagu

SEQ ID NO: 511506 - RNA, 15 nt, Chlamydophila pneumoniae CWL029
acaucauguagugcu

SEQ ID NO: 511507 - RNA, 20 nt, Chlamydophila pneumoniae CWL029
acaucauuaucauaaauacg

SEQ ID NO: 511508 - RNA, 19 nt, Chlamydophila pneumoniae CWL029
acaucaaagcaauuucucc

SEQ ID NO: 511509 - RNA, 13 nt, Chlamydophila pneumoniae CWL029
acaucaaagaauu

SEQ ID NO: 511510 - RNA, 14 nt, Chlamydophila pneumoniae CWL029
acauacaucaaaau

SEQ ID NO: 511511 - RNA, 18 nt, Chlamydophila pneumoniae CWL029
acauacaucaaaaugcug

SEQ ID NO: 511512 - RNA, 15 nt, Chlamydophila pneumoniae CWL029
acauacauucuauuc

SEQ ID NO: 511513 - RNA, 13 nt, Chlamydophila pneumoniae CWL029
acauauucuccuu

SEQ ID NO: 511514 - RNA, 14 nt, Chlamydophila pneumoniae CWL029
acauauucuccuua

SEQ ID NO: 511515 - RNA, 22 nt, Chlamydophila pneumoniae CWL029
acauauucuccuuaccaauaug

SEQ ID NO: 511516 - RNA, 17 nt, Chlamydophila pneumoniae CWL029
acagcuccauuuaaaug

SEQ ID NO: 511517 - RNA, 22 nt, Chlamydophila pneumoniae CWL029
acagcuucuucguaagcugcaa

SEQ ID NO: 511518 - RNA, 18 nt, Chlamydophila pneumoniae CWL029
acagcugggaucuggcuc

SEQ ID NO: 511519 - RNA, 19 nt, Chlamydophila pneumoniae CWL029
acagcugggaucuggcuca

SEQ ID NO: 511520 - RNA, 14 nt, Chlamydophila pneumoniae CWL029
acagcuuuaucuuc

SEQ ID NO: 511521 - RNA, 15 nt, Chlamydophila pneumoniae CWL029
acagcuucuuuucca

SEQ ID NO: 511522 - RNA, 16 nt, Chlamydophila pneumoniae CWL029
acagcuucuuuuccag

SEQ ID NO: 511523 - RNA, 14 nt, Chlamydophila pneumoniae CWL029
acagcuucuuuucc

SEQ ID NO: 511524 - RNA, 16 nt, Chlamydophila pneumoniae CWL029
acaggagcuagaagag

SEQ ID NO: 511525 - RNA, 12 nt, Chlamydophila pneumoniae CWL029
acaggaaagaau

SEQ ID NO: 511526 - RNA, 19 nt, Chlamydophila pneumoniae CWL029
acaggcaggccacuuccua

SEQ ID NO: 511527 - RNA, 14 nt, Chlamydophila pneumoniae CWL029
acagcuaauacauc

SEQ ID NO: 511528 - RNA, 22 nt, Chlamydophila pneumoniae CWL029
acagcuaaucaauccaagaaua

SEQ ID NO: 511529 - RNA, 17 nt, Chlamydophila pneumoniae CWL029
acagcguguauccaucu

SEQ ID NO: 511530 - RNA, 14 nt, Chlamydophila pneumoniae CWL029
acagcguauaggaa

SEQ ID NO: 511531 - RNA, 19 nt, Chlamydophila pneumoniae CWL029
acagcgcgaucacuuuccu

SEQ ID NO: 511532 - RNA, 13 nt, Chlamydophila pneumoniae CWL029
acagccagcagaa

SEQ ID NO: 511533 - RNA, 20 nt, Chlamydophila pneumoniae CWL029
acagagcgccuccaccugca

SEQ ID NO: 511534 - RNA, 19 nt, Chlamydophila pneumoniae CWL029
acagagaauugcauucuua

SEQ ID NO: 511535 - RNA, 21 nt, Chlamydophila pneumoniae CWL029
acagagucagaagcuauucca

SEQ ID NO: 511536 - RNA, 23 nt, Chlamydophila pneumoniae CWL029
acagaucugcauaauuuuucuua

SEQ ID NO: 511537 - RNA, 12 nt, Chlamydophila pneumoniae CWL029
acagagucuggg

SEQ ID NO: 511538 - RNA, 17 nt, Chlamydophila pneumoniae CWL029
acagauuucuucuucag

SEQ ID NO: 511539 - RNA, 18 nt, Chlamydophila pneumoniae CWL029
acagauuucuucuucaga

SEQ ID NO: 511540 - RNA, 15 nt, Chlamydophila pneumoniae CWL029
acagauguaaaugcu

SEQ ID NO: 511541 - RNA, 11 nt, Chlamydophila pneumoniae CWL029
acacucucuac

SEQ ID NO: 511542 - RNA, 17 nt, Chlamydophila pneumoniae CWL029
aauuucaggagcuccug

SEQ ID NO: 511543 - RNA, 18 nt, Chlamydophila pneumoniae CWL029
acacugcgagagaaaguc

SEQ ID NO: 511544 - RNA, 20 nt, Chlamydophila pneumoniae CWL029
acacugguagcuaaauuuag

SEQ ID NO: 511545 - RNA, 13 nt, Chlamydophila pneumoniae CWL029
acacugcgagaga

SEQ ID NO: 511546 - RNA, 17 nt, Chlamydophila pneumoniae CWL029
acacuugcuuaaggaaa

SEQ ID NO: 511547 - RNA, 20 nt, Chlamydophila pneumoniae CWL029
acacuuccuacggcaagaau

SEQ ID NO: 511548 - RNA, 19 nt, Chlamydophila pneumoniae CWL029
acacuuaaagguaaaacua

SEQ ID NO: 511549 - RNA, 15 nt, Chlamydophila pneumoniae CWL029
acagaaugauaagaa

SEQ ID NO: 511550 - RNA, 16 nt, Chlamydophila pneumoniae CWL029
acagaaugauaagaaa

SEQ ID NO: 511551 - RNA, 17 nt, Chlamydophila pneumoniae CWL029
acagaaugauaagaaag

SEQ ID NO: 511552 - RNA, 14 nt, Chlamydophila pneumoniae CWL029
acacuuuguuuuuc

SEQ ID NO: 511553 - RNA, 23 nt, Chlamydophila pneumoniae CWL029
acacuuuuaaagauaaggaccag

SEQ ID NO: 511554 - RNA, 17 nt, Chlamydophila pneumoniae CWL029
acagacaagcaaggaaa

SEQ ID NO: 511555 - RNA, 15 nt, Chlamydophila pneumoniae CWL029
acagaccaaaucauc

SEQ ID NO: 511556 - RNA, 22 nt, Chlamydophila pneumoniae CWL029
accccacgcuaaacuaaaaugg

SEQ ID NO: 511557 - RNA, 20 nt, Chlamydophila pneumoniae CWL029
acccagagaauguucccaaa

SEQ ID NO: 511558 - RNA, 21 nt, Chlamydophila pneumoniae CWL029
acccagagaauguucccaaau

SEQ ID NO: 511559 - RNA, 16 nt, Chlamydophila pneumoniae CWL029
acccccacuucuuuuu

SEQ ID NO: 511560 - RNA, 18 nt, Chlamydophila pneumoniae CWL029
acccaauucuuaaaaagc

SEQ ID NO: 511561 - RNA, 14 nt, Chlamydophila pneumoniae CWL029
acccaagagaccca

SEQ ID NO: 511562 - RNA, 16 nt, Chlamydophila pneumoniae CWL029
acccaccauucuugaa

SEQ ID NO: 511563 - RNA, 16 nt, Chlamydophila pneumoniae CWL029
accauugcucuaaguu

SEQ ID NO: 511564 - RNA, 17 nt, Chlamydophila pneumoniae CWL029
accauucuugaagaucu

SEQ ID NO: 511565 - RNA, 14 nt, Chlamydophila pneumoniae CWL029
accauaaagaauuc

SEQ ID NO: 511566 - RNA, 17 nt, Chlamydophila pneumoniae CWL029
accauaaggagauuccu

SEQ ID NO: 511567 - RNA, 20 nt, Chlamydophila pneumoniae CWL029
accagguagagugucuuccu

SEQ ID NO: 511568 - RNA, 14 nt, Chlamydophila pneumoniae CWL029
accagggagaccua

SEQ ID NO: 511569 - RNA, 15 nt, Chlamydophila pneumoniae CWL029
accagauaaagcaaa

SEQ ID NO: 511570 - RNA, 16 nt, Chlamydophila pneumoniae CWL029
accagauaaagcaaag

SEQ ID NO: 511571 - RNA, 23 nt, Chlamydophila pneumoniae CWL029
accagauaaagcaaagauaaaga

SEQ ID NO: 511572 - RNA, 18 nt, Chlamydophila pneumoniae CWL029
accagaugauuuuuugaa

SEQ ID NO: 511573 - RNA, 14 nt, Chlamydophila pneumoniae CWL029
accagaagacuccc

SEQ ID NO: 511574 - RNA, 17 nt, Chlamydophila pneumoniae CWL029
accagaagcaugaauga

SEQ ID NO: 511575 - RNA, 21 nt, Chlamydophila pneumoniae CWL029
accagaaggaagguucucaaa

SEQ ID NO: 511576 - RNA, 22 nt, Chlamydophila pneumoniae CWL029
accacuguccaugcacgagauu

SEQ ID NO: 511577 - RNA, 17 nt, Chlamydophila pneumoniae CWL029
accacggauuuucucua

SEQ ID NO: 511578 - RNA, 15 nt, Chlamydophila pneumoniae CWL029
accaaguuauuauau

SEQ ID NO: 511579 - RNA, 15 nt, Chlamydophila pneumoniae CWL029
accaacugagcuauu

SEQ ID NO: 511580 - RNA, 16 nt, Chlamydophila pneumoniae CWL029
accaaccaguuucuug

SEQ ID NO: 511581 - RNA, 18 nt, Chlamydophila pneumoniae CWL029
accaauucucucucugca

SEQ ID NO: 511582 - RNA, 16 nt, Chlamydophila pneumoniae CWL029
accaauugcagucacu

SEQ ID NO: 511583 - RNA, 20 nt, Chlamydophila pneumoniae CWL029
accaauccggcauaaaaaag

SEQ ID NO: 511584 - RNA, 20 nt, Chlamydophila pneumoniae CWL029
acauuuaagucauuagcaag

SEQ ID NO: 511585 - RNA, 13 nt, Chlamydophila pneumoniae CWL029
acauuuagaagua

SEQ ID NO: 511586 - RNA, 13 nt, Chlamydophila pneumoniae CWL029
acauguaaacaaa

SEQ ID NO: 511587 - RNA, 20 nt, Chlamydophila pneumoniae CWL029
acauguaaacaaaagcagac

SEQ ID NO: 511588 - RNA, 22 nt, Chlamydophila pneumoniae CWL029
accaaaaaaguaacuaucuaca

SEQ ID NO: 511589 - RNA, 22 nt, Chlamydophila pneumoniae CWL029
accaaaaauuccguuaagaugu

SEQ ID NO: 511590 - RNA, 19 nt, Chlamydophila pneumoniae CWL029
accaaagugacuuccucca

SEQ ID NO: 511591 - RNA, 18 nt, Chlamydophila pneumoniae CWL029
accaaauaauuaaauaua

SEQ ID NO: 511592 - RNA, 19 nt, Chlamydophila pneumoniae CWL029
accaaauagagaguaguga

SEQ ID NO: 511593 - RNA, 15 nt, Chlamydophila pneumoniae CWL029
accaacaucaaagaa

SEQ ID NO: 511594 - RNA, 16 nt, Chlamydophila pneumoniae CWL029
accaacaucaaagaau

SEQ ID NO: 511595 - RNA, 20 nt, Chlamydophila pneumoniae CWL029
acgauuucuuuuaguuguga

SEQ ID NO: 511596 - RNA, 22 nt, Chlamydophila pneumoniae CWL029
acgaucuacguuggacugcaag

SEQ ID NO: 511597 - RNA, 14 nt, Chlamydophila pneumoniae CWL029
acgauccaucucau

SEQ ID NO: 511598 - RNA, 18 nt, Chlamydophila pneumoniae CWL029
acgauccaucucaucgaa

SEQ ID NO: 511599 - RNA, 19 nt, Chlamydophila pneumoniae CWL029
acgaucaaauuccuucuca

SEQ ID NO: 511600 - RNA, 20 nt, Chlamydophila pneumoniae CWL029
acgaucacauuccaagaaaa

SEQ ID NO: 511601 - RNA, 21 nt, Chlamydophila pneumoniae CWL029
acgaucacauuccaagaaaaa

SEQ ID NO: 511602 - RNA, 23 nt, Chlamydophila pneumoniae CWL029
acgaguucucccgugaacaaaaa

SEQ ID NO: 511603 - RNA, 15 nt, Chlamydophila pneumoniae CWL029
acgagucccuucuuu

SEQ ID NO: 511604 - RNA, 14 nt, Chlamydophila pneumoniae CWL029
acgagcgcuuucuu

SEQ ID NO: 511605 - RNA, 17 nt, Chlamydophila pneumoniae CWL029
acgagcccuagauagca

SEQ ID NO: 511606 - RNA, 19 nt, Chlamydophila pneumoniae CWL029
acgagaaguuugauaagcu

SEQ ID NO: 511607 - RNA, 11 nt, Chlamydophila pneumoniae CWL029
acgagacugca

SEQ ID NO: 511608 - RNA, 18 nt, Chlamydophila pneumoniae CWL029
acgagacugcaaaggaag

SEQ ID NO: 511609 - RNA, 14 nt, Chlamydophila pneumoniae CWL029
acgacucugccaug

SEQ ID NO: 511610 - RNA, 18 nt, Chlamydophila pneumoniae CWL029
acgacucugccaugucua

SEQ ID NO: 511611 - RNA, 20 nt, Chlamydophila pneumoniae CWL029
acgacguuuaauuccuugga

SEQ ID NO: 511612 - RNA, 17 nt, Chlamydophila pneumoniae CWL029
acgaccaacuccucaaa

SEQ ID NO: 511613 - RNA, 21 nt, Chlamydophila pneumoniae CWL029
acgacaugccuaaauagcuca

SEQ ID NO: 511614 - RNA, 19 nt, Chlamydophila pneumoniae CWL029
acgaaguuagcuaacucgg

SEQ ID NO: 511615 - RNA, 21 nt, Chlamydophila pneumoniae CWL029
acgaauacuguucgauaagaa

SEQ ID NO: 511616 - RNA, 16 nt, Chlamydophila pneumoniae CWL029
acgaauccaaaaaaga

SEQ ID NO: 511617 - RNA, 24 nt, Chlamydophila pneumoniae CWL029
acgaauguguugcucuaccaacug

SEQ ID NO: 511618 - RNA, 19 nt, Chlamydophila pneumoniae CWL029
acgaauuucaacagcuuca

SEQ ID NO: 511619 - RNA, 20 nt, Chlamydophila pneumoniae CWL029
acgaauuucacacagcggua

SEQ ID NO: 511620 - RNA, 14 nt, Chlamydophila pneumoniae CWL029
acgacaaggacagg

SEQ ID NO: 511621 - RNA, 19 nt, Chlamydophila pneumoniae CWL029
acgaagaaaacgcaccuua

SEQ ID NO: 511622 - RNA, 14 nt, Chlamydophila pneumoniae CWL029
acgaacuaaaggaa

SEQ ID NO: 511623 - RNA, 20 nt, Chlamydophila pneumoniae CWL029
acgaacaugccugaaaacaa

SEQ ID NO: 511624 - RNA, 16 nt, Chlamydophila pneumoniae CWL029
accuuuuuuuaaaaau

SEQ ID NO: 511625 - RNA, 23 nt, Chlamydophila pneumoniae CWL029
acgaaaaucuacacgcuauagca

SEQ ID NO: 511626 - RNA, 12 nt, Chlamydophila pneumoniae CWL029
acgaaaaggaga

SEQ ID NO: 511627 - RNA, 13 nt, Chlamydophila pneumoniae CWL029
acgaaaaggagaa

SEQ ID NO: 511628 - RNA, 23 nt, Chlamydophila pneumoniae CWL029
accuuuaacccgcuugcaucuua

SEQ ID NO: 511629 - RNA, 12 nt, Chlamydophila pneumoniae CWL029
accuuuaggaac

SEQ ID NO: 511630 - RNA, 15 nt, Chlamydophila pneumoniae CWL029
accuuuaggaagcug

SEQ ID NO: 511631 - RNA, 18 nt, Chlamydophila pneumoniae CWL029
accuuuuucauugaugcu

SEQ ID NO: 511632 - RNA, 22 nt, Chlamydophila pneumoniae CWL029
accuuugguagaaagacaaaaa

SEQ ID NO: 511633 - RNA, 16 nt, Chlamydophila pneumoniae CWL029
accuugagacaaagaa

SEQ ID NO: 511634 - RNA, 21 nt, Chlamydophila pneumoniae CWL029
accuugagacaaagaaucccc

SEQ ID NO: 511635 - RNA, 14 nt, Chlamydophila pneumoniae CWL029
accuugaaguuuuu

SEQ ID NO: 511636 - RNA, 20 nt, Chlamydophila pneumoniae CWL029
accuugauacugaaucccgu

SEQ ID NO: 511637 - RNA, 17 nt, Chlamydophila pneumoniae CWL029
accuucggaucuuccca

SEQ ID NO: 511638 - RNA, 17 nt, Chlamydophila pneumoniae CWL029
accuuccccaagcucuc

SEQ ID NO: 511639 - RNA, 16 nt, Chlamydophila pneumoniae CWL029
accuucacaagaaaac

SEQ ID NO: 511640 - RNA, 19 nt, Chlamydophila pneumoniae CWL029
accuuaguuuuuucuaagg

SEQ ID NO: 511641 - RNA, 18 nt, Chlamydophila pneumoniae CWL029
accuucaaugauuucuuu

SEQ ID NO: 511642 - RNA, 21 nt, Chlamydophila pneumoniae CWL029
accuucaaugauuucuuuagc

SEQ ID NO: 511643 - RNA, 17 nt, Chlamydophila pneumoniae CWL029
accuguguaaugagcug

SEQ ID NO: 511644 - RNA, 18 nt, Chlamydophila pneumoniae CWL029
accuguguaaugagcugg

SEQ ID NO: 511645 - RNA, 21 nt, Chlamydophila pneumoniae CWL029
accuguaaagaccaaauagag

SEQ ID NO: 511646 - RNA, 10 nt, Chlamydophila pneumoniae CWL029
accugggcaa

SEQ ID NO: 511647 - RNA, 13 nt, Chlamydophila pneumoniae CWL029
accucuuuucuua

SEQ ID NO: 511648 - RNA, 12 nt, Chlamydophila pneumoniae CWL029
accucuuuucuu

SEQ ID NO: 511649 - RNA, 23 nt, Chlamydophila pneumoniae CWL029
accucuuuucuuaucaugaaaag

SEQ ID NO: 511650 - RNA, 21 nt, Chlamydophila pneumoniae CWL029
accugaagagcgcuauugcua

SEQ ID NO: 511651 - RNA, 18 nt, Chlamydophila pneumoniae CWL029
accugcaaaugaagggau

SEQ ID NO: 511652 - RNA, 14 nt, Chlamydophila pneumoniae CWL029
accucugcauguug

SEQ ID NO: 511653 - RNA, 19 nt, Chlamydophila pneumoniae CWL029
accucugcauguugcaaag

SEQ ID NO: 511654 - RNA, 15 nt, Chlamydophila pneumoniae CWL029
accucuucaaagaca

SEQ ID NO: 511655 - RNA, 12 nt, Chlamydophila pneumoniae CWL029
accucuaauuug

SEQ ID NO: 511656 - RNA, 14 nt, Chlamydophila pneumoniae CWL029
accucgccucuugu

SEQ ID NO: 511657 - RNA, 20 nt, Chlamydophila pneumoniae CWL029
accuauugugcuuuucucuu

SEQ ID NO: 511658 - RNA, 13 nt, Chlamydophila pneumoniae CWL029
accuauuugcaac

SEQ ID NO: 511659 - RNA, 19 nt, Chlamydophila pneumoniae CWL029
accucaagaugcauucuga

SEQ ID NO: 511660 - RNA, 12 nt, Chlamydophila pneumoniae CWL029
accucaucagaa

SEQ ID NO: 511661 - RNA, 18 nt, Chlamydophila pneumoniae CWL029
accucaucucgcagucca

SEQ ID NO: 511662 - RNA, 17 nt, Chlamydophila pneumoniae CWL029
accucaucucuggaaua

SEQ ID NO: 511663 - RNA, 13 nt, Chlamydophila pneumoniae CWL029
accuccgcccccu

SEQ ID NO: 511664 - RNA, 21 nt, Chlamydophila pneumoniae CWL029
accuccauagaauccucggaa

SEQ ID NO: 511665 - RNA, 17 nt, Chlamydophila pneumoniae CWL029
accuaccugcuaccugu

SEQ ID NO: 511666 - RNA, 16 nt, Chlamydophila pneumoniae CWL029
accuacuaaacccugu

SEQ ID NO: 511667 - RNA, 18 nt, Chlamydophila pneumoniae CWL029
accuacugggaaaucuaa

SEQ ID NO: 511668 - RNA, 13 nt, Chlamydophila pneumoniae CWL029
accuacuuauugu

SEQ ID NO: 511669 - RNA, 22 nt, Chlamydophila pneumoniae CWL029
accuacagaucaggauucuaaa

SEQ ID NO: 511670 - RNA, 14 nt, Chlamydophila pneumoniae CWL029
accuaauaaagaag

SEQ ID NO: 511671 - RNA, 13 nt, Chlamydophila pneumoniae CWL029
accuaauacagga

SEQ ID NO: 511672 - RNA, 18 nt, Chlamydophila pneumoniae CWL029
accguuucaggaaacuca

SEQ ID NO: 511673 - RNA, 15 nt, Chlamydophila pneumoniae CWL029
accguuuccuccucu

SEQ ID NO: 511674 - RNA, 20 nt, Chlamydophila pneumoniae CWL029
accgucccaugcguccaaua

SEQ ID NO: 511675 - RNA, 16 nt, Chlamydophila pneumoniae CWL029
accguaaagaaaagca

SEQ ID NO: 511676 - RNA, 14 nt, Chlamydophila pneumoniae CWL029
accguaaagaaaag

SEQ ID NO: 511677 - RNA, 19 nt, Chlamydophila pneumoniae CWL029
accguaacugaggcaaaga

SEQ ID NO: 511678 - RNA, 22 nt, Chlamydophila pneumoniae CWL029
agaaaggcuuuucuuuuucuag

SEQ ID NO: 511679 - RNA, 17 nt, Chlamydophila pneumoniae CWL029
agaaaggcgcucuuacc

SEQ ID NO: 511680 - RNA, 17 nt, Chlamydophila pneumoniae CWL029
agaaacuuaguuuugaa

SEQ ID NO: 511681 - RNA, 18 nt, Chlamydophila pneumoniae CWL029
agaaacuuaguuuugaaa

SEQ ID NO: 511682 - RNA, 21 nt, Chlamydophila pneumoniae CWL029
agaaacugcuccugaagcuga

SEQ ID NO: 511683 - RNA, 14 nt, Chlamydophila pneumoniae CWL029
agaaacugcuccug

SEQ ID NO: 511684 - RNA, 19 nt, Chlamydophila pneumoniae CWL029
agaaacugcuccugaagcu

SEQ ID NO: 511685 - RNA, 15 nt, Chlamydophila pneumoniae CWL029
agaaacuccaaaaua

SEQ ID NO: 511686 - RNA, 16 nt, Chlamydophila pneumoniae CWL029
agaaacuccaaaauau

SEQ ID NO: 511687 - RNA, 17 nt, Chlamydophila pneumoniae CWL029
agaaacuccaaaauauu

SEQ ID NO: 511688 - RNA, 20 nt, Chlamydophila pneumoniae CWL029
agaaaauucucagauugcuu

SEQ ID NO: 511689 - RNA, 18 nt, Chlamydophila pneumoniae CWL029
agaaaaucugcagcagau

SEQ ID NO: 511690 - RNA, 14 nt, Chlamydophila pneumoniae CWL029
agaaaauaucaccu

SEQ ID NO: 511691 - RNA, 13 nt, Chlamydophila pneumoniae CWL029
agaaaaaucuaac

SEQ ID NO: 511692 - RNA, 20 nt, Chlamydophila pneumoniae CWL029
agaaaaaucuaacacagucc

SEQ ID NO: 511693 - RNA, 21 nt, Chlamydophila pneumoniae CWL029
agaaaaauucuucgagagcau

SEQ ID NO: 511694 - RNA, 17 nt, Chlamydophila pneumoniae CWL029
agaaacccgcaacucuu

SEQ ID NO: 511695 - RNA, 13 nt, Chlamydophila pneumoniae CWL029
acuuuuuucccuc

SEQ ID NO: 511696 - RNA, 14 nt, Chlamydophila pneumoniae CWL029
acuuuuuuguuaau

SEQ ID NO: 511697 - RNA, 16 nt, Chlamydophila pneumoniae CWL029
acuuuuuuucuucucu

SEQ ID NO: 511698 - RNA, 18 nt, Chlamydophila pneumoniae CWL029
acuuuuuuucuucucuaa

SEQ ID NO: 511699 - RNA, 20 nt, Chlamydophila pneumoniae CWL029
acuuuuugccacaacucauc

SEQ ID NO: 511700 - RNA, 18 nt, Chlamydophila pneumoniae CWL029
acuuuuguugcaauucca

SEQ ID NO: 511701 - RNA, 20 nt, Chlamydophila pneumoniae CWL029
acuuuucucuuuaauccagu

SEQ ID NO: 511702 - RNA, 21 nt, Chlamydophila pneumoniae CWL029
acuuuugaagauccugaguau

SEQ ID NO: 511703 - RNA, 18 nt, Chlamydophila pneumoniae CWL029
acuuuuguacacagagau

SEQ ID NO: 511704 - RNA, 22 nt, Chlamydophila pneumoniae CWL029
acuuuuguacacagagaugcuu

SEQ ID NO: 511705 - RNA, 13 nt, Chlamydophila pneumoniae CWL029
acuuccuuuuucu

SEQ ID NO: 511706 - RNA, 16 nt, Chlamydophila pneumoniae CWL029
acuucgacacgaacuu

SEQ ID NO: 511707 - RNA, 20 nt, Chlamydophila pneumoniae CWL029
acuucgacacgaacuuugac

SEQ ID NO: 511708 - RNA, 14 nt, Chlamydophila pneumoniae CWL029
acuucgaugucuuu

SEQ ID NO: 511709 - RNA, 16 nt, Chlamydophila pneumoniae CWL029
acuucgaugucuuucc

SEQ ID NO: 511710 - RNA, 21 nt, Chlamydophila pneumoniae CWL029
acuucgaugucuuuccaggca

SEQ ID NO: 511711 - RNA, 17 nt, Chlamydophila pneumoniae CWL029
acuucgcaaauuuuucg

SEQ ID NO: 511712 - RNA, 19 nt, Chlamydophila pneumoniae CWL029
agaacugcuuggucacacc

SEQ ID NO: 511713 - RNA, 22 nt, Chlamydophila pneumoniae CWL029
agaacucuuaaagguaaagcuu

SEQ ID NO: 511714 - RNA, 20 nt, Chlamydophila pneumoniae CWL029
agaacucuauuuggcucgcu

SEQ ID NO: 511715 - RNA, 13 nt, Chlamydophila pneumoniae CWL029
agaacucuccucg

SEQ ID NO: 511716 - RNA, 16 nt, Chlamydophila pneumoniae CWL029
agaacuccauucagau

SEQ ID NO: 511717 - RNA, 17 nt, Chlamydophila pneumoniae CWL029
agaacucaacuuuuuua

SEQ ID NO: 511718 - RNA, 13 nt, Chlamydophila pneumoniae CWL029
agaacguaagcuu

SEQ ID NO: 511719 - RNA, 21 nt, Chlamydophila pneumoniae CWL029
agaacguccucaccuugugag

SEQ ID NO: 511720 - RNA, 20 nt, Chlamydophila pneumoniae CWL029
agaaccuucacaagaaaaca

SEQ ID NO: 511721 - RNA, 12 nt, Chlamydophila pneumoniae CWL029
agaacgaauuuc

SEQ ID NO: 511722 - RNA, 14 nt, Chlamydophila pneumoniae CWL029
agaaccuguuuuuc

SEQ ID NO: 511723 - RNA, 16 nt, Chlamydophila pneumoniae CWL029
agaaccuguuuuucua

SEQ ID NO: 511724 - RNA, 17 nt, Chlamydophila pneumoniae CWL029
agaaccuguuuuucuaa

SEQ ID NO: 511725 - RNA, 15 nt, Chlamydophila pneumoniae CWL029
agaaccuucacaaga

SEQ ID NO: 511726 - RNA, 12 nt, Chlamydophila pneumoniae CWL029
agaaccuccacc

SEQ ID NO: 511727 - RNA, 21 nt, Chlamydophila pneumoniae CWL029
agaacagcauggacuccaaga

SEQ ID NO: 511728 - RNA, 16 nt, Chlamydophila pneumoniae CWL029
agaacauaaccucggu

SEQ ID NO: 511729 - RNA, 13 nt, Chlamydophila pneumoniae CWL029
agaacagcagaaa

SEQ ID NO: 511730 - RNA, 18 nt, Chlamydophila pneumoniae CWL029
agaacagaggaucuagaa

SEQ ID NO: 511731 - RNA, 21 nt, Chlamydophila pneumoniae CWL029
agaacagaggaucuagaaaau

SEQ ID NO: 511732 - RNA, 16 nt, Chlamydophila pneumoniae CWL029
agaacacucagagaug

SEQ ID NO: 511733 - RNA, 15 nt, Chlamydophila pneumoniae CWL029
agaacaugcccccac

SEQ ID NO: 511734 - RNA, 21 nt, Chlamydophila pneumoniae CWL029
agaacauagucguuuucucga

SEQ ID NO: 511735 - RNA, 18 nt, Chlamydophila pneumoniae CWL029
agaaaguauuccucuuag

SEQ ID NO: 511736 - RNA, 15 nt, Chlamydophila pneumoniae CWL029
agaaaguagagacau

SEQ ID NO: 511737 - RNA, 19 nt, Chlamydophila pneumoniae CWL029
agaaauucuguagauacua

SEQ ID NO: 511738 - RNA, 21 nt, Chlamydophila pneumoniae CWL029
agaaauuuuuaauuuuucuaa

SEQ ID NO: 511739 - RNA, 13 nt, Chlamydophila pneumoniae CWL029
agaacaacgcugc

SEQ ID NO: 511740 - RNA, 21 nt, Chlamydophila pneumoniae CWL029
agaacaacgcugcuucucuac

SEQ ID NO: 511741 - RNA, 13 nt, Chlamydophila pneumoniae CWL029
agaacaccaucac

SEQ ID NO: 511742 - RNA, 22 nt, Chlamydophila pneumoniae CWL029
agacguuaucuaagacuucugg

SEQ ID NO: 511743 - RNA, 23 nt, Chlamydophila pneumoniae CWL029
agacgugcucucuacuucuguag

SEQ ID NO: 511744 - RNA, 21 nt, Chlamydophila pneumoniae CWL029
agacguucgacaacaacauaa

SEQ ID NO: 511745 - RNA, 19 nt, Chlamydophila pneumoniae CWL029
agacguaggugccugaaga

SEQ ID NO: 511746 - RNA, 18 nt, Chlamydophila pneumoniae CWL029
agaccuaacgcaacaucc

SEQ ID NO: 511747 - RNA, 21 nt, Chlamydophila pneumoniae CWL029
agaccuaacgcaacauccauu

SEQ ID NO: 511748 - RNA, 16 nt, Chlamydophila pneumoniae CWL029
agacgaggagaagucg

SEQ ID NO: 511749 - RNA, 19 nt, Chlamydophila pneumoniae CWL029
agaccauaaaaucaacaag

SEQ ID NO: 511750 - RNA, 20 nt, Chlamydophila pneumoniae CWL029
agaccaugaccuuuagcugc

SEQ ID NO: 511751 - RNA, 22 nt, Chlamydophila pneumoniae CWL029
agaccguugccagcuugcccuu

SEQ ID NO: 511752 - RNA, 15 nt, Chlamydophila pneumoniae CWL029
agaccauacacaaau

SEQ ID NO: 511753 - RNA, 16 nt, Chlamydophila pneumoniae CWL029
agacacgccuccuuca

SEQ ID NO: 511754 - RNA, 23 nt, Chlamydophila pneumoniae CWL029
agacaaguaaacagcaaaguaau

SEQ ID NO: 511755 - RNA, 14 nt, Chlamydophila pneumoniae CWL029
agacaauaaaaaag

SEQ ID NO: 511756 - RNA, 21 nt, Chlamydophila pneumoniae CWL029
agacaacuauguuauccauac

SEQ ID NO: 511757 - RNA, 13 nt, Chlamydophila pneumoniae CWL029
agacaagaaaaua

SEQ ID NO: 511758 - RNA, 16 nt, Chlamydophila pneumoniae CWL029
agaauuucgucuucau

SEQ ID NO: 511759 - RNA, 19 nt, Chlamydophila pneumoniae CWL029
agacaacgcaggaagaaca

SEQ ID NO: 511760 - RNA, 16 nt, Chlamydophila pneumoniae CWL029
agaauugcaaaguacu

SEQ ID NO: 511761 - RNA, 20 nt, Chlamydophila pneumoniae CWL029
agacacuugcuuaaggaaac

SEQ ID NO: 511762 - RNA, 15 nt, Chlamydophila pneumoniae CWL029
agaaucuaaguaaaa

SEQ ID NO: 511763 - RNA, 16 nt, Chlamydophila pneumoniae CWL029
agaaucuauagaacua

SEQ ID NO: 511764 - RNA, 21 nt, Chlamydophila pneumoniae CWL029
agaaucguucccaucacauaa

SEQ ID NO: 511765 - RNA, 12 nt, Chlamydophila pneumoniae CWL029
agaauccuuuuu

SEQ ID NO: 511766 - RNA, 20 nt, Chlamydophila pneumoniae CWL029
agaauccucggaagauaaau

SEQ ID NO: 511767 - RNA, 21 nt, Chlamydophila pneumoniae CWL029
agaauccucuauccaucaucg

SEQ ID NO: 511768 - RNA, 20 nt, Chlamydophila pneumoniae CWL029
agaauccugaguaaaaucau

SEQ ID NO: 511769 - RNA, 21 nt, Chlamydophila pneumoniae CWL029
agaauccugaguaaaaucaua

SEQ ID NO: 511770 - RNA, 21 nt, Chlamydophila pneumoniae CWL029
agaauacucauauuuugucuu

SEQ ID NO: 511771 - RNA, 17 nt, Chlamydophila pneumoniae CWL029
agaauacucuagguuuu

SEQ ID NO: 511772 - RNA, 13 nt, Chlamydophila pneumoniae CWL029
agaauagcaagca

SEQ ID NO: 511773 - RNA, 16 nt, Chlamydophila pneumoniae CWL029
agaauagcaggaagga

SEQ ID NO: 511774 - RNA, 15 nt, Chlamydophila pneumoniae CWL029
agaauagcaugaagg

SEQ ID NO: 511775 - RNA, 18 nt, Chlamydophila pneumoniae CWL029
agaauagccauaauuaga

SEQ ID NO: 511776 - RNA, 21 nt, Chlamydophila pneumoniae CWL029
agaauauggccuagcuuucuu

SEQ ID NO: 511777 - RNA, 20 nt, Chlamydophila pneumoniae CWL029
agaaucucugaccaucaaug

SEQ ID NO: 511778 - RNA, 16 nt, Chlamydophila pneumoniae CWL029
agaaucuccucaucag

SEQ ID NO: 511779 - RNA, 18 nt, Chlamydophila pneumoniae CWL029
agaaucuccauuuagaau

SEQ ID NO: 511780 - RNA, 18 nt, Chlamydophila pneumoniae CWL029
agaaucucugaccaucaa

SEQ ID NO: 511781 - RNA, 17 nt, Chlamydophila pneumoniae CWL029
agaaucuuuucuagaaa

SEQ ID NO: 511782 - RNA, 17 nt, Chlamydophila pneumoniae CWL029
agaaugaacaauagaaa

SEQ ID NO: 511783 - RNA, 21 nt, Chlamydophila pneumoniae CWL029
agaaugcuguaaucgagagaa

SEQ ID NO: 511784 - RNA, 14 nt, Chlamydophila pneumoniae CWL029
agaauguaugugaa

SEQ ID NO: 511785 - RNA, 21 nt, Chlamydophila pneumoniae CWL029
agaagcucuaucuuugguaug

SEQ ID NO: 511786 - RNA, 22 nt, Chlamydophila pneumoniae CWL029
agaagcuccugaguauccgaau

SEQ ID NO: 511787 - RNA, 19 nt, Chlamydophila pneumoniae CWL029
agaagcucacucuuuaaaa

SEQ ID NO: 511788 - RNA, 20 nt, Chlamydophila pneumoniae CWL029
agaagcucacucuuuaaaaa

SEQ ID NO: 511789 - RNA, 23 nt, Chlamydophila pneumoniae CWL029
agaauaccguuuuaggaagguca

SEQ ID NO: 511790 - RNA, 15 nt, Chlamydophila pneumoniae CWL029
agaauacaaacaaga

SEQ ID NO: 511791 - RNA, 23 nt, Chlamydophila pneumoniae CWL029
agaagucgcuagaucacaagaaa

SEQ ID NO: 511792 - RNA, 14 nt, Chlamydophila pneumoniae CWL029
agaagucgcaguaa

SEQ ID NO: 511793 - RNA, 13 nt, Chlamydophila pneumoniae CWL029
agaagcaugaagc

SEQ ID NO: 511794 - RNA, 14 nt, Chlamydophila pneumoniae CWL029
agaagcauugagga

SEQ ID NO: 511795 - RNA, 14 nt, Chlamydophila pneumoniae CWL029
agaagcaagaauca

SEQ ID NO: 511796 - RNA, 21 nt, Chlamydophila pneumoniae CWL029
agaagcacuucuuuaggagca

SEQ ID NO: 511797 - RNA, 16 nt, Chlamydophila pneumoniae CWL029
agaacuuuugaauuaa

SEQ ID NO: 511798 - RNA, 16 nt, Chlamydophila pneumoniae CWL029
agaagaaccucauuuu

SEQ ID NO: 511799 - RNA, 16 nt, Chlamydophila pneumoniae CWL029
agaagaagcaaaagau

SEQ ID NO: 511800 - RNA, 13 nt, Chlamydophila pneumoniae CWL029
agaacuucuccaa

SEQ ID NO: 511801 - RNA, 16 nt, Chlamydophila pneumoniae CWL029
agaacuuccugauucu

SEQ ID NO: 511802 - RNA, 12 nt, Chlamydophila pneumoniae CWL029
agaacuucaaca

SEQ ID NO: 511803 - RNA, 15 nt, Chlamydophila pneumoniae CWL029
agaacuuuacaauua

SEQ ID NO: 511804 - RNA, 16 nt, Chlamydophila pneumoniae CWL029
agaacuuuagggaaga

SEQ ID NO: 511805 - RNA, 19 nt, Chlamydophila pneumoniae CWL029
agaacuuucgucuuugcuu

SEQ ID NO: 511806 - RNA, 20 nt, Chlamydophila pneumoniae CWL029
agaacuuucgucuuugcuuu

SEQ ID NO: 511807 - RNA, 15 nt, Chlamydophila pneumoniae CWL029
agauguaaagagcaa

SEQ ID NO: 511808 - RNA, 18 nt, Chlamydophila pneumoniae CWL029
agauguuaugaguuuuua

SEQ ID NO: 511809 - RNA, 13 nt, Chlamydophila pneumoniae CWL029
agaugucuugguu

SEQ ID NO: 511810 - RNA, 24 nt, Chlamydophila pneumoniae CWL029
agauguuuucguaaauaugaauua

SEQ ID NO: 511811 - RNA, 20 nt, Chlamydophila pneumoniae CWL029
agauuaccgaagagccccca

SEQ ID NO: 511812 - RNA, 13 nt, Chlamydophila pneumoniae CWL029
agaugcuggaacu

SEQ ID NO: 511813 - RNA, 23 nt, Chlamydophila pneumoniae CWL029
agaugcuucuaaacaauuucaau

SEQ ID NO: 511814 - RNA, 14 nt, Chlamydophila pneumoniae CWL029
agauucugaagaga

SEQ ID NO: 511815 - RNA, 16 nt, Chlamydophila pneumoniae CWL029
agauucuucagaaucu

SEQ ID NO: 511816 - RNA, 21 nt, Chlamydophila pneumoniae CWL029
agauugaaggcaccaacacuu

SEQ ID NO: 511817 - RNA, 17 nt, Chlamydophila pneumoniae CWL029
agauugauuucuugcuu

SEQ ID NO: 511818 - RNA, 17 nt, Chlamydophila pneumoniae CWL029
agauugaggauaaguuc

SEQ ID NO: 511819 - RNA, 22 nt, Chlamydophila pneumoniae CWL029
agauugaggauaaguucuucca

SEQ ID NO: 511820 - RNA, 16 nt, Chlamydophila pneumoniae CWL029
agauuccuaacuucug

SEQ ID NO: 511821 - RNA, 15 nt, Chlamydophila pneumoniae CWL029
agauucauuaauguu

SEQ ID NO: 511822 - RNA, 16 nt, Chlamydophila pneumoniae CWL029
agauucauaaaacugu

SEQ ID NO: 511823 - RNA, 13 nt, Chlamydophila pneumoniae CWL029
agauucaaagaag

SEQ ID NO: 511824 - RNA, 15 nt, Chlamydophila pneumoniae CWL029
agauucaagcaaugc

SEQ ID NO: 511825 - RNA, 20 nt, Chlamydophila pneumoniae CWL029
agaugagaaaaucugcagca

SEQ ID NO: 511826 - RNA, 16 nt, Chlamydophila pneumoniae CWL029
agaugagguaucccac

SEQ ID NO: 511827 - RNA, 23 nt, Chlamydophila pneumoniae CWL029
agaugaauaccagaagcaaaggu

SEQ ID NO: 511828 - RNA, 20 nt, Chlamydophila pneumoniae CWL029
agaugaacgucuaaacgcga

SEQ ID NO: 511829 - RNA, 14 nt, Chlamydophila pneumoniae CWL029
agaugaaguuccca

SEQ ID NO: 511830 - RNA, 14 nt, Chlamydophila pneumoniae CWL029
agaucuuuuugcca

SEQ ID NO: 511831 - RNA, 13 nt, Chlamydophila pneumoniae CWL029
agaucuuuuguaa

SEQ ID NO: 511832 - RNA, 23 nt, Chlamydophila pneumoniae CWL029
agaucuuuucuacuucaggaaau

SEQ ID NO: 511833 - RNA, 21 nt, Chlamydophila pneumoniae CWL029
agaucuuuauuuuuaaaaaua

SEQ ID NO: 511834 - RNA, 20 nt, Chlamydophila pneumoniae CWL029
agaucugcaaacgcaaugau

SEQ ID NO: 511835 - RNA, 20 nt, Chlamydophila pneumoniae CWL029
agaucucuguguuuugagga

SEQ ID NO: 511836 - RNA, 17 nt, Chlamydophila pneumoniae CWL029
agaucucuuuagcaauc

SEQ ID NO: 511837 - RNA, 20 nt, Chlamydophila pneumoniae CWL029
agaucucgucuuggaaugcu

SEQ ID NO: 511838 - RNA, 17 nt, Chlamydophila pneumoniae CWL029
agaucugcauaauuuuu

SEQ ID NO: 511839 - RNA, 23 nt, Chlamydophila pneumoniae CWL029
agaucuggagagggaaggaauaa

SEQ ID NO: 511840 - RNA, 16 nt, Chlamydophila pneumoniae CWL029
agaucuuuagaauaag

SEQ ID NO: 511841 - RNA, 15 nt, Chlamydophila pneumoniae CWL029
agaucuugaacagag

SEQ ID NO: 511842 - RNA, 13 nt, Chlamydophila pneumoniae CWL029
agaucuucauaac

SEQ ID NO: 511843 - RNA, 15 nt, Chlamydophila pneumoniae CWL029
agaucgaucucugug

SEQ ID NO: 511844 - RNA, 18 nt, Chlamydophila pneumoniae CWL029
agaucuccgccuacaaua

SEQ ID NO: 511845 - RNA, 23 nt, Chlamydophila pneumoniae CWL029
agaucuacaagacuacgacagaa

SEQ ID NO: 511846 - RNA, 14 nt, Chlamydophila pneumoniae CWL029
agaucuacaucaaa

SEQ ID NO: 511847 - RNA, 15 nt, Chlamydophila pneumoniae CWL029
agaucuacaucaaau

SEQ ID NO: 511848 - RNA, 20 nt, Chlamydophila pneumoniae CWL029
agauccucaaagaguuuuuu

SEQ ID NO: 511849 - RNA, 17 nt, Chlamydophila pneumoniae CWL029
agauccugaaaguacag

SEQ ID NO: 511850 - RNA, 15 nt, Chlamydophila pneumoniae CWL029
agauccugaaaguac

SEQ ID NO: 511851 - RNA, 13 nt, Chlamydophila pneumoniae CWL029
agaucccagaaga

SEQ ID NO: 511852 - RNA, 13 nt, Chlamydophila pneumoniae CWL029
agauccaugaaca

SEQ ID NO: 511853 - RNA, 15 nt, Chlamydophila pneumoniae CWL029
agaucauaaacagca

SEQ ID NO: 511854 - RNA, 14 nt, Chlamydophila pneumoniae CWL029
agauccaaagccug

SEQ ID NO: 511855 - RNA, 16 nt, Chlamydophila pneumoniae CWL029
agaucauuagcaucau

SEQ ID NO: 511856 - RNA, 19 nt, Chlamydophila pneumoniae CWL029
agaucauuagcaucaucuc

SEQ ID NO: 511857 - RNA, 19 nt, Chlamydophila pneumoniae CWL029
agauauucaagaggaccga

SEQ ID NO: 511858 - RNA, 14 nt, Chlamydophila pneumoniae CWL029
agaucaaaacuccg

SEQ ID NO: 511859 - RNA, 23 nt, Chlamydophila pneumoniae CWL029
agaucaaguccucgccgcugccc

SEQ ID NO: 511860 - RNA, 15 nt, Chlamydophila pneumoniae CWL029
agaucaauauagaga

SEQ ID NO: 511861 - RNA, 14 nt, Chlamydophila pneumoniae CWL029
agaucacaucaaga

SEQ ID NO: 511862 - RNA, 17 nt, Chlamydophila pneumoniae CWL029
agaucacaucaagauag

SEQ ID NO: 511863 - RNA, 19 nt, Chlamydophila pneumoniae CWL029
agaucagaggaaucuaaga

SEQ ID NO: 511864 - RNA, 12 nt, Chlamydophila pneumoniae CWL029
agaucagcuccc

SEQ ID NO: 511865 - RNA, 14 nt, Chlamydophila pneumoniae CWL029
agaucauaaacagc

SEQ ID NO: 511866 - RNA, 12 nt, Chlamydophila pneumoniae CWL029
agauauagagag

SEQ ID NO: 511867 - RNA, 19 nt, Chlamydophila pneumoniae CWL029
agauaguucacaagugcau

SEQ ID NO: 511868 - RNA, 19 nt, Chlamydophila pneumoniae CWL029
agauaugccucaggucugc

SEQ ID NO: 511869 - RNA, 23 nt, Chlamydophila pneumoniae CWL029
agauaugccucaggucugcugag

SEQ ID NO: 511870 - RNA, 13 nt, Chlamydophila pneumoniae CWL029
agauaugaagaga

SEQ ID NO: 511871 - RNA, 15 nt, Chlamydophila pneumoniae CWL029
agauaugaagagacg

SEQ ID NO: 511872 - RNA, 16 nt, Chlamydophila pneumoniae CWL029
agauauauuuuuaaag

SEQ ID NO: 511873 - RNA, 18 nt, Chlamydophila pneumoniae CWL029
agauacuucuccacagcu

SEQ ID NO: 511874 - RNA, 15 nt, Chlamydophila pneumoniae CWL029
agauacguuuccccc

SEQ ID NO: 511875 - RNA, 21 nt, Chlamydophila pneumoniae CWL029
agauacuaucugccauaggau

SEQ ID NO: 511876 - RNA, 22 nt, Chlamydophila pneumoniae CWL029
agauacuaucugccauaggauc

SEQ ID NO: 511877 - RNA, 19 nt, Chlamydophila pneumoniae CWL029
agauacgcuuacaaauaac

SEQ ID NO: 511878 - RNA, 17 nt, Chlamydophila pneumoniae CWL029
agauacggguucguuuc

SEQ ID NO: 511879 - RNA, 20 nt, Chlamydophila pneumoniae CWL029
agauagcuuacagagaaauu

SEQ ID NO: 511880 - RNA, 14 nt, Chlamydophila pneumoniae CWL029
agauagcucuugcg

SEQ ID NO: 511881 - RNA, 14 nt, Chlamydophila pneumoniae CWL029
agauagcaaaucaa

SEQ ID NO: 511882 - RNA, 16 nt, Chlamydophila pneumoniae CWL029
agauagcaaaucaaua

SEQ ID NO: 511883 - RNA, 21 nt, Chlamydophila pneumoniae CWL029
agaguuucuuuugauugaaac

SEQ ID NO: 511884 - RNA, 19 nt, Chlamydophila pneumoniae CWL029
agaguuuuacaucaaugau

SEQ ID NO: 511885 - RNA, 20 nt, Chlamydophila pneumoniae CWL029
agaguuucgaauucaaugag

SEQ ID NO: 511886 - RNA, 23 nt, Chlamydophila pneumoniae CWL029
agaguugcuuuauggcucaacuu

SEQ ID NO: 511887 - RNA, 14 nt, Chlamydophila pneumoniae CWL029
agaguugauaaaua

SEQ ID NO: 511888 - RNA, 14 nt, Chlamydophila pneumoniae CWL029
agagcuucuaaaaa

SEQ ID NO: 511889 - RNA, 22 nt, Chlamydophila pneumoniae CWL029
agagcuggggauggucuucccc

SEQ ID NO: 511890 - RNA, 18 nt, Chlamydophila pneumoniae CWL029
agagcugauccagcucca

SEQ ID NO: 511891 - RNA, 19 nt, Chlamydophila pneumoniae CWL029
agagcuuuuagguagagaa

SEQ ID NO: 511892 - RNA, 20 nt, Chlamydophila pneumoniae CWL029
agaggggaaccaaggacgua

SEQ ID NO: 511893 - RNA, 14 nt, Chlamydophila pneumoniae CWL029
agagcuuucagaaa

SEQ ID NO: 511894 - RNA, 20 nt, Chlamydophila pneumoniae CWL029
agagcaagauucuucagaau

SEQ ID NO: 511895 - RNA, 16 nt, Chlamydophila pneumoniae CWL029
agagcgcguuucaaau

SEQ ID NO: 511896 - RNA, 23 nt, Chlamydophila pneumoniae CWL029
agagcgcguuucaaauaggaucu

SEQ ID NO: 511897 - RNA, 18 nt, Chlamydophila pneumoniae CWL029
agagccuuuucagauuuu

SEQ ID NO: 511898 - RNA, 23 nt, Chlamydophila pneumoniae CWL029
agagucuucguuucuuugaguua

SEQ ID NO: 511899 - RNA, 18 nt, Chlamydophila pneumoniae CWL029
agagucuuugaugcuaaa

SEQ ID NO: 511900 - RNA, 17 nt, Chlamydophila pneumoniae CWL029
agagucugcagcagaug

SEQ ID NO: 511901 - RNA, 14 nt, Chlamydophila pneumoniae CWL029
agagucugcagcag

SEQ ID NO: 511902 - RNA, 23 nt, Chlamydophila pneumoniae CWL029
agagucucacucuuuucuagaaa

SEQ ID NO: 511903 - RNA, 14 nt, Chlamydophila pneumoniae CWL029
agagucacuagcag

SEQ ID NO: 511904 - RNA, 17 nt, Chlamydophila pneumoniae CWL029
agaggucuuugaguagc

SEQ ID NO: 511905 - RNA, 16 nt, Chlamydophila pneumoniae CWL029
agagguaaccagagag

SEQ ID NO: 511906 - RNA, 20 nt, Chlamydophila pneumoniae CWL029
agaggguuuuuuugcugcga

SEQ ID NO: 511907 - RNA, 22 nt, Chlamydophila pneumoniae CWL029
agagagcuugucacacugcgag

SEQ ID NO: 511908 - RNA, 15 nt, Chlamydophila pneumoniae CWL029
agagaggguaagcug

SEQ ID NO: 511909 - RNA, 17 nt, Chlamydophila pneumoniae CWL029
agagagucggcuuuaga

SEQ ID NO: 511910 - RNA, 22 nt, Chlamydophila pneumoniae CWL029
agagagucggcuuuagaaaagu

SEQ ID NO: 511911 - RNA, 23 nt, Chlamydophila pneumoniae CWL029
agagagucuucguuucuuugagu

SEQ ID NO: 511912 - RNA, 17 nt, Chlamydophila pneumoniae CWL029
agagaguucucucuuca

SEQ ID NO: 511913 - RNA, 23 nt, Chlamydophila pneumoniae CWL029
agagaguucuuguaauaaaagaa

SEQ ID NO: 511914 - RNA, 15 nt, Chlamydophila pneumoniae CWL029
agagagccuuuccua

SEQ ID NO: 511915 - RNA, 18 nt, Chlamydophila pneumoniae CWL029
agagagaucacuguauuu

SEQ ID NO: 511916 - RNA, 16 nt, Chlamydophila pneumoniae CWL029
agagacuguagccuuu

SEQ ID NO: 511917 - RNA, 16 nt, Chlamydophila pneumoniae CWL029
agacuauagaaaagga

SEQ ID NO: 511918 - RNA, 17 nt, Chlamydophila pneumoniae CWL029
agacuagcuuuuuuuau

SEQ ID NO: 511919 - RNA, 15 nt, Chlamydophila pneumoniae CWL029
agacuaaaaaagaga

SEQ ID NO: 511920 - RNA, 20 nt, Chlamydophila pneumoniae CWL029
agacuaaaugacgaguugaa

SEQ ID NO: 511921 - RNA, 17 nt, Chlamydophila pneumoniae CWL029
agagauccaaugacaau

SEQ ID NO: 511922 - RNA, 12 nt, Chlamydophila pneumoniae CWL029
agagauuuuucu

SEQ ID NO: 511923 - RNA, 14 nt, Chlamydophila pneumoniae CWL029
agagauuuuucuag

SEQ ID NO: 511924 - RNA, 19 nt, Chlamydophila pneumoniae CWL029
agagauuuuucuaggaauc

SEQ ID NO: 511925 - RNA, 14 nt, Chlamydophila pneumoniae CWL029
agagauucuacaaa

SEQ ID NO: 511926 - RNA, 19 nt, Chlamydophila pneumoniae CWL029
agagauuaccgaagagccc

SEQ ID NO: 511927 - RNA, 18 nt, Chlamydophila pneumoniae CWL029
agagauuguaauuuccuu

SEQ ID NO: 511928 - RNA, 21 nt, Chlamydophila pneumoniae CWL029
agagauuuuccauaggaacaa

SEQ ID NO: 511929 - RNA, 22 nt, Chlamydophila pneumoniae CWL029
agagauuuuccauaggaacaaa

SEQ ID NO: 511930 - RNA, 23 nt, Chlamydophila pneumoniae CWL029
acuucaggaaauaauuuguuuag

SEQ ID NO: 511931 - RNA, 15 nt, Chlamydophila pneumoniae CWL029
acuucagcuuugcuu

SEQ ID NO: 511932 - RNA, 16 nt, Chlamydophila pneumoniae CWL029
acuucaccuugaaguu

SEQ ID NO: 511933 - RNA, 16 nt, Chlamydophila pneumoniae CWL029
acuucacguugcaaug

SEQ ID NO: 511934 - RNA, 17 nt, Chlamydophila pneumoniae CWL029
acuuccccaaacaugga

SEQ ID NO: 511935 - RNA, 19 nt, Chlamydophila pneumoniae CWL029
acuucccgaacagcggcaa

SEQ ID NO: 511936 - RNA, 15 nt, Chlamydophila pneumoniae CWL029
acuucccucaugaag

SEQ ID NO: 511937 - RNA, 18 nt, Chlamydophila pneumoniae CWL029
acuuccucuucaauuucu

SEQ ID NO: 511938 - RNA, 22 nt, Chlamydophila pneumoniae CWL029
acuuccuacgacaugccuaaau

SEQ ID NO: 511939 - RNA, 20 nt, Chlamydophila pneumoniae CWL029
acuuccuacggcaagaaucg

SEQ ID NO: 511940 - RNA, 16 nt, Chlamydophila pneumoniae CWL029
acuuaucuuuaaauuc

SEQ ID NO: 511941 - RNA, 16 nt, Chlamydophila pneumoniae CWL029
acuucaaugaagaaaa

SEQ ID NO: 511942 - RNA, 13 nt, Chlamydophila pneumoniae CWL029
acuucacaaagaa

SEQ ID NO: 511943 - RNA, 14 nt, Chlamydophila pneumoniae CWL029
acuucacaaagaac

SEQ ID NO: 511944 - RNA, 16 nt, Chlamydophila pneumoniae CWL029
acuucacaaagaacca

SEQ ID NO: 511945 - RNA, 14 nt, Chlamydophila pneumoniae CWL029
acuuaguuuugaaa

SEQ ID NO: 511946 - RNA, 15 nt, Chlamydophila pneumoniae CWL029
acuuaguuuugaaaa

SEQ ID NO: 511947 - RNA, 15 nt, Chlamydophila pneumoniae CWL029
acuuauauuggcuuu

SEQ ID NO: 511948 - RNA, 18 nt, Chlamydophila pneumoniae CWL029
acuuaucgaaugcugcac

SEQ ID NO: 511949 - RNA, 18 nt, Chlamydophila pneumoniae CWL029
acuguucgauaagaacuu

SEQ ID NO: 511950 - RNA, 15 nt, Chlamydophila pneumoniae CWL029
acuguucauaaucca

SEQ ID NO: 511951 - RNA, 15 nt, Chlamydophila pneumoniae CWL029
acuguguaugaauca

SEQ ID NO: 511952 - RNA, 17 nt, Chlamydophila pneumoniae CWL029
acuguguucaauagcaa

SEQ ID NO: 511953 - RNA, 21 nt, Chlamydophila pneumoniae CWL029
acuuaagauacuucuccacag

SEQ ID NO: 511954 - RNA, 18 nt, Chlamydophila pneumoniae CWL029
acuuaauccuguagggaa

SEQ ID NO: 511955 - RNA, 13 nt, Chlamydophila pneumoniae CWL029
acuuagcaaugaa

SEQ ID NO: 511956 - RNA, 15 nt, Chlamydophila pneumoniae CWL029
acuuaggaauuuuuc

SEQ ID NO: 511957 - RNA, 17 nt, Chlamydophila pneumoniae CWL029
acuuagguaauguaguc

SEQ ID NO: 511958 - RNA, 22 nt, Chlamydophila pneumoniae CWL029
acuuaggguucucaaagaucau

SEQ ID NO: 511959 - RNA, 19 nt, Chlamydophila pneumoniae CWL029
acuguugauccuucuuaug

SEQ ID NO: 511960 - RNA, 15 nt, Chlamydophila pneumoniae CWL029
acuguuuuucuucca

SEQ ID NO: 511961 - RNA, 19 nt, Chlamydophila pneumoniae CWL029
acuuaaagcuugagaaaag

SEQ ID NO: 511962 - RNA, 17 nt, Chlamydophila pneumoniae CWL029
acuuaaagguaaaacua

SEQ ID NO: 511963 - RNA, 17 nt, Chlamydophila pneumoniae CWL029
acuggcgacuugccaau

SEQ ID NO: 511964 - RNA, 14 nt, Chlamydophila pneumoniae CWL029
acuggacuucguuu

SEQ ID NO: 511965 - RNA, 15 nt, Chlamydophila pneumoniae CWL029
acuggagagguaacc

SEQ ID NO: 511966 - RNA, 21 nt, Chlamydophila pneumoniae CWL029
acuggaggcuguguaaaaguu

SEQ ID NO: 511967 - RNA, 13 nt, Chlamydophila pneumoniae CWL029
acuggaaugacau

SEQ ID NO: 511968 - RNA, 19 nt, Chlamydophila pneumoniae CWL029
acugcuuggucacaccaaa

SEQ ID NO: 511969 - RNA, 17 nt, Chlamydophila pneumoniae CWL029
acugcuuuaggcccaag

SEQ ID NO: 511970 - RNA, 17 nt, Chlamydophila pneumoniae CWL029
acugcugacaucuccaa

SEQ ID NO: 511971 - RNA, 21 nt, Chlamydophila pneumoniae CWL029
acugcuacuuuaaaguggcaa

SEQ ID NO: 511972 - RNA, 15 nt, Chlamydophila pneumoniae CWL029
acugcgagagaaagu

SEQ ID NO: 511973 - RNA, 15 nt, Chlamydophila pneumoniae CWL029
acugcagagaaauuc

SEQ ID NO: 511974 - RNA, 23 nt, Chlamydophila pneumoniae CWL029
acugacuucuaugauaucaccag

SEQ ID NO: 511975 - RNA, 15 nt, Chlamydophila pneumoniae CWL029
acucuuuucuagaaa

SEQ ID NO: 511976 - RNA, 12 nt, Chlamydophila pneumoniae CWL029
acugaaagaugu

SEQ ID NO: 511977 - RNA, 17 nt, Chlamydophila pneumoniae CWL029
acugaucugaaauagca

SEQ ID NO: 511978 - RNA, 13 nt, Chlamydophila pneumoniae CWL029
acugaugaaaaag

SEQ ID NO: 511979 - RNA, 16 nt, Chlamydophila pneumoniae CWL029
acugaugccaagaaau

SEQ ID NO: 511980 - RNA, 16 nt, Chlamydophila pneumoniae CWL029
acucgauuauuucuug

SEQ ID NO: 511981 - RNA, 15 nt, Chlamydophila pneumoniae CWL029
acucuacaucuucuu

SEQ ID NO: 511982 - RNA, 18 nt, Chlamydophila pneumoniae CWL029
acucuaaucugauucaau

SEQ ID NO: 511983 - RNA, 12 nt, Chlamydophila pneumoniae CWL029
acucuacaagug

SEQ ID NO: 511984 - RNA, 17 nt, Chlamydophila pneumoniae CWL029
acucuaucgaagagccc

SEQ ID NO: 511985 - RNA, 22 nt, Chlamydophila pneumoniae CWL029
acucuagaaaauauuccuggaa

SEQ ID NO: 511986 - RNA, 16 nt, Chlamydophila pneumoniae CWL029
acucuagggucaagaa

SEQ ID NO: 511987 - RNA, 16 nt, Chlamydophila pneumoniae CWL029
acucucuuccaaaagu

SEQ ID NO: 511988 - RNA, 20 nt, Chlamydophila pneumoniae CWL029
acucucuuccuucuccugua

SEQ ID NO: 511989 - RNA, 21 nt, Chlamydophila pneumoniae CWL029
acucucugcagggaauccugu

SEQ ID NO: 511990 - RNA, 14 nt, Chlamydophila pneumoniae CWL029
acucucuuccuucu

SEQ ID NO: 511991 - RNA, 15 nt, Chlamydophila pneumoniae CWL029
acucucuuccuucuc

SEQ ID NO: 511992 - RNA, 18 nt, Chlamydophila pneumoniae CWL029
acucugaaguacacuaca

SEQ ID NO: 511993 - RNA, 22 nt, Chlamydophila pneumoniae CWL029
acucugcccgucuuagaaucca

SEQ ID NO: 511994 - RNA, 15 nt, Chlamydophila pneumoniae CWL029
acucuuuuaagacaa

SEQ ID NO: 511995 - RNA, 16 nt, Chlamydophila pneumoniae CWL029
acucuuuuaagacaau

SEQ ID NO: 511996 - RNA, 19 nt, Chlamydophila pneumoniae CWL029
acucuuuuaagacaauaua

SEQ ID NO: 511997 - RNA, 16 nt, Chlamydophila pneumoniae CWL029
acucuuuucuagaaac

SEQ ID NO: 511998 - RNA, 23 nt, Chlamydophila pneumoniae CWL029
acucuuuucuagaaacugcuccu

SEQ ID NO: 511999 - RNA, 17 nt, Chlamydophila pneumoniae CWL029
acucugggaauuguucu

SEQ ID NO: 512000 - RNA, 17 nt, Chlamydophila pneumoniae CWL029
acucaaucucuuugaca

SEQ ID NO: 512001 - RNA, 16 nt, Chlamydophila pneumoniae CWL029
acucaaggaguuuuaa

SEQ ID NO: 512002 - RNA, 13 nt, Chlamydophila pneumoniae CWL029
acucaacuuuuuu

SEQ ID NO: 512003 - RNA, 22 nt, Chlamydophila pneumoniae CWL029
acuccuaagucguuaacaucaa

SEQ ID NO: 512004 - RNA, 21 nt, Chlamydophila pneumoniae CWL029
acucaauuaugcccaaggaaa

SEQ ID NO: 512005 - RNA, 22 nt, Chlamydophila pneumoniae CWL029
acucaauuaugcccaaggaaaa

SEQ ID NO: 512006 - RNA, 13 nt, Chlamydophila pneumoniae CWL029
acuccucagaauc

SEQ ID NO: 512007 - RNA, 14 nt, Chlamydophila pneumoniae CWL029
acuccugacucuua

SEQ ID NO: 512008 - RNA, 13 nt, Chlamydophila pneumoniae CWL029
acuccuuuuaaaa

SEQ ID NO: 512009 - RNA, 18 nt, Chlamydophila pneumoniae CWL029
acucgaauuguguguuuu

SEQ ID NO: 512010 - RNA, 13 nt, Chlamydophila pneumoniae CWL029
acuacauucagga

SEQ ID NO: 512011 - RNA, 17 nt, Chlamydophila pneumoniae CWL029
acuacaggaauucucau

SEQ ID NO: 512012 - RNA, 15 nt, Chlamydophila pneumoniae CWL029
acuacauaauaagca

SEQ ID NO: 512013 - RNA, 17 nt, Chlamydophila pneumoniae CWL029
acuacauucgcaagaau

SEQ ID NO: 512014 - RNA, 19 nt, Chlamydophila pneumoniae CWL029
acuacagcugcuagagcag

SEQ ID NO: 512015 - RNA, 16 nt, Chlamydophila pneumoniae CWL029
acuaaacgaucaaauu

SEQ ID NO: 512016 - RNA, 23 nt, Chlamydophila pneumoniae CWL029
acuaaacuccauuguuguugcau

SEQ ID NO: 512017 - RNA, 12 nt, Chlamydophila pneumoniae CWL029
acuaaaggugaa

SEQ ID NO: 512018 - RNA, 23 nt, Chlamydophila pneumoniae CWL029
acuaaaucaacuacaucuccaag

SEQ ID NO: 512019 - RNA, 15 nt, Chlamydophila pneumoniae CWL029
acuaguucuucuuua

SEQ ID NO: 512020 - RNA, 14 nt, Chlamydophila pneumoniae CWL029
acuacuuaaagcuu

SEQ ID NO: 512021 - RNA, 21 nt, Chlamydophila pneumoniae CWL029
acuacuguagaguuuucuuuc

SEQ ID NO: 512022 - RNA, 21 nt, Chlamydophila pneumoniae CWL029
acuacuuaaagcuugagaaaa

SEQ ID NO: 512023 - RNA, 15 nt, Chlamydophila pneumoniae CWL029
acuacuuaaauccua

SEQ ID NO: 512024 - RNA, 17 nt, Chlamydophila pneumoniae CWL029
acuacuuacaagaacaa

SEQ ID NO: 512025 - RNA, 23 nt, Chlamydophila pneumoniae CWL029
acuauccgcacucauaggguagu

SEQ ID NO: 512026 - RNA, 15 nt, Chlamydophila pneumoniae CWL029
acuaugguaagcauu

SEQ ID NO: 512027 - RNA, 15 nt, Chlamydophila pneumoniae CWL029
acuauguguuuccuu

SEQ ID NO: 512028 - RNA, 20 nt, Chlamydophila pneumoniae CWL029
acuauuaauacuuugccaac

SEQ ID NO: 512029 - RNA, 15 nt, Chlamydophila pneumoniae CWL029
acuauuaauacuuug

SEQ ID NO: 512030 - RNA, 18 nt, Chlamydophila pneumoniae CWL029
acuaucauggacaagcaa

SEQ ID NO: 512031 - RNA, 23 nt, Chlamydophila pneumoniae CWL029
acuaucauggacaagcaaaagca

SEQ ID NO: 512032 - RNA, 20 nt, Chlamydophila pneumoniae CWL029
acuauaaaagccagggcagc

SEQ ID NO: 512033 - RNA, 15 nt, Chlamydophila pneumoniae CWL029
acucaaauucaaaau

SEQ ID NO: 512034 - RNA, 21 nt, Chlamydophila pneumoniae CWL029
acucaaaucuuucaaggaaca

SEQ ID NO: 512035 - RNA, 12 nt, Chlamydophila pneumoniae CWL029
acucaaacccuc

SEQ ID NO: 512036 - RNA, 21 nt, Chlamydophila pneumoniae CWL029
acuauugggagguucgcagaa

SEQ ID NO: 512037 - RNA, 15 nt, Chlamydophila pneumoniae CWL029
acuauuuucauucca

SEQ ID NO: 512038 - RNA, 21 nt, Chlamydophila pneumoniae CWL029
acuaaaagaauaauagcaagc

SEQ ID NO: 512039 - RNA, 14 nt, Chlamydophila pneumoniae CWL029
acuaaaaucucauu

SEQ ID NO: 512040 - RNA, 17 nt, Chlamydophila pneumoniae CWL029
acuaaaccuucaaugau

SEQ ID NO: 512041 - RNA, 15 nt, Chlamydophila pneumoniae CWL029
acguuugaucuucuc

SEQ ID NO: 512042 - RNA, 15 nt, Chlamydophila pneumoniae CWL029
acguuggacugcaag

SEQ ID NO: 512043 - RNA, 20 nt, Chlamydophila pneumoniae CWL029
acguuaucuaagacuucugg

SEQ ID NO: 512044 - RNA, 17 nt, Chlamydophila pneumoniae CWL029
acguuugacaaauuuau

SEQ ID NO: 512045 - RNA, 20 nt, Chlamydophila pneumoniae CWL029
acguuuaauuccuuggauuc

SEQ ID NO: 512046 - RNA, 15 nt, Chlamydophila pneumoniae CWL029
acguuguugcaauuc

SEQ ID NO: 512047 - RNA, 19 nt, Chlamydophila pneumoniae CWL029
acguccucaccuugugaga

SEQ ID NO: 512048 - RNA, 17 nt, Chlamydophila pneumoniae CWL029
acguccugaugccuuuu

SEQ ID NO: 512049 - RNA, 19 nt, Chlamydophila pneumoniae CWL029
acguacgcaaguaaagaaa

SEQ ID NO: 512050 - RNA, 21 nt, Chlamydophila pneumoniae CWL029
acguccauuucauguaagaau

SEQ ID NO: 512051 - RNA, 16 nt, Chlamydophila pneumoniae CWL029
acgucuaaagacgaag

SEQ ID NO: 512052 - RNA, 16 nt, Chlamydophila pneumoniae CWL029
acgugcucucuacuuc

SEQ ID NO: 512053 - RNA, 21 nt, Chlamydophila pneumoniae CWL029
acgguuucugggaugcacacg

SEQ ID NO: 512054 - RNA, 14 nt, Chlamydophila pneumoniae CWL029
acguaacguaguca

SEQ ID NO: 512055 - RNA, 12 nt, Chlamydophila pneumoniae CWL029
acguaagguguc

SEQ ID NO: 512056 - RNA, 21 nt, Chlamydophila pneumoniae CWL029
acggugcuguuguaauaaaag

SEQ ID NO: 512057 - RNA, 23 nt, Chlamydophila pneumoniae CWL029
acgguaaggaggaaucuugauga

SEQ ID NO: 512058 - RNA, 19 nt, Chlamydophila pneumoniae CWL029
acgguagucaaaggaucca

SEQ ID NO: 512059 - RNA, 22 nt, Chlamydophila pneumoniae CWL029
acgguaagaucucguagcucag

SEQ ID NO: 512060 - RNA, 13 nt, Chlamydophila pneumoniae CWL029
acggaaaaucaca

SEQ ID NO: 512061 - RNA, 17 nt, Chlamydophila pneumoniae CWL029
acgcuuuuucuugaaaa

SEQ ID NO: 512062 - RNA, 18 nt, Chlamydophila pneumoniae CWL029
acgcuuuuucuugaaaaa

SEQ ID NO: 512063 - RNA, 15 nt, Chlamydophila pneumoniae CWL029
acggaaagcacauac

SEQ ID NO: 512064 - RNA, 20 nt, Chlamydophila pneumoniae CWL029
acggauauucuuuagggcua

SEQ ID NO: 512065 - RNA, 15 nt, Chlamydophila pneumoniae CWL029
acgcaaguaaagaaa

SEQ ID NO: 512066 - RNA, 17 nt, Chlamydophila pneumoniae CWL029
acgcaaugauuucucua

SEQ ID NO: 512067 - RNA, 16 nt, Chlamydophila pneumoniae CWL029
acgcaaguaaagaaau

SEQ ID NO: 512068 - RNA, 20 nt, Chlamydophila pneumoniae CWL029
aggaauuagagaaauuuuua

SEQ ID NO: 512069 - RNA, 16 nt, Chlamydophila pneumoniae CWL029
aggaauuccucucaca

SEQ ID NO: 512070 - RNA, 17 nt, Chlamydophila pneumoniae CWL029
aggaauucuuuaugaga

SEQ ID NO: 512071 - RNA, 20 nt, Chlamydophila pneumoniae CWL029
aggaauucuuuaugagagag

SEQ ID NO: 512072 - RNA, 15 nt, Chlamydophila pneumoniae CWL029
aggaauuuucagccu

SEQ ID NO: 512073 - RNA, 14 nt, Chlamydophila pneumoniae CWL029
aggaauuuuucuag

SEQ ID NO: 512074 - RNA, 20 nt, Chlamydophila pneumoniae CWL029
aggaaucuugaugaccucua

SEQ ID NO: 512075 - RNA, 23 nt, Chlamydophila pneumoniae CWL029
aggaaucuugaugaccucuauac

SEQ ID NO: 512076 - RNA, 14 nt, Chlamydophila pneumoniae CWL029
aggaaugagcggca

SEQ ID NO: 512077 - RNA, 14 nt, Chlamydophila pneumoniae CWL029
aggaaucauaacca

SEQ ID NO: 512078 - RNA, 11 nt, Chlamydophila pneumoniae CWL029
aggaaucacug

SEQ ID NO: 512079 - RNA, 19 nt, Chlamydophila pneumoniae CWL029
aggaaguaguggacuauag

SEQ ID NO: 512080 - RNA, 19 nt, Chlamydophila pneumoniae CWL029
aggaagguucucaaagcua

SEQ ID NO: 512081 - RNA, 21 nt, Chlamydophila pneumoniae CWL029
aggaaguccgauagcaaugau

SEQ ID NO: 512082 - RNA, 19 nt, Chlamydophila pneumoniae CWL029
aggaauaacaccaaaagaa

SEQ ID NO: 512083 - RNA, 17 nt, Chlamydophila pneumoniae CWL029
aggaauaaucaaccaaa

SEQ ID NO: 512084 - RNA, 19 nt, Chlamydophila pneumoniae CWL029
aggaagauauccuuuugaa

SEQ ID NO: 512085 - RNA, 14 nt, Chlamydophila pneumoniae CWL029
aggaagcucuucua

SEQ ID NO: 512086 - RNA, 16 nt, Chlamydophila pneumoniae CWL029
aggaagcucuucuacu

SEQ ID NO: 512087 - RNA, 16 nt, Chlamydophila pneumoniae CWL029
aggaaggaaaucacag

SEQ ID NO: 512088 - RNA, 15 nt, Chlamydophila pneumoniae CWL029
aggaaggaauagaga

SEQ ID NO: 512089 - RNA, 14 nt, Chlamydophila pneumoniae CWL029
aggaaggaauagag

SEQ ID NO: 512090 - RNA, 19 nt, Chlamydophila pneumoniae CWL029
aggaacucuuuaaaagggc

SEQ ID NO: 512091 - RNA, 15 nt, Chlamydophila pneumoniae CWL029
aggaacuugaauacc

SEQ ID NO: 512092 - RNA, 22 nt, Chlamydophila pneumoniae CWL029
aggaacagcauuagggaaaggu

SEQ ID NO: 512093 - RNA, 14 nt, Chlamydophila pneumoniae CWL029
aggaacaauguaaa

SEQ ID NO: 512094 - RNA, 18 nt, Chlamydophila pneumoniae CWL029
aggaaaucgcauuacaaa

SEQ ID NO: 512095 - RNA, 21 nt, Chlamydophila pneumoniae CWL029
aggaaaucccgagauaugaag

SEQ ID NO: 512096 - RNA, 22 nt, Chlamydophila pneumoniae CWL029
aggaaaucccgagauaugaaga

SEQ ID NO: 512097 - RNA, 11 nt, Chlamydophila pneumoniae CWL029
aggaaauuccg

SEQ ID NO: 512098 - RNA, 19 nt, Chlamydophila pneumoniae CWL029
aggaaaucacagagucugg

SEQ ID NO: 512099 - RNA, 18 nt, Chlamydophila pneumoniae CWL029
aggaaacuagauuucuac

SEQ ID NO: 512100 - RNA, 16 nt, Chlamydophila pneumoniae CWL029
aggaaaauucuuaaaa

SEQ ID NO: 512101 - RNA, 15 nt, Chlamydophila pneumoniae CWL029
aggaaacagugguau

SEQ ID NO: 512102 - RNA, 21 nt, Chlamydophila pneumoniae CWL029
aggaaacagugguaugcuuuu

SEQ ID NO: 512103 - RNA, 21 nt, Chlamydophila pneumoniae CWL029
aggaaacgauuucuucuucua

SEQ ID NO: 512104 - RNA, 19 nt, Chlamydophila pneumoniae CWL029
aggaaaaaaaaucugcuau

SEQ ID NO: 512105 - RNA, 14 nt, Chlamydophila pneumoniae CWL029
agcuuuuuucucuu

SEQ ID NO: 512106 - RNA, 14 nt, Chlamydophila pneumoniae CWL029
aggaaaagcaaaau

SEQ ID NO: 512107 - RNA, 12 nt, Chlamydophila pneumoniae CWL029
agcuuuuugcuu

SEQ ID NO: 512108 - RNA, 18 nt, Chlamydophila pneumoniae CWL029
agcuuuuugcuuuucccu

SEQ ID NO: 512109 - RNA, 12 nt, Chlamydophila pneumoniae CWL029
agcuuuuuucuc

SEQ ID NO: 512110 - RNA, 22 nt, Chlamydophila pneumoniae CWL029
aggauagguccguuuuuucaga

SEQ ID NO: 512111 - RNA, 19 nt, Chlamydophila pneumoniae CWL029
aggauagugacuccugguu

SEQ ID NO: 512112 - RNA, 16 nt, Chlamydophila pneumoniae CWL029
aggauauauagagcag

SEQ ID NO: 512113 - RNA, 18 nt, Chlamydophila pneumoniae CWL029
aggauaaguucuuccaaa

SEQ ID NO: 512114 - RNA, 20 nt, Chlamydophila pneumoniae CWL029
aggauagaccccccauucca

SEQ ID NO: 512115 - RNA, 21 nt, Chlamydophila pneumoniae CWL029
aggauagaccccccauuccaa

SEQ ID NO: 512116 - RNA, 22 nt, Chlamydophila pneumoniae CWL029
aggauagaccccccauuccaaa

SEQ ID NO: 512117 - RNA, 22 nt, Chlamydophila pneumoniae CWL029
aggaucauaccgacaagcauca

SEQ ID NO: 512118 - RNA, 13 nt, Chlamydophila pneumoniae CWL029
aggaguuuuccaa

SEQ ID NO: 512119 - RNA, 20 nt, Chlamydophila pneumoniae CWL029
aggaguuuucaagucuguaa

SEQ ID NO: 512120 - RNA, 23 nt, Chlamydophila pneumoniae CWL029
aggaguccccuggcguucaggau

SEQ ID NO: 512121 - RNA, 20 nt, Chlamydophila pneumoniae CWL029
aggagucgugcaggagaaca

SEQ ID NO: 512122 - RNA, 19 nt, Chlamydophila pneumoniae CWL029
aggagguccuuggcauuca

SEQ ID NO: 512123 - RNA, 13 nt, Chlamydophila pneumoniae CWL029
aggagguggugga

SEQ ID NO: 512124 - RNA, 18 nt, Chlamydophila pneumoniae CWL029
aggaguauagcaugaucu

SEQ ID NO: 512125 - RNA, 15 nt, Chlamydophila pneumoniae CWL029
aggagcuuuuaccuu

SEQ ID NO: 512126 - RNA, 17 nt, Chlamydophila pneumoniae CWL029
aggagcucccuaagauu

SEQ ID NO: 512127 - RNA, 13 nt, Chlamydophila pneumoniae CWL029
aggagcuccuccu

SEQ ID NO: 512128 - RNA, 14 nt, Chlamydophila pneumoniae CWL029
aggacucuuucuau

SEQ ID NO: 512129 - RNA, 22 nt, Chlamydophila pneumoniae CWL029
aggacuguuuguuuauuaucua

SEQ ID NO: 512130 - RNA, 22 nt, Chlamydophila pneumoniae CWL029
aggacucccucaaaauuuaaau

SEQ ID NO: 512131 - RNA, 19 nt, Chlamydophila pneumoniae CWL029
aggagaauacaaacaagaa

SEQ ID NO: 512132 - RNA, 17 nt, Chlamydophila pneumoniae CWL029
aggacuucgcaaauuuu

SEQ ID NO: 512133 - RNA, 16 nt, Chlamydophila pneumoniae CWL029
aggagagaauccuuuu

SEQ ID NO: 512134 - RNA, 16 nt, Chlamydophila pneumoniae CWL029
aggagacuaaaagaau

SEQ ID NO: 512135 - RNA, 20 nt, Chlamydophila pneumoniae CWL029
aggagagcacuuuuaauauu

SEQ ID NO: 512136 - RNA, 20 nt, Chlamydophila pneumoniae CWL029
aggagagcuucuucuguaaa

SEQ ID NO: 512137 - RNA, 15 nt, Chlamydophila pneumoniae CWL029
aggacagcacauaga

SEQ ID NO: 512138 - RNA, 17 nt, Chlamydophila pneumoniae CWL029
aggaccacaauuccuaa

SEQ ID NO: 512139 - RNA, 18 nt, Chlamydophila pneumoniae CWL029
aggaccuguuuucuuuuc

SEQ ID NO: 512140 - RNA, 15 nt, Chlamydophila pneumoniae CWL029
aggaccugugaguaa

SEQ ID NO: 512141 - RNA, 19 nt, Chlamydophila pneumoniae CWL029
aggacgcacauuuagaagu

SEQ ID NO: 512142 - RNA, 16 nt, Chlamydophila pneumoniae CWL029
aggacguaaaaagaaa

SEQ ID NO: 512143 - RNA, 22 nt, Chlamydophila pneumoniae CWL029
aggcccaccagggguuucuaaa

SEQ ID NO: 512144 - RNA, 12 nt, Chlamydophila pneumoniae CWL029
aggcauuaauaa

SEQ ID NO: 512145 - RNA, 16 nt, Chlamydophila pneumoniae CWL029
aggcauuaauaacuuu

SEQ ID NO: 512146 - RNA, 17 nt, Chlamydophila pneumoniae CWL029
aggcauuacacaacucu

SEQ ID NO: 512147 - RNA, 17 nt, Chlamydophila pneumoniae CWL029
aggcauggcacaguccu

SEQ ID NO: 512148 - RNA, 13 nt, Chlamydophila pneumoniae CWL029
aggccaaagaaca

SEQ ID NO: 512149 - RNA, 17 nt, Chlamydophila pneumoniae CWL029
aggccaaagaacagcac

SEQ ID NO: 512150 - RNA, 13 nt, Chlamydophila pneumoniae CWL029
aggcaucacuaau

SEQ ID NO: 512151 - RNA, 20 nt, Chlamydophila pneumoniae CWL029
aggcaucuagagucucuuuc

SEQ ID NO: 512152 - RNA, 23 nt, Chlamydophila pneumoniae CWL029
aggcacccaaacugaugccaaga

SEQ ID NO: 512153 - RNA, 16 nt, Chlamydophila pneumoniae CWL029
aggcacagcaaucaca

SEQ ID NO: 512154 - RNA, 21 nt, Chlamydophila pneumoniae CWL029
aggcagauagacaaccuagaa

SEQ ID NO: 512155 - RNA, 12 nt, Chlamydophila pneumoniae CWL029
aggcaaagauca

SEQ ID NO: 512156 - RNA, 13 nt, Chlamydophila pneumoniae CWL029
aggauuuuccauu

SEQ ID NO: 512157 - RNA, 17 nt, Chlamydophila pneumoniae CWL029
aggauguuguggaucag

SEQ ID NO: 512158 - RNA, 12 nt, Chlamydophila pneumoniae CWL029
aggauuccuuga

SEQ ID NO: 512159 - RNA, 17 nt, Chlamydophila pneumoniae CWL029
aggauucuuuugcaaug

SEQ ID NO: 512160 - RNA, 18 nt, Chlamydophila pneumoniae CWL029
aggauucuaaaaagaaaa

SEQ ID NO: 512161 - RNA, 18 nt, Chlamydophila pneumoniae CWL029
aggauucuauaacuacaa

SEQ ID NO: 512162 - RNA, 17 nt, Chlamydophila pneumoniae CWL029
aggauugcacucaucuu

SEQ ID NO: 512163 - RNA, 15 nt, Chlamydophila pneumoniae CWL029
aggauucuuuuugau

SEQ ID NO: 512164 - RNA, 17 nt, Chlamydophila pneumoniae CWL029
aggaugucgcuuuugcu

SEQ ID NO: 512165 - RNA, 16 nt, Chlamydophila pneumoniae CWL029
aggauggaaucaggga

SEQ ID NO: 512166 - RNA, 14 nt, Chlamydophila pneumoniae CWL029
aggaucuucuauuu

SEQ ID NO: 512167 - RNA, 20 nt, Chlamydophila pneumoniae CWL029
aggaucuuuggguucuucca

SEQ ID NO: 512168 - RNA, 13 nt, Chlamydophila pneumoniae CWL029
agcuugguuuucu

SEQ ID NO: 512169 - RNA, 19 nt, Chlamydophila pneumoniae CWL029
agcuugguuuucuccuucu

SEQ ID NO: 512170 - RNA, 13 nt, Chlamydophila pneumoniae CWL029
agcuugucacacu

SEQ ID NO: 512171 - RNA, 22 nt, Chlamydophila pneumoniae CWL029
agcuugccagcagaaguuccuu

SEQ ID NO: 512172 - RNA, 17 nt, Chlamydophila pneumoniae CWL029
agcuuucguuuucuagc

SEQ ID NO: 512173 - RNA, 23 nt, Chlamydophila pneumoniae CWL029
agcuuucguuuucuagcauagug

SEQ ID NO: 512174 - RNA, 18 nt, Chlamydophila pneumoniae CWL029
agcuuuauugauagcuga

SEQ ID NO: 512175 - RNA, 18 nt, Chlamydophila pneumoniae CWL029
agcuuuaacaugccaaaa

SEQ ID NO: 512176 - RNA, 20 nt, Chlamydophila pneumoniae CWL029
agcuuguuuuugcaaggcaa

SEQ ID NO: 512177 - RNA, 12 nt, Chlamydophila pneumoniae CWL029
agcuuuaaucag

SEQ ID NO: 512178 - RNA, 20 nt, Chlamydophila pneumoniae CWL029
agcuuuugcuacagcuucuu

SEQ ID NO: 512179 - RNA, 17 nt, Chlamydophila pneumoniae CWL029
agcuuuuaguuucccac

SEQ ID NO: 512180 - RNA, 21 nt, Chlamydophila pneumoniae CWL029
agcuuucuuggagaagaggua

SEQ ID NO: 512181 - RNA, 18 nt, Chlamydophila pneumoniae CWL029
agcuuuggcgucugcccu

SEQ ID NO: 512182 - RNA, 22 nt, Chlamydophila pneumoniae CWL029
agcuucuuguuuuuguggacaa

SEQ ID NO: 512183 - RNA, 13 nt, Chlamydophila pneumoniae CWL029
agcuucuugaugu

SEQ ID NO: 512184 - RNA, 18 nt, Chlamydophila pneumoniae CWL029
agcuucuucaacgaggaa

SEQ ID NO: 512185 - RNA, 17 nt, Chlamydophila pneumoniae CWL029
agcuucuuucuaggccg

SEQ ID NO: 512186 - RNA, 15 nt, Chlamydophila pneumoniae CWL029
agcuucuuucuuacu

SEQ ID NO: 512187 - RNA, 19 nt, Chlamydophila pneumoniae CWL029
agcuucuuucuuacuaaag

SEQ ID NO: 512188 - RNA, 13 nt, Chlamydophila pneumoniae CWL029
agcuucuaaaaac

SEQ ID NO: 512189 - RNA, 20 nt, Chlamydophila pneumoniae CWL029
agcuucggggaagcguagca

SEQ ID NO: 512190 - RNA, 15 nt, Chlamydophila pneumoniae CWL029
agcuuccugcuccuc

SEQ ID NO: 512191 - RNA, 23 nt, Chlamydophila pneumoniae CWL029
agcuuccugcuccucuucuuccc

SEQ ID NO: 512192 - RNA, 23 nt, Chlamydophila pneumoniae CWL029
agcuuccggcuuguaggaucuga

SEQ ID NO: 512193 - RNA, 23 nt, Chlamydophila pneumoniae CWL029
agcuuccucacguucugcaacaa

SEQ ID NO: 512194 - RNA, 21 nt, Chlamydophila pneumoniae CWL029
agcuuccgucugaauguaacu

SEQ ID NO: 512195 - RNA, 20 nt, Chlamydophila pneumoniae CWL029
agcuuccucacguucugcaa

SEQ ID NO: 512196 - RNA, 16 nt, Chlamydophila pneumoniae CWL029
agcuucccaauuguau

SEQ ID NO: 512197 - RNA, 18 nt, Chlamydophila pneumoniae CWL029
agcuuacuuucuuuuagc

SEQ ID NO: 512198 - RNA, 14 nt, Chlamydophila pneumoniae CWL029
agcuuacuuagaac

SEQ ID NO: 512199 - RNA, 22 nt, Chlamydophila pneumoniae CWL029
agcuucaaaggcaaccucugca

SEQ ID NO: 512200 - RNA, 20 nt, Chlamydophila pneumoniae CWL029
agcuguuuacuuuucucuuu

SEQ ID NO: 512201 - RNA, 21 nt, Chlamydophila pneumoniae CWL029
agcuguugcguuugagcuaag

SEQ ID NO: 512202 - RNA, 18 nt, Chlamydophila pneumoniae CWL029
agcuguggcgauuuuacu

SEQ ID NO: 512203 - RNA, 12 nt, Chlamydophila pneumoniae CWL029
agcugugguggu

SEQ ID NO: 512204 - RNA, 12 nt, Chlamydophila pneumoniae CWL029
agcugugcauuu

SEQ ID NO: 512205 - RNA, 20 nt, Chlamydophila pneumoniae CWL029
agcugucaauccaacaaaga

SEQ ID NO: 512206 - RNA, 15 nt, Chlamydophila pneumoniae CWL029
agcuguccagucuau

SEQ ID NO: 512207 - RNA, 20 nt, Chlamydophila pneumoniae CWL029
agcuguccagucuauagccu

SEQ ID NO: 512208 - RNA, 22 nt, Chlamydophila pneumoniae CWL029
agcuguaaccaacaucaaagaa

SEQ ID NO: 512209 - RNA, 16 nt, Chlamydophila pneumoniae CWL029
agcuguauugggaaug

SEQ ID NO: 512210 - RNA, 15 nt, Chlamydophila pneumoniae CWL029
agcuggaucuucuga

SEQ ID NO: 512211 - RNA, 15 nt, Chlamydophila pneumoniae CWL029
agcugcuucuucaga

SEQ ID NO: 512212 - RNA, 15 nt, Chlamydophila pneumoniae CWL029
agcugcuuuuucuac

SEQ ID NO: 512213 - RNA, 16 nt, Chlamydophila pneumoniae CWL029
agcugcuuuuucuacu

SEQ ID NO: 512214 - RNA, 23 nt, Chlamydophila pneumoniae CWL029
agcucuaauucuucuacagaaua

SEQ ID NO: 512215 - RNA, 23 nt, Chlamydophila pneumoniae CWL029
agcucuaaaaaagauaaagcuac

SEQ ID NO: 512216 - RNA, 19 nt, Chlamydophila pneumoniae CWL029
agcucuaaguccaacauca

SEQ ID NO: 512217 - RNA, 16 nt, Chlamydophila pneumoniae CWL029
agcucuauuucugccu

SEQ ID NO: 512218 - RNA, 18 nt, Chlamydophila pneumoniae CWL029
agcucuagggguuucccu

SEQ ID NO: 512219 - RNA, 20 nt, Chlamydophila pneumoniae CWL029
agcucuaggauaucauauuu

SEQ ID NO: 512220 - RNA, 15 nt, Chlamydophila pneumoniae CWL029
agcucucgacgaaca

SEQ ID NO: 512221 - RNA, 21 nt, Chlamydophila pneumoniae CWL029
agcucaggaaaacuuaauaag

SEQ ID NO: 512222 - RNA, 19 nt, Chlamydophila pneumoniae CWL029
agcucacgcaccauuccuu

SEQ ID NO: 512223 - RNA, 23 nt, Chlamydophila pneumoniae CWL029
agcucuggagauugcuaagcauu

SEQ ID NO: 512224 - RNA, 20 nt, Chlamydophila pneumoniae CWL029
agcucuuugggauaaaaagu

SEQ ID NO: 512225 - RNA, 16 nt, Chlamydophila pneumoniae CWL029
agcugaaaucauggaa

SEQ ID NO: 512226 - RNA, 14 nt, Chlamydophila pneumoniae CWL029
agcugaauccaggu

SEQ ID NO: 512227 - RNA, 19 nt, Chlamydophila pneumoniae CWL029
agcugacaacaaaugugac

SEQ ID NO: 512228 - RNA, 22 nt, Chlamydophila pneumoniae CWL029
agcugccagugacauaaucaca

SEQ ID NO: 512229 - RNA, 12 nt, Chlamydophila pneumoniae CWL029
agcuauuuuuga

SEQ ID NO: 512230 - RNA, 13 nt, Chlamydophila pneumoniae CWL029
agcuauuucucua

SEQ ID NO: 512231 - RNA, 12 nt, Chlamydophila pneumoniae CWL029
agcucaaaaagu

SEQ ID NO: 512232 - RNA, 14 nt, Chlamydophila pneumoniae CWL029
agcucaaaaaguuc

SEQ ID NO: 512233 - RNA, 16 nt, Chlamydophila pneumoniae CWL029
agcucacaacccuuua

SEQ ID NO: 512234 - RNA, 22 nt, Chlamydophila pneumoniae CWL029
agcuaucuugagcaucacggag

SEQ ID NO: 512235 - RNA, 15 nt, Chlamydophila pneumoniae CWL029
agcuacaaguccccc

SEQ ID NO: 512236 - RNA, 17 nt, Chlamydophila pneumoniae CWL029
agcuaauuuaaaugccu

SEQ ID NO: 512237 - RNA, 17 nt, Chlamydophila pneumoniae CWL029
agcuaaguaacaguccu

SEQ ID NO: 512238 - RNA, 20 nt, Chlamydophila pneumoniae CWL029
agcuaagggaaauccacaga

SEQ ID NO: 512239 - RNA, 12 nt, Chlamydophila pneumoniae CWL029
agcuaagagcau

SEQ ID NO: 512240 - RNA, 22 nt, Chlamydophila pneumoniae CWL029
agcuaaauuguuaucaggaacu

SEQ ID NO: 512241 - RNA, 12 nt, Chlamydophila pneumoniae CWL029
agcguuaacaac

SEQ ID NO: 512242 - RNA, 16 nt, Chlamydophila pneumoniae CWL029
agcguacaggaagucc

SEQ ID NO: 512243 - RNA, 22 nt, Chlamydophila pneumoniae CWL029
agcgucuaucgacucuucgccc

SEQ ID NO: 512244 - RNA, 16 nt, Chlamydophila pneumoniae CWL029
agcgucguguuuucac

SEQ ID NO: 512245 - RNA, 22 nt, Chlamydophila pneumoniae CWL029
agcguauccgcugcccaugcuu

SEQ ID NO: 512246 - RNA, 16 nt, Chlamydophila pneumoniae CWL029
agcguauuccccacug

SEQ ID NO: 512247 - RNA, 19 nt, Chlamydophila pneumoniae CWL029
agcggaacaacuuugaggc

SEQ ID NO: 512248 - RNA, 17 nt, Chlamydophila pneumoniae CWL029
agauugguaaggagagu

SEQ ID NO: 512249 - RNA, 15 nt, Chlamydophila pneumoniae CWL029
agggaugcucuagaa

SEQ ID NO: 512250 - RNA, 12 nt, Chlamydophila pneumoniae CWL029
agggaugggauc

SEQ ID NO: 512251 - RNA, 15 nt, Chlamydophila pneumoniae CWL029
agggaugcagaucau

SEQ ID NO: 512252 - RNA, 18 nt, Chlamydophila pneumoniae CWL029
agggauguuuaauacaaa

SEQ ID NO: 512253 - RNA, 13 nt, Chlamydophila pneumoniae CWL029
agggaugaagaua

SEQ ID NO: 512254 - RNA, 15 nt, Chlamydophila pneumoniae CWL029
agggaugaagauaaa

SEQ ID NO: 512255 - RNA, 16 nt, Chlamydophila pneumoniae CWL029
agggaucuucaucccu

SEQ ID NO: 512256 - RNA, 20 nt, Chlamydophila pneumoniae CWL029
agggaucuccuucaugcagu

SEQ ID NO: 512257 - RNA, 19 nt, Chlamydophila pneumoniae CWL029
agggauucuuguuggauug

SEQ ID NO: 512258 - RNA, 19 nt, Chlamydophila pneumoniae CWL029
agggaucauguagcagagc

SEQ ID NO: 512259 - RNA, 17 nt, Chlamydophila pneumoniae CWL029
agggagacucuugaggc

SEQ ID NO: 512260 - RNA, 17 nt, Chlamydophila pneumoniae CWL029
agggacguuguaucccu

SEQ ID NO: 512261 - RNA, 22 nt, Chlamydophila pneumoniae CWL029
agggaauuucauguccuccaug

SEQ ID NO: 512262 - RNA, 10 nt, Chlamydophila pneumoniae CWL029
agggaaaaag

SEQ ID NO: 512263 - RNA, 14 nt, Chlamydophila pneumoniae CWL029
aggcuuuuuucuau

SEQ ID NO: 512264 - RNA, 16 nt, Chlamydophila pneumoniae CWL029
aggcuuuucuuuuucu

SEQ ID NO: 512265 - RNA, 22 nt, Chlamydophila pneumoniae CWL029
agggaaaggagcgcuacuguau

SEQ ID NO: 512266 - RNA, 21 nt, Chlamydophila pneumoniae CWL029
agggaaaggucggggagaaca

SEQ ID NO: 512267 - RNA, 18 nt, Chlamydophila pneumoniae CWL029
agggaaaguucaguaaaa

SEQ ID NO: 512268 - RNA, 15 nt, Chlamydophila pneumoniae CWL029
aggcuuguuucuguu

SEQ ID NO: 512269 - RNA, 17 nt, Chlamydophila pneumoniae CWL029
aggcuuaauaaacauca

SEQ ID NO: 512270 - RNA, 15 nt, Chlamydophila pneumoniae CWL029
aggcuguguaaaagu

SEQ ID NO: 512271 - RNA, 13 nt, Chlamydophila pneumoniae CWL029
aggcugcuaucaa

SEQ ID NO: 512272 - RNA, 23 nt, Chlamydophila pneumoniae CWL029
aggguagccauccacgaccugca

SEQ ID NO: 512273 - RNA, 14 nt, Chlamydophila pneumoniae CWL029
aggguaaagaaaua

SEQ ID NO: 512274 - RNA, 18 nt, Chlamydophila pneumoniae CWL029
agggguuucuaaauacuu

SEQ ID NO: 512275 - RNA, 19 nt, Chlamydophila pneumoniae CWL029
agggguucccucuccuuga

SEQ ID NO: 512276 - RNA, 16 nt, Chlamydophila pneumoniae CWL029
agggggccugccauga

SEQ ID NO: 512277 - RNA, 13 nt, Chlamydophila pneumoniae CWL029
aggggcucgacac

SEQ ID NO: 512278 - RNA, 23 nt, Chlamydophila pneumoniae CWL029
aggggcgcauggcggucuuuguu

SEQ ID NO: 512279 - RNA, 14 nt, Chlamydophila pneumoniae CWL029
aggggaagaggaau

SEQ ID NO: 512280 - RNA, 15 nt, Chlamydophila pneumoniae CWL029
aggggaagaggaaug

SEQ ID NO: 512281 - RNA, 14 nt, Chlamydophila pneumoniae CWL029
agggcuucaacauu

SEQ ID NO: 512282 - RNA, 20 nt, Chlamydophila pneumoniae CWL029
agggcaucuuuuacagacug

SEQ ID NO: 512283 - RNA, 17 nt, Chlamydophila pneumoniae CWL029
agggcauguaguuagag

SEQ ID NO: 512284 - RNA, 22 nt, Chlamydophila pneumoniae CWL029
agggcauucuguaauuuugaga

SEQ ID NO: 512285 - RNA, 14 nt, Chlamydophila pneumoniae CWL029
agggcggaauacuu

SEQ ID NO: 512286 - RNA, 14 nt, Chlamydophila pneumoniae CWL029
aggcucuuuuagag

SEQ ID NO: 512287 - RNA, 13 nt, Chlamydophila pneumoniae CWL029
aggcucucgacac

SEQ ID NO: 512288 - RNA, 16 nt, Chlamydophila pneumoniae CWL029
aggcugcacacauccu

SEQ ID NO: 512289 - RNA, 21 nt, Chlamydophila pneumoniae CWL029
aggcuccuccuuugacacccu

SEQ ID NO: 512290 - RNA, 20 nt, Chlamydophila pneumoniae CWL029
aggcuccucugcuaagcaca

SEQ ID NO: 512291 - RNA, 21 nt, Chlamydophila pneumoniae CWL029
aggcuaaaaccuagacucugc

SEQ ID NO: 512292 - RNA, 15 nt, Chlamydophila pneumoniae CWL029
aggcuacugaagagg

SEQ ID NO: 512293 - RNA, 14 nt, Chlamydophila pneumoniae CWL029
aggcggaaaggaag

SEQ ID NO: 512294 - RNA, 17 nt, Chlamydophila pneumoniae CWL029
aggcgauaguaaacaga

SEQ ID NO: 512295 - RNA, 18 nt, Chlamydophila pneumoniae CWL029
aggccuccauuucuagga

SEQ ID NO: 512296 - RNA, 23 nt, Chlamydophila pneumoniae CWL029
aggccuccauuucuaggaauugc

SEQ ID NO: 512297 - RNA, 23 nt, Chlamydophila pneumoniae CWL029
aggccgggauuuuaauucaaaaa

SEQ ID NO: 512298 - RNA, 14 nt, Chlamydophila pneumoniae CWL029
aguaauuacagcuu

SEQ ID NO: 512299 - RNA, 16 nt, Chlamydophila pneumoniae CWL029
aguaauguuaacgaau

SEQ ID NO: 512300 - RNA, 23 nt, Chlamydophila pneumoniae CWL029
aguaauuccaaaauaaaaggagc

SEQ ID NO: 512301 - RNA, 17 nt, Chlamydophila pneumoniae CWL029
aguaaucacuucagcac

SEQ ID NO: 512302 - RNA, 15 nt, Chlamydophila pneumoniae CWL029
aguacccagucaucg

SEQ ID NO: 512303 - RNA, 14 nt, Chlamydophila pneumoniae CWL029
aguaccaagaaaau

SEQ ID NO: 512304 - RNA, 15 nt, Chlamydophila pneumoniae CWL029
aguaccaagaaaaua

SEQ ID NO: 512305 - RNA, 21 nt, Chlamydophila pneumoniae CWL029
aguacauuaucacagcaaucu

SEQ ID NO: 512306 - RNA, 21 nt, Chlamydophila pneumoniae CWL029
aguaagcgauuucgacagcag

SEQ ID NO: 512307 - RNA, 17 nt, Chlamydophila pneumoniae CWL029
aguaaggaacaauguaa

SEQ ID NO: 512308 - RNA, 19 nt, Chlamydophila pneumoniae CWL029
aguaaggaacaauguaaau

SEQ ID NO: 512309 - RNA, 13 nt, Chlamydophila pneumoniae CWL029
aguaacuaucuac

SEQ ID NO: 512310 - RNA, 15 nt, Chlamydophila pneumoniae CWL029
aguaacuuaaucaau

SEQ ID NO: 512311 - RNA, 23 nt, Chlamydophila pneumoniae CWL029
aguaaccaauacagcauaaaaau

SEQ ID NO: 512312 - RNA, 20 nt, Chlamydophila pneumoniae CWL029
aguaaagaaauucuggaguc

SEQ ID NO: 512313 - RNA, 12 nt, Chlamydophila pneumoniae CWL029
aguaaagccaca

SEQ ID NO: 512314 - RNA, 20 nt, Chlamydophila pneumoniae CWL029
aguaaagccacauucuucug

SEQ ID NO: 512315 - RNA, 13 nt, Chlamydophila pneumoniae CWL029
aguaaaacacaaa

SEQ ID NO: 512316 - RNA, 21 nt, Chlamydophila pneumoniae CWL029
agguuugggugcuaaguuguu

SEQ ID NO: 512317 - RNA, 22 nt, Chlamydophila pneumoniae CWL029
agguuuuaaaaugugucuugcu

SEQ ID NO: 512318 - RNA, 23 nt, Chlamydophila pneumoniae CWL029
agguuuugaagcuccucacaucu

SEQ ID NO: 512319 - RNA, 20 nt, Chlamydophila pneumoniae CWL029
agguuuuuccaacuucaacu

SEQ ID NO: 512320 - RNA, 21 nt, Chlamydophila pneumoniae CWL029
agguuuuuccaacuucaacuu

SEQ ID NO: 512321 - RNA, 17 nt, Chlamydophila pneumoniae CWL029
agguuccugcuugauuu

SEQ ID NO: 512322 - RNA, 12 nt, Chlamydophila pneumoniae CWL029
agguucacuuca

SEQ ID NO: 512323 - RNA, 21 nt, Chlamydophila pneumoniae CWL029
agguuccacagagaccuucuc

SEQ ID NO: 512324 - RNA, 22 nt, Chlamydophila pneumoniae CWL029
agguugggcagaagcuucugaa

SEQ ID NO: 512325 - RNA, 16 nt, Chlamydophila pneumoniae CWL029
agguuauguacuagau

SEQ ID NO: 512326 - RNA, 21 nt, Chlamydophila pneumoniae CWL029
agguuauuuaauccaaaaacu

SEQ ID NO: 512327 - RNA, 17 nt, Chlamydophila pneumoniae CWL029
agguguagguuccugcu

SEQ ID NO: 512328 - RNA, 22 nt, Chlamydophila pneumoniae CWL029
agguguuuuggcugcuuuuguu

SEQ ID NO: 512329 - RNA, 15 nt, Chlamydophila pneumoniae CWL029
aggugauauuuucuu

SEQ ID NO: 512330 - RNA, 17 nt, Chlamydophila pneumoniae CWL029
aggucuuccaucucuuu

SEQ ID NO: 512331 - RNA, 17 nt, Chlamydophila pneumoniae CWL029
aggucugcugaggagag

SEQ ID NO: 512332 - RNA, 21 nt, Chlamydophila pneumoniae CWL029
aggucuguuggucucuauuua

SEQ ID NO: 512333 - RNA, 15 nt, Chlamydophila pneumoniae CWL029
aggucuuuucuuuuu

SEQ ID NO: 512334 - RNA, 16 nt, Chlamydophila pneumoniae CWL029
aggucgcaucaaugac

SEQ ID NO: 512335 - RNA, 16 nt, Chlamydophila pneumoniae CWL029
agguaauccucgauac

SEQ ID NO: 512336 - RNA, 20 nt, Chlamydophila pneumoniae CWL029
agguagcagaguuuuucccu

SEQ ID NO: 512337 - RNA, 20 nt, Chlamydophila pneumoniae CWL029
agguagcauaggcuaagacu

SEQ ID NO: 512338 - RNA, 14 nt, Chlamydophila pneumoniae CWL029
agguagaguccaca

SEQ ID NO: 512339 - RNA, 16 nt, Chlamydophila pneumoniae CWL029
agguagaguccacagu

SEQ ID NO: 512340 - RNA, 15 nt, Chlamydophila pneumoniae CWL029
agguagauagaaauu

SEQ ID NO: 512341 - RNA, 20 nt, Chlamydophila pneumoniae CWL029
agguacgcuuuuucuugaaa

SEQ ID NO: 512342 - RNA, 13 nt, Chlamydophila pneumoniae CWL029
agguacuuuauag

SEQ ID NO: 512343 - RNA, 14 nt, Chlamydophila pneumoniae CWL029
aggucacuacccug

SEQ ID NO: 512344 - RNA, 15 nt, Chlamydophila pneumoniae CWL029
aggucagcccugccu

SEQ ID NO: 512345 - RNA, 20 nt, Chlamydophila pneumoniae CWL029
aggucacagcauuuucucug

SEQ ID NO: 512346 - RNA, 14 nt, Chlamydophila pneumoniae CWL029
agguaucuccuuga

SEQ ID NO: 512347 - RNA, 17 nt, Chlamydophila pneumoniae CWL029
agguaguuuucuucuuu

SEQ ID NO: 512348 - RNA, 19 nt, Chlamydophila pneumoniae CWL029
agguaaauuuuuaaaacuc

SEQ ID NO: 512349 - RNA, 19 nt, Chlamydophila pneumoniae CWL029
agguaacauccauagagaa

SEQ ID NO: 512350 - RNA, 21 nt, Chlamydophila pneumoniae CWL029
aggguugugucucugaagacc

SEQ ID NO: 512351 - RNA, 20 nt, Chlamydophila pneumoniae CWL029
aggguucaauuccuuucucc

SEQ ID NO: 512352 - RNA, 12 nt, Chlamydophila pneumoniae CWL029
aggguuugcaug

SEQ ID NO: 512353 - RNA, 17 nt, Chlamydophila pneumoniae CWL029
agguaaaacuacaggaa

SEQ ID NO: 512354 - RNA, 23 nt, Chlamydophila pneumoniae CWL029
agggucggauuuagauuaaagag

SEQ ID NO: 512355 - RNA, 20 nt, Chlamydophila pneumoniae CWL029
aggguauccugcuccaaaau

SEQ ID NO: 512356 - RNA, 14 nt, Chlamydophila pneumoniae CWL029
aucagcacacugcu

SEQ ID NO: 512357 - RNA, 15 nt, Chlamydophila pneumoniae CWL029
aucagcacacugcuu

SEQ ID NO: 512358 - RNA, 15 nt, Chlamydophila pneumoniae CWL029
aucagcaaaacuccc

SEQ ID NO: 512359 - RNA, 14 nt, Chlamydophila pneumoniae CWL029
aucagcaacauaaa

SEQ ID NO: 512360 - RNA, 17 nt, Chlamydophila pneumoniae CWL029
aucagcaacauaaaguu

SEQ ID NO: 512361 - RNA, 23 nt, Chlamydophila pneumoniae CWL029
aucagcaacaucguuaauauaau

SEQ ID NO: 512362 - RNA, 19 nt, Chlamydophila pneumoniae CWL029
aucagaacaacgcugcuuc

SEQ ID NO: 512363 - RNA, 21 nt, Chlamydophila pneumoniae CWL029
aucagaagguaaauuuuuaaa

SEQ ID NO: 512364 - RNA, 12 nt, Chlamydophila pneumoniae CWL029
aucagaaaugaa

SEQ ID NO: 512365 - RNA, 18 nt, Chlamydophila pneumoniae CWL029
aucacuuauauuuucuau

SEQ ID NO: 512366 - RNA, 16 nt, Chlamydophila pneumoniae CWL029
aucagacugaagagca

SEQ ID NO: 512367 - RNA, 17 nt, Chlamydophila pneumoniae CWL029
aucagaaucguucccau

SEQ ID NO: 512368 - RNA, 23 nt, Chlamydophila pneumoniae CWL029
aucagaaucguucccaucacaua

SEQ ID NO: 512369 - RNA, 16 nt, Chlamydophila pneumoniae CWL029
aucagaaucuaaguaa

SEQ ID NO: 512370 - RNA, 16 nt, Chlamydophila pneumoniae CWL029
aucagagacaaguuca

SEQ ID NO: 512371 - RNA, 22 nt, Chlamydophila pneumoniae CWL029
aucagaggccaccaaaaauucc

SEQ ID NO: 512372 - RNA, 15 nt, Chlamydophila pneumoniae CWL029
aucacguccuucuau

SEQ ID NO: 512373 - RNA, 15 nt, Chlamydophila pneumoniae CWL029
aucacuaucauggac

SEQ ID NO: 512374 - RNA, 16 nt, Chlamydophila pneumoniae CWL029
aucacggaugguugcu

SEQ ID NO: 512375 - RNA, 18 nt, Chlamydophila pneumoniae CWL029
aucacggaugguugcuuc

SEQ ID NO: 512376 - RNA, 20 nt, Chlamydophila pneumoniae CWL029
aucacguaaggugucugcca

SEQ ID NO: 512377 - RNA, 20 nt, Chlamydophila pneumoniae CWL029
aucaccuucggaucuuccca

SEQ ID NO: 512378 - RNA, 18 nt, Chlamydophila pneumoniae CWL029
aucacaggcuucaucaca

SEQ ID NO: 512379 - RNA, 23 nt, Chlamydophila pneumoniae CWL029
aucacagccaucgguucggucuc

SEQ ID NO: 512380 - RNA, 16 nt, Chlamydophila pneumoniae CWL029
aucacacuuucaucca

SEQ ID NO: 512381 - RNA, 12 nt, Chlamydophila pneumoniae CWL029
aucacaucaguu

SEQ ID NO: 512382 - RNA, 21 nt, Chlamydophila pneumoniae CWL029
aucacaguuaagacgcagaaa

SEQ ID NO: 512383 - RNA, 13 nt, Chlamydophila pneumoniae CWL029
aucacaguuaaga

SEQ ID NO: 512384 - RNA, 17 nt, Chlamydophila pneumoniae CWL029
aucacauaaaucaacau

SEQ ID NO: 512385 - RNA, 15 nt, Chlamydophila pneumoniae CWL029
aucacauagaaaaca

SEQ ID NO: 512386 - RNA, 15 nt, Chlamydophila pneumoniae CWL029
aucacauuccaagaa

SEQ ID NO: 512387 - RNA, 16 nt, Chlamydophila pneumoniae CWL029
aucaccagcauuaaga

SEQ ID NO: 512388 - RNA, 19 nt, Chlamydophila pneumoniae CWL029
aucaccguacuucccucau

SEQ ID NO: 512389 - RNA, 21 nt, Chlamydophila pneumoniae CWL029
aucacaauuuuaaaaucuccu

SEQ ID NO: 512390 - RNA, 15 nt, Chlamydophila pneumoniae CWL029
aucacaagaaagaau

SEQ ID NO: 512391 - RNA, 17 nt, Chlamydophila pneumoniae CWL029
aucaaugagaucugcaa

SEQ ID NO: 512392 - RNA, 14 nt, Chlamydophila pneumoniae CWL029
aucaaugccuugcg

SEQ ID NO: 512393 - RNA, 13 nt, Chlamydophila pneumoniae CWL029
aucaagccuaaau

SEQ ID NO: 512394 - RNA, 13 nt, Chlamydophila pneumoniae CWL029
aucaaccaaaaug

SEQ ID NO: 512395 - RNA, 19 nt, Chlamydophila pneumoniae CWL029
auauugcaaagcaucuugu

SEQ ID NO: 512396 - RNA, 15 nt, Chlamydophila pneumoniae CWL029
auauucuccuuacca

SEQ ID NO: 512397 - RNA, 14 nt, Chlamydophila pneumoniae CWL029
auauuccuggaaca

SEQ ID NO: 512398 - RNA, 23 nt, Chlamydophila pneumoniae CWL029
auauucuaaggugcuauuuuaaa

SEQ ID NO: 512399 - RNA, 22 nt, Chlamydophila pneumoniae CWL029
aucaaaaacacugcgcaaagaa

SEQ ID NO: 512400 - RNA, 19 nt, Chlamydophila pneumoniae CWL029
aucaaaaaaaacgccauac

SEQ ID NO: 512401 - RNA, 21 nt, Chlamydophila pneumoniae CWL029
auauuuuuugagaaauauaaa

SEQ ID NO: 512402 - RNA, 20 nt, Chlamydophila pneumoniae CWL029
auauuuucuugucucuugcg

SEQ ID NO: 512403 - RNA, 15 nt, Chlamydophila pneumoniae CWL029
auauuuuuauuuaaa

SEQ ID NO: 512404 - RNA, 16 nt, Chlamydophila pneumoniae CWL029
auauuuuuguccugca

SEQ ID NO: 512405 - RNA, 17 nt, Chlamydophila pneumoniae CWL029
auauugucaagaggcug

SEQ ID NO: 512406 - RNA, 18 nt, Chlamydophila pneumoniae CWL029
auauugucaagaggcugu

SEQ ID NO: 512407 - RNA, 15 nt, Chlamydophila pneumoniae CWL029
auauuguucuuccaa

SEQ ID NO: 512408 - RNA, 11 nt, Chlamydophila pneumoniae CWL029
auauuuaaaag

SEQ ID NO: 512409 - RNA, 23 nt, Chlamydophila pneumoniae CWL029
auaucuucuggguucuccacaug

SEQ ID NO: 512410 - RNA, 18 nt, Chlamydophila pneumoniae CWL029
auaucuugaauucucaag

SEQ ID NO: 512411 - RNA, 20 nt, Chlamydophila pneumoniae CWL029
auaucuucuggguucuccac

SEQ ID NO: 512412 - RNA, 11 nt, Chlamydophila pneumoniae CWL029
auaucuucaga

SEQ ID NO: 512413 - RNA, 22 nt, Chlamydophila pneumoniae CWL029
auaucugcgccagcucucuuga

SEQ ID NO: 512414 - RNA, 15 nt, Chlamydophila pneumoniae CWL029
auauccaccuuacca

SEQ ID NO: 512415 - RNA, 19 nt, Chlamydophila pneumoniae CWL029
auaucgccguuaaagacuu

SEQ ID NO: 512416 - RNA, 14 nt, Chlamydophila pneumoniae CWL029
auauauuuuuaaag

SEQ ID NO: 512417 - RNA, 16 nt, Chlamydophila pneumoniae CWL029
auaucaaagcauugca

SEQ ID NO: 512418 - RNA, 23 nt, Chlamydophila pneumoniae CWL029
auaucaguauggcguuuuuuuug

SEQ ID NO: 512419 - RNA, 17 nt, Chlamydophila pneumoniae CWL029
auaucauuaagaagauu

SEQ ID NO: 512420 - RNA, 18 nt, Chlamydophila pneumoniae CWL029
auaucauuaagaagauuc

SEQ ID NO: 512421 - RNA, 20 nt, Chlamydophila pneumoniae CWL029
auaucaccagguccuucugg

SEQ ID NO: 512422 - RNA, 16 nt, Chlamydophila pneumoniae CWL029
auaucaccuacaucag

SEQ ID NO: 512423 - RNA, 20 nt, Chlamydophila pneumoniae CWL029
auauaagauaauagagaaga

SEQ ID NO: 512424 - RNA, 16 nt, Chlamydophila pneumoniae CWL029
auauaauuccaauugc

SEQ ID NO: 512425 - RNA, 13 nt, Chlamydophila pneumoniae CWL029
auauaaaagaaga

SEQ ID NO: 512426 - RNA, 20 nt, Chlamydophila pneumoniae CWL029
auaguuuuuauuuuuaaaua

SEQ ID NO: 512427 - RNA, 17 nt, Chlamydophila pneumoniae CWL029
auaguuuuuauuuuuaa

SEQ ID NO: 512428 - RNA, 15 nt, Chlamydophila pneumoniae CWL029
auaguguuccaaaac

SEQ ID NO: 512429 - RNA, 22 nt, Chlamydophila pneumoniae CWL029
auaguggcgaauccuagagaac

SEQ ID NO: 512430 - RNA, 21 nt, Chlamydophila pneumoniae CWL029
auaguagcgaauccagaauuu

SEQ ID NO: 512431 - RNA, 22 nt, Chlamydophila pneumoniae CWL029
auaguauaauagugagcucccu

SEQ ID NO: 512432 - RNA, 13 nt, Chlamydophila pneumoniae CWL029
auaguagaacugc

SEQ ID NO: 512433 - RNA, 18 nt, Chlamydophila pneumoniae CWL029
auaguaaacagaagugcu

SEQ ID NO: 512434 - RNA, 17 nt, Chlamydophila pneumoniae CWL029
auagguaucagcaagau

SEQ ID NO: 512435 - RNA, 22 nt, Chlamydophila pneumoniae CWL029
auaggcucuuuagcaaacauuu

SEQ ID NO: 512436 - RNA, 19 nt, Chlamydophila pneumoniae CWL029
auagggcaggcggaaagga

SEQ ID NO: 512437 - RNA, 12 nt, Chlamydophila pneumoniae CWL029
auagggaauuuc

SEQ ID NO: 512438 - RNA, 16 nt, Chlamydophila pneumoniae CWL029
auaggauccaggaguu

SEQ ID NO: 512439 - RNA, 14 nt, Chlamydophila pneumoniae CWL029
auaggaucugcaug

SEQ ID NO: 512440 - RNA, 13 nt, Chlamydophila pneumoniae CWL029
auaggauaagaaa

SEQ ID NO: 512441 - RNA, 15 nt, Chlamydophila pneumoniae CWL029
auaggauaagaaauu

SEQ ID NO: 512442 - RNA, 23 nt, Chlamydophila pneumoniae CWL029
auaggaauugcagcaaggagagu

SEQ ID NO: 512443 - RNA, 13 nt, Chlamydophila pneumoniae CWL029
auaggcauuacac

SEQ ID NO: 512444 - RNA, 20 nt, Chlamydophila pneumoniae CWL029
auaggccaagagcuugucuu

SEQ ID NO: 512445 - RNA, 19 nt, Chlamydophila pneumoniae CWL029
auaggcauuacacaacucu

SEQ ID NO: 512446 - RNA, 23 nt, Chlamydophila pneumoniae CWL029
auagcaggaaggaauagagaaag

SEQ ID NO: 512447 - RNA, 17 nt, Chlamydophila pneumoniae CWL029
auagccaucauagcaaa

SEQ ID NO: 512448 - RNA, 13 nt, Chlamydophila pneumoniae CWL029
auaggaagcucuu

SEQ ID NO: 512449 - RNA, 15 nt, Chlamydophila pneumoniae CWL029
auagcuuccuguagu

SEQ ID NO: 512450 - RNA, 17 nt, Chlamydophila pneumoniae CWL029
auagcuuccuguaguga

SEQ ID NO: 512451 - RNA, 17 nt, Chlamydophila pneumoniae CWL029
auagcuuuggaacgugc

SEQ ID NO: 512452 - RNA, 21 nt, Chlamydophila pneumoniae CWL029
auagcuucugacucuguugca

SEQ ID NO: 512453 - RNA, 19 nt, Chlamydophila pneumoniae CWL029
auagcuuacuuagaacuau

SEQ ID NO: 512454 - RNA, 23 nt, Chlamydophila pneumoniae CWL029
auagcuggcaaugauauccucaa

SEQ ID NO: 512455 - RNA, 21 nt, Chlamydophila pneumoniae CWL029
auagcuggggauuaguagcua

SEQ ID NO: 512456 - RNA, 19 nt, Chlamydophila pneumoniae CWL029
auagcugaggcaucuauug

SEQ ID NO: 512457 - RNA, 18 nt, Chlamydophila pneumoniae CWL029
auagcuggaucuucugau

SEQ ID NO: 512458 - RNA, 21 nt, Chlamydophila pneumoniae CWL029
auagcuggcaaugauauccuc

SEQ ID NO: 512459 - RNA, 19 nt, Chlamydophila pneumoniae CWL029
auagcuaagagcaucuuug

SEQ ID NO: 512460 - RNA, 17 nt, Chlamydophila pneumoniae CWL029
auagcuaugaguugcuu

SEQ ID NO: 512461 - RNA, 13 nt, Chlamydophila pneumoniae CWL029
auagcucagcucu

SEQ ID NO: 512462 - RNA, 23 nt, Chlamydophila pneumoniae CWL029
auagauucguuauccucgucuuc

SEQ ID NO: 512463 - RNA, 12 nt, Chlamydophila pneumoniae CWL029
auagaucucuug

SEQ ID NO: 512464 - RNA, 13 nt, Chlamydophila pneumoniae CWL029
auagaucucuuga

SEQ ID NO: 512465 - RNA, 21 nt, Chlamydophila pneumoniae CWL029
auagaguaucuaaaacuucuu

SEQ ID NO: 512466 - RNA, 17 nt, Chlamydophila pneumoniae CWL029
auagaguaucuaaaacu

SEQ ID NO: 512467 - RNA, 14 nt, Chlamydophila pneumoniae CWL029
auagagucucuuga

SEQ ID NO: 512468 - RNA, 17 nt, Chlamydophila pneumoniae CWL029
auagaggaccgaaaaac

SEQ ID NO: 512469 - RNA, 20 nt, Chlamydophila pneumoniae CWL029
auagaggagauccuaagaga

SEQ ID NO: 512470 - RNA, 13 nt, Chlamydophila pneumoniae CWL029
auagagcucuaaa

SEQ ID NO: 512471 - RNA, 15 nt, Chlamydophila pneumoniae CWL029
auagagcucuaaaaa

SEQ ID NO: 512472 - RNA, 20 nt, Chlamydophila pneumoniae CWL029
auagaguagcucaucuagaa

SEQ ID NO: 512473 - RNA, 21 nt, Chlamydophila pneumoniae CWL029
auagaguagcucaucuagaaa

SEQ ID NO: 512474 - RNA, 13 nt, Chlamydophila pneumoniae CWL029
auacuucuccuga

SEQ ID NO: 512475 - RNA, 14 nt, Chlamydophila pneumoniae CWL029
auagagauucuaca

SEQ ID NO: 512476 - RNA, 17 nt, Chlamydophila pneumoniae CWL029
auagagccuagagaguu

SEQ ID NO: 512477 - RNA, 23 nt, Chlamydophila pneumoniae CWL029
auagagccuccuccuucugcaau

SEQ ID NO: 512478 - RNA, 21 nt, Chlamydophila pneumoniae CWL029
auagagagcgccuaaacccac

SEQ ID NO: 512479 - RNA, 16 nt, Chlamydophila pneumoniae CWL029
auacuguuaacaagua

SEQ ID NO: 512480 - RNA, 15 nt, Chlamydophila pneumoniae CWL029
auacuucuccacagc

SEQ ID NO: 512481 - RNA, 14 nt, Chlamydophila pneumoniae CWL029
auacuucuccugaa

SEQ ID NO: 512482 - RNA, 15 nt, Chlamydophila pneumoniae CWL029
auacucauauuuugu

SEQ ID NO: 512483 - RNA, 15 nt, Chlamydophila pneumoniae CWL029
auacuccacuuuuuu

SEQ ID NO: 512484 - RNA, 18 nt, Chlamydophila pneumoniae CWL029
auacucuagguuuucucu

SEQ ID NO: 512485 - RNA, 16 nt, Chlamydophila pneumoniae CWL029
auacucgucaaauuca

SEQ ID NO: 512486 - RNA, 15 nt, Chlamydophila pneumoniae CWL029
auacgucguuacagc

SEQ ID NO: 512487 - RNA, 19 nt, Chlamydophila pneumoniae CWL029
auacgccaaggucuucccg

SEQ ID NO: 512488 - RNA, 15 nt, Chlamydophila pneumoniae CWL029
auacguccagccugc

SEQ ID NO: 512489 - RNA, 14 nt, Chlamydophila pneumoniae CWL029
auaccuccuccaau

SEQ ID NO: 512490 - RNA, 18 nt, Chlamydophila pneumoniae CWL029
auaccuccuccaaucugc

SEQ ID NO: 512491 - RNA, 19 nt, Chlamydophila pneumoniae CWL029
auaccuccuccaaucugcu

SEQ ID NO: 512492 - RNA, 15 nt, Chlamydophila pneumoniae CWL029
auaauuagaacagca

SEQ ID NO: 512493 - RNA, 14 nt, Chlamydophila pneumoniae CWL029
auaauuagaacagc

SEQ ID NO: 512494 - RNA, 15 nt, Chlamydophila pneumoniae CWL029
auaccgcuguuuuau

SEQ ID NO: 512495 - RNA, 23 nt, Chlamydophila pneumoniae CWL029
auaccggcaaauaaaguccucca

SEQ ID NO: 512496 - RNA, 12 nt, Chlamydophila pneumoniae CWL029
aguuuuuuucuu

SEQ ID NO: 512497 - RNA, 16 nt, Chlamydophila pneumoniae CWL029
aguuuugaggauuucu

SEQ ID NO: 512498 - RNA, 15 nt, Chlamydophila pneumoniae CWL029
aguuuugaaaucaaa

SEQ ID NO: 512499 - RNA, 19 nt, Chlamydophila pneumoniae CWL029
aguuuucgauacacaagau

SEQ ID NO: 512500 - RNA, 21 nt, Chlamydophila pneumoniae CWL029
aguuucuuuugcaaaucuucg

SEQ ID NO: 512501 - RNA, 18 nt, Chlamydophila pneumoniae CWL029
aguuugcaugcaacggag

SEQ ID NO: 512502 - RNA, 18 nt, Chlamydophila pneumoniae CWL029
aguuucuaucuaaucaau

SEQ ID NO: 512503 - RNA, 21 nt, Chlamydophila pneumoniae CWL029
aguuuaccugaaaaaacagua

SEQ ID NO: 512504 - RNA, 18 nt, Chlamydophila pneumoniae CWL029
aguuuacaaauaaaauga

SEQ ID NO: 512505 - RNA, 17 nt, Chlamydophila pneumoniae CWL029
aguuuaauguuuggcca

SEQ ID NO: 512506 - RNA, 19 nt, Chlamydophila pneumoniae CWL029
aguuguuguggaaucacgu

SEQ ID NO: 512507 - RNA, 22 nt, Chlamydophila pneumoniae CWL029
aguuguuuuuugagauacagcu

SEQ ID NO: 512508 - RNA, 17 nt, Chlamydophila pneumoniae CWL029
aguugauuguagagaca

SEQ ID NO: 512509 - RNA, 19 nt, Chlamydophila pneumoniae CWL029
aguugauuguagagacaua

SEQ ID NO: 512510 - RNA, 23 nt, Chlamydophila pneumoniae CWL029
aguucuucauuccaggauucuau

SEQ ID NO: 512511 - RNA, 15 nt, Chlamydophila pneumoniae CWL029
aguucuuccaaagcu

SEQ ID NO: 512512 - RNA, 10 nt, Chlamydophila pneumoniae CWL029
aguucuuccu

SEQ ID NO: 512513 - RNA, 22 nt, Chlamydophila pneumoniae CWL029
aguucuuuuugcagaucuuuua

SEQ ID NO: 512514 - RNA, 14 nt, Chlamydophila pneumoniae CWL029
aguucuuccuucuu

SEQ ID NO: 512515 - RNA, 20 nt, Chlamydophila pneumoniae CWL029
aguugaacugacaccaggag

SEQ ID NO: 512516 - RNA, 21 nt, Chlamydophila pneumoniae CWL029
aguugaaguuuugcucucuag

SEQ ID NO: 512517 - RNA, 17 nt, Chlamydophila pneumoniae CWL029
aguucguuggcccagag

SEQ ID NO: 512518 - RNA, 17 nt, Chlamydophila pneumoniae CWL029
aguucgggcuaaucauu

SEQ ID NO: 512519 - RNA, 20 nt, Chlamydophila pneumoniae CWL029
aguuccucauccucaucauc

SEQ ID NO: 512520 - RNA, 21 nt, Chlamydophila pneumoniae CWL029
aguuccucauccucaucauca

SEQ ID NO: 512521 - RNA, 22 nt, Chlamydophila pneumoniae CWL029
aguuccucauccucaucaucag

SEQ ID NO: 512522 - RNA, 17 nt, Chlamydophila pneumoniae CWL029
aguucauuuuaguuuuc

SEQ ID NO: 512523 - RNA, 18 nt, Chlamydophila pneumoniae CWL029
aguuccaaaucucaaucg

SEQ ID NO: 512524 - RNA, 21 nt, Chlamydophila pneumoniae CWL029
aguuccaagacaauaaaaaag

SEQ ID NO: 512525 - RNA, 23 nt, Chlamydophila pneumoniae CWL029
aguuccaagacaauaaaaaagag

SEQ ID NO: 512526 - RNA, 23 nt, Chlamydophila pneumoniae CWL029
aguuaggaucccugauuccuugg

SEQ ID NO: 512527 - RNA, 23 nt, Chlamydophila pneumoniae CWL029
aguuagccuggcuaaaggaucau

SEQ ID NO: 512528 - RNA, 16 nt, Chlamydophila pneumoniae CWL029
aguuagaagagucauu

SEQ ID NO: 512529 - RNA, 20 nt, Chlamydophila pneumoniae CWL029
aguuagaagagucauuauca

SEQ ID NO: 512530 - RNA, 14 nt, Chlamydophila pneumoniae CWL029
aguuacgugagaac

SEQ ID NO: 512531 - RNA, 16 nt, Chlamydophila pneumoniae CWL029
aguguuucuuuaucua

SEQ ID NO: 512532 - RNA, 15 nt, Chlamydophila pneumoniae CWL029
aguguguuucaaaca

SEQ ID NO: 512533 - RNA, 16 nt, Chlamydophila pneumoniae CWL029
aguguguuucaaacaa

SEQ ID NO: 512534 - RNA, 21 nt, Chlamydophila pneumoniae CWL029
agugugguuuaccuuguuuuc

SEQ ID NO: 512535 - RNA, 15 nt, Chlamydophila pneumoniae CWL029
aguguguaaauguuu

SEQ ID NO: 512536 - RNA, 14 nt, Chlamydophila pneumoniae CWL029
agugugcucuguau

SEQ ID NO: 512537 - RNA, 17 nt, Chlamydophila pneumoniae CWL029
agugugacugcagagaa

SEQ ID NO: 512538 - RNA, 15 nt, Chlamydophila pneumoniae CWL029
agugugaggagacuu

SEQ ID NO: 512539 - RNA, 18 nt, Chlamydophila pneumoniae CWL029
aguggcuuauagagagaa

SEQ ID NO: 512540 - RNA, 19 nt, Chlamydophila pneumoniae CWL029
aguggcuuauagagagaau

SEQ ID NO: 512541 - RNA, 14 nt, Chlamydophila pneumoniae CWL029
agugggaauguugu

SEQ ID NO: 512542 - RNA, 14 nt, Chlamydophila pneumoniae CWL029
aguggucaauugca

SEQ ID NO: 512543 - RNA, 16 nt, Chlamydophila pneumoniae CWL029
aguggucggcagaaac

SEQ ID NO: 512544 - RNA, 19 nt, Chlamydophila pneumoniae CWL029
agugguuccugaaaagcau

SEQ ID NO: 512545 - RNA, 23 nt, Chlamydophila pneumoniae CWL029
aguguaacauugaccuaaaggaa

SEQ ID NO: 512546 - RNA, 19 nt, Chlamydophila pneumoniae CWL029
aguguauaacguagauguc

SEQ ID NO: 512547 - RNA, 21 nt, Chlamydophila pneumoniae CWL029
aguguauaacguagaugucuu

SEQ ID NO: 512548 - RNA, 17 nt, Chlamydophila pneumoniae CWL029
aguguauaucagcaaaa

SEQ ID NO: 512549 - RNA, 14 nt, Chlamydophila pneumoniae CWL029
agugugacugcaga

SEQ ID NO: 512550 - RNA, 22 nt, Chlamydophila pneumoniae CWL029
agugucuaagauauagagagag

SEQ ID NO: 512551 - RNA, 14 nt, Chlamydophila pneumoniae CWL029
agugucccauggcu

SEQ ID NO: 512552 - RNA, 16 nt, Chlamydophila pneumoniae CWL029
agugucauacgcagca

SEQ ID NO: 512553 - RNA, 20 nt, Chlamydophila pneumoniae CWL029
agugucaucggcuucuccaa

SEQ ID NO: 512554 - RNA, 19 nt, Chlamydophila pneumoniae CWL029
agugucaucggcuucucca

SEQ ID NO: 512555 - RNA, 15 nt, Chlamydophila pneumoniae CWL029
agugcucaguaaaua

SEQ ID NO: 512556 - RNA, 18 nt, Chlamydophila pneumoniae CWL029
agugccaagagcaucaca

SEQ ID NO: 512557 - RNA, 14 nt, Chlamydophila pneumoniae CWL029
agugacuuuucuuc

SEQ ID NO: 512558 - RNA, 16 nt, Chlamydophila pneumoniae CWL029
agugacuuuucuucuu

SEQ ID NO: 512559 - RNA, 14 nt, Chlamydophila pneumoniae CWL029
agugagaucaaaaa

SEQ ID NO: 512560 - RNA, 11 nt, Chlamydophila pneumoniae CWL029
agugagauacg

SEQ ID NO: 512561 - RNA, 23 nt, Chlamydophila pneumoniae CWL029
agucuauagccucuucuacacca

SEQ ID NO: 512562 - RNA, 18 nt, Chlamydophila pneumoniae CWL029
agucuauaucuacagcua

SEQ ID NO: 512563 - RNA, 20 nt, Chlamydophila pneumoniae CWL029
aguccuucuagguauuuguu

SEQ ID NO: 512564 - RNA, 22 nt, Chlamydophila pneumoniae CWL029
aguccuucuucccagccuugau

SEQ ID NO: 512565 - RNA, 16 nt, Chlamydophila pneumoniae CWL029
agucuucccucuccuu

SEQ ID NO: 512566 - RNA, 17 nt, Chlamydophila pneumoniae CWL029
agucuucccucuccuug

SEQ ID NO: 512567 - RNA, 23 nt, Chlamydophila pneumoniae CWL029
agucuucccucuccuugaagcaa

SEQ ID NO: 512568 - RNA, 18 nt, Chlamydophila pneumoniae CWL029
agucugugagaaauaggu

SEQ ID NO: 512569 - RNA, 15 nt, Chlamydophila pneumoniae CWL029
agucuguuuuggaaa

SEQ ID NO: 512570 - RNA, 18 nt, Chlamydophila pneumoniae CWL029
agucuguuuuggaaagaa

SEQ ID NO: 512571 - RNA, 22 nt, Chlamydophila pneumoniae CWL029
agucuguuuuggaaagaaggga

SEQ ID NO: 512572 - RNA, 21 nt, Chlamydophila pneumoniae CWL029
agucugguuuuucuccugacu

SEQ ID NO: 512573 - RNA, 15 nt, Chlamydophila pneumoniae CWL029
agucugauguaggug

SEQ ID NO: 512574 - RNA, 12 nt, Chlamydophila pneumoniae CWL029
agucugaacauu

SEQ ID NO: 512575 - RNA, 17 nt, Chlamydophila pneumoniae CWL029
agucugaacauucuuaa

SEQ ID NO: 512576 - RNA, 14 nt, Chlamydophila pneumoniae CWL029
agucugcagcagau

SEQ ID NO: 512577 - RNA, 17 nt, Chlamydophila pneumoniae CWL029
agucuuucuaagaagac

SEQ ID NO: 512578 - RNA, 14 nt, Chlamydophila pneumoniae CWL029
agucuuuuucagaa

SEQ ID NO: 512579 - RNA, 16 nt, Chlamydophila pneumoniae CWL029
agucuuggacguuccu

SEQ ID NO: 512580 - RNA, 23 nt, Chlamydophila pneumoniae CWL029
agucuugcgccagcaaagauuaa

SEQ ID NO: 512581 - RNA, 17 nt, Chlamydophila pneumoniae CWL029
agucuucuuuccccaag

SEQ ID NO: 512582 - RNA, 19 nt, Chlamydophila pneumoniae CWL029
agucuucuuagaaagacua

SEQ ID NO: 512583 - RNA, 18 nt, Chlamydophila pneumoniae CWL029
agucuugcgccagcaaag

SEQ ID NO: 512584 - RNA, 17 nt, Chlamydophila pneumoniae CWL029
agugaccauagcauaga

SEQ ID NO: 512585 - RNA, 16 nt, Chlamydophila pneumoniae CWL029
agugacaccaacaaca

SEQ ID NO: 512586 - RNA, 17 nt, Chlamydophila pneumoniae CWL029
agugacaccaacaacaa

SEQ ID NO: 512587 - RNA, 18 nt, Chlamydophila pneumoniae CWL029
auaagaacuuuagggaag

SEQ ID NO: 512588 - RNA, 19 nt, Chlamydophila pneumoniae CWL029
auaacuuugcaugaggaga

SEQ ID NO: 512589 - RNA, 13 nt, Chlamydophila pneumoniae CWL029
auaacuuuaucau

SEQ ID NO: 512590 - RNA, 19 nt, Chlamydophila pneumoniae CWL029
auaacugugcuccauagca

SEQ ID NO: 512591 - RNA, 21 nt, Chlamydophila pneumoniae CWL029
auaacuccacuaccaaggcag

SEQ ID NO: 512592 - RNA, 16 nt, Chlamydophila pneumoniae CWL029
auaacuauugggaaug

SEQ ID NO: 512593 - RNA, 23 nt, Chlamydophila pneumoniae CWL029
auaacuauugggaaugcauuuca

SEQ ID NO: 512594 - RNA, 15 nt, Chlamydophila pneumoniae CWL029
auaaccuaaggcaug

SEQ ID NO: 512595 - RNA, 17 nt, Chlamydophila pneumoniae CWL029
auaaccuccauagaauc

SEQ ID NO: 512596 - RNA, 16 nt, Chlamydophila pneumoniae CWL029
auaacacuucuuucuu

SEQ ID NO: 512597 - RNA, 16 nt, Chlamydophila pneumoniae CWL029
auaacauugcuugcua

SEQ ID NO: 512598 - RNA, 16 nt, Chlamydophila pneumoniae CWL029
auaacauuuagauaaa

SEQ ID NO: 512599 - RNA, 20 nt, Chlamydophila pneumoniae CWL029
auaacauuuagauaaagaaa

SEQ ID NO: 512600 - RNA, 20 nt, Chlamydophila pneumoniae CWL029
auaacauuucguuuuuucuu

SEQ ID NO: 512601 - RNA, 21 nt, Chlamydophila pneumoniae CWL029
auaaccaaaagaauuaagaag

SEQ ID NO: 512602 - RNA, 17 nt, Chlamydophila pneumoniae CWL029
auaaccaacuuccuaua

SEQ ID NO: 512603 - RNA, 21 nt, Chlamydophila pneumoniae CWL029
auaaccaacuuccuauaaaaa

SEQ ID NO: 512604 - RNA, 22 nt, Chlamydophila pneumoniae CWL029
auaaccgaaacuucucagauaa

SEQ ID NO: 512605 - RNA, 23 nt, Chlamydophila pneumoniae CWL029
auaaaaauaccaguagagaaugu

SEQ ID NO: 512606 - RNA, 21 nt, Chlamydophila pneumoniae CWL029
auaaagaucgggucuacaaca

SEQ ID NO: 512607 - RNA, 22 nt, Chlamydophila pneumoniae CWL029
auaaagaucuuuauuuuuaaaa

SEQ ID NO: 512608 - RNA, 15 nt, Chlamydophila pneumoniae CWL029
auaaagaucuuuuau

SEQ ID NO: 512609 - RNA, 15 nt, Chlamydophila pneumoniae CWL029
auaaagcaaaugccu

SEQ ID NO: 512610 - RNA, 19 nt, Chlamydophila pneumoniae CWL029
auaaagcaacuguaaauuu

SEQ ID NO: 512611 - RNA, 12 nt, Chlamydophila pneumoniae CWL029
auaaagagcuga

SEQ ID NO: 512612 - RNA, 20 nt, Chlamydophila pneumoniae CWL029
auaaacucuuguugucuaug

SEQ ID NO: 512613 - RNA, 22 nt, Chlamydophila pneumoniae CWL029
auaaacuucaaugaagaaaaau

SEQ ID NO: 512614 - RNA, 14 nt, Chlamydophila pneumoniae CWL029
auaaaccuuugguu

SEQ ID NO: 512615 - RNA, 15 nt, Chlamydophila pneumoniae CWL029
auaaaccuuugguuu

SEQ ID NO: 512616 - RNA, 17 nt, Chlamydophila pneumoniae CWL029
auaaaucuauuccccuc

SEQ ID NO: 512617 - RNA, 21 nt, Chlamydophila pneumoniae CWL029
auaaauccgcagagucuauau

SEQ ID NO: 512618 - RNA, 23 nt, Chlamydophila pneumoniae CWL029
auaaauaauuacaauuuuagaua

SEQ ID NO: 512619 - RNA, 14 nt, Chlamydophila pneumoniae CWL029
auaaaggcauaacu

SEQ ID NO: 512620 - RNA, 23 nt, Chlamydophila pneumoniae CWL029
auaaagguuacaagcaauacuaa

SEQ ID NO: 512621 - RNA, 11 nt, Chlamydophila pneumoniae CWL029
auaaaguauau

SEQ ID NO: 512622 - RNA, 13 nt, Chlamydophila pneumoniae CWL029
auaauaaaagcac

SEQ ID NO: 512623 - RNA, 15 nt, Chlamydophila pneumoniae CWL029
auaauaaaagcaccc

SEQ ID NO: 512624 - RNA, 17 nt, Chlamydophila pneumoniae CWL029
auaaguuacuuucugau

SEQ ID NO: 512625 - RNA, 16 nt, Chlamydophila pneumoniae CWL029
auaagugacuuuucuu

SEQ ID NO: 512626 - RNA, 23 nt, Chlamydophila pneumoniae CWL029
auaagggggaucuucagagagaa

SEQ ID NO: 512627 - RNA, 14 nt, Chlamydophila pneumoniae CWL029
auaaggcuugagga

SEQ ID NO: 512628 - RNA, 14 nt, Chlamydophila pneumoniae CWL029
auaaggcuuuucug

SEQ ID NO: 512629 - RNA, 20 nt, Chlamydophila pneumoniae CWL029
auaaggcuuuucugcuccug

SEQ ID NO: 512630 - RNA, 19 nt, Chlamydophila pneumoniae CWL029
auaaggauucugagaaguu

SEQ ID NO: 512631 - RNA, 17 nt, Chlamydophila pneumoniae CWL029
auaagauaaagaauucu

SEQ ID NO: 512632 - RNA, 17 nt, Chlamydophila pneumoniae CWL029
auaagauaauagagaag

SEQ ID NO: 512633 - RNA, 15 nt, Chlamydophila pneumoniae CWL029
auaagauagcucuug

SEQ ID NO: 512634 - RNA, 18 nt, Chlamydophila pneumoniae CWL029
auaagauccaaaaauucu

SEQ ID NO: 512635 - RNA, 20 nt, Chlamydophila pneumoniae CWL029
auaagaucuuucauuuuaug

SEQ ID NO: 512636 - RNA, 16 nt, Chlamydophila pneumoniae CWL029
auaagcaagcaacuga

SEQ ID NO: 512637 - RNA, 13 nt, Chlamydophila pneumoniae CWL029
auaagagacauuu

SEQ ID NO: 512638 - RNA, 20 nt, Chlamydophila pneumoniae CWL029
auaagaaugguuauuucuug

SEQ ID NO: 512639 - RNA, 14 nt, Chlamydophila pneumoniae CWL029
auaagaacucuauu

SEQ ID NO: 512640 - RNA, 22 nt, Chlamydophila pneumoniae CWL029
auaagaagcucuaucuuuggua

SEQ ID NO: 512641 - RNA, 20 nt, Chlamydophila pneumoniae CWL029
auaagcaggaaaagcaaaau

SEQ ID NO: 512642 - RNA, 22 nt, Chlamydophila pneumoniae CWL029
auaagcaccacgaccuauacca

SEQ ID NO: 512643 - RNA, 15 nt, Chlamydophila pneumoniae CWL029
auaagcuugccagca

SEQ ID NO: 512644 - RNA, 17 nt, Chlamydophila pneumoniae CWL029
auaagcuugccagcaga

SEQ ID NO: 512645 - RNA, 19 nt, Chlamydophila pneumoniae CWL029
auaagcuugccagcagaag

SEQ ID NO: 512646 - RNA, 20 nt, Chlamydophila pneumoniae CWL029
auaagcuaacaccucuucaa

SEQ ID NO: 512647 - RNA, 22 nt, Chlamydophila pneumoniae CWL029
auaauagugagcucccugaugu

SEQ ID NO: 512648 - RNA, 21 nt, Chlamydophila pneumoniae CWL029
auaauauuuuuuuaagaucuc

SEQ ID NO: 512649 - RNA, 13 nt, Chlamydophila pneumoniae CWL029
auaaucaaccaaa

SEQ ID NO: 512650 - RNA, 13 nt, Chlamydophila pneumoniae CWL029
auaaucaauccac

SEQ ID NO: 512651 - RNA, 19 nt, Chlamydophila pneumoniae CWL029
auaauaggauaagaaauua

SEQ ID NO: 512652 - RNA, 20 nt, Chlamydophila pneumoniae CWL029
auaauaggauaagaaauuaa

SEQ ID NO: 512653 - RNA, 14 nt, Chlamydophila pneumoniae CWL029
auaauagagaagaa

SEQ ID NO: 512654 - RNA, 14 nt, Chlamydophila pneumoniae CWL029
auaauagagccucc

SEQ ID NO: 512655 - RNA, 18 nt, Chlamydophila pneumoniae CWL029
auaaucgcacuucuauuu

SEQ ID NO: 512656 - RNA, 18 nt, Chlamydophila pneumoniae CWL029
auaaucacuuaauaaugu

SEQ ID NO: 512657 - RNA, 20 nt, Chlamydophila pneumoniae CWL029
auaaucagaggagccuccau

SEQ ID NO: 512658 - RNA, 21 nt, Chlamydophila pneumoniae CWL029
auaaucagaggagccuccaua

SEQ ID NO: 512659 - RNA, 18 nt, Chlamydophila pneumoniae CWL029
auaaugaagcagggaaaa

SEQ ID NO: 512660 - RNA, 19 nt, Chlamydophila pneumoniae CWL029
auaaugcucacuucuuugc

SEQ ID NO: 512661 - RNA, 20 nt, Chlamydophila pneumoniae CWL029
aucggaucuuuucuuucuaa

SEQ ID NO: 512662 - RNA, 22 nt, Chlamydophila pneumoniae CWL029
aucggaucuuuucuuucuaaga

SEQ ID NO: 512663 - RNA, 15 nt, Chlamydophila pneumoniae CWL029
aucgcguguaaaagc

SEQ ID NO: 512664 - RNA, 20 nt, Chlamydophila pneumoniae CWL029
aucggcuucuccaacuucca

SEQ ID NO: 512665 - RNA, 17 nt, Chlamydophila pneumoniae CWL029
aucuaaauaagauuuua

SEQ ID NO: 512666 - RNA, 20 nt, Chlamydophila pneumoniae CWL029
aucuaaagguuuuaaauuua

SEQ ID NO: 512667 - RNA, 14 nt, Chlamydophila pneumoniae CWL029
aucuaaaggaagau

SEQ ID NO: 512668 - RNA, 20 nt, Chlamydophila pneumoniae CWL029
aucuacaagacuacgacaga

SEQ ID NO: 512669 - RNA, 18 nt, Chlamydophila pneumoniae CWL029
aucuacacacacgccaau

SEQ ID NO: 512670 - RNA, 13 nt, Chlamydophila pneumoniae CWL029
aucuacagagaga

SEQ ID NO: 512671 - RNA, 14 nt, Chlamydophila pneumoniae CWL029
aucuacagagagaa

SEQ ID NO: 512672 - RNA, 13 nt, Chlamydophila pneumoniae CWL029
aucuaaaaucaca

SEQ ID NO: 512673 - RNA, 14 nt, Chlamydophila pneumoniae CWL029
aucuaaaaucacac

SEQ ID NO: 512674 - RNA, 19 nt, Chlamydophila pneumoniae CWL029
aucgugauugcugucagaa

SEQ ID NO: 512675 - RNA, 20 nt, Chlamydophila pneumoniae CWL029
aucgucgccuuuuccuaaau

SEQ ID NO: 512676 - RNA, 15 nt, Chlamydophila pneumoniae CWL029
aucguccucaccgau

SEQ ID NO: 512677 - RNA, 16 nt, Chlamydophila pneumoniae CWL029
aucgucccuaaagcuu

SEQ ID NO: 512678 - RNA, 15 nt, Chlamydophila pneumoniae CWL029
aucgcaaucaaagag

SEQ ID NO: 512679 - RNA, 20 nt, Chlamydophila pneumoniae CWL029
aucgcaaucagcaacaucgu

SEQ ID NO: 512680 - RNA, 15 nt, Chlamydophila pneumoniae CWL029
aucgcaaauuuccau

SEQ ID NO: 512681 - RNA, 20 nt, Chlamydophila pneumoniae CWL029
aucgagcucuuuaagaacuu

SEQ ID NO: 512682 - RNA, 19 nt, Chlamydophila pneumoniae CWL029
aucgaaaccacagcaaaga

SEQ ID NO: 512683 - RNA, 19 nt, Chlamydophila pneumoniae CWL029
auccuuuuuguaguaagau

SEQ ID NO: 512684 - RNA, 17 nt, Chlamydophila pneumoniae CWL029
aucgaacagagaugcaa

SEQ ID NO: 512685 - RNA, 14 nt, Chlamydophila pneumoniae CWL029
aucagcuguugcgu

SEQ ID NO: 512686 - RNA, 15 nt, Chlamydophila pneumoniae CWL029
auccuuuggaagcua

SEQ ID NO: 512687 - RNA, 20 nt, Chlamydophila pneumoniae CWL029
auccuuuggaagcuaucauu

SEQ ID NO: 512688 - RNA, 19 nt, Chlamydophila pneumoniae CWL029
aucagcuggguaaguccac

SEQ ID NO: 512689 - RNA, 19 nt, Chlamydophila pneumoniae CWL029
aucugcgacaaaaaugccu

SEQ ID NO: 512690 - RNA, 22 nt, Chlamydophila pneumoniae CWL029
aucugcgacaaaaaugccugaa

SEQ ID NO: 512691 - RNA, 21 nt, Chlamydophila pneumoniae CWL029
aucugcaauuccgaagaagaa

SEQ ID NO: 512692 - RNA, 22 nt, Chlamydophila pneumoniae CWL029
aucugaucuucagggacaucau

SEQ ID NO: 512693 - RNA, 21 nt, Chlamydophila pneumoniae CWL029
aucugaugcaccauaauauaa

SEQ ID NO: 512694 - RNA, 20 nt, Chlamydophila pneumoniae CWL029
aucugacagaccuugcauua

SEQ ID NO: 512695 - RNA, 19 nt, Chlamydophila pneumoniae CWL029
aucugagcauaacuugaag

SEQ ID NO: 512696 - RNA, 21 nt, Chlamydophila pneumoniae CWL029
aucugagcauaacuugaagaa

SEQ ID NO: 512697 - RNA, 23 nt, Chlamydophila pneumoniae CWL029
aucugagucauaagcucuauuuc

SEQ ID NO: 512698 - RNA, 19 nt, Chlamydophila pneumoniae CWL029
aucucuuuuggaagaccuu

SEQ ID NO: 512699 - RNA, 16 nt, Chlamydophila pneumoniae CWL029
aucucuugaagcacuu

SEQ ID NO: 512700 - RNA, 15 nt, Chlamydophila pneumoniae CWL029
aucucuucuguagga

SEQ ID NO: 512701 - RNA, 17 nt, Chlamydophila pneumoniae CWL029
aucucuucuguaggaac

SEQ ID NO: 512702 - RNA, 13 nt, Chlamydophila pneumoniae CWL029
aucucugcuuucc

SEQ ID NO: 512703 - RNA, 17 nt, Chlamydophila pneumoniae CWL029
aucucugcuuuccacac

SEQ ID NO: 512704 - RNA, 20 nt, Chlamydophila pneumoniae CWL029
aucucuggcauaauccugaa

SEQ ID NO: 512705 - RNA, 14 nt, Chlamydophila pneumoniae CWL029
aucucucuuuaaaa

SEQ ID NO: 512706 - RNA, 23 nt, Chlamydophila pneumoniae CWL029
aucucuguuuuuugaaaacuuca

SEQ ID NO: 512707 - RNA, 14 nt, Chlamydophila pneumoniae CWL029
aucucuuaaaauau

SEQ ID NO: 512708 - RNA, 19 nt, Chlamydophila pneumoniae CWL029
aucucuggaauacauuccu

SEQ ID NO: 512709 - RNA, 21 nt, Chlamydophila pneumoniae CWL029
aucucugcccccuguuugaac

SEQ ID NO: 512710 - RNA, 18 nt, Chlamydophila pneumoniae CWL029
aucucugacuugcaagcu

SEQ ID NO: 512711 - RNA, 22 nt, Chlamydophila pneumoniae CWL029
aucucugacuugcaagcuucuu

SEQ ID NO: 512712 - RNA, 19 nt, Chlamydophila pneumoniae CWL029
aucucuccuugacaaauaa

SEQ ID NO: 512713 - RNA, 19 nt, Chlamydophila pneumoniae CWL029
aucucucuuccugcugcuu

SEQ ID NO: 512714 - RNA, 15 nt, Chlamydophila pneumoniae CWL029
aucucgggagaacau

SEQ ID NO: 512715 - RNA, 22 nt, Chlamydophila pneumoniae CWL029
aucucgcuauuccauaaaaaug

SEQ ID NO: 512716 - RNA, 13 nt, Chlamydophila pneumoniae CWL029
aucucuccagcuu

SEQ ID NO: 512717 - RNA, 24 nt, Chlamydophila pneumoniae CWL029
aucucuaccgaacagagcgucuau

SEQ ID NO: 512718 - RNA, 21 nt, Chlamydophila pneumoniae CWL029
aucucuagggauaauuaaacu

SEQ ID NO: 512719 - RNA, 18 nt, Chlamydophila pneumoniae CWL029
aucucuaguucuagaaag

SEQ ID NO: 512720 - RNA, 23 nt, Chlamydophila pneumoniae CWL029
aucucuagggauaauuaaacucu

SEQ ID NO: 512721 - RNA, 22 nt, Chlamydophila pneumoniae CWL029
aucucguagcuauuuuugagga

SEQ ID NO: 512722 - RNA, 16 nt, Chlamydophila pneumoniae CWL029
aucuccugcagguuug

SEQ ID NO: 512723 - RNA, 20 nt, Chlamydophila pneumoniae CWL029
aucuccgauagagauucuuu

SEQ ID NO: 512724 - RNA, 22 nt, Chlamydophila pneumoniae CWL029
aucuccgcauggcguaaugcuc

SEQ ID NO: 512725 - RNA, 14 nt, Chlamydophila pneumoniae CWL029
aucuccaaagauca

SEQ ID NO: 512726 - RNA, 15 nt, Chlamydophila pneumoniae CWL029
aucuccaaagaucau

SEQ ID NO: 512727 - RNA, 17 nt, Chlamydophila pneumoniae CWL029
aucucauuccagcaucu

SEQ ID NO: 512728 - RNA, 18 nt, Chlamydophila pneumoniae CWL029
aucuccagaaauuuuuac

SEQ ID NO: 512729 - RNA, 19 nt, Chlamydophila pneumoniae CWL029
aucuccaaacauuuuuaag

SEQ ID NO: 512730 - RNA, 12 nt, Chlamydophila pneumoniae CWL029
aucucagugaac

SEQ ID NO: 512731 - RNA, 14 nt, Chlamydophila pneumoniae CWL029
aucucacuggcucc

SEQ ID NO: 512732 - RNA, 18 nt, Chlamydophila pneumoniae CWL029
aucucacuggcuccuaaa

SEQ ID NO: 512733 - RNA, 19 nt, Chlamydophila pneumoniae CWL029
aucucacuggcuccuaaac

SEQ ID NO: 512734 - RNA, 18 nt, Chlamydophila pneumoniae CWL029
aucucaaugcgauaacca

SEQ ID NO: 512735 - RNA, 17 nt, Chlamydophila pneumoniae CWL029
aucucacaaaagucucu

SEQ ID NO: 512736 - RNA, 22 nt, Chlamydophila pneumoniae CWL029
aucuaucugcaauuccgaagaa

SEQ ID NO: 512737 - RNA, 17 nt, Chlamydophila pneumoniae CWL029
aucuaugaaguccugau

SEQ ID NO: 512738 - RNA, 15 nt, Chlamydophila pneumoniae CWL029
aucuaugagaguaag

SEQ ID NO: 512739 - RNA, 20 nt, Chlamydophila pneumoniae CWL029
aucuauccuuaggugaaaua

SEQ ID NO: 512740 - RNA, 23 nt, Chlamydophila pneumoniae CWL029
aucuauagcauuguuuggcaguu

SEQ ID NO: 512741 - RNA, 18 nt, Chlamydophila pneumoniae CWL029
aucuauaggauuugcaua

SEQ ID NO: 512742 - RNA, 16 nt, Chlamydophila pneumoniae CWL029
aucuagaaagauuuau

SEQ ID NO: 512743 - RNA, 14 nt, Chlamydophila pneumoniae CWL029
aucuagaacauaca

SEQ ID NO: 512744 - RNA, 15 nt, Chlamydophila pneumoniae CWL029
aucuacucuuuaaaa

SEQ ID NO: 512745 - RNA, 17 nt, Chlamydophila pneumoniae CWL029
aucuaccgugaagauuu

SEQ ID NO: 512746 - RNA, 16 nt, Chlamydophila pneumoniae CWL029
aucuagagucucuuuc

SEQ ID NO: 512747 - RNA, 21 nt, Chlamydophila pneumoniae CWL029
aucuagaagcauucucaauuc

SEQ ID NO: 512748 - RNA, 15 nt, Chlamydophila pneumoniae CWL029
aucuaggucgauauc

SEQ ID NO: 512749 - RNA, 22 nt, Chlamydophila pneumoniae CWL029
aucuaggucgauaucccacaga

SEQ ID NO: 512750 - RNA, 13 nt, Chlamydophila pneumoniae CWL029
aucuauaaaugua

SEQ ID NO: 512751 - RNA, 18 nt, Chlamydophila pneumoniae CWL029
aucuauacccaguuguau

SEQ ID NO: 512752 - RNA, 17 nt, Chlamydophila pneumoniae CWL029
augccuuuggcaaucau

SEQ ID NO: 512753 - RNA, 21 nt, Chlamydophila pneumoniae CWL029
augccuggccaucaucaccag

SEQ ID NO: 512754 - RNA, 19 nt, Chlamydophila pneumoniae CWL029
augccucuuucauacuaaa

SEQ ID NO: 512755 - RNA, 19 nt, Chlamydophila pneumoniae CWL029
augccucaggucugcugag

SEQ ID NO: 512756 - RNA, 14 nt, Chlamydophila pneumoniae CWL029
augccugaaaacaa

SEQ ID NO: 512757 - RNA, 19 nt, Chlamydophila pneumoniae CWL029
augccugaaaacaaggcaa

SEQ ID NO: 512758 - RNA, 15 nt, Chlamydophila pneumoniae CWL029
augccgcaucuagaa

SEQ ID NO: 512759 - RNA, 12 nt, Chlamydophila pneumoniae CWL029
augcccuguucu

SEQ ID NO: 512760 - RNA, 15 nt, Chlamydophila pneumoniae CWL029
augccauuguagaga

SEQ ID NO: 512761 - RNA, 13 nt, Chlamydophila pneumoniae CWL029
augccaguuccua

SEQ ID NO: 512762 - RNA, 19 nt, Chlamydophila pneumoniae CWL029
augccaguuccuaaagcuu

SEQ ID NO: 512763 - RNA, 18 nt, Chlamydophila pneumoniae CWL029
augccauaaauacaggcc

SEQ ID NO: 512764 - RNA, 11 nt, Chlamydophila pneumoniae CWL029
augcccaaaca

SEQ ID NO: 512765 - RNA, 13 nt, Chlamydophila pneumoniae CWL029
augcccaaggaaa

SEQ ID NO: 512766 - RNA, 16 nt, Chlamydophila pneumoniae CWL029
augcaaugguugucuu

SEQ ID NO: 512767 - RNA, 12 nt, Chlamydophila pneumoniae CWL029
augcacaaaaua

SEQ ID NO: 512768 - RNA, 14 nt, Chlamydophila pneumoniae CWL029
augcacaaaauaaa

SEQ ID NO: 512769 - RNA, 15 nt, Chlamydophila pneumoniae CWL029
augcaauacuuuucu

SEQ ID NO: 512770 - RNA, 18 nt, Chlamydophila pneumoniae CWL029
augcaagugcgcuaccag

SEQ ID NO: 512771 - RNA, 14 nt, Chlamydophila pneumoniae CWL029
augcaagugcuuuc

SEQ ID NO: 512772 - RNA, 21 nt, Chlamydophila pneumoniae CWL029
augcaacagagucagaagcua

SEQ ID NO: 512773 - RNA, 16 nt, Chlamydophila pneumoniae CWL029
augcaacggagaaauu

SEQ ID NO: 512774 - RNA, 15 nt, Chlamydophila pneumoniae CWL029
augcaagcaacucuu

SEQ ID NO: 512775 - RNA, 14 nt, Chlamydophila pneumoniae CWL029
augauaaagccugc

SEQ ID NO: 512776 - RNA, 15 nt, Chlamydophila pneumoniae CWL029
augaucuuuaggaaa

SEQ ID NO: 512777 - RNA, 18 nt, Chlamydophila pneumoniae CWL029
augaguuuacuaacucug

SEQ ID NO: 512778 - RNA, 17 nt, Chlamydophila pneumoniae CWL029
augaugacauugcaaua

SEQ ID NO: 512779 - RNA, 16 nt, Chlamydophila pneumoniae CWL029
augaagucuucuuucc

SEQ ID NO: 512780 - RNA, 17 nt, Chlamydophila pneumoniae CWL029
augaaucacaucuaaag

SEQ ID NO: 512781 - RNA, 21 nt, Chlamydophila pneumoniae CWL029
augaaucgaagaacagaggau

SEQ ID NO: 512782 - RNA, 14 nt, Chlamydophila pneumoniae CWL029
augaauaccagaag

SEQ ID NO: 512783 - RNA, 15 nt, Chlamydophila pneumoniae CWL029
augaaugauuuccau

SEQ ID NO: 512784 - RNA, 14 nt, Chlamydophila pneumoniae CWL029
augaaugacugcag

SEQ ID NO: 512785 - RNA, 17 nt, Chlamydophila pneumoniae CWL029
augaauugucaucucau

SEQ ID NO: 512786 - RNA, 17 nt, Chlamydophila pneumoniae CWL029
augacauugcaauacau

SEQ ID NO: 512787 - RNA, 16 nt, Chlamydophila pneumoniae CWL029
augaccaagaacauag

SEQ ID NO: 512788 - RNA, 17 nt, Chlamydophila pneumoniae CWL029
augagaguuucuaaugu

SEQ ID NO: 512789 - RNA, 16 nt, Chlamydophila pneumoniae CWL029
augagaucagcuccca

SEQ ID NO: 512790 - RNA, 15 nt, Chlamydophila pneumoniae CWL029
augagauccaaagcc

SEQ ID NO: 512791 - RNA, 23 nt, Chlamydophila pneumoniae CWL029
augagauccaaagccugaaaaau

SEQ ID NO: 512792 - RNA, 18 nt, Chlamydophila pneumoniae CWL029
augagagagcucuucagc

SEQ ID NO: 512793 - RNA, 13 nt, Chlamydophila pneumoniae CWL029
augagagagcucu

SEQ ID NO: 512794 - RNA, 17 nt, Chlamydophila pneumoniae CWL029
augagaauuuucaugau

SEQ ID NO: 512795 - RNA, 13 nt, Chlamydophila pneumoniae CWL029
augagaugggcua

SEQ ID NO: 512796 - RNA, 16 nt, Chlamydophila pneumoniae CWL029
augaccuuuagcugcu

SEQ ID NO: 512797 - RNA, 20 nt, Chlamydophila pneumoniae CWL029
augagaaauacgcuuuucuu

SEQ ID NO: 512798 - RNA, 22 nt, Chlamydophila pneumoniae CWL029
augacuuuuguugcaauuccau

SEQ ID NO: 512799 - RNA, 12 nt, Chlamydophila pneumoniae CWL029
augagaaaaaga

SEQ ID NO: 512800 - RNA, 14 nt, Chlamydophila pneumoniae CWL029
augagaaaaagaau

SEQ ID NO: 512801 - RNA, 18 nt, Chlamydophila pneumoniae CWL029
augaaauaguguuucuuu

SEQ ID NO: 512802 - RNA, 20 nt, Chlamydophila pneumoniae CWL029
augaacugccugagaaaagu

SEQ ID NO: 512803 - RNA, 18 nt, Chlamydophila pneumoniae CWL029
augaagaacuacucucau

SEQ ID NO: 512804 - RNA, 14 nt, Chlamydophila pneumoniae CWL029
augaagauaaaauc

SEQ ID NO: 512805 - RNA, 15 nt, Chlamydophila pneumoniae CWL029
augaagauaaaaucu

SEQ ID NO: 512806 - RNA, 18 nt, Chlamydophila pneumoniae CWL029
aucuuuucuuucuaagau

SEQ ID NO: 512807 - RNA, 15 nt, Chlamydophila pneumoniae CWL029
aucuuuucaaaagaa

SEQ ID NO: 512808 - RNA, 17 nt, Chlamydophila pneumoniae CWL029
aucuuuccucucaugaa

SEQ ID NO: 512809 - RNA, 21 nt, Chlamydophila pneumoniae CWL029
aucuuuccucucaugaaauuu

SEQ ID NO: 512810 - RNA, 16 nt, Chlamydophila pneumoniae CWL029
aucuuuuacagacuga

SEQ ID NO: 512811 - RNA, 21 nt, Chlamydophila pneumoniae CWL029
aucuuucauucccuuuuucca

SEQ ID NO: 512812 - RNA, 14 nt, Chlamydophila pneumoniae CWL029
aucuuucaucaaug

SEQ ID NO: 512813 - RNA, 22 nt, Chlamydophila pneumoniae CWL029
aucuugaugaccucuauaccua

SEQ ID NO: 512814 - RNA, 15 nt, Chlamydophila pneumoniae CWL029
aucuugauuaggaac

SEQ ID NO: 512815 - RNA, 17 nt, Chlamydophila pneumoniae CWL029
aucuuuaaauucgccaa

SEQ ID NO: 512816 - RNA, 18 nt, Chlamydophila pneumoniae CWL029
aucuuuaaauucgccaaa

SEQ ID NO: 512817 - RNA, 14 nt, Chlamydophila pneumoniae CWL029
aucuugauaaaaga

SEQ ID NO: 512818 - RNA, 15 nt, Chlamydophila pneumoniae CWL029
aucuucuuugccaau

SEQ ID NO: 512819 - RNA, 13 nt, Chlamydophila pneumoniae CWL029
aucuugaaaguac

SEQ ID NO: 512820 - RNA, 13 nt, Chlamydophila pneumoniae CWL029
aucuugaacagag

SEQ ID NO: 512821 - RNA, 23 nt, Chlamydophila pneumoniae CWL029
aucuugaacagagacuuccucuu

SEQ ID NO: 512822 - RNA, 15 nt, Chlamydophila pneumoniae CWL029
aucugcguuuaaggg

SEQ ID NO: 512823 - RNA, 18 nt, Chlamydophila pneumoniae CWL029
aucuggggcuuccagaaa

SEQ ID NO: 512824 - RNA, 13 nt, Chlamydophila pneumoniae CWL029
aucuucugaaauc

SEQ ID NO: 512825 - RNA, 17 nt, Chlamydophila pneumoniae CWL029
aucuucucuuaugaagu

SEQ ID NO: 512826 - RNA, 19 nt, Chlamydophila pneumoniae CWL029
aucuucuggguucuccaca

SEQ ID NO: 512827 - RNA, 15 nt, Chlamydophila pneumoniae CWL029
aucuucuuagccaaa

SEQ ID NO: 512828 - RNA, 19 nt, Chlamydophila pneumoniae CWL029
aucuucuuagccaaaauuu

SEQ ID NO: 512829 - RNA, 22 nt, Chlamydophila pneumoniae CWL029
aucuucuucuggcugagagaag

SEQ ID NO: 512830 - RNA, 18 nt, Chlamydophila pneumoniae CWL029
aucuucuuggcuuucccc

SEQ ID NO: 512831 - RNA, 23 nt, Chlamydophila pneumoniae CWL029
aucuucuuucuaucgauagccau

SEQ ID NO: 512832 - RNA, 19 nt, Chlamydophila pneumoniae CWL029
auguccuucaaaauguuua

SEQ ID NO: 512833 - RNA, 20 nt, Chlamydophila pneumoniae CWL029
augucuuguugcaugggaau

SEQ ID NO: 512834 - RNA, 19 nt, Chlamydophila pneumoniae CWL029
augugacgcaagagacaag

SEQ ID NO: 512835 - RNA, 16 nt, Chlamydophila pneumoniae CWL029
augucuuugaauauau

SEQ ID NO: 512836 - RNA, 16 nt, Chlamydophila pneumoniae CWL029
auguguuuccuuuucu

SEQ ID NO: 512837 - RNA, 21 nt, Chlamydophila pneumoniae CWL029
auguuaagcguauagaauaga

SEQ ID NO: 512838 - RNA, 15 nt, Chlamydophila pneumoniae CWL029
auguuaaucuaauuu

SEQ ID NO: 512839 - RNA, 18 nt, Chlamydophila pneumoniae CWL029
augugcuuuugguucuug

SEQ ID NO: 512840 - RNA, 17 nt, Chlamydophila pneumoniae CWL029
auguccauuaauauccc

SEQ ID NO: 512841 - RNA, 15 nt, Chlamydophila pneumoniae CWL029
auguauaaacuccac

SEQ ID NO: 512842 - RNA, 17 nt, Chlamydophila pneumoniae CWL029
auguaaucccagauuuu

SEQ ID NO: 512843 - RNA, 23 nt, Chlamydophila pneumoniae CWL029
auguagguaugacucguguggau

SEQ ID NO: 512844 - RNA, 12 nt, Chlamydophila pneumoniae CWL029
auguaguaaauu

SEQ ID NO: 512845 - RNA, 16 nt, Chlamydophila pneumoniae CWL029
auguagcuguuccaag

SEQ ID NO: 512846 - RNA, 17 nt, Chlamydophila pneumoniae CWL029
auguaaaaaauuauuug

SEQ ID NO: 512847 - RNA, 13 nt, Chlamydophila pneumoniae CWL029
augguaauuuuuc

SEQ ID NO: 512848 - RNA, 14 nt, Chlamydophila pneumoniae CWL029
augguaauuuuuca

SEQ ID NO: 512849 - RNA, 22 nt, Chlamydophila pneumoniae CWL029
auggucucgaaauccuaaaaag

SEQ ID NO: 512850 - RNA, 17 nt, Chlamydophila pneumoniae CWL029
auggugaagaauaauag

SEQ ID NO: 512851 - RNA, 23 nt, Chlamydophila pneumoniae CWL029
auggguuuccuggucuccagaag

SEQ ID NO: 512852 - RNA, 22 nt, Chlamydophila pneumoniae CWL029
auggggauuaucccaaacuucu

SEQ ID NO: 512853 - RNA, 15 nt, Chlamydophila pneumoniae CWL029
augggaucggucuuu

SEQ ID NO: 512854 - RNA, 15 nt, Chlamydophila pneumoniae CWL029
augggaauaaaaaug

SEQ ID NO: 512855 - RNA, 15 nt, Chlamydophila pneumoniae CWL029
augggaauuugauuu

SEQ ID NO: 512856 - RNA, 16 nt, Chlamydophila pneumoniae CWL029
augggagaagcuaagg

SEQ ID NO: 512857 - RNA, 16 nt, Chlamydophila pneumoniae CWL029
auggcaucuaagccag

SEQ ID NO: 512858 - RNA, 18 nt, Chlamydophila pneumoniae CWL029
auggcagcuuggauggga

SEQ ID NO: 512859 - RNA, 18 nt, Chlamydophila pneumoniae CWL029
augcgcagcucggaugga

SEQ ID NO: 512860 - RNA, 16 nt, Chlamydophila pneumoniae CWL029
auuaauaucccaguuu

SEQ ID NO: 512861 - RNA, 20 nt, Chlamydophila pneumoniae CWL029
auuaauaucccaguuuuccc

SEQ ID NO: 512862 - RNA, 13 nt, Chlamydophila pneumoniae CWL029
auuaauaaauuua

SEQ ID NO: 512863 - RNA, 17 nt, Chlamydophila pneumoniae CWL029
auuaauacuuugccaac

SEQ ID NO: 512864 - RNA, 16 nt, Chlamydophila pneumoniae CWL029
auuaauaaauuuaucu

SEQ ID NO: 512865 - RNA, 13 nt, Chlamydophila pneumoniae CWL029
auuaagucaccuu

SEQ ID NO: 512866 - RNA, 14 nt, Chlamydophila pneumoniae CWL029
auuaagaauggaug

SEQ ID NO: 512867 - RNA, 17 nt, Chlamydophila pneumoniae CWL029
auuaagacucaauacuu

SEQ ID NO: 512868 - RNA, 20 nt, Chlamydophila pneumoniae CWL029
auuaagacucaauacuucag

SEQ ID NO: 512869 - RNA, 16 nt, Chlamydophila pneumoniae CWL029
auuaagauaaacagca

SEQ ID NO: 512870 - RNA, 11 nt, Chlamydophila pneumoniae CWL029
auuaagauauc

SEQ ID NO: 512871 - RNA, 18 nt, Chlamydophila pneumoniae CWL029
auuaacuuuauacagcug

SEQ ID NO: 512872 - RNA, 12 nt, Chlamydophila pneumoniae CWL029
auuaacuuuaua

SEQ ID NO: 512873 - RNA, 22 nt, Chlamydophila pneumoniae CWL029
auuaacuccucggcaacuacug

SEQ ID NO: 512874 - RNA, 20 nt, Chlamydophila pneumoniae CWL029
auuaacagagcgccuccacc

SEQ ID NO: 512875 - RNA, 19 nt, Chlamydophila pneumoniae CWL029
auuaaaucguauugacuuu

SEQ ID NO: 512876 - RNA, 22 nt, Chlamydophila pneumoniae CWL029
auuaaaucguauugacuuuggu

SEQ ID NO: 512877 - RNA, 18 nt, Chlamydophila pneumoniae CWL029
auuaaauucuuuucuaca

SEQ ID NO: 512878 - RNA, 17 nt, Chlamydophila pneumoniae CWL029
auuaaagugaaagcaac

SEQ ID NO: 512879 - RNA, 18 nt, Chlamydophila pneumoniae CWL029
auuaaauauauaaagaac

SEQ ID NO: 512880 - RNA, 16 nt, Chlamydophila pneumoniae CWL029
auuaaacgaauacugu

SEQ ID NO: 512881 - RNA, 17 nt, Chlamydophila pneumoniae CWL029
auuaaaaauuuaaaaga

SEQ ID NO: 512882 - RNA, 21 nt, Chlamydophila pneumoniae CWL029
auuaaaaguuccaaaucucaa

SEQ ID NO: 512883 - RNA, 15 nt, Chlamydophila pneumoniae CWL029
auuaaaaauuuaaaa

SEQ ID NO: 512884 - RNA, 15 nt, Chlamydophila pneumoniae CWL029
auguugucucauggg

SEQ ID NO: 512885 - RNA, 22 nt, Chlamydophila pneumoniae CWL029
auguuuguaguguugaauaaga

SEQ ID NO: 512886 - RNA, 20 nt, Chlamydophila pneumoniae CWL029
auguuuguaguguugaauaa

SEQ ID NO: 512887 - RNA, 12 nt, Chlamydophila pneumoniae CWL029
auuauucuagag

SEQ ID NO: 512888 - RNA, 12 nt, Chlamydophila pneumoniae CWL029
auuauucccuaa

SEQ ID NO: 512889 - RNA, 13 nt, Chlamydophila pneumoniae CWL029
auuauugaauaag

SEQ ID NO: 512890 - RNA, 17 nt, Chlamydophila pneumoniae CWL029
auuaugcccaaggaaaa

SEQ ID NO: 512891 - RNA, 18 nt, Chlamydophila pneumoniae CWL029
auuaugcccaaggaaaaa

SEQ ID NO: 512892 - RNA, 19 nt, Chlamydophila pneumoniae CWL029
auuaugcccaaggaaaaac

SEQ ID NO: 512893 - RNA, 20 nt, Chlamydophila pneumoniae CWL029
auuaugcccaaggaaaaaca

SEQ ID NO: 512894 - RNA, 17 nt, Chlamydophila pneumoniae CWL029
auuauguauaaacucca

SEQ ID NO: 512895 - RNA, 12 nt, Chlamydophila pneumoniae CWL029
auuauuaaacuc

SEQ ID NO: 512896 - RNA, 17 nt, Chlamydophila pneumoniae CWL029
auuaucaagaaauucuu

SEQ ID NO: 512897 - RNA, 16 nt, Chlamydophila pneumoniae CWL029
auuaucccaaacuucu

SEQ ID NO: 512898 - RNA, 17 nt, Chlamydophila pneumoniae CWL029
auuaucccaaacuucuu

SEQ ID NO: 512899 - RNA, 12 nt, Chlamydophila pneumoniae CWL029
auuaucuccaaa

SEQ ID NO: 512900 - RNA, 19 nt, Chlamydophila pneumoniae CWL029
auuaucguuucaguuuuau

SEQ ID NO: 512901 - RNA, 14 nt, Chlamydophila pneumoniae CWL029
auuaucuaagaaua

SEQ ID NO: 512902 - RNA, 14 nt, Chlamydophila pneumoniae CWL029
auuaucuuguuucg

SEQ ID NO: 512903 - RNA, 17 nt, Chlamydophila pneumoniae CWL029
auuaucuuguuucguaa

SEQ ID NO: 512904 - RNA, 17 nt, Chlamydophila pneumoniae CWL029
auucaacacggacacua

SEQ ID NO: 512905 - RNA, 23 nt, Chlamydophila pneumoniae CWL029
auucaaauauaugaguuuacuaa

SEQ ID NO: 512906 - RNA, 15 nt, Chlamydophila pneumoniae CWL029
auuauuucuaaaaaa

SEQ ID NO: 512907 - RNA, 17 nt, Chlamydophila pneumoniae CWL029
auuauuucuaaaaaaua

SEQ ID NO: 512908 - RNA, 12 nt, Chlamydophila pneumoniae CWL029
auuauuuuaaag

SEQ ID NO: 512909 - RNA, 21 nt, Chlamydophila pneumoniae CWL029
auuauuuguuucuuccauaca

SEQ ID NO: 512910 - RNA, 15 nt, Chlamydophila pneumoniae CWL029
auucaaaaucaaagu

SEQ ID NO: 512911 - RNA, 20 nt, Chlamydophila pneumoniae CWL029
auucaaacuccuuuuaaaau

SEQ ID NO: 512912 - RNA, 21 nt, Chlamydophila pneumoniae CWL029
auucaaacuccuuuuaaaauu

SEQ ID NO: 512913 - RNA, 18 nt, Chlamydophila pneumoniae CWL029
auucaaaauagaagccac

SEQ ID NO: 512914 - RNA, 15 nt, Chlamydophila pneumoniae CWL029
auucacaucuuaaaa

SEQ ID NO: 512915 - RNA, 19 nt, Chlamydophila pneumoniae CWL029
auucacaucuuaaaaacua

SEQ ID NO: 512916 - RNA, 15 nt, Chlamydophila pneumoniae CWL029
auucaaugcagcuaa

SEQ ID NO: 512917 - RNA, 15 nt, Chlamydophila pneumoniae CWL029
auucacaaaucuucc

SEQ ID NO: 512918 - RNA, 18 nt, Chlamydophila pneumoniae CWL029
auucacaaaucuuccccu

SEQ ID NO: 512919 - RNA, 18 nt, Chlamydophila pneumoniae CWL029
auucacgccuauagauuc

SEQ ID NO: 512920 - RNA, 12 nt, Chlamydophila pneumoniae CWL029
auucacuggaau

SEQ ID NO: 512921 - RNA, 14 nt, Chlamydophila pneumoniae CWL029
auucacuggaauga

SEQ ID NO: 512922 - RNA, 19 nt, Chlamydophila pneumoniae CWL029
auucagauggucagucucg

SEQ ID NO: 512923 - RNA, 16 nt, Chlamydophila pneumoniae CWL029
auuaguuucacauagu

SEQ ID NO: 512924 - RNA, 12 nt, Chlamydophila pneumoniae CWL029
auuaguuuguuu

SEQ ID NO: 512925 - RNA, 14 nt, Chlamydophila pneumoniae CWL029
auuauaaauagaaa

SEQ ID NO: 512926 - RNA, 22 nt, Chlamydophila pneumoniae CWL029
auuagggaaaggucggggagaa

SEQ ID NO: 512927 - RNA, 20 nt, Chlamydophila pneumoniae CWL029
auuaguaaaugccucuuuca

SEQ ID NO: 512928 - RNA, 14 nt, Chlamydophila pneumoniae CWL029
auuaguaacuaaau

SEQ ID NO: 512929 - RNA, 20 nt, Chlamydophila pneumoniae CWL029
auuaguagcuauucucaaau

SEQ ID NO: 512930 - RNA, 17 nt, Chlamydophila pneumoniae CWL029
auuagaaaagauaaaac

SEQ ID NO: 512931 - RNA, 15 nt, Chlamydophila pneumoniae CWL029
auuagaaucucugcc

SEQ ID NO: 512932 - RNA, 17 nt, Chlamydophila pneumoniae CWL029
auuagagccccaacccu

SEQ ID NO: 512933 - RNA, 15 nt, Chlamydophila pneumoniae CWL029
auuagaguuugguuu

SEQ ID NO: 512934 - RNA, 20 nt, Chlamydophila pneumoniae CWL029
auuagcccuacgaauccaaa

SEQ ID NO: 512935 - RNA, 15 nt, Chlamydophila pneumoniae CWL029
auuagcgaguacuuu

SEQ ID NO: 512936 - RNA, 13 nt, Chlamydophila pneumoniae CWL029
auuagcuaaauca

SEQ ID NO: 512937 - RNA, 18 nt, Chlamydophila pneumoniae CWL029
auuacaucuaacucuaau

SEQ ID NO: 512938 - RNA, 18 nt, Chlamydophila pneumoniae CWL029
auuacagaaaggcuuuuc

SEQ ID NO: 512939 - RNA, 19 nt, Chlamydophila pneumoniae CWL029
auuacacaacucuuucccu

SEQ ID NO: 512940 - RNA, 14 nt, Chlamydophila pneumoniae CWL029
auuaccugcuaaac

SEQ ID NO: 512941 - RNA, 17 nt, Chlamydophila pneumoniae CWL029
auuaccuuaucgccaac

SEQ ID NO: 512942 - RNA, 15 nt, Chlamydophila pneumoniae CWL029
auuaccuugagacaa

SEQ ID NO: 512943 - RNA, 17 nt, Chlamydophila pneumoniae CWL029
auuaccguuuccuccuc

SEQ ID NO: 512944 - RNA, 19 nt, Chlamydophila pneumoniae CWL029
auuaccuccuauuuucuua

SEQ ID NO: 512945 - RNA, 17 nt, Chlamydophila pneumoniae CWL029
auuacuagaucccucaa

SEQ ID NO: 512946 - RNA, 17 nt, Chlamydophila pneumoniae CWL029
auuacucgcucugcacg

SEQ ID NO: 512947 - RNA, 23 nt, Chlamydophila pneumoniae CWL029
auuacggaaaauacagccagcag

SEQ ID NO: 512948 - RNA, 21 nt, Chlamydophila pneumoniae CWL029
auuguaaaucauuggaaccau

SEQ ID NO: 512949 - RNA, 16 nt, Chlamydophila pneumoniae CWL029
auuguaauuuccuuag

SEQ ID NO: 512950 - RNA, 22 nt, Chlamydophila pneumoniae CWL029
auuguaauuucuaaauagaaaa

SEQ ID NO: 512951 - RNA, 23 nt, Chlamydophila pneumoniae CWL029
auugugcauuaccuccuauuuuc

SEQ ID NO: 512952 - RNA, 17 nt, Chlamydophila pneumoniae CWL029
auugugcucaauacaga

SEQ ID NO: 512953 - RNA, 12 nt, Chlamydophila pneumoniae CWL029
auugucuuaaaa

SEQ ID NO: 512954 - RNA, 13 nt, Chlamydophila pneumoniae CWL029
auuguuguugcau

SEQ ID NO: 512955 - RNA, 21 nt, Chlamydophila pneumoniae CWL029
auuguuuaaguccuucuuccc

SEQ ID NO: 512956 - RNA, 15 nt, Chlamydophila pneumoniae CWL029
auuguucuugaaguu

SEQ ID NO: 512957 - RNA, 23 nt, Chlamydophila pneumoniae CWL029
auuguucuuuacuacaugaggau

SEQ ID NO: 512958 - RNA, 15 nt, Chlamydophila pneumoniae CWL029
auuguucaaaaauag

SEQ ID NO: 512959 - RNA, 13 nt, Chlamydophila pneumoniae CWL029
auuuaaauaaaac

SEQ ID NO: 512960 - RNA, 17 nt, Chlamydophila pneumoniae CWL029
auuuaaauauaaauuua

SEQ ID NO: 512961 - RNA, 15 nt, Chlamydophila pneumoniae CWL029
auuuaaauauagaaa

SEQ ID NO: 512962 - RNA, 15 nt, Chlamydophila pneumoniae CWL029
auuuaacaacaugcg

SEQ ID NO: 512963 - RNA, 15 nt, Chlamydophila pneumoniae CWL029
auuuagagagaaaca

SEQ ID NO: 512964 - RNA, 21 nt, Chlamydophila pneumoniae CWL029
auuuagauaaagaaagcgcuc

SEQ ID NO: 512965 - RNA, 18 nt, Chlamydophila pneumoniae CWL029
auuuagauuaaagagacu

SEQ ID NO: 512966 - RNA, 11 nt, Chlamydophila pneumoniae CWL029
auuuagaaauc

SEQ ID NO: 512967 - RNA, 14 nt, Chlamydophila pneumoniae CWL029
auuucaggagcucc

SEQ ID NO: 512968 - RNA, 14 nt, Chlamydophila pneumoniae CWL029
auuucaaagaugca

SEQ ID NO: 512969 - RNA, 17 nt, Chlamydophila pneumoniae CWL029
auuuauuuugucuuuuu

SEQ ID NO: 512970 - RNA, 17 nt, Chlamydophila pneumoniae CWL029
auugcuugcgcagcuuc

SEQ ID NO: 512971 - RNA, 14 nt, Chlamydophila pneumoniae CWL029
auugcuuucccccu

SEQ ID NO: 512972 - RNA, 15 nt, Chlamydophila pneumoniae CWL029
auugcuucuuccaag

SEQ ID NO: 512973 - RNA, 18 nt, Chlamydophila pneumoniae CWL029
auuggaggauaaaugagu

SEQ ID NO: 512974 - RNA, 15 nt, Chlamydophila pneumoniae CWL029
auuggaugauagcua

SEQ ID NO: 512975 - RNA, 22 nt, Chlamydophila pneumoniae CWL029
auugggagguucgcagaacuuc

SEQ ID NO: 512976 - RNA, 13 nt, Chlamydophila pneumoniae CWL029
auugccuucuucu

SEQ ID NO: 512977 - RNA, 21 nt, Chlamydophila pneumoniae CWL029
auugccuucuucuuguucuuc

SEQ ID NO: 512978 - RNA, 21 nt, Chlamydophila pneumoniae CWL029
auugcuaucaaagacucauga

SEQ ID NO: 512979 - RNA, 22 nt, Chlamydophila pneumoniae CWL029
auugcucguauuagaguuucuu

SEQ ID NO: 512980 - RNA, 17 nt, Chlamydophila pneumoniae CWL029
auugcacucaucuugag

SEQ ID NO: 512981 - RNA, 19 nt, Chlamydophila pneumoniae CWL029
auugccgugaguugcaauu

SEQ ID NO: 512982 - RNA, 19 nt, Chlamydophila pneumoniae CWL029
auugcaaaaaugaaagaaa

SEQ ID NO: 512983 - RNA, 14 nt, Chlamydophila pneumoniae CWL029
auugcaaaauuuaa

SEQ ID NO: 512984 - RNA, 14 nt, Chlamydophila pneumoniae CWL029
auugcaaaguacua

SEQ ID NO: 512985 - RNA, 17 nt, Chlamydophila pneumoniae CWL029
auugcaaaguacuacaa

SEQ ID NO: 512986 - RNA, 22 nt, Chlamydophila pneumoniae CWL029
auucuucagaaucuuugugaua

SEQ ID NO: 512987 - RNA, 19 nt, Chlamydophila pneumoniae CWL029
auugaaaccguaacugagg

SEQ ID NO: 512988 - RNA, 23 nt, Chlamydophila pneumoniae CWL029
auugaaacuuuuuuucuucucua

SEQ ID NO: 512989 - RNA, 15 nt, Chlamydophila pneumoniae CWL029
auugacugcuagagu

SEQ ID NO: 512990 - RNA, 22 nt, Chlamydophila pneumoniae CWL029
auugaauaagcuuuccucucca

SEQ ID NO: 512991 - RNA, 13 nt, Chlamydophila pneumoniae CWL029
auugaaucagauu

SEQ ID NO: 512992 - RNA, 21 nt, Chlamydophila pneumoniae CWL029
auugacgacgacgucuucuua

SEQ ID NO: 512993 - RNA, 19 nt, Chlamydophila pneumoniae CWL029
auugacguagacgauuuuc

SEQ ID NO: 512994 - RNA, 19 nt, Chlamydophila pneumoniae CWL029
auugacuaucgcaaauuuc

SEQ ID NO: 512995 - RNA, 20 nt, Chlamydophila pneumoniae CWL029
auucuaggggagguaaaaua

SEQ ID NO: 512996 - RNA, 19 nt, Chlamydophila pneumoniae CWL029
auucuaggccuaaagaauu

SEQ ID NO: 512997 - RNA, 17 nt, Chlamydophila pneumoniae CWL029
auucaggacccuuuucc

SEQ ID NO: 512998 - RNA, 11 nt, Chlamydophila pneumoniae CWL029
auucugucuau

SEQ ID NO: 512999 - RNA, 20 nt, Chlamydophila pneumoniae CWL029
auucuuaaaaagcuaaacaa

SEQ ID NO: 513000 - RNA, 19 nt, Chlamydophila pneumoniae CWL029
auucuuaauauaaaagaag

SEQ ID NO: 513001 - RNA, 18 nt, Chlamydophila pneumoniae CWL029
auucugcuuuaucucuau

SEQ ID NO: 513002 - RNA, 18 nt, Chlamydophila pneumoniae CWL029
auuuuauuaguuuugaaa

SEQ ID NO: 513003 - RNA, 21 nt, Chlamydophila pneumoniae CWL029
auuuucagccugucuauaaaa

SEQ ID NO: 513004 - RNA, 23 nt, Chlamydophila pneumoniae CWL029
auuuucagaagagaaacacaaau

SEQ ID NO: 513005 - RNA, 21 nt, Chlamydophila pneumoniae CWL029
auuuuacuugcgauacaauaa

SEQ ID NO: 513006 - RNA, 13 nt, Chlamydophila pneumoniae CWL029
auuuuaaagucac

SEQ ID NO: 513007 - RNA, 14 nt, Chlamydophila pneumoniae CWL029
auuuuaaagccucc

SEQ ID NO: 513008 - RNA, 23 nt, Chlamydophila pneumoniae CWL029
auuuucaugggcagcgauauaag

SEQ ID NO: 513009 - RNA, 17 nt, Chlamydophila pneumoniae CWL029
auuuucucugagcagcu

SEQ ID NO: 513010 - RNA, 20 nt, Chlamydophila pneumoniae CWL029
auuuucuggugccuguaauu

SEQ ID NO: 513011 - RNA, 21 nt, Chlamydophila pneumoniae CWL029
auuuucuuaugaccaagaaca

SEQ ID NO: 513012 - RNA, 19 nt, Chlamydophila pneumoniae CWL029
auuuugcaaaugaaaagag

SEQ ID NO: 513013 - RNA, 14 nt, Chlamydophila pneumoniae CWL029
auuugauucccgga

SEQ ID NO: 513014 - RNA, 17 nt, Chlamydophila pneumoniae CWL029
auuuuaaacuuacagcc

SEQ ID NO: 513015 - RNA, 16 nt, Chlamydophila pneumoniae CWL029
auuuuaaaaucuccuc

SEQ ID NO: 513016 - RNA, 18 nt, Chlamydophila pneumoniae CWL029
auuuuaaaaucuccucuc

SEQ ID NO: 513017 - RNA, 23 nt, Chlamydophila pneumoniae CWL029
auuugucuagugaagcugcuucu

SEQ ID NO: 513018 - RNA, 19 nt, Chlamydophila pneumoniae CWL029
auuuguccuuugcuaagaa

SEQ ID NO: 513019 - RNA, 22 nt, Chlamydophila pneumoniae CWL029
auuugugggacucuuccuucua

SEQ ID NO: 513020 - RNA, 11 nt, Chlamydophila pneumoniae CWL029
auuucuucuuc

SEQ ID NO: 513021 - RNA, 18 nt, Chlamydophila pneumoniae CWL029
auuucuugacuuguuucu

SEQ ID NO: 513022 - RNA, 23 nt, Chlamydophila pneumoniae CWL029
auuucuugagucugaacauucuu

SEQ ID NO: 513023 - RNA, 13 nt, Chlamydophila pneumoniae CWL029
auuugaacaugag

SEQ ID NO: 513024 - RNA, 16 nt, Chlamydophila pneumoniae CWL029
auuugaacaugaggau

SEQ ID NO: 513025 - RNA, 21 nt, Chlamydophila pneumoniae CWL029
auuugaauaaaggacauagac

SEQ ID NO: 513026 - RNA, 17 nt, Chlamydophila pneumoniae CWL029
auuucauguaagaaugu

SEQ ID NO: 513027 - RNA, 23 nt, Chlamydophila pneumoniae CWL029
auuucuaaauagaaaacauagag

SEQ ID NO: 513028 - RNA, 13 nt, Chlamydophila pneumoniae CWL029
auuucuauuauuu

SEQ ID NO: 513029 - RNA, 15 nt, Chlamydophila pneumoniae CWL029
auuucuccagcagcu

SEQ ID NO: 513030 - RNA, 19 nt, Chlamydophila pneumoniae CWL029
auuucuccgucaagaacaa

SEQ ID NO: 513031 - RNA, 15 nt, Chlamydophila pneumoniae CWL029
caaaagaauuaagaa

SEQ ID NO: 513032 - RNA, 21 nt, Chlamydophila pneumoniae CWL029
caaaagaauuaagaagaagcu

SEQ ID NO: 513033 - RNA, 18 nt, Chlamydophila pneumoniae CWL029
caaaagaaaucaaacauu

SEQ ID NO: 513034 - RNA, 21 nt, Chlamydophila pneumoniae CWL029
caaaagaauuccuaaaacgag

SEQ ID NO: 513035 - RNA, 16 nt, Chlamydophila pneumoniae CWL029
caaaacauaaccuccu

SEQ ID NO: 513036 - RNA, 14 nt, Chlamydophila pneumoniae CWL029
caaaacaaaagcca

SEQ ID NO: 513037 - RNA, 21 nt, Chlamydophila pneumoniae CWL029
caaaaaucgugcuuagagccu

SEQ ID NO: 513038 - RNA, 10 nt, Chlamydophila pneumoniae CWL029
caaaaauucc

SEQ ID NO: 513039 - RNA, 20 nt, Chlamydophila pneumoniae CWL029
caaaaaguugaggaaaggag

SEQ ID NO: 513040 - RNA, 17 nt, Chlamydophila pneumoniae CWL029
caaaaagcuucuuucuu

SEQ ID NO: 513041 - RNA, 21 nt, Chlamydophila pneumoniae CWL029
caaaaaggacucuuucuauag

SEQ ID NO: 513042 - RNA, 20 nt, Chlamydophila pneumoniae CWL029
caaaaagcuucuuucuuacu

SEQ ID NO: 513043 - RNA, 13 nt, Chlamydophila pneumoniae CWL029
caaaaaaugcucc

SEQ ID NO: 513044 - RNA, 15 nt, Chlamydophila pneumoniae CWL029
caaaaaaguaacuau

SEQ ID NO: 513045 - RNA, 15 nt, Chlamydophila pneumoniae CWL029
auuuuuugagaaaua

SEQ ID NO: 513046 - RNA, 14 nt, Chlamydophila pneumoniae CWL029
auuuuuucauuguu

SEQ ID NO: 513047 - RNA, 14 nt, Chlamydophila pneumoniae CWL029
auuuuuuccuuaau

SEQ ID NO: 513048 - RNA, 16 nt, Chlamydophila pneumoniae CWL029
auuuuuucuguuccug

SEQ ID NO: 513049 - RNA, 19 nt, Chlamydophila pneumoniae CWL029
caaaaaagagcccaaaaac

SEQ ID NO: 513050 - RNA, 17 nt, Chlamydophila pneumoniae CWL029
caaaaaagggaucuccu

SEQ ID NO: 513051 - RNA, 14 nt, Chlamydophila pneumoniae CWL029
auuuuucuauaaua

SEQ ID NO: 513052 - RNA, 14 nt, Chlamydophila pneumoniae CWL029
auuuuuccuccucc

SEQ ID NO: 513053 - RNA, 17 nt, Chlamydophila pneumoniae CWL029
auuuuuccuucaacaca

SEQ ID NO: 513054 - RNA, 21 nt, Chlamydophila pneumoniae CWL029
auuuuucgagaauauacagau

SEQ ID NO: 513055 - RNA, 14 nt, Chlamydophila pneumoniae CWL029
auuuuuccagaaau

SEQ ID NO: 513056 - RNA, 12 nt, Chlamydophila pneumoniae CWL029
auuuuuaaaaug

SEQ ID NO: 513057 - RNA, 12 nt, Chlamydophila pneumoniae CWL029
auuuuuaaauac

SEQ ID NO: 513058 - RNA, 14 nt, Chlamydophila pneumoniae CWL029
auuuuuaaauacag

SEQ ID NO: 513059 - RNA, 15 nt, Chlamydophila pneumoniae CWL029
auuuuuaaauacaga

SEQ ID NO: 513060 - RNA, 13 nt, Chlamydophila pneumoniae CWL029
auuuuugcagagu

SEQ ID NO: 513061 - RNA, 23 nt, Chlamydophila pneumoniae CWL029
auuuuuuaaccgagcuuuuugcu

SEQ ID NO: 513062 - RNA, 23 nt, Chlamydophila pneumoniae CWL029
caagcauaguacgauccaucuca

SEQ ID NO: 513063 - RNA, 18 nt, Chlamydophila pneumoniae CWL029
caagcauuguuuguccua

SEQ ID NO: 513064 - RNA, 22 nt, Chlamydophila pneumoniae CWL029
caagcaggugugugguaaaaau

SEQ ID NO: 513065 - RNA, 21 nt, Chlamydophila pneumoniae CWL029
caagcagauagagcuucuuua

SEQ ID NO: 513066 - RNA, 16 nt, Chlamydophila pneumoniae CWL029
caagcacuuucgcaaa

SEQ ID NO: 513067 - RNA, 13 nt, Chlamydophila pneumoniae CWL029
caacuuccauaug

SEQ ID NO: 513068 - RNA, 21 nt, Chlamydophila pneumoniae CWL029
caagguaacauccauagagaa

SEQ ID NO: 513069 - RNA, 22 nt, Chlamydophila pneumoniae CWL029
caagguaacauccauagagaac

SEQ ID NO: 513070 - RNA, 23 nt, Chlamydophila pneumoniae CWL029
caaggucacagcauuuucucuga

SEQ ID NO: 513071 - RNA, 20 nt, Chlamydophila pneumoniae CWL029
caaggggcguucuugaaaaa

SEQ ID NO: 513072 - RNA, 17 nt, Chlamydophila pneumoniae CWL029
caaggccuaaucuugua

SEQ ID NO: 513073 - RNA, 22 nt, Chlamydophila pneumoniae CWL029
caaggagagcuucuucuguaaa

SEQ ID NO: 513074 - RNA, 19 nt, Chlamydophila pneumoniae CWL029
caaggagucacuggcauca

SEQ ID NO: 513075 - RNA, 21 nt, Chlamydophila pneumoniae CWL029
caaggaguccaugcuaaaacu

SEQ ID NO: 513076 - RNA, 12 nt, Chlamydophila pneumoniae CWL029
caaggaaaaaaa

SEQ ID NO: 513077 - RNA, 16 nt, Chlamydophila pneumoniae CWL029
caaggaacauuugagc

SEQ ID NO: 513078 - RNA, 14 nt, Chlamydophila pneumoniae CWL029
caaggaaaaacaaa

SEQ ID NO: 513079 - RNA, 11 nt, Chlamydophila pneumoniae CWL029
caaggaaaauu

SEQ ID NO: 513080 - RNA, 19 nt, Chlamydophila pneumoniae CWL029
caaggacaggaccugugag

SEQ ID NO: 513081 - RNA, 24 nt, Chlamydophila pneumoniae CWL029
caauaauaucgguuccuauaugaa

SEQ ID NO: 513082 - RNA, 19 nt, Chlamydophila pneumoniae CWL029
caauaauaacgcuccaaug

SEQ ID NO: 513083 - RNA, 18 nt, Chlamydophila pneumoniae CWL029
caauaagcuugccagcag

SEQ ID NO: 513084 - RNA, 20 nt, Chlamydophila pneumoniae CWL029
caauaagcuugccagcagaa

SEQ ID NO: 513085 - RNA, 22 nt, Chlamydophila pneumoniae CWL029
caauaaacgagacugcaaagga

SEQ ID NO: 513086 - RNA, 14 nt, Chlamydophila pneumoniae CWL029
caauaaauccaaaa

SEQ ID NO: 513087 - RNA, 22 nt, Chlamydophila pneumoniae CWL029
caauaacaaacgccgcucuuga

SEQ ID NO: 513088 - RNA, 23 nt, Chlamydophila pneumoniae CWL029
caauaaaaggcuauuguguuuuu

SEQ ID NO: 513089 - RNA, 13 nt, Chlamydophila pneumoniae CWL029
caaguuucuuuug

SEQ ID NO: 513090 - RNA, 19 nt, Chlamydophila pneumoniae CWL029
caagucagccaagacaaaa

SEQ ID NO: 513091 - RNA, 14 nt, Chlamydophila pneumoniae CWL029
caagucauaaagau

SEQ ID NO: 513092 - RNA, 15 nt, Chlamydophila pneumoniae CWL029
caaguagcucucucc

SEQ ID NO: 513093 - RNA, 15 nt, Chlamydophila pneumoniae CWL029
caauaauuucaaaga

SEQ ID NO: 513094 - RNA, 16 nt, Chlamydophila pneumoniae CWL029
caauaauuucaaagau

SEQ ID NO: 513095 - RNA, 14 nt, Chlamydophila pneumoniae CWL029
caauacgaucuuuu

SEQ ID NO: 513096 - RNA, 20 nt, Chlamydophila pneumoniae CWL029
caauacgccgggccacuuca

SEQ ID NO: 513097 - RNA, 18 nt, Chlamydophila pneumoniae CWL029
caauacgcuagcucuuaa

SEQ ID NO: 513098 - RNA, 23 nt, Chlamydophila pneumoniae CWL029
caauacuggagagguaaccagag

SEQ ID NO: 513099 - RNA, 23 nt, Chlamydophila pneumoniae CWL029
caauacuucaggacgcacauuua

SEQ ID NO: 513100 - RNA, 17 nt, Chlamydophila pneumoniae CWL029
caauauaaaugcuauuu

SEQ ID NO: 513101 - RNA, 20 nt, Chlamydophila pneumoniae CWL029
caauauaaaugcuauuuucc

SEQ ID NO: 513102 - RNA, 21 nt, Chlamydophila pneumoniae CWL029
caauauaaaugcuauuuuccu

SEQ ID NO: 513103 - RNA, 21 nt, Chlamydophila pneumoniae CWL029
caauaggccagaauguacaua

SEQ ID NO: 513104 - RNA, 15 nt, Chlamydophila pneumoniae CWL029
caaugcuucuucagc

SEQ ID NO: 513105 - RNA, 17 nt, Chlamydophila pneumoniae CWL029
caauggaaauagagaaa

SEQ ID NO: 513106 - RNA, 14 nt, Chlamydophila pneumoniae CWL029
caaugcgauaacca

SEQ ID NO: 513107 - RNA, 16 nt, Chlamydophila pneumoniae CWL029
caaugcgauaaccacu

SEQ ID NO: 513108 - RNA, 18 nt, Chlamydophila pneumoniae CWL029
caaucugguuaagcacca

SEQ ID NO: 513109 - RNA, 20 nt, Chlamydophila pneumoniae CWL029
caaucuuccuuaaccuccuc

SEQ ID NO: 513110 - RNA, 20 nt, Chlamydophila pneumoniae CWL029
caaucuuucuucuagagcuu

SEQ ID NO: 513111 - RNA, 19 nt, Chlamydophila pneumoniae CWL029
caaucuuucauucccuuuu

SEQ ID NO: 513112 - RNA, 16 nt, Chlamydophila pneumoniae CWL029
caaugagcucuauuuc

SEQ ID NO: 513113 - RNA, 18 nt, Chlamydophila pneumoniae CWL029
caaugagcaucugaguca

SEQ ID NO: 513114 - RNA, 14 nt, Chlamydophila pneumoniae CWL029
caaugauaauuuca

SEQ ID NO: 513115 - RNA, 20 nt, Chlamydophila pneumoniae CWL029
caaugauaauuucauuauag

SEQ ID NO: 513116 - RNA, 20 nt, Chlamydophila pneumoniae CWL029
caaugauauaaaagcugaau

SEQ ID NO: 513117 - RNA, 15 nt, Chlamydophila pneumoniae CWL029
caaugauguuuuuua

SEQ ID NO: 513118 - RNA, 11 nt, Chlamydophila pneumoniae CWL029
caaugcauuug

SEQ ID NO: 513119 - RNA, 15 nt, Chlamydophila pneumoniae CWL029
caaugcaugaaucuc

SEQ ID NO: 513120 - RNA, 19 nt, Chlamydophila pneumoniae CWL029
caaugcaaccuguaaagac

SEQ ID NO: 513121 - RNA, 22 nt, Chlamydophila pneumoniae CWL029
caaugauuucuuuagcuuuauu

SEQ ID NO: 513122 - RNA, 13 nt, Chlamydophila pneumoniae CWL029
caauccuuccuua

SEQ ID NO: 513123 - RNA, 22 nt, Chlamydophila pneumoniae CWL029
caaucguagccccauagagccu

SEQ ID NO: 513124 - RNA, 13 nt, Chlamydophila pneumoniae CWL029
caaucuaaaauca

SEQ ID NO: 513125 - RNA, 14 nt, Chlamydophila pneumoniae CWL029
caaucuaaaaucac

SEQ ID NO: 513126 - RNA, 14 nt, Chlamydophila pneumoniae CWL029
caaucuaaauaaga

SEQ ID NO: 513127 - RNA, 17 nt, Chlamydophila pneumoniae CWL029
caaucucuuucacaaag

SEQ ID NO: 513128 - RNA, 13 nt, Chlamydophila pneumoniae CWL029
caaucugcugaag

SEQ ID NO: 513129 - RNA, 14 nt, Chlamydophila pneumoniae CWL029
caaucucuuuaaaa

SEQ ID NO: 513130 - RNA, 16 nt, Chlamydophila pneumoniae CWL029
caauccacgcuccucu

SEQ ID NO: 513131 - RNA, 19 nt, Chlamydophila pneumoniae CWL029
caauccacgcuccucuaac

SEQ ID NO: 513132 - RNA, 19 nt, Chlamydophila pneumoniae CWL029
caauccccugcaucucugc

SEQ ID NO: 513133 - RNA, 17 nt, Chlamydophila pneumoniae CWL029
caauccggcauaaaaaa

SEQ ID NO: 513134 - RNA, 14 nt, Chlamydophila pneumoniae CWL029
caaucccucuaccc

SEQ ID NO: 513135 - RNA, 23 nt, Chlamydophila pneumoniae CWL029
caaccuagaaucacauaaaauaa

SEQ ID NO: 513136 - RNA, 13 nt, Chlamydophila pneumoniae CWL029
caacggacauuuu

SEQ ID NO: 513137 - RNA, 14 nt, Chlamydophila pneumoniae CWL029
caacggauaagacg

SEQ ID NO: 513138 - RNA, 19 nt, Chlamydophila pneumoniae CWL029
caacugauguuuuauagau

SEQ ID NO: 513139 - RNA, 20 nt, Chlamydophila pneumoniae CWL029
caacugauguuuuauagaua

SEQ ID NO: 513140 - RNA, 15 nt, Chlamydophila pneumoniae CWL029
caacucuucagcagg

SEQ ID NO: 513141 - RNA, 21 nt, Chlamydophila pneumoniae CWL029
caacugaaaaaccauaagaau

SEQ ID NO: 513142 - RNA, 17 nt, Chlamydophila pneumoniae CWL029
caacuacuguagaguuu

SEQ ID NO: 513143 - RNA, 21 nt, Chlamydophila pneumoniae CWL029
caacuacagagggcuucauuc

SEQ ID NO: 513144 - RNA, 23 nt, Chlamydophila pneumoniae CWL029
caacuacauaauaagcaggaaaa

SEQ ID NO: 513145 - RNA, 15 nt, Chlamydophila pneumoniae CWL029
caaccgccuuuauau

SEQ ID NO: 513146 - RNA, 19 nt, Chlamydophila pneumoniae CWL029
caacccuauuuaaggacgu

SEQ ID NO: 513147 - RNA, 16 nt, Chlamydophila pneumoniae CWL029
caacccgaauuccucu

SEQ ID NO: 513148 - RNA, 18 nt, Chlamydophila pneumoniae CWL029
caacccgaauuccucucc

SEQ ID NO: 513149 - RNA, 18 nt, Chlamydophila pneumoniae CWL029
caaccaucccauauggau

SEQ ID NO: 513150 - RNA, 18 nt, Chlamydophila pneumoniae CWL029
caaccacacaggauuguu

SEQ ID NO: 513151 - RNA, 18 nt, Chlamydophila pneumoniae CWL029
caacagguaagacgagca

SEQ ID NO: 513152 - RNA, 12 nt, Chlamydophila pneumoniae CWL029
caacauucguua

SEQ ID NO: 513153 - RNA, 20 nt, Chlamydophila pneumoniae CWL029
caacauugaguugguuuugu

SEQ ID NO: 513154 - RNA, 17 nt, Chlamydophila pneumoniae CWL029
caacaaucuuucuucua

SEQ ID NO: 513155 - RNA, 17 nt, Chlamydophila pneumoniae CWL029
caaauuucuucuggaua

SEQ ID NO: 513156 - RNA, 14 nt, Chlamydophila pneumoniae CWL029
caaauugagaaaua

SEQ ID NO: 513157 - RNA, 17 nt, Chlamydophila pneumoniae CWL029
caaauugagaaauauaa

SEQ ID NO: 513158 - RNA, 23 nt, Chlamydophila pneumoniae CWL029
caaauugcaauuuucuaaagauu

SEQ ID NO: 513159 - RNA, 18 nt, Chlamydophila pneumoniae CWL029
caaauuuccauaggaucu

SEQ ID NO: 513160 - RNA, 23 nt, Chlamydophila pneumoniae CWL029
caacagcuaauacaucaccacug

SEQ ID NO: 513161 - RNA, 17 nt, Chlamydophila pneumoniae CWL029
caaauaguucaucauau

SEQ ID NO: 513162 - RNA, 21 nt, Chlamydophila pneumoniae CWL029
caaaucaucgcaaucaaagag

SEQ ID NO: 513163 - RNA, 19 nt, Chlamydophila pneumoniae CWL029
caaauugagaaauauaacu

SEQ ID NO: 513164 - RNA, 21 nt, Chlamydophila pneumoniae CWL029
caaaucucauuccagcaucuu

SEQ ID NO: 513165 - RNA, 19 nt, Chlamydophila pneumoniae CWL029
caaauagauuuuuacuugc

SEQ ID NO: 513166 - RNA, 12 nt, Chlamydophila pneumoniae CWL029
caaauaauuaaa

SEQ ID NO: 513167 - RNA, 20 nt, Chlamydophila pneumoniae CWL029
caaauaauuaaauauauaaa

SEQ ID NO: 513168 - RNA, 14 nt, Chlamydophila pneumoniae CWL029
caaauaaagcaacu

SEQ ID NO: 513169 - RNA, 22 nt, Chlamydophila pneumoniae CWL029
caaauaaguccuguuugaaaau

SEQ ID NO: 513170 - RNA, 19 nt, Chlamydophila pneumoniae CWL029
caaaguuuaugacacagcu

SEQ ID NO: 513171 - RNA, 12 nt, Chlamydophila pneumoniae CWL029
caaaguuuauga

SEQ ID NO: 513172 - RNA, 20 nt, Chlamydophila pneumoniae CWL029
caaaguuaaugcaagcaacu

SEQ ID NO: 513173 - RNA, 17 nt, Chlamydophila pneumoniae CWL029
caaagucaaauacuucu

SEQ ID NO: 513174 - RNA, 18 nt, Chlamydophila pneumoniae CWL029
caaagugacuuccuccaa

SEQ ID NO: 513175 - RNA, 21 nt, Chlamydophila pneumoniae CWL029
caaagcgaccugcaaaugaag

SEQ ID NO: 513176 - RNA, 23 nt, Chlamydophila pneumoniae CWL029
caaagguuauggaugcuaaauuu

SEQ ID NO: 513177 - RNA, 20 nt, Chlamydophila pneumoniae CWL029
caaagguuuuugauugcgaa

SEQ ID NO: 513178 - RNA, 20 nt, Chlamydophila pneumoniae CWL029
caaaguacuaauuacagaau

SEQ ID NO: 513179 - RNA, 23 nt, Chlamydophila pneumoniae CWL029
caaaguaaugugcgcacaaggga

SEQ ID NO: 513180 - RNA, 22 nt, Chlamydophila pneumoniae CWL029
caaaguaggauugauaaauuug

SEQ ID NO: 513181 - RNA, 14 nt, Chlamydophila pneumoniae CWL029
caaagacauccaag

SEQ ID NO: 513182 - RNA, 14 nt, Chlamydophila pneumoniae CWL029
caaagauuuccaau

SEQ ID NO: 513183 - RNA, 20 nt, Chlamydophila pneumoniae CWL029
caaagacaggcucaugaaau

SEQ ID NO: 513184 - RNA, 23 nt, Chlamydophila pneumoniae CWL029
caaagacaggcucaugaaauuuc

SEQ ID NO: 513185 - RNA, 18 nt, Chlamydophila pneumoniae CWL029
caaagaauucagagaaag

SEQ ID NO: 513186 - RNA, 16 nt, Chlamydophila pneumoniae CWL029
caaagcccccuccccc

SEQ ID NO: 513187 - RNA, 15 nt, Chlamydophila pneumoniae CWL029
caaagccaaauucuc

SEQ ID NO: 513188 - RNA, 19 nt, Chlamydophila pneumoniae CWL029
caaagcagauccugcuucu

SEQ ID NO: 513189 - RNA, 16 nt, Chlamydophila pneumoniae CWL029
caaagaauucagagaa

SEQ ID NO: 513190 - RNA, 23 nt, Chlamydophila pneumoniae CWL029
caaagaagucgcuagaucacaag

SEQ ID NO: 513191 - RNA, 21 nt, Chlamydophila pneumoniae CWL029
caaagaaaauucucagauugc

SEQ ID NO: 513192 - RNA, 13 nt, Chlamydophila pneumoniae CWL029
caaagaaagugaa

SEQ ID NO: 513193 - RNA, 17 nt, Chlamydophila pneumoniae CWL029
caaaaggcccaacucuu

SEQ ID NO: 513194 - RNA, 18 nt, Chlamydophila pneumoniae CWL029
caaaaggcccaacucuug

SEQ ID NO: 513195 - RNA, 21 nt, Chlamydophila pneumoniae CWL029
caaacuuggucauuauaguag

SEQ ID NO: 513196 - RNA, 18 nt, Chlamydophila pneumoniae CWL029
caaaagccauuccauauc

SEQ ID NO: 513197 - RNA, 23 nt, Chlamydophila pneumoniae CWL029
cagaugagagguguacaguugcg

SEQ ID NO: 513198 - RNA, 16 nt, Chlamydophila pneumoniae CWL029
cagauccugcuucuau

SEQ ID NO: 513199 - RNA, 13 nt, Chlamydophila pneumoniae CWL029
cagaucucuuuag

SEQ ID NO: 513200 - RNA, 14 nt, Chlamydophila pneumoniae CWL029
cagaucugcauaau

SEQ ID NO: 513201 - RNA, 20 nt, Chlamydophila pneumoniae CWL029
cagaucugcauaauuuuucu

SEQ ID NO: 513202 - RNA, 17 nt, Chlamydophila pneumoniae CWL029
cagaucuuuuaugcgag

SEQ ID NO: 513203 - RNA, 20 nt, Chlamydophila pneumoniae CWL029
cagauuuuuuaaccucuuuu

SEQ ID NO: 513204 - RNA, 17 nt, Chlamydophila pneumoniae CWL029
cagauugcacuugcggu

SEQ ID NO: 513205 - RNA, 18 nt, Chlamydophila pneumoniae CWL029
cagauuagaaaagauaaa

SEQ ID NO: 513206 - RNA, 23 nt, Chlamydophila pneumoniae CWL029
cagauuagaaaagauaaaacauu

SEQ ID NO: 513207 - RNA, 22 nt, Chlamydophila pneumoniae CWL029
cagauguuuucguaaauaugaa

SEQ ID NO: 513208 - RNA, 14 nt, Chlamydophila pneumoniae CWL029
cagauggucagucu

SEQ ID NO: 513209 - RNA, 16 nt, Chlamydophila pneumoniae CWL029
cagauggucagucucg

SEQ ID NO: 513210 - RNA, 17 nt, Chlamydophila pneumoniae CWL029
cagauguaaucuugauc

SEQ ID NO: 513211 - RNA, 17 nt, Chlamydophila pneumoniae CWL029
cagcacaggcauggucu

SEQ ID NO: 513212 - RNA, 23 nt, Chlamydophila pneumoniae CWL029
cagcacaagaaccuguuuuucua

SEQ ID NO: 513213 - RNA, 23 nt, Chlamydophila pneumoniae CWL029
cagcaagaacauaaccucggucu

SEQ ID NO: 513214 - RNA, 19 nt, Chlamydophila pneumoniae CWL029
cagcaacuaaagcauacuu

SEQ ID NO: 513215 - RNA, 17 nt, Chlamydophila pneumoniae CWL029
cagcaagaucuaacuuc

SEQ ID NO: 513216 - RNA, 15 nt, Chlamydophila pneumoniae CWL029
cagcaacaaccaaaa

SEQ ID NO: 513217 - RNA, 17 nt, Chlamydophila pneumoniae CWL029
cagcaaagaaguuauaa

SEQ ID NO: 513218 - RNA, 18 nt, Chlamydophila pneumoniae CWL029
cagcaaagacauccaagc

SEQ ID NO: 513219 - RNA, 18 nt, Chlamydophila pneumoniae CWL029
cagauaccaaaauaccau

SEQ ID NO: 513220 - RNA, 18 nt, Chlamydophila pneumoniae CWL029
cagaguccuucuuuuccg

SEQ ID NO: 513221 - RNA, 15 nt, Chlamydophila pneumoniae CWL029
cagaguccuucuuuu

SEQ ID NO: 513222 - RNA, 22 nt, Chlamydophila pneumoniae CWL029
cagagucuauaucuacagcuau

SEQ ID NO: 513223 - RNA, 22 nt, Chlamydophila pneumoniae CWL029
cagauaaagcaaagauaaagaa

SEQ ID NO: 513224 - RNA, 23 nt, Chlamydophila pneumoniae CWL029
cagaggaucuagaaaaugaagag

SEQ ID NO: 513225 - RNA, 12 nt, Chlamydophila pneumoniae CWL029
cagaggagccuc

SEQ ID NO: 513226 - RNA, 18 nt, Chlamydophila pneumoniae CWL029
cagaggagccuccauaau

SEQ ID NO: 513227 - RNA, 17 nt, Chlamydophila pneumoniae CWL029
cagaggccaccaaaaau

SEQ ID NO: 513228 - RNA, 19 nt, Chlamydophila pneumoniae CWL029
cagagcuucuaaaaacucu

SEQ ID NO: 513229 - RNA, 16 nt, Chlamydophila pneumoniae CWL029
cagagccgucuacuuu

SEQ ID NO: 513230 - RNA, 16 nt, Chlamydophila pneumoniae CWL029
cagagcgccuccaccu

SEQ ID NO: 513231 - RNA, 20 nt, Chlamydophila pneumoniae CWL029
cagaccucucccuugggauu

SEQ ID NO: 513232 - RNA, 14 nt, Chlamydophila pneumoniae CWL029
cagacuuuccucuc

SEQ ID NO: 513233 - RNA, 19 nt, Chlamydophila pneumoniae CWL029
cagagaaauuaacagagcg

SEQ ID NO: 513234 - RNA, 23 nt, Chlamydophila pneumoniae CWL029
cagagaaauuaacagagcgccuc

SEQ ID NO: 513235 - RNA, 13 nt, Chlamydophila pneumoniae CWL029
cagagaaaaucaa

SEQ ID NO: 513236 - RNA, 14 nt, Chlamydophila pneumoniae CWL029
cagagaacaauaaa

SEQ ID NO: 513237 - RNA, 16 nt, Chlamydophila pneumoniae CWL029
cagagaugcuucuaaa

SEQ ID NO: 513238 - RNA, 12 nt, Chlamydophila pneumoniae CWL029
cagagauggucu

SEQ ID NO: 513239 - RNA, 15 nt, Chlamydophila pneumoniae CWL029
cagagauguggcaga

SEQ ID NO: 513240 - RNA, 17 nt, Chlamydophila pneumoniae CWL029
cagagauugccaggaga

SEQ ID NO: 513241 - RNA, 21 nt, Chlamydophila pneumoniae CWL029
cagagacuuccucuucaauuu

SEQ ID NO: 513242 - RNA, 22 nt, Chlamydophila pneumoniae CWL029
cagagacuuccucuucaauuuc

SEQ ID NO: 513243 - RNA, 15 nt, Chlamydophila pneumoniae CWL029
cagagcauucgauuu

SEQ ID NO: 513244 - RNA, 18 nt, Chlamydophila pneumoniae CWL029
cagagauugccaggagag

SEQ ID NO: 513245 - RNA, 16 nt, Chlamydophila pneumoniae CWL029
cagaaugauaagaaag

SEQ ID NO: 513246 - RNA, 17 nt, Chlamydophila pneumoniae CWL029
cagaaucuaaguaaaac

SEQ ID NO: 513247 - RNA, 19 nt, Chlamydophila pneumoniae CWL029
cagaauccugaguaaaauc

SEQ ID NO: 513248 - RNA, 20 nt, Chlamydophila pneumoniae CWL029
cagaauaggaacaaagcucu

SEQ ID NO: 513249 - RNA, 19 nt, Chlamydophila pneumoniae CWL029
cagaauuuuaucagaaacu

SEQ ID NO: 513250 - RNA, 18 nt, Chlamydophila pneumoniae CWL029
cagaauuuuaucagaaac

SEQ ID NO: 513251 - RNA, 20 nt, Chlamydophila pneumoniae CWL029
cagacaagcaaggaaaaaaa

SEQ ID NO: 513252 - RNA, 16 nt, Chlamydophila pneumoniae CWL029
cagaauguacauagag

SEQ ID NO: 513253 - RNA, 17 nt, Chlamydophila pneumoniae CWL029
cagaauugcaaaguacu

SEQ ID NO: 513254 - RNA, 18 nt, Chlamydophila pneumoniae CWL029
cagaaguuccuacuucug

SEQ ID NO: 513255 - RNA, 16 nt, Chlamydophila pneumoniae CWL029
cagaagucuuggacgu

SEQ ID NO: 513256 - RNA, 23 nt, Chlamydophila pneumoniae CWL029
cagaagugaucuugagaaaagaa

SEQ ID NO: 513257 - RNA, 22 nt, Chlamydophila pneumoniae CWL029
cagaagguaaauuuuuaaaacu

SEQ ID NO: 513258 - RNA, 15 nt, Chlamydophila pneumoniae CWL029
cagaagguuccacag

SEQ ID NO: 513259 - RNA, 14 nt, Chlamydophila pneumoniae CWL029
cagaagguaaauuu

SEQ ID NO: 513260 - RNA, 16 nt, Chlamydophila pneumoniae CWL029
cagaaggcuuguuucu

SEQ ID NO: 513261 - RNA, 15 nt, Chlamydophila pneumoniae CWL029
cagaagcuccugagu

SEQ ID NO: 513262 - RNA, 13 nt, Chlamydophila pneumoniae CWL029
cagaagcaaaggu

SEQ ID NO: 513263 - RNA, 16 nt, Chlamydophila pneumoniae CWL029
cagaagcauugaggac

SEQ ID NO: 513264 - RNA, 20 nt, Chlamydophila pneumoniae CWL029
cagaagcauugaggacaaca

SEQ ID NO: 513265 - RNA, 16 nt, Chlamydophila pneumoniae CWL029
cagaaacuccaaaaua

SEQ ID NO: 513266 - RNA, 18 nt, Chlamydophila pneumoniae CWL029
cagaaacgcaugaaccua

SEQ ID NO: 513267 - RNA, 14 nt, Chlamydophila pneumoniae CWL029
cagaaacaugaagu

SEQ ID NO: 513268 - RNA, 18 nt, Chlamydophila pneumoniae CWL029
cagaaacacugaacgcca

SEQ ID NO: 513269 - RNA, 18 nt, Chlamydophila pneumoniae CWL029
cagaaaggagauccacag

SEQ ID NO: 513270 - RNA, 18 nt, Chlamydophila pneumoniae CWL029
cagaaagauaucccaaag

SEQ ID NO: 513271 - RNA, 16 nt, Chlamydophila pneumoniae CWL029
cagaaagagcuaaaga

SEQ ID NO: 513272 - RNA, 17 nt, Chlamydophila pneumoniae CWL029
cagaaagagcuaaagaa

SEQ ID NO: 513273 - RNA, 18 nt, Chlamydophila pneumoniae CWL029
cagaaagaaggucuucca

SEQ ID NO: 513274 - RNA, 19 nt, Chlamydophila pneumoniae CWL029
cagaaacuggcggauugcu

SEQ ID NO: 513275 - RNA, 21 nt, Chlamydophila pneumoniae CWL029
cagaaauacguccagccugca

SEQ ID NO: 513276 - RNA, 20 nt, Chlamydophila pneumoniae CWL029
cagaaauggcauagggauga

SEQ ID NO: 513277 - RNA, 17 nt, Chlamydophila pneumoniae CWL029
cagaaaugaagccaaaa

SEQ ID NO: 513278 - RNA, 13 nt, Chlamydophila pneumoniae CWL029
cagaacaacgcug

SEQ ID NO: 513279 - RNA, 19 nt, Chlamydophila pneumoniae CWL029
cagaacaacgcugcuucuc

SEQ ID NO: 513280 - RNA, 20 nt, Chlamydophila pneumoniae CWL029
cagaacaacgcugcuucucu

SEQ ID NO: 513281 - RNA, 21 nt, Chlamydophila pneumoniae CWL029
cagaacaacgcugcuucucua

SEQ ID NO: 513282 - RNA, 22 nt, Chlamydophila pneumoniae CWL029
cagaacaccaucacauccugua

SEQ ID NO: 513283 - RNA, 14 nt, Chlamydophila pneumoniae CWL029
cagaaaaaucuaac

SEQ ID NO: 513284 - RNA, 16 nt, Chlamydophila pneumoniae CWL029
cacuugcuuaaggaaa

SEQ ID NO: 513285 - RNA, 21 nt, Chlamydophila pneumoniae CWL029
cacuugguagcgucucuucuu

SEQ ID NO: 513286 - RNA, 20 nt, Chlamydophila pneumoniae CWL029
cacuugcauggauccuucau

SEQ ID NO: 513287 - RNA, 16 nt, Chlamydophila pneumoniae CWL029
cacuuacuucaagaaa

SEQ ID NO: 513288 - RNA, 14 nt, Chlamydophila pneumoniae CWL029
cacuucagcacgaa

SEQ ID NO: 513289 - RNA, 17 nt, Chlamydophila pneumoniae CWL029
cacuucuuuaggagcau

SEQ ID NO: 513290 - RNA, 12 nt, Chlamydophila pneumoniae CWL029
cacuucuuuuuc

SEQ ID NO: 513291 - RNA, 22 nt, Chlamydophila pneumoniae CWL029
cacuucuuugccguauagauuu

SEQ ID NO: 513292 - RNA, 17 nt, Chlamydophila pneumoniae CWL029
cacuguaucagcaagcc

SEQ ID NO: 513293 - RNA, 19 nt, Chlamydophila pneumoniae CWL029
cacuuaaaaaacuuccuaa

SEQ ID NO: 513294 - RNA, 18 nt, Chlamydophila pneumoniae CWL029
cacugguagcuaaauuua

SEQ ID NO: 513295 - RNA, 24 nt, Chlamydophila pneumoniae CWL029
cacuggaaugacauaagcacucuu

SEQ ID NO: 513296 - RNA, 17 nt, Chlamydophila pneumoniae CWL029
caaugucgucucagaaa

SEQ ID NO: 513297 - RNA, 20 nt, Chlamydophila pneumoniae CWL029
caauguuuagaauuuguccu

SEQ ID NO: 513298 - RNA, 12 nt, Chlamydophila pneumoniae CWL029
caauuaaaaaau

SEQ ID NO: 513299 - RNA, 18 nt, Chlamydophila pneumoniae CWL029
caauuaaaaaauuaucuc

SEQ ID NO: 513300 - RNA, 24 nt, Chlamydophila pneumoniae CWL029
cagcgacaacacgcccacggaaag

SEQ ID NO: 513301 - RNA, 21 nt, Chlamydophila pneumoniae CWL029
cagccuuggcucuagaaauau

SEQ ID NO: 513302 - RNA, 15 nt, Chlamydophila pneumoniae CWL029
cagccugcaccagac

SEQ ID NO: 513303 - RNA, 17 nt, Chlamydophila pneumoniae CWL029
cagccuggaaagcuucu

SEQ ID NO: 513304 - RNA, 22 nt, Chlamydophila pneumoniae CWL029
cagccuggaaagcuucuggauu

SEQ ID NO: 513305 - RNA, 13 nt, Chlamydophila pneumoniae CWL029
cagccugucuaua

SEQ ID NO: 513306 - RNA, 19 nt, Chlamydophila pneumoniae CWL029
cagccugucuauaaaauaa

SEQ ID NO: 513307 - RNA, 22 nt, Chlamydophila pneumoniae CWL029
cagccuguaaagaaggaggucc

SEQ ID NO: 513308 - RNA, 22 nt, Chlamydophila pneumoniae CWL029
cagccugugagcucucgacgaa

SEQ ID NO: 513309 - RNA, 13 nt, Chlamydophila pneumoniae CWL029
cagccggagcuuc

SEQ ID NO: 513310 - RNA, 21 nt, Chlamydophila pneumoniae CWL029
cagcgcugugaggaaaauucc

SEQ ID NO: 513311 - RNA, 12 nt, Chlamydophila pneumoniae CWL029
cagcccacuguu

SEQ ID NO: 513312 - RNA, 16 nt, Chlamydophila pneumoniae CWL029
cagcauuuucuaaagu

SEQ ID NO: 513313 - RNA, 17 nt, Chlamydophila pneumoniae CWL029
cagcauugccuggggau

SEQ ID NO: 513314 - RNA, 19 nt, Chlamydophila pneumoniae CWL029
cagcaugugcagaagguuc

SEQ ID NO: 513315 - RNA, 23 nt, Chlamydophila pneumoniae CWL029
cagcauuaagauaaacagcacag

SEQ ID NO: 513316 - RNA, 22 nt, Chlamydophila pneumoniae CWL029
cagcauaaggauucugagaagu

SEQ ID NO: 513317 - RNA, 18 nt, Chlamydophila pneumoniae CWL029
cagcauaaaaauucucau

SEQ ID NO: 513318 - RNA, 13 nt, Chlamydophila pneumoniae CWL029
cagcagaugaaac

SEQ ID NO: 513319 - RNA, 14 nt, Chlamydophila pneumoniae CWL029
cagcagaugaaacu

SEQ ID NO: 513320 - RNA, 15 nt, Chlamydophila pneumoniae CWL029
cagcagaaucauaau

SEQ ID NO: 513321 - RNA, 18 nt, Chlamydophila pneumoniae CWL029
cagcacuuuuauuaugua

SEQ ID NO: 513322 - RNA, 14 nt, Chlamydophila pneumoniae CWL029
cagcacucuuuuuc

SEQ ID NO: 513323 - RNA, 20 nt, Chlamydophila pneumoniae CWL029
cagcaccuuuaggaagcugu

SEQ ID NO: 513324 - RNA, 21 nt, Chlamydophila pneumoniae CWL029
cauuaucuucguaauaacuau

SEQ ID NO: 513325 - RNA, 18 nt, Chlamydophila pneumoniae CWL029
cauucguuaggugaccca

SEQ ID NO: 513326 - RNA, 15 nt, Chlamydophila pneumoniae CWL029
cauucucacagcaug

SEQ ID NO: 513327 - RNA, 18 nt, Chlamydophila pneumoniae CWL029
cauugaauccuucuauag

SEQ ID NO: 513328 - RNA, 22 nt, Chlamydophila pneumoniae CWL029
cauugaagagcuugcuguacga

SEQ ID NO: 513329 - RNA, 17 nt, Chlamydophila pneumoniae CWL029
cauugaugcuuaagagu

SEQ ID NO: 513330 - RNA, 16 nt, Chlamydophila pneumoniae CWL029
cauugcaaaaaugaaa

SEQ ID NO: 513331 - RNA, 14 nt, Chlamydophila pneumoniae CWL029
cauugccuugcugc

SEQ ID NO: 513332 - RNA, 13 nt, Chlamydophila pneumoniae CWL029
cauuguuuaaguc

SEQ ID NO: 513333 - RNA, 23 nt, Chlamydophila pneumoniae CWL029
cauuguuuaaguccuucuuccca

SEQ ID NO: 513334 - RNA, 21 nt, Chlamydophila pneumoniae CWL029
cauuguuuggcaguucacuga

SEQ ID NO: 513335 - RNA, 23 nt, Chlamydophila pneumoniae CWL029
cauuguuuguccuaggagagcua

SEQ ID NO: 513336 - RNA, 16 nt, Chlamydophila pneumoniae CWL029
cauuuaaacuaagaau

SEQ ID NO: 513337 - RNA, 15 nt, Chlamydophila pneumoniae CWL029
cauuuguuuggaaau

SEQ ID NO: 513338 - RNA, 16 nt, Chlamydophila pneumoniae CWL029
cauuugcuauuuuccc

SEQ ID NO: 513339 - RNA, 20 nt, Chlamydophila pneumoniae CWL029
cauuuaaagcugaaauucuu

SEQ ID NO: 513340 - RNA, 17 nt, Chlamydophila pneumoniae CWL029
cauuuuauccacugcgc

SEQ ID NO: 513341 - RNA, 14 nt, Chlamydophila pneumoniae CWL029
cauuuuaugaucuc

SEQ ID NO: 513342 - RNA, 15 nt, Chlamydophila pneumoniae CWL029
cauuuucuuuuaaga

SEQ ID NO: 513343 - RNA, 15 nt, Chlamydophila pneumoniae CWL029
cauuuuucaauaacc

SEQ ID NO: 513344 - RNA, 14 nt, Chlamydophila pneumoniae CWL029
cauuuuuccuccuc

SEQ ID NO: 513345 - RNA, 17 nt, Chlamydophila pneumoniae CWL029
cauuuuuggaaaaccau

SEQ ID NO: 513346 - RNA, 21 nt, Chlamydophila pneumoniae CWL029
cauuagcaagagcucuugaga

SEQ ID NO: 513347 - RNA, 19 nt, Chlamydophila pneumoniae CWL029
cauuagcaaucgaauagcu

SEQ ID NO: 513348 - RNA, 22 nt, Chlamydophila pneumoniae CWL029
cauuagcccuacgaauccaaaa

SEQ ID NO: 513349 - RNA, 20 nt, Chlamydophila pneumoniae CWL029
cauuaagcucaaaauuuccu

SEQ ID NO: 513350 - RNA, 12 nt, Chlamydophila pneumoniae CWL029
cauuaaggugug

SEQ ID NO: 513351 - RNA, 17 nt, Chlamydophila pneumoniae CWL029
caugucuucauaugcuc

SEQ ID NO: 513352 - RNA, 14 nt, Chlamydophila pneumoniae CWL029
cauguuucuuccug

SEQ ID NO: 513353 - RNA, 20 nt, Chlamydophila pneumoniae CWL029
cauguuuaauaucagcuucu

SEQ ID NO: 513354 - RNA, 13 nt, Chlamydophila pneumoniae CWL029
cauguuucacuua

SEQ ID NO: 513355 - RNA, 19 nt, Chlamydophila pneumoniae CWL029
cauggcuggaaagccaagc

SEQ ID NO: 513356 - RNA, 22 nt, Chlamydophila pneumoniae CWL029
cauggcuuugugagcugcuggu

SEQ ID NO: 513357 - RNA, 15 nt, Chlamydophila pneumoniae CWL029
cauggauucacaucu

SEQ ID NO: 513358 - RNA, 16 nt, Chlamydophila pneumoniae CWL029
cauggacaauauagag

SEQ ID NO: 513359 - RNA, 17 nt, Chlamydophila pneumoniae CWL029
cauggauauggaauggc

SEQ ID NO: 513360 - RNA, 15 nt, Chlamydophila pneumoniae CWL029
cauggacuccaagaa

SEQ ID NO: 513361 - RNA, 16 nt, Chlamydophila pneumoniae CWL029
caugcuaauaauuccu

SEQ ID NO: 513362 - RNA, 16 nt, Chlamydophila pneumoniae CWL029
caugcggacuuuauuc

SEQ ID NO: 513363 - RNA, 22 nt, Chlamydophila pneumoniae CWL029
caugcacgagagccucggaagu

SEQ ID NO: 513364 - RNA, 16 nt, Chlamydophila pneumoniae CWL029
caugaaaaaagaauaa

SEQ ID NO: 513365 - RNA, 21 nt, Chlamydophila pneumoniae CWL029
caugaaaagcuagucuucuua

SEQ ID NO: 513366 - RNA, 23 nt, Chlamydophila pneumoniae CWL029
caugaaagauaaugucuccaucg

SEQ ID NO: 513367 - RNA, 16 nt, Chlamydophila pneumoniae CWL029
caucuuuucaaaagaa

SEQ ID NO: 513368 - RNA, 19 nt, Chlamydophila pneumoniae CWL029
caucuuuucaaaagaaaag

SEQ ID NO: 513369 - RNA, 19 nt, Chlamydophila pneumoniae CWL029
caugccuaaauagcucagu

SEQ ID NO: 513370 - RNA, 22 nt, Chlamydophila pneumoniae CWL029
caugccuggccaucaucaccag

SEQ ID NO: 513371 - RNA, 12 nt, Chlamydophila pneumoniae CWL029
caucuuccucuu

SEQ ID NO: 513372 - RNA, 12 nt, Chlamydophila pneumoniae CWL029
caucuuguucug

SEQ ID NO: 513373 - RNA, 23 nt, Chlamydophila pneumoniae CWL029
caucugucauuaaaaauuuaaaa

SEQ ID NO: 513374 - RNA, 22 nt, Chlamydophila pneumoniae CWL029
caucuggaauggccacagcuau

SEQ ID NO: 513375 - RNA, 23 nt, Chlamydophila pneumoniae CWL029
caucuuaucaagagcucguaauc

SEQ ID NO: 513376 - RNA, 17 nt, Chlamydophila pneumoniae CWL029
caucuucacuaaaugac

SEQ ID NO: 513377 - RNA, 13 nt, Chlamydophila pneumoniae CWL029
caucuccugaagc

SEQ ID NO: 513378 - RNA, 14 nt, Chlamydophila pneumoniae CWL029
caucuccugaagcc

SEQ ID NO: 513379 - RNA, 18 nt, Chlamydophila pneumoniae CWL029
caucugcguuuaaggguu

SEQ ID NO: 513380 - RNA, 17 nt, Chlamydophila pneumoniae CWL029
caucuacgauguuuucu

SEQ ID NO: 513381 - RNA, 17 nt, Chlamydophila pneumoniae CWL029
caucgguuuccaagaca

SEQ ID NO: 513382 - RNA, 20 nt, Chlamydophila pneumoniae CWL029
caucuagaagcauucucaau

SEQ ID NO: 513383 - RNA, 22 nt, Chlamydophila pneumoniae CWL029
caucuagaagcauucucaauuc

SEQ ID NO: 513384 - RNA, 17 nt, Chlamydophila pneumoniae CWL029
caucuagaaagauuuau

SEQ ID NO: 513385 - RNA, 19 nt, Chlamydophila pneumoniae CWL029
caucgguucggucucuucu

SEQ ID NO: 513386 - RNA, 23 nt, Chlamydophila pneumoniae CWL029
caucgguucggucucuucucugu

SEQ ID NO: 513387 - RNA, 24 nt, Chlamydophila pneumoniae CWL029
caucgguucggucucuucucuguu

SEQ ID NO: 513388 - RNA, 18 nt, Chlamydophila pneumoniae CWL029
caucgacaaguaccuucu

SEQ ID NO: 513389 - RNA, 18 nt, Chlamydophila pneumoniae CWL029
cauccuucuuuaccuaug

SEQ ID NO: 513390 - RNA, 18 nt, Chlamydophila pneumoniae CWL029
cauccuuguagaacuucu

SEQ ID NO: 513391 - RNA, 22 nt, Chlamydophila pneumoniae CWL029
cauccuuguagaacuucucaag

SEQ ID NO: 513392 - RNA, 21 nt, Chlamydophila pneumoniae CWL029
caucgaaaccacagcaaagac

SEQ ID NO: 513393 - RNA, 12 nt, Chlamydophila pneumoniae CWL029
cauccagaagua

SEQ ID NO: 513394 - RNA, 16 nt, Chlamydophila pneumoniae CWL029
cauccagacaagacac

SEQ ID NO: 513395 - RNA, 17 nt, Chlamydophila pneumoniae CWL029
cauccagacaagacacu

SEQ ID NO: 513396 - RNA, 23 nt, Chlamydophila pneumoniae CWL029
caucgagaaaugcucuucugcag

SEQ ID NO: 513397 - RNA, 18 nt, Chlamydophila pneumoniae CWL029
cauccaaaaugucuuuuu

SEQ ID NO: 513398 - RNA, 18 nt, Chlamydophila pneumoniae CWL029
caucaucuccugaagcca

SEQ ID NO: 513399 - RNA, 20 nt, Chlamydophila pneumoniae CWL029
caucaugaaauacccgcacc

SEQ ID NO: 513400 - RNA, 17 nt, Chlamydophila pneumoniae CWL029
caucauccucaggaccu

SEQ ID NO: 513401 - RNA, 12 nt, Chlamydophila pneumoniae CWL029
caucaucaccag

SEQ ID NO: 513402 - RNA, 21 nt, Chlamydophila pneumoniae CWL029
caucauaaagugcgagguaug

SEQ ID NO: 513403 - RNA, 13 nt, Chlamydophila pneumoniae CWL029
caucaguaaaaga

SEQ ID NO: 513404 - RNA, 22 nt, Chlamydophila pneumoniae CWL029
caucaccuucggaucuucccau

SEQ ID NO: 513405 - RNA, 14 nt, Chlamydophila pneumoniae CWL029
caucacgaggagcu

SEQ ID NO: 513406 - RNA, 23 nt, Chlamydophila pneumoniae CWL029
caucaaaagauaugucuugcuuu

SEQ ID NO: 513407 - RNA, 21 nt, Chlamydophila pneumoniae CWL029
caucaaaagauaugucuugcu

SEQ ID NO: 513408 - RNA, 12 nt, Chlamydophila pneumoniae CWL029
caucaaaaagau

SEQ ID NO: 513409 - RNA, 13 nt, Chlamydophila pneumoniae CWL029
caucaaaacauaa

SEQ ID NO: 513410 - RNA, 15 nt, Chlamydophila pneumoniae CWL029
cauauuuugucuuca

SEQ ID NO: 513411 - RNA, 20 nt, Chlamydophila pneumoniae CWL029
cauauuuuucuugaagguuc

SEQ ID NO: 513412 - RNA, 13 nt, Chlamydophila pneumoniae CWL029
caucaaaaaauac

SEQ ID NO: 513413 - RNA, 13 nt, Chlamydophila pneumoniae CWL029
caucaaggccuau

SEQ ID NO: 513414 - RNA, 12 nt, Chlamydophila pneumoniae CWL029
caucaagagaua

SEQ ID NO: 513415 - RNA, 14 nt, Chlamydophila pneumoniae CWL029
cauaugcuccagaa

SEQ ID NO: 513416 - RNA, 14 nt, Chlamydophila pneumoniae CWL029
cauaugcucucccg

SEQ ID NO: 513417 - RNA, 15 nt, Chlamydophila pneumoniae CWL029
cauaucggcagcagc

SEQ ID NO: 513418 - RNA, 22 nt, Chlamydophila pneumoniae CWL029
cauauaaagacucucuuccaaa

SEQ ID NO: 513419 - RNA, 16 nt, Chlamydophila pneumoniae CWL029
cauacgguaaggagga

SEQ ID NO: 513420 - RNA, 15 nt, Chlamydophila pneumoniae CWL029
cauacuuauccuuuu

SEQ ID NO: 513421 - RNA, 16 nt, Chlamydophila pneumoniae CWL029
cauacuuauccuuuuc

SEQ ID NO: 513422 - RNA, 14 nt, Chlamydophila pneumoniae CWL029
cauacucuucaucc

SEQ ID NO: 513423 - RNA, 13 nt, Chlamydophila pneumoniae CWL029
cauacugauauac

SEQ ID NO: 513424 - RNA, 12 nt, Chlamydophila pneumoniae CWL029
cauacgguauac

SEQ ID NO: 513425 - RNA, 14 nt, Chlamydophila pneumoniae CWL029
cauacucgucaaau

SEQ ID NO: 513426 - RNA, 15 nt, Chlamydophila pneumoniae CWL029
cauacucgucaaauu

SEQ ID NO: 513427 - RNA, 17 nt, Chlamydophila pneumoniae CWL029
cauacccuucuucuuca

SEQ ID NO: 513428 - RNA, 16 nt, Chlamydophila pneumoniae CWL029
cauacaguagaaacau

SEQ ID NO: 513429 - RNA, 21 nt, Chlamydophila pneumoniae CWL029
cauacaggcuccucugcuaag

SEQ ID NO: 513430 - RNA, 23 nt, Chlamydophila pneumoniae CWL029
cauacaggcuccucugcuaagca

SEQ ID NO: 513431 - RNA, 18 nt, Chlamydophila pneumoniae CWL029
cauacaugcuaauccagc

SEQ ID NO: 513432 - RNA, 19 nt, Chlamydophila pneumoniae CWL029
cauacaugcuaauccagca

SEQ ID NO: 513433 - RNA, 16 nt, Chlamydophila pneumoniae CWL029
cauaaucucaccagaa

SEQ ID NO: 513434 - RNA, 19 nt, Chlamydophila pneumoniae CWL029
cauacaccccaguuucuug

SEQ ID NO: 513435 - RNA, 16 nt, Chlamydophila pneumoniae CWL029
cauaaugagacagaca

SEQ ID NO: 513436 - RNA, 20 nt, Chlamydophila pneumoniae CWL029
cauaaccuuugacaacacca

SEQ ID NO: 513437 - RNA, 18 nt, Chlamydophila pneumoniae CWL029
cauaaccucggucucgcu

SEQ ID NO: 513438 - RNA, 13 nt, Chlamydophila pneumoniae CWL029
cauaaccugggca

SEQ ID NO: 513439 - RNA, 18 nt, Chlamydophila pneumoniae CWL029
cauaacgggguugucucu

SEQ ID NO: 513440 - RNA, 11 nt, Chlamydophila pneumoniae CWL029
caguucuucau

SEQ ID NO: 513441 - RNA, 15 nt, Chlamydophila pneumoniae CWL029
caguucuuucugcuu

SEQ ID NO: 513442 - RNA, 13 nt, Chlamydophila pneumoniae CWL029
caguuaaagagca

SEQ ID NO: 513443 - RNA, 21 nt, Chlamydophila pneumoniae CWL029
caguugguagagcaacacauu

SEQ ID NO: 513444 - RNA, 17 nt, Chlamydophila pneumoniae CWL029
caguuggcguuuucuag

SEQ ID NO: 513445 - RNA, 20 nt, Chlamydophila pneumoniae CWL029
caguugcgcgcccucuucua

SEQ ID NO: 513446 - RNA, 19 nt, Chlamydophila pneumoniae CWL029
cauaacaagggaagagaaa

SEQ ID NO: 513447 - RNA, 13 nt, Chlamydophila pneumoniae CWL029
cauaacauugcuu

SEQ ID NO: 513448 - RNA, 15 nt, Chlamydophila pneumoniae CWL029
cauaacauugcuugc

SEQ ID NO: 513449 - RNA, 15 nt, Chlamydophila pneumoniae CWL029
cauaaaaauucucau

SEQ ID NO: 513450 - RNA, 20 nt, Chlamydophila pneumoniae CWL029
cauaaacaucgcagcaggau

SEQ ID NO: 513451 - RNA, 19 nt, Chlamydophila pneumoniae CWL029
cauaaacuccuaggggaau

SEQ ID NO: 513452 - RNA, 19 nt, Chlamydophila pneumoniae CWL029
cauaaagacccuucuuucc

SEQ ID NO: 513453 - RNA, 23 nt, Chlamydophila pneumoniae CWL029
cagucuugcgccagcaaagauua

SEQ ID NO: 513454 - RNA, 15 nt, Chlamydophila pneumoniae CWL029
cagugaauccuucca

SEQ ID NO: 513455 - RNA, 20 nt, Chlamydophila pneumoniae CWL029
caguggacggggagagccau

SEQ ID NO: 513456 - RNA, 16 nt, Chlamydophila pneumoniae CWL029
caguguauaacguaga

SEQ ID NO: 513457 - RNA, 23 nt, Chlamydophila pneumoniae CWL029
caguguccacugcagcagguguc

SEQ ID NO: 513458 - RNA, 16 nt, Chlamydophila pneumoniae CWL029
cagugcugccaugaca

SEQ ID NO: 513459 - RNA, 14 nt, Chlamydophila pneumoniae CWL029
cagucuccuggaac

SEQ ID NO: 513460 - RNA, 20 nt, Chlamydophila pneumoniae CWL029
cagucuggcuuaggaggagg

SEQ ID NO: 513461 - RNA, 15 nt, Chlamydophila pneumoniae CWL029
cagucugugagaaau

SEQ ID NO: 513462 - RNA, 15 nt, Chlamydophila pneumoniae CWL029
cagucguauucaggu

SEQ ID NO: 513463 - RNA, 19 nt, Chlamydophila pneumoniae CWL029
cagucgugagaagcaucuu

SEQ ID NO: 513464 - RNA, 13 nt, Chlamydophila pneumoniae CWL029
caguccucucccu

SEQ ID NO: 513465 - RNA, 21 nt, Chlamydophila pneumoniae CWL029
caguagagccucuaagaaaau

SEQ ID NO: 513466 - RNA, 16 nt, Chlamydophila pneumoniae CWL029
caguagaucuucugaa

SEQ ID NO: 513467 - RNA, 17 nt, Chlamydophila pneumoniae CWL029
caguauaagaugcugaa

SEQ ID NO: 513468 - RNA, 13 nt, Chlamydophila pneumoniae CWL029
caguauagagaag

SEQ ID NO: 513469 - RNA, 19 nt, Chlamydophila pneumoniae CWL029
caguaucaauaaucggccg

SEQ ID NO: 513470 - RNA, 18 nt, Chlamydophila pneumoniae CWL029
caguacuaaauuaguaaa

SEQ ID NO: 513471 - RNA, 19 nt, Chlamydophila pneumoniae CWL029
caguaaaaggucugcgucu

SEQ ID NO: 513472 - RNA, 20 nt, Chlamydophila pneumoniae CWL029
caguaaaacacaaauagcaa

SEQ ID NO: 513473 - RNA, 19 nt, Chlamydophila pneumoniae CWL029
caggugcggaacucaucac

SEQ ID NO: 513474 - RNA, 14 nt, Chlamydophila pneumoniae CWL029
cagguaaacaacaa

SEQ ID NO: 513475 - RNA, 14 nt, Chlamydophila pneumoniae CWL029
caggggauaaaacu

SEQ ID NO: 513476 - RNA, 23 nt, Chlamydophila pneumoniae CWL029
caggggaugugauguucugcugc

SEQ ID NO: 513477 - RNA, 13 nt, Chlamydophila pneumoniae CWL029
caggggugagauc

SEQ ID NO: 513478 - RNA, 21 nt, Chlamydophila pneumoniae CWL029
caggcuccaucacgaggagcu

SEQ ID NO: 513479 - RNA, 14 nt, Chlamydophila pneumoniae CWL029
caggcucaugaaau

SEQ ID NO: 513480 - RNA, 19 nt, Chlamydophila pneumoniae CWL029
cagggacucuuuccauagc

SEQ ID NO: 513481 - RNA, 21 nt, Chlamydophila pneumoniae CWL029
cagggaauccuguaacacccu

SEQ ID NO: 513482 - RNA, 14 nt, Chlamydophila pneumoniae CWL029
caggcuacauaguu

SEQ ID NO: 513483 - RNA, 19 nt, Chlamydophila pneumoniae CWL029
caggauuacggaaaauaca

SEQ ID NO: 513484 - RNA, 14 nt, Chlamydophila pneumoniae CWL029
caggacuucgcaaa

SEQ ID NO: 513485 - RNA, 23 nt, Chlamydophila pneumoniae CWL029
caggacuguuuguuuauuaucua

SEQ ID NO: 513486 - RNA, 15 nt, Chlamydophila pneumoniae CWL029
caggagcuccuccuu

SEQ ID NO: 513487 - RNA, 12 nt, Chlamydophila pneumoniae CWL029
caggagcuccug

SEQ ID NO: 513488 - RNA, 17 nt, Chlamydophila pneumoniae CWL029
caggagcuagaagagcg

SEQ ID NO: 513489 - RNA, 14 nt, Chlamydophila pneumoniae CWL029
caggagcuccuccu

SEQ ID NO: 513490 - RNA, 22 nt, Chlamydophila pneumoniae CWL029
caggaguuccgcggccaucauu

SEQ ID NO: 513491 - RNA, 16 nt, Chlamydophila pneumoniae CWL029
caggaguucuugauuc

SEQ ID NO: 513492 - RNA, 11 nt, Chlamydophila pneumoniae CWL029
caggaggcgcg

SEQ ID NO: 513493 - RNA, 20 nt, Chlamydophila pneumoniae CWL029
caggaccuaagggcucuccu

SEQ ID NO: 513494 - RNA, 15 nt, Chlamydophila pneumoniae CWL029
caggacaugccuuag

SEQ ID NO: 513495 - RNA, 23 nt, Chlamydophila pneumoniae CWL029
caggaaucacuguaucagcaagc

SEQ ID NO: 513496 - RNA, 16 nt, Chlamydophila pneumoniae CWL029
caggaauaaucaacca

SEQ ID NO: 513497 - RNA, 19 nt, Chlamydophila pneumoniae CWL029
caggaaguccgauagcaau

SEQ ID NO: 513498 - RNA, 17 nt, Chlamydophila pneumoniae CWL029
caggaaggaauagagaa

SEQ ID NO: 513499 - RNA, 17 nt, Chlamydophila pneumoniae CWL029
caggaaguccauguaca

SEQ ID NO: 513500 - RNA, 16 nt, Chlamydophila pneumoniae CWL029
caggaacuaaaaguuu

SEQ ID NO: 513501 - RNA, 13 nt, Chlamydophila pneumoniae CWL029
cagcuguacagaa

SEQ ID NO: 513502 - RNA, 17 nt, Chlamydophila pneumoniae CWL029
cagcuucaggauuagua

SEQ ID NO: 513503 - RNA, 20 nt, Chlamydophila pneumoniae CWL029
cagcuucuugauguacagua

SEQ ID NO: 513504 - RNA, 18 nt, Chlamydophila pneumoniae CWL029
ccuuagcauuaggaaagu

SEQ ID NO: 513505 - RNA, 22 nt, Chlamydophila pneumoniae CWL029
ccuuagcagcacccauaaggga

SEQ ID NO: 513506 - RNA, 20 nt, Chlamydophila pneumoniae CWL029
ccuuacggccccuggaauuu

SEQ ID NO: 513507 - RNA, 17 nt, Chlamydophila pneumoniae CWL029
ccuuaucuugcugccca

SEQ ID NO: 513508 - RNA, 17 nt, Chlamydophila pneumoniae CWL029
ccuuauugguaacacga

SEQ ID NO: 513509 - RNA, 18 nt, Chlamydophila pneumoniae CWL029
ccuuaggcuuaauaaaca

SEQ ID NO: 513510 - RNA, 15 nt, Chlamydophila pneumoniae CWL029
ccuuaguuuuuucua

SEQ ID NO: 513511 - RNA, 23 nt, Chlamydophila pneumoniae CWL029
ccuuaucgcagcugauagggaaa

SEQ ID NO: 513512 - RNA, 16 nt, Chlamydophila pneumoniae CWL029
ccuucaggauuuucca

SEQ ID NO: 513513 - RNA, 18 nt, Chlamydophila pneumoniae CWL029
ccuucagaauucucaagu

SEQ ID NO: 513514 - RNA, 20 nt, Chlamydophila pneumoniae CWL029
ccuucaacacaccauuuuug

SEQ ID NO: 513515 - RNA, 12 nt, Chlamydophila pneumoniae CWL029
ccuucaacacac

SEQ ID NO: 513516 - RNA, 24 nt, Chlamydophila pneumoniae CWL029
ccuucaauacgcuagcucuuaaau

SEQ ID NO: 513517 - RNA, 16 nt, Chlamydophila pneumoniae CWL029
ccuucaagucgagaaa

SEQ ID NO: 513518 - RNA, 19 nt, Chlamydophila pneumoniae CWL029
ccuucacaagaaaacaaag

SEQ ID NO: 513519 - RNA, 22 nt, Chlamydophila pneumoniae CWL029
ccuguuucaacauaacaugaga

SEQ ID NO: 513520 - RNA, 18 nt, Chlamydophila pneumoniae CWL029
ccuuaaagagaaucuccu

SEQ ID NO: 513521 - RNA, 17 nt, Chlamydophila pneumoniae CWL029
ccuuaaccuccucaaga

SEQ ID NO: 513522 - RNA, 13 nt, Chlamydophila pneumoniae CWL029
ccugugauuuccu

SEQ ID NO: 513523 - RNA, 17 nt, Chlamydophila pneumoniae CWL029
ccugugauuuccugacu

SEQ ID NO: 513524 - RNA, 23 nt, Chlamydophila pneumoniae CWL029
ccuggaaaugaauauaauuccaa

SEQ ID NO: 513525 - RNA, 20 nt, Chlamydophila pneumoniae CWL029
ccuggaacaguauaaucaga

SEQ ID NO: 513526 - RNA, 17 nt, Chlamydophila pneumoniae CWL029
ccuggaaagcuucugga

SEQ ID NO: 513527 - RNA, 12 nt, Chlamydophila pneumoniae CWL029
ccugcugcuuca

SEQ ID NO: 513528 - RNA, 17 nt, Chlamydophila pneumoniae CWL029
ccugcugccaugcagcc

SEQ ID NO: 513529 - RNA, 16 nt, Chlamydophila pneumoniae CWL029
ccugcuccucuucuuc

SEQ ID NO: 513530 - RNA, 19 nt, Chlamydophila pneumoniae CWL029
ccugcccauuuuuggaaaa

SEQ ID NO: 513531 - RNA, 21 nt, Chlamydophila pneumoniae CWL029
ccugaucuguagguguaauua

SEQ ID NO: 513532 - RNA, 21 nt, Chlamydophila pneumoniae CWL029
ccugacucuuuuaagacaaua

SEQ ID NO: 513533 - RNA, 17 nt, Chlamydophila pneumoniae CWL029
ccugauacgcagcuaga

SEQ ID NO: 513534 - RNA, 23 nt, Chlamydophila pneumoniae CWL029
ccugaguacuuugugauuacagc

SEQ ID NO: 513535 - RNA, 20 nt, Chlamydophila pneumoniae CWL029
ccugagaaaaguugccuaaa

SEQ ID NO: 513536 - RNA, 18 nt, Chlamydophila pneumoniae CWL029
ccugagaccauaaaauca

SEQ ID NO: 513537 - RNA, 12 nt, Chlamydophila pneumoniae CWL029
ccugagaguguu

SEQ ID NO: 513538 - RNA, 20 nt, Chlamydophila pneumoniae CWL029
ccucuacgcuauucuuaagc

SEQ ID NO: 513539 - RNA, 17 nt, Chlamydophila pneumoniae CWL029
ccucuagaagacacagg

SEQ ID NO: 513540 - RNA, 20 nt, Chlamydophila pneumoniae CWL029
ccucugcauguugcaaagca

SEQ ID NO: 513541 - RNA, 18 nt, Chlamydophila pneumoniae CWL029
ccucuguagguuuuucca

SEQ ID NO: 513542 - RNA, 14 nt, Chlamydophila pneumoniae CWL029
ccucuucaauuucu

SEQ ID NO: 513543 - RNA, 20 nt, Chlamydophila pneumoniae CWL029
ccucugggaagacucucauc

SEQ ID NO: 513544 - RNA, 16 nt, Chlamydophila pneumoniae CWL029
ccucugggaagacucu

SEQ ID NO: 513545 - RNA, 13 nt, Chlamydophila pneumoniae CWL029
ccucagucucucu

SEQ ID NO: 513546 - RNA, 17 nt, Chlamydophila pneumoniae CWL029
ccucgauacuguugauc

SEQ ID NO: 513547 - RNA, 21 nt, Chlamydophila pneumoniae CWL029
ccucgaguauggcaaauaaaa

SEQ ID NO: 513548 - RNA, 20 nt, Chlamydophila pneumoniae CWL029
ccucgagcagaaacuccaaa

SEQ ID NO: 513549 - RNA, 21 nt, Chlamydophila pneumoniae CWL029
ccucgagcagaaacuccaaaa

SEQ ID NO: 513550 - RNA, 22 nt, Chlamydophila pneumoniae CWL029
ccucgcaauccaggaauagaaa

SEQ ID NO: 513551 - RNA, 23 nt, Chlamydophila pneumoniae CWL029
ccuacacugguagcuaaauuuag

SEQ ID NO: 513552 - RNA, 19 nt, Chlamydophila pneumoniae CWL029
ccuacaaucgccuuacaau

SEQ ID NO: 513553 - RNA, 14 nt, Chlamydophila pneumoniae CWL029
ccuacuaaacccug

SEQ ID NO: 513554 - RNA, 17 nt, Chlamydophila pneumoniae CWL029
ccuagauagcaaaucaa

SEQ ID NO: 513555 - RNA, 14 nt, Chlamydophila pneumoniae CWL029
ccuagaauaggaau

SEQ ID NO: 513556 - RNA, 16 nt, Chlamydophila pneumoniae CWL029
ccuaggagaaaucaca

SEQ ID NO: 513557 - RNA, 21 nt, Chlamydophila pneumoniae CWL029
ccuauaccaucuuuaaaaggc

SEQ ID NO: 513558 - RNA, 21 nt, Chlamydophila pneumoniae CWL029
ccuauaaagcaaaugccugua

SEQ ID NO: 513559 - RNA, 15 nt, Chlamydophila pneumoniae CWL029
ccuauaguaauuucu

SEQ ID NO: 513560 - RNA, 16 nt, Chlamydophila pneumoniae CWL029
ccuauaguauaauagu

SEQ ID NO: 513561 - RNA, 16 nt, Chlamydophila pneumoniae CWL029
ccuaucaaagcaaaag

SEQ ID NO: 513562 - RNA, 18 nt, Chlamydophila pneumoniae CWL029
ccuaucaaagcaaaaguc

SEQ ID NO: 513563 - RNA, 19 nt, Chlamydophila pneumoniae CWL029
ccucacuaacggcaguaug

SEQ ID NO: 513564 - RNA, 21 nt, Chlamydophila pneumoniae CWL029
ccucagaauccauuuugccca

SEQ ID NO: 513565 - RNA, 13 nt, Chlamydophila pneumoniae CWL029
ccucacaagaagc

SEQ ID NO: 513566 - RNA, 17 nt, Chlamydophila pneumoniae CWL029
ccucacauguuucacuu

SEQ ID NO: 513567 - RNA, 22 nt, Chlamydophila pneumoniae CWL029
ccuauuugcaacaaucuuucuu

SEQ ID NO: 513568 - RNA, 17 nt, Chlamydophila pneumoniae CWL029
ccuauugguguaucucu

SEQ ID NO: 513569 - RNA, 10 nt, Chlamydophila pneumoniae CWL029
ccuauuuaag

SEQ ID NO: 513570 - RNA, 19 nt, Chlamydophila pneumoniae CWL029
ccucaaagaguuuuuuaga

SEQ ID NO: 513571 - RNA, 16 nt, Chlamydophila pneumoniae CWL029
ccucaagauaaauccc

SEQ ID NO: 513572 - RNA, 18 nt, Chlamydophila pneumoniae CWL029
ccucaagauaaaucccac

SEQ ID NO: 513573 - RNA, 21 nt, Chlamydophila pneumoniae CWL029
ccuaaaccaucacuuccuguu

SEQ ID NO: 513574 - RNA, 20 nt, Chlamydophila pneumoniae CWL029
ccuaaaauggugaagaauaa

SEQ ID NO: 513575 - RNA, 20 nt, Chlamydophila pneumoniae CWL029
ccuaaaaaggucagcccugc

SEQ ID NO: 513576 - RNA, 19 nt, Chlamydophila pneumoniae CWL029
ccuaaggagaauccuuuag

SEQ ID NO: 513577 - RNA, 15 nt, Chlamydophila pneumoniae CWL029
ccuaagggcucuccu

SEQ ID NO: 513578 - RNA, 23 nt, Chlamydophila pneumoniae CWL029
ccuaagguuuccaugagaauaug

SEQ ID NO: 513579 - RNA, 16 nt, Chlamydophila pneumoniae CWL029
ccuaagugauaaggaa

SEQ ID NO: 513580 - RNA, 17 nt, Chlamydophila pneumoniae CWL029
ccuaagugauaaggaag

SEQ ID NO: 513581 - RNA, 13 nt, Chlamydophila pneumoniae CWL029
ccuaauaaagaag

SEQ ID NO: 513582 - RNA, 17 nt, Chlamydophila pneumoniae CWL029
ccuaagcucauaagaaa

SEQ ID NO: 513583 - RNA, 18 nt, Chlamydophila pneumoniae CWL029
ccuaagagauuuuccaua

SEQ ID NO: 513584 - RNA, 23 nt, Chlamydophila pneumoniae CWL029
ccuaagagauuuuccauaggaac

SEQ ID NO: 513585 - RNA, 20 nt, Chlamydophila pneumoniae CWL029
ccuaaaucugcuuuuaucuc

SEQ ID NO: 513586 - RNA, 21 nt, Chlamydophila pneumoniae CWL029
ccuaaaucugcuuuuaucuca

SEQ ID NO: 513587 - RNA, 16 nt, Chlamydophila pneumoniae CWL029
ccuaaauuaaauaucu

SEQ ID NO: 513588 - RNA, 16 nt, Chlamydophila pneumoniae CWL029
ccuaaauucauaacac

SEQ ID NO: 513589 - RNA, 11 nt, Chlamydophila pneumoniae CWL029
ccuaaagcauc

SEQ ID NO: 513590 - RNA, 23 nt, Chlamydophila pneumoniae CWL029
ccuaaaguuugagcuaagcugaa

SEQ ID NO: 513591 - RNA, 12 nt, Chlamydophila pneumoniae CWL029
ccguccucccca

SEQ ID NO: 513592 - RNA, 14 nt, Chlamydophila pneumoniae CWL029
ccguauucccaggu

SEQ ID NO: 513593 - RNA, 21 nt, Chlamydophila pneumoniae CWL029
ccguauuuuuuacguucuuuc

SEQ ID NO: 513594 - RNA, 15 nt, Chlamydophila pneumoniae CWL029
ccguccaguucuuca

SEQ ID NO: 513595 - RNA, 14 nt, Chlamydophila pneumoniae CWL029
ccgccuuucuaccc

SEQ ID NO: 513596 - RNA, 16 nt, Chlamydophila pneumoniae CWL029
ccgccuuuauauaaag

SEQ ID NO: 513597 - RNA, 14 nt, Chlamydophila pneumoniae CWL029
ccgcauuuccuagu

SEQ ID NO: 513598 - RNA, 16 nt, Chlamydophila pneumoniae CWL029
ccgcagcaaaaauaug

SEQ ID NO: 513599 - RNA, 17 nt, Chlamydophila pneumoniae CWL029
ccgccauaacacuuugc

SEQ ID NO: 513600 - RNA, 19 nt, Chlamydophila pneumoniae CWL029
ccgaggagggaaacaccgu

SEQ ID NO: 513601 - RNA, 18 nt, Chlamydophila pneumoniae CWL029
ccgaaucuuucaaaagaa

SEQ ID NO: 513602 - RNA, 15 nt, Chlamydophila pneumoniae CWL029
ccgaaaguaucuuca

SEQ ID NO: 513603 - RNA, 16 nt, Chlamydophila pneumoniae CWL029
ccgaaacuucucagau

SEQ ID NO: 513604 - RNA, 13 nt, Chlamydophila pneumoniae CWL029
cccuuucugcaau

SEQ ID NO: 513605 - RNA, 23 nt, Chlamydophila pneumoniae CWL029
cccuuuauacuguuuuucuucca

SEQ ID NO: 513606 - RNA, 23 nt, Chlamydophila pneumoniae CWL029
cccuuuaaaaguacgaccaacuc

SEQ ID NO: 513607 - RNA, 15 nt, Chlamydophila pneumoniae CWL029
cccucagaaaggaga

SEQ ID NO: 513608 - RNA, 23 nt, Chlamydophila pneumoniae CWL029
cccucacaagaagcaaacccaca

SEQ ID NO: 513609 - RNA, 22 nt, Chlamydophila pneumoniae CWL029
cccucccccaccaaagugacuu

SEQ ID NO: 513610 - RNA, 14 nt, Chlamydophila pneumoniae CWL029
cccuacagcagaaa

SEQ ID NO: 513611 - RNA, 19 nt, Chlamydophila pneumoniae CWL029
cccucaagcgauuucgaaa

SEQ ID NO: 513612 - RNA, 19 nt, Chlamydophila pneumoniae CWL029
cccucacaauauaaaugcu

SEQ ID NO: 513613 - RNA, 13 nt, Chlamydophila pneumoniae CWL029
cccgugagcaugc

SEQ ID NO: 513614 - RNA, 16 nt, Chlamydophila pneumoniae CWL029
cccggaggcaaagauc

SEQ ID NO: 513615 - RNA, 22 nt, Chlamydophila pneumoniae CWL029
cccgaguccuaaaauuucuagg

SEQ ID NO: 513616 - RNA, 19 nt, Chlamydophila pneumoniae CWL029
ccccucgaaucucaucugg

SEQ ID NO: 513617 - RNA, 14 nt, Chlamydophila pneumoniae CWL029
cccaugucuucaua

SEQ ID NO: 513618 - RNA, 11 nt, Chlamydophila pneumoniae CWL029
cccauuacagc

SEQ ID NO: 513619 - RNA, 11 nt, Chlamydophila pneumoniae CWL029
cccauuccugc

SEQ ID NO: 513620 - RNA, 14 nt, Chlamydophila pneumoniae CWL029
ccccacgcuaaacu

SEQ ID NO: 513621 - RNA, 19 nt, Chlamydophila pneumoniae CWL029
ccccacgcuaaacuaaaau

SEQ ID NO: 513622 - RNA, 22 nt, Chlamydophila pneumoniae CWL029
ccccaaucaguucaucuagaug

SEQ ID NO: 513623 - RNA, 15 nt, Chlamydophila pneumoniae CWL029
cccaaagcuaaaaug

SEQ ID NO: 513624 - RNA, 19 nt, Chlamydophila pneumoniae CWL029
cccaaacugaugccaagaa

SEQ ID NO: 513625 - RNA, 17 nt, Chlamydophila pneumoniae CWL029
cccaaagaggggagcua

SEQ ID NO: 513626 - RNA, 21 nt, Chlamydophila pneumoniae CWL029
cccaccaaagugacuuccucc

SEQ ID NO: 513627 - RNA, 18 nt, Chlamydophila pneumoniae CWL029
ccauuuuuggaaaaccau

SEQ ID NO: 513628 - RNA, 13 nt, Chlamydophila pneumoniae CWL029
ccauuuucuaaga

SEQ ID NO: 513629 - RNA, 15 nt, Chlamydophila pneumoniae CWL029
ccauuuuuccuccuc

SEQ ID NO: 513630 - RNA, 22 nt, Chlamydophila pneumoniae CWL029
ccauuuuugaauaugauuucca

SEQ ID NO: 513631 - RNA, 12 nt, Chlamydophila pneumoniae CWL029
ccauuuucuaag

SEQ ID NO: 513632 - RNA, 18 nt, Chlamydophila pneumoniae CWL029
ccauugaucagaaucuaa

SEQ ID NO: 513633 - RNA, 22 nt, Chlamydophila pneumoniae CWL029
ccauugaucagaaucuaaguaa

SEQ ID NO: 513634 - RNA, 19 nt, Chlamydophila pneumoniae CWL029
ccauuucauguaagaaugu

SEQ ID NO: 513635 - RNA, 15 nt, Chlamydophila pneumoniae CWL029
ccauuguuguugcau

SEQ ID NO: 513636 - RNA, 13 nt, Chlamydophila pneumoniae CWL029
cccacuccagaaa

SEQ ID NO: 513637 - RNA, 14 nt, Chlamydophila pneumoniae CWL029
cccacuagcccuug

SEQ ID NO: 513638 - RNA, 21 nt, Chlamydophila pneumoniae CWL029
cccacgggucaggagguggug

SEQ ID NO: 513639 - RNA, 18 nt, Chlamydophila pneumoniae CWL029
cccacggcaaguuguggc

SEQ ID NO: 513640 - RNA, 23 nt, Chlamydophila pneumoniae CWL029
ccaucauaaaacgugauugcugc

SEQ ID NO: 513641 - RNA, 13 nt, Chlamydophila pneumoniae CWL029
ccaucaucaccag

SEQ ID NO: 513642 - RNA, 20 nt, Chlamydophila pneumoniae CWL029
ccaucggcauuucuccacau

SEQ ID NO: 513643 - RNA, 19 nt, Chlamydophila pneumoniae CWL029
ccauaauuuuagcuucuuu

SEQ ID NO: 513644 - RNA, 22 nt, Chlamydophila pneumoniae CWL029
ccauaagaaugguuauuucuug

SEQ ID NO: 513645 - RNA, 22 nt, Chlamydophila pneumoniae CWL029
ccauaauuagaacagcauggac

SEQ ID NO: 513646 - RNA, 18 nt, Chlamydophila pneumoniae CWL029
ccauaauuucuuucacau

SEQ ID NO: 513647 - RNA, 20 nt, Chlamydophila pneumoniae CWL029
ccauaauuucuuucacaucu

SEQ ID NO: 513648 - RNA, 14 nt, Chlamydophila pneumoniae CWL029
ccaucaagguauug

SEQ ID NO: 513649 - RNA, 16 nt, Chlamydophila pneumoniae CWL029
ccauauccauggaaug

SEQ ID NO: 513650 - RNA, 14 nt, Chlamydophila pneumoniae CWL029
ccaucacuuccugu

SEQ ID NO: 513651 - RNA, 17 nt, Chlamydophila pneumoniae CWL029
ccaucacuuccuguugu

SEQ ID NO: 513652 - RNA, 19 nt, Chlamydophila pneumoniae CWL029
ccauaacagcacucacgcu

SEQ ID NO: 513653 - RNA, 21 nt, Chlamydophila pneumoniae CWL029
ccauaaccgucacuguuuucc

SEQ ID NO: 513654 - RNA, 16 nt, Chlamydophila pneumoniae CWL029
ccagggguuucuaaau

SEQ ID NO: 513655 - RNA, 19 nt, Chlamydophila pneumoniae CWL029
ccaggcugcgcuacaccca

SEQ ID NO: 513656 - RNA, 14 nt, Chlamydophila pneumoniae CWL029
ccaggauggcuccu

SEQ ID NO: 513657 - RNA, 15 nt, Chlamydophila pneumoniae CWL029
ccaggaauagaaaga

SEQ ID NO: 513658 - RNA, 22 nt, Chlamydophila pneumoniae CWL029
ccaggaauagaaagacauccuu

SEQ ID NO: 513659 - RNA, 18 nt, Chlamydophila pneumoniae CWL029
ccagcugauauccuugcu

SEQ ID NO: 513660 - RNA, 16 nt, Chlamydophila pneumoniae CWL029
ccagcgaugucuuuga

SEQ ID NO: 513661 - RNA, 13 nt, Chlamydophila pneumoniae CWL029
ccagaugccuuga

SEQ ID NO: 513662 - RNA, 19 nt, Chlamydophila pneumoniae CWL029
ccagaauauagacuuguau

SEQ ID NO: 513663 - RNA, 22 nt, Chlamydophila pneumoniae CWL029
ccagaagucgcaguaaugccaa

SEQ ID NO: 513664 - RNA, 22 nt, Chlamydophila pneumoniae CWL029
ccagagucgugccugguccaug

SEQ ID NO: 513665 - RNA, 18 nt, Chlamydophila pneumoniae CWL029
ccagauaaagcaaagaua

SEQ ID NO: 513666 - RNA, 20 nt, Chlamydophila pneumoniae CWL029
ccagcaccuuuaggaagcug

SEQ ID NO: 513667 - RNA, 23 nt, Chlamydophila pneumoniae CWL029
ccagcaccuuuaggaagcuguac

SEQ ID NO: 513668 - RNA, 21 nt, Chlamydophila pneumoniae CWL029
ccagaacaccaucacauccug

SEQ ID NO: 513669 - RNA, 14 nt, Chlamydophila pneumoniae CWL029
ccagaaauuacugu

SEQ ID NO: 513670 - RNA, 12 nt, Chlamydophila pneumoniae CWL029
ccacugcuuuag

SEQ ID NO: 513671 - RNA, 22 nt, Chlamydophila pneumoniae CWL029
ccacuccagaaaguauuccucu

SEQ ID NO: 513672 - RNA, 13 nt, Chlamydophila pneumoniae CWL029
ccacguccauuuc

SEQ ID NO: 513673 - RNA, 14 nt, Chlamydophila pneumoniae CWL029
ccacgaauucuuua

SEQ ID NO: 513674 - RNA, 16 nt, Chlamydophila pneumoniae CWL029
ccacgaauucuuuaaa

SEQ ID NO: 513675 - RNA, 22 nt, Chlamydophila pneumoniae CWL029
ccacgaccugcaaacuccccag

SEQ ID NO: 513676 - RNA, 13 nt, Chlamydophila pneumoniae CWL029
cggauuuucucua

SEQ ID NO: 513677 - RNA, 17 nt, Chlamydophila pneumoniae CWL029
cggauuuucucuacaca

SEQ ID NO: 513678 - RNA, 12 nt, Chlamydophila pneumoniae CWL029
cggaucuguaau

SEQ ID NO: 513679 - RNA, 19 nt, Chlamydophila pneumoniae CWL029
cggaucuucaauuggagga

SEQ ID NO: 513680 - RNA, 19 nt, Chlamydophila pneumoniae CWL029
cggaucgucgccuuuuccu

SEQ ID NO: 513681 - RNA, 22 nt, Chlamydophila pneumoniae CWL029
cggaucgucgccuuuuccuaaa

SEQ ID NO: 513682 - RNA, 14 nt, Chlamydophila pneumoniae CWL029
cggaacguauccuu

SEQ ID NO: 513683 - RNA, 13 nt, Chlamydophila pneumoniae CWL029
cggaacuaaagag

SEQ ID NO: 513684 - RNA, 23 nt, Chlamydophila pneumoniae CWL029
cggaacucucuucccccagaccu

SEQ ID NO: 513685 - RNA, 20 nt, Chlamydophila pneumoniae CWL029
cggcacuuacuucaagaaaa

SEQ ID NO: 513686 - RNA, 19 nt, Chlamydophila pneumoniae CWL029
cggaaaauacagccagcag

SEQ ID NO: 513687 - RNA, 17 nt, Chlamydophila pneumoniae CWL029
cggaaaaucacacuuuc

SEQ ID NO: 513688 - RNA, 23 nt, Chlamydophila pneumoniae CWL029
cggaaaauacagccagcagaagg

SEQ ID NO: 513689 - RNA, 12 nt, Chlamydophila pneumoniae CWL029
cgcuuuuuuaaa

SEQ ID NO: 513690 - RNA, 14 nt, Chlamydophila pneumoniae CWL029
cgcuuuuuuaaagu

SEQ ID NO: 513691 - RNA, 11 nt, Chlamydophila pneumoniae CWL029
cgcuuuugcua

SEQ ID NO: 513692 - RNA, 13 nt, Chlamydophila pneumoniae CWL029
cgcuuacaaauaa

SEQ ID NO: 513693 - RNA, 13 nt, Chlamydophila pneumoniae CWL029
cgcuugcaucuua

SEQ ID NO: 513694 - RNA, 21 nt, Chlamydophila pneumoniae CWL029
cgcuuagagaauuggaagcuu

SEQ ID NO: 513695 - RNA, 21 nt, Chlamydophila pneumoniae CWL029
cgcuugugguuagaggaagca

SEQ ID NO: 513696 - RNA, 18 nt, Chlamydophila pneumoniae CWL029
cgcuuuauguuuuguccu

SEQ ID NO: 513697 - RNA, 21 nt, Chlamydophila pneumoniae CWL029
cgcuguugaaaugcaguucuu

SEQ ID NO: 513698 - RNA, 14 nt, Chlamydophila pneumoniae CWL029
cgcugugaggaaaa

SEQ ID NO: 513699 - RNA, 14 nt, Chlamydophila pneumoniae CWL029
cgcucguauugaua

SEQ ID NO: 513700 - RNA, 19 nt, Chlamydophila pneumoniae CWL029
cgcucuaaacucucuuccu

SEQ ID NO: 513701 - RNA, 20 nt, Chlamydophila pneumoniae CWL029
cgcucuaagcugugcauuuu

SEQ ID NO: 513702 - RNA, 14 nt, Chlamydophila pneumoniae CWL029
cgcucucuccauga

SEQ ID NO: 513703 - RNA, 23 nt, Chlamydophila pneumoniae CWL029
cgcugcuucucuacuaaaaucuc

SEQ ID NO: 513704 - RNA, 17 nt, Chlamydophila pneumoniae CWL029
cgcuagaggaucuucaa

SEQ ID NO: 513705 - RNA, 12 nt, Chlamydophila pneumoniae CWL029
cgcggaucuucu

SEQ ID NO: 513706 - RNA, 20 nt, Chlamydophila pneumoniae CWL029
cgucaugagccgauguugca

SEQ ID NO: 513707 - RNA, 16 nt, Chlamydophila pneumoniae CWL029
cgucaguaaaacacaa

SEQ ID NO: 513708 - RNA, 24 nt, Chlamydophila pneumoniae CWL029
cgucaggaacccuggaugaacauc

SEQ ID NO: 513709 - RNA, 17 nt, Chlamydophila pneumoniae CWL029
cgucacauuuguuguca

SEQ ID NO: 513710 - RNA, 16 nt, Chlamydophila pneumoniae CWL029
cgucaaagguuuuaaa

SEQ ID NO: 513711 - RNA, 12 nt, Chlamydophila pneumoniae CWL029
cgucacugcgca

SEQ ID NO: 513712 - RNA, 19 nt, Chlamydophila pneumoniae CWL029
cgucacuguuuuccagaaa

SEQ ID NO: 513713 - RNA, 19 nt, Chlamydophila pneumoniae CWL029
cguauggauuucuccagca

SEQ ID NO: 513714 - RNA, 16 nt, Chlamydophila pneumoniae CWL029
cguaugcaucaaugaa

SEQ ID NO: 513715 - RNA, 21 nt, Chlamydophila pneumoniae CWL029
cguauccuugauuuuaaaaug

SEQ ID NO: 513716 - RNA, 16 nt, Chlamydophila pneumoniae CWL029
cguagguuugcugcuc

SEQ ID NO: 513717 - RNA, 18 nt, Chlamydophila pneumoniae CWL029
cguaggugccugaagaug

SEQ ID NO: 513718 - RNA, 21 nt, Chlamydophila pneumoniae CWL029
cguauacgucccacaaaauuu

SEQ ID NO: 513719 - RNA, 14 nt, Chlamydophila pneumoniae CWL029
cguauagauuuucc

SEQ ID NO: 513720 - RNA, 15 nt, Chlamydophila pneumoniae CWL029
cguauagauuuuccg

SEQ ID NO: 513721 - RNA, 22 nt, Chlamydophila pneumoniae CWL029
cguauagguacgcuuuuucuug

SEQ ID NO: 513722 - RNA, 14 nt, Chlamydophila pneumoniae CWL029
cguagcagaggcag

SEQ ID NO: 513723 - RNA, 23 nt, Chlamydophila pneumoniae CWL029
cguacuuuacacuauaagacauu

SEQ ID NO: 513724 - RNA, 17 nt, Chlamydophila pneumoniae CWL029
cguagacgcucuaaacu

SEQ ID NO: 513725 - RNA, 21 nt, Chlamydophila pneumoniae CWL029
cguagacgcucuaaacucucu

SEQ ID NO: 513726 - RNA, 19 nt, Chlamydophila pneumoniae CWL029
cguaggguagaaaaguuug

SEQ ID NO: 513727 - RNA, 18 nt, Chlamydophila pneumoniae CWL029
cguagcuugcgagcuucu

SEQ ID NO: 513728 - RNA, 21 nt, Chlamydophila pneumoniae CWL029
cguagcuugcgagcuucuuga

SEQ ID NO: 513729 - RNA, 13 nt, Chlamydophila pneumoniae CWL029
cgguuucugggau

SEQ ID NO: 513730 - RNA, 16 nt, Chlamydophila pneumoniae CWL029
cgguuucuuuuuuuug

SEQ ID NO: 513731 - RNA, 21 nt, Chlamydophila pneumoniae CWL029
cgguuuaaacagaucuuuauc

SEQ ID NO: 513732 - RNA, 16 nt, Chlamydophila pneumoniae CWL029
cggugggccucuuccc

SEQ ID NO: 513733 - RNA, 21 nt, Chlamydophila pneumoniae CWL029
cggucacguucuuagaaagcg

SEQ ID NO: 513734 - RNA, 21 nt, Chlamydophila pneumoniae CWL029
cgcgauuuucaaccaagguug

SEQ ID NO: 513735 - RNA, 23 nt, Chlamydophila pneumoniae CWL029
cgcgagugugacugcagagaaau

SEQ ID NO: 513736 - RNA, 23 nt, Chlamydophila pneumoniae CWL029
cgcgagcuauuuuacuuacuaaa

SEQ ID NO: 513737 - RNA, 15 nt, Chlamydophila pneumoniae CWL029
cgccuuuuccuaaau

SEQ ID NO: 513738 - RNA, 14 nt, Chlamydophila pneumoniae CWL029
cgccuucuaauuuc

SEQ ID NO: 513739 - RNA, 13 nt, Chlamydophila pneumoniae CWL029
cgcgaagcuuucc

SEQ ID NO: 513740 - RNA, 20 nt, Chlamydophila pneumoniae CWL029
cgccuucaagucgagaaaca

SEQ ID NO: 513741 - RNA, 13 nt, Chlamydophila pneumoniae CWL029
cgccuagaauggc

SEQ ID NO: 513742 - RNA, 12 nt, Chlamydophila pneumoniae CWL029
cgccccaugaau

SEQ ID NO: 513743 - RNA, 21 nt, Chlamydophila pneumoniae CWL029
cgcacaccagcucgagaucuu

SEQ ID NO: 513744 - RNA, 16 nt, Chlamydophila pneumoniae CWL029
cgcaaaggaaaagaua

SEQ ID NO: 513745 - RNA, 15 nt, Chlamydophila pneumoniae CWL029
cgcaccauuccuuag

SEQ ID NO: 513746 - RNA, 21 nt, Chlamydophila pneumoniae CWL029
cgauggcaguuuuaaugagag

SEQ ID NO: 513747 - RNA, 19 nt, Chlamydophila pneumoniae CWL029
cgaugaaacugaagguaaa

SEQ ID NO: 513748 - RNA, 22 nt, Chlamydophila pneumoniae CWL029
cgaucuucucauccagacaaga

SEQ ID NO: 513749 - RNA, 18 nt, Chlamydophila pneumoniae CWL029
cgaugacagggaaagaac

SEQ ID NO: 513750 - RNA, 17 nt, Chlamydophila pneumoniae CWL029
cgaugacagggaaagaa

SEQ ID NO: 513751 - RNA, 14 nt, Chlamydophila pneumoniae CWL029
cgaucgucaguaaa

SEQ ID NO: 513752 - RNA, 13 nt, Chlamydophila pneumoniae CWL029
cgauacgaaggau

SEQ ID NO: 513753 - RNA, 20 nt, Chlamydophila pneumoniae CWL029
cgauacgaaggaucauauuu

SEQ ID NO: 513754 - RNA, 13 nt, Chlamydophila pneumoniae CWL029
cgauaaaaacucc

SEQ ID NO: 513755 - RNA, 22 nt, Chlamydophila pneumoniae CWL029
ccuucauacguuuuuuuccuuu

SEQ ID NO: 513756 - RNA, 13 nt, Chlamydophila pneumoniae CWL029
ccuucauucuuuc

SEQ ID NO: 513757 - RNA, 16 nt, Chlamydophila pneumoniae CWL029
cuuccaauuguaaauc

SEQ ID NO: 513758 - RNA, 21 nt, Chlamydophila pneumoniae CWL029
cuuccacacaacucguuucag

SEQ ID NO: 513759 - RNA, 20 nt, Chlamydophila pneumoniae CWL029
cuuccacuguucuucuucag

SEQ ID NO: 513760 - RNA, 17 nt, Chlamydophila pneumoniae CWL029
cuucagaaucuuuguga

SEQ ID NO: 513761 - RNA, 18 nt, Chlamydophila pneumoniae CWL029
cuuccaacggacauuuuc

SEQ ID NO: 513762 - RNA, 16 nt, Chlamydophila pneumoniae CWL029
cuuccaagugcucagu

SEQ ID NO: 513763 - RNA, 22 nt, Chlamydophila pneumoniae CWL029
cuuccaaagacugagcuucuau

SEQ ID NO: 513764 - RNA, 13 nt, Chlamydophila pneumoniae CWL029
cuuccugcugcuu

SEQ ID NO: 513765 - RNA, 20 nt, Chlamydophila pneumoniae CWL029
cuuccgugcgauuuccccuu

SEQ ID NO: 513766 - RNA, 14 nt, Chlamydophila pneumoniae CWL029
cuucccucuccuug

SEQ ID NO: 513767 - RNA, 14 nt, Chlamydophila pneumoniae CWL029
cuuccuccaaaauu

SEQ ID NO: 513768 - RNA, 13 nt, Chlamydophila pneumoniae CWL029
cuuccuauaaaaa

SEQ ID NO: 513769 - RNA, 20 nt, Chlamydophila pneumoniae CWL029
cuuccccaagcucucuccau

SEQ ID NO: 513770 - RNA, 21 nt, Chlamydophila pneumoniae CWL029
cuucccauuucuucuuagaaa

SEQ ID NO: 513771 - RNA, 15 nt, Chlamydophila pneumoniae CWL029
cuucccccagaccua

SEQ ID NO: 513772 - RNA, 18 nt, Chlamydophila pneumoniae CWL029
cuucccucaugaagaauu

SEQ ID NO: 513773 - RNA, 22 nt, Chlamydophila pneumoniae CWL029
cuucccgaaggggaagaggaau

SEQ ID NO: 513774 - RNA, 14 nt, Chlamydophila pneumoniae CWL029
cuucuaugaauuga

SEQ ID NO: 513775 - RNA, 18 nt, Chlamydophila pneumoniae CWL029
cuucuaugauaucaccag

SEQ ID NO: 513776 - RNA, 17 nt, Chlamydophila pneumoniae CWL029
cuucuagguauuuguuu

SEQ ID NO: 513777 - RNA, 12 nt, Chlamydophila pneumoniae CWL029
cuucuaaaacca

SEQ ID NO: 513778 - RNA, 16 nt, Chlamydophila pneumoniae CWL029
cuucuaaggaaauuac

SEQ ID NO: 513779 - RNA, 20 nt, Chlamydophila pneumoniae CWL029
cuucuaaggaaauuacaauc

SEQ ID NO: 513780 - RNA, 13 nt, Chlamydophila pneumoniae CWL029
cuucuacagcauc

SEQ ID NO: 513781 - RNA, 21 nt, Chlamydophila pneumoniae CWL029
cuucuacagaauaggaacaaa

SEQ ID NO: 513782 - RNA, 22 nt, Chlamydophila pneumoniae CWL029
cuucguuagaaaccaugaugca

SEQ ID NO: 513783 - RNA, 15 nt, Chlamydophila pneumoniae CWL029
cuucguuucgcuuug

SEQ ID NO: 513784 - RNA, 14 nt, Chlamydophila pneumoniae CWL029
cuucggaucuguaa

SEQ ID NO: 513785 - RNA, 17 nt, Chlamydophila pneumoniae CWL029
cuucggaauacugcgca

SEQ ID NO: 513786 - RNA, 15 nt, Chlamydophila pneumoniae CWL029
cuucggaucuguaau

SEQ ID NO: 513787 - RNA, 17 nt, Chlamydophila pneumoniae CWL029
cuuccuucuucuucaaa

SEQ ID NO: 513788 - RNA, 13 nt, Chlamydophila pneumoniae CWL029
cuuccuuuuucug

SEQ ID NO: 513789 - RNA, 15 nt, Chlamydophila pneumoniae CWL029
cuucgacaaggaagc

SEQ ID NO: 513790 - RNA, 20 nt, Chlamydophila pneumoniae CWL029
cuucgaagcggagcaucuuu

SEQ ID NO: 513791 - RNA, 21 nt, Chlamydophila pneumoniae CWL029
cuucgacuucaccuugaaguu

SEQ ID NO: 513792 - RNA, 21 nt, Chlamydophila pneumoniae CWL029
cuucaauaggaauuagagaaa

SEQ ID NO: 513793 - RNA, 22 nt, Chlamydophila pneumoniae CWL029
cuucaaguuucuuuugcaaauc

SEQ ID NO: 513794 - RNA, 16 nt, Chlamydophila pneumoniae CWL029
cuucacucuuucugua

SEQ ID NO: 513795 - RNA, 12 nt, Chlamydophila pneumoniae CWL029
cuucaacucuau

SEQ ID NO: 513796 - RNA, 16 nt, Chlamydophila pneumoniae CWL029
cuucaagaaaaacccc

SEQ ID NO: 513797 - RNA, 15 nt, Chlamydophila pneumoniae CWL029
cuucaagaaaugccc

SEQ ID NO: 513798 - RNA, 19 nt, Chlamydophila pneumoniae CWL029
cuucaagagcuuuuacaaa

SEQ ID NO: 513799 - RNA, 15 nt, Chlamydophila pneumoniae CWL029
cuucaagguacuuua

SEQ ID NO: 513800 - RNA, 19 nt, Chlamydophila pneumoniae CWL029
cuucaaggcaucuucuuug

SEQ ID NO: 513801 - RNA, 23 nt, Chlamydophila pneumoniae CWL029
cuucaaggcaucuucuuugccaa

SEQ ID NO: 513802 - RNA, 13 nt, Chlamydophila pneumoniae CWL029
cuucaaaugaaau

SEQ ID NO: 513803 - RNA, 21 nt, Chlamydophila pneumoniae CWL029
cuucaaaaguuccccaauuuc

SEQ ID NO: 513804 - RNA, 14 nt, Chlamydophila pneumoniae CWL029
cuucaaaaaacaac

SEQ ID NO: 513805 - RNA, 12 nt, Chlamydophila pneumoniae CWL029
cuucaaaaagcu

SEQ ID NO: 513806 - RNA, 20 nt, Chlamydophila pneumoniae CWL029
cuuauaaacuucaaugaaga

SEQ ID NO: 513807 - RNA, 20 nt, Chlamydophila pneumoniae CWL029
cuuaucuuuaaauucgccaa

SEQ ID NO: 513808 - RNA, 14 nt, Chlamydophila pneumoniae CWL029
cuuaugcucauuaa

SEQ ID NO: 513809 - RNA, 17 nt, Chlamydophila pneumoniae CWL029
cuuauguagauugaucc

SEQ ID NO: 513810 - RNA, 21 nt, Chlamydophila pneumoniae CWL029
cuuauguagauugauccagcc

SEQ ID NO: 513811 - RNA, 16 nt, Chlamydophila pneumoniae CWL029
cuuaguaucgagcucu

SEQ ID NO: 513812 - RNA, 23 nt, Chlamydophila pneumoniae CWL029
cuuaguccgguuucuucuaccaa

SEQ ID NO: 513813 - RNA, 19 nt, Chlamydophila pneumoniae CWL029
cuuagggccguauucccag

SEQ ID NO: 513814 - RNA, 15 nt, Chlamydophila pneumoniae CWL029
cuuaggguucucaaa

SEQ ID NO: 513815 - RNA, 16 nt, Chlamydophila pneumoniae CWL029
cuuaggguucucaaag

SEQ ID NO: 513816 - RNA, 15 nt, Chlamydophila pneumoniae CWL029
cuuaggauucuuauc

SEQ ID NO: 513817 - RNA, 20 nt, Chlamydophila pneumoniae CWL029
cuuaggauucuuaucacaaa

SEQ ID NO: 513818 - RNA, 15 nt, Chlamydophila pneumoniae CWL029
cuuaggaauuuuucu

SEQ ID NO: 513819 - RNA, 15 nt, Chlamydophila pneumoniae CWL029
cuuaggaaagagucu

SEQ ID NO: 513820 - RNA, 20 nt, Chlamydophila pneumoniae CWL029
cuuagagcgaauguagccaa

SEQ ID NO: 513821 - RNA, 16 nt, Chlamydophila pneumoniae CWL029
cuuagccccuccaaca

SEQ ID NO: 513822 - RNA, 22 nt, Chlamydophila pneumoniae CWL029
cuuagaaucuaagauccugaga

SEQ ID NO: 513823 - RNA, 22 nt, Chlamydophila pneumoniae CWL029
cuuagaagggaaaguaccuuua

SEQ ID NO: 513824 - RNA, 15 nt, Chlamydophila pneumoniae CWL029
cuuacauaaaccuuu

SEQ ID NO: 513825 - RNA, 16 nt, Chlamydophila pneumoniae CWL029
cuuacauccaauuuug

SEQ ID NO: 513826 - RNA, 20 nt, Chlamydophila pneumoniae CWL029
cuuaaugagaguuucuaaug

SEQ ID NO: 513827 - RNA, 15 nt, Chlamydophila pneumoniae CWL029
cuuaauaauguuuua

SEQ ID NO: 513828 - RNA, 13 nt, Chlamydophila pneumoniae CWL029
cuuaauaaacauc

SEQ ID NO: 513829 - RNA, 16 nt, Chlamydophila pneumoniae CWL029
cuuaacuuuaggcccu

SEQ ID NO: 513830 - RNA, 22 nt, Chlamydophila pneumoniae CWL029
cuuaagaguuuuacaucaauga

SEQ ID NO: 513831 - RNA, 21 nt, Chlamydophila pneumoniae CWL029
cuuaacuggcaaucuaaaauc

SEQ ID NO: 513832 - RNA, 18 nt, Chlamydophila pneumoniae CWL029
cuguuccugaguacuuug

SEQ ID NO: 513833 - RNA, 17 nt, Chlamydophila pneumoniae CWL029
cuguucccacuaagaau

SEQ ID NO: 513834 - RNA, 18 nt, Chlamydophila pneumoniae CWL029
cuuaaccuccucaagaau

SEQ ID NO: 513835 - RNA, 11 nt, Chlamydophila pneumoniae CWL029
cuuaacaacau

SEQ ID NO: 513836 - RNA, 20 nt, Chlamydophila pneumoniae CWL029
cuuaacaaccgccuuuauau

SEQ ID NO: 513837 - RNA, 19 nt, Chlamydophila pneumoniae CWL029
cuuugcuggagacaacuau

SEQ ID NO: 513838 - RNA, 13 nt, Chlamydophila pneumoniae CWL029
cuuugcuuaaaaa

SEQ ID NO: 513839 - RNA, 15 nt, Chlamydophila pneumoniae CWL029
cuuugcuuaaaaagu

SEQ ID NO: 513840 - RNA, 14 nt, Chlamydophila pneumoniae CWL029
cuuugcaugaggag

SEQ ID NO: 513841 - RNA, 23 nt, Chlamydophila pneumoniae CWL029
cuuugcgaacgaagacuuguucu

SEQ ID NO: 513842 - RNA, 17 nt, Chlamydophila pneumoniae CWL029
cuuugauuuucaggaga

SEQ ID NO: 513843 - RNA, 16 nt, Chlamydophila pneumoniae CWL029
cuuugaauuuccaaag

SEQ ID NO: 513844 - RNA, 16 nt, Chlamydophila pneumoniae CWL029
cuuugacaucuaauuu

SEQ ID NO: 513845 - RNA, 15 nt, Chlamydophila pneumoniae CWL029
cuuugacauugaauc

SEQ ID NO: 513846 - RNA, 15 nt, Chlamydophila pneumoniae CWL029
cuuugagaucuugaa

SEQ ID NO: 513847 - RNA, 17 nt, Chlamydophila pneumoniae CWL029
cuuugagaucuugaaug

SEQ ID NO: 513848 - RNA, 19 nt, Chlamydophila pneumoniae CWL029
cuuugaggcaagucucaaa

SEQ ID NO: 513849 - RNA, 15 nt, Chlamydophila pneumoniae CWL029
cuuugagucuuuuuc

SEQ ID NO: 513850 - RNA, 15 nt, Chlamydophila pneumoniae CWL029
cuuugaguuaagcaa

SEQ ID NO: 513851 - RNA, 16 nt, Chlamydophila pneumoniae CWL029
cuuugaauaaugcauc

SEQ ID NO: 513852 - RNA, 21 nt, Chlamydophila pneumoniae CWL029
cuuugaauaaugcaucccccg

SEQ ID NO: 513853 - RNA, 23 nt, Chlamydophila pneumoniae CWL029
cuuugaagcucgaccucuagcuc

SEQ ID NO: 513854 - RNA, 19 nt, Chlamydophila pneumoniae CWL029
cuuucuaagaauucuuugc

SEQ ID NO: 513855 - RNA, 23 nt, Chlamydophila pneumoniae CWL029
cuuucuaagaauucuuugccaag

SEQ ID NO: 513856 - RNA, 15 nt, Chlamydophila pneumoniae CWL029
cuuuaggaacuugaa

SEQ ID NO: 513857 - RNA, 17 nt, Chlamydophila pneumoniae CWL029
cuuuagggaauccccaa

SEQ ID NO: 513858 - RNA, 15 nt, Chlamydophila pneumoniae CWL029
cuuuauuuaaauaaa

SEQ ID NO: 513859 - RNA, 17 nt, Chlamydophila pneumoniae CWL029
cuuucaaccuccgcucu

SEQ ID NO: 513860 - RNA, 10 nt, Chlamydophila pneumoniae CWL029
cuuucaaagg

SEQ ID NO: 513861 - RNA, 22 nt, Chlamydophila pneumoniae CWL029
cuuucaagagcagugaaauuuu

SEQ ID NO: 513862 - RNA, 11 nt, Chlamydophila pneumoniae CWL029
cuuucaaggaa

SEQ ID NO: 513863 - RNA, 22 nt, Chlamydophila pneumoniae CWL029
cuuuauuuugaugcuucuuuca

SEQ ID NO: 513864 - RNA, 18 nt, Chlamydophila pneumoniae CWL029
cuuucaauguaauugcgc

SEQ ID NO: 513865 - RNA, 14 nt, Chlamydophila pneumoniae CWL029
cuuuagcugcugaa

SEQ ID NO: 513866 - RNA, 16 nt, Chlamydophila pneumoniae CWL029
cuuuagcaaucucuuu

SEQ ID NO: 513867 - RNA, 17 nt, Chlamydophila pneumoniae CWL029
cuuuagaaaagugcccu

SEQ ID NO: 513868 - RNA, 21 nt, Chlamydophila pneumoniae CWL029
cuugucuuccacgaaggaauc

SEQ ID NO: 513869 - RNA, 19 nt, Chlamydophila pneumoniae CWL029
cuugucgcgacaagacaau

SEQ ID NO: 513870 - RNA, 16 nt, Chlamydophila pneumoniae CWL029
cuugucuaggagcuuc

SEQ ID NO: 513871 - RNA, 16 nt, Chlamydophila pneumoniae CWL029
cuuuaagauuuuuaga

SEQ ID NO: 513872 - RNA, 18 nt, Chlamydophila pneumoniae CWL029
cuuuaagguugcuuuucu

SEQ ID NO: 513873 - RNA, 18 nt, Chlamydophila pneumoniae CWL029
cuuggucggaguuuuuuu

SEQ ID NO: 513874 - RNA, 19 nt, Chlamydophila pneumoniae CWL029
cuuggucgaucaagguguu

SEQ ID NO: 513875 - RNA, 16 nt, Chlamydophila pneumoniae CWL029
cuuguauaagagcaag

SEQ ID NO: 513876 - RNA, 18 nt, Chlamydophila pneumoniae CWL029
cuuguauuguacuuuuug

SEQ ID NO: 513877 - RNA, 20 nt, Chlamydophila pneumoniae CWL029
cuugucacacugcgagagaa

SEQ ID NO: 513878 - RNA, 21 nt, Chlamydophila pneumoniae CWL029
cuuguagcucccguuccuuua

SEQ ID NO: 513879 - RNA, 19 nt, Chlamydophila pneumoniae CWL029
cuugguagcgucucuucuu

SEQ ID NO: 513880 - RNA, 20 nt, Chlamydophila pneumoniae CWL029
cuugguaggaugucgcuuuu

SEQ ID NO: 513881 - RNA, 19 nt, Chlamydophila pneumoniae CWL029
cuugggcaaauaggagagc

SEQ ID NO: 513882 - RNA, 15 nt, Chlamydophila pneumoniae CWL029
cuugggacauuuccc

SEQ ID NO: 513883 - RNA, 16 nt, Chlamydophila pneumoniae CWL029
cuuggcucuagaaaua

SEQ ID NO: 513884 - RNA, 18 nt, Chlamydophila pneumoniae CWL029
cuugcuuauccaaguguu

SEQ ID NO: 513885 - RNA, 13 nt, Chlamydophila pneumoniae CWL029
cuuggauuucuuc

SEQ ID NO: 513886 - RNA, 18 nt, Chlamydophila pneumoniae CWL029
cuuggauuucuucuucua

SEQ ID NO: 513887 - RNA, 20 nt, Chlamydophila pneumoniae CWL029
cuugcugauuucuuuuucag

SEQ ID NO: 513888 - RNA, 15 nt, Chlamydophila pneumoniae CWL029
cuugcgacauaacca

SEQ ID NO: 513889 - RNA, 18 nt, Chlamydophila pneumoniae CWL029
cuugccaguauugauaau

SEQ ID NO: 513890 - RNA, 16 nt, Chlamydophila pneumoniae CWL029
cuugccagcagaaguu

SEQ ID NO: 513891 - RNA, 17 nt, Chlamydophila pneumoniae CWL029
cuugcaaggagcuuuuc

SEQ ID NO: 513892 - RNA, 21 nt, Chlamydophila pneumoniae CWL029
cuugcaaaacagcaucaggau

SEQ ID NO: 513893 - RNA, 24 nt, Chlamydophila pneumoniae CWL029
cuugcaaaacagcaucaggauucu

SEQ ID NO: 513894 - RNA, 19 nt, Chlamydophila pneumoniae CWL029
cuugauuuuaaaaugaccg

SEQ ID NO: 513895 - RNA, 13 nt, Chlamydophila pneumoniae CWL029
cuugaucuacaaa

SEQ ID NO: 513896 - RNA, 15 nt, Chlamydophila pneumoniae CWL029
cuugaucuacaaaaa

SEQ ID NO: 513897 - RNA, 21 nt, Chlamydophila pneumoniae CWL029
cuugaucuacaaaaacuagaa

SEQ ID NO: 513898 - RNA, 14 nt, Chlamydophila pneumoniae CWL029
cuugauauuugucu

SEQ ID NO: 513899 - RNA, 18 nt, Chlamydophila pneumoniae CWL029
cuugagaaaagaacaggg

SEQ ID NO: 513900 - RNA, 16 nt, Chlamydophila pneumoniae CWL029
cuugacucuaauucag

SEQ ID NO: 513901 - RNA, 22 nt, Chlamydophila pneumoniae CWL029
cuugacucuaauucagaaagac

SEQ ID NO: 513902 - RNA, 22 nt, Chlamydophila pneumoniae CWL029
cuugaucaggauggucauacca

SEQ ID NO: 513903 - RNA, 15 nt, Chlamydophila pneumoniae CWL029
cuugaaguucuucaa

SEQ ID NO: 513904 - RNA, 20 nt, Chlamydophila pneumoniae CWL029
cuugaaguuuugguuuuaga

SEQ ID NO: 513905 - RNA, 15 nt, Chlamydophila pneumoniae CWL029
cuugaaguuuuuucu

SEQ ID NO: 513906 - RNA, 15 nt, Chlamydophila pneumoniae CWL029
cuugaauucucaagg

SEQ ID NO: 513907 - RNA, 15 nt, Chlamydophila pneumoniae CWL029
cuugacaaauaaguc

SEQ ID NO: 513908 - RNA, 19 nt, Chlamydophila pneumoniae CWL029
cuugaccucaucagaagug

SEQ ID NO: 513909 - RNA, 20 nt, Chlamydophila pneumoniae CWL029
cuugacggcaggacucuuua

SEQ ID NO: 513910 - RNA, 20 nt, Chlamydophila pneumoniae CWL029
cuucuuuccauaaagcccca

SEQ ID NO: 513911 - RNA, 18 nt, Chlamydophila pneumoniae CWL029
cuucuuucugcucuucua

SEQ ID NO: 513912 - RNA, 14 nt, Chlamydophila pneumoniae CWL029
cuucuccaacccca

SEQ ID NO: 513913 - RNA, 17 nt, Chlamydophila pneumoniae CWL029
cuucuccagagcaagau

SEQ ID NO: 513914 - RNA, 19 nt, Chlamydophila pneumoniae CWL029
cuucucaagaucuucauca

SEQ ID NO: 513915 - RNA, 16 nt, Chlamydophila pneumoniae CWL029
cuucuauuuuuuugga

SEQ ID NO: 513916 - RNA, 11 nt, Chlamydophila pneumoniae CWL029
cuucucaaaga

SEQ ID NO: 513917 - RNA, 11 nt, Chlamydophila pneumoniae CWL029
cuucucagaaa

SEQ ID NO: 513918 - RNA, 12 nt, Chlamydophila pneumoniae CWL029
cuucuuuuucuu

SEQ ID NO: 513919 - RNA, 13 nt, Chlamydophila pneumoniae CWL029
cuugaagaucucc

SEQ ID NO: 513920 - RNA, 14 nt, Chlamydophila pneumoniae CWL029
cuguggcaauagcg

SEQ ID NO: 513921 - RNA, 19 nt, Chlamydophila pneumoniae CWL029
cuguggcauacucuuugca

SEQ ID NO: 513922 - RNA, 22 nt, Chlamydophila pneumoniae CWL029
cuguggcauacucuuugcagug

SEQ ID NO: 513923 - RNA, 23 nt, Chlamydophila pneumoniae CWL029
cuguggcguaagcaauaucuaua

SEQ ID NO: 513924 - RNA, 13 nt, Chlamydophila pneumoniae CWL029
cuguuaacucaga

SEQ ID NO: 513925 - RNA, 23 nt, Chlamydophila pneumoniae CWL029
cuguguuuuauccaccaagacug

SEQ ID NO: 513926 - RNA, 13 nt, Chlamydophila pneumoniae CWL029
cuguguuuuuagg

SEQ ID NO: 513927 - RNA, 17 nt, Chlamydophila pneumoniae CWL029
cuguucauaauccaaga

SEQ ID NO: 513928 - RNA, 22 nt, Chlamydophila pneumoniae CWL029
cugugauuuccugacuauaaaa

SEQ ID NO: 513929 - RNA, 15 nt, Chlamydophila pneumoniae CWL029
cugugcaucagucag

SEQ ID NO: 513930 - RNA, 23 nt, Chlamydophila pneumoniae CWL029
cugugcaucagucagacucacau

SEQ ID NO: 513931 - RNA, 18 nt, Chlamydophila pneumoniae CWL029
cugugcauuuucuucuug

SEQ ID NO: 513932 - RNA, 16 nt, Chlamydophila pneumoniae CWL029
cugugaaaauuuucuu

SEQ ID NO: 513933 - RNA, 13 nt, Chlamydophila pneumoniae CWL029
cugugauaguaga

SEQ ID NO: 513934 - RNA, 14 nt, Chlamydophila pneumoniae CWL029
cugugauaguagaa

SEQ ID NO: 513935 - RNA, 17 nt, Chlamydophila pneumoniae CWL029
cuguauagaaacuguua

SEQ ID NO: 513936 - RNA, 20 nt, Chlamydophila pneumoniae CWL029
cuguagggaaagacucaucu

SEQ ID NO: 513937 - RNA, 18 nt, Chlamydophila pneumoniae CWL029
cuguauagaaacuguuaa

SEQ ID NO: 513938 - RNA, 16 nt, Chlamydophila pneumoniae CWL029
cuguaucgacuguaca

SEQ ID NO: 513939 - RNA, 14 nt, Chlamydophila pneumoniae CWL029
cuguccauccaaau

SEQ ID NO: 513940 - RNA, 15 nt, Chlamydophila pneumoniae CWL029
cuguccauccaaaua

SEQ ID NO: 513941 - RNA, 14 nt, Chlamydophila pneumoniae CWL029
cugucauuaaaaau

SEQ ID NO: 513942 - RNA, 23 nt, Chlamydophila pneumoniae CWL029
cugucauuaaaaauuuaaaagau

SEQ ID NO: 513943 - RNA, 14 nt, Chlamydophila pneumoniae CWL029
cugucauccuugcg

SEQ ID NO: 513944 - RNA, 18 nt, Chlamydophila pneumoniae CWL029
cuguaucgauaguuuuug

SEQ ID NO: 513945 - RNA, 16 nt, Chlamydophila pneumoniae CWL029
cuguacgguaaaucca

SEQ ID NO: 513946 - RNA, 12 nt, Chlamydophila pneumoniae CWL029
cuguaagaaaau

SEQ ID NO: 513947 - RNA, 18 nt, Chlamydophila pneumoniae CWL029
cuguaacuugcauuuuuu

SEQ ID NO: 513948 - RNA, 20 nt, Chlamydophila pneumoniae CWL029
cuguagauuuucccuaagag

SEQ ID NO: 513949 - RNA, 21 nt, Chlamydophila pneumoniae CWL029
cuguagagcgcccgaaucuuu

SEQ ID NO: 513950 - RNA, 17 nt, Chlamydophila pneumoniae CWL029
cuguagaaacauuuaag

SEQ ID NO: 513951 - RNA, 21 nt, Chlamydophila pneumoniae CWL029
cuggguucuccacaugcccaa

SEQ ID NO: 513952 - RNA, 19 nt, Chlamydophila pneumoniae CWL029
cugguaaaggauauugaua

SEQ ID NO: 513953 - RNA, 21 nt, Chlamydophila pneumoniae CWL029
cugguuaagcaccauaaugga

SEQ ID NO: 513954 - RNA, 16 nt, Chlamydophila pneumoniae CWL029
cuggggcuuccagaaa

SEQ ID NO: 513955 - RNA, 20 nt, Chlamydophila pneumoniae CWL029
cugggggagcuagaaagucc

SEQ ID NO: 513956 - RNA, 15 nt, Chlamydophila pneumoniae CWL029
cugggcgucuucuuc

SEQ ID NO: 513957 - RNA, 19 nt, Chlamydophila pneumoniae CWL029
cugggauguucaaagccau

SEQ ID NO: 513958 - RNA, 15 nt, Chlamydophila pneumoniae CWL029
cugggaagacucuca

SEQ ID NO: 513959 - RNA, 19 nt, Chlamydophila pneumoniae CWL029
cugggaaggggagauuccc

SEQ ID NO: 513960 - RNA, 18 nt, Chlamydophila pneumoniae CWL029
cugggaauuguucuugaa

SEQ ID NO: 513961 - RNA, 20 nt, Chlamydophila pneumoniae CWL029
cuggcuccuaaacucaauua

SEQ ID NO: 513962 - RNA, 13 nt, Chlamydophila pneumoniae CWL029
cuggcuaaaggau

SEQ ID NO: 513963 - RNA, 14 nt, Chlamydophila pneumoniae CWL029
cuggcuauggaaga

SEQ ID NO: 513964 - RNA, 14 nt, Chlamydophila pneumoniae CWL029
cuggcugagagaag

SEQ ID NO: 513965 - RNA, 12 nt, Chlamydophila pneumoniae CWL029
cuggcuuaggag

SEQ ID NO: 513966 - RNA, 19 nt, Chlamydophila pneumoniae CWL029
cugcuuacaauugaaaauu

SEQ ID NO: 513967 - RNA, 17 nt, Chlamydophila pneumoniae CWL029
cugcuucuauagagaca

SEQ ID NO: 513968 - RNA, 13 nt, Chlamydophila pneumoniae CWL029
cuggccaucauca

SEQ ID NO: 513969 - RNA, 13 nt, Chlamydophila pneumoniae CWL029
cugcugaggagag

SEQ ID NO: 513970 - RNA, 16 nt, Chlamydophila pneumoniae CWL029
cugcugcuaagccaaa

SEQ ID NO: 513971 - RNA, 12 nt, Chlamydophila pneumoniae CWL029
cugcugcuacga

SEQ ID NO: 513972 - RNA, 21 nt, Chlamydophila pneumoniae CWL029
cugcuguguuauggaaaucac

SEQ ID NO: 513973 - RNA, 11 nt, Chlamydophila pneumoniae CWL029
cugcuccugaa

SEQ ID NO: 513974 - RNA, 13 nt, Chlamydophila pneumoniae CWL029
cugcuccugaagc

SEQ ID NO: 513975 - RNA, 13 nt, Chlamydophila pneumoniae CWL029
cugcugaaaucau

SEQ ID NO: 513976 - RNA, 16 nt, Chlamydophila pneumoniae CWL029
cugcugacaucuccaa

SEQ ID NO: 513977 - RNA, 19 nt, Chlamydophila pneumoniae CWL029
cugcgucaauaagcuugcc

SEQ ID NO: 513978 - RNA, 16 nt, Chlamydophila pneumoniae CWL029
cugcgcuagcuccagc

SEQ ID NO: 513979 - RNA, 19 nt, Chlamydophila pneumoniae CWL029
cugcgacuacaagauagug

SEQ ID NO: 513980 - RNA, 22 nt, Chlamydophila pneumoniae CWL029
cugcgacacgaauuucuaacuu

SEQ ID NO: 513981 - RNA, 14 nt, Chlamydophila pneumoniae CWL029
cugcauguugcaaa

SEQ ID NO: 513982 - RNA, 15 nt, Chlamydophila pneumoniae CWL029
cugcauaauuuuucu

SEQ ID NO: 513983 - RNA, 18 nt, Chlamydophila pneumoniae CWL029
cugcauaaucucaccaga

SEQ ID NO: 513984 - RNA, 20 nt, Chlamydophila pneumoniae CWL029
cugcauaaucucaccagaag

SEQ ID NO: 513985 - RNA, 16 nt, Chlamydophila pneumoniae CWL029
cugcauaauuuuucuu

SEQ ID NO: 513986 - RNA, 20 nt, Chlamydophila pneumoniae CWL029
cugcauacccuucuucuuca

SEQ ID NO: 513987 - RNA, 19 nt, Chlamydophila pneumoniae CWL029
cugcaucccaccgacaaga

SEQ ID NO: 513988 - RNA, 19 nt, Chlamydophila pneumoniae CWL029
cugcagcaggugucagacu

SEQ ID NO: 513989 - RNA, 16 nt, Chlamydophila pneumoniae CWL029
cugcagcagaugaaac

SEQ ID NO: 513990 - RNA, 23 nt, Chlamydophila pneumoniae CWL029
cugcacgaucgcgauaagaagcu

SEQ ID NO: 513991 - RNA, 21 nt, Chlamydophila pneumoniae CWL029
cugauguaggugauauuuucu

SEQ ID NO: 513992 - RNA, 23 nt, Chlamydophila pneumoniae CWL029
cugauguaggugauauuuucuug

SEQ ID NO: 513993 - RNA, 12 nt, Chlamydophila pneumoniae CWL029
cugauucuccca

SEQ ID NO: 513994 - RNA, 19 nt, Chlamydophila pneumoniae CWL029
cugauucucccaauaucca

SEQ ID NO: 513995 - RNA, 22 nt, Chlamydophila pneumoniae CWL029
cugauucucccaauauccagaa

SEQ ID NO: 513996 - RNA, 23 nt, Chlamydophila pneumoniae CWL029
cugauucuccgucccccggcucu

SEQ ID NO: 513997 - RNA, 18 nt, Chlamydophila pneumoniae CWL029
cugauucuguauaaacaa

SEQ ID NO: 513998 - RNA, 20 nt, Chlamydophila pneumoniae CWL029
cugauuuuucaagaccuaag

SEQ ID NO: 513999 - RNA, 16 nt, Chlamydophila pneumoniae CWL029
cugaugccuuuuucuu

SEQ ID NO: 514000 - RNA, 22 nt, Chlamydophila pneumoniae CWL029
cugaugccaagaaauauacugc

SEQ ID NO: 514001 - RNA, 16 nt, Chlamydophila pneumoniae CWL029
cugagcaacuucuucg

SEQ ID NO: 514002 - RNA, 23 nt, Chlamydophila pneumoniae CWL029
cugagcaacuucuucguuagaga

SEQ ID NO: 514003 - RNA, 17 nt, Chlamydophila pneumoniae CWL029
cugagcacgaguucucc

SEQ ID NO: 514004 - RNA, 14 nt, Chlamydophila pneumoniae CWL029
cugacugcauagac

SEQ ID NO: 514005 - RNA, 23 nt, Chlamydophila pneumoniae CWL029
cugagacauauugaagauauuau

SEQ ID NO: 514006 - RNA, 19 nt, Chlamydophila pneumoniae CWL029
cugagaccauaaaaucaac

SEQ ID NO: 514007 - RNA, 13 nt, Chlamydophila pneumoniae CWL029
cugagaauacaac

SEQ ID NO: 514008 - RNA, 18 nt, Chlamydophila pneumoniae CWL029
cugagaauacaacccuuu

SEQ ID NO: 514009 - RNA, 20 nt, Chlamydophila pneumoniae CWL029
cugacucuuauugcagaauc

SEQ ID NO: 514010 - RNA, 22 nt, Chlamydophila pneumoniae CWL029
cugacuauagggagacucuuga

SEQ ID NO: 514011 - RNA, 22 nt, Chlamydophila pneumoniae CWL029
cugacccuguagcgaagagagu

SEQ ID NO: 514012 - RNA, 18 nt, Chlamydophila pneumoniae CWL029
cugaaucccguuaaaaaa

SEQ ID NO: 514013 - RNA, 18 nt, Chlamydophila pneumoniae CWL029
cugaauaugcuuuucaaa

SEQ ID NO: 514014 - RNA, 20 nt, Chlamydophila pneumoniae CWL029
cugaauauaguuuaaauguc

SEQ ID NO: 514015 - RNA, 17 nt, Chlamydophila pneumoniae CWL029
cugaauaccguuucagg

SEQ ID NO: 514016 - RNA, 16 nt, Chlamydophila pneumoniae CWL029
cugaauagcucuuuuc

SEQ ID NO: 514017 - RNA, 17 nt, Chlamydophila pneumoniae CWL029
cugaauagcucuuuuca

SEQ ID NO: 514018 - RNA, 22 nt, Chlamydophila pneumoniae CWL029
cugaauagcucuuuucaugaua

SEQ ID NO: 514019 - RNA, 16 nt, Chlamydophila pneumoniae CWL029
cugaagggacagucuc

SEQ ID NO: 514020 - RNA, 16 nt, Chlamydophila pneumoniae CWL029
cugaagcuaaaaaauu

SEQ ID NO: 514021 - RNA, 17 nt, Chlamydophila pneumoniae CWL029
cugaagcugcaaacuga

SEQ ID NO: 514022 - RNA, 11 nt, Chlamydophila pneumoniae CWL029
cugaagcugca

SEQ ID NO: 514023 - RNA, 13 nt, Chlamydophila pneumoniae CWL029
cugaagauuuuuu

SEQ ID NO: 514024 - RNA, 14 nt, Chlamydophila pneumoniae CWL029
cugaagaugagaaa

SEQ ID NO: 514025 - RNA, 21 nt, Chlamydophila pneumoniae CWL029
cugaagagcaauuaagaaacu

SEQ ID NO: 514026 - RNA, 21 nt, Chlamydophila pneumoniae CWL029
cugaagauauauuuuuaaaga

SEQ ID NO: 514027 - RNA, 24 nt, Chlamydophila pneumoniae CWL029
cugaagcagcuucugcaggauuug

SEQ ID NO: 514028 - RNA, 20 nt, Chlamydophila pneumoniae CWL029
cugaagccaugacaaagggu

SEQ ID NO: 514029 - RNA, 15 nt, Chlamydophila pneumoniae CWL029
cugaagaccccucuu

SEQ ID NO: 514030 - RNA, 22 nt, Chlamydophila pneumoniae CWL029
cugaacuguucauaauccaaga

SEQ ID NO: 514031 - RNA, 16 nt, Chlamydophila pneumoniae CWL029
cugaacaucuccagca

SEQ ID NO: 514032 - RNA, 20 nt, Chlamydophila pneumoniae CWL029
cugaaccaaaucuaucugca

SEQ ID NO: 514033 - RNA, 14 nt, Chlamydophila pneumoniae CWL029
cugaacgagguaac

SEQ ID NO: 514034 - RNA, 13 nt, Chlamydophila pneumoniae CWL029
cugaaauuaaguc

SEQ ID NO: 514035 - RNA, 16 nt, Chlamydophila pneumoniae CWL029
cugaaaucaaaaaaaa

SEQ ID NO: 514036 - RNA, 15 nt, Chlamydophila pneumoniae CWL029
cugaaauccugggca

SEQ ID NO: 514037 - RNA, 18 nt, Chlamydophila pneumoniae CWL029
cugaaauugucuucagug

SEQ ID NO: 514038 - RNA, 20 nt, Chlamydophila pneumoniae CWL029
cugaaaccuucucucuuaaa

SEQ ID NO: 514039 - RNA, 20 nt, Chlamydophila pneumoniae CWL029
cugaaagaacacuccugacu

SEQ ID NO: 514040 - RNA, 17 nt, Chlamydophila pneumoniae CWL029
cugaaagaacacuccug

SEQ ID NO: 514041 - RNA, 15 nt, Chlamydophila pneumoniae CWL029
cugaaaguacgcaua

SEQ ID NO: 514042 - RNA, 13 nt, Chlamydophila pneumoniae CWL029
cucuuuuaagaca

SEQ ID NO: 514043 - RNA, 23 nt, Chlamydophila pneumoniae CWL029
cucuuugacaucuaauuuuaaau

SEQ ID NO: 514044 - RNA, 17 nt, Chlamydophila pneumoniae CWL029
cucuuucgaugcuauuu

SEQ ID NO: 514045 - RNA, 16 nt, Chlamydophila pneumoniae CWL029
cucuuuccuuagcauu

SEQ ID NO: 514046 - RNA, 16 nt, Chlamydophila pneumoniae CWL029
cucuuucuaaaacauc

SEQ ID NO: 514047 - RNA, 15 nt, Chlamydophila pneumoniae CWL029
cucuucuacuuuaag

SEQ ID NO: 514048 - RNA, 23 nt, Chlamydophila pneumoniae CWL029
cucuucuacuuuaagaagcacuu

SEQ ID NO: 514049 - RNA, 21 nt, Chlamydophila pneumoniae CWL029
cucuucgcuggcauguuuaau

SEQ ID NO: 514050 - RNA, 20 nt, Chlamydophila pneumoniae CWL029
cucuugauugcuaucaaaga

SEQ ID NO: 514051 - RNA, 16 nt, Chlamydophila pneumoniae CWL029
cucuugaauauuuaaa

SEQ ID NO: 514052 - RNA, 15 nt, Chlamydophila pneumoniae CWL029
cucuucuuuggaugc

SEQ ID NO: 514053 - RNA, 20 nt, Chlamydophila pneumoniae CWL029
cucuuuauauuuuuugagaa

SEQ ID NO: 514054 - RNA, 23 nt, Chlamydophila pneumoniae CWL029
cucuuuauauuuuuugagaaaua

SEQ ID NO: 514055 - RNA, 16 nt, Chlamydophila pneumoniae CWL029
cucuuuauauuuuuug

SEQ ID NO: 514056 - RNA, 19 nt, Chlamydophila pneumoniae CWL029
cucuuuagcaaacauuuuu

SEQ ID NO: 514057 - RNA, 21 nt, Chlamydophila pneumoniae CWL029
cucuuuagcaaacauuuuuau

SEQ ID NO: 514058 - RNA, 22 nt, Chlamydophila pneumoniae CWL029
cucuuuaauccaguuuuuuaaa

SEQ ID NO: 514059 - RNA, 14 nt, Chlamydophila pneumoniae CWL029
cucuuucagcucaa

SEQ ID NO: 514060 - RNA, 16 nt, Chlamydophila pneumoniae CWL029
cucuuucagcucaagu

SEQ ID NO: 514061 - RNA, 18 nt, Chlamydophila pneumoniae CWL029
cucuuuaaaaauagaaau

SEQ ID NO: 514062 - RNA, 21 nt, Chlamydophila pneumoniae CWL029
cucuuuaaaaauuaaagugaa

SEQ ID NO: 514063 - RNA, 14 nt, Chlamydophila pneumoniae CWL029
cucuuuaagaacuu

SEQ ID NO: 514064 - RNA, 19 nt, Chlamydophila pneumoniae CWL029
cucuuuaagcaagagcucc

SEQ ID NO: 514065 - RNA, 15 nt, Chlamydophila pneumoniae CWL029
cucuuggaugaccuu

SEQ ID NO: 514066 - RNA, 20 nt, Chlamydophila pneumoniae CWL029
cucugugccaucuguagacc

SEQ ID NO: 514067 - RNA, 23 nt, Chlamydophila pneumoniae CWL029
cucugugguuccuggauuuagga

SEQ ID NO: 514068 - RNA, 23 nt, Chlamydophila pneumoniae CWL029
cucugugguuuuuauucuuaaug

SEQ ID NO: 514069 - RNA, 18 nt, Chlamydophila pneumoniae CWL029
cucuguaguaaagccaca

SEQ ID NO: 514070 - RNA, 20 nt, Chlamydophila pneumoniae CWL029
cucuguaagaacguggggaa

SEQ ID NO: 514071 - RNA, 23 nt, Chlamydophila pneumoniae CWL029
cucuuaaaugugaaaucguaucu

SEQ ID NO: 514072 - RNA, 12 nt, Chlamydophila pneumoniae CWL029
cucuuaacuggc

SEQ ID NO: 514073 - RNA, 15 nt, Chlamydophila pneumoniae CWL029
cucuucaaaagaccg

SEQ ID NO: 514074 - RNA, 15 nt, Chlamydophila pneumoniae CWL029
cucuucauuuucuuu

SEQ ID NO: 514075 - RNA, 21 nt, Chlamydophila pneumoniae CWL029
cucuucaauuucuucaucaau

SEQ ID NO: 514076 - RNA, 18 nt, Chlamydophila pneumoniae CWL029
cucuuccuucuacagauu

SEQ ID NO: 514077 - RNA, 14 nt, Chlamydophila pneumoniae CWL029
cucuuccugcugcu

SEQ ID NO: 514078 - RNA, 15 nt, Chlamydophila pneumoniae CWL029
cucuuccugcugcuu

SEQ ID NO: 514079 - RNA, 15 nt, Chlamydophila pneumoniae CWL029
cucuuccuucuauug

SEQ ID NO: 514080 - RNA, 19 nt, Chlamydophila pneumoniae CWL029
cucugguauagaaacaccg

SEQ ID NO: 514081 - RNA, 20 nt, Chlamydophila pneumoniae CWL029
cucugguauagaaacaccgu

SEQ ID NO: 514082 - RNA, 21 nt, Chlamydophila pneumoniae CWL029
cucugggaagacucucaucag

SEQ ID NO: 514083 - RNA, 15 nt, Chlamydophila pneumoniae CWL029
cucugccuaccaaag

SEQ ID NO: 514084 - RNA, 16 nt, Chlamydophila pneumoniae CWL029
cucugcauauugcucu

SEQ ID NO: 514085 - RNA, 19 nt, Chlamydophila pneumoniae CWL029
cucugccaugucuaaagga

SEQ ID NO: 514086 - RNA, 18 nt, Chlamydophila pneumoniae CWL029
cucugaucccucaaaauc

SEQ ID NO: 514087 - RNA, 18 nt, Chlamydophila pneumoniae CWL029
cucugagucgacaugcag

SEQ ID NO: 514088 - RNA, 21 nt, Chlamydophila pneumoniae CWL029
cucugacuugcaagcuucuug

SEQ ID NO: 514089 - RNA, 20 nt, Chlamydophila pneumoniae CWL029
cucugaagaccccucuugcu

SEQ ID NO: 514090 - RNA, 16 nt, Chlamydophila pneumoniae CWL029
cucugaagcuaaaaaa

SEQ ID NO: 514091 - RNA, 12 nt, Chlamydophila pneumoniae CWL029
cucugaaggauu

SEQ ID NO: 514092 - RNA, 15 nt, Chlamydophila pneumoniae CWL029
cucucuugcuauacc

SEQ ID NO: 514093 - RNA, 15 nt, Chlamydophila pneumoniae CWL029
cucucuuuaaaaaua

SEQ ID NO: 514094 - RNA, 23 nt, Chlamydophila pneumoniae CWL029
cucucucaagucuauuugaaaag

SEQ ID NO: 514095 - RNA, 16 nt, Chlamydophila pneumoniae CWL029
cucucuccaugagcuc

SEQ ID NO: 514096 - RNA, 19 nt, Chlamydophila pneumoniae CWL029
cucucuguagcacuucuca

SEQ ID NO: 514097 - RNA, 21 nt, Chlamydophila pneumoniae CWL029
cucucuguagcacuucucagc

SEQ ID NO: 514098 - RNA, 13 nt, Chlamydophila pneumoniae CWL029
cucucuuccaaaa

SEQ ID NO: 514099 - RNA, 14 nt, Chlamydophila pneumoniae CWL029
cucucuucccccag

SEQ ID NO: 514100 - RNA, 13 nt, Chlamydophila pneumoniae CWL029
cucucuuccugcu

SEQ ID NO: 514101 - RNA, 13 nt, Chlamydophila pneumoniae CWL029
cucucuuccuucu

SEQ ID NO: 514102 - RNA, 17 nt, Chlamydophila pneumoniae CWL029
cucucuuuaaaaauaua

SEQ ID NO: 514103 - RNA, 18 nt, Chlamydophila pneumoniae CWL029
cucucuuuauauuuuuug

SEQ ID NO: 514104 - RNA, 15 nt, Chlamydophila pneumoniae CWL029
cucucuuuaucuuua

SEQ ID NO: 514105 - RNA, 13 nt, Chlamydophila pneumoniae CWL029
cucucgcuaagca

SEQ ID NO: 514106 - RNA, 24 nt, Chlamydophila pneumoniae CWL029
cucuccuugacaaauaaguccugu

SEQ ID NO: 514107 - RNA, 16 nt, Chlamydophila pneumoniae CWL029
cucuccugcaaaaagu

SEQ ID NO: 514108 - RNA, 23 nt, Chlamydophila pneumoniae CWL029
cucuccuaaugccgagaauacag

SEQ ID NO: 514109 - RNA, 12 nt, Chlamydophila pneumoniae CWL029
cucuccauggcu

SEQ ID NO: 514110 - RNA, 19 nt, Chlamydophila pneumoniae CWL029
cucuccgauaugggcuuug

SEQ ID NO: 514111 - RNA, 13 nt, Chlamydophila pneumoniae CWL029
cucucaugaaauu

SEQ ID NO: 514112 - RNA, 18 nt, Chlamydophila pneumoniae CWL029
cucuccagaagucgcagu

SEQ ID NO: 514113 - RNA, 22 nt, Chlamydophila pneumoniae CWL029
cucucaucaaagcaaagagcaa

SEQ ID NO: 514114 - RNA, 13 nt, Chlamydophila pneumoniae CWL029
cucuaguaagaaa

SEQ ID NO: 514115 - RNA, 15 nt, Chlamydophila pneumoniae CWL029
cucuagggguuuccc

SEQ ID NO: 514116 - RNA, 23 nt, Chlamydophila pneumoniae CWL029
cucuauagugcauaccuuaccau

SEQ ID NO: 514117 - RNA, 17 nt, Chlamydophila pneumoniae CWL029
cucuauauauccugagu

SEQ ID NO: 514118 - RNA, 19 nt, Chlamydophila pneumoniae CWL029
cucuauauauccugaguga

SEQ ID NO: 514119 - RNA, 17 nt, Chlamydophila pneumoniae CWL029
cucuauauuuuuuccca

SEQ ID NO: 514120 - RNA, 14 nt, Chlamydophila pneumoniae CWL029
cucucacugagugu

SEQ ID NO: 514121 - RNA, 13 nt, Chlamydophila pneumoniae CWL029
cucucacugagug

SEQ ID NO: 514122 - RNA, 13 nt, Chlamydophila pneumoniae CWL029
cucucaauaagau

SEQ ID NO: 514123 - RNA, 18 nt, Chlamydophila pneumoniae CWL029
cucuaauucuucuacaga

SEQ ID NO: 514124 - RNA, 23 nt, Chlamydophila pneumoniae CWL029
cucuagcaccuaauaaagaaggu

SEQ ID NO: 514125 - RNA, 23 nt, Chlamydophila pneumoniae CWL029
cucuagccaauauagaagcugcu

SEQ ID NO: 514126 - RNA, 14 nt, Chlamydophila pneumoniae CWL029
cucuagccaccaac

SEQ ID NO: 514127 - RNA, 21 nt, Chlamydophila pneumoniae CWL029
cucuagccaccaacaguccug

SEQ ID NO: 514128 - RNA, 17 nt, Chlamydophila pneumoniae CWL029
cucuagcucaaaucuca

SEQ ID NO: 514129 - RNA, 19 nt, Chlamydophila pneumoniae CWL029
cucuagggauaauuaaacu

SEQ ID NO: 514130 - RNA, 21 nt, Chlamydophila pneumoniae CWL029
cucuaagcugugcauuuucuu

SEQ ID NO: 514131 - RNA, 21 nt, Chlamydophila pneumoniae CWL029
cucuaaggacaaaucucccaa

SEQ ID NO: 514132 - RNA, 18 nt, Chlamydophila pneumoniae CWL029
cucuaaguccaacaucag

SEQ ID NO: 514133 - RNA, 14 nt, Chlamydophila pneumoniae CWL029
cucuaacuucauua

SEQ ID NO: 514134 - RNA, 18 nt, Chlamydophila pneumoniae CWL029
cucuaagcagccucuucu

SEQ ID NO: 514135 - RNA, 16 nt, Chlamydophila pneumoniae CWL029
cucuaagcgaaacauu

SEQ ID NO: 514136 - RNA, 17 nt, Chlamydophila pneumoniae CWL029
cucuaagcgaaacauua

SEQ ID NO: 514137 - RNA, 17 nt, Chlamydophila pneumoniae CWL029
cucguuauauuuuucug

SEQ ID NO: 514138 - RNA, 20 nt, Chlamydophila pneumoniae CWL029
cucguagcuauuuuugagga

SEQ ID NO: 514139 - RNA, 22 nt, Chlamydophila pneumoniae CWL029
cucgcaguccuugagcuaacga

SEQ ID NO: 514140 - RNA, 19 nt, Chlamydophila pneumoniae CWL029
cucgcaauccaggaauaga

SEQ ID NO: 514141 - RNA, 19 nt, Chlamydophila pneumoniae CWL029
cucgaacucugaaguacac

SEQ ID NO: 514142 - RNA, 16 nt, Chlamydophila pneumoniae CWL029
cucgaagaaaauaaag

SEQ ID NO: 514143 - RNA, 19 nt, Chlamydophila pneumoniae CWL029
cucgaacaggagagagaag

SEQ ID NO: 514144 - RNA, 12 nt, Chlamydophila pneumoniae CWL029
cucgaaauccua

SEQ ID NO: 514145 - RNA, 19 nt, Chlamydophila pneumoniae CWL029
cuccuucauucacagcagu

SEQ ID NO: 514146 - RNA, 19 nt, Chlamydophila pneumoniae CWL029
cuccuucaauacgcuagcu

SEQ ID NO: 514147 - RNA, 13 nt, Chlamydophila pneumoniae CWL029
cuccuucucccug

SEQ ID NO: 514148 - RNA, 13 nt, Chlamydophila pneumoniae CWL029
cucgaaacucuuu

SEQ ID NO: 514149 - RNA, 19 nt, Chlamydophila pneumoniae CWL029
cucgaaacucuuugaggau

SEQ ID NO: 514150 - RNA, 13 nt, Chlamydophila pneumoniae CWL029
cuccuuuaaauaa

SEQ ID NO: 514151 - RNA, 17 nt, Chlamydophila pneumoniae CWL029
cuccuuugagucuuuuu

SEQ ID NO: 514152 - RNA, 18 nt, Chlamydophila pneumoniae CWL029
cuccuuuguauucagugu

SEQ ID NO: 514153 - RNA, 13 nt, Chlamydophila pneumoniae CWL029
cuccuggaagaau

SEQ ID NO: 514154 - RNA, 23 nt, Chlamydophila pneumoniae CWL029
cuccugaagccaugacaaagggu

SEQ ID NO: 514155 - RNA, 21 nt, Chlamydophila pneumoniae CWL029
cuccugaagggacaaguacga

SEQ ID NO: 514156 - RNA, 12 nt, Chlamydophila pneumoniae CWL029
cuccugaagcug

SEQ ID NO: 514157 - RNA, 23 nt, Chlamydophila pneumoniae CWL029
cuccucguuaauaagaaccucua

SEQ ID NO: 514158 - RNA, 15 nt, Chlamydophila pneumoniae CWL029
cuccucgucuaaaga

SEQ ID NO: 514159 - RNA, 17 nt, Chlamydophila pneumoniae CWL029
cuccuccaaucugcuga

SEQ ID NO: 514160 - RNA, 23 nt, Chlamydophila pneumoniae CWL029
cuccgcuuuuacgaaugagauca

SEQ ID NO: 514161 - RNA, 19 nt, Chlamydophila pneumoniae CWL029
cuccucagaauccauuuug

SEQ ID NO: 514162 - RNA, 20 nt, Chlamydophila pneumoniae CWL029
cuccgucauauuuaaaaggc

SEQ ID NO: 514163 - RNA, 20 nt, Chlamydophila pneumoniae CWL029
cucccuagguuuuaucuuua

SEQ ID NO: 514164 - RNA, 17 nt, Chlamydophila pneumoniae CWL029
cucccuaugccaguucc

SEQ ID NO: 514165 - RNA, 20 nt, Chlamydophila pneumoniae CWL029
cuccgaauggagaaggacac

SEQ ID NO: 514166 - RNA, 20 nt, Chlamydophila pneumoniae CWL029
cucccguuccuuuagccugg

SEQ ID NO: 514167 - RNA, 15 nt, Chlamydophila pneumoniae CWL029
cuccgaggcuucuga

SEQ ID NO: 514168 - RNA, 16 nt, Chlamydophila pneumoniae CWL029
cuccgccuacaauacu

SEQ ID NO: 514169 - RNA, 18 nt, Chlamydophila pneumoniae CWL029
cuccacaugcccaaacau

SEQ ID NO: 514170 - RNA, 22 nt, Chlamydophila pneumoniae CWL029
cuccacaugcccaaacaucauu

SEQ ID NO: 514171 - RNA, 14 nt, Chlamydophila pneumoniae CWL029
cuccacaugccugc

SEQ ID NO: 514172 - RNA, 13 nt, Chlamydophila pneumoniae CWL029
cuccaccaggagc

SEQ ID NO: 514173 - RNA, 19 nt, Chlamydophila pneumoniae CWL029
cuccaccaggagcuccucc

SEQ ID NO: 514174 - RNA, 21 nt, Chlamydophila pneumoniae CWL029
cuccaccaggagcuccuccuu

SEQ ID NO: 514175 - RNA, 18 nt, Chlamydophila pneumoniae CWL029
cucagcguucgcucucuu

SEQ ID NO: 514176 - RNA, 15 nt, Chlamydophila pneumoniae CWL029
cucacucuuuucuag

SEQ ID NO: 514177 - RNA, 17 nt, Chlamydophila pneumoniae CWL029
cucacuggcuccuaaac

SEQ ID NO: 514178 - RNA, 16 nt, Chlamydophila pneumoniae CWL029
cucauagcuuccugua

SEQ ID NO: 514179 - RNA, 18 nt, Chlamydophila pneumoniae CWL029
cucauagcuuccuguagu

SEQ ID NO: 514180 - RNA, 18 nt, Chlamydophila pneumoniae CWL029
cucauaguuucuaucuaa

SEQ ID NO: 514181 - RNA, 19 nt, Chlamydophila pneumoniae CWL029
cucagugaacucuucaaga

SEQ ID NO: 514182 - RNA, 23 nt, Chlamydophila pneumoniae CWL029
cucagugaacucuucaagagcuu

SEQ ID NO: 514183 - RNA, 15 nt, Chlamydophila pneumoniae CWL029
cucaguguauuguuu

SEQ ID NO: 514184 - RNA, 12 nt, Chlamydophila pneumoniae CWL029
cucaguugagaa

SEQ ID NO: 514185 - RNA, 15 nt, Chlamydophila pneumoniae CWL029
cucauaacccaaagg

SEQ ID NO: 514186 - RNA, 13 nt, Chlamydophila pneumoniae CWL029
cuccaaugggcag

SEQ ID NO: 514187 - RNA, 18 nt, Chlamydophila pneumoniae CWL029
cuccaagucagccaagac

SEQ ID NO: 514188 - RNA, 19 nt, Chlamydophila pneumoniae CWL029
cuccaagcuuggucgcaag

SEQ ID NO: 514189 - RNA, 14 nt, Chlamydophila pneumoniae CWL029
cuccaagaauagca

SEQ ID NO: 514190 - RNA, 11 nt, Chlamydophila pneumoniae CWL029
cuccaaauaaa

SEQ ID NO: 514191 - RNA, 23 nt, Chlamydophila pneumoniae CWL029
cuccaacaccgaaggcacuggca

SEQ ID NO: 514192 - RNA, 13 nt, Chlamydophila pneumoniae CWL029
cuccaacagucug

SEQ ID NO: 514193 - RNA, 19 nt, Chlamydophila pneumoniae CWL029
cuccaacuaaaccuucaau

SEQ ID NO: 514194 - RNA, 13 nt, Chlamydophila pneumoniae CWL029
cuccaacuuccau

SEQ ID NO: 514195 - RNA, 18 nt, Chlamydophila pneumoniae CWL029
cucauuccagcaucuucu

SEQ ID NO: 514196 - RNA, 22 nt, Chlamydophila pneumoniae CWL029
cucauugcggcaccaaagaugc

SEQ ID NO: 514197 - RNA, 21 nt, Chlamydophila pneumoniae CWL029
cuccaaacauuuuuaaggaaa

SEQ ID NO: 514198 - RNA, 14 nt, Chlamydophila pneumoniae CWL029
cuccaaaauaaucu

SEQ ID NO: 514199 - RNA, 19 nt, Chlamydophila pneumoniae CWL029
cucauccagacaagacacu

SEQ ID NO: 514200 - RNA, 22 nt, Chlamydophila pneumoniae CWL029
cucaucauaaauaggcucuaca

SEQ ID NO: 514201 - RNA, 21 nt, Chlamydophila pneumoniae CWL029
cucaugaaauuucauucucac

SEQ ID NO: 514202 - RNA, 20 nt, Chlamydophila pneumoniae CWL029
cucaucuuugaacaacuccu

SEQ ID NO: 514203 - RNA, 19 nt, Chlamydophila pneumoniae CWL029
cucaugcggacuuuauucu

SEQ ID NO: 514204 - RNA, 14 nt, Chlamydophila pneumoniae CWL029
cucaauacuucagg

SEQ ID NO: 514205 - RNA, 15 nt, Chlamydophila pneumoniae CWL029
cucacaaacaacaga

SEQ ID NO: 514206 - RNA, 20 nt, Chlamydophila pneumoniae CWL029
cucacaaacaacagaaaugu

SEQ ID NO: 514207 - RNA, 19 nt, Chlamydophila pneumoniae CWL029
cucacaacccuuuaucaag

SEQ ID NO: 514208 - RNA, 23 nt, Chlamydophila pneumoniae CWL029
cucaacuuaaguugaccuuuuuc

SEQ ID NO: 514209 - RNA, 19 nt, Chlamydophila pneumoniae CWL029
cucaagaagaugauuggac

SEQ ID NO: 514210 - RNA, 15 nt, Chlamydophila pneumoniae CWL029
cucaagaauaugaac

SEQ ID NO: 514211 - RNA, 17 nt, Chlamydophila pneumoniae CWL029
cucaagagcaugcuuga

SEQ ID NO: 514212 - RNA, 20 nt, Chlamydophila pneumoniae CWL029
cucaagagcaugcuugagga

SEQ ID NO: 514213 - RNA, 13 nt, Chlamydophila pneumoniae CWL029
cucaaaucuuuca

SEQ ID NO: 514214 - RNA, 13 nt, Chlamydophila pneumoniae CWL029
cucaaaaucacau

SEQ ID NO: 514215 - RNA, 23 nt, Chlamydophila pneumoniae CWL029
cucaaaauuuaaauauagaaaau

SEQ ID NO: 514216 - RNA, 21 nt, Chlamydophila pneumoniae CWL029
cuauugguguaucucuuaaaa

SEQ ID NO: 514217 - RNA, 20 nt, Chlamydophila pneumoniae CWL029
cuauugcugcggccacauua

SEQ ID NO: 514218 - RNA, 22 nt, Chlamydophila pneumoniae CWL029
cuauucuauacgcuuaacauga

SEQ ID NO: 514219 - RNA, 20 nt, Chlamydophila pneumoniae CWL029
cuauucccgacucggagacc

SEQ ID NO: 514220 - RNA, 22 nt, Chlamydophila pneumoniae CWL029
cuauuccauaaaaauguaauuu

SEQ ID NO: 514221 - RNA, 20 nt, Chlamydophila pneumoniae CWL029
cuauuagcgcggucacuuca

SEQ ID NO: 514222 - RNA, 15 nt, Chlamydophila pneumoniae CWL029
cuauuauuuuaaagu

SEQ ID NO: 514223 - RNA, 12 nt, Chlamydophila pneumoniae CWL029
cuaucuccagaa

SEQ ID NO: 514224 - RNA, 15 nt, Chlamydophila pneumoniae CWL029
cuaugcacaaaauaa

SEQ ID NO: 514225 - RNA, 19 nt, Chlamydophila pneumoniae CWL029
cuaugcgcucuaagagccc

SEQ ID NO: 514226 - RNA, 15 nt, Chlamydophila pneumoniae CWL029
cuaugucuguuccca

SEQ ID NO: 514227 - RNA, 23 nt, Chlamydophila pneumoniae CWL029
cuaugugaugucgcgaaaguaaa

SEQ ID NO: 514228 - RNA, 13 nt, Chlamydophila pneumoniae CWL029
cuauguguucucg

SEQ ID NO: 514229 - RNA, 18 nt, Chlamydophila pneumoniae CWL029
cuaucgguuuaaacagau

SEQ ID NO: 514230 - RNA, 16 nt, Chlamydophila pneumoniae CWL029
cuaucuaaucaauucg

SEQ ID NO: 514231 - RNA, 23 nt, Chlamydophila pneumoniae CWL029
cuaugaugagaacguccucaccu

SEQ ID NO: 514232 - RNA, 16 nt, Chlamydophila pneumoniae CWL029
cuauagcaauccauag

SEQ ID NO: 514233 - RNA, 17 nt, Chlamydophila pneumoniae CWL029
cuauagcuggaucuucu

SEQ ID NO: 514234 - RNA, 20 nt, Chlamydophila pneumoniae CWL029
cuauagggaucuccuugaga

SEQ ID NO: 514235 - RNA, 13 nt, Chlamydophila pneumoniae CWL029
cuauagggaucuc

SEQ ID NO: 514236 - RNA, 21 nt, Chlamydophila pneumoniae CWL029
cuauagucuguuuuggaaaga

SEQ ID NO: 514237 - RNA, 22 nt, Chlamydophila pneumoniae CWL029
cuauagucuguuuuggaaagaa

SEQ ID NO: 514238 - RNA, 16 nt, Chlamydophila pneumoniae CWL029
cuaguuuuucuuuaga

SEQ ID NO: 514239 - RNA, 18 nt, Chlamydophila pneumoniae CWL029
cuauaaaaaccuuaucgc

SEQ ID NO: 514240 - RNA, 19 nt, Chlamydophila pneumoniae CWL029
cuauaaaaaccuuaucgca

SEQ ID NO: 514241 - RNA, 15 nt, Chlamydophila pneumoniae CWL029
cuauagaucuugaaa

SEQ ID NO: 514242 - RNA, 19 nt, Chlamydophila pneumoniae CWL029
cuauagaucuugaaaagau

SEQ ID NO: 514243 - RNA, 19 nt, Chlamydophila pneumoniae CWL029
cuauagaugccauaagucc

SEQ ID NO: 514244 - RNA, 20 nt, Chlamydophila pneumoniae CWL029
cuaucaucaaugguuaaaac

SEQ ID NO: 514245 - RNA, 22 nt, Chlamydophila pneumoniae CWL029
cuaucagagcgaucgcaaucag

SEQ ID NO: 514246 - RNA, 20 nt, Chlamydophila pneumoniae CWL029
cuaucagcuggguaagucca

SEQ ID NO: 514247 - RNA, 13 nt, Chlamydophila pneumoniae CWL029
cuauauuuuuucc

SEQ ID NO: 514248 - RNA, 14 nt, Chlamydophila pneumoniae CWL029
cuauauuuuuuccc

SEQ ID NO: 514249 - RNA, 19 nt, Chlamydophila pneumoniae CWL029
cuagggacuucucaaagac

SEQ ID NO: 514250 - RNA, 21 nt, Chlamydophila pneumoniae CWL029
cuaggaacucuuuaaaagggc

SEQ ID NO: 514251 - RNA, 21 nt, Chlamydophila pneumoniae CWL029
cuaggcgcauaugcuccagaa

SEQ ID NO: 514252 - RNA, 14 nt, Chlamydophila pneumoniae CWL029
cuagcuccagcauc

SEQ ID NO: 514253 - RNA, 12 nt, Chlamydophila pneumoniae CWL029
cuagaucuucaa

SEQ ID NO: 514254 - RNA, 15 nt, Chlamydophila pneumoniae CWL029
cuagaugaagagugg

SEQ ID NO: 514255 - RNA, 18 nt, Chlamydophila pneumoniae CWL029
cuagagaaccuccuauuc

SEQ ID NO: 514256 - RNA, 22 nt, Chlamydophila pneumoniae CWL029
cuagagaguucuuguaauaaaa

SEQ ID NO: 514257 - RNA, 20 nt, Chlamydophila pneumoniae CWL029
cuagcaaaucuaaaaccuga

SEQ ID NO: 514258 - RNA, 15 nt, Chlamydophila pneumoniae CWL029
cuagguauuuguuuc

SEQ ID NO: 514259 - RNA, 20 nt, Chlamydophila pneumoniae CWL029
cuaggguuucuacaggauau

SEQ ID NO: 514260 - RNA, 11 nt, Chlamydophila pneumoniae CWL029
cuagguucucc

SEQ ID NO: 514261 - RNA, 14 nt, Chlamydophila pneumoniae CWL029
cuagguucuuuuuu

SEQ ID NO: 514262 - RNA, 13 nt, Chlamydophila pneumoniae CWL029
cuagucuuucaac

SEQ ID NO: 514263 - RNA, 21 nt, Chlamydophila pneumoniae CWL029
cuagucuuucaaccuccgcuc

SEQ ID NO: 514264 - RNA, 20 nt, Chlamydophila pneumoniae CWL029
cuagugaagcugcuucuuca

SEQ ID NO: 514265 - RNA, 23 nt, Chlamydophila pneumoniae CWL029
cuaguauuaagauagacucucac

SEQ ID NO: 514266 - RNA, 17 nt, Chlamydophila pneumoniae CWL029
cuaguauuaagauagac

SEQ ID NO: 514267 - RNA, 15 nt, Chlamydophila pneumoniae CWL029
cuaguccuguacauc

SEQ ID NO: 514268 - RNA, 19 nt, Chlamydophila pneumoniae CWL029
cuacuugucugauuaguuc

SEQ ID NO: 514269 - RNA, 21 nt, Chlamydophila pneumoniae CWL029
cuacuugucugauuaguucuc

SEQ ID NO: 514270 - RNA, 20 nt, Chlamydophila pneumoniae CWL029
cuacuuuaaaguggcaaucu

SEQ ID NO: 514271 - RNA, 18 nt, Chlamydophila pneumoniae CWL029
cuacuucugcaggacugu

SEQ ID NO: 514272 - RNA, 13 nt, Chlamydophila pneumoniae CWL029
cuacuuauuguuc

SEQ ID NO: 514273 - RNA, 18 nt, Chlamydophila pneumoniae CWL029
cuagacaacaaauugaug

SEQ ID NO: 514274 - RNA, 14 nt, Chlamydophila pneumoniae CWL029
cuagacagccuuga

SEQ ID NO: 514275 - RNA, 17 nt, Chlamydophila pneumoniae CWL029
cuagaaucacauaaaau

SEQ ID NO: 514276 - RNA, 20 nt, Chlamydophila pneumoniae CWL029
cuagaauaccguuuuaggaa

SEQ ID NO: 514277 - RNA, 16 nt, Chlamydophila pneumoniae CWL029
cuagaaaacgcucucc

SEQ ID NO: 514278 - RNA, 19 nt, Chlamydophila pneumoniae CWL029
cuagaaucacauaaaauaa

SEQ ID NO: 514279 - RNA, 17 nt, Chlamydophila pneumoniae CWL029
cuacuguccauccaaau

SEQ ID NO: 514280 - RNA, 13 nt, Chlamydophila pneumoniae CWL029
cuacuuacaagaa

SEQ ID NO: 514281 - RNA, 18 nt, Chlamydophila pneumoniae CWL029
cuacccucaucauccuca

SEQ ID NO: 514282 - RNA, 20 nt, Chlamydophila pneumoniae CWL029
cuaccccacgcuaaacuaaa

SEQ ID NO: 514283 - RNA, 21 nt, Chlamydophila pneumoniae CWL029
cuaccccacgcuaaacuaaaa

SEQ ID NO: 514284 - RNA, 13 nt, Chlamydophila pneumoniae CWL029
cuaaugacagcug

SEQ ID NO: 514285 - RNA, 20 nt, Chlamydophila pneumoniae CWL029
cuaaugacagcugagaaauu

SEQ ID NO: 514286 - RNA, 15 nt, Chlamydophila pneumoniae CWL029
cuaaucucaggcauu

SEQ ID NO: 514287 - RNA, 19 nt, Chlamydophila pneumoniae CWL029
cuaaucuaugaaguccuga

SEQ ID NO: 514288 - RNA, 14 nt, Chlamydophila pneumoniae CWL029
cuaauccagcaaca

SEQ ID NO: 514289 - RNA, 20 nt, Chlamydophila pneumoniae CWL029
cuaaucacagcgucagggau

SEQ ID NO: 514290 - RNA, 23 nt, Chlamydophila pneumoniae CWL029
cuaaucaccuuaggcuuaauaaa

SEQ ID NO: 514291 - RNA, 12 nt, Chlamydophila pneumoniae CWL029
cuaauauugauu

SEQ ID NO: 514292 - RNA, 17 nt, Chlamydophila pneumoniae CWL029
cuaaucaauccaagaau

SEQ ID NO: 514293 - RNA, 19 nt, Chlamydophila pneumoniae CWL029
cuaaucacagcgucaggga

SEQ ID NO: 514294 - RNA, 17 nt, Chlamydophila pneumoniae CWL029
cuaauaagauccaaaaa

SEQ ID NO: 514295 - RNA, 22 nt, Chlamydophila pneumoniae CWL029
cuaauaaaauuggcuuuugaga

SEQ ID NO: 514296 - RNA, 17 nt, Chlamydophila pneumoniae CWL029
cuaaguaaaacugcgcu

SEQ ID NO: 514297 - RNA, 19 nt, Chlamydophila pneumoniae CWL029
cuaaguaacaguccucucc

SEQ ID NO: 514298 - RNA, 19 nt, Chlamydophila pneumoniae CWL029
cuaaggacaaaucucccaa

SEQ ID NO: 514299 - RNA, 19 nt, Chlamydophila pneumoniae CWL029
cuaagcagccucuucucua

SEQ ID NO: 514300 - RNA, 16 nt, Chlamydophila pneumoniae CWL029
cuaagcacaagaaucc

SEQ ID NO: 514301 - RNA, 21 nt, Chlamydophila pneumoniae CWL029
cuaagcagccucuucucuacc

SEQ ID NO: 514302 - RNA, 17 nt, Chlamydophila pneumoniae CWL029
cuaagcaaagcggcucu

SEQ ID NO: 514303 - RNA, 13 nt, Chlamydophila pneumoniae CWL029
cuaagcaauauuu

SEQ ID NO: 514304 - RNA, 15 nt, Chlamydophila pneumoniae CWL029
cuaagcaauauuucu

SEQ ID NO: 514305 - RNA, 23 nt, Chlamydophila pneumoniae CWL029
cuaagaucuuuagaauaagagcu

SEQ ID NO: 514306 - RNA, 19 nt, Chlamydophila pneumoniae CWL029
cuaagggcucuagauauuc

SEQ ID NO: 514307 - RNA, 19 nt, Chlamydophila pneumoniae CWL029
cuaagagcaucuuugggaa

SEQ ID NO: 514308 - RNA, 13 nt, Chlamydophila pneumoniae CWL029
cuaagacugucua

SEQ ID NO: 514309 - RNA, 21 nt, Chlamydophila pneumoniae CWL029
cuaagaguuccaagacaauaa

SEQ ID NO: 514310 - RNA, 17 nt, Chlamydophila pneumoniae CWL029
cuaagauccugagacca

SEQ ID NO: 514311 - RNA, 20 nt, Chlamydophila pneumoniae CWL029
cuaacuaucucuguuuuuug

SEQ ID NO: 514312 - RNA, 12 nt, Chlamydophila pneumoniae CWL029
cuaaaucugcuu

SEQ ID NO: 514313 - RNA, 16 nt, Chlamydophila pneumoniae CWL029
cuaaaucuauacccag

SEQ ID NO: 514314 - RNA, 21 nt, Chlamydophila pneumoniae CWL029
cuaaauauaucgcguguaaaa

SEQ ID NO: 514315 - RNA, 14 nt, Chlamydophila pneumoniae CWL029
cuaaauagaaaaca

SEQ ID NO: 514316 - RNA, 20 nt, Chlamydophila pneumoniae CWL029
cuacaaaauuauuaaacucg

SEQ ID NO: 514317 - RNA, 22 nt, Chlamydophila pneumoniae CWL029
cuacaaaauccacauccuugua

SEQ ID NO: 514318 - RNA, 15 nt, Chlamydophila pneumoniae CWL029
cuaauuuaaaugccu

SEQ ID NO: 514319 - RNA, 12 nt, Chlamydophila pneumoniae CWL029
cuaauuucaaua

SEQ ID NO: 514320 - RNA, 17 nt, Chlamydophila pneumoniae CWL029
cuaauuuccuucaggau

SEQ ID NO: 514321 - RNA, 13 nt, Chlamydophila pneumoniae CWL029
cuacaaguugaga

SEQ ID NO: 514322 - RNA, 13 nt, Chlamydophila pneumoniae CWL029
cuacaauacucug

SEQ ID NO: 514323 - RNA, 19 nt, Chlamydophila pneumoniae CWL029
cuacaaucccgaguccuaa

SEQ ID NO: 514324 - RNA, 20 nt, Chlamydophila pneumoniae CWL029
cuacacacaugacaaauaaa

SEQ ID NO: 514325 - RNA, 23 nt, Chlamydophila pneumoniae CWL029
cuacacagacuugaggaaucuga

SEQ ID NO: 514326 - RNA, 22 nt, Chlamydophila pneumoniae CWL029
cuacacaguagccuucuucucg

SEQ ID NO: 514327 - RNA, 19 nt, Chlamydophila pneumoniae CWL029
cuacacgcuauagcaacag

SEQ ID NO: 514328 - RNA, 14 nt, Chlamydophila pneumoniae CWL029
cuacaccauagaac

SEQ ID NO: 514329 - RNA, 20 nt, Chlamydophila pneumoniae CWL029
cuacacccaggaaacuagau

SEQ ID NO: 514330 - RNA, 19 nt, Chlamydophila pneumoniae CWL029
cuacauaguuguucggaca

SEQ ID NO: 514331 - RNA, 22 nt, Chlamydophila pneumoniae CWL029
cuacauaguuguucggacaaaa

SEQ ID NO: 514332 - RNA, 21 nt, Chlamydophila pneumoniae CWL029
cuacauaguuuuuauuuuuaa

SEQ ID NO: 514333 - RNA, 15 nt, Chlamydophila pneumoniae CWL029
cuacaucuuguucug

SEQ ID NO: 514334 - RNA, 23 nt, Chlamydophila pneumoniae CWL029
cuacagaaagagcuaaagaaacu

SEQ ID NO: 514335 - RNA, 22 nt, Chlamydophila pneumoniae CWL029
cuacacugguagcuaaauuuag

SEQ ID NO: 514336 - RNA, 19 nt, Chlamydophila pneumoniae CWL029
cuacagagggcuucauucc

SEQ ID NO: 514337 - RNA, 15 nt, Chlamydophila pneumoniae CWL029
cuacagaggaaucua

SEQ ID NO: 514338 - RNA, 17 nt, Chlamydophila pneumoniae CWL029
cuacagagggaauuuca

SEQ ID NO: 514339 - RNA, 18 nt, Chlamydophila pneumoniae CWL029
cuacagagggaauuucau

SEQ ID NO: 514340 - RNA, 15 nt, Chlamydophila pneumoniae CWL029
cuacauuugcuauuu

SEQ ID NO: 514341 - RNA, 18 nt, Chlamydophila pneumoniae CWL029
cuacauuugcuauuuucc

SEQ ID NO: 514342 - RNA, 16 nt, Chlamydophila pneumoniae CWL029
cuacauguaaagcaag

SEQ ID NO: 514343 - RNA, 22 nt, Chlamydophila pneumoniae CWL029
cuaccaaagucgauacccaaag

SEQ ID NO: 514344 - RNA, 13 nt, Chlamydophila pneumoniae CWL029
cuaccaauucucu

SEQ ID NO: 514345 - RNA, 21 nt, Chlamydophila pneumoniae CWL029
cuaccaggcugcgcuacaccc

SEQ ID NO: 514346 - RNA, 14 nt, Chlamydophila pneumoniae CWL029
cuaccauuaaggaa

SEQ ID NO: 514347 - RNA, 15 nt, Chlamydophila pneumoniae CWL029
cuaccauuaaggaau

SEQ ID NO: 514348 - RNA, 14 nt, Chlamydophila pneumoniae CWL029
cguuucagaaguca

SEQ ID NO: 514349 - RNA, 16 nt, Chlamydophila pneumoniae CWL029
cguuuucuagaaaaga

SEQ ID NO: 514350 - RNA, 18 nt, Chlamydophila pneumoniae CWL029
cguuuugcuguggaauuu

SEQ ID NO: 514351 - RNA, 17 nt, Chlamydophila pneumoniae CWL029
cuaaacgauuguaauuu

SEQ ID NO: 514352 - RNA, 23 nt, Chlamydophila pneumoniae CWL029
cuaaacgcgagcuauuuuacuua

SEQ ID NO: 514353 - RNA, 13 nt, Chlamydophila pneumoniae CWL029
cuaaacagggaau

SEQ ID NO: 514354 - RNA, 20 nt, Chlamydophila pneumoniae CWL029
cuaaacaacucccguuuugu

SEQ ID NO: 514355 - RNA, 14 nt, Chlamydophila pneumoniae CWL029
cuaaaaguuuuuua

SEQ ID NO: 514356 - RNA, 13 nt, Chlamydophila pneumoniae CWL029
cuaaauaaaccac

SEQ ID NO: 514357 - RNA, 14 nt, Chlamydophila pneumoniae CWL029
cuaaagcuuuugcu

SEQ ID NO: 514358 - RNA, 13 nt, Chlamydophila pneumoniae CWL029
cuaaaggaacugu

SEQ ID NO: 514359 - RNA, 18 nt, Chlamydophila pneumoniae CWL029
cuaaagcugcuuuuucua

SEQ ID NO: 514360 - RNA, 22 nt, Chlamydophila pneumoniae CWL029
cuaaagcugccagugacauaau

SEQ ID NO: 514361 - RNA, 16 nt, Chlamydophila pneumoniae CWL029
cuaaagcugcuuuuuc

SEQ ID NO: 514362 - RNA, 12 nt, Chlamydophila pneumoniae CWL029
cuaaacucucca

SEQ ID NO: 514363 - RNA, 14 nt, Chlamydophila pneumoniae CWL029
cuaaacucucuucc

SEQ ID NO: 514364 - RNA, 21 nt, Chlamydophila pneumoniae CWL029
cuaaacucucuuccuucuccu

SEQ ID NO: 514365 - RNA, 21 nt, Chlamydophila pneumoniae CWL029
cguucguggagcaucauucca

SEQ ID NO: 514366 - RNA, 15 nt, Chlamydophila pneumoniae CWL029
cguuauccucgucuu

SEQ ID NO: 514367 - RNA, 16 nt, Chlamydophila pneumoniae CWL029
cguccacaagcuuuuc

SEQ ID NO: 514368 - RNA, 13 nt, Chlamydophila pneumoniae CWL029
aaaaaacaguaga

SEQ ID NO: 514369 - RNA, 22 nt, Chlamydophila pneumoniae CWL029
aaaaaaagaccaaauaauuaaa

SEQ ID NO: 514370 - RNA, 14 nt, Chlamydophila pneumoniae CWL029
aaaaaaaaucugcu

SEQ ID NO: 514371 - RNA, 13 nt, Chlamydophila pneumoniae CWL029
aaaaaaaucuucu

SEQ ID NO: 514372 - RNA, 18 nt, Chlamydophila pneumoniae CWL029
aaaaaagcuagucuuucu

SEQ ID NO: 514373 - RNA, 11 nt, Chlamydophila pneumoniae CWL029
aaaaaagccaa

SEQ ID NO: 514374 - RNA, 23 nt, Chlamydophila pneumoniae CWL029
aaaaaauaucuccguuaccaaaa

SEQ ID NO: 514375 - RNA, 12 nt, Chlamydophila pneumoniae CWL029
aaaaaauaaaau

SEQ ID NO: 514376 - RNA, 22 nt, Chlamydophila pneumoniae CWL029
aaaaacacugcgcaaagaacuc

SEQ ID NO: 514377 - RNA, 14 nt, Chlamydophila pneumoniae CWL029
aaaaaauuuuauag

SEQ ID NO: 514378 - RNA, 13 nt, Chlamydophila pneumoniae CWL029
aaaaacaaaccuc

SEQ ID NO: 514379 - RNA, 21 nt, Chlamydophila pneumoniae CWL029
aaaaaaucuucuuagccaaaa

SEQ ID NO: 514380 - RNA, 23 nt, Chlamydophila pneumoniae CWL029
aaaaaaugcuccugcaaaaaacc

SEQ ID NO: 514381 - RNA, 12 nt, Chlamydophila pneumoniae CWL029
aaaaaauucuaa

SEQ ID NO: 514382 - RNA, 22 nt, Chlamydophila pneumoniae CWL029
aaaaaaucccagauuacaagag

SEQ ID NO: 514383 - RNA, 11 nt, Chlamydophila pneumoniae CWL029
aaaaaaucaau

SEQ ID NO: 514384 - RNA, 20 nt, Chlamydophila pneumoniae CWL029
aaaaaauacaggaaucuccu

SEQ ID NO: 514385 - RNA, 19 nt, Chlamydophila pneumoniae CWL029
aaaaaaucucgagaagacc

SEQ ID NO: 514386 - RNA, 19 nt, Chlamydophila pneumoniae CWL029
aaaaaccagccaauaacau

SEQ ID NO: 514387 - RNA, 16 nt, Chlamydophila pneumoniae CWL029
aaaaacccucaaagaa

SEQ ID NO: 514388 - RNA, 15 nt, Chlamydophila pneumoniae CWL029
aaaaauagaaauaag

SEQ ID NO: 514389 - RNA, 14 nt, Chlamydophila pneumoniae CWL029
aaaaauagauaagu

SEQ ID NO: 514390 - RNA, 13 nt, Chlamydophila pneumoniae CWL029
aaaaauaucuccg

SEQ ID NO: 514391 - RNA, 12 nt, Chlamydophila pneumoniae CWL029
aaaaauauaucu

SEQ ID NO: 514392 - RNA, 21 nt, Chlamydophila pneumoniae CWL029
aaaacaagcuuuuaauguguu

SEQ ID NO: 514393 - RNA, 15 nt, Chlamydophila pneumoniae CWL029
aaaacaaggcaaaaa

SEQ ID NO: 514394 - RNA, 21 nt, Chlamydophila pneumoniae CWL029
aaaaauuuuauaggaauaaca

SEQ ID NO: 514395 - RNA, 16 nt, Chlamydophila pneumoniae CWL029
aaaaauuucaugagga

SEQ ID NO: 514396 - RNA, 15 nt, Chlamydophila pneumoniae CWL029
aaaaauuaagaaccc

SEQ ID NO: 514397 - RNA, 17 nt, Chlamydophila pneumoniae CWL029
aaaaaucccuguucuag

SEQ ID NO: 514398 - RNA, 16 nt, Chlamydophila pneumoniae CWL029
aaaaauccgauaagau

SEQ ID NO: 514399 - RNA, 17 nt, Chlamydophila pneumoniae CWL029
aaaaauccgauaagaua

SEQ ID NO: 514400 - RNA, 22 nt, Chlamydophila pneumoniae CWL029
aaaaaucccuguucuagcaaau

SEQ ID NO: 514401 - RNA, 20 nt, Chlamydophila pneumoniae CWL029
aaaaauccugagagauaggu

SEQ ID NO: 514402 - RNA, 13 nt, Chlamydophila pneumoniae CWL029
aaaacaauuuccu

SEQ ID NO: 514403 - RNA, 23 nt, Chlamydophila pneumoniae CWL029
aaaagcaaucguguuuuccugag

SEQ ID NO: 514404 - RNA, 15 nt, Chlamydophila pneumoniae CWL029
aaaagcacuuaaaaa

SEQ ID NO: 514405 - RNA, 21 nt, Chlamydophila pneumoniae CWL029
aaaagcacuuaaaaaacuucc

SEQ ID NO: 514406 - RNA, 13 nt, Chlamydophila pneumoniae CWL029
aaaagaucuaagu

SEQ ID NO: 514407 - RNA, 21 nt, Chlamydophila pneumoniae CWL029
aaaagauaguuauuaauaaau

SEQ ID NO: 514408 - RNA, 15 nt, Chlamydophila pneumoniae CWL029
aaaagagcucaaaaa

SEQ ID NO: 514409 - RNA, 20 nt, Chlamydophila pneumoniae CWL029
aaaagagcucaaaaaguucc

SEQ ID NO: 514410 - RNA, 18 nt, Chlamydophila pneumoniae CWL029
aaaagauaaaacauucuc

SEQ ID NO: 514411 - RNA, 15 nt, Chlamydophila pneumoniae CWL029
aaaagagcaagaugg

SEQ ID NO: 514412 - RNA, 16 nt, Chlamydophila pneumoniae CWL029
aaaagacuuaccguuu

SEQ ID NO: 514413 - RNA, 14 nt, Chlamydophila pneumoniae CWL029
aaaagacaagagaa

SEQ ID NO: 514414 - RNA, 21 nt, Chlamydophila pneumoniae CWL029
aaaagaacauuaagaggaaag

SEQ ID NO: 514415 - RNA, 16 nt, Chlamydophila pneumoniae CWL029
aaaagaaaucaaacau

SEQ ID NO: 514416 - RNA, 20 nt, Chlamydophila pneumoniae CWL029
aaaagaaagaauaucuuuug

SEQ ID NO: 514417 - RNA, 12 nt, Chlamydophila pneumoniae CWL029
aaaagaaagaau

SEQ ID NO: 514418 - RNA, 14 nt, Chlamydophila pneumoniae CWL029
aaaacuucaaaagu

SEQ ID NO: 514419 - RNA, 22 nt, Chlamydophila pneumoniae CWL029
aaaacuucccaucuuguucuaa

SEQ ID NO: 514420 - RNA, 13 nt, Chlamydophila pneumoniae CWL029
aaaacuucccauc

SEQ ID NO: 514421 - RNA, 21 nt, Chlamydophila pneumoniae CWL029
aaaacuccgcacuugcucuuu

SEQ ID NO: 514422 - RNA, 21 nt, Chlamydophila pneumoniae CWL029
aaaacucaaggaguuuuaacu

SEQ ID NO: 514423 - RNA, 16 nt, Chlamydophila pneumoniae CWL029
aaaacugcaaaaagau

SEQ ID NO: 514424 - RNA, 15 nt, Chlamydophila pneumoniae CWL029
aaaacgguaaauauc

SEQ ID NO: 514425 - RNA, 20 nt, Chlamydophila pneumoniae CWL029
aaaaccaauuucuccgcuuu

SEQ ID NO: 514426 - RNA, 15 nt, Chlamydophila pneumoniae CWL029
aaaacuacauucuaa

SEQ ID NO: 514427 - RNA, 20 nt, Chlamydophila pneumoniae CWL029
aaaacuauaaaagccagggc

SEQ ID NO: 514428 - RNA, 21 nt, Chlamydophila pneumoniae CWL029
aaaauccaggacuucgcaaau

SEQ ID NO: 514429 - RNA, 10 nt, Chlamydophila pneumoniae CWL029
aaaaucacau

SEQ ID NO: 514430 - RNA, 17 nt, Chlamydophila pneumoniae CWL029
aaaaucaagaagagaaa

SEQ ID NO: 514431 - RNA, 22 nt, Chlamydophila pneumoniae CWL029
aaaaucaagaagagaaaagaua

SEQ ID NO: 514432 - RNA, 21 nt, Chlamydophila pneumoniae CWL029
aaaaucaaauagauuuuuacu

SEQ ID NO: 514433 - RNA, 16 nt, Chlamydophila pneumoniae CWL029
aaaaucaacucuccau

SEQ ID NO: 514434 - RNA, 14 nt, Chlamydophila pneumoniae CWL029
aaaaucaaauagau

SEQ ID NO: 514435 - RNA, 23 nt, Chlamydophila pneumoniae CWL029
aaaauagaaauaagcaucuagaa

SEQ ID NO: 514436 - RNA, 13 nt, Chlamydophila pneumoniae CWL029
aaaauagacauuc

SEQ ID NO: 514437 - RNA, 18 nt, Chlamydophila pneumoniae CWL029
aaaauaauuuuauuaguu

SEQ ID NO: 514438 - RNA, 16 nt, Chlamydophila pneumoniae CWL029
aaaaguaguuuuaaga

SEQ ID NO: 514439 - RNA, 20 nt, Chlamydophila pneumoniae CWL029
aaaaguaguuuuaagaaggu

SEQ ID NO: 514440 - RNA, 22 nt, Chlamydophila pneumoniae CWL029
aaaagcacuuaaaaaacuuccu

SEQ ID NO: 514441 - RNA, 23 nt, Chlamydophila pneumoniae CWL029
aaaagcauagucgucuuuuaaag

SEQ ID NO: 514442 - RNA, 12 nt, Chlamydophila pneumoniae CWL029
aaaagccuuucu

SEQ ID NO: 514443 - RNA, 14 nt, Chlamydophila pneumoniae CWL029
aaaauaaaaggagc

SEQ ID NO: 514444 - RNA, 22 nt, Chlamydophila pneumoniae CWL029
aaaaguuccccaauuucuuuuu

SEQ ID NO: 514445 - RNA, 13 nt, Chlamydophila pneumoniae CWL029
aaaauaaaaggag

SEQ ID NO: 514446 - RNA, 20 nt, Chlamydophila pneumoniae CWL029
aaaauuauguauaaacucca

SEQ ID NO: 514447 - RNA, 18 nt, Chlamydophila pneumoniae CWL029
aaaaugcacuuugaauaa

SEQ ID NO: 514448 - RNA, 17 nt, Chlamydophila pneumoniae CWL029
aaaaugcccguccccuc

SEQ ID NO: 514449 - RNA, 20 nt, Chlamydophila pneumoniae CWL029
aaaaugcgaggaaaaaggag

SEQ ID NO: 514450 - RNA, 23 nt, Chlamydophila pneumoniae CWL029
aaaaugcuccugcaaaaaaccag

SEQ ID NO: 514451 - RNA, 14 nt, Chlamydophila pneumoniae CWL029
aaaaugauucauaa

SEQ ID NO: 514452 - RNA, 14 nt, Chlamydophila pneumoniae CWL029
aaaaucuccucucu

SEQ ID NO: 514453 - RNA, 14 nt, Chlamydophila pneumoniae CWL029
aaaauuucuuauaa

SEQ ID NO: 514454 - RNA, 15 nt, Chlamydophila pneumoniae CWL029
aaaauuucuuauaaa

SEQ ID NO: 514455 - RNA, 17 nt, Chlamydophila pneumoniae CWL029
aaaauuucuuauaaaaa

SEQ ID NO: 514456 - RNA, 18 nt, Chlamydophila pneumoniae CWL029
aaaauuucuuauaaaaaa

SEQ ID NO: 514457 - RNA, 19 nt, Chlamydophila pneumoniae CWL029
aaaauucccauagcaugag

SEQ ID NO: 514458 - RNA, 14 nt, Chlamydophila pneumoniae CWL029
aaaauuuaaaaaaa

SEQ ID NO: 514459 - RNA, 16 nt, Chlamydophila pneumoniae CWL029
aaaauuuaaauauaga

SEQ ID NO: 514460 - RNA, 17 nt, Chlamydophila pneumoniae CWL029
aaaauuuaaauauagaa

SEQ ID NO: 514461 - RNA, 18 nt, Chlamydophila pneumoniae CWL029
aaaauuuaaauauagaaa

SEQ ID NO: 514462 - RNA, 15 nt, Chlamydophila pneumoniae CWL029
aaaauucaaaucccu

SEQ ID NO: 514463 - RNA, 20 nt, Chlamydophila pneumoniae CWL029
aaaauucaaaucccugaugc

SEQ ID NO: 514464 - RNA, 17 nt, Chlamydophila pneumoniae CWL029
aaaauucaugcaaaaca

SEQ ID NO: 514465 - RNA, 14 nt, Chlamydophila pneumoniae CWL029
aaacaacaaacuac

SEQ ID NO: 514466 - RNA, 17 nt, Chlamydophila pneumoniae CWL029
aaaauuuugauaccucu

SEQ ID NO: 514467 - RNA, 15 nt, Chlamydophila pneumoniae CWL029
aaacaaaaucuuuua

SEQ ID NO: 514468 - RNA, 12 nt, Chlamydophila pneumoniae CWL029
aaacaaaaucuu

SEQ ID NO: 514469 - RNA, 15 nt, Chlamydophila pneumoniae CWL029
aaacaaaagccauuc

SEQ ID NO: 514470 - RNA, 18 nt, Chlamydophila pneumoniae CWL029
aaauucgaauucucagaa

SEQ ID NO: 514471 - RNA, 23 nt, Chlamydophila pneumoniae CWL029
aaauuccgacccagucaaaauau

SEQ ID NO: 514472 - RNA, 17 nt, Chlamydophila pneumoniae CWL029
aaauuccuucucagaaa

SEQ ID NO: 514473 - RNA, 23 nt, Chlamydophila pneumoniae CWL029
aaauucuagaccugccaagauac

SEQ ID NO: 514474 - RNA, 23 nt, Chlamydophila pneumoniae CWL029
aaauucucauaaccuaaggcaug

SEQ ID NO: 514475 - RNA, 16 nt, Chlamydophila pneumoniae CWL029
aaauucaggacccuuu

SEQ ID NO: 514476 - RNA, 22 nt, Chlamydophila pneumoniae CWL029
aaauucaagacuauagaaaagg

SEQ ID NO: 514477 - RNA, 19 nt, Chlamydophila pneumoniae CWL029
aaauucaccaaccaguuuc

SEQ ID NO: 514478 - RNA, 21 nt, Chlamydophila pneumoniae CWL029
aaauuaccguuuccuccucuu

SEQ ID NO: 514479 - RNA, 16 nt, Chlamydophila pneumoniae CWL029
aaauuaaauucuuuuc

SEQ ID NO: 514480 - RNA, 13 nt, Chlamydophila pneumoniae CWL029
aaauuaacaacac

SEQ ID NO: 514481 - RNA, 12 nt, Chlamydophila pneumoniae CWL029
aaauuaacagag

SEQ ID NO: 514482 - RNA, 19 nt, Chlamydophila pneumoniae CWL029
aaaugcuuguauaaaugcu

SEQ ID NO: 514483 - RNA, 22 nt, Chlamydophila pneumoniae CWL029
aaaugugcucggacagaaagau

SEQ ID NO: 514484 - RNA, 14 nt, Chlamydophila pneumoniae CWL029
aaaaagcuucuuuc

SEQ ID NO: 514485 - RNA, 19 nt, Chlamydophila pneumoniae CWL029
aaaaagcuucuuucuuacu

SEQ ID NO: 514486 - RNA, 18 nt, Chlamydophila pneumoniae CWL029
aaaaagcuuuuuucucuu

SEQ ID NO: 514487 - RNA, 20 nt, Chlamydophila pneumoniae CWL029
aaaaagcuuuuuucucuugc

SEQ ID NO: 514488 - RNA, 18 nt, Chlamydophila pneumoniae CWL029
aaaaaggacucuuucuau

SEQ ID NO: 514489 - RNA, 19 nt, Chlamydophila pneumoniae CWL029
aaaaagccuaugauaaagc

SEQ ID NO: 514490 - RNA, 12 nt, Chlamydophila pneumoniae CWL029
aaaaagcuaaac

SEQ ID NO: 514491 - RNA, 13 nt, Chlamydophila pneumoniae CWL029
aaaugccugaaaa

SEQ ID NO: 514492 - RNA, 15 nt, Chlamydophila pneumoniae CWL029
aaaugcgaggaaaaa

SEQ ID NO: 514493 - RNA, 18 nt, Chlamydophila pneumoniae CWL029
aaaugcuauuuuccucua

SEQ ID NO: 514494 - RNA, 23 nt, Chlamydophila pneumoniae CWL029
aaaugauuuggccaacaguguag

SEQ ID NO: 514495 - RNA, 22 nt, Chlamydophila pneumoniae CWL029
aaaugcaaaccaaaaaaguaac

SEQ ID NO: 514496 - RNA, 14 nt, Chlamydophila pneumoniae CWL029
aaaucuuacauaaa

SEQ ID NO: 514497 - RNA, 12 nt, Chlamydophila pneumoniae CWL029
aaaucaucaaaa

SEQ ID NO: 514498 - RNA, 21 nt, Chlamydophila pneumoniae CWL029
aaaucauuggaaccauaggau

SEQ ID NO: 514499 - RNA, 18 nt, Chlamydophila pneumoniae CWL029
aaaucauuuaaagcugaa

SEQ ID NO: 514500 - RNA, 21 nt, Chlamydophila pneumoniae CWL029
aaaucucauuccagcaucuuc

SEQ ID NO: 514501 - RNA, 12 nt, Chlamydophila pneumoniae CWL029
aaaucucauuuc

SEQ ID NO: 514502 - RNA, 17 nt, Chlamydophila pneumoniae CWL029
aaaucucauuucguaga

SEQ ID NO: 514503 - RNA, 13 nt, Chlamydophila pneumoniae CWL029
aaaucuaucugca

SEQ ID NO: 514504 - RNA, 20 nt, Chlamydophila pneumoniae CWL029
aaaucuccguuugucccuuu

SEQ ID NO: 514505 - RNA, 15 nt, Chlamydophila pneumoniae CWL029
aaaucuacauguaaa

SEQ ID NO: 514506 - RNA, 20 nt, Chlamydophila pneumoniae CWL029
aaaucuacucuuuaaaaaua

SEQ ID NO: 514507 - RNA, 20 nt, Chlamydophila pneumoniae CWL029
aaauaaccuagaaggaggag

SEQ ID NO: 514508 - RNA, 13 nt, Chlamydophila pneumoniae CWL029
aaauaaaaggagc

SEQ ID NO: 514509 - RNA, 13 nt, Chlamydophila pneumoniae CWL029
aaauacuucuccu

SEQ ID NO: 514510 - RNA, 14 nt, Chlamydophila pneumoniae CWL029
aaauacuucuccug

SEQ ID NO: 514511 - RNA, 16 nt, Chlamydophila pneumoniae CWL029
aaauacuucuccugaa

SEQ ID NO: 514512 - RNA, 19 nt, Chlamydophila pneumoniae CWL029
aaauagccucuccuugaga

SEQ ID NO: 514513 - RNA, 19 nt, Chlamydophila pneumoniae CWL029
aaauagcaucccuucuucu

SEQ ID NO: 514514 - RNA, 21 nt, Chlamydophila pneumoniae CWL029
aaauaggaucucucuuuccuu

SEQ ID NO: 514515 - RNA, 23 nt, Chlamydophila pneumoniae CWL029
aaauaggaaaguugcaacucucu

SEQ ID NO: 514516 - RNA, 14 nt, Chlamydophila pneumoniae CWL029
aaauaggagagcac

SEQ ID NO: 514517 - RNA, 15 nt, Chlamydophila pneumoniae CWL029
aaauacgcuuuucuu

SEQ ID NO: 514518 - RNA, 14 nt, Chlamydophila pneumoniae CWL029
aaauacuccacuuu

SEQ ID NO: 514519 - RNA, 17 nt, Chlamydophila pneumoniae CWL029
aaauaggaucucucuuu

SEQ ID NO: 514520 - RNA, 13 nt, Chlamydophila pneumoniae CWL029
aaaucacacuuaa

SEQ ID NO: 514521 - RNA, 13 nt, Chlamydophila pneumoniae CWL029
aaaucaauaauaa

SEQ ID NO: 514522 - RNA, 19 nt, Chlamydophila pneumoniae CWL029
aaaucaccauauccaugac

SEQ ID NO: 514523 - RNA, 19 nt, Chlamydophila pneumoniae CWL029
aaaucaccagcauuaagau

SEQ ID NO: 514524 - RNA, 17 nt, Chlamydophila pneumoniae CWL029
aaaucaagccacagaga

SEQ ID NO: 514525 - RNA, 18 nt, Chlamydophila pneumoniae CWL029
aaaucaagccacagagaa

SEQ ID NO: 514526 - RNA, 14 nt, Chlamydophila pneumoniae CWL029
aaaucaacuacacu

SEQ ID NO: 514527 - RNA, 21 nt, Chlamydophila pneumoniae CWL029
aaaucaacucuccauccucag

SEQ ID NO: 514528 - RNA, 15 nt, Chlamydophila pneumoniae CWL029
aaaucaagaagagaa

SEQ ID NO: 514529 - RNA, 13 nt, Chlamydophila pneumoniae CWL029
aaaucaacaucac

SEQ ID NO: 514530 - RNA, 14 nt, Chlamydophila pneumoniae CWL029
aaaucagacuuaaa

SEQ ID NO: 514531 - RNA, 18 nt, Chlamydophila pneumoniae CWL029
aaagucacucaaacccuc

SEQ ID NO: 514532 - RNA, 18 nt, Chlamydophila pneumoniae CWL029
aaagucacggcgaaagcu

SEQ ID NO: 514533 - RNA, 18 nt, Chlamydophila pneumoniae CWL029
aaaguauuccucuuagga

SEQ ID NO: 514534 - RNA, 16 nt, Chlamydophila pneumoniae CWL029
aaaguaccuaggaucu

SEQ ID NO: 514535 - RNA, 21 nt, Chlamydophila pneumoniae CWL029
aaaguaccuauugugcuuuuc

SEQ ID NO: 514536 - RNA, 13 nt, Chlamydophila pneumoniae CWL029
aaaguaccuuuaa

SEQ ID NO: 514537 - RNA, 23 nt, Chlamydophila pneumoniae CWL029
aaaguaccuuuaacccgcuugca

SEQ ID NO: 514538 - RNA, 15 nt, Chlamydophila pneumoniae CWL029
aaaguacuacaauaa

SEQ ID NO: 514539 - RNA, 16 nt, Chlamydophila pneumoniae CWL029
aaaguacgaccaacuc

SEQ ID NO: 514540 - RNA, 18 nt, Chlamydophila pneumoniae CWL029
aaaguacgcauaggccaa

SEQ ID NO: 514541 - RNA, 16 nt, Chlamydophila pneumoniae CWL029
aaagggcgcuucccua

SEQ ID NO: 514542 - RNA, 22 nt, Chlamydophila pneumoniae CWL029
aaaggggaacaacaucaugaaa

SEQ ID NO: 514543 - RNA, 17 nt, Chlamydophila pneumoniae CWL029
aaagguuuuaaauuuag

SEQ ID NO: 514544 - RNA, 14 nt, Chlamydophila pneumoniae CWL029
aaagguuguaagga

SEQ ID NO: 514545 - RNA, 14 nt, Chlamydophila pneumoniae CWL029
aaagguuuugaagc

SEQ ID NO: 514546 - RNA, 15 nt, Chlamydophila pneumoniae CWL029
aaaguaaaaaauaca

SEQ ID NO: 514547 - RNA, 22 nt, Chlamydophila pneumoniae CWL029
aaagguugcuaagaucuuuaga

SEQ ID NO: 514548 - RNA, 19 nt, Chlamydophila pneumoniae CWL029
aaaggggcuccuaaagcau

SEQ ID NO: 514549 - RNA, 19 nt, Chlamydophila pneumoniae CWL029
aaagcguuucgauaauuuu

SEQ ID NO: 514550 - RNA, 13 nt, Chlamydophila pneumoniae CWL029
aaagcuaaacaac

SEQ ID NO: 514551 - RNA, 23 nt, Chlamydophila pneumoniae CWL029
aaagccggcccacucaaaagaag

SEQ ID NO: 514552 - RNA, 22 nt, Chlamydophila pneumoniae CWL029
aaagcccccucccccaccaaag

SEQ ID NO: 514553 - RNA, 23 nt, Chlamydophila pneumoniae CWL029
aaagcccauuccugcaguauuau

SEQ ID NO: 514554 - RNA, 22 nt, Chlamydophila pneumoniae CWL029
aaagccgauacccaucuagaaa

SEQ ID NO: 514555 - RNA, 23 nt, Chlamydophila pneumoniae CWL029
aaagcuuaucccauaaauguaua

SEQ ID NO: 514556 - RNA, 16 nt, Chlamydophila pneumoniae CWL029
aaagcuguauugggaa

SEQ ID NO: 514557 - RNA, 17 nt, Chlamydophila pneumoniae CWL029
aaagcuguauugggaau

SEQ ID NO: 514558 - RNA, 22 nt, Chlamydophila pneumoniae CWL029
aaagcuguaaccaacaucaaag

SEQ ID NO: 514559 - RNA, 15 nt, Chlamydophila pneumoniae CWL029
aaaggaauaugcucu

SEQ ID NO: 514560 - RNA, 18 nt, Chlamydophila pneumoniae CWL029
aaaggaaucccuuuuuaa

SEQ ID NO: 514561 - RNA, 20 nt, Chlamydophila pneumoniae CWL029
aaaggacauagacuuugagu

SEQ ID NO: 514562 - RNA, 17 nt, Chlamydophila pneumoniae CWL029
aaaggaccacaauuccu

SEQ ID NO: 514563 - RNA, 19 nt, Chlamydophila pneumoniae CWL029
aaaggcaacaacgccuaca

SEQ ID NO: 514564 - RNA, 16 nt, Chlamydophila pneumoniae CWL029
aaaggaccuguuuucu

SEQ ID NO: 514565 - RNA, 16 nt, Chlamydophila pneumoniae CWL029
aaagaauacucauauu

SEQ ID NO: 514566 - RNA, 12 nt, Chlamydophila pneumoniae CWL029
aaacuuucuucu

SEQ ID NO: 514567 - RNA, 13 nt, Chlamydophila pneumoniae CWL029
aaacuuucuucuc

SEQ ID NO: 514568 - RNA, 22 nt, Chlamydophila pneumoniae CWL029
aaacuuucuucucuaggaagau

SEQ ID NO: 514569 - RNA, 13 nt, Chlamydophila pneumoniae CWL029
aaacuuucuuuuu

SEQ ID NO: 514570 - RNA, 20 nt, Chlamydophila pneumoniae CWL029
aaacuuucuuuuugagauaa

SEQ ID NO: 514571 - RNA, 14 nt, Chlamydophila pneumoniae CWL029
aaagaaguccuagg

SEQ ID NO: 514572 - RNA, 22 nt, Chlamydophila pneumoniae CWL029
aaagaaguuuacaaauaaaaug

SEQ ID NO: 514573 - RNA, 13 nt, Chlamydophila pneumoniae CWL029
aaagacucuugaa

SEQ ID NO: 514574 - RNA, 19 nt, Chlamydophila pneumoniae CWL029
aaagacucuugaauauuua

SEQ ID NO: 514575 - RNA, 22 nt, Chlamydophila pneumoniae CWL029
aaagacucaugaaauaguguuu

SEQ ID NO: 514576 - RNA, 14 nt, Chlamydophila pneumoniae CWL029
aaagagcucaaaaa

SEQ ID NO: 514577 - RNA, 16 nt, Chlamydophila pneumoniae CWL029
aaagagcucaaaaagu

SEQ ID NO: 514578 - RNA, 23 nt, Chlamydophila pneumoniae CWL029
aaagagcccaaaaacacucaaau

SEQ ID NO: 514579 - RNA, 17 nt, Chlamydophila pneumoniae CWL029
aaagagcccaaaaacac

SEQ ID NO: 514580 - RNA, 14 nt, Chlamydophila pneumoniae CWL029
aaagagcaaggaac

SEQ ID NO: 514581 - RNA, 13 nt, Chlamydophila pneumoniae CWL029
aaagauaaagaag

SEQ ID NO: 514582 - RNA, 23 nt, Chlamydophila pneumoniae CWL029
aaagagcuucuucuaaagcagaa

SEQ ID NO: 514583 - RNA, 15 nt, Chlamydophila pneumoniae CWL029
aaagagcuuugauuc

SEQ ID NO: 514584 - RNA, 18 nt, Chlamydophila pneumoniae CWL029
aaagagugccaagagcau

SEQ ID NO: 514585 - RNA, 23 nt, Chlamydophila pneumoniae CWL029
aaagagugccaagagcaucacaa

SEQ ID NO: 514586 - RNA, 17 nt, Chlamydophila pneumoniae CWL029
aaagcaaaaugguuguu

SEQ ID NO: 514587 - RNA, 20 nt, Chlamydophila pneumoniae CWL029
aaagauagcgacgucaucau

SEQ ID NO: 514588 - RNA, 21 nt, Chlamydophila pneumoniae CWL029
aaagauagcgacgucaucaua

SEQ ID NO: 514589 - RNA, 20 nt, Chlamydophila pneumoniae CWL029
aaagauauagauucaugaaa

SEQ ID NO: 514590 - RNA, 14 nt, Chlamydophila pneumoniae CWL029
aaagauaugucuug

SEQ ID NO: 514591 - RNA, 21 nt, Chlamydophila pneumoniae CWL029
aaagauaguuauuaauaaauu

SEQ ID NO: 514592 - RNA, 14 nt, Chlamydophila pneumoniae CWL029
aaagcauugcaaau

SEQ ID NO: 514593 - RNA, 16 nt, Chlamydophila pneumoniae CWL029
aaagcaugaugccauu

SEQ ID NO: 514594 - RNA, 12 nt, Chlamydophila pneumoniae CWL029
aaagcagcgaag

SEQ ID NO: 514595 - RNA, 22 nt, Chlamydophila pneumoniae CWL029
aaagcagcgaagauuuagggaa

SEQ ID NO: 514596 - RNA, 15 nt, Chlamydophila pneumoniae CWL029
aaagcagauccugcu

SEQ ID NO: 514597 - RNA, 18 nt, Chlamydophila pneumoniae CWL029
aaagccaagaagauguag

SEQ ID NO: 514598 - RNA, 15 nt, Chlamydophila pneumoniae CWL029
aaacugucauguauc

SEQ ID NO: 514599 - RNA, 14 nt, Chlamydophila pneumoniae CWL029
aaacugucauccuu

SEQ ID NO: 514600 - RNA, 20 nt, Chlamydophila pneumoniae CWL029
aaacuggcggauugcuuugc

SEQ ID NO: 514601 - RNA, 13 nt, Chlamydophila pneumoniae CWL029
aaacugcuccuga

SEQ ID NO: 514602 - RNA, 14 nt, Chlamydophila pneumoniae CWL029
aaacugcuccugaa

SEQ ID NO: 514603 - RNA, 15 nt, Chlamydophila pneumoniae CWL029
aaacugcgcuagcuc

SEQ ID NO: 514604 - RNA, 15 nt, Chlamydophila pneumoniae CWL029
aaacugcaaaaagau

SEQ ID NO: 514605 - RNA, 13 nt, Chlamydophila pneumoniae CWL029
aaacugaugccaa

SEQ ID NO: 514606 - RNA, 19 nt, Chlamydophila pneumoniae CWL029
aaacugaugccaagaaaua

SEQ ID NO: 514607 - RNA, 22 nt, Chlamydophila pneumoniae CWL029
aaacuuguuuucguaagagaau

SEQ ID NO: 514608 - RNA, 17 nt, Chlamydophila pneumoniae CWL029
aaacuucuucucgguuu

SEQ ID NO: 514609 - RNA, 12 nt, Chlamydophila pneumoniae CWL029
aaacuucuugug

SEQ ID NO: 514610 - RNA, 14 nt, Chlamydophila pneumoniae CWL029
aaacuuacagccac

SEQ ID NO: 514611 - RNA, 15 nt, Chlamydophila pneumoniae CWL029
aaacuuaguuuugaa

SEQ ID NO: 514612 - RNA, 19 nt, Chlamydophila pneumoniae CWL029
aaacuuaguuuugaaaaga

SEQ ID NO: 514613 - RNA, 17 nt, Chlamydophila pneumoniae CWL029
aaacuucuaacuguaca

SEQ ID NO: 514614 - RNA, 13 nt, Chlamydophila pneumoniae CWL029
aaacuucucagau

SEQ ID NO: 514615 - RNA, 22 nt, Chlamydophila pneumoniae CWL029
aaacuuccuaacuaucucuguu

SEQ ID NO: 514616 - RNA, 20 nt, Chlamydophila pneumoniae CWL029
aaacuucgauuggaagcaaa

SEQ ID NO: 514617 - RNA, 11 nt, Chlamydophila pneumoniae CWL029
aaacuucaaaa

SEQ ID NO: 514618 - RNA, 14 nt, Chlamydophila pneumoniae CWL029
aaacuaguucuucu

SEQ ID NO: 514619 - RNA, 16 nt, Chlamydophila pneumoniae CWL029
aaacuaguucuucuuu

SEQ ID NO: 514620 - RNA, 12 nt, Chlamydophila pneumoniae CWL029
aaacuaggaaaa

SEQ ID NO: 514621 - RNA, 14 nt, Chlamydophila pneumoniae CWL029
aaacuacauucuaa

SEQ ID NO: 514622 - RNA, 12 nt, Chlamydophila pneumoniae CWL029
aaacuccaaaau

SEQ ID NO: 514623 - RNA, 20 nt, Chlamydophila pneumoniae CWL029
aaacuccaaaauauucuuuc

SEQ ID NO: 514624 - RNA, 21 nt, Chlamydophila pneumoniae CWL029
aaacuccgcacuugcucuuua

SEQ ID NO: 514625 - RNA, 22 nt, Chlamydophila pneumoniae CWL029
aaacuccgcacuugcucuuuaa

SEQ ID NO: 514626 - RNA, 18 nt, Chlamydophila pneumoniae CWL029
aaacuccccaguuuucca

SEQ ID NO: 514627 - RNA, 17 nt, Chlamydophila pneumoniae CWL029
aaacuccggauucuuua

SEQ ID NO: 514628 - RNA, 15 nt, Chlamydophila pneumoniae CWL029
aaacuccuuuuaaaa

SEQ ID NO: 514629 - RNA, 19 nt, Chlamydophila pneumoniae CWL029
aaacucucuuccuucuccu

SEQ ID NO: 514630 - RNA, 20 nt, Chlamydophila pneumoniae CWL029
aaacucugacgucuccaaca

SEQ ID NO: 514631 - RNA, 11 nt, Chlamydophila pneumoniae CWL029
aaacucucagg

SEQ ID NO: 514632 - RNA, 13 nt, Chlamydophila pneumoniae CWL029
aaacucuauuuuc

SEQ ID NO: 514633 - RNA, 13 nt, Chlamydophila pneumoniae CWL029
aaacucucuuccu

SEQ ID NO: 514634 - RNA, 16 nt, Chlamydophila pneumoniae CWL029
aaacgcucuccuagac

SEQ ID NO: 514635 - RNA, 13 nt, Chlamydophila pneumoniae CWL029
aaacgcgagcuau

SEQ ID NO: 514636 - RNA, 19 nt, Chlamydophila pneumoniae CWL029
aaacggcuguacuucccca

SEQ ID NO: 514637 - RNA, 17 nt, Chlamydophila pneumoniae CWL029
aaacggcauuugccccu

SEQ ID NO: 514638 - RNA, 17 nt, Chlamydophila pneumoniae CWL029
aaacgguaaauaucuua

SEQ ID NO: 514639 - RNA, 17 nt, Chlamydophila pneumoniae CWL029
aaacuaaaucaacuaca

SEQ ID NO: 514640 - RNA, 16 nt, Chlamydophila pneumoniae CWL029
aaacaacuugguaagc

SEQ ID NO: 514641 - RNA, 16 nt, Chlamydophila pneumoniae CWL029
aaacaagcuuuuaaug

SEQ ID NO: 514642 - RNA, 14 nt, Chlamydophila pneumoniae CWL029
aaacgaaagcagug

SEQ ID NO: 514643 - RNA, 16 nt, Chlamydophila pneumoniae CWL029
aaacgaaagcagugug

SEQ ID NO: 514644 - RNA, 17 nt, Chlamydophila pneumoniae CWL029
aaaccuucagauccgau

SEQ ID NO: 514645 - RNA, 17 nt, Chlamydophila pneumoniae CWL029
aaaccuucaaugauuuc

SEQ ID NO: 514646 - RNA, 22 nt, Chlamydophila pneumoniae CWL029
aaacgaugagcacauucaagau

SEQ ID NO: 514647 - RNA, 21 nt, Chlamydophila pneumoniae CWL029
aaacgcccucuagaagacaca

SEQ ID NO: 514648 - RNA, 18 nt, Chlamydophila pneumoniae CWL029
aaacgcccuucaggacau

SEQ ID NO: 514649 - RNA, 22 nt, Chlamydophila pneumoniae CWL029
aagcugagguagcaucucucuc

SEQ ID NO: 514650 - RNA, 22 nt, Chlamydophila pneumoniae CWL029
aagcugagaauacaacccuuua

SEQ ID NO: 514651 - RNA, 17 nt, Chlamydophila pneumoniae CWL029
aagcugcaaacugaucu

SEQ ID NO: 514652 - RNA, 18 nt, Chlamydophila pneumoniae CWL029
aagcugccagugacauaa

SEQ ID NO: 514653 - RNA, 23 nt, Chlamydophila pneumoniae CWL029
aagcugccagugacauaaucaca

SEQ ID NO: 514654 - RNA, 19 nt, Chlamydophila pneumoniae CWL029
aagcuguauugggaaugga

SEQ ID NO: 514655 - RNA, 11 nt, Chlamydophila pneumoniae CWL029
aagcugugcau

SEQ ID NO: 514656 - RNA, 21 nt, Chlamydophila pneumoniae CWL029
aagcugcuucgggaacgugcu

SEQ ID NO: 514657 - RNA, 11 nt, Chlamydophila pneumoniae CWL029
aagcugcugcu

SEQ ID NO: 514658 - RNA, 23 nt, Chlamydophila pneumoniae CWL029
aagcugcugcuacgacuacaucu

SEQ ID NO: 514659 - RNA, 18 nt, Chlamydophila pneumoniae CWL029
aaggacucuuucuauagc

SEQ ID NO: 514660 - RNA, 21 nt, Chlamydophila pneumoniae CWL029
aaggagcggaguaacuaauaa

SEQ ID NO: 514661 - RNA, 14 nt, Chlamydophila pneumoniae CWL029
aaggauucugagaa

SEQ ID NO: 514662 - RNA, 18 nt, Chlamydophila pneumoniae CWL029
aaggagucgugcaggaga

SEQ ID NO: 514663 - RNA, 16 nt, Chlamydophila pneumoniae CWL029
aaggagguccuuggca

SEQ ID NO: 514664 - RNA, 21 nt, Chlamydophila pneumoniae CWL029
aaggaggaggagcacuaggca

SEQ ID NO: 514665 - RNA, 17 nt, Chlamydophila pneumoniae CWL029
aagcuucaucaaaacau

SEQ ID NO: 514666 - RNA, 18 nt, Chlamydophila pneumoniae CWL029
aagcuucaucaaaacaua

SEQ ID NO: 514667 - RNA, 17 nt, Chlamydophila pneumoniae CWL029
aagcuuuuaauguguuc

SEQ ID NO: 514668 - RNA, 23 nt, Chlamydophila pneumoniae CWL029
aagcuuuucuuccaaagacugag

SEQ ID NO: 514669 - RNA, 17 nt, Chlamydophila pneumoniae CWL029
aagcguagcaaaguuaa

SEQ ID NO: 514670 - RNA, 17 nt, Chlamydophila pneumoniae CWL029
aagcguuaacaacuucu

SEQ ID NO: 514671 - RNA, 19 nt, Chlamydophila pneumoniae CWL029
aagcguuucgacgagaagg

SEQ ID NO: 514672 - RNA, 17 nt, Chlamydophila pneumoniae CWL029
aagcuaacaccucuuca

SEQ ID NO: 514673 - RNA, 20 nt, Chlamydophila pneumoniae CWL029
aagcugacaaauagaaagga

SEQ ID NO: 514674 - RNA, 16 nt, Chlamydophila pneumoniae CWL029
aagcucuuucauaaga

SEQ ID NO: 514675 - RNA, 14 nt, Chlamydophila pneumoniae CWL029
aagcucuccuucag

SEQ ID NO: 514676 - RNA, 19 nt, Chlamydophila pneumoniae CWL029
aagcucgaccucuagcuca

SEQ ID NO: 514677 - RNA, 16 nt, Chlamydophila pneumoniae CWL029
aagcuccucacaucuc

SEQ ID NO: 514678 - RNA, 20 nt, Chlamydophila pneumoniae CWL029
aagggaugcucuagaaaacg

SEQ ID NO: 514679 - RNA, 14 nt, Chlamydophila pneumoniae CWL029
aagggauucuuguu

SEQ ID NO: 514680 - RNA, 22 nt, Chlamydophila pneumoniae CWL029
aagggauguuuaauacaaaaaa

SEQ ID NO: 514681 - RNA, 12 nt, Chlamydophila pneumoniae CWL029
aagggaugaaga

SEQ ID NO: 514682 - RNA, 17 nt, Chlamydophila pneumoniae CWL029
aagggaugaagauaaaa

SEQ ID NO: 514683 - RNA, 18 nt, Chlamydophila pneumoniae CWL029
aagggaugaagauaaaau

SEQ ID NO: 514684 - RNA, 18 nt, Chlamydophila pneumoniae CWL029
aagggacuuguuguuuca

SEQ ID NO: 514685 - RNA, 16 nt, Chlamydophila pneumoniae CWL029
aagguaaaacuacagg

SEQ ID NO: 514686 - RNA, 21 nt, Chlamydophila pneumoniae CWL029
aaggcgaaaucuucaccacaa

SEQ ID NO: 514687 - RNA, 18 nt, Chlamydophila pneumoniae CWL029
aaggcgccuaacaacuuu

SEQ ID NO: 514688 - RNA, 18 nt, Chlamydophila pneumoniae CWL029
aaggcggcuuuuugcaag

SEQ ID NO: 514689 - RNA, 17 nt, Chlamydophila pneumoniae CWL029
aaggcaauagcagcagc

SEQ ID NO: 514690 - RNA, 14 nt, Chlamydophila pneumoniae CWL029
aaggcaaaaaguug

SEQ ID NO: 514691 - RNA, 19 nt, Chlamydophila pneumoniae CWL029
aaggcaaaaaguugaggaa

SEQ ID NO: 514692 - RNA, 23 nt, Chlamydophila pneumoniae CWL029
aaggcaaaaaguugaggaaagga

SEQ ID NO: 514693 - RNA, 14 nt, Chlamydophila pneumoniae CWL029
aagguuuccaugag

SEQ ID NO: 514694 - RNA, 18 nt, Chlamydophila pneumoniae CWL029
aagguuuuauaaagaucg

SEQ ID NO: 514695 - RNA, 19 nt, Chlamydophila pneumoniae CWL029
aagguuacaccuaaaguuu

SEQ ID NO: 514696 - RNA, 13 nt, Chlamydophila pneumoniae CWL029
aagguuccaaaaa

SEQ ID NO: 514697 - RNA, 19 nt, Chlamydophila pneumoniae CWL029
aagguucccuacuccauug

SEQ ID NO: 514698 - RNA, 12 nt, Chlamydophila pneumoniae CWL029
aagguucucaaa

SEQ ID NO: 514699 - RNA, 21 nt, Chlamydophila pneumoniae CWL029
aagguugcuuuucuaggauuu

SEQ ID NO: 514700 - RNA, 18 nt, Chlamydophila pneumoniae CWL029
aagguauuucucuccaca

SEQ ID NO: 514701 - RNA, 17 nt, Chlamydophila pneumoniae CWL029
aagguagaguccacagu

SEQ ID NO: 514702 - RNA, 16 nt, Chlamydophila pneumoniae CWL029
aagguagcuagcguuu

SEQ ID NO: 514703 - RNA, 20 nt, Chlamydophila pneumoniae CWL029
aagguaguuuucuucuuuaa

SEQ ID NO: 514704 - RNA, 22 nt, Chlamydophila pneumoniae CWL029
aagguacugcucaaugacacgg

SEQ ID NO: 514705 - RNA, 22 nt, Chlamydophila pneumoniae CWL029
aaggucugcgucuuuaauuaaa

SEQ ID NO: 514706 - RNA, 20 nt, Chlamydophila pneumoniae CWL029
aagguccaugucuaaagauu

SEQ ID NO: 514707 - RNA, 15 nt, Chlamydophila pneumoniae CWL029
aagccaguacuaaau

SEQ ID NO: 514708 - RNA, 14 nt, Chlamydophila pneumoniae CWL029
aagccauuuucuaa

SEQ ID NO: 514709 - RNA, 21 nt, Chlamydophila pneumoniae CWL029
aagcccucauccccucagaaa

SEQ ID NO: 514710 - RNA, 23 nt, Chlamydophila pneumoniae CWL029
aagcauuuuugggaaaagaaaag

SEQ ID NO: 514711 - RNA, 20 nt, Chlamydophila pneumoniae CWL029
aagcauucugcuagagcuuu

SEQ ID NO: 514712 - RNA, 23 nt, Chlamydophila pneumoniae CWL029
aagcauucugcuagagcuuucag

SEQ ID NO: 514713 - RNA, 23 nt, Chlamydophila pneumoniae CWL029
aagcagugugccaauuuuuguag

SEQ ID NO: 514714 - RNA, 12 nt, Chlamydophila pneumoniae CWL029
aagcaggagcau

SEQ ID NO: 514715 - RNA, 17 nt, Chlamydophila pneumoniae CWL029
aagcaucuuucaucaau

SEQ ID NO: 514716 - RNA, 22 nt, Chlamydophila pneumoniae CWL029
aagcauagucgucuuuuaaaga

SEQ ID NO: 514717 - RNA, 20 nt, Chlamydophila pneumoniae CWL029
aagcaucacggacuccgucu

SEQ ID NO: 514718 - RNA, 13 nt, Chlamydophila pneumoniae CWL029
aagcauagcccga

SEQ ID NO: 514719 - RNA, 18 nt, Chlamydophila pneumoniae CWL029
aagcagccucuucucuac

SEQ ID NO: 514720 - RNA, 18 nt, Chlamydophila pneumoniae CWL029
aagcagauccugcuucua

SEQ ID NO: 514721 - RNA, 18 nt, Chlamydophila pneumoniae CWL029
aagcagaggguuccaaga

SEQ ID NO: 514722 - RNA, 13 nt, Chlamydophila pneumoniae CWL029
aagcagaaacuuu

SEQ ID NO: 514723 - RNA, 19 nt, Chlamydophila pneumoniae CWL029
aagcagaaacuuuaaaagc

SEQ ID NO: 514724 - RNA, 12 nt, Chlamydophila pneumoniae CWL029
aagcacugauga

SEQ ID NO: 514725 - RNA, 14 nt, Chlamydophila pneumoniae CWL029
aagcacuuaaaaaa

SEQ ID NO: 514726 - RNA, 20 nt, Chlamydophila pneumoniae CWL029
aagcacccucuucauccgaa

SEQ ID NO: 514727 - RNA, 14 nt, Chlamydophila pneumoniae CWL029
aagcaaggaaaaaa

SEQ ID NO: 514728 - RNA, 15 nt, Chlamydophila pneumoniae CWL029
aagcaaggaaaaaaa

SEQ ID NO: 514729 - RNA, 22 nt, Chlamydophila pneumoniae CWL029
aagcaaggaaaaaaaaucugcu

SEQ ID NO: 514730 - RNA, 20 nt, Chlamydophila pneumoniae CWL029
aagcaauaucuauagaaggc

SEQ ID NO: 514731 - RNA, 13 nt, Chlamydophila pneumoniae CWL029
aagcaauaucugu

SEQ ID NO: 514732 - RNA, 15 nt, Chlamydophila pneumoniae CWL029
aagcaauauuucugu

SEQ ID NO: 514733 - RNA, 22 nt, Chlamydophila pneumoniae CWL029
aagcacauacaguacgcaaagu

SEQ ID NO: 514734 - RNA, 18 nt, Chlamydophila pneumoniae CWL029
aagcaacuaaacucucca

SEQ ID NO: 514735 - RNA, 13 nt, Chlamydophila pneumoniae CWL029
aagcaacucuuca

SEQ ID NO: 514736 - RNA, 18 nt, Chlamydophila pneumoniae CWL029
aagcaaaugccuguacua

SEQ ID NO: 514737 - RNA, 22 nt, Chlamydophila pneumoniae CWL029
aagcaaagaaaauucucagauu

SEQ ID NO: 514738 - RNA, 17 nt, Chlamydophila pneumoniae CWL029
aagcaaagauaaagaag

SEQ ID NO: 514739 - RNA, 12 nt, Chlamydophila pneumoniae CWL029
aagcaaaaguca

SEQ ID NO: 514740 - RNA, 13 nt, Chlamydophila pneumoniae CWL029
aagcaaaaacuuu

SEQ ID NO: 514741 - RNA, 18 nt, Chlamydophila pneumoniae CWL029
aagauuuuguaggaacau

SEQ ID NO: 514742 - RNA, 21 nt, Chlamydophila pneumoniae CWL029
aagauuuuggugagaucaucu

SEQ ID NO: 514743 - RNA, 14 nt, Chlamydophila pneumoniae CWL029
aagauuuugaaaau

SEQ ID NO: 514744 - RNA, 20 nt, Chlamydophila pneumoniae CWL029
aagauuuuaggggguuuuuc

SEQ ID NO: 514745 - RNA, 23 nt, Chlamydophila pneumoniae CWL029
aagauuuccaauccauucugaga

SEQ ID NO: 514746 - RNA, 11 nt, Chlamydophila pneumoniae CWL029
aagauuccuaa

SEQ ID NO: 514747 - RNA, 16 nt, Chlamydophila pneumoniae CWL029
aagauucuuuaaucua

SEQ ID NO: 514748 - RNA, 14 nt, Chlamydophila pneumoniae CWL029
aagauuauucuaga

SEQ ID NO: 514749 - RNA, 15 nt, Chlamydophila pneumoniae CWL029
aagauucaaagaagu

SEQ ID NO: 514750 - RNA, 16 nt, Chlamydophila pneumoniae CWL029
aagauucaaagaaguc

SEQ ID NO: 514751 - RNA, 17 nt, Chlamydophila pneumoniae CWL029
aagauucaaagaagucg

SEQ ID NO: 514752 - RNA, 22 nt, Chlamydophila pneumoniae CWL029
aagaugugcucgacguauuugc

SEQ ID NO: 514753 - RNA, 12 nt, Chlamydophila pneumoniae CWL029
aagaugcuggaa

SEQ ID NO: 514754 - RNA, 22 nt, Chlamydophila pneumoniae CWL029
aagaugcauucugauccgaaaa

SEQ ID NO: 514755 - RNA, 22 nt, Chlamydophila pneumoniae CWL029
aagaugcugaaccuuugguaga

SEQ ID NO: 514756 - RNA, 16 nt, Chlamydophila pneumoniae CWL029
aagauggcaaggaaaa

SEQ ID NO: 514757 - RNA, 17 nt, Chlamydophila pneumoniae CWL029
aagaauguagcuguucc

SEQ ID NO: 514758 - RNA, 20 nt, Chlamydophila pneumoniae CWL029
aagaauguagcuguuccaag

SEQ ID NO: 514759 - RNA, 17 nt, Chlamydophila pneumoniae CWL029
aagaauucuuugccaag

SEQ ID NO: 514760 - RNA, 18 nt, Chlamydophila pneumoniae CWL029
aagaucuccgaagacuac

SEQ ID NO: 514761 - RNA, 23 nt, Chlamydophila pneumoniae CWL029
aagaauuccuaaaacgagcaggg

SEQ ID NO: 514762 - RNA, 16 nt, Chlamydophila pneumoniae CWL029
aagaauuaagaagaag

SEQ ID NO: 514763 - RNA, 19 nt, Chlamydophila pneumoniae CWL029
aagaauuaccgcgagccau

SEQ ID NO: 514764 - RNA, 17 nt, Chlamydophila pneumoniae CWL029
aagaucuugaacagaga

SEQ ID NO: 514765 - RNA, 12 nt, Chlamydophila pneumoniae CWL029
aagaucucuuuu

SEQ ID NO: 514766 - RNA, 18 nt, Chlamydophila pneumoniae CWL029
aagaucucuuuuggaaga

SEQ ID NO: 514767 - RNA, 20 nt, Chlamydophila pneumoniae CWL029
aagaugacgagcccuagaua

SEQ ID NO: 514768 - RNA, 15 nt, Chlamydophila pneumoniae CWL029
aagaugaagaaacuu

SEQ ID NO: 514769 - RNA, 16 nt, Chlamydophila pneumoniae CWL029
aauacagcauaaaaau

SEQ ID NO: 514770 - RNA, 20 nt, Chlamydophila pneumoniae CWL029
aauacagccagcagaaggcu

SEQ ID NO: 514771 - RNA, 12 nt, Chlamydophila pneumoniae CWL029
aauaauuaaauc

SEQ ID NO: 514772 - RNA, 13 nt, Chlamydophila pneumoniae CWL029
aauaauuaaauau

SEQ ID NO: 514773 - RNA, 14 nt, Chlamydophila pneumoniae CWL029
aauaauuaaaucgu

SEQ ID NO: 514774 - RNA, 14 nt, Chlamydophila pneumoniae CWL029
aauaauguuuuaau

SEQ ID NO: 514775 - RNA, 20 nt, Chlamydophila pneumoniae CWL029
aauaauguuuuaauagcuaa

SEQ ID NO: 514776 - RNA, 19 nt, Chlamydophila pneumoniae CWL029
aauaaucaaccaaaaugca

SEQ ID NO: 514777 - RNA, 15 nt, Chlamydophila pneumoniae CWL029
aaaaauaccaguaga

SEQ ID NO: 514778 - RNA, 21 nt, Chlamydophila pneumoniae CWL029
aauaacuauaauauaacugca

SEQ ID NO: 514779 - RNA, 22 nt, Chlamydophila pneumoniae CWL029
aauagagaaagagugccaagag

SEQ ID NO: 514780 - RNA, 15 nt, Chlamydophila pneumoniae CWL029
aauagagucucuuga

SEQ ID NO: 514781 - RNA, 14 nt, Chlamydophila pneumoniae CWL029
aauagaaauaagca

SEQ ID NO: 514782 - RNA, 20 nt, Chlamydophila pneumoniae CWL029
aauagaaaagguauuaggaa

SEQ ID NO: 514783 - RNA, 13 nt, Chlamydophila pneumoniae CWL029
aauacuucuccuc

SEQ ID NO: 514784 - RNA, 14 nt, Chlamydophila pneumoniae CWL029
aauacuuaauccug

SEQ ID NO: 514785 - RNA, 16 nt, Chlamydophila pneumoniae CWL029
aauacuuaauccugua

SEQ ID NO: 514786 - RNA, 22 nt, Chlamydophila pneumoniae CWL029
aauacuggagagguaaccagag

SEQ ID NO: 514787 - RNA, 19 nt, Chlamydophila pneumoniae CWL029
aauacuccacuuuuuuccc

SEQ ID NO: 514788 - RNA, 16 nt, Chlamydophila pneumoniae CWL029
aauacuccacuuuuuu

SEQ ID NO: 514789 - RNA, 22 nt, Chlamydophila pneumoniae CWL029
aauacuaagaagcucacucuuu

SEQ ID NO: 514790 - RNA, 19 nt, Chlamydophila pneumoniae CWL029
aauacgcuuuucuucuuua

SEQ ID NO: 514791 - RNA, 16 nt, Chlamydophila pneumoniae CWL029
aauacggacauaccua

SEQ ID NO: 514792 - RNA, 15 nt, Chlamydophila pneumoniae CWL029
aauacgaucugcuuu

SEQ ID NO: 514793 - RNA, 14 nt, Chlamydophila pneumoniae CWL029
aauacgaucuuuug

SEQ ID NO: 514794 - RNA, 20 nt, Chlamydophila pneumoniae CWL029
aauacaucaccacugcucca

SEQ ID NO: 514795 - RNA, 21 nt, Chlamydophila pneumoniae CWL029
aauacccucaaauuggaauuc

SEQ ID NO: 514796 - RNA, 19 nt, Chlamydophila pneumoniae CWL029
aagugcucaguaaauauuu

SEQ ID NO: 514797 - RNA, 16 nt, Chlamydophila pneumoniae CWL029
aagugcucaguaaaua

SEQ ID NO: 514798 - RNA, 17 nt, Chlamydophila pneumoniae CWL029
aagugaucuugagaaaa

SEQ ID NO: 514799 - RNA, 22 nt, Chlamydophila pneumoniae CWL029
aagucuuggacguuccuuucuc

SEQ ID NO: 514800 - RNA, 19 nt, Chlamydophila pneumoniae CWL029
aagugaggagaauagcaag

SEQ ID NO: 514801 - RNA, 18 nt, Chlamydophila pneumoniae CWL029
aagugauaaggaagaauu

SEQ ID NO: 514802 - RNA, 18 nt, Chlamydophila pneumoniae CWL029
aaguaaucaugauaaaaa

SEQ ID NO: 514803 - RNA, 19 nt, Chlamydophila pneumoniae CWL029
aagucuucccucuccuuga

SEQ ID NO: 514804 - RNA, 14 nt, Chlamydophila pneumoniae CWL029
aaguaacgauaaga

SEQ ID NO: 514805 - RNA, 23 nt, Chlamydophila pneumoniae CWL029
aaguuucuuuugcaaaucuucga

SEQ ID NO: 514806 - RNA, 15 nt, Chlamydophila pneumoniae CWL029
aaguuugcaugcaac

SEQ ID NO: 514807 - RNA, 20 nt, Chlamydophila pneumoniae CWL029
aaguuuguagcagcaagaac

SEQ ID NO: 514808 - RNA, 14 nt, Chlamydophila pneumoniae CWL029
aaguuuaggcagga

SEQ ID NO: 514809 - RNA, 16 nt, Chlamydophila pneumoniae CWL029
aaguuucaaucucucc

SEQ ID NO: 514810 - RNA, 21 nt, Chlamydophila pneumoniae CWL029
aaguugcaacucucuuuaaac

SEQ ID NO: 514811 - RNA, 16 nt, Chlamydophila pneumoniae CWL029
aaguugccuaaagaga

SEQ ID NO: 514812 - RNA, 13 nt, Chlamydophila pneumoniae CWL029
aaguucucaaaga

SEQ ID NO: 514813 - RNA, 23 nt, Chlamydophila pneumoniae CWL029
aaguucggcgccuucaaaaaaca

SEQ ID NO: 514814 - RNA, 21 nt, Chlamydophila pneumoniae CWL029
aaguucgggucgauguucucg

SEQ ID NO: 514815 - RNA, 20 nt, Chlamydophila pneumoniae CWL029
aagugucugaguuagcuuuu

SEQ ID NO: 514816 - RNA, 14 nt, Chlamydophila pneumoniae CWL029
aaguuagccuggcu

SEQ ID NO: 514817 - RNA, 20 nt, Chlamydophila pneumoniae CWL029
aaguuagcuaacucggaaaa

SEQ ID NO: 514818 - RNA, 15 nt, Chlamydophila pneumoniae CWL029
aaguguauuuaaauu

SEQ ID NO: 514819 - RNA, 14 nt, Chlamydophila pneumoniae CWL029
aauaaaauuuaaaa

SEQ ID NO: 514820 - RNA, 14 nt, Chlamydophila pneumoniae CWL029
aauaaaacuuucuu

SEQ ID NO: 514821 - RNA, 22 nt, Chlamydophila pneumoniae CWL029
aauaaaaaaacccucaaagaau

SEQ ID NO: 514822 - RNA, 16 nt, Chlamydophila pneumoniae CWL029
aaguuuguauuuucua

SEQ ID NO: 514823 - RNA, 19 nt, Chlamydophila pneumoniae CWL029
aaguuugucguaauugcug

SEQ ID NO: 514824 - RNA, 15 nt, Chlamydophila pneumoniae CWL029
aaguuuugaggauuu

SEQ ID NO: 514825 - RNA, 23 nt, Chlamydophila pneumoniae CWL029
aaguuuugaggauuucuugcaag

SEQ ID NO: 514826 - RNA, 20 nt, Chlamydophila pneumoniae CWL029
aaguuuugauuuugcaguga

SEQ ID NO: 514827 - RNA, 19 nt, Chlamydophila pneumoniae CWL029
aaguuuugguuuuagaaau

SEQ ID NO: 514828 - RNA, 20 nt, Chlamydophila pneumoniae CWL029
aaguuuugcucucuagauuu

SEQ ID NO: 514829 - RNA, 16 nt, Chlamydophila pneumoniae CWL029
aaguuuuuucaauccu

SEQ ID NO: 514830 - RNA, 18 nt, Chlamydophila pneumoniae CWL029
aauaacaccaaaagaaua

SEQ ID NO: 514831 - RNA, 13 nt, Chlamydophila pneumoniae CWL029
aauaaauuuaucu

SEQ ID NO: 514832 - RNA, 13 nt, Chlamydophila pneumoniae CWL029
aagaauaaaauag

SEQ ID NO: 514833 - RNA, 14 nt, Chlamydophila pneumoniae CWL029
aagaaguaggaaau

SEQ ID NO: 514834 - RNA, 17 nt, Chlamydophila pneumoniae CWL029
aagaagguuuauuagaa

SEQ ID NO: 514835 - RNA, 16 nt, Chlamydophila pneumoniae CWL029
aagaaguacaagugaa

SEQ ID NO: 514836 - RNA, 18 nt, Chlamydophila pneumoniae CWL029
aagaagguccaugucuaa

SEQ ID NO: 514837 - RNA, 14 nt, Chlamydophila pneumoniae CWL029
aagaaggcagagaa

SEQ ID NO: 514838 - RNA, 15 nt, Chlamydophila pneumoniae CWL029
aagaagaaggacaac

SEQ ID NO: 514839 - RNA, 17 nt, Chlamydophila pneumoniae CWL029
aagaacuuagcaaugaa

SEQ ID NO: 514840 - RNA, 19 nt, Chlamydophila pneumoniae CWL029
aagaacuuaaaauucaaau

SEQ ID NO: 514841 - RNA, 20 nt, Chlamydophila pneumoniae CWL029
aagaacuuaaaauucaaauc

SEQ ID NO: 514842 - RNA, 15 nt, Chlamydophila pneumoniae CWL029
aagaacuuuagggaa

SEQ ID NO: 514843 - RNA, 22 nt, Chlamydophila pneumoniae CWL029
aagaacuccuuugagucuuuuu

SEQ ID NO: 514844 - RNA, 17 nt, Chlamydophila pneumoniae CWL029
aagaacugaagagucaa

SEQ ID NO: 514845 - RNA, 20 nt, Chlamydophila pneumoniae CWL029
aagaagcucacucuuuaaaa

SEQ ID NO: 514846 - RNA, 20 nt, Chlamydophila pneumoniae CWL029
aagaagcucguacuguuccu

SEQ ID NO: 514847 - RNA, 21 nt, Chlamydophila pneumoniae CWL029
aagaagcagcacucuuuuucu

SEQ ID NO: 514848 - RNA, 18 nt, Chlamydophila pneumoniae CWL029
aagaacgauaaaauugaa

SEQ ID NO: 514849 - RNA, 15 nt, Chlamydophila pneumoniae CWL029
aagaaccuguuuuuc

SEQ ID NO: 514850 - RNA, 20 nt, Chlamydophila pneumoniae CWL029
aagaaccucuaauuugauga

SEQ ID NO: 514851 - RNA, 18 nt, Chlamydophila pneumoniae CWL029
aagaacccgauacauccu

SEQ ID NO: 514852 - RNA, 17 nt, Chlamydophila pneumoniae CWL029
aagaacccauugaauuu

SEQ ID NO: 514853 - RNA, 13 nt, Chlamydophila pneumoniae CWL029
aagaacagcacuc

SEQ ID NO: 514854 - RNA, 13 nt, Chlamydophila pneumoniae CWL029
aagaacagcagaa

SEQ ID NO: 514855 - RNA, 13 nt, Chlamydophila pneumoniae CWL029
aagaacaguuugc

SEQ ID NO: 514856 - RNA, 17 nt, Chlamydophila pneumoniae CWL029
aagaaauucugacuaua

SEQ ID NO: 514857 - RNA, 13 nt, Chlamydophila pneumoniae CWL029
aagaaauuaacaa

SEQ ID NO: 514858 - RNA, 15 nt, Chlamydophila pneumoniae CWL029
aagaaauuaacaaca

SEQ ID NO: 514859 - RNA, 17 nt, Chlamydophila pneumoniae CWL029
aagaaagugaaaccauu

SEQ ID NO: 514860 - RNA, 11 nt, Chlamydophila pneumoniae CWL029
aagaaacuucc

SEQ ID NO: 514861 - RNA, 13 nt, Chlamydophila pneumoniae CWL029
aagaaaagcaauc

SEQ ID NO: 514862 - RNA, 21 nt, Chlamydophila pneumoniae CWL029
aagaaaacaaagucacggcga

SEQ ID NO: 514863 - RNA, 17 nt, Chlamydophila pneumoniae CWL029
aacuugauuuguuuagc

SEQ ID NO: 514864 - RNA, 20 nt, Chlamydophila pneumoniae CWL029
aacuugcuuuuuugaaagcu

SEQ ID NO: 514865 - RNA, 17 nt, Chlamydophila pneumoniae CWL029
aacuuggugagcagcuu

SEQ ID NO: 514866 - RNA, 20 nt, Chlamydophila pneumoniae CWL029
aagaaaaaccccuagaacuu

SEQ ID NO: 514867 - RNA, 14 nt, Chlamydophila pneumoniae CWL029
aacuucuucguuag

SEQ ID NO: 514868 - RNA, 18 nt, Chlamydophila pneumoniae CWL029
aacuucuucguuagagaa

SEQ ID NO: 514869 - RNA, 23 nt, Chlamydophila pneumoniae CWL029
aacuucuguaucgacuguacaaa

SEQ ID NO: 514870 - RNA, 14 nt, Chlamydophila pneumoniae CWL029
aacuugagccaaca

SEQ ID NO: 514871 - RNA, 13 nt, Chlamydophila pneumoniae CWL029
aacuucaaaaguu

SEQ ID NO: 514872 - RNA, 14 nt, Chlamydophila pneumoniae CWL029
aacuucaacaaagg

SEQ ID NO: 514873 - RNA, 19 nt, Chlamydophila pneumoniae CWL029
aacuucaacuucuccaacu

SEQ ID NO: 514874 - RNA, 16 nt, Chlamydophila pneumoniae CWL029
aacuucaaugaaagcu

SEQ ID NO: 514875 - RNA, 21 nt, Chlamydophila pneumoniae CWL029
aacuuaguuuugaaaagauuu

SEQ ID NO: 514876 - RNA, 17 nt, Chlamydophila pneumoniae CWL029
aacuuaaagacuugcuu

SEQ ID NO: 514877 - RNA, 19 nt, Chlamydophila pneumoniae CWL029
aacugcuuggucacaccaa

SEQ ID NO: 514878 - RNA, 14 nt, Chlamydophila pneumoniae CWL029
aacugcauaaucuc

SEQ ID NO: 514879 - RNA, 13 nt, Chlamydophila pneumoniae CWL029
aacucuuugagga

SEQ ID NO: 514880 - RNA, 22 nt, Chlamydophila pneumoniae CWL029
aacucuuuaauugugcucucua

SEQ ID NO: 514881 - RNA, 20 nt, Chlamydophila pneumoniae CWL029
aacguauccuugauuuuaaa

SEQ ID NO: 514882 - RNA, 18 nt, Chlamydophila pneumoniae CWL029
aacguagaugucuugguu

SEQ ID NO: 514883 - RNA, 17 nt, Chlamydophila pneumoniae CWL029
aacguagcuacaaaauu

SEQ ID NO: 514884 - RNA, 20 nt, Chlamydophila pneumoniae CWL029
aacguaagcuuuuuaccaau

SEQ ID NO: 514885 - RNA, 23 nt, Chlamydophila pneumoniae CWL029
aacguacucuucuuuuuaucaug

SEQ ID NO: 514886 - RNA, 12 nt, Chlamydophila pneumoniae CWL029
aacguacuuagg

SEQ ID NO: 514887 - RNA, 15 nt, Chlamydophila pneumoniae CWL029
aacguacuuagguaa

SEQ ID NO: 514888 - RNA, 12 nt, Chlamydophila pneumoniae CWL029
aacguugauugg

SEQ ID NO: 514889 - RNA, 19 nt, Chlamydophila pneumoniae CWL029
aacgugauugcugcugcua

SEQ ID NO: 514890 - RNA, 14 nt, Chlamydophila pneumoniae CWL029
aacuaaacucucca

SEQ ID NO: 514891 - RNA, 20 nt, Chlamydophila pneumoniae CWL029
aacuaaaacagccuagcaaa

SEQ ID NO: 514892 - RNA, 22 nt, Chlamydophila pneumoniae CWL029
aacuaaaaugguaaaccuaccu

SEQ ID NO: 514893 - RNA, 19 nt, Chlamydophila pneumoniae CWL029
aacuaaauucuuaacaaua

SEQ ID NO: 514894 - RNA, 20 nt, Chlamydophila pneumoniae CWL029
aacuaacauagauaagguaa

SEQ ID NO: 514895 - RNA, 19 nt, Chlamydophila pneumoniae CWL029
aacuauaauauaacugcau

SEQ ID NO: 514896 - RNA, 13 nt, Chlamydophila pneumoniae CWL029
aacuagaccaaua

SEQ ID NO: 514897 - RNA, 17 nt, Chlamydophila pneumoniae CWL029
aacuacuuaaauccuaa

SEQ ID NO: 514898 - RNA, 18 nt, Chlamydophila pneumoniae CWL029
aacuacucucauucaccu

SEQ ID NO: 514899 - RNA, 15 nt, Chlamydophila pneumoniae CWL029
aacuaccagaugccu

SEQ ID NO: 514900 - RNA, 23 nt, Chlamydophila pneumoniae CWL029
aacggaacuaaagagaucacagg

SEQ ID NO: 514901 - RNA, 13 nt, Chlamydophila pneumoniae CWL029
aacgcuuuucuaa

SEQ ID NO: 514902 - RNA, 23 nt, Chlamydophila pneumoniae CWL029
aacgaucgucaguaaaacacaaa

SEQ ID NO: 514903 - RNA, 21 nt, Chlamydophila pneumoniae CWL029
aacgcccuucaggacaugccu

SEQ ID NO: 514904 - RNA, 22 nt, Chlamydophila pneumoniae CWL029
aaccgcaaaaagcuucuuucuu

SEQ ID NO: 514905 - RNA, 20 nt, Chlamydophila pneumoniae CWL029
aacccuaguucauuagcuaa

SEQ ID NO: 514906 - RNA, 13 nt, Chlamydophila pneumoniae CWL029
aacccuauuuaag

SEQ ID NO: 514907 - RNA, 14 nt, Chlamydophila pneumoniae CWL029
aacccuauuuaagg

SEQ ID NO: 514908 - RNA, 16 nt, Chlamydophila pneumoniae CWL029
aacccuuuaaugauca

SEQ ID NO: 514909 - RNA, 22 nt, Chlamydophila pneumoniae CWL029
aacccuuuauacuguuuuucuu

SEQ ID NO: 514910 - RNA, 16 nt, Chlamydophila pneumoniae CWL029
aacccugggcucacuc

SEQ ID NO: 514911 - RNA, 14 nt, Chlamydophila pneumoniae CWL029
aaccgaaacuucuc

SEQ ID NO: 514912 - RNA, 22 nt, Chlamydophila pneumoniae CWL029
aaccgaaacuucucagauaaaa

SEQ ID NO: 514913 - RNA, 17 nt, Chlamydophila pneumoniae CWL029
aaccgagacuauuuugg

SEQ ID NO: 514914 - RNA, 13 nt, Chlamydophila pneumoniae CWL029
aaccaugaggcug

SEQ ID NO: 514915 - RNA, 17 nt, Chlamydophila pneumoniae CWL029
aaccaauuucuccgcuu

SEQ ID NO: 514916 - RNA, 20 nt, Chlamydophila pneumoniae CWL029
aaccaauugagcucucuagc

SEQ ID NO: 514917 - RNA, 23 nt, Chlamydophila pneumoniae CWL029
aaccaaucuugagcauccaaaau

SEQ ID NO: 514918 - RNA, 16 nt, Chlamydophila pneumoniae CWL029
aaccaauaaacuuugu

SEQ ID NO: 514919 - RNA, 23 nt, Chlamydophila pneumoniae CWL029
aaccaaccuuguugaaaggcuga

SEQ ID NO: 514920 - RNA, 16 nt, Chlamydophila pneumoniae CWL029
aaccaacaucaaagaa

SEQ ID NO: 514921 - RNA, 16 nt, Chlamydophila pneumoniae CWL029
aacauugaguugguuu

SEQ ID NO: 514922 - RNA, 17 nt, Chlamydophila pneumoniae CWL029
aacauucuucugucugu

SEQ ID NO: 514923 - RNA, 23 nt, Chlamydophila pneumoniae CWL029
aacaugacggugcuguuguaaua

SEQ ID NO: 514924 - RNA, 14 nt, Chlamydophila pneumoniae CWL029
aacaugagauacgu

SEQ ID NO: 514925 - RNA, 15 nt, Chlamydophila pneumoniae CWL029
aacauccauagagaa

SEQ ID NO: 514926 - RNA, 13 nt, Chlamydophila pneumoniae CWL029
aacaucaaagaau

SEQ ID NO: 514927 - RNA, 14 nt, Chlamydophila pneumoniae CWL029
aacaucaaagaauu

SEQ ID NO: 514928 - RNA, 19 nt, Chlamydophila pneumoniae CWL029
aacauacacgucuaagaau

SEQ ID NO: 514929 - RNA, 13 nt, Chlamydophila pneumoniae CWL029
aacacuuuuaaag

SEQ ID NO: 514930 - RNA, 14 nt, Chlamydophila pneumoniae CWL029
aacagaaauugcuu

SEQ ID NO: 514931 - RNA, 16 nt, Chlamydophila pneumoniae CWL029
aacagaaauugcuucu

SEQ ID NO: 514932 - RNA, 21 nt, Chlamydophila pneumoniae CWL029
aacagcauggacuccaagaau

SEQ ID NO: 514933 - RNA, 17 nt, Chlamydophila pneumoniae CWL029
aacagaucuuuaucauu

SEQ ID NO: 514934 - RNA, 20 nt, Chlamydophila pneumoniae CWL029
aacagcacucacgcucucgc

SEQ ID NO: 514935 - RNA, 18 nt, Chlamydophila pneumoniae CWL029
aacagcacucacgcucuc

SEQ ID NO: 514936 - RNA, 20 nt, Chlamydophila pneumoniae CWL029
aacagauuuuucaagaacuc

SEQ ID NO: 514937 - RNA, 23 nt, Chlamydophila pneumoniae CWL029
aacacgucacuggggcauaagaa

SEQ ID NO: 514938 - RNA, 17 nt, Chlamydophila pneumoniae CWL029
aacacgucgaacaugac

SEQ ID NO: 514939 - RNA, 20 nt, Chlamydophila pneumoniae CWL029
aacacgccugcgaaagcgag

SEQ ID NO: 514940 - RNA, 18 nt, Chlamydophila pneumoniae CWL029
aacacgagugccuucuuc

SEQ ID NO: 514941 - RNA, 21 nt, Chlamydophila pneumoniae CWL029
aacacucucuaccaucaugaa

SEQ ID NO: 514942 - RNA, 22 nt, Chlamydophila pneumoniae CWL029
aacacuuaguccgguuucuucu

SEQ ID NO: 514943 - RNA, 14 nt, Chlamydophila pneumoniae CWL029
aacaccucaauacg

SEQ ID NO: 514944 - RNA, 20 nt, Chlamydophila pneumoniae CWL029
aacacccucccucauaagau

SEQ ID NO: 514945 - RNA, 15 nt, Chlamydophila pneumoniae CWL029
aacaaugcaucccug

SEQ ID NO: 514946 - RNA, 14 nt, Chlamydophila pneumoniae CWL029
aacaaucuuucuuc

SEQ ID NO: 514947 - RNA, 16 nt, Chlamydophila pneumoniae CWL029
aacaauaguaaagcau

SEQ ID NO: 514948 - RNA, 23 nt, Chlamydophila pneumoniae CWL029
aacaauaaacgagacugcaaagg

SEQ ID NO: 514949 - RNA, 16 nt, Chlamydophila pneumoniae CWL029
aaauucuuuucuacau

SEQ ID NO: 514950 - RNA, 17 nt, Chlamydophila pneumoniae CWL029
aaauucuucgagagcau

SEQ ID NO: 514951 - RNA, 21 nt, Chlamydophila pneumoniae CWL029
aaauucuuaacaauauaugcu

SEQ ID NO: 514952 - RNA, 15 nt, Chlamydophila pneumoniae CWL029
aaauucuuaaaacug

SEQ ID NO: 514953 - RNA, 20 nt, Chlamydophila pneumoniae CWL029
aaauucuggaauuucccaua

SEQ ID NO: 514954 - RNA, 22 nt, Chlamydophila pneumoniae CWL029
aaauucuggagucgagcagaaa

SEQ ID NO: 514955 - RNA, 18 nt, Chlamydophila pneumoniae CWL029
aaauucuguaaagugaaa

SEQ ID NO: 514956 - RNA, 13 nt, Chlamydophila pneumoniae CWL029
aaaaaguaacuau

SEQ ID NO: 514957 - RNA, 15 nt, Chlamydophila pneumoniae CWL029
aaaaaguaacuaucu

SEQ ID NO: 514958 - RNA, 14 nt, Chlamydophila pneumoniae CWL029
aacacaaauagcaa

SEQ ID NO: 514959 - RNA, 20 nt, Chlamydophila pneumoniae CWL029
aacacagauaggaaccacuu

SEQ ID NO: 514960 - RNA, 18 nt, Chlamydophila pneumoniae CWL029
aaaaagggaucuccuuca

SEQ ID NO: 514961 - RNA, 16 nt, Chlamydophila pneumoniae CWL029
aaaaagggaugaagau

SEQ ID NO: 514962 - RNA, 21 nt, Chlamydophila pneumoniae CWL029
aaaaagggaugaagauaaaau

SEQ ID NO: 514963 - RNA, 23 nt, Chlamydophila pneumoniae CWL029
aacacaguuugagaaagaccacc

SEQ ID NO: 514964 - RNA, 23 nt, Chlamydophila pneumoniae CWL029
aaucauuggaaccauaggauagg

SEQ ID NO: 514965 - RNA, 23 nt, Chlamydophila pneumoniae CWL029
aaucaugauaaaaauuuucagga

SEQ ID NO: 514966 - RNA, 15 nt, Chlamydophila pneumoniae CWL029
aaucaugauaaaaau

SEQ ID NO: 514967 - RNA, 17 nt, Chlamydophila pneumoniae CWL029
aaucagcacacugcuua

SEQ ID NO: 514968 - RNA, 23 nt, Chlamydophila pneumoniae CWL029
aaucagcaacaucguuaauauaa

SEQ ID NO: 514969 - RNA, 19 nt, Chlamydophila pneumoniae CWL029
aauccagaauuuucugcga

SEQ ID NO: 514970 - RNA, 19 nt, Chlamydophila pneumoniae CWL029
aauccagauuguucaaaaa

SEQ ID NO: 514971 - RNA, 19 nt, Chlamydophila pneumoniae CWL029
aauccaaaaacuucuaacu

SEQ ID NO: 514972 - RNA, 21 nt, Chlamydophila pneumoniae CWL029
aauccaaaaaaugcuccugca

SEQ ID NO: 514973 - RNA, 21 nt, Chlamydophila pneumoniae CWL029
aauccauucugagaaagaagu

SEQ ID NO: 514974 - RNA, 22 nt, Chlamydophila pneumoniae CWL029
aauccauuuugcccacuucuac

SEQ ID NO: 514975 - RNA, 15 nt, Chlamydophila pneumoniae CWL029
aauccauucugagaa

SEQ ID NO: 514976 - RNA, 18 nt, Chlamydophila pneumoniae CWL029
aauccauucugagaaaga

SEQ ID NO: 514977 - RNA, 23 nt, Chlamydophila pneumoniae CWL029
aauccagauuguucaaaaauaga

SEQ ID NO: 514978 - RNA, 21 nt, Chlamydophila pneumoniae CWL029
aauccagccacccccacuucu

SEQ ID NO: 514979 - RNA, 22 nt, Chlamydophila pneumoniae CWL029
aaucgagagaagaaauucugac

SEQ ID NO: 514980 - RNA, 20 nt, Chlamydophila pneumoniae CWL029
aaucgauaacguugccuguu

SEQ ID NO: 514981 - RNA, 19 nt, Chlamydophila pneumoniae CWL029
aauccuguucuacauagau

SEQ ID NO: 514982 - RNA, 12 nt, Chlamydophila pneumoniae CWL029
aauccuaaaaag

SEQ ID NO: 514983 - RNA, 22 nt, Chlamydophila pneumoniae CWL029
aauccuaaaaaggguuccucuu

SEQ ID NO: 514984 - RNA, 14 nt, Chlamydophila pneumoniae CWL029
aauccuucucccuc

SEQ ID NO: 514985 - RNA, 13 nt, Chlamydophila pneumoniae CWL029
aauccuuccuuac

SEQ ID NO: 514986 - RNA, 21 nt, Chlamydophila pneumoniae CWL029
aauccgauaagauaaagaauu

SEQ ID NO: 514987 - RNA, 19 nt, Chlamydophila pneumoniae CWL029
aaucccuguguguuuuuuc

SEQ ID NO: 514988 - RNA, 18 nt, Chlamydophila pneumoniae CWL029
aaucccgugcuaggaaga

SEQ ID NO: 514989 - RNA, 22 nt, Chlamydophila pneumoniae CWL029
aaucccugaugcaguaauucca

SEQ ID NO: 514990 - RNA, 20 nt, Chlamydophila pneumoniae CWL029
aaucccugcacucuuucaga

SEQ ID NO: 514991 - RNA, 16 nt, Chlamydophila pneumoniae CWL029
aauccggcauaaaaaa

SEQ ID NO: 514992 - RNA, 14 nt, Chlamydophila pneumoniae CWL029
aaucugcucucuga

SEQ ID NO: 514993 - RNA, 15 nt, Chlamydophila pneumoniae CWL029
aaucugcuauaacca

SEQ ID NO: 514994 - RNA, 16 nt, Chlamydophila pneumoniae CWL029
aaucugcuauaaccaa

SEQ ID NO: 514995 - RNA, 14 nt, Chlamydophila pneumoniae CWL029
aaucuggggcuucc

SEQ ID NO: 514996 - RNA, 18 nt, Chlamydophila pneumoniae CWL029
aaucuggggcuuccagaa

SEQ ID NO: 514997 - RNA, 15 nt, Chlamydophila pneumoniae CWL029
aaucuggaaugacua

SEQ ID NO: 514998 - RNA, 17 nt, Chlamydophila pneumoniae CWL029
aaucugauucaauugag

SEQ ID NO: 514999 - RNA, 19 nt, Chlamydophila pneumoniae CWL029
aaucucuuucauaaauuca

SEQ ID NO: 515000 - RNA, 20 nt, Chlamydophila pneumoniae CWL029
aaucucuuucauaaauucag

SEQ ID NO: 515001 - RNA, 17 nt, Chlamydophila pneumoniae CWL029
aaucuucgauuguaacu

SEQ ID NO: 515002 - RNA, 13 nt, Chlamydophila pneumoniae CWL029
aaucuuccccuaa

SEQ ID NO: 515003 - RNA, 17 nt, Chlamydophila pneumoniae CWL029
aaucuuccccuaaaaau

SEQ ID NO: 515004 - RNA, 17 nt, Chlamydophila pneumoniae CWL029
aaucuuaugggagaagc

SEQ ID NO: 515005 - RNA, 18 nt, Chlamydophila pneumoniae CWL029
aaucuuaugggagaagcu

SEQ ID NO: 515006 - RNA, 15 nt, Chlamydophila pneumoniae CWL029
aaucuguaagaaaau

SEQ ID NO: 515007 - RNA, 19 nt, Chlamydophila pneumoniae CWL029
aaucugugaguacccaguc

SEQ ID NO: 515008 - RNA, 23 nt, Chlamydophila pneumoniae CWL029
aaucugugaguacccagucaucg

SEQ ID NO: 515009 - RNA, 23 nt, Chlamydophila pneumoniae CWL029
aaucuuacauaaaccuuugguuu

SEQ ID NO: 515010 - RNA, 13 nt, Chlamydophila pneumoniae CWL029
aaucucuccuuga

SEQ ID NO: 515011 - RNA, 22 nt, Chlamydophila pneumoniae CWL029
aaucuccaaacauuuuuaagga

SEQ ID NO: 515012 - RNA, 18 nt, Chlamydophila pneumoniae CWL029
aaucucauuccagcaucu

SEQ ID NO: 515013 - RNA, 20 nt, Chlamydophila pneumoniae CWL029
aaucucaccagaagcaacua

SEQ ID NO: 515014 - RNA, 15 nt, Chlamydophila pneumoniae CWL029
aaucguguuuuccug

SEQ ID NO: 515015 - RNA, 18 nt, Chlamydophila pneumoniae CWL029
aaucuaccgugaagauuu

SEQ ID NO: 515016 - RNA, 19 nt, Chlamydophila pneumoniae CWL029
aaaaauuuaaaagauuccu

SEQ ID NO: 515017 - RNA, 21 nt, Chlamydophila pneumoniae CWL029
aaucgcacuucuauuucugcu

SEQ ID NO: 515018 - RNA, 16 nt, Chlamydophila pneumoniae CWL029
aaucgcaucaaaaaau

SEQ ID NO: 515019 - RNA, 18 nt, Chlamydophila pneumoniae CWL029
aauauguacugaugugaa

SEQ ID NO: 515020 - RNA, 23 nt, Chlamydophila pneumoniae CWL029
aauagcaggaaggaauagagaaa

SEQ ID NO: 515021 - RNA, 14 nt, Chlamydophila pneumoniae CWL029
aauaugcucuccuu

SEQ ID NO: 515022 - RNA, 19 nt, Chlamydophila pneumoniae CWL029
aauauuuuaccauugagau

SEQ ID NO: 515023 - RNA, 18 nt, Chlamydophila pneumoniae CWL029
aauauugaucuuuccucu

SEQ ID NO: 515024 - RNA, 15 nt, Chlamydophila pneumoniae CWL029
aauauucuuggaaga

SEQ ID NO: 515025 - RNA, 13 nt, Chlamydophila pneumoniae CWL029
aaucaauccaaga

SEQ ID NO: 515026 - RNA, 13 nt, Chlamydophila pneumoniae CWL029
aaucaauccacaa

SEQ ID NO: 515027 - RNA, 22 nt, Chlamydophila pneumoniae CWL029
aaucaauccuauggcagcagga

SEQ ID NO: 515028 - RNA, 12 nt, Chlamydophila pneumoniae CWL029
aaucaagaagag

SEQ ID NO: 515029 - RNA, 17 nt, Chlamydophila pneumoniae CWL029
aaucaagaguuucgaau

SEQ ID NO: 515030 - RNA, 18 nt, Chlamydophila pneumoniae CWL029
aaucaagaguuucgaauu

SEQ ID NO: 515031 - RNA, 13 nt, Chlamydophila pneumoniae CWL029
aaucaagauaaag

SEQ ID NO: 515032 - RNA, 16 nt, Chlamydophila pneumoniae CWL029
aaucaagccacagaga

SEQ ID NO: 515033 - RNA, 17 nt, Chlamydophila pneumoniae CWL029
aaucaagccacagagaa

SEQ ID NO: 515034 - RNA, 11 nt, Chlamydophila pneumoniae CWL029
aaucaaauuca

SEQ ID NO: 515035 - RNA, 12 nt, Chlamydophila pneumoniae CWL029
aaucaaauucaa

SEQ ID NO: 515036 - RNA, 14 nt, Chlamydophila pneumoniae CWL029
aaucaaccaaaaug

SEQ ID NO: 515037 - RNA, 19 nt, Chlamydophila pneumoniae CWL029
aaucaccaauuuuuucccc

SEQ ID NO: 515038 - RNA, 17 nt, Chlamydophila pneumoniae CWL029
aaucaccauauccauga

SEQ ID NO: 515039 - RNA, 20 nt, Chlamydophila pneumoniae CWL029
aaucacgacgucaucaccau

SEQ ID NO: 515040 - RNA, 12 nt, Chlamydophila pneumoniae CWL029
aaucacucucua

SEQ ID NO: 515041 - RNA, 21 nt, Chlamydophila pneumoniae CWL029
aaucacucuaugaucuacaga

SEQ ID NO: 515042 - RNA, 14 nt, Chlamydophila pneumoniae CWL029
aaucagaggagccu

SEQ ID NO: 515043 - RNA, 20 nt, Chlamydophila pneumoniae CWL029
aaucagaggagccuccauaa

SEQ ID NO: 515044 - RNA, 20 nt, Chlamydophila pneumoniae CWL029
aaucacuuaauaauguuuua

SEQ ID NO: 515045 - RNA, 18 nt, Chlamydophila pneumoniae CWL029
aauucgaauucucagaaa

SEQ ID NO: 515046 - RNA, 16 nt, Chlamydophila pneumoniae CWL029
aauucgaauucucaga

SEQ ID NO: 515047 - RNA, 17 nt, Chlamydophila pneumoniae CWL029
aauucuagaccugccaa

SEQ ID NO: 515048 - RNA, 18 nt, Chlamydophila pneumoniae CWL029
aauuccuucucagaaaga

SEQ ID NO: 515049 - RNA, 14 nt, Chlamydophila pneumoniae CWL029
aauuccuuggauuc

SEQ ID NO: 515050 - RNA, 22 nt, Chlamydophila pneumoniae CWL029
aauuccuucucagaaagauauc

SEQ ID NO: 515051 - RNA, 12 nt, Chlamydophila pneumoniae CWL029
aauuccuuucuc

SEQ ID NO: 515052 - RNA, 22 nt, Chlamydophila pneumoniae CWL029
aauuccuuucuccagcauuuuu

SEQ ID NO: 515053 - RNA, 16 nt, Chlamydophila pneumoniae CWL029
aauucucagaaagccu

SEQ ID NO: 515054 - RNA, 16 nt, Chlamydophila pneumoniae CWL029
aauucucagauugcuu

SEQ ID NO: 515055 - RNA, 22 nt, Chlamydophila pneumoniae CWL029
aauucucugacacuccucagaa

SEQ ID NO: 515056 - RNA, 15 nt, Chlamydophila pneumoniae CWL029
aauucucucucugca

SEQ ID NO: 515057 - RNA, 18 nt, Chlamydophila pneumoniae CWL029
aauucucugacacuccuc

SEQ ID NO: 515058 - RNA, 18 nt, Chlamydophila pneumoniae CWL029
aauucugaagauauauuu

SEQ ID NO: 515059 - RNA, 15 nt, Chlamydophila pneumoniae CWL029
aauuccaucuggaau

SEQ ID NO: 515060 - RNA, 22 nt, Chlamydophila pneumoniae CWL029
aauuccauagguuagaaaugaa

SEQ ID NO: 515061 - RNA, 21 nt, Chlamydophila pneumoniae CWL029
aauuccccguguuuggagaag

SEQ ID NO: 515062 - RNA, 23 nt, Chlamydophila pneumoniae CWL029
aauucaugcaaaacaacaucacu

SEQ ID NO: 515063 - RNA, 13 nt, Chlamydophila pneumoniae CWL029
aauucagagaaag

SEQ ID NO: 515064 - RNA, 19 nt, Chlamydophila pneumoniae CWL029
aauuaucuccaaagaucau

SEQ ID NO: 515065 - RNA, 16 nt, Chlamydophila pneumoniae CWL029
aauuauuauuaguuaa

SEQ ID NO: 515066 - RNA, 17 nt, Chlamydophila pneumoniae CWL029
aauuauccagaaagauu

SEQ ID NO: 515067 - RNA, 14 nt, Chlamydophila pneumoniae CWL029
aauuaucagagaca

SEQ ID NO: 515068 - RNA, 18 nt, Chlamydophila pneumoniae CWL029
aauuggcguaauaauucc

SEQ ID NO: 515069 - RNA, 19 nt, Chlamydophila pneumoniae CWL029
aauugguggagcucauuua

SEQ ID NO: 515070 - RNA, 13 nt, Chlamydophila pneumoniae CWL029
aauugcuuucccc

SEQ ID NO: 515071 - RNA, 21 nt, Chlamydophila pneumoniae CWL029
aauugcuggaggccaaagaac

SEQ ID NO: 515072 - RNA, 15 nt, Chlamydophila pneumoniae CWL029
aauugcucuugcucu

SEQ ID NO: 515073 - RNA, 13 nt, Chlamydophila pneumoniae CWL029
aauugcauucuua

SEQ ID NO: 515074 - RNA, 17 nt, Chlamydophila pneumoniae CWL029
aaaacaacauucguuag

SEQ ID NO: 515075 - RNA, 18 nt, Chlamydophila pneumoniae CWL029
aauugcaucggacuguaa

SEQ ID NO: 515076 - RNA, 22 nt, Chlamydophila pneumoniae CWL029
aauugcagucacuacuguucua

SEQ ID NO: 515077 - RNA, 22 nt, Chlamydophila pneumoniae CWL029
aauugcauuaagauaaacauua

SEQ ID NO: 515078 - RNA, 16 nt, Chlamydophila pneumoniae CWL029
aauuguucuugaaguu

SEQ ID NO: 515079 - RNA, 13 nt, Chlamydophila pneumoniae CWL029
aauuguagagaga

SEQ ID NO: 515080 - RNA, 21 nt, Chlamydophila pneumoniae CWL029
aauuguaucuguauccuuccu

SEQ ID NO: 515081 - RNA, 15 nt, Chlamydophila pneumoniae CWL029
aauugucuucagugc

SEQ ID NO: 515082 - RNA, 19 nt, Chlamydophila pneumoniae CWL029
aauuaaacuuucuucucua

SEQ ID NO: 515083 - RNA, 23 nt, Chlamydophila pneumoniae CWL029
aauuaaaaguucagcaaagaagu

SEQ ID NO: 515084 - RNA, 15 nt, Chlamydophila pneumoniae CWL029
aauuaaauauauaaa

SEQ ID NO: 515085 - RNA, 13 nt, Chlamydophila pneumoniae CWL029
aauuaaauaucua

SEQ ID NO: 515086 - RNA, 15 nt, Chlamydophila pneumoniae CWL029
aauuaacagagcgcc

SEQ ID NO: 515087 - RNA, 16 nt, Chlamydophila pneumoniae CWL029
aauuaacagagcgccu

SEQ ID NO: 515088 - RNA, 18 nt, Chlamydophila pneumoniae CWL029
aauguuuggccaacagcu

SEQ ID NO: 515089 - RNA, 14 nt, Chlamydophila pneumoniae CWL029
aauguuuuuaaacc

SEQ ID NO: 515090 - RNA, 18 nt, Chlamydophila pneumoniae CWL029
aaugucgucucagaaaaa

SEQ ID NO: 515091 - RNA, 18 nt, Chlamydophila pneumoniae CWL029
aauguccaacucagcuuu

SEQ ID NO: 515092 - RNA, 20 nt, Chlamydophila pneumoniae CWL029
aauguucccaaauagaaaau

SEQ ID NO: 515093 - RNA, 15 nt, Chlamydophila pneumoniae CWL029
aauguggugauuucu

SEQ ID NO: 515094 - RNA, 22 nt, Chlamydophila pneumoniae CWL029
aaugugucuugcugauuuuugc

SEQ ID NO: 515095 - RNA, 23 nt, Chlamydophila pneumoniae CWL029
aaugugcaauaggaaaaaauacc

SEQ ID NO: 515096 - RNA, 16 nt, Chlamydophila pneumoniae CWL029
aaugugcucggcacuu

SEQ ID NO: 515097 - RNA, 15 nt, Chlamydophila pneumoniae CWL029
aaugugcuuuugguu

SEQ ID NO: 515098 - RNA, 17 nt, Chlamydophila pneumoniae CWL029
aaugugcuuuugguucu

SEQ ID NO: 515099 - RNA, 16 nt, Chlamydophila pneumoniae CWL029
aauggaaauagagaaa

SEQ ID NO: 515100 - RNA, 19 nt, Chlamydophila pneumoniae CWL029
aaugcggaccuuaagauga

SEQ ID NO: 515101 - RNA, 20 nt, Chlamydophila pneumoniae CWL029
aauggaaacauagaaucauu

SEQ ID NO: 515102 - RNA, 16 nt, Chlamydophila pneumoniae CWL029
aauggcaugaaagaua

SEQ ID NO: 515103 - RNA, 15 nt, Chlamydophila pneumoniae CWL029
aaugguuccugaagc

SEQ ID NO: 515104 - RNA, 15 nt, Chlamydophila pneumoniae CWL029
aauggcgauaaaugc

SEQ ID NO: 515105 - RNA, 17 nt, Chlamydophila pneumoniae CWL029
aaugccuuaaauguauu

SEQ ID NO: 515106 - RNA, 16 nt, Chlamydophila pneumoniae CWL029
aaugcgauaaccacua

SEQ ID NO: 515107 - RNA, 20 nt, Chlamydophila pneumoniae CWL029
aaugcgaugcggucagaaac

SEQ ID NO: 515108 - RNA, 16 nt, Chlamydophila pneumoniae CWL029
aaugcacuuugaauaa

SEQ ID NO: 515109 - RNA, 19 nt, Chlamydophila pneumoniae CWL029
aaucuugagcauccaaaau

SEQ ID NO: 515110 - RNA, 23 nt, Chlamydophila pneumoniae CWL029
aaucuugagcauccaaaaugucu

SEQ ID NO: 515111 - RNA, 18 nt, Chlamydophila pneumoniae CWL029
aaucuugaucagcaauca

SEQ ID NO: 515112 - RNA, 15 nt, Chlamydophila pneumoniae CWL029
acaaaaaggacucuu

SEQ ID NO: 515113 - RNA, 21 nt, Chlamydophila pneumoniae CWL029
acaaaaacugcgcuagcucca

SEQ ID NO: 515114 - RNA, 17 nt, Chlamydophila pneumoniae CWL029
acaaaaaauaaaaucaa

SEQ ID NO: 515115 - RNA, 20 nt, Chlamydophila pneumoniae CWL029
acaaaaaagggaucuccuuc

SEQ ID NO: 515116 - RNA, 18 nt, Chlamydophila pneumoniae CWL029
acaaaaccuggauugauc

SEQ ID NO: 515117 - RNA, 12 nt, Chlamydophila pneumoniae CWL029
acaaaauaaaac

SEQ ID NO: 515118 - RNA, 20 nt, Chlamydophila pneumoniae CWL029
acaaaauccacauccuugua

SEQ ID NO: 515119 - RNA, 15 nt, Chlamydophila pneumoniae CWL029
acaaacuaaaucaac

SEQ ID NO: 515120 - RNA, 18 nt, Chlamydophila pneumoniae CWL029
acaaacagauuuuucaag

SEQ ID NO: 515121 - RNA, 23 nt, Chlamydophila pneumoniae CWL029
acaaacagauuuuucaagaacuc

SEQ ID NO: 515122 - RNA, 15 nt, Chlamydophila pneumoniae CWL029
acaaacaacagaaau

SEQ ID NO: 515123 - RNA, 20 nt, Chlamydophila pneumoniae CWL029
acaaaauucaugcaaaacaa

SEQ ID NO: 515124 - RNA, 14 nt, Chlamydophila pneumoniae CWL029
acaaauaaacugac

SEQ ID NO: 515125 - RNA, 18 nt, Chlamydophila pneumoniae CWL029
acaaaggguuucuuucca

SEQ ID NO: 515126 - RNA, 19 nt, Chlamydophila pneumoniae CWL029
acaaaugcgguaucuccgg

SEQ ID NO: 515127 - RNA, 19 nt, Chlamydophila pneumoniae CWL029
acaaauuaccuugagacaa

SEQ ID NO: 515128 - RNA, 14 nt, Chlamydophila pneumoniae CWL029
acaaauggcaugaa

SEQ ID NO: 515129 - RNA, 19 nt, Chlamydophila pneumoniae CWL029
acaaaugugacgcaagaga

SEQ ID NO: 515130 - RNA, 14 nt, Chlamydophila pneumoniae CWL029
acaacagagacaag

SEQ ID NO: 515131 - RNA, 15 nt, Chlamydophila pneumoniae CWL029
acaacaguugcggag

SEQ ID NO: 515132 - RNA, 15 nt, Chlamydophila pneumoniae CWL029
acaacauaacagggu

SEQ ID NO: 515133 - RNA, 17 nt, Chlamydophila pneumoniae CWL029
acaacaacauaaagaag

SEQ ID NO: 515134 - RNA, 13 nt, Chlamydophila pneumoniae CWL029
acaacaauaauac

SEQ ID NO: 515135 - RNA, 18 nt, Chlamydophila pneumoniae CWL029
acaacaccacagaggucg

SEQ ID NO: 515136 - RNA, 21 nt, Chlamydophila pneumoniae CWL029
acaaauuuaucggcuaaagaa

SEQ ID NO: 515137 - RNA, 19 nt, Chlamydophila pneumoniae CWL029
acaaauuuuugcagaguug

SEQ ID NO: 515138 - RNA, 22 nt, Chlamydophila pneumoniae CWL029
acaacaaacuaccagaugccuu

SEQ ID NO: 515139 - RNA, 13 nt, Chlamydophila pneumoniae CWL029
acaaccacuuccu

SEQ ID NO: 515140 - RNA, 15 nt, Chlamydophila pneumoniae CWL029
acaacaucacuauca

SEQ ID NO: 515141 - RNA, 16 nt, Chlamydophila pneumoniae CWL029
acaaccgccuuuauau

SEQ ID NO: 515142 - RNA, 21 nt, Chlamydophila pneumoniae CWL029
acaaccuagaaucacauaaaa

SEQ ID NO: 515143 - RNA, 21 nt, Chlamydophila pneumoniae CWL029
acacgcuugugguuagaggaa

SEQ ID NO: 515144 - RNA, 19 nt, Chlamydophila pneumoniae CWL029
acacgccuccuucaaagau

SEQ ID NO: 515145 - RNA, 19 nt, Chlamydophila pneumoniae CWL029
acacgcacuugcuuaucca

SEQ ID NO: 515146 - RNA, 15 nt, Chlamydophila pneumoniae CWL029
acacgaggagccucu

SEQ ID NO: 515147 - RNA, 21 nt, Chlamydophila pneumoniae CWL029
acacgaauuucuaacuuaaua

SEQ ID NO: 515148 - RNA, 13 nt, Chlamydophila pneumoniae CWL029
acacgacgaggac

SEQ ID NO: 515149 - RNA, 21 nt, Chlamydophila pneumoniae CWL029
acaccucuucucuauaaaaaa

SEQ ID NO: 515150 - RNA, 17 nt, Chlamydophila pneumoniae CWL029
acacccccgcagcuucu

SEQ ID NO: 515151 - RNA, 15 nt, Chlamydophila pneumoniae CWL029
acaccauuuuugaau

SEQ ID NO: 515152 - RNA, 19 nt, Chlamydophila pneumoniae CWL029
acacaacucuuaaaucgcu

SEQ ID NO: 515153 - RNA, 17 nt, Chlamydophila pneumoniae CWL029
acaccaaaagaauacuc

SEQ ID NO: 515154 - RNA, 20 nt, Chlamydophila pneumoniae CWL029
acacauugucucuuuuaaag

SEQ ID NO: 515155 - RNA, 12 nt, Chlamydophila pneumoniae CWL029
acaccaaauccu

SEQ ID NO: 515156 - RNA, 14 nt, Chlamydophila pneumoniae CWL029
acaccaaauccugc

SEQ ID NO: 515157 - RNA, 13 nt, Chlamydophila pneumoniae CWL029
acacaacucuuua

SEQ ID NO: 515158 - RNA, 15 nt, Chlamydophila pneumoniae CWL029
acaaggucuuuuccu

SEQ ID NO: 515159 - RNA, 14 nt, Chlamydophila pneumoniae CWL029
acaagcuuccuugg

SEQ ID NO: 515160 - RNA, 19 nt, Chlamydophila pneumoniae CWL029
acaagcuucaucaaaacau

SEQ ID NO: 515161 - RNA, 22 nt, Chlamydophila pneumoniae CWL029
acaagcuucaucaaaacauaau

SEQ ID NO: 515162 - RNA, 17 nt, Chlamydophila pneumoniae CWL029
acaacgcaggaagaaca

SEQ ID NO: 515163 - RNA, 15 nt, Chlamydophila pneumoniae CWL029
acaauacucucugcu

SEQ ID NO: 515164 - RNA, 15 nt, Chlamydophila pneumoniae CWL029
acaauaaaaaagaga

SEQ ID NO: 515165 - RNA, 16 nt, Chlamydophila pneumoniae CWL029
acaauaccaucucuuu

SEQ ID NO: 515166 - RNA, 23 nt, Chlamydophila pneumoniae CWL029
acaauaccaucucuuucuauuuc

SEQ ID NO: 515167 - RNA, 17 nt, Chlamydophila pneumoniae CWL029
acaaguuuuuucaaucc

SEQ ID NO: 515168 - RNA, 19 nt, Chlamydophila pneumoniae CWL029
acaaguuuuuucaauccuu

SEQ ID NO: 515169 - RNA, 15 nt, Chlamydophila pneumoniae CWL029
acaaguugagagaga

SEQ ID NO: 515170 - RNA, 20 nt, Chlamydophila pneumoniae CWL029
acaaucgugauugcugucag

SEQ ID NO: 515171 - RNA, 17 nt, Chlamydophila pneumoniae CWL029
acaauccucacuauuaa

SEQ ID NO: 515172 - RNA, 19 nt, Chlamydophila pneumoniae CWL029
acaauccucacuauuaaua

SEQ ID NO: 515173 - RNA, 22 nt, Chlamydophila pneumoniae CWL029
acaauccucacuauuaauacuu

SEQ ID NO: 515174 - RNA, 16 nt, Chlamydophila pneumoniae CWL029
acaaugaucuuucgaa

SEQ ID NO: 515175 - RNA, 22 nt, Chlamydophila pneumoniae CWL029
acaaugcgauacgaaggaucau

SEQ ID NO: 515176 - RNA, 20 nt, Chlamydophila pneumoniae CWL029
acaauuuuaaaaucuccucu

SEQ ID NO: 515177 - RNA, 16 nt, Chlamydophila pneumoniae CWL029
acaauuugcuccucca

SEQ ID NO: 515178 - RNA, 18 nt, Chlamydophila pneumoniae CWL029
acaauuugcuccuccaaa

SEQ ID NO: 515179 - RNA, 22 nt, Chlamydophila pneumoniae CWL029
acaauuccguacgcuauaaaua

SEQ ID NO: 515180 - RNA, 20 nt, Chlamydophila pneumoniae CWL029
acaauuccuaaaacaagaag

SEQ ID NO: 515181 - RNA, 20 nt, Chlamydophila pneumoniae CWL029
acaauucgauguuaaggcuu

SEQ ID NO: 515182 - RNA, 20 nt, Chlamydophila pneumoniae CWL029
acagcaaucugcagguaagg

SEQ ID NO: 515183 - RNA, 13 nt, Chlamydophila pneumoniae CWL029
acagcacaggcau

SEQ ID NO: 515184 - RNA, 22 nt, Chlamydophila pneumoniae CWL029
acacgucacuggggcauaagaa

SEQ ID NO: 515185 - RNA, 16 nt, Chlamydophila pneumoniae CWL029
acagccuguuuucuuc

SEQ ID NO: 515186 - RNA, 13 nt, Chlamydophila pneumoniae CWL029
acagccggagcuu

SEQ ID NO: 515187 - RNA, 20 nt, Chlamydophila pneumoniae CWL029
acagccggagcuucuaagau

SEQ ID NO: 515188 - RNA, 13 nt, Chlamydophila pneumoniae CWL029
acagcuaaucaua

SEQ ID NO: 515189 - RNA, 20 nt, Chlamydophila pneumoniae CWL029
acagcuaaucauagccauca

SEQ ID NO: 515190 - RNA, 18 nt, Chlamydophila pneumoniae CWL029
acagcuaucgagauaucg

SEQ ID NO: 515191 - RNA, 12 nt, Chlamydophila pneumoniae CWL029
acagcuccauuu

SEQ ID NO: 515192 - RNA, 16 nt, Chlamydophila pneumoniae CWL029
acagcuccauuuaaau

SEQ ID NO: 515193 - RNA, 18 nt, Chlamydophila pneumoniae CWL029
acagcuucuuuuccagca

SEQ ID NO: 515194 - RNA, 16 nt, Chlamydophila pneumoniae CWL029
acagcuuuaaucagag

SEQ ID NO: 515195 - RNA, 14 nt, Chlamydophila pneumoniae CWL029
acaggaauaggcuc

SEQ ID NO: 515196 - RNA, 18 nt, Chlamydophila pneumoniae CWL029
acaggaauaggcucuuua

SEQ ID NO: 515197 - RNA, 20 nt, Chlamydophila pneumoniae CWL029
acaggaauucucaucggcau

SEQ ID NO: 515198 - RNA, 19 nt, Chlamydophila pneumoniae CWL029
acaggcucaugaaauuuca

SEQ ID NO: 515199 - RNA, 17 nt, Chlamydophila pneumoniae CWL029
acaggcuccucugcuaa

SEQ ID NO: 515200 - RNA, 23 nt, Chlamydophila pneumoniae CWL029
acaggcuccucugcuaagcacaa

SEQ ID NO: 515201 - RNA, 15 nt, Chlamydophila pneumoniae CWL029
acauaacacuuuguu

SEQ ID NO: 515202 - RNA, 14 nt, Chlamydophila pneumoniae CWL029
acauaacaugagaa

SEQ ID NO: 515203 - RNA, 19 nt, Chlamydophila pneumoniae CWL029
acauaaccucggucucgcu

SEQ ID NO: 515204 - RNA, 13 nt, Chlamydophila pneumoniae CWL029
acauaaagucaaa

SEQ ID NO: 515205 - RNA, 19 nt, Chlamydophila pneumoniae CWL029
acauaaagacccuucuuuc

SEQ ID NO: 515206 - RNA, 13 nt, Chlamydophila pneumoniae CWL029
acauaaagaucuu

SEQ ID NO: 515207 - RNA, 21 nt, Chlamydophila pneumoniae CWL029
acauaaagaucuuuauuuuua

SEQ ID NO: 515208 - RNA, 12 nt, Chlamydophila pneumoniae CWL029
acauaaaucaac

SEQ ID NO: 515209 - RNA, 19 nt, Chlamydophila pneumoniae CWL029
acauaaaucaacaucacaa

SEQ ID NO: 515210 - RNA, 20 nt, Chlamydophila pneumoniae CWL029
acauaaaucaacaucacaau

SEQ ID NO: 515211 - RNA, 19 nt, Chlamydophila pneumoniae CWL029
acaguuuguaaaaagccua

SEQ ID NO: 515212 - RNA, 16 nt, Chlamydophila pneumoniae CWL029
acaguuugagaaagac

SEQ ID NO: 515213 - RNA, 16 nt, Chlamydophila pneumoniae CWL029
acaguucuuucugcuu

SEQ ID NO: 515214 - RNA, 19 nt, Chlamydophila pneumoniae CWL029
acaguuggcguuuucuaga

SEQ ID NO: 515215 - RNA, 17 nt, Chlamydophila pneumoniae CWL029
acagucugugagaaaua

SEQ ID NO: 515216 - RNA, 16 nt, Chlamydophila pneumoniae CWL029
acagugacacgcuuuc

SEQ ID NO: 515217 - RNA, 18 nt, Chlamydophila pneumoniae CWL029
acagugauuuagaaaucu

SEQ ID NO: 515218 - RNA, 22 nt, Chlamydophila pneumoniae CWL029
acagugauuuagaaaucucacu

SEQ ID NO: 515219 - RNA, 20 nt, Chlamydophila pneumoniae CWL029
acagugguaugcuuuuccuu

SEQ ID NO: 515220 - RNA, 23 nt, Chlamydophila pneumoniae CWL029
acaguccuuuaccaucgucucca

SEQ ID NO: 515221 - RNA, 22 nt, Chlamydophila pneumoniae CWL029
acaguaggcgaugcaaauucca

SEQ ID NO: 515222 - RNA, 13 nt, Chlamydophila pneumoniae CWL029
acaguaauuauuu

SEQ ID NO: 515223 - RNA, 13 nt, Chlamydophila pneumoniae CWL029
acagguucacuuc

SEQ ID NO: 515224 - RNA, 21 nt, Chlamydophila pneumoniae CWL029
acaggggaugugauguucugc

SEQ ID NO: 515225 - RNA, 22 nt, Chlamydophila pneumoniae CWL029
acagggccugagaccauaaaau

SEQ ID NO: 515226 - RNA, 15 nt, Chlamydophila pneumoniae CWL029
acagguaauacccuc

SEQ ID NO: 515227 - RNA, 17 nt, Chlamydophila pneumoniae CWL029
acaucucacagauacca

SEQ ID NO: 515228 - RNA, 22 nt, Chlamydophila pneumoniae CWL029
acaucuccaagauaauuaugua

SEQ ID NO: 515229 - RNA, 13 nt, Chlamydophila pneumoniae CWL029
acaucguauauaa

SEQ ID NO: 515230 - RNA, 12 nt, Chlamydophila pneumoniae CWL029
acaucuccugca

SEQ ID NO: 515231 - RNA, 16 nt, Chlamydophila pneumoniae CWL029
acaucuccugcagguu

SEQ ID NO: 515232 - RNA, 12 nt, Chlamydophila pneumoniae CWL029
acaucuccuuuc

SEQ ID NO: 515233 - RNA, 14 nt, Chlamydophila pneumoniae CWL029
acaucuuaaaaacu

SEQ ID NO: 515234 - RNA, 15 nt, Chlamydophila pneumoniae CWL029
acaucugugauuaau

SEQ ID NO: 515235 - RNA, 14 nt, Chlamydophila pneumoniae CWL029
acaugccuuaggcu

SEQ ID NO: 515236 - RNA, 17 nt, Chlamydophila pneumoniae CWL029
acaugccuaaauagcuc

SEQ ID NO: 515237 - RNA, 13 nt, Chlamydophila pneumoniae CWL029
acaugccugaaaa

SEQ ID NO: 515238 - RNA, 22 nt, Chlamydophila pneumoniae CWL029
acaugccugaaaacaaggcaaa

SEQ ID NO: 515239 - RNA, 19 nt, Chlamydophila pneumoniae CWL029
acaugcgaagggaggagaa

SEQ ID NO: 515240 - RNA, 13 nt, Chlamydophila pneumoniae CWL029
acaugcccaaaca

SEQ ID NO: 515241 - RNA, 16 nt, Chlamydophila pneumoniae CWL029
acaugaggauacacuu

SEQ ID NO: 515242 - RNA, 20 nt, Chlamydophila pneumoniae CWL029
acaugaggcacauguaggau

SEQ ID NO: 515243 - RNA, 16 nt, Chlamydophila pneumoniae CWL029
acaugcgcguauaagg

SEQ ID NO: 515244 - RNA, 18 nt, Chlamydophila pneumoniae CWL029
acaugcucaagaagauga

SEQ ID NO: 515245 - RNA, 17 nt, Chlamydophila pneumoniae CWL029
acauccuggagcaugag

SEQ ID NO: 515246 - RNA, 18 nt, Chlamydophila pneumoniae CWL029
acauccuggagcaugaga

SEQ ID NO: 515247 - RNA, 13 nt, Chlamydophila pneumoniae CWL029
acauccuguaguu

SEQ ID NO: 515248 - RNA, 22 nt, Chlamydophila pneumoniae CWL029
acauaauaagcaggaaaagcaa

SEQ ID NO: 515249 - RNA, 18 nt, Chlamydophila pneumoniae CWL029
acauaacgggguugucuc

SEQ ID NO: 515250 - RNA, 14 nt, Chlamydophila pneumoniae CWL029
acaucaccacugcu

SEQ ID NO: 515251 - RNA, 11 nt, Chlamydophila pneumoniae CWL029
acaucaaugau

SEQ ID NO: 515252 - RNA, 18 nt, Chlamydophila pneumoniae CWL029
acauuugcagacacaaaa

SEQ ID NO: 515253 - RNA, 18 nt, Chlamydophila pneumoniae CWL029
acauuugcuauuuucccu

SEQ ID NO: 515254 - RNA, 23 nt, Chlamydophila pneumoniae CWL029
acauuucuugauccaucugcucu

SEQ ID NO: 515255 - RNA, 15 nt, Chlamydophila pneumoniae CWL029
acauuuagauaaaga

SEQ ID NO: 515256 - RNA, 19 nt, Chlamydophila pneumoniae CWL029
acauuuguugucagcuuug

SEQ ID NO: 515257 - RNA, 14 nt, Chlamydophila pneumoniae CWL029
acauuuugguaucu

SEQ ID NO: 515258 - RNA, 15 nt, Chlamydophila pneumoniae CWL029
acauucuuaauaucu

SEQ ID NO: 515259 - RNA, 21 nt, Chlamydophila pneumoniae CWL029
acauucuucugucuguauuuc

SEQ ID NO: 515260 - RNA, 13 nt, Chlamydophila pneumoniae CWL029
acauuagagagug

SEQ ID NO: 515261 - RNA, 22 nt, Chlamydophila pneumoniae CWL029
acauuagcgacgacgacgccua

SEQ ID NO: 515262 - RNA, 22 nt, Chlamydophila pneumoniae CWL029
acauuaccguucccuaaaguaa

SEQ ID NO: 515263 - RNA, 17 nt, Chlamydophila pneumoniae CWL029
acauucuucugucugua

SEQ ID NO: 515264 - RNA, 20 nt, Chlamydophila pneumoniae CWL029
acauugaguugguuuuguaa

SEQ ID NO: 515265 - RNA, 17 nt, Chlamydophila pneumoniae CWL029
accaacacuuuuaaaga

SEQ ID NO: 515266 - RNA, 19 nt, Chlamydophila pneumoniae CWL029
accaaagucgauacccaaa

SEQ ID NO: 515267 - RNA, 15 nt, Chlamydophila pneumoniae CWL029
accaaauaauuaaau

SEQ ID NO: 515268 - RNA, 19 nt, Chlamydophila pneumoniae CWL029
acauuuuuauuuccuuauc

SEQ ID NO: 515269 - RNA, 16 nt, Chlamydophila pneumoniae CWL029
acauuuuucuauaaua

SEQ ID NO: 515270 - RNA, 18 nt, Chlamydophila pneumoniae CWL029
accaaaauuauguauaaa

SEQ ID NO: 515271 - RNA, 22 nt, Chlamydophila pneumoniae CWL029
accaaacuuucuuuucuauauu

SEQ ID NO: 515272 - RNA, 21 nt, Chlamydophila pneumoniae CWL029
accaaacuuucuuuucuauau

SEQ ID NO: 515273 - RNA, 18 nt, Chlamydophila pneumoniae CWL029
acuuguucagcuagagca

SEQ ID NO: 515274 - RNA, 23 nt, Chlamydophila pneumoniae CWL029
acuuguaccguaaagaaaagcaa

SEQ ID NO: 515275 - RNA, 18 nt, Chlamydophila pneumoniae CWL029
acuugcaagcuucuuguu

SEQ ID NO: 515276 - RNA, 16 nt, Chlamydophila pneumoniae CWL029
acuuaguuuugaaaag

SEQ ID NO: 515277 - RNA, 20 nt, Chlamydophila pneumoniae CWL029
acuuauaccaccccaaagca

SEQ ID NO: 515278 - RNA, 13 nt, Chlamydophila pneumoniae CWL029
acuugcucuuuag

SEQ ID NO: 515279 - RNA, 15 nt, Chlamydophila pneumoniae CWL029
acuugcucuuuaaua

SEQ ID NO: 515280 - RNA, 14 nt, Chlamydophila pneumoniae CWL029
acuugcuuauccaa

SEQ ID NO: 515281 - RNA, 21 nt, Chlamydophila pneumoniae CWL029
acuugcuuuuuugaaagcugg

SEQ ID NO: 515282 - RNA, 17 nt, Chlamydophila pneumoniae CWL029
acuugcgauacaauaaa

SEQ ID NO: 515283 - RNA, 15 nt, Chlamydophila pneumoniae CWL029
acuugcccaaaaguu

SEQ ID NO: 515284 - RNA, 15 nt, Chlamydophila pneumoniae CWL029
acuuuauagaaagua

SEQ ID NO: 515285 - RNA, 22 nt, Chlamydophila pneumoniae CWL029
acuuuaggcccugacuuagagu

SEQ ID NO: 515286 - RNA, 16 nt, Chlamydophila pneumoniae CWL029
acuuuagggaagaaau

SEQ ID NO: 515287 - RNA, 18 nt, Chlamydophila pneumoniae CWL029
acuuuagggaagaaauua

SEQ ID NO: 515288 - RNA, 22 nt, Chlamydophila pneumoniae CWL029
acuuuagaaauuccaauuuuug

SEQ ID NO: 515289 - RNA, 23 nt, Chlamydophila pneumoniae CWL029
acuuuagaaauuccaauuuuugc

SEQ ID NO: 515290 - RNA, 14 nt, Chlamydophila pneumoniae CWL029
acuuuauucucuuc

SEQ ID NO: 515291 - RNA, 20 nt, Chlamydophila pneumoniae CWL029
acuuuauucucuucacuauu

SEQ ID NO: 515292 - RNA, 21 nt, Chlamydophila pneumoniae CWL029
acuuguuaggaaaauucuuaa

SEQ ID NO: 515293 - RNA, 12 nt, Chlamydophila pneumoniae CWL029
acuuguuucucc

SEQ ID NO: 515294 - RNA, 16 nt, Chlamydophila pneumoniae CWL029
acuuguuucuccuauu

SEQ ID NO: 515295 - RNA, 22 nt, Chlamydophila pneumoniae CWL029
acuuguuucuccuauuggugua

SEQ ID NO: 515296 - RNA, 14 nt, Chlamydophila pneumoniae CWL029
acuuuaacgaagaa

SEQ ID NO: 515297 - RNA, 12 nt, Chlamydophila pneumoniae CWL029
acuuuaagaagc

SEQ ID NO: 515298 - RNA, 20 nt, Chlamydophila pneumoniae CWL029
acuuuacacuauaagacauu

SEQ ID NO: 515299 - RNA, 15 nt, Chlamydophila pneumoniae CWL029
acuuugugauuacag

SEQ ID NO: 515300 - RNA, 22 nt, Chlamydophila pneumoniae CWL029
acuuuguuaauagaagaucauu

SEQ ID NO: 515301 - RNA, 21 nt, Chlamydophila pneumoniae CWL029
acuuuuaauauuugagaagau

SEQ ID NO: 515302 - RNA, 17 nt, Chlamydophila pneumoniae CWL029
acuuuuaauccuuucac

SEQ ID NO: 515303 - RNA, 16 nt, Chlamydophila pneumoniae CWL029
acuuuuacugaaauua

SEQ ID NO: 515304 - RNA, 24 nt, Chlamydophila pneumoniae CWL029
acuuugauuguauagcuuacuuag

SEQ ID NO: 515305 - RNA, 18 nt, Chlamydophila pneumoniae CWL029
acuuugauuguauagcuu

SEQ ID NO: 515306 - RNA, 15 nt, Chlamydophila pneumoniae CWL029
acuuugccauuucua

SEQ ID NO: 515307 - RNA, 21 nt, Chlamydophila pneumoniae CWL029
acuuucugagccccuugcaaa

SEQ ID NO: 515308 - RNA, 22 nt, Chlamydophila pneumoniae CWL029
acuuucugagccccuugcaaaa

SEQ ID NO: 515309 - RNA, 23 nt, Chlamydophila pneumoniae CWL029
acuuucugagccccuugcaaaag

SEQ ID NO: 515310 - RNA, 16 nt, Chlamydophila pneumoniae CWL029
acuuucugauugagaa

SEQ ID NO: 515311 - RNA, 15 nt, Chlamydophila pneumoniae CWL029
acuuucuucucuagg

SEQ ID NO: 515312 - RNA, 17 nt, Chlamydophila pneumoniae CWL029
acuuuccguagccuuac

SEQ ID NO: 515313 - RNA, 18 nt, Chlamydophila pneumoniae CWL029
acuuuccuggguaagcau

SEQ ID NO: 515314 - RNA, 22 nt, Chlamydophila pneumoniae CWL029
acuuucgaagcgcucuacaaau

SEQ ID NO: 515315 - RNA, 16 nt, Chlamydophila pneumoniae CWL029
agaaaauguaaaaaau

SEQ ID NO: 515316 - RNA, 22 nt, Chlamydophila pneumoniae CWL029
agaaaaucucuaagaaucuaua

SEQ ID NO: 515317 - RNA, 19 nt, Chlamydophila pneumoniae CWL029
agaaaaucaacucuccauc

SEQ ID NO: 515318 - RNA, 14 nt, Chlamydophila pneumoniae CWL029
acuuuuuuucaaau

SEQ ID NO: 515319 - RNA, 21 nt, Chlamydophila pneumoniae CWL029
acuuuuuucccuccaccagaa

SEQ ID NO: 515320 - RNA, 21 nt, Chlamydophila pneumoniae CWL029
agaagcaugaagcagaaacuu

SEQ ID NO: 515321 - RNA, 14 nt, Chlamydophila pneumoniae CWL029
agaagagucauuau

SEQ ID NO: 515322 - RNA, 15 nt, Chlamydophila pneumoniae CWL029
agaagccuuccuugu

SEQ ID NO: 515323 - RNA, 19 nt, Chlamydophila pneumoniae CWL029
agaaguuuacaaauaaaau

SEQ ID NO: 515324 - RNA, 20 nt, Chlamydophila pneumoniae CWL029
agaaguuugauaagcuaaca

SEQ ID NO: 515325 - RNA, 17 nt, Chlamydophila pneumoniae CWL029
agaaguuuacaaauaaa

SEQ ID NO: 515326 - RNA, 23 nt, Chlamydophila pneumoniae CWL029
agaaguguauuuaaauucuggaa

SEQ ID NO: 515327 - RNA, 15 nt, Chlamydophila pneumoniae CWL029
agaaguggccuugcc

SEQ ID NO: 515328 - RNA, 19 nt, Chlamydophila pneumoniae CWL029
agaagugaucuugagaaaa

SEQ ID NO: 515329 - RNA, 18 nt, Chlamydophila pneumoniae CWL029
agaauacaaacaagaagc

SEQ ID NO: 515330 - RNA, 13 nt, Chlamydophila pneumoniae CWL029
agaauaaucucuu

SEQ ID NO: 515331 - RNA, 14 nt, Chlamydophila pneumoniae CWL029
agaauacaaacaag

SEQ ID NO: 515332 - RNA, 14 nt, Chlamydophila pneumoniae CWL029
agaauaaaauagga

SEQ ID NO: 515333 - RNA, 15 nt, Chlamydophila pneumoniae CWL029
agaauaaaauggccu

SEQ ID NO: 515334 - RNA, 15 nt, Chlamydophila pneumoniae CWL029
agaauacaacccuuu

SEQ ID NO: 515335 - RNA, 20 nt, Chlamydophila pneumoniae CWL029
agaauacaacccuuuauacu

SEQ ID NO: 515336 - RNA, 16 nt, Chlamydophila pneumoniae CWL029
agaauaccuauagguu

SEQ ID NO: 515337 - RNA, 22 nt, Chlamydophila pneumoniae CWL029
agaauacucuagguuuucucuu

SEQ ID NO: 515338 - RNA, 24 nt, Chlamydophila pneumoniae CWL029
agaauagccauaauuagaacagca

SEQ ID NO: 515339 - RNA, 19 nt, Chlamydophila pneumoniae CWL029
agaauaggaacaaagcucu

SEQ ID NO: 515340 - RNA, 21 nt, Chlamydophila pneumoniae CWL029
agaauagggguagugaucugc

SEQ ID NO: 515341 - RNA, 13 nt, Chlamydophila pneumoniae CWL029
agaaucaauaaaa

SEQ ID NO: 515342 - RNA, 13 nt, Chlamydophila pneumoniae CWL029
agaauaucaucuu

SEQ ID NO: 515343 - RNA, 13 nt, Chlamydophila pneumoniae CWL029
agaauucagagaa

SEQ ID NO: 515344 - RNA, 15 nt, Chlamydophila pneumoniae CWL029
agaauucagagaaag

SEQ ID NO: 515345 - RNA, 14 nt, Chlamydophila pneumoniae CWL029
agaaucuccucauc

SEQ ID NO: 515346 - RNA, 17 nt, Chlamydophila pneumoniae CWL029
agaaucuccauuuagaa

SEQ ID NO: 515347 - RNA, 23 nt, Chlamydophila pneumoniae CWL029
agaaucguucuuagcgcauguau

SEQ ID NO: 515348 - RNA, 12 nt, Chlamydophila pneumoniae CWL029
agaaucucugcc

SEQ ID NO: 515349 - RNA, 12 nt, Chlamydophila pneumoniae CWL029
agaaucuuugug

SEQ ID NO: 515350 - RNA, 15 nt, Chlamydophila pneumoniae CWL029
agaaugcccuguucu

SEQ ID NO: 515351 - RNA, 17 nt, Chlamydophila pneumoniae CWL029
agaacaaaaaaucaauc

SEQ ID NO: 515352 - RNA, 15 nt, Chlamydophila pneumoniae CWL029
agaaauguuuuuaaa

SEQ ID NO: 515353 - RNA, 16 nt, Chlamydophila pneumoniae CWL029
agaaauguuuuuaaac

SEQ ID NO: 515354 - RNA, 17 nt, Chlamydophila pneumoniae CWL029
agaaauguaagaaggca

SEQ ID NO: 515355 - RNA, 21 nt, Chlamydophila pneumoniae CWL029
agaaaugcucuucugcagcgu

SEQ ID NO: 515356 - RNA, 17 nt, Chlamydophila pneumoniae CWL029
agaaaucugcauuccag

SEQ ID NO: 515357 - RNA, 19 nt, Chlamydophila pneumoniae CWL029
agaaaucugcauuccagga

SEQ ID NO: 515358 - RNA, 18 nt, Chlamydophila pneumoniae CWL029
agaaaugaaacgaaagca

SEQ ID NO: 515359 - RNA, 15 nt, Chlamydophila pneumoniae CWL029
agaaaugaagccaaa

SEQ ID NO: 515360 - RNA, 21 nt, Chlamydophila pneumoniae CWL029
agaaaucuacucuuuaaaaau

SEQ ID NO: 515361 - RNA, 18 nt, Chlamydophila pneumoniae CWL029
aaaacacugcgcaaagaa

SEQ ID NO: 515362 - RNA, 20 nt, Chlamydophila pneumoniae CWL029
aaaacagauaagacaauaaa

SEQ ID NO: 515363 - RNA, 17 nt, Chlamydophila pneumoniae CWL029
agaaacuaguucuucuu

SEQ ID NO: 515364 - RNA, 17 nt, Chlamydophila pneumoniae CWL029
aaaacaccugcccauuu

SEQ ID NO: 515365 - RNA, 13 nt, Chlamydophila pneumoniae CWL029
agaaacacugaac

SEQ ID NO: 515366 - RNA, 19 nt, Chlamydophila pneumoniae CWL029
agaaacacaguuugagaaa

SEQ ID NO: 515367 - RNA, 12 nt, Chlamydophila pneumoniae CWL029
agaaacaacuug

SEQ ID NO: 515368 - RNA, 21 nt, Chlamydophila pneumoniae CWL029
agaaacacaaauucaccaacc

SEQ ID NO: 515369 - RNA, 19 nt, Chlamydophila pneumoniae CWL029
agaacgaacaguucauguu

SEQ ID NO: 515370 - RNA, 11 nt, Chlamydophila pneumoniae CWL029
agaaccuccac

SEQ ID NO: 515371 - RNA, 19 nt, Chlamydophila pneumoniae CWL029
agaaccuucacaagaaaac

SEQ ID NO: 515372 - RNA, 21 nt, Chlamydophila pneumoniae CWL029
agaaccuucacaagaaaacaa

SEQ ID NO: 515373 - RNA, 24 nt, Chlamydophila pneumoniae CWL029
agaaccuucacaagaaaacaaagu

SEQ ID NO: 515374 - RNA, 20 nt, Chlamydophila pneumoniae CWL029
agaacaucuucccaccccug

SEQ ID NO: 515375 - RNA, 21 nt, Chlamydophila pneumoniae CWL029
agaacaugaccuuuaggaacu

SEQ ID NO: 515376 - RNA, 20 nt, Chlamydophila pneumoniae CWL029
agaacauguuucuaagcuga

SEQ ID NO: 515377 - RNA, 14 nt, Chlamydophila pneumoniae CWL029
agaagagaaacaca

SEQ ID NO: 515378 - RNA, 14 nt, Chlamydophila pneumoniae CWL029
agaagagaaaguag

SEQ ID NO: 515379 - RNA, 21 nt, Chlamydophila pneumoniae CWL029
agaagacaggagcuacugaaa

SEQ ID NO: 515380 - RNA, 18 nt, Chlamydophila pneumoniae CWL029
agaagacuagcuuuucau

SEQ ID NO: 515381 - RNA, 16 nt, Chlamydophila pneumoniae CWL029
agaagaaggacaacua

SEQ ID NO: 515382 - RNA, 19 nt, Chlamydophila pneumoniae CWL029
agaacuuuugaauuaaaag

SEQ ID NO: 515383 - RNA, 17 nt, Chlamydophila pneumoniae CWL029
agaagaaauuagaggga

SEQ ID NO: 515384 - RNA, 18 nt, Chlamydophila pneumoniae CWL029
agaacgucaccauuaaau

SEQ ID NO: 515385 - RNA, 18 nt, Chlamydophila pneumoniae CWL029
agaacguggggaaauuaa

SEQ ID NO: 515386 - RNA, 18 nt, Chlamydophila pneumoniae CWL029
agaacgucuaaagacgaa

SEQ ID NO: 515387 - RNA, 21 nt, Chlamydophila pneumoniae CWL029
agaacuuuaacgaagaaggga

SEQ ID NO: 515388 - RNA, 24 nt, Chlamydophila pneumoniae CWL029
agaacuuucgucuuugcuuucuag

SEQ ID NO: 515389 - RNA, 21 nt, Chlamydophila pneumoniae CWL029
agauaguauuuuugaaaccaa

SEQ ID NO: 515390 - RNA, 16 nt, Chlamydophila pneumoniae CWL029
agauagguuuuuguaa

SEQ ID NO: 515391 - RNA, 18 nt, Chlamydophila pneumoniae CWL029
agauaggauggaguacuu

SEQ ID NO: 515392 - RNA, 22 nt, Chlamydophila pneumoniae CWL029
agauaggaacucacaaacaaca

SEQ ID NO: 515393 - RNA, 11 nt, Chlamydophila pneumoniae CWL029
agauagucuug

SEQ ID NO: 515394 - RNA, 15 nt, Chlamydophila pneumoniae CWL029
agauaguuauuaaua

SEQ ID NO: 515395 - RNA, 21 nt, Chlamydophila pneumoniae CWL029
agauaguucacaagugcauua

SEQ ID NO: 515396 - RNA, 14 nt, Chlamydophila pneumoniae CWL029
agaucacaagaaag

SEQ ID NO: 515397 - RNA, 23 nt, Chlamydophila pneumoniae CWL029
agauaggaacucacaaacaacag

SEQ ID NO: 515398 - RNA, 20 nt, Chlamydophila pneumoniae CWL029
agauaaucuguaagaaaaug

SEQ ID NO: 515399 - RNA, 14 nt, Chlamydophila pneumoniae CWL029
agaguuucuuuuga

SEQ ID NO: 515400 - RNA, 14 nt, Chlamydophila pneumoniae CWL029
agaguuuuucccuc

SEQ ID NO: 515401 - RNA, 20 nt, Chlamydophila pneumoniae CWL029
agaguuuuuguguuugacug

SEQ ID NO: 515402 - RNA, 18 nt, Chlamydophila pneumoniae CWL029
agaguuuuuuagaggagc

SEQ ID NO: 515403 - RNA, 20 nt, Chlamydophila pneumoniae CWL029
agaguuuuuuagaggagcuu

SEQ ID NO: 515404 - RNA, 16 nt, Chlamydophila pneumoniae CWL029
agaguauuagcgagua

SEQ ID NO: 515405 - RNA, 19 nt, Chlamydophila pneumoniae CWL029
agaguauuagcgaguacuu

SEQ ID NO: 515406 - RNA, 18 nt, Chlamydophila pneumoniae CWL029
agagcuucuaaaaacucu

SEQ ID NO: 515407 - RNA, 17 nt, Chlamydophila pneumoniae CWL029
agagucaaacuuauaca

SEQ ID NO: 515408 - RNA, 20 nt, Chlamydophila pneumoniae CWL029
agagcuuccauuggaauccu

SEQ ID NO: 515409 - RNA, 16 nt, Chlamydophila pneumoniae CWL029
agagcuuccauuggaa

SEQ ID NO: 515410 - RNA, 20 nt, Chlamydophila pneumoniae CWL029
aaaaccacagaaugauaaga

SEQ ID NO: 515411 - RNA, 18 nt, Chlamydophila pneumoniae CWL029
aaaaccacuucucuguau

SEQ ID NO: 515412 - RNA, 20 nt, Chlamydophila pneumoniae CWL029
agagucucacucuuuucuag

SEQ ID NO: 515413 - RNA, 23 nt, Chlamydophila pneumoniae CWL029
agagucuugcagacggggaucua

SEQ ID NO: 515414 - RNA, 16 nt, Chlamydophila pneumoniae CWL029
agagugaccauagcau

SEQ ID NO: 515415 - RNA, 16 nt, Chlamydophila pneumoniae CWL029
agagugacucaucagu

SEQ ID NO: 515416 - RNA, 16 nt, Chlamydophila pneumoniae CWL029
agaguccuucuuuucc

SEQ ID NO: 515417 - RNA, 15 nt, Chlamydophila pneumoniae CWL029
agaguccuuuuuguu

SEQ ID NO: 515418 - RNA, 16 nt, Chlamydophila pneumoniae CWL029
agaguccgaagccuuc

SEQ ID NO: 515419 - RNA, 16 nt, Chlamydophila pneumoniae CWL029
agaguccugggguucu

SEQ ID NO: 515420 - RNA, 14 nt, Chlamydophila pneumoniae CWL029
agaguccaagguuc

SEQ ID NO: 515421 - RNA, 17 nt, Chlamydophila pneumoniae CWL029
agauguaaagagcaaca

SEQ ID NO: 515422 - RNA, 21 nt, Chlamydophila pneumoniae CWL029
agauguaaagagcaacaguaa

SEQ ID NO: 515423 - RNA, 16 nt, Chlamydophila pneumoniae CWL029
agaugggcuaacuuau

SEQ ID NO: 515424 - RNA, 22 nt, Chlamydophila pneumoniae CWL029
agauggucuuggguuuuaaaug

SEQ ID NO: 515425 - RNA, 17 nt, Chlamydophila pneumoniae CWL029
agaugcuucuaaacaau

SEQ ID NO: 515426 - RNA, 15 nt, Chlamydophila pneumoniae CWL029
agaucuuuuugccag

SEQ ID NO: 515427 - RNA, 18 nt, Chlamydophila pneumoniae CWL029
agaucuucugaaaucaaa

SEQ ID NO: 515428 - RNA, 20 nt, Chlamydophila pneumoniae CWL029
agaucuucugaaaucaaaaa

SEQ ID NO: 515429 - RNA, 13 nt, Chlamydophila pneumoniae CWL029
agaugaagaaacu

SEQ ID NO: 515430 - RNA, 12 nt, Chlamydophila pneumoniae CWL029
agaugaagagug

SEQ ID NO: 515431 - RNA, 15 nt, Chlamydophila pneumoniae CWL029
agaugaaguucccac

SEQ ID NO: 515432 - RNA, 18 nt, Chlamydophila pneumoniae CWL029
agaugaauaccagaagca

SEQ ID NO: 515433 - RNA, 22 nt, Chlamydophila pneumoniae CWL029
agaugcgcucggauuucaugau

SEQ ID NO: 515434 - RNA, 15 nt, Chlamydophila pneumoniae CWL029
agaugcuaacaacuc

SEQ ID NO: 515435 - RNA, 22 nt, Chlamydophila pneumoniae CWL029
agaugcuauuuacugaaacauu

SEQ ID NO: 515436 - RNA, 19 nt, Chlamydophila pneumoniae CWL029
agaucucuugaagcacuuu

SEQ ID NO: 515437 - RNA, 18 nt, Chlamydophila pneumoniae CWL029
agaucuccgaagacuacc

SEQ ID NO: 515438 - RNA, 22 nt, Chlamydophila pneumoniae CWL029
agaucugcaaacgcaaugauuu

SEQ ID NO: 515439 - RNA, 13 nt, Chlamydophila pneumoniae CWL029
agaucuucaucac

SEQ ID NO: 515440 - RNA, 21 nt, Chlamydophila pneumoniae CWL029
agaucuucaucacaaaauuca

SEQ ID NO: 515441 - RNA, 16 nt, Chlamydophila pneumoniae CWL029
agaucuucugaaauca

SEQ ID NO: 515442 - RNA, 11 nt, Chlamydophila pneumoniae CWL029
agaucuugaac

SEQ ID NO: 515443 - RNA, 14 nt, Chlamydophila pneumoniae CWL029
agaucuacaagacu

SEQ ID NO: 515444 - RNA, 17 nt, Chlamydophila pneumoniae CWL029
agaucguuagagaccca

SEQ ID NO: 515445 - RNA, 20 nt, Chlamydophila pneumoniae CWL029
agaucgggucuacaacaguu

SEQ ID NO: 515446 - RNA, 21 nt, Chlamydophila pneumoniae CWL029
agauccuuuaaagauucccca

SEQ ID NO: 515447 - RNA, 23 nt, Chlamydophila pneumoniae CWL029
agauccuuuaaagauuccccaua

SEQ ID NO: 515448 - RNA, 22 nt, Chlamydophila pneumoniae CWL029
agaucgaucucugugguuccug

SEQ ID NO: 515449 - RNA, 19 nt, Chlamydophila pneumoniae CWL029
agauccuaagagauuuucc

SEQ ID NO: 515450 - RNA, 18 nt, Chlamydophila pneumoniae CWL029
agaucgagaucauuagca

SEQ ID NO: 515451 - RNA, 15 nt, Chlamydophila pneumoniae CWL029
agauccgauauacuu

SEQ ID NO: 515452 - RNA, 17 nt, Chlamydophila pneumoniae CWL029
agauccaugaacagcau

SEQ ID NO: 515453 - RNA, 21 nt, Chlamydophila pneumoniae CWL029
agauccgauauacuuauacca

SEQ ID NO: 515454 - RNA, 19 nt, Chlamydophila pneumoniae CWL029
agagcucguaauccuucuu

SEQ ID NO: 515455 - RNA, 15 nt, Chlamydophila pneumoniae CWL029
agagcuaugaugaga

SEQ ID NO: 515456 - RNA, 21 nt, Chlamydophila pneumoniae CWL029
agagcuaaagaaacuucugac

SEQ ID NO: 515457 - RNA, 22 nt, Chlamydophila pneumoniae CWL029
agagcuaaagaaacuucugacc

SEQ ID NO: 515458 - RNA, 17 nt, Chlamydophila pneumoniae CWL029
agagcgcguuucaaaua

SEQ ID NO: 515459 - RNA, 20 nt, Chlamydophila pneumoniae CWL029
agagccauuuuccaggacca

SEQ ID NO: 515460 - RNA, 20 nt, Chlamydophila pneumoniae CWL029
agagagugcguacucuucuu

SEQ ID NO: 515461 - RNA, 18 nt, Chlamydophila pneumoniae CWL029
agagaguuuguaacucaa

SEQ ID NO: 515462 - RNA, 14 nt, Chlamydophila pneumoniae CWL029
agagagcaagauaa

SEQ ID NO: 515463 - RNA, 13 nt, Chlamydophila pneumoniae CWL029
agagagaacagga

SEQ ID NO: 515464 - RNA, 22 nt, Chlamydophila pneumoniae CWL029
agagauauagguaucagcaaga

SEQ ID NO: 515465 - RNA, 14 nt, Chlamydophila pneumoniae CWL029
agagaucacaggga

SEQ ID NO: 515466 - RNA, 13 nt, Chlamydophila pneumoniae CWL029
agagaucacugua

SEQ ID NO: 515467 - RNA, 23 nt, Chlamydophila pneumoniae CWL029
agagauagggggacaccugaaga

SEQ ID NO: 515468 - RNA, 21 nt, Chlamydophila pneumoniae CWL029
agagauugccaggagagcuaa

SEQ ID NO: 515469 - RNA, 23 nt, Chlamydophila pneumoniae CWL029
agagauuuuucuaggaaucuuuu

SEQ ID NO: 515470 - RNA, 16 nt, Chlamydophila pneumoniae CWL029
agagauuuuuucauac

SEQ ID NO: 515471 - RNA, 17 nt, Chlamydophila pneumoniae CWL029
agagcaaacaucaaaga

SEQ ID NO: 515472 - RNA, 15 nt, Chlamydophila pneumoniae CWL029
agagaacgaacaguu

SEQ ID NO: 515473 - RNA, 17 nt, Chlamydophila pneumoniae CWL029
agagaaauuaacagagc

SEQ ID NO: 515474 - RNA, 14 nt, Chlamydophila pneumoniae CWL029
agagaacaggaggu

SEQ ID NO: 515475 - RNA, 15 nt, Chlamydophila pneumoniae CWL029
agagaaacacaaauu

SEQ ID NO: 515476 - RNA, 19 nt, Chlamydophila pneumoniae CWL029
agagaaaauaucacauucc

SEQ ID NO: 515477 - RNA, 17 nt, Chlamydophila pneumoniae CWL029
agacuuguucagcuaga

SEQ ID NO: 515478 - RNA, 23 nt, Chlamydophila pneumoniae CWL029
agacuuguucagcuagagcacau

SEQ ID NO: 515479 - RNA, 14 nt, Chlamydophila pneumoniae CWL029
agacuuguauucuu

SEQ ID NO: 515480 - RNA, 13 nt, Chlamydophila pneumoniae CWL029
agacuuucugacg

SEQ ID NO: 515481 - RNA, 18 nt, Chlamydophila pneumoniae CWL029
agacuuugccauuucuau

SEQ ID NO: 515482 - RNA, 15 nt, Chlamydophila pneumoniae CWL029
agagaagcagaaucu

SEQ ID NO: 515483 - RNA, 17 nt, Chlamydophila pneumoniae CWL029
agagaagauuucuauag

SEQ ID NO: 515484 - RNA, 14 nt, Chlamydophila pneumoniae CWL029
agagaacuccauuc

SEQ ID NO: 515485 - RNA, 17 nt, Chlamydophila pneumoniae CWL029
agagaacuccauucaga

SEQ ID NO: 515486 - RNA, 16 nt, Chlamydophila pneumoniae CWL029
agagaacuuuugaauu

SEQ ID NO: 515487 - RNA, 18 nt, Chlamydophila pneumoniae CWL029
agagaacuuuugaauuaa

SEQ ID NO: 515488 - RNA, 15 nt, Chlamydophila pneumoniae CWL029
agagaagaagcaaaa

SEQ ID NO: 515489 - RNA, 17 nt, Chlamydophila pneumoniae CWL029
agagaagacaggagcua

SEQ ID NO: 515490 - RNA, 20 nt, Chlamydophila pneumoniae CWL029
agagaagagguguccauaau

SEQ ID NO: 515491 - RNA, 18 nt, Chlamydophila pneumoniae CWL029
agagaaucuccucaucag

SEQ ID NO: 515492 - RNA, 22 nt, Chlamydophila pneumoniae CWL029
agagaauccguuagaacucgaa

SEQ ID NO: 515493 - RNA, 18 nt, Chlamydophila pneumoniae CWL029
agagaauguuccuguaaa

SEQ ID NO: 515494 - RNA, 15 nt, Chlamydophila pneumoniae CWL029
agagaccuucucuuc

SEQ ID NO: 515495 - RNA, 20 nt, Chlamydophila pneumoniae CWL029
agagacccaacaguucuuuc

SEQ ID NO: 515496 - RNA, 21 nt, Chlamydophila pneumoniae CWL029
agagaauuugauauccagggu

SEQ ID NO: 515497 - RNA, 18 nt, Chlamydophila pneumoniae CWL029
agagacaagaaaauauca

SEQ ID NO: 515498 - RNA, 20 nt, Chlamydophila pneumoniae CWL029
agagacagccuguuuucuuc

SEQ ID NO: 515499 - RNA, 16 nt, Chlamydophila pneumoniae CWL029
agacugcaaaggaagg

SEQ ID NO: 515500 - RNA, 13 nt, Chlamydophila pneumoniae CWL029
agacugaaaagau

SEQ ID NO: 515501 - RNA, 23 nt, Chlamydophila pneumoniae CWL029
agacucucacugagugucccaug

SEQ ID NO: 515502 - RNA, 14 nt, Chlamydophila pneumoniae CWL029
agacucucaucagc

SEQ ID NO: 515503 - RNA, 19 nt, Chlamydophila pneumoniae CWL029
agacucucuuccaaaagua

SEQ ID NO: 515504 - RNA, 19 nt, Chlamydophila pneumoniae CWL029
agacuuccucuucaauuuc

SEQ ID NO: 515505 - RNA, 21 nt, Chlamydophila pneumoniae CWL029
agacuuaaaguacguccugau

SEQ ID NO: 515506 - RNA, 23 nt, Chlamydophila pneumoniae CWL029
agacuggucuaacuuagagcgaa

SEQ ID NO: 515507 - RNA, 18 nt, Chlamydophila pneumoniae CWL029
agacuagagucacuagca

SEQ ID NO: 515508 - RNA, 19 nt, Chlamydophila pneumoniae CWL029
agacucaugaaauaguguu

SEQ ID NO: 515509 - RNA, 16 nt, Chlamydophila pneumoniae CWL029
agacgaccuuuaagau

SEQ ID NO: 515510 - RNA, 15 nt, Chlamydophila pneumoniae CWL029
aaaacauaucccaua

SEQ ID NO: 515511 - RNA, 13 nt, Chlamydophila pneumoniae CWL029
aaaacaucuguau

SEQ ID NO: 515512 - RNA, 13 nt, Chlamydophila pneumoniae CWL029
agacccuucuuuc

SEQ ID NO: 515513 - RNA, 14 nt, Chlamydophila pneumoniae CWL029
agaccuaaaaaggu

SEQ ID NO: 515514 - RNA, 13 nt, Chlamydophila pneumoniae CWL029
agaauuuguccuu

SEQ ID NO: 515515 - RNA, 14 nt, Chlamydophila pneumoniae CWL029
agaauuuguccuuu

SEQ ID NO: 515516 - RNA, 13 nt, Chlamydophila pneumoniae CWL029
agaauuucuucuu

SEQ ID NO: 515517 - RNA, 16 nt, Chlamydophila pneumoniae CWL029
agaauuccuaaaacga

SEQ ID NO: 515518 - RNA, 20 nt, Chlamydophila pneumoniae CWL029
agcguauaggaaacugucau

SEQ ID NO: 515519 - RNA, 21 nt, Chlamydophila pneumoniae CWL029
agcguacuuuacacuauaaga

SEQ ID NO: 515520 - RNA, 18 nt, Chlamydophila pneumoniae CWL029
agcgguagcgucuagcua

SEQ ID NO: 515521 - RNA, 17 nt, Chlamydophila pneumoniae CWL029
agcggacuuuagcgcua

SEQ ID NO: 515522 - RNA, 23 nt, Chlamydophila pneumoniae CWL029
agcggaguccuucuugcaaagau

SEQ ID NO: 515523 - RNA, 21 nt, Chlamydophila pneumoniae CWL029
agcggaagcaccgccugaccu

SEQ ID NO: 515524 - RNA, 21 nt, Chlamydophila pneumoniae CWL029
agcggaacguauccuugauuu

SEQ ID NO: 515525 - RNA, 21 nt, Chlamydophila pneumoniae CWL029
agcgcuuuauguuuuguccuu

SEQ ID NO: 515526 - RNA, 22 nt, Chlamydophila pneumoniae CWL029
agcgcuuucuuuuauuaaggga

SEQ ID NO: 515527 - RNA, 20 nt, Chlamydophila pneumoniae CWL029
agcgcucgugggaggaaucc

SEQ ID NO: 515528 - RNA, 20 nt, Chlamydophila pneumoniae CWL029
agcgaccugcaaaugaaggg

SEQ ID NO: 515529 - RNA, 20 nt, Chlamydophila pneumoniae CWL029
agcgaaccaaagucaugucc

SEQ ID NO: 515530 - RNA, 21 nt, Chlamydophila pneumoniae CWL029
agccuuguaaauaguauacaa

SEQ ID NO: 515531 - RNA, 17 nt, Chlamydophila pneumoniae CWL029
agccuuggcucuagaaa

SEQ ID NO: 515532 - RNA, 13 nt, Chlamydophila pneumoniae CWL029
agccuucauucca

SEQ ID NO: 515533 - RNA, 12 nt, Chlamydophila pneumoniae CWL029
agccuuccuugu

SEQ ID NO: 515534 - RNA, 16 nt, Chlamydophila pneumoniae CWL029
agccucuacccucuga

SEQ ID NO: 515535 - RNA, 23 nt, Chlamydophila pneumoniae CWL029
agccuuacggccccuggaauuuc

SEQ ID NO: 515536 - RNA, 13 nt, Chlamydophila pneumoniae CWL029
agccuuagcagca

SEQ ID NO: 515537 - RNA, 12 nt, Chlamydophila pneumoniae CWL029
agccucacagaa

SEQ ID NO: 515538 - RNA, 22 nt, Chlamydophila pneumoniae CWL029
agccucacagaauuguuuuguu

SEQ ID NO: 515539 - RNA, 20 nt, Chlamydophila pneumoniae CWL029
agccuccauuuagacaagac

SEQ ID NO: 515540 - RNA, 23 nt, Chlamydophila pneumoniae CWL029
agccuccauuuagacaagacacc

SEQ ID NO: 515541 - RNA, 20 nt, Chlamydophila pneumoniae CWL029
agccucccgaagacaauguc

SEQ ID NO: 515542 - RNA, 19 nt, Chlamydophila pneumoniae CWL029
agccucccgaagacaaugu

SEQ ID NO: 515543 - RNA, 17 nt, Chlamydophila pneumoniae CWL029
agccucgaaauuuucag

SEQ ID NO: 515544 - RNA, 21 nt, Chlamydophila pneumoniae CWL029
agccucgaaauuuucagaaga

SEQ ID NO: 515545 - RNA, 23 nt, Chlamydophila pneumoniae CWL029
agccucgagcagaaacuccaaaa

SEQ ID NO: 515546 - RNA, 12 nt, Chlamydophila pneumoniae CWL029
agccuagcaaaa

SEQ ID NO: 515547 - RNA, 21 nt, Chlamydophila pneumoniae CWL029
agccguaggguagccauccac

SEQ ID NO: 515548 - RNA, 20 nt, Chlamydophila pneumoniae CWL029
agcccuccaguuuuacgaac

SEQ ID NO: 515549 - RNA, 18 nt, Chlamydophila pneumoniae CWL029
agccgauguugcagaaug

SEQ ID NO: 515550 - RNA, 14 nt, Chlamydophila pneumoniae CWL029
agccaguacuaaau

SEQ ID NO: 515551 - RNA, 13 nt, Chlamydophila pneumoniae CWL029
agccacagagaau

SEQ ID NO: 515552 - RNA, 19 nt, Chlamydophila pneumoniae CWL029
agccaaauaccaaggcugc

SEQ ID NO: 515553 - RNA, 15 nt, Chlamydophila pneumoniae CWL029
agccacuaaguuuag

SEQ ID NO: 515554 - RNA, 18 nt, Chlamydophila pneumoniae CWL029
agccacauucuucugaua

SEQ ID NO: 515555 - RNA, 15 nt, Chlamydophila pneumoniae CWL029
agcauuagggaaagg

SEQ ID NO: 515556 - RNA, 20 nt, Chlamydophila pneumoniae CWL029
agcauguucgauuuucucuu

SEQ ID NO: 515557 - RNA, 13 nt, Chlamydophila pneumoniae CWL029
agcaucucaagag

SEQ ID NO: 515558 - RNA, 14 nt, Chlamydophila pneumoniae CWL029
agcaucucucucca

SEQ ID NO: 515559 - RNA, 23 nt, Chlamydophila pneumoniae CWL029
agcaucugagucauaagcucuau

SEQ ID NO: 515560 - RNA, 18 nt, Chlamydophila pneumoniae CWL029
agcauucugcuagagcuu

SEQ ID NO: 515561 - RNA, 23 nt, Chlamydophila pneumoniae CWL029
agcauucccgacucaaucaaauu

SEQ ID NO: 515562 - RNA, 18 nt, Chlamydophila pneumoniae CWL029
agcauuggacaacgcuuc

SEQ ID NO: 515563 - RNA, 22 nt, Chlamydophila pneumoniae CWL029
agcauugucgaguauaauugac

SEQ ID NO: 515564 - RNA, 21 nt, Chlamydophila pneumoniae CWL029
agcauuuccaaacccauauuc

SEQ ID NO: 515565 - RNA, 20 nt, Chlamydophila pneumoniae CWL029
agccaaaaccaauuucuccg

SEQ ID NO: 515566 - RNA, 21 nt, Chlamydophila pneumoniae CWL029
agcauuucucuaugagaacgu

SEQ ID NO: 515567 - RNA, 16 nt, Chlamydophila pneumoniae CWL029
agcauuucuuucucuu

SEQ ID NO: 515568 - RNA, 22 nt, Chlamydophila pneumoniae CWL029
agcauuuuacgaaucuuuuuca

SEQ ID NO: 515569 - RNA, 16 nt, Chlamydophila pneumoniae CWL029
agcauuuuauccacug

SEQ ID NO: 515570 - RNA, 13 nt, Chlamydophila pneumoniae CWL029
agcauuuucucug

SEQ ID NO: 515571 - RNA, 16 nt, Chlamydophila pneumoniae CWL029
agcauuuucucugagc

SEQ ID NO: 515572 - RNA, 20 nt, Chlamydophila pneumoniae CWL029
agcaggugugugguaaaaau

SEQ ID NO: 515573 - RNA, 21 nt, Chlamydophila pneumoniae CWL029
agcauccuguagagcaagauu

SEQ ID NO: 515574 - RNA, 13 nt, Chlamydophila pneumoniae CWL029
agcauaacuugaa

SEQ ID NO: 515575 - RNA, 17 nt, Chlamydophila pneumoniae CWL029
agcauaacuugaagaag

SEQ ID NO: 515576 - RNA, 21 nt, Chlamydophila pneumoniae CWL029
agcauaacuugaagaaguaca

SEQ ID NO: 515577 - RNA, 15 nt, Chlamydophila pneumoniae CWL029
agcaggaaaagcaaa

SEQ ID NO: 515578 - RNA, 20 nt, Chlamydophila pneumoniae CWL029
agcaggaauaaucaaccaaa

SEQ ID NO: 515579 - RNA, 18 nt, Chlamydophila pneumoniae CWL029
agcagaccucucccuugg

SEQ ID NO: 515580 - RNA, 23 nt, Chlamydophila pneumoniae CWL029
agcagaccucucccuugggauuc

SEQ ID NO: 515581 - RNA, 14 nt, Chlamydophila pneumoniae CWL029
aaaaccuucuccaa

SEQ ID NO: 515582 - RNA, 15 nt, Chlamydophila pneumoniae CWL029
agcagccucuucucu

SEQ ID NO: 515583 - RNA, 17 nt, Chlamydophila pneumoniae CWL029
agcacgcacuaaucuau

SEQ ID NO: 515584 - RNA, 21 nt, Chlamydophila pneumoniae CWL029
agcagaaguccuaucaaagca

SEQ ID NO: 515585 - RNA, 14 nt, Chlamydophila pneumoniae CWL029
agcacauagagugu

SEQ ID NO: 515586 - RNA, 22 nt, Chlamydophila pneumoniae CWL029
agcacauacaguacgcaaagua

SEQ ID NO: 515587 - RNA, 13 nt, Chlamydophila pneumoniae CWL029
agcacauuuuucu

SEQ ID NO: 515588 - RNA, 14 nt, Chlamydophila pneumoniae CWL029
agcaccacgaccua

SEQ ID NO: 515589 - RNA, 19 nt, Chlamydophila pneumoniae CWL029
agcaccacgaccuauacca

SEQ ID NO: 515590 - RNA, 19 nt, Chlamydophila pneumoniae CWL029
agcaauggcuuuuuuuguc

SEQ ID NO: 515591 - RNA, 18 nt, Chlamydophila pneumoniae CWL029
agcaauucgguagagcua

SEQ ID NO: 515592 - RNA, 22 nt, Chlamydophila pneumoniae CWL029
agcaaucaguaaacccucagaa

SEQ ID NO: 515593 - RNA, 13 nt, Chlamydophila pneumoniae CWL029
agcaauaucugug

SEQ ID NO: 515594 - RNA, 15 nt, Chlamydophila pneumoniae CWL029
agcaaucgaauagcu

SEQ ID NO: 515595 - RNA, 22 nt, Chlamydophila pneumoniae CWL029
agcaauccauaguccuagcaga

SEQ ID NO: 515596 - RNA, 15 nt, Chlamydophila pneumoniae CWL029
agcaagaaucacugc

SEQ ID NO: 515597 - RNA, 14 nt, Chlamydophila pneumoniae CWL029
agcaagaacauaac

SEQ ID NO: 515598 - RNA, 19 nt, Chlamydophila pneumoniae CWL029
agcaagaaaauaggugacu

SEQ ID NO: 515599 - RNA, 18 nt, Chlamydophila pneumoniae CWL029
agcaagagcuauaccuau

SEQ ID NO: 515600 - RNA, 19 nt, Chlamydophila pneumoniae CWL029
agcaagauaaucauuaaga

SEQ ID NO: 515601 - RNA, 17 nt, Chlamydophila pneumoniae CWL029
agcaagagcucuugaga

SEQ ID NO: 515602 - RNA, 17 nt, Chlamydophila pneumoniae CWL029
agcaagguaacauccau

SEQ ID NO: 515603 - RNA, 18 nt, Chlamydophila pneumoniae CWL029
agcaagguaacauccaua

SEQ ID NO: 515604 - RNA, 19 nt, Chlamydophila pneumoniae CWL029
agcaaggggaguuuucuua

SEQ ID NO: 515605 - RNA, 18 nt, Chlamydophila pneumoniae CWL029
agcaaggggaguuuucuu

SEQ ID NO: 515606 - RNA, 15 nt, Chlamydophila pneumoniae CWL029
agcaaguagcucucu

SEQ ID NO: 515607 - RNA, 23 nt, Chlamydophila pneumoniae CWL029
agcaaguuguugauaauuacaga

SEQ ID NO: 515608 - RNA, 23 nt, Chlamydophila pneumoniae CWL029
agcaacuucuucguuagagaaga

SEQ ID NO: 515609 - RNA, 20 nt, Chlamydophila pneumoniae CWL029
agcaacuacagagggcuuca

SEQ ID NO: 515610 - RNA, 14 nt, Chlamydophila pneumoniae CWL029
agcaacuaaacucu

SEQ ID NO: 515611 - RNA, 17 nt, Chlamydophila pneumoniae CWL029
agauuaugaugccucau

SEQ ID NO: 515612 - RNA, 20 nt, Chlamydophila pneumoniae CWL029
agauuauuuguuucuuccau

SEQ ID NO: 515613 - RNA, 15 nt, Chlamydophila pneumoniae CWL029
agcaacgcaugacgc

SEQ ID NO: 515614 - RNA, 19 nt, Chlamydophila pneumoniae CWL029
agcaacgcaugacgcuuuu

SEQ ID NO: 515615 - RNA, 18 nt, Chlamydophila pneumoniae CWL029
acuuaauaauguuuuaau

SEQ ID NO: 515616 - RNA, 13 nt, Chlamydophila pneumoniae CWL029
acuuaagauacuu

SEQ ID NO: 515617 - RNA, 22 nt, Chlamydophila pneumoniae CWL029
acuuaagauacuucuccacagc

SEQ ID NO: 515618 - RNA, 14 nt, Chlamydophila pneumoniae CWL029
acuuaauccuguag

SEQ ID NO: 515619 - RNA, 24 nt, Chlamydophila pneumoniae CWL029
acuuaggguucucaaagaucaucu

SEQ ID NO: 515620 - RNA, 13 nt, Chlamydophila pneumoniae CWL029
acuuaaaaaacuu

SEQ ID NO: 515621 - RNA, 13 nt, Chlamydophila pneumoniae CWL029
acuguuuuucuuc

SEQ ID NO: 515622 - RNA, 19 nt, Chlamydophila pneumoniae CWL029
acuguuuuuuaucuccuga

SEQ ID NO: 515623 - RNA, 22 nt, Chlamydophila pneumoniae CWL029
acuguuuguuuauuaucuacag

SEQ ID NO: 515624 - RNA, 15 nt, Chlamydophila pneumoniae CWL029
acuguaaauccggcu

SEQ ID NO: 515625 - RNA, 22 nt, Chlamydophila pneumoniae CWL029
acuguaaauuucauuugaaaua

SEQ ID NO: 515626 - RNA, 15 nt, Chlamydophila pneumoniae CWL029
acuguauagaaacug

SEQ ID NO: 515627 - RNA, 18 nt, Chlamydophila pneumoniae CWL029
acuguauagaaacuguua

SEQ ID NO: 515628 - RNA, 21 nt, Chlamydophila pneumoniae CWL029
acugucauguauccgaaaucu

SEQ ID NO: 515629 - RNA, 14 nt, Chlamydophila pneumoniae CWL029
acuguccauccaaa

SEQ ID NO: 515630 - RNA, 18 nt, Chlamydophila pneumoniae CWL029
acuguguucaauagcaaa

SEQ ID NO: 515631 - RNA, 18 nt, Chlamydophila pneumoniae CWL029
acuguuaacaagauucuc

SEQ ID NO: 515632 - RNA, 16 nt, Chlamydophila pneumoniae CWL029
acugcuucaaaacaua

SEQ ID NO: 515633 - RNA, 15 nt, Chlamydophila pneumoniae CWL029
acugggaaaucuaaa

SEQ ID NO: 515634 - RNA, 20 nt, Chlamydophila pneumoniae CWL029
acugggaaaucuaaacagua

SEQ ID NO: 515635 - RNA, 13 nt, Chlamydophila pneumoniae CWL029
acugcagauugca

SEQ ID NO: 515636 - RNA, 22 nt, Chlamydophila pneumoniae CWL029
acugccagcgaucacauagaaa

SEQ ID NO: 515637 - RNA, 18 nt, Chlamydophila pneumoniae CWL029
acugccagcgaucacaua

SEQ ID NO: 515638 - RNA, 22 nt, Chlamydophila pneumoniae CWL029
acugaugccaagaaauauacug

SEQ ID NO: 515639 - RNA, 19 nt, Chlamydophila pneumoniae CWL029
acugcuuacaauugaaaau

SEQ ID NO: 515640 - RNA, 14 nt, Chlamydophila pneumoniae CWL029
acugcucaaugaca

SEQ ID NO: 515641 - RNA, 13 nt, Chlamydophila pneumoniae CWL029
acugcuagagucc

SEQ ID NO: 515642 - RNA, 22 nt, Chlamydophila pneumoniae CWL029
acucuaugaucuacagauaggg

SEQ ID NO: 515643 - RNA, 17 nt, Chlamydophila pneumoniae CWL029
acucuagguuuucucuu

SEQ ID NO: 515644 - RNA, 21 nt, Chlamydophila pneumoniae CWL029
acucuaguuuuucuuuagaga

SEQ ID NO: 515645 - RNA, 14 nt, Chlamydophila pneumoniae CWL029
acucuagaaaauau

SEQ ID NO: 515646 - RNA, 15 nt, Chlamydophila pneumoniae CWL029
acucuagguuuucuc

SEQ ID NO: 515647 - RNA, 16 nt, Chlamydophila pneumoniae CWL029
acucggugggccucuu

SEQ ID NO: 515648 - RNA, 14 nt, Chlamydophila pneumoniae CWL029
acucgucaaauuca

SEQ ID NO: 515649 - RNA, 22 nt, Chlamydophila pneumoniae CWL029
acucucaguuaaagagcauccu

SEQ ID NO: 515650 - RNA, 18 nt, Chlamydophila pneumoniae CWL029
acugaacgccaucuccac

SEQ ID NO: 515651 - RNA, 15 nt, Chlamydophila pneumoniae CWL029
acugaauaguagagu

SEQ ID NO: 515652 - RNA, 11 nt, Chlamydophila pneumoniae CWL029
acugaauauca

SEQ ID NO: 515653 - RNA, 17 nt, Chlamydophila pneumoniae CWL029
acugacuuuaugaucuc

SEQ ID NO: 515654 - RNA, 22 nt, Chlamydophila pneumoniae CWL029
acugaugaaaaagcugacacuc

SEQ ID NO: 515655 - RNA, 18 nt, Chlamydophila pneumoniae CWL029
acucgauuauuucuuguu

SEQ ID NO: 515656 - RNA, 19 nt, Chlamydophila pneumoniae CWL029
acucgccauaauagucucu

SEQ ID NO: 515657 - RNA, 14 nt, Chlamydophila pneumoniae CWL029
acucgcgucaugca

SEQ ID NO: 515658 - RNA, 21 nt, Chlamydophila pneumoniae CWL029
acuccuuugagucuuuuucag

SEQ ID NO: 515659 - RNA, 13 nt, Chlamydophila pneumoniae CWL029
acuccuuaacaac

SEQ ID NO: 515660 - RNA, 16 nt, Chlamydophila pneumoniae CWL029
acuccgagcauuuuac

SEQ ID NO: 515661 - RNA, 14 nt, Chlamydophila pneumoniae CWL029
acucccucaaaauu

SEQ ID NO: 515662 - RNA, 17 nt, Chlamydophila pneumoniae CWL029
acucccucaaaauuuaa

SEQ ID NO: 515663 - RNA, 13 nt, Chlamydophila pneumoniae CWL029
acucaucacaauu

SEQ ID NO: 515664 - RNA, 19 nt, Chlamydophila pneumoniae CWL029
acucaucacaauuuuaaaa

SEQ ID NO: 515665 - RNA, 12 nt, Chlamydophila pneumoniae CWL029
acucaucacaau

SEQ ID NO: 515666 - RNA, 12 nt, Chlamydophila pneumoniae CWL029
acucagagauug

SEQ ID NO: 515667 - RNA, 13 nt, Chlamydophila pneumoniae CWL029
acucagagaaaau

SEQ ID NO: 515668 - RNA, 14 nt, Chlamydophila pneumoniae CWL029
acucagagauugcc

SEQ ID NO: 515669 - RNA, 16 nt, Chlamydophila pneumoniae CWL029
acucagcgcaucacga

SEQ ID NO: 515670 - RNA, 21 nt, Chlamydophila pneumoniae CWL029
acucagcucccaugugcugaa

SEQ ID NO: 515671 - RNA, 20 nt, Chlamydophila pneumoniae CWL029
acucaggauauauagagcag

SEQ ID NO: 515672 - RNA, 13 nt, Chlamydophila pneumoniae CWL029
acuccaagaauag

SEQ ID NO: 515673 - RNA, 19 nt, Chlamydophila pneumoniae CWL029
acuccaagaauagcaggaa

SEQ ID NO: 515674 - RNA, 21 nt, Chlamydophila pneumoniae CWL029
acuccaaaauauucuuucaaa

SEQ ID NO: 515675 - RNA, 20 nt, Chlamydophila pneumoniae CWL029
acuccacgaauucuuuaaaa

SEQ ID NO: 515676 - RNA, 23 nt, Chlamydophila pneumoniae CWL029
acuccaagucagccaagacaaaa

SEQ ID NO: 515677 - RNA, 18 nt, Chlamydophila pneumoniae CWL029
acucauccuaaauuaaau

SEQ ID NO: 515678 - RNA, 16 nt, Chlamydophila pneumoniae CWL029
acucaucuugaguaag

SEQ ID NO: 515679 - RNA, 16 nt, Chlamydophila pneumoniae CWL029
acucaacuuuuuuacu

SEQ ID NO: 515680 - RNA, 20 nt, Chlamydophila pneumoniae CWL029
acucaaggaguuuuaacuaa

SEQ ID NO: 515681 - RNA, 16 nt, Chlamydophila pneumoniae CWL029
acucaaauucaaaaua

SEQ ID NO: 515682 - RNA, 20 nt, Chlamydophila pneumoniae CWL029
acucaaauucaaaauagaag

SEQ ID NO: 515683 - RNA, 12 nt, Chlamydophila pneumoniae CWL029
acucaaagaacu

SEQ ID NO: 515684 - RNA, 15 nt, Chlamydophila pneumoniae CWL029
acuauguuauccaua

SEQ ID NO: 515685 - RNA, 15 nt, Chlamydophila pneumoniae CWL029
acucacaaacaacag

SEQ ID NO: 515686 - RNA, 19 nt, Chlamydophila pneumoniae CWL029
acucacaaacaacagaaau

SEQ ID NO: 515687 - RNA, 21 nt, Chlamydophila pneumoniae CWL029
acucacaaacaacagaaaugu

SEQ ID NO: 515688 - RNA, 22 nt, Chlamydophila pneumoniae CWL029
acucacagaguucgcgaccugu

SEQ ID NO: 515689 - RNA, 14 nt, Chlamydophila pneumoniae CWL029
acucacauuugcuu

SEQ ID NO: 515690 - RNA, 19 nt, Chlamydophila pneumoniae CWL029
acucacauuugcuuuaaca

SEQ ID NO: 515691 - RNA, 16 nt, Chlamydophila pneumoniae CWL029
acuaucgcaaauuucc

SEQ ID NO: 515692 - RNA, 19 nt, Chlamydophila pneumoniae CWL029
acuaucgguuuaaacagau

SEQ ID NO: 515693 - RNA, 17 nt, Chlamydophila pneumoniae CWL029
acuaucucuguuuuuug

SEQ ID NO: 515694 - RNA, 20 nt, Chlamydophila pneumoniae CWL029
acuaucauggacaagcaaaa

SEQ ID NO: 515695 - RNA, 20 nt, Chlamydophila pneumoniae CWL029
acuagcucucuugcuauacc

SEQ ID NO: 515696 - RNA, 12 nt, Chlamydophila pneumoniae CWL029
acuagaaaaaau

SEQ ID NO: 515697 - RNA, 14 nt, Chlamydophila pneumoniae CWL029
acuacuuacaagaa

SEQ ID NO: 515698 - RNA, 18 nt, Chlamydophila pneumoniae CWL029
acuaggcaugguaggagc

SEQ ID NO: 515699 - RNA, 21 nt, Chlamydophila pneumoniae CWL029
acuagguuauuaucaaaguga

SEQ ID NO: 515700 - RNA, 12 nt, Chlamydophila pneumoniae CWL029
acuacugaaaca

SEQ ID NO: 515701 - RNA, 16 nt, Chlamydophila pneumoniae CWL029
acuacugaaacacuuu

SEQ ID NO: 515702 - RNA, 16 nt, Chlamydophila pneumoniae CWL029
acuacucucaucaagg

SEQ ID NO: 515703 - RNA, 18 nt, Chlamydophila pneumoniae CWL029
acguucccacgagcacaa

SEQ ID NO: 515704 - RNA, 16 nt, Chlamydophila pneumoniae CWL029
acgucuccaacagucu

SEQ ID NO: 515705 - RNA, 15 nt, Chlamydophila pneumoniae CWL029
acgugcaucucuuca

SEQ ID NO: 515706 - RNA, 12 nt, Chlamydophila pneumoniae CWL029
acgugguuuuug

SEQ ID NO: 515707 - RNA, 21 nt, Chlamydophila pneumoniae CWL029
acguauagggaaccuugauac

SEQ ID NO: 515708 - RNA, 20 nt, Chlamydophila pneumoniae CWL029
acgggucaggagguggugga

SEQ ID NO: 515709 - RNA, 16 nt, Chlamydophila pneumoniae CWL029
acgggcaauauaucca

SEQ ID NO: 515710 - RNA, 16 nt, Chlamydophila pneumoniae CWL029
acgcuaaacuaaaaug

SEQ ID NO: 515711 - RNA, 17 nt, Chlamydophila pneumoniae CWL029
acgcuccucuaacuuca

SEQ ID NO: 515712 - RNA, 13 nt, Chlamydophila pneumoniae CWL029
acgcgcuucuuca

SEQ ID NO: 515713 - RNA, 18 nt, Chlamydophila pneumoniae CWL029
acgccuccuucaaagaua

SEQ ID NO: 515714 - RNA, 19 nt, Chlamydophila pneumoniae CWL029
acgccuucaagucgagaaa

SEQ ID NO: 515715 - RNA, 21 nt, Chlamydophila pneumoniae CWL029
acgccgcucuugauagcuaag

SEQ ID NO: 515716 - RNA, 13 nt, Chlamydophila pneumoniae CWL029
acgcccaugucuu

SEQ ID NO: 515717 - RNA, 21 nt, Chlamydophila pneumoniae CWL029
acgcccacggaaagcacauac

SEQ ID NO: 515718 - RNA, 18 nt, Chlamydophila pneumoniae CWL029
acgcccacggaaagcaca

SEQ ID NO: 515719 - RNA, 18 nt, Chlamydophila pneumoniae CWL029
acgauauuuagagagaaa

SEQ ID NO: 515720 - RNA, 22 nt, Chlamydophila pneumoniae CWL029
acgauauuugggauauuggaga

SEQ ID NO: 515721 - RNA, 17 nt, Chlamydophila pneumoniae CWL029
acgauaguacuuauccu

SEQ ID NO: 515722 - RNA, 21 nt, Chlamydophila pneumoniae CWL029
acgaguucgcggaucuucuuc

SEQ ID NO: 515723 - RNA, 17 nt, Chlamydophila pneumoniae CWL029
acgacucugccaugucu

SEQ ID NO: 515724 - RNA, 21 nt, Chlamydophila pneumoniae CWL029
acgagcaugcuaagcaucaga

SEQ ID NO: 515725 - RNA, 13 nt, Chlamydophila pneumoniae CWL029
acgagcuguccag

SEQ ID NO: 515726 - RNA, 13 nt, Chlamydophila pneumoniae CWL029
acgaccuauacca

SEQ ID NO: 515727 - RNA, 16 nt, Chlamydophila pneumoniae CWL029
acgaccucgaauuccu

SEQ ID NO: 515728 - RNA, 11 nt, Chlamydophila pneumoniae CWL029
acgacgaggac

SEQ ID NO: 515729 - RNA, 16 nt, Chlamydophila pneumoniae CWL029
acgacgucaucaccau

SEQ ID NO: 515730 - RNA, 23 nt, Chlamydophila pneumoniae CWL029
acgacgucuucuuagaagagaaa

SEQ ID NO: 515731 - RNA, 16 nt, Chlamydophila pneumoniae CWL029
acgacguuuugcugug

SEQ ID NO: 515732 - RNA, 16 nt, Chlamydophila pneumoniae CWL029
acgaaucguuucucug

SEQ ID NO: 515733 - RNA, 13 nt, Chlamydophila pneumoniae CWL029
acgaaagcacaua

SEQ ID NO: 515734 - RNA, 15 nt, Chlamydophila pneumoniae CWL029
acgaaagcacauaag

SEQ ID NO: 515735 - RNA, 17 nt, Chlamydophila pneumoniae CWL029
acgaaagcacauaagau

SEQ ID NO: 515736 - RNA, 15 nt, Chlamydophila pneumoniae CWL029
acgaaagcagugugc

SEQ ID NO: 515737 - RNA, 14 nt, Chlamydophila pneumoniae CWL029
acgaauaauuaaau

SEQ ID NO: 515738 - RNA, 15 nt, Chlamydophila pneumoniae CWL029
accuuuggauucaga

SEQ ID NO: 515739 - RNA, 18 nt, Chlamydophila pneumoniae CWL029
accuuugguagaaagaca

SEQ ID NO: 515740 - RNA, 14 nt, Chlamydophila pneumoniae CWL029
acgaaaaucuacac

SEQ ID NO: 515741 - RNA, 22 nt, Chlamydophila pneumoniae CWL029
acgaauugcuugcgcaucagca

SEQ ID NO: 515742 - RNA, 13 nt, Chlamydophila pneumoniae CWL029
acgacaaaucacg

SEQ ID NO: 515743 - RNA, 18 nt, Chlamydophila pneumoniae CWL029
acgacauacaucaaaaug

SEQ ID NO: 515744 - RNA, 23 nt, Chlamydophila pneumoniae CWL029
accuguagcuacagauucuugua

SEQ ID NO: 515745 - RNA, 14 nt, Chlamydophila pneumoniae CWL029
accuguaaagacca

SEQ ID NO: 515746 - RNA, 17 nt, Chlamydophila pneumoniae CWL029
accugugaaaauuuucu

SEQ ID NO: 515747 - RNA, 13 nt, Chlamydophila pneumoniae CWL029
accuucacaagaa

SEQ ID NO: 515748 - RNA, 17 nt, Chlamydophila pneumoniae CWL029
accuuguauaagagcaa

SEQ ID NO: 515749 - RNA, 19 nt, Chlamydophila pneumoniae CWL029
accuggauugauccacaga

SEQ ID NO: 515750 - RNA, 22 nt, Chlamydophila pneumoniae CWL029
accuccaccaggagcuccuccu

SEQ ID NO: 515751 - RNA, 19 nt, Chlamydophila pneumoniae CWL029
accucauggagguucucaa

SEQ ID NO: 515752 - RNA, 15 nt, Chlamydophila pneumoniae CWL029
accucaaagccaucu

SEQ ID NO: 515753 - RNA, 13 nt, Chlamydophila pneumoniae CWL029
accuauugugcuu

SEQ ID NO: 515754 - RNA, 16 nt, Chlamydophila pneumoniae CWL029
accuauuuaagggaaa

SEQ ID NO: 515755 - RNA, 19 nt, Chlamydophila pneumoniae CWL029
accuauuugcaacaaucuu

SEQ ID NO: 515756 - RNA, 20 nt, Chlamydophila pneumoniae CWL029
accuauuugcaacaaucuuu

SEQ ID NO: 515757 - RNA, 20 nt, Chlamydophila pneumoniae CWL029
accuacuaaacccuguccaa

SEQ ID NO: 515758 - RNA, 17 nt, Chlamydophila pneumoniae CWL029
accuacguuuucucuau

SEQ ID NO: 515759 - RNA, 17 nt, Chlamydophila pneumoniae CWL029
accuacugggaaaucua

SEQ ID NO: 515760 - RNA, 14 nt, Chlamydophila pneumoniae CWL029
accguuaauuuuug

SEQ ID NO: 515761 - RNA, 21 nt, Chlamydophila pneumoniae CWL029
accgucacuguuuuccagaaa

SEQ ID NO: 515762 - RNA, 18 nt, Chlamydophila pneumoniae CWL029
accguaaagaaaagcaau

SEQ ID NO: 515763 - RNA, 17 nt, Chlamydophila pneumoniae CWL029
accguaaagaaaagcaa

SEQ ID NO: 515764 - RNA, 18 nt, Chlamydophila pneumoniae CWL029
accggacugacuucuaug

SEQ ID NO: 515765 - RNA, 21 nt, Chlamydophila pneumoniae CWL029
accgcaaaaagcuucuuucuu

SEQ ID NO: 515766 - RNA, 19 nt, Chlamydophila pneumoniae CWL029
accgagcuuuuugcuuuuc

SEQ ID NO: 515767 - RNA, 21 nt, Chlamydophila pneumoniae CWL029
accgacauacucgucaaauuc

SEQ ID NO: 515768 - RNA, 20 nt, Chlamydophila pneumoniae CWL029
accgaaucucuccagcuuga

SEQ ID NO: 515769 - RNA, 19 nt, Chlamydophila pneumoniae CWL029
accgaauuuucaauuguaa

SEQ ID NO: 515770 - RNA, 13 nt, Chlamydophila pneumoniae CWL029
accgaacagagcg

SEQ ID NO: 515771 - RNA, 15 nt, Chlamydophila pneumoniae CWL029
acccucaaagaauac

SEQ ID NO: 515772 - RNA, 21 nt, Chlamydophila pneumoniae CWL029
acccucaaagaauacucuaag

SEQ ID NO: 515773 - RNA, 18 nt, Chlamydophila pneumoniae CWL029
acccugggcucacucuaa

SEQ ID NO: 515774 - RNA, 20 nt, Chlamydophila pneumoniae CWL029
acccuagguagcucgagauu

SEQ ID NO: 515775 - RNA, 16 nt, Chlamydophila pneumoniae CWL029
acccacgcaugccucu

SEQ ID NO: 515776 - RNA, 22 nt, Chlamydophila pneumoniae CWL029
accaugaccuuuagcugcugaa

SEQ ID NO: 515777 - RNA, 19 nt, Chlamydophila pneumoniae CWL029
accaugaagguagccgagg

SEQ ID NO: 515778 - RNA, 20 nt, Chlamydophila pneumoniae CWL029
accaucugcguuuaaggguu

SEQ ID NO: 515779 - RNA, 18 nt, Chlamydophila pneumoniae CWL029
acccaguuguauccagcu

SEQ ID NO: 515780 - RNA, 23 nt, Chlamydophila pneumoniae CWL029
acccaguuguauccagcucaagg

SEQ ID NO: 515781 - RNA, 18 nt, Chlamydophila pneumoniae CWL029
acccauaaugguacaaua

SEQ ID NO: 515782 - RNA, 13 nt, Chlamydophila pneumoniae CWL029
accccuagaacuu

SEQ ID NO: 515783 - RNA, 23 nt, Chlamydophila pneumoniae CWL029
acccauugaauuuaugggugaga

SEQ ID NO: 515784 - RNA, 13 nt, Chlamydophila pneumoniae CWL029
accccaaagcaga

SEQ ID NO: 515785 - RNA, 20 nt, Chlamydophila pneumoniae CWL029
accccaaagcagauccugcu

SEQ ID NO: 515786 - RNA, 20 nt, Chlamydophila pneumoniae CWL029
accccaaucaguucaucuag

SEQ ID NO: 515787 - RNA, 12 nt, Chlamydophila pneumoniae CWL029
acccccgcagcu

SEQ ID NO: 515788 - RNA, 19 nt, Chlamydophila pneumoniae CWL029
acccccuggcugggcuaca

SEQ ID NO: 515789 - RNA, 12 nt, Chlamydophila pneumoniae CWL029
accauaaaacaa

SEQ ID NO: 515790 - RNA, 16 nt, Chlamydophila pneumoniae CWL029
accauccuguagcuuu

SEQ ID NO: 515791 - RNA, 19 nt, Chlamydophila pneumoniae CWL029
accaucgucuccaaaaauu

SEQ ID NO: 515792 - RNA, 22 nt, Chlamydophila pneumoniae CWL029
accaucgucuccaaaaauuccc

SEQ ID NO: 515793 - RNA, 16 nt, Chlamydophila pneumoniae CWL029
accaggagcuccuccu

SEQ ID NO: 515794 - RNA, 19 nt, Chlamydophila pneumoniae CWL029
accaggagcuccuccuuga

SEQ ID NO: 515795 - RNA, 15 nt, Chlamydophila pneumoniae CWL029
accagcauuaagaua

SEQ ID NO: 515796 - RNA, 21 nt, Chlamydophila pneumoniae CWL029
accagcauuaagauaaacagc

SEQ ID NO: 515797 - RNA, 23 nt, Chlamydophila pneumoniae CWL029
accagcauuaagauaaacagcac

SEQ ID NO: 515798 - RNA, 15 nt, Chlamydophila pneumoniae CWL029
accagaugauuuuuu

SEQ ID NO: 515799 - RNA, 12 nt, Chlamydophila pneumoniae CWL029
accaacuuccua

SEQ ID NO: 515800 - RNA, 17 nt, Chlamydophila pneumoniae CWL029
accaagacaauggaaau

SEQ ID NO: 515801 - RNA, 15 nt, Chlamydophila pneumoniae CWL029
accaagaugucucca

SEQ ID NO: 515802 - RNA, 13 nt, Chlamydophila pneumoniae CWL029
accagaagcaacu

SEQ ID NO: 515803 - RNA, 18 nt, Chlamydophila pneumoniae CWL029
aguacauuaucacagcaa

SEQ ID NO: 515804 - RNA, 16 nt, Chlamydophila pneumoniae CWL029
aguaccuaggaucuac

SEQ ID NO: 515805 - RNA, 23 nt, Chlamydophila pneumoniae CWL029
aguacgaccaacuccucaaaaga

SEQ ID NO: 515806 - RNA, 17 nt, Chlamydophila pneumoniae CWL029
aguacgcaaaguacuaa

SEQ ID NO: 515807 - RNA, 13 nt, Chlamydophila pneumoniae CWL029
aguaaggagagac

SEQ ID NO: 515808 - RNA, 23 nt, Chlamydophila pneumoniae CWL029
aguaaucuggaagcaaucuguau

SEQ ID NO: 515809 - RNA, 23 nt, Chlamydophila pneumoniae CWL029
aguaauuauuuucuacacuguug

SEQ ID NO: 515810 - RNA, 22 nt, Chlamydophila pneumoniae CWL029
aguaauuccaaaauaaaaggag

SEQ ID NO: 515811 - RNA, 21 nt, Chlamydophila pneumoniae CWL029
aguacagauuucagauaaucu

SEQ ID NO: 515812 - RNA, 15 nt, Chlamydophila pneumoniae CWL029
aguacaggcuccauc

SEQ ID NO: 515813 - RNA, 15 nt, Chlamydophila pneumoniae CWL029
aguaagaagucuuca

SEQ ID NO: 515814 - RNA, 16 nt, Chlamydophila pneumoniae CWL029
aguaacugcaaagaga

SEQ ID NO: 515815 - RNA, 19 nt, Chlamydophila pneumoniae CWL029
aguaacuuaaucaauccua

SEQ ID NO: 515816 - RNA, 15 nt, Chlamydophila pneumoniae CWL029
aguaacuaucuacac

SEQ ID NO: 515817 - RNA, 14 nt, Chlamydophila pneumoniae CWL029
aguaacugcaaaga

SEQ ID NO: 515818 - RNA, 19 nt, Chlamydophila pneumoniae CWL029
aguaaauauuuuaccauug

SEQ ID NO: 515819 - RNA, 23 nt, Chlamydophila pneumoniae CWL029
aguaaauauuuuaccauugagau

SEQ ID NO: 515820 - RNA, 22 nt, Chlamydophila pneumoniae CWL029
agguucuuuucggaucagaaug

SEQ ID NO: 515821 - RNA, 21 nt, Chlamydophila pneumoniae CWL029
agguucuugcuuauugucuua

SEQ ID NO: 515822 - RNA, 13 nt, Chlamydophila pneumoniae CWL029
aguaaaguaugca

SEQ ID NO: 515823 - RNA, 14 nt, Chlamydophila pneumoniae CWL029
agguuuuuccaacu

SEQ ID NO: 515824 - RNA, 15 nt, Chlamydophila pneumoniae CWL029
agguuaucuuuuugg

SEQ ID NO: 515825 - RNA, 13 nt, Chlamydophila pneumoniae CWL029
agguucaccagaa

SEQ ID NO: 515826 - RNA, 16 nt, Chlamydophila pneumoniae CWL029
agguggguagccagga

SEQ ID NO: 515827 - RNA, 17 nt, Chlamydophila pneumoniae CWL029
aggugcggaacucauca

SEQ ID NO: 515828 - RNA, 21 nt, Chlamydophila pneumoniae CWL029
aggucugcucuauauauccug

SEQ ID NO: 515829 - RNA, 14 nt, Chlamydophila pneumoniae CWL029
aggugaaaguacag

SEQ ID NO: 515830 - RNA, 16 nt, Chlamydophila pneumoniae CWL029
aggucuuuuccuguag

SEQ ID NO: 515831 - RNA, 19 nt, Chlamydophila pneumoniae CWL029
aggucgaagauucaaagaa

SEQ ID NO: 515832 - RNA, 20 nt, Chlamydophila pneumoniae CWL029
aggucgaagauucaaagaag

SEQ ID NO: 515833 - RNA, 16 nt, Chlamydophila pneumoniae CWL029
aggucacagcauuuuc

SEQ ID NO: 515834 - RNA, 21 nt, Chlamydophila pneumoniae CWL029
aggucagcaaggggaguuuuc

SEQ ID NO: 515835 - RNA, 16 nt, Chlamydophila pneumoniae CWL029
agguaaauuuuuaaaa

SEQ ID NO: 515836 - RNA, 21 nt, Chlamydophila pneumoniae CWL029
agguaaccagagagcuuuuag

SEQ ID NO: 515837 - RNA, 23 nt, Chlamydophila pneumoniae CWL029
agguauuuccuucuguuuucaca

SEQ ID NO: 515838 - RNA, 15 nt, Chlamydophila pneumoniae CWL029
agguaaccagagagc

SEQ ID NO: 515839 - RNA, 20 nt, Chlamydophila pneumoniae CWL029
agguauugcaaauuucauuu

SEQ ID NO: 515840 - RNA, 19 nt, Chlamydophila pneumoniae CWL029
aggguuuugaaauaauuuu

SEQ ID NO: 515841 - RNA, 15 nt, Chlamydophila pneumoniae CWL029
agguaaaauaaagag

SEQ ID NO: 515842 - RNA, 16 nt, Chlamydophila pneumoniae CWL029
agguaaaauaaagagc

SEQ ID NO: 515843 - RNA, 15 nt, Chlamydophila pneumoniae CWL029
aggguguuugcauag

SEQ ID NO: 515844 - RNA, 16 nt, Chlamydophila pneumoniae CWL029
aggguucaauuccuuu

SEQ ID NO: 515845 - RNA, 12 nt, Chlamydophila pneumoniae CWL029
aggguucaucug

SEQ ID NO: 515846 - RNA, 15 nt, Chlamydophila pneumoniae CWL029
aggguucucaaagau

SEQ ID NO: 515847 - RNA, 13 nt, Chlamydophila pneumoniae CWL029
aggggcuuuccuu

SEQ ID NO: 515848 - RNA, 14 nt, Chlamydophila pneumoniae CWL029
agggggccugccau

SEQ ID NO: 515849 - RNA, 17 nt, Chlamydophila pneumoniae CWL029
agggggaucuucagaga

SEQ ID NO: 515850 - RNA, 18 nt, Chlamydophila pneumoniae CWL029
agggggaucuucagagag

SEQ ID NO: 515851 - RNA, 23 nt, Chlamydophila pneumoniae CWL029
agggggaucuucagagagaacag

SEQ ID NO: 515852 - RNA, 17 nt, Chlamydophila pneumoniae CWL029
aggcuguguaaaaguua

SEQ ID NO: 515853 - RNA, 17 nt, Chlamydophila pneumoniae CWL029
agggaugaagauaaaau

SEQ ID NO: 515854 - RNA, 10 nt, Chlamydophila pneumoniae CWL029
agggauccca

SEQ ID NO: 515855 - RNA, 12 nt, Chlamydophila pneumoniae CWL029
agggaucccaaa

SEQ ID NO: 515856 - RNA, 19 nt, Chlamydophila pneumoniae CWL029
aggcugucguuaccguuuc

SEQ ID NO: 515857 - RNA, 21 nt, Chlamydophila pneumoniae CWL029
aggcuguccuugcagcccugc

SEQ ID NO: 515858 - RNA, 21 nt, Chlamydophila pneumoniae CWL029
aggcugccagagauucuucac

SEQ ID NO: 515859 - RNA, 14 nt, Chlamydophila pneumoniae CWL029
aggcuauuguguuu

SEQ ID NO: 515860 - RNA, 21 nt, Chlamydophila pneumoniae CWL029
aggcuauaauuaacguuucuu

SEQ ID NO: 515861 - RNA, 13 nt, Chlamydophila pneumoniae CWL029
aggcuccagcaua

SEQ ID NO: 515862 - RNA, 21 nt, Chlamydophila pneumoniae CWL029
aggcucuuaucgugacucuua

SEQ ID NO: 515863 - RNA, 22 nt, Chlamydophila pneumoniae CWL029
aggcucucgacacuauguguuu

SEQ ID NO: 515864 - RNA, 22 nt, Chlamydophila pneumoniae CWL029
aggcucuacaggagaagcggaa

SEQ ID NO: 515865 - RNA, 15 nt, Chlamydophila pneumoniae CWL029
aggcauaaucuccaa

SEQ ID NO: 515866 - RNA, 19 nt, Chlamydophila pneumoniae CWL029
aggcauacaguagaaacau

SEQ ID NO: 515867 - RNA, 16 nt, Chlamydophila pneumoniae CWL029
aggcauaacugugcuc

SEQ ID NO: 515868 - RNA, 14 nt, Chlamydophila pneumoniae CWL029
aggcauaagaucau

SEQ ID NO: 515869 - RNA, 14 nt, Chlamydophila pneumoniae CWL029
aggccaggagacua

SEQ ID NO: 515870 - RNA, 18 nt, Chlamydophila pneumoniae CWL029
aggcaauuuuuauaauau

SEQ ID NO: 515871 - RNA, 19 nt, Chlamydophila pneumoniae CWL029
aggcaauuuuuauaauauu

SEQ ID NO: 515872 - RNA, 20 nt, Chlamydophila pneumoniae CWL029
aggcaggccacuuccuauaa

SEQ ID NO: 515873 - RNA, 16 nt, Chlamydophila pneumoniae CWL029
aggcaaagaucaguuu

SEQ ID NO: 515874 - RNA, 14 nt, Chlamydophila pneumoniae CWL029
aggcaaagauuucc

SEQ ID NO: 515875 - RNA, 14 nt, Chlamydophila pneumoniae CWL029
aggauguuccuugu

SEQ ID NO: 515876 - RNA, 16 nt, Chlamydophila pneumoniae CWL029
aggaugcuuagcaaag

SEQ ID NO: 515877 - RNA, 16 nt, Chlamydophila pneumoniae CWL029
aggaugcuugugagau

SEQ ID NO: 515878 - RNA, 15 nt, Chlamydophila pneumoniae CWL029
aggauaucauauuuu

SEQ ID NO: 515879 - RNA, 17 nt, Chlamydophila pneumoniae CWL029
aggaucauuaaagucca

SEQ ID NO: 515880 - RNA, 15 nt, Chlamydophila pneumoniae CWL029
aggaucugguugagg

SEQ ID NO: 515881 - RNA, 17 nt, Chlamydophila pneumoniae CWL029
aggaucuuauauaaaac

SEQ ID NO: 515882 - RNA, 19 nt, Chlamydophila pneumoniae CWL029
aggaucuuauauaaaacuu

SEQ ID NO: 515883 - RNA, 15 nt, Chlamydophila pneumoniae CWL029
aggaucugcauggau

SEQ ID NO: 515884 - RNA, 23 nt, Chlamydophila pneumoniae CWL029
aggagucgugcaggagaacaaua

SEQ ID NO: 515885 - RNA, 21 nt, Chlamydophila pneumoniae CWL029
aggacguaacguagucaaaaa

SEQ ID NO: 515886 - RNA, 16 nt, Chlamydophila pneumoniae CWL029
aggaggauuuccuagg

SEQ ID NO: 515887 - RNA, 21 nt, Chlamydophila pneumoniae CWL029
aggaggauuuccuagguucuu

SEQ ID NO: 515888 - RNA, 18 nt, Chlamydophila pneumoniae CWL029
aggaguuuucaagucugu

SEQ ID NO: 515889 - RNA, 12 nt, Chlamydophila pneumoniae CWL029
aggaguuuucca

SEQ ID NO: 515890 - RNA, 20 nt, Chlamydophila pneumoniae CWL029
aggauaaccaucaaucacuc

SEQ ID NO: 515891 - RNA, 16 nt, Chlamydophila pneumoniae CWL029
aggauacgaauaaguu

SEQ ID NO: 515892 - RNA, 17 nt, Chlamydophila pneumoniae CWL029
aggauacgaauaaguuu

SEQ ID NO: 515893 - RNA, 16 nt, Chlamydophila pneumoniae CWL029
aggauacucacagagu

SEQ ID NO: 515894 - RNA, 21 nt, Chlamydophila pneumoniae CWL029
aggauagcaauucgguagagc

SEQ ID NO: 515895 - RNA, 22 nt, Chlamydophila pneumoniae CWL029
aggauagcaauucgguagagcu

SEQ ID NO: 515896 - RNA, 21 nt, Chlamydophila pneumoniae CWL029
aggaccgugguaucccugagc

SEQ ID NO: 515897 - RNA, 16 nt, Chlamydophila pneumoniae CWL029
aggaccuaagggcucu

SEQ ID NO: 515898 - RNA, 16 nt, Chlamydophila pneumoniae CWL029
aggaccuguaguaaaa

SEQ ID NO: 515899 - RNA, 19 nt, Chlamydophila pneumoniae CWL029
aggaccuuggacucuaggg

SEQ ID NO: 515900 - RNA, 13 nt, Chlamydophila pneumoniae CWL029
aggaccaggugua

SEQ ID NO: 515901 - RNA, 14 nt, Chlamydophila pneumoniae CWL029
aggaauuaaaauau

SEQ ID NO: 515902 - RNA, 20 nt, Chlamydophila pneumoniae CWL029
aggaccagguguagguuccu

SEQ ID NO: 515903 - RNA, 23 nt, Chlamydophila pneumoniae CWL029
aggaccagguguagguuccugcu

SEQ ID NO: 515904 - RNA, 13 nt, Chlamydophila pneumoniae CWL029
aggaaucuaagaa

SEQ ID NO: 515905 - RNA, 14 nt, Chlamydophila pneumoniae CWL029
aggaaugaagagag

SEQ ID NO: 515906 - RNA, 19 nt, Chlamydophila pneumoniae CWL029
aggaaucccugcacucuuu

SEQ ID NO: 515907 - RNA, 15 nt, Chlamydophila pneumoniae CWL029
aggaaacguucuuuc

SEQ ID NO: 515908 - RNA, 24 nt, Chlamydophila pneumoniae CWL029
aggaaaauucaguauaagaugcug

SEQ ID NO: 515909 - RNA, 19 nt, Chlamydophila pneumoniae CWL029
aggaauaaucaaccaaaau

SEQ ID NO: 515910 - RNA, 21 nt, Chlamydophila pneumoniae CWL029
aggaauaacaccaaaagaaua

SEQ ID NO: 515911 - RNA, 17 nt, Chlamydophila pneumoniae CWL029
aggaauagagaaagagu

SEQ ID NO: 515912 - RNA, 14 nt, Chlamydophila pneumoniae CWL029
aggaauagaaagac

SEQ ID NO: 515913 - RNA, 15 nt, Chlamydophila pneumoniae CWL029
aggaauagagaaaga

SEQ ID NO: 515914 - RNA, 21 nt, Chlamydophila pneumoniae CWL029
aggaaucauaaccaaaagaau

SEQ ID NO: 515915 - RNA, 17 nt, Chlamydophila pneumoniae CWL029
agcuuuaacaugccaaa

SEQ ID NO: 515916 - RNA, 16 nt, Chlamydophila pneumoniae CWL029
agcuuucagaaaagaa

SEQ ID NO: 515917 - RNA, 22 nt, Chlamydophila pneumoniae CWL029
agcuuuuuucucuugcuucaga

SEQ ID NO: 515918 - RNA, 13 nt, Chlamydophila pneumoniae CWL029
agcuuuugugaua

SEQ ID NO: 515919 - RNA, 17 nt, Chlamydophila pneumoniae CWL029
agcuucuuuuccagcaa

SEQ ID NO: 515920 - RNA, 19 nt, Chlamydophila pneumoniae CWL029
agcuucuuuaucuagcucu

SEQ ID NO: 515921 - RNA, 20 nt, Chlamydophila pneumoniae CWL029
agcuucuuuaucuagcucuu

SEQ ID NO: 515922 - RNA, 22 nt, Chlamydophila pneumoniae CWL029
agcuucaaguuucuuuugcaaa

SEQ ID NO: 515923 - RNA, 17 nt, Chlamydophila pneumoniae CWL029
agcuucaaaaagcuccc

SEQ ID NO: 515924 - RNA, 19 nt, Chlamydophila pneumoniae CWL029
agcugcaaucucaaaauca

SEQ ID NO: 515925 - RNA, 15 nt, Chlamydophila pneumoniae CWL029
agcugcgucaauaag

SEQ ID NO: 515926 - RNA, 20 nt, Chlamydophila pneumoniae CWL029
agcuggggauggucuucccc

SEQ ID NO: 515927 - RNA, 13 nt, Chlamydophila pneumoniae CWL029
agcuguuguucug

SEQ ID NO: 515928 - RNA, 16 nt, Chlamydophila pneumoniae CWL029
agcuguuucucuguau

SEQ ID NO: 515929 - RNA, 13 nt, Chlamydophila pneumoniae CWL029
agcuggcaaugau

SEQ ID NO: 515930 - RNA, 16 nt, Chlamydophila pneumoniae CWL029
agcucuugagaaagcu

SEQ ID NO: 515931 - RNA, 16 nt, Chlamydophila pneumoniae CWL029
agcucuuucuuggauu

SEQ ID NO: 515932 - RNA, 15 nt, Chlamydophila pneumoniae CWL029
agcugaggcaucuau

SEQ ID NO: 515933 - RNA, 23 nt, Chlamydophila pneumoniae CWL029
agcugagguagcaucucucucca

SEQ ID NO: 515934 - RNA, 18 nt, Chlamydophila pneumoniae CWL029
agcucucgacgaacaugc

SEQ ID NO: 515935 - RNA, 22 nt, Chlamydophila pneumoniae CWL029
agcucuaaaaaagauaaagcua

SEQ ID NO: 515936 - RNA, 15 nt, Chlamydophila pneumoniae CWL029
agcucuauuucugcc

SEQ ID NO: 515937 - RNA, 15 nt, Chlamydophila pneumoniae CWL029
agcucucuccaucua

SEQ ID NO: 515938 - RNA, 12 nt, Chlamydophila pneumoniae CWL029
agcucuggagau

SEQ ID NO: 515939 - RNA, 18 nt, Chlamydophila pneumoniae CWL029
agcucuggauugaaagag

SEQ ID NO: 515940 - RNA, 13 nt, Chlamydophila pneumoniae CWL029
agcuccuggauau

SEQ ID NO: 515941 - RNA, 21 nt, Chlamydophila pneumoniae CWL029
agcucgaaucacgaauaaggc

SEQ ID NO: 515942 - RNA, 21 nt, Chlamydophila pneumoniae CWL029
agcucgaggucuuuucuuuuu

SEQ ID NO: 515943 - RNA, 19 nt, Chlamydophila pneumoniae CWL029
agcucgagaucuuuuugcc

SEQ ID NO: 515944 - RNA, 22 nt, Chlamydophila pneumoniae CWL029
agcucggauggacuacugaaac

SEQ ID NO: 515945 - RNA, 14 nt, Chlamydophila pneumoniae CWL029
agcuccgcuagagg

SEQ ID NO: 515946 - RNA, 16 nt, Chlamydophila pneumoniae CWL029
agcucccucuagagcu

SEQ ID NO: 515947 - RNA, 20 nt, Chlamydophila pneumoniae CWL029
agcgucucuucuuccucuac

SEQ ID NO: 515948 - RNA, 15 nt, Chlamydophila pneumoniae CWL029
auaagauaauagaga

SEQ ID NO: 515949 - RNA, 16 nt, Chlamydophila pneumoniae CWL029
auaagagacauuucuu

SEQ ID NO: 515950 - RNA, 18 nt, Chlamydophila pneumoniae CWL029
auaagaaaauccuaacaa

SEQ ID NO: 515951 - RNA, 14 nt, Chlamydophila pneumoniae CWL029
auaagaccagaaag

SEQ ID NO: 515952 - RNA, 15 nt, Chlamydophila pneumoniae CWL029
auaagaccagaaagg

SEQ ID NO: 515953 - RNA, 20 nt, Chlamydophila pneumoniae CWL029
auaacuuugcaugaggagac

SEQ ID NO: 515954 - RNA, 16 nt, Chlamydophila pneumoniae CWL029
auaacuuuaucauaga

SEQ ID NO: 515955 - RNA, 20 nt, Chlamydophila pneumoniae CWL029
auaacuugagccaacagguu

SEQ ID NO: 515956 - RNA, 23 nt, Chlamydophila pneumoniae CWL029
auaacuccaggggauaaaacuau

SEQ ID NO: 515957 - RNA, 12 nt, Chlamydophila pneumoniae CWL029
auaaauuugcuu

SEQ ID NO: 515958 - RNA, 13 nt, Chlamydophila pneumoniae CWL029
auaaauuuauaaa

SEQ ID NO: 515959 - RNA, 18 nt, Chlamydophila pneumoniae CWL029
auaagcuugccagcagaa

SEQ ID NO: 515960 - RNA, 18 nt, Chlamydophila pneumoniae CWL029
auaaggagauuccuaaac

SEQ ID NO: 515961 - RNA, 21 nt, Chlamydophila pneumoniae CWL029
auaaggauguuguggaucaga

SEQ ID NO: 515962 - RNA, 21 nt, Chlamydophila pneumoniae CWL029
auaagcuugccagcagaaguu

SEQ ID NO: 515963 - RNA, 18 nt, Chlamydophila pneumoniae CWL029
auaagggggaucuucaga

SEQ ID NO: 515964 - RNA, 23 nt, Chlamydophila pneumoniae CWL029
auaagaucucgugaauuacaggc

SEQ ID NO: 515965 - RNA, 15 nt, Chlamydophila pneumoniae CWL029
auaagauauucaaga

SEQ ID NO: 515966 - RNA, 13 nt, Chlamydophila pneumoniae CWL029
auaagaucaauau

SEQ ID NO: 515967 - RNA, 14 nt, Chlamydophila pneumoniae CWL029
auaagauccaaaaa

SEQ ID NO: 515968 - RNA, 15 nt, Chlamydophila pneumoniae CWL029
auaagauccaaaaau

SEQ ID NO: 515969 - RNA, 14 nt, Chlamydophila pneumoniae CWL029
auaagauuuugaaa

SEQ ID NO: 515970 - RNA, 20 nt, Chlamydophila pneumoniae CWL029
auaagcaccacgaccuauac

SEQ ID NO: 515971 - RNA, 16 nt, Chlamydophila pneumoniae CWL029
auaagcaggaaaagca

SEQ ID NO: 515972 - RNA, 18 nt, Chlamydophila pneumoniae CWL029
auaagcaggaaaagcaaa

SEQ ID NO: 515973 - RNA, 18 nt, Chlamydophila pneumoniae CWL029
auaagcauauuuaaauau

SEQ ID NO: 515974 - RNA, 20 nt, Chlamydophila pneumoniae CWL029
auaagcauauuuaaauauaa

SEQ ID NO: 515975 - RNA, 16 nt, Chlamydophila pneumoniae CWL029
auaagccaguacuaaa

SEQ ID NO: 515976 - RNA, 21 nt, Chlamydophila pneumoniae CWL029
auaauagauauacgcccaugu

SEQ ID NO: 515977 - RNA, 13 nt, Chlamydophila pneumoniae CWL029
auaauagagccuc

SEQ ID NO: 515978 - RNA, 19 nt, Chlamydophila pneumoniae CWL029
auaauagagaagaagcaaa

SEQ ID NO: 515979 - RNA, 16 nt, Chlamydophila pneumoniae CWL029
auaagucaaaaugugc

SEQ ID NO: 515980 - RNA, 19 nt, Chlamydophila pneumoniae CWL029
auaaguagauuaaaggcau

SEQ ID NO: 515981 - RNA, 14 nt, Chlamydophila pneumoniae CWL029
auaauccaagauac

SEQ ID NO: 515982 - RNA, 18 nt, Chlamydophila pneumoniae CWL029
auaauaucgguuccuaua

SEQ ID NO: 515983 - RNA, 14 nt, Chlamydophila pneumoniae CWL029
auaaucaaccaaaa

SEQ ID NO: 515984 - RNA, 12 nt, Chlamydophila pneumoniae CWL029
auaauuaaacuc

SEQ ID NO: 515985 - RNA, 13 nt, Chlamydophila pneumoniae CWL029
auaauuaaauaua

SEQ ID NO: 515986 - RNA, 17 nt, Chlamydophila pneumoniae CWL029
auaauguuuuaauagcu

SEQ ID NO: 515987 - RNA, 15 nt, Chlamydophila pneumoniae CWL029
auaauuagagagaau

SEQ ID NO: 515988 - RNA, 18 nt, Chlamydophila pneumoniae CWL029
auaauuauguagaucuac

SEQ ID NO: 515989 - RNA, 22 nt, Chlamydophila pneumoniae CWL029
auaaucucaccagaagcaacua

SEQ ID NO: 515990 - RNA, 19 nt, Chlamydophila pneumoniae CWL029
auaaucuccaaacauuuuu

SEQ ID NO: 515991 - RNA, 16 nt, Chlamydophila pneumoniae CWL029
auaaucccuacccccu

SEQ ID NO: 515992 - RNA, 15 nt, Chlamydophila pneumoniae CWL029
auaaugcucacuucu

SEQ ID NO: 515993 - RNA, 17 nt, Chlamydophila pneumoniae CWL029
aguuuuuuucuaaauuu

SEQ ID NO: 515994 - RNA, 14 nt, Chlamydophila pneumoniae CWL029
auaaaaaaacccuc

SEQ ID NO: 515995 - RNA, 19 nt, Chlamydophila pneumoniae CWL029
aguuuuuguucauccagaa

SEQ ID NO: 515996 - RNA, 22 nt, Chlamydophila pneumoniae CWL029
aguuuuuuaaauaccuagagcu

SEQ ID NO: 515997 - RNA, 12 nt, Chlamydophila pneumoniae CWL029
aguuuuuuagag

SEQ ID NO: 515998 - RNA, 18 nt, Chlamydophila pneumoniae CWL029
aguuuuuaauuuucuguu

SEQ ID NO: 515999 - RNA, 16 nt, Chlamydophila pneumoniae CWL029
aguuuuuauuuuuaaa

SEQ ID NO: 516000 - RNA, 20 nt, Chlamydophila pneumoniae CWL029
aguuuugguuuuagaaaugu

SEQ ID NO: 516001 - RNA, 23 nt, Chlamydophila pneumoniae CWL029
aguuuugguuuuagaaauguuuu

SEQ ID NO: 516002 - RNA, 20 nt, Chlamydophila pneumoniae CWL029
aguuuucuuaacuccagcga

SEQ ID NO: 516003 - RNA, 23 nt, Chlamydophila pneumoniae CWL029
aguugguugcagucguauucagg

SEQ ID NO: 516004 - RNA, 13 nt, Chlamydophila pneumoniae CWL029
aguugggcauuua

SEQ ID NO: 516005 - RNA, 15 nt, Chlamydophila pneumoniae CWL029
aguuggcguuuucua

SEQ ID NO: 516006 - RNA, 21 nt, Chlamydophila pneumoniae CWL029
auaaaaauuuucaggaacuuu

SEQ ID NO: 516007 - RNA, 20 nt, Chlamydophila pneumoniae CWL029
auaaaaaugguaauuuuuca

SEQ ID NO: 516008 - RNA, 16 nt, Chlamydophila pneumoniae CWL029
auaaaaauuaagaacc

SEQ ID NO: 516009 - RNA, 16 nt, Chlamydophila pneumoniae CWL029
auaaaaaguuuuuguu

SEQ ID NO: 516010 - RNA, 17 nt, Chlamydophila pneumoniae CWL029
auaaaagagcucaaaaa

SEQ ID NO: 516011 - RNA, 16 nt, Chlamydophila pneumoniae CWL029
auaaaagaggaagaug

SEQ ID NO: 516012 - RNA, 20 nt, Chlamydophila pneumoniae CWL029
auaaaaggguagcgaaugaa

SEQ ID NO: 516013 - RNA, 22 nt, Chlamydophila pneumoniae CWL029
auaaaacgugauugcugcugcu

SEQ ID NO: 516014 - RNA, 19 nt, Chlamydophila pneumoniae CWL029
auaaauucaagacuauaga

SEQ ID NO: 516015 - RNA, 17 nt, Chlamydophila pneumoniae CWL029
auaaauggaggauacuc

SEQ ID NO: 516016 - RNA, 20 nt, Chlamydophila pneumoniae CWL029
auaaauggaggauacucaca

SEQ ID NO: 516017 - RNA, 24 nt, Chlamydophila pneumoniae CWL029
auaaaggcauaacugugcuccaua

SEQ ID NO: 516018 - RNA, 16 nt, Chlamydophila pneumoniae CWL029
auaaaggcucuuuuag

SEQ ID NO: 516019 - RNA, 19 nt, Chlamydophila pneumoniae CWL029
auaaacuccacgaauucuu

SEQ ID NO: 516020 - RNA, 24 nt, Chlamydophila pneumoniae CWL029
auaaacagcgguugccuuucucuu

SEQ ID NO: 516021 - RNA, 15 nt, Chlamydophila pneumoniae CWL029
auaaacauacaugcu

SEQ ID NO: 516022 - RNA, 21 nt, Chlamydophila pneumoniae CWL029
auaaacauauucuccuuacca

SEQ ID NO: 516023 - RNA, 22 nt, Chlamydophila pneumoniae CWL029
auaaagaaguuuacaaauaaaa

SEQ ID NO: 516024 - RNA, 13 nt, Chlamydophila pneumoniae CWL029
auaaagaauuccc

SEQ ID NO: 516025 - RNA, 12 nt, Chlamydophila pneumoniae CWL029
auaaagaggcuc

SEQ ID NO: 516026 - RNA, 21 nt, Chlamydophila pneumoniae CWL029
auaaagauaaucuguaagaaa

SEQ ID NO: 516027 - RNA, 14 nt, Chlamydophila pneumoniae CWL029
auaaagaucuucau

SEQ ID NO: 516028 - RNA, 14 nt, Chlamydophila pneumoniae CWL029
auaaaggacauaga

SEQ ID NO: 516029 - RNA, 20 nt, Chlamydophila pneumoniae CWL029
auaaaggaccuguuuucuuu

SEQ ID NO: 516030 - RNA, 17 nt, Chlamydophila pneumoniae CWL029
aguuggaacauaucgau

SEQ ID NO: 516031 - RNA, 21 nt, Chlamydophila pneumoniae CWL029
aguuggaucaaggaguacucu

SEQ ID NO: 516032 - RNA, 15 nt, Chlamydophila pneumoniae CWL029
aguuggaucauucuu

SEQ ID NO: 516033 - RNA, 18 nt, Chlamydophila pneumoniae CWL029
aguugacgcgcuucuuca

SEQ ID NO: 516034 - RNA, 15 nt, Chlamydophila pneumoniae CWL029
aguugaggaaaggag

SEQ ID NO: 516035 - RNA, 16 nt, Chlamydophila pneumoniae CWL029
aguugaggaaaggagg

SEQ ID NO: 516036 - RNA, 21 nt, Chlamydophila pneumoniae CWL029
aguugaaaugagugagaaugc

SEQ ID NO: 516037 - RNA, 12 nt, Chlamydophila pneumoniae CWL029
aguugaaaugag

SEQ ID NO: 516038 - RNA, 21 nt, Chlamydophila pneumoniae CWL029
aguucuuguaauaaaagaaca

SEQ ID NO: 516039 - RNA, 18 nt, Chlamydophila pneumoniae CWL029
aguucuuuagcuacagaa

SEQ ID NO: 516040 - RNA, 13 nt, Chlamydophila pneumoniae CWL029
aguucuuucugcu

SEQ ID NO: 516041 - RNA, 20 nt, Chlamydophila pneumoniae CWL029
aguucgcggaucuucuucug

SEQ ID NO: 516042 - RNA, 16 nt, Chlamydophila pneumoniae CWL029
aguucgcacuaauuuc

SEQ ID NO: 516043 - RNA, 15 nt, Chlamydophila pneumoniae CWL029
aguuccucauccuca

SEQ ID NO: 516044 - RNA, 22 nt, Chlamydophila pneumoniae CWL029
aguucaucauauuuuucuugaa

SEQ ID NO: 516045 - RNA, 16 nt, Chlamydophila pneumoniae CWL029
aguucccacuggacuu

SEQ ID NO: 516046 - RNA, 13 nt, Chlamydophila pneumoniae CWL029
aguucacaagcag

SEQ ID NO: 516047 - RNA, 22 nt, Chlamydophila pneumoniae CWL029
aguucacaagugcauuaucuaa

SEQ ID NO: 516048 - RNA, 17 nt, Chlamydophila pneumoniae CWL029
aguucauaaccugggca

SEQ ID NO: 516049 - RNA, 20 nt, Chlamydophila pneumoniae CWL029
aguuagguagauagaaauuc

SEQ ID NO: 516050 - RNA, 15 nt, Chlamydophila pneumoniae CWL029
aguuaggaucccuga

SEQ ID NO: 516051 - RNA, 16 nt, Chlamydophila pneumoniae CWL029
aguuaaagagcauccu

SEQ ID NO: 516052 - RNA, 18 nt, Chlamydophila pneumoniae CWL029
aguguugccagcccaugu

SEQ ID NO: 516053 - RNA, 22 nt, Chlamydophila pneumoniae CWL029
aguguuguuggagcagaaacuc

SEQ ID NO: 516054 - RNA, 15 nt, Chlamydophila pneumoniae CWL029
agugucuaagauaua

SEQ ID NO: 516055 - RNA, 23 nt, Chlamydophila pneumoniae CWL029
agugucuaagauauagagagagu

SEQ ID NO: 516056 - RNA, 19 nt, Chlamydophila pneumoniae CWL029
agugugacugcagagaaau

SEQ ID NO: 516057 - RNA, 11 nt, Chlamydophila pneumoniae CWL029
aguguguuuca

SEQ ID NO: 516058 - RNA, 18 nt, Chlamydophila pneumoniae CWL029
aguguucgagcaucucaa

SEQ ID NO: 516059 - RNA, 16 nt, Chlamydophila pneumoniae CWL029
aguguguaaauguuuu

SEQ ID NO: 516060 - RNA, 17 nt, Chlamydophila pneumoniae CWL029
aguggacggggagagcc

SEQ ID NO: 516061 - RNA, 19 nt, Chlamydophila pneumoniae CWL029
aguggacuauagaugccau

SEQ ID NO: 516062 - RNA, 13 nt, Chlamydophila pneumoniae CWL029
aguggcgacugca

SEQ ID NO: 516063 - RNA, 19 nt, Chlamydophila pneumoniae CWL029
aguggaaauugugaaaaaa

SEQ ID NO: 516064 - RNA, 19 nt, Chlamydophila pneumoniae CWL029
agugcucaguaaauauuuu

SEQ ID NO: 516065 - RNA, 15 nt, Chlamydophila pneumoniae CWL029
agugcuagaugaaga

SEQ ID NO: 516066 - RNA, 16 nt, Chlamydophila pneumoniae CWL029
agugcguacucuucuu

SEQ ID NO: 516067 - RNA, 15 nt, Chlamydophila pneumoniae CWL029
agugauaaggaagaa

SEQ ID NO: 516068 - RNA, 22 nt, Chlamydophila pneumoniae CWL029
agugagcucccugauguugccc

SEQ ID NO: 516069 - RNA, 21 nt, Chlamydophila pneumoniae CWL029
agugaggccuccauuucuagg

SEQ ID NO: 516070 - RNA, 20 nt, Chlamydophila pneumoniae CWL029
agucuugaguucuuuuguuu

SEQ ID NO: 516071 - RNA, 17 nt, Chlamydophila pneumoniae CWL029
agucuugaguucuuuug

SEQ ID NO: 516072 - RNA, 20 nt, Chlamydophila pneumoniae CWL029
agucuugcgccagcaaagau

SEQ ID NO: 516073 - RNA, 21 nt, Chlamydophila pneumoniae CWL029
agucuugcgccagcaaagauu

SEQ ID NO: 516074 - RNA, 15 nt, Chlamydophila pneumoniae CWL029
agucuugcgccagca

SEQ ID NO: 516075 - RNA, 15 nt, Chlamydophila pneumoniae CWL029
agucuggcauaaguc

SEQ ID NO: 516076 - RNA, 18 nt, Chlamydophila pneumoniae CWL029
agucugguuuuucuccug

SEQ ID NO: 516077 - RNA, 16 nt, Chlamydophila pneumoniae CWL029
agucucaguugagaac

SEQ ID NO: 516078 - RNA, 23 nt, Chlamydophila pneumoniae CWL029
agucucauggauuacugaagauc

SEQ ID NO: 516079 - RNA, 16 nt, Chlamydophila pneumoniae CWL029
agugacuuccuccaaa

SEQ ID NO: 516080 - RNA, 15 nt, Chlamydophila pneumoniae CWL029
agugaacuuuuguac

SEQ ID NO: 516081 - RNA, 17 nt, Chlamydophila pneumoniae CWL029
agugaauuucuugacuu

SEQ ID NO: 516082 - RNA, 15 nt, Chlamydophila pneumoniae CWL029
agucguuaacaucaa

SEQ ID NO: 516083 - RNA, 21 nt, Chlamydophila pneumoniae CWL029
agucguuuucucgaauagaaa

SEQ ID NO: 516084 - RNA, 17 nt, Chlamydophila pneumoniae CWL029
agucuauaucuacagcu

SEQ ID NO: 516085 - RNA, 17 nt, Chlamydophila pneumoniae CWL029
agucuauuugaaaagaa

SEQ ID NO: 516086 - RNA, 20 nt, Chlamydophila pneumoniae CWL029
agucguauucagguucugaa

SEQ ID NO: 516087 - RNA, 13 nt, Chlamydophila pneumoniae CWL029
aguccuucuuccc

SEQ ID NO: 516088 - RNA, 19 nt, Chlamydophila pneumoniae CWL029
aguccuucuugcaaagaua

SEQ ID NO: 516089 - RNA, 13 nt, Chlamydophila pneumoniae CWL029
aguccuucuuuuc

SEQ ID NO: 516090 - RNA, 17 nt, Chlamydophila pneumoniae CWL029
aguccuugaauuaguuu

SEQ ID NO: 516091 - RNA, 20 nt, Chlamydophila pneumoniae CWL029
aguccuuauuucaaagaaga

SEQ ID NO: 516092 - RNA, 18 nt, Chlamydophila pneumoniae CWL029
aguccuguauauucugaa

SEQ ID NO: 516093 - RNA, 21 nt, Chlamydophila pneumoniae CWL029
aguccuggauuuuaaagcaaa

SEQ ID NO: 516094 - RNA, 23 nt, Chlamydophila pneumoniae CWL029
aguccuuuaccaucgucuccaaa

SEQ ID NO: 516095 - RNA, 18 nt, Chlamydophila pneumoniae CWL029
agucccuaaccucgccuc

SEQ ID NO: 516096 - RNA, 23 nt, Chlamydophila pneumoniae CWL029
agucccuaaccucgccucuuguc

SEQ ID NO: 516097 - RNA, 16 nt, Chlamydophila pneumoniae CWL029
agucccccuaagggcu

SEQ ID NO: 516098 - RNA, 18 nt, Chlamydophila pneumoniae CWL029
agucauacauuugauuca

SEQ ID NO: 516099 - RNA, 19 nt, Chlamydophila pneumoniae CWL029
agucaggaagaugcuggaa

SEQ ID NO: 516100 - RNA, 17 nt, Chlamydophila pneumoniae CWL029
agucagguaaagagcuu

SEQ ID NO: 516101 - RNA, 15 nt, Chlamydophila pneumoniae CWL029
aguccaguuuguuga

SEQ ID NO: 516102 - RNA, 18 nt, Chlamydophila pneumoniae CWL029
aguccaugaaucugguuc

SEQ ID NO: 516103 - RNA, 16 nt, Chlamydophila pneumoniae CWL029
aguccauguacagaaa

SEQ ID NO: 516104 - RNA, 18 nt, Chlamydophila pneumoniae CWL029
aguccauguacagaaaau

SEQ ID NO: 516105 - RNA, 16 nt, Chlamydophila pneumoniae CWL029
aguccagacuuuccuc

SEQ ID NO: 516106 - RNA, 23 nt, Chlamydophila pneumoniae CWL029
agucauguccguucgagagguuc

SEQ ID NO: 516107 - RNA, 13 nt, Chlamydophila pneumoniae CWL029
aguccaagguucu

SEQ ID NO: 516108 - RNA, 10 nt, Chlamydophila pneumoniae CWL029
aguccacauc

SEQ ID NO: 516109 - RNA, 17 nt, Chlamydophila pneumoniae CWL029
aguagaauccuucuccc

SEQ ID NO: 516110 - RNA, 19 nt, Chlamydophila pneumoniae CWL029
aguagaauccuucucccuc

SEQ ID NO: 516111 - RNA, 18 nt, Chlamydophila pneumoniae CWL029
aguacuuauccugaacau

SEQ ID NO: 516112 - RNA, 15 nt, Chlamydophila pneumoniae CWL029
aguacuucuuacccu

SEQ ID NO: 516113 - RNA, 16 nt, Chlamydophila pneumoniae CWL029
agucaccuuacaucca

SEQ ID NO: 516114 - RNA, 16 nt, Chlamydophila pneumoniae CWL029
agucacaaauuuuugc

SEQ ID NO: 516115 - RNA, 20 nt, Chlamydophila pneumoniae CWL029
auaguauuuuugaaaccaag

SEQ ID NO: 516116 - RNA, 16 nt, Chlamydophila pneumoniae CWL029
auaguauuuuuaaaua

SEQ ID NO: 516117 - RNA, 21 nt, Chlamydophila pneumoniae CWL029
auaguagacauauccaaugag

SEQ ID NO: 516118 - RNA, 15 nt, Chlamydophila pneumoniae CWL029
auaguaaacagaagu

SEQ ID NO: 516119 - RNA, 13 nt, Chlamydophila pneumoniae CWL029
auagguagaggca

SEQ ID NO: 516120 - RNA, 20 nt, Chlamydophila pneumoniae CWL029
auaggcucuuuagcaaacau

SEQ ID NO: 516121 - RNA, 23 nt, Chlamydophila pneumoniae CWL029
auaggcugcacacauccuggagc

SEQ ID NO: 516122 - RNA, 20 nt, Chlamydophila pneumoniae CWL029
auagggaucuccuugagaga

SEQ ID NO: 516123 - RNA, 22 nt, Chlamydophila pneumoniae CWL029
auagggcaggcggaaaggaagg

SEQ ID NO: 516124 - RNA, 16 nt, Chlamydophila pneumoniae CWL029
auagggccauuagcaa

SEQ ID NO: 516125 - RNA, 16 nt, Chlamydophila pneumoniae CWL029
auagccgagaucuuug

SEQ ID NO: 516126 - RNA, 21 nt, Chlamydophila pneumoniae CWL029
auagccgacaugcuuuccuuc

SEQ ID NO: 516127 - RNA, 15 nt, Chlamydophila pneumoniae CWL029
auagcccgaaauuca

SEQ ID NO: 516128 - RNA, 22 nt, Chlamydophila pneumoniae CWL029
auagccauuagaaucucugccc

SEQ ID NO: 516129 - RNA, 15 nt, Chlamydophila pneumoniae CWL029
auagaggaaugaucc

SEQ ID NO: 516130 - RNA, 21 nt, Chlamydophila pneumoniae CWL029
auagagcuucuuuaucuagcu

SEQ ID NO: 516131 - RNA, 19 nt, Chlamydophila pneumoniae CWL029
auagccauaauuagaacag

SEQ ID NO: 516132 - RNA, 18 nt, Chlamydophila pneumoniae CWL029
auagccaucauagcaaac

SEQ ID NO: 516133 - RNA, 17 nt, Chlamydophila pneumoniae CWL029
auagagauucuacaaau

SEQ ID NO: 516134 - RNA, 18 nt, Chlamydophila pneumoniae CWL029
auagagagcgcagagucu

SEQ ID NO: 516135 - RNA, 20 nt, Chlamydophila pneumoniae CWL029
auagagccuagagaguucuu

SEQ ID NO: 516136 - RNA, 14 nt, Chlamydophila pneumoniae CWL029
auagagcgguucuu

SEQ ID NO: 516137 - RNA, 21 nt, Chlamydophila pneumoniae CWL029
auagagcgguucuuucuagaa

SEQ ID NO: 516138 - RNA, 22 nt, Chlamydophila pneumoniae CWL029
auagagcgguucuuucuagaau

SEQ ID NO: 516139 - RNA, 14 nt, Chlamydophila pneumoniae CWL029
auagagcucuaaaa

SEQ ID NO: 516140 - RNA, 16 nt, Chlamydophila pneumoniae CWL029
auagcuuugaagagca

SEQ ID NO: 516141 - RNA, 23 nt, Chlamydophila pneumoniae CWL029
auaggaaacgcccuucuuaguaa

SEQ ID NO: 516142 - RNA, 17 nt, Chlamydophila pneumoniae CWL029
auagcuggaucuucuga

SEQ ID NO: 516143 - RNA, 23 nt, Chlamydophila pneumoniae CWL029
auaggaacucacaaacaacagaa

SEQ ID NO: 516144 - RNA, 21 nt, Chlamydophila pneumoniae CWL029
auaggaauaacaccaaaagaa

SEQ ID NO: 516145 - RNA, 23 nt, Chlamydophila pneumoniae CWL029
auaggaacaaagccaaauucucg

SEQ ID NO: 516146 - RNA, 16 nt, Chlamydophila pneumoniae CWL029
auaggaauuagagaaa

SEQ ID NO: 516147 - RNA, 15 nt, Chlamydophila pneumoniae CWL029
auaggauccaggagu

SEQ ID NO: 516148 - RNA, 15 nt, Chlamydophila pneumoniae CWL029
auaggcaaguguuuu

SEQ ID NO: 516149 - RNA, 16 nt, Chlamydophila pneumoniae CWL029
auaucaaagaucugaa

SEQ ID NO: 516150 - RNA, 17 nt, Chlamydophila pneumoniae CWL029
auauauaagaucuuuca

SEQ ID NO: 516151 - RNA, 13 nt, Chlamydophila pneumoniae CWL029
auaucagcaaaaa

SEQ ID NO: 516152 - RNA, 14 nt, Chlamydophila pneumoniae CWL029
auaucagcaaaaaa

SEQ ID NO: 516153 - RNA, 16 nt, Chlamydophila pneumoniae CWL029
auaucagcaaaaaacu

SEQ ID NO: 516154 - RNA, 16 nt, Chlamydophila pneumoniae CWL029
auaucagcagcuucua

SEQ ID NO: 516155 - RNA, 13 nt, Chlamydophila pneumoniae CWL029
auaucagcuucuu

SEQ ID NO: 516156 - RNA, 20 nt, Chlamydophila pneumoniae CWL029
auaucaugcaauacuuuucu

SEQ ID NO: 516157 - RNA, 18 nt, Chlamydophila pneumoniae CWL029
auauccguagguguuaag

SEQ ID NO: 516158 - RNA, 12 nt, Chlamydophila pneumoniae CWL029
auauccagaaau

SEQ ID NO: 516159 - RNA, 17 nt, Chlamydophila pneumoniae CWL029
auauccaaugagagaga

SEQ ID NO: 516160 - RNA, 16 nt, Chlamydophila pneumoniae CWL029
auauagguuaagccaa

SEQ ID NO: 516161 - RNA, 22 nt, Chlamydophila pneumoniae CWL029
auauagguuuagauugccuuug

SEQ ID NO: 516162 - RNA, 19 nt, Chlamydophila pneumoniae CWL029
auauagggagacuuugcca

SEQ ID NO: 516163 - RNA, 13 nt, Chlamydophila pneumoniae CWL029
auauacaauccag

SEQ ID NO: 516164 - RNA, 16 nt, Chlamydophila pneumoniae CWL029
auaguuaaauuuccaa

SEQ ID NO: 516165 - RNA, 23 nt, Chlamydophila pneumoniae CWL029
auaguguauaucagcaaaaaacu

SEQ ID NO: 516166 - RNA, 21 nt, Chlamydophila pneumoniae CWL029
auagucuguuuuggaaagaag

SEQ ID NO: 516167 - RNA, 15 nt, Chlamydophila pneumoniae CWL029
auacucuuugcagug

SEQ ID NO: 516168 - RNA, 15 nt, Chlamydophila pneumoniae CWL029
auacuacucucauca

SEQ ID NO: 516169 - RNA, 22 nt, Chlamydophila pneumoniae CWL029
auacuaagaagcucacucuuua

SEQ ID NO: 516170 - RNA, 13 nt, Chlamydophila pneumoniae CWL029
auacguuuuuccc

SEQ ID NO: 516171 - RNA, 19 nt, Chlamydophila pneumoniae CWL029
auacuaaaacuacaacagg

SEQ ID NO: 516172 - RNA, 16 nt, Chlamydophila pneumoniae CWL029
auaccguuuuaggaag

SEQ ID NO: 516173 - RNA, 12 nt, Chlamydophila pneumoniae CWL029
auaccuacuaaa

SEQ ID NO: 516174 - RNA, 22 nt, Chlamydophila pneumoniae CWL029
auaccuagagcucugaaauaaa

SEQ ID NO: 516175 - RNA, 17 nt, Chlamydophila pneumoniae CWL029
auacgugcuugaauauu

SEQ ID NO: 516176 - RNA, 22 nt, Chlamydophila pneumoniae CWL029
auacgguauaccauguuaucaa

SEQ ID NO: 516177 - RNA, 20 nt, Chlamydophila pneumoniae CWL029
auacguaauccagauuguuc

SEQ ID NO: 516178 - RNA, 16 nt, Chlamydophila pneumoniae CWL029
auacguaguccuuauu

SEQ ID NO: 516179 - RNA, 17 nt, Chlamydophila pneumoniae CWL029
auacguaguccuuauuu

SEQ ID NO: 516180 - RNA, 21 nt, Chlamydophila pneumoniae CWL029
auacggacuucacaaagaacc

SEQ ID NO: 516181 - RNA, 14 nt, Chlamydophila pneumoniae CWL029
auacgcuuuucuuc

SEQ ID NO: 516182 - RNA, 13 nt, Chlamydophila pneumoniae CWL029
auagaaaguacag

SEQ ID NO: 516183 - RNA, 18 nt, Chlamydophila pneumoniae CWL029
auagaaaguacagauuuc

SEQ ID NO: 516184 - RNA, 18 nt, Chlamydophila pneumoniae CWL029
auacuguuaacaaguacc

SEQ ID NO: 516185 - RNA, 17 nt, Chlamydophila pneumoniae CWL029
auacuguuuuucuucca

SEQ ID NO: 516186 - RNA, 20 nt, Chlamydophila pneumoniae CWL029
auagaaauaagcaucuagaa

SEQ ID NO: 516187 - RNA, 20 nt, Chlamydophila pneumoniae CWL029
auagaacgaauuucaacagc

SEQ ID NO: 516188 - RNA, 21 nt, Chlamydophila pneumoniae CWL029
auagacacuugcuuaaggaaa

SEQ ID NO: 516189 - RNA, 22 nt, Chlamydophila pneumoniae CWL029
auagacaggauggaaucaggga

SEQ ID NO: 516190 - RNA, 17 nt, Chlamydophila pneumoniae CWL029
auagaccccccauucca

SEQ ID NO: 516191 - RNA, 17 nt, Chlamydophila pneumoniae CWL029
auagagagaaugacuuu

SEQ ID NO: 516192 - RNA, 15 nt, Chlamydophila pneumoniae CWL029
auagaagcugcugcu

SEQ ID NO: 516193 - RNA, 14 nt, Chlamydophila pneumoniae CWL029
auagaagcuguaaa

SEQ ID NO: 516194 - RNA, 15 nt, Chlamydophila pneumoniae CWL029
auagaauacacagcu

SEQ ID NO: 516195 - RNA, 14 nt, Chlamydophila pneumoniae CWL029
auagaauagaaugu

SEQ ID NO: 516196 - RNA, 17 nt, Chlamydophila pneumoniae CWL029
auagaauacacagcuau

SEQ ID NO: 516197 - RNA, 19 nt, Chlamydophila pneumoniae CWL029
auagaauccucggaagaua

SEQ ID NO: 516198 - RNA, 17 nt, Chlamydophila pneumoniae CWL029
auaccaucucuuucuau

SEQ ID NO: 516199 - RNA, 15 nt, Chlamydophila pneumoniae CWL029
auaccaaggcugcug

SEQ ID NO: 516200 - RNA, 23 nt, Chlamydophila pneumoniae CWL029
auaccaagaugucuccaaagaua

SEQ ID NO: 516201 - RNA, 21 nt, Chlamydophila pneumoniae CWL029
auaccacagcuguacagaaca

SEQ ID NO: 516202 - RNA, 22 nt, Chlamydophila pneumoniae CWL029
auaccacagcuguacagaacaa

SEQ ID NO: 516203 - RNA, 17 nt, Chlamydophila pneumoniae CWL029
auaccacuacugagcuu

SEQ ID NO: 516204 - RNA, 18 nt, Chlamydophila pneumoniae CWL029
auaauucugcacauccgu

SEQ ID NO: 516205 - RNA, 14 nt, Chlamydophila pneumoniae CWL029
auacaguuggcguu

SEQ ID NO: 516206 - RNA, 13 nt, Chlamydophila pneumoniae CWL029
auacauagggaaa

SEQ ID NO: 516207 - RNA, 22 nt, Chlamydophila pneumoniae CWL029
auacauaucuccuuuaaauaaa

SEQ ID NO: 516208 - RNA, 22 nt, Chlamydophila pneumoniae CWL029
auacaucccauucaauaauuuc

SEQ ID NO: 516209 - RNA, 16 nt, Chlamydophila pneumoniae CWL029
auacaucaaaaugcug

SEQ ID NO: 516210 - RNA, 23 nt, Chlamydophila pneumoniae CWL029
auacaucaccacugcuccaauuu

SEQ ID NO: 516211 - RNA, 18 nt, Chlamydophila pneumoniae CWL029
auacauccucacuagaga

SEQ ID NO: 516212 - RNA, 22 nt, Chlamydophila pneumoniae CWL029
auacaucuuaagagcaaacauc

SEQ ID NO: 516213 - RNA, 14 nt, Chlamydophila pneumoniae CWL029
auacauucuauucu

SEQ ID NO: 516214 - RNA, 16 nt, Chlamydophila pneumoniae CWL029
aucacagcaaucugca

SEQ ID NO: 516215 - RNA, 14 nt, Chlamydophila pneumoniae CWL029
aucacauaaaucaa

SEQ ID NO: 516216 - RNA, 22 nt, Chlamydophila pneumoniae CWL029
aucacacuuaaagguaaaacua

SEQ ID NO: 516217 - RNA, 13 nt, Chlamydophila pneumoniae CWL029
aucacacuuucau

SEQ ID NO: 516218 - RNA, 19 nt, Chlamydophila pneumoniae CWL029
aucacauuccaagaaaaau

SEQ ID NO: 516219 - RNA, 15 nt, Chlamydophila pneumoniae CWL029
aucacaucaguuaac

SEQ ID NO: 516220 - RNA, 17 nt, Chlamydophila pneumoniae CWL029
aucacauagaaaacaua

SEQ ID NO: 516221 - RNA, 15 nt, Chlamydophila pneumoniae CWL029
aucacaauuuuaaaa

SEQ ID NO: 516222 - RNA, 19 nt, Chlamydophila pneumoniae CWL029
aucacaaauugucugagga

SEQ ID NO: 516223 - RNA, 14 nt, Chlamydophila pneumoniae CWL029
aucaauucgcucag

SEQ ID NO: 516224 - RNA, 17 nt, Chlamydophila pneumoniae CWL029
aucacgaaaaggagaau

SEQ ID NO: 516225 - RNA, 14 nt, Chlamydophila pneumoniae CWL029
aucacgaaaaggag

SEQ ID NO: 516226 - RNA, 15 nt, Chlamydophila pneumoniae CWL029
aucacgaaaaggaga

SEQ ID NO: 516227 - RNA, 21 nt, Chlamydophila pneumoniae CWL029
aucaccuucggaucuucccau

SEQ ID NO: 516228 - RNA, 16 nt, Chlamydophila pneumoniae CWL029
aucaguaaaagacuga

SEQ ID NO: 516229 - RNA, 22 nt, Chlamydophila pneumoniae CWL029
aaaacggcuguacuuccccaaa

SEQ ID NO: 516230 - RNA, 15 nt, Chlamydophila pneumoniae CWL029
aaaacggauagggcu

SEQ ID NO: 516231 - RNA, 20 nt, Chlamydophila pneumoniae CWL029
aaaacgguaaauaucuuaac

SEQ ID NO: 516232 - RNA, 17 nt, Chlamydophila pneumoniae CWL029
aucaggauucuaaaaag

SEQ ID NO: 516233 - RNA, 22 nt, Chlamydophila pneumoniae CWL029
aucaggauucuaaaaagaaaag

SEQ ID NO: 516234 - RNA, 18 nt, Chlamydophila pneumoniae CWL029
aucagaaucuaaguaaaa

SEQ ID NO: 516235 - RNA, 19 nt, Chlamydophila pneumoniae CWL029
aucagaauccugaguaaaa

SEQ ID NO: 516236 - RNA, 21 nt, Chlamydophila pneumoniae CWL029
aucagaauccugaguaaaauc

SEQ ID NO: 516237 - RNA, 19 nt, Chlamydophila pneumoniae CWL029
aucagaagguaaauuuuua

SEQ ID NO: 516238 - RNA, 20 nt, Chlamydophila pneumoniae CWL029
aucagaaaugaagccaaaag

SEQ ID NO: 516239 - RNA, 23 nt, Chlamydophila pneumoniae CWL029
aucagaacaacgcugcuucucua

SEQ ID NO: 516240 - RNA, 17 nt, Chlamydophila pneumoniae CWL029
auauucuuucaaaccac

SEQ ID NO: 516241 - RNA, 13 nt, Chlamydophila pneumoniae CWL029
auauucuaaaggg

SEQ ID NO: 516242 - RNA, 21 nt, Chlamydophila pneumoniae CWL029
auauucuaaggugcuauuuua

SEQ ID NO: 516243 - RNA, 15 nt, Chlamydophila pneumoniae CWL029
auauucucgaaaaau

SEQ ID NO: 516244 - RNA, 17 nt, Chlamydophila pneumoniae CWL029
auauucucgaaaaauuu

SEQ ID NO: 516245 - RNA, 23 nt, Chlamydophila pneumoniae CWL029
auauucugaaauuucugaaacaa

SEQ ID NO: 516246 - RNA, 14 nt, Chlamydophila pneumoniae CWL029
auauucugauucuc

SEQ ID NO: 516247 - RNA, 16 nt, Chlamydophila pneumoniae CWL029
auauuuacgaaaacau

SEQ ID NO: 516248 - RNA, 15 nt, Chlamydophila pneumoniae CWL029
auauuuagagagaaa

SEQ ID NO: 516249 - RNA, 22 nt, Chlamydophila pneumoniae CWL029
aucaaaaauagcaggauagcaa

SEQ ID NO: 516250 - RNA, 12 nt, Chlamydophila pneumoniae CWL029
aucaaaaaugau

SEQ ID NO: 516251 - RNA, 14 nt, Chlamydophila pneumoniae CWL029
aucaaaaaaaagac

SEQ ID NO: 516252 - RNA, 15 nt, Chlamydophila pneumoniae CWL029
aucaaaguauauauu

SEQ ID NO: 516253 - RNA, 16 nt, Chlamydophila pneumoniae CWL029
aucaaaguauauauuu

SEQ ID NO: 516254 - RNA, 14 nt, Chlamydophila pneumoniae CWL029
aucaaagcaaagag

SEQ ID NO: 516255 - RNA, 12 nt, Chlamydophila pneumoniae CWL029
aucaaagaauua

SEQ ID NO: 516256 - RNA, 20 nt, Chlamydophila pneumoniae CWL029
aucaaauucaaccaaacguc

SEQ ID NO: 516257 - RNA, 14 nt, Chlamydophila pneumoniae CWL029
aucaacauucuucu

SEQ ID NO: 516258 - RNA, 22 nt, Chlamydophila pneumoniae CWL029
aucaacauucuucugucuguau

SEQ ID NO: 516259 - RNA, 22 nt, Chlamydophila pneumoniae CWL029
aucaaccgaagauccuagagaa

SEQ ID NO: 516260 - RNA, 14 nt, Chlamydophila pneumoniae CWL029
aucaacucuccauc

SEQ ID NO: 516261 - RNA, 16 nt, Chlamydophila pneumoniae CWL029
aucaacucuccauccu

SEQ ID NO: 516262 - RNA, 14 nt, Chlamydophila pneumoniae CWL029
auauggaauggcuu

SEQ ID NO: 516263 - RNA, 16 nt, Chlamydophila pneumoniae CWL029
auaugcuuuucaaaua

SEQ ID NO: 516264 - RNA, 19 nt, Chlamydophila pneumoniae CWL029
auaugcuuggcaauagcuu

SEQ ID NO: 516265 - RNA, 23 nt, Chlamydophila pneumoniae CWL029
auaugcucgugcgacugcucuuu

SEQ ID NO: 516266 - RNA, 13 nt, Chlamydophila pneumoniae CWL029
auaugcucucccg

SEQ ID NO: 516267 - RNA, 17 nt, Chlamydophila pneumoniae CWL029
auaugcucgugcgacug

SEQ ID NO: 516268 - RNA, 21 nt, Chlamydophila pneumoniae CWL029
auauggcugucacggaagaac

SEQ ID NO: 516269 - RNA, 23 nt, Chlamydophila pneumoniae CWL029
auauggguguaaauuuuuccuuc

SEQ ID NO: 516270 - RNA, 19 nt, Chlamydophila pneumoniae CWL029
auauguccgugagcaacaa

SEQ ID NO: 516271 - RNA, 15 nt, Chlamydophila pneumoniae CWL029
auaugucgcuuucau

SEQ ID NO: 516272 - RNA, 20 nt, Chlamydophila pneumoniae CWL029
augacacagagaacaauaaa

SEQ ID NO: 516273 - RNA, 13 nt, Chlamydophila pneumoniae CWL029
augaccuuauagu

SEQ ID NO: 516274 - RNA, 15 nt, Chlamydophila pneumoniae CWL029
augaccuuuaggaac

SEQ ID NO: 516275 - RNA, 14 nt, Chlamydophila pneumoniae CWL029
augaccgcaaggag

SEQ ID NO: 516276 - RNA, 14 nt, Chlamydophila pneumoniae CWL029
augagaguaaguuu

SEQ ID NO: 516277 - RNA, 19 nt, Chlamydophila pneumoniae CWL029
augagauccaaagccugaa

SEQ ID NO: 516278 - RNA, 13 nt, Chlamydophila pneumoniae CWL029
augagauccaaag

SEQ ID NO: 516279 - RNA, 17 nt, Chlamydophila pneumoniae CWL029
augagaacguaagcuuu

SEQ ID NO: 516280 - RNA, 22 nt, Chlamydophila pneumoniae CWL029
augagaacgucuaaagacgaag

SEQ ID NO: 516281 - RNA, 15 nt, Chlamydophila pneumoniae CWL029
augaaaccuucagau

SEQ ID NO: 516282 - RNA, 16 nt, Chlamydophila pneumoniae CWL029
augaaacgaaagcagu

SEQ ID NO: 516283 - RNA, 19 nt, Chlamydophila pneumoniae CWL029
augaaaaaagaauaaaaau

SEQ ID NO: 516284 - RNA, 17 nt, Chlamydophila pneumoniae CWL029
augaaaggcucguagau

SEQ ID NO: 516285 - RNA, 14 nt, Chlamydophila pneumoniae CWL029
augaaagcuguauu

SEQ ID NO: 516286 - RNA, 12 nt, Chlamydophila pneumoniae CWL029
augaagaaaaau

SEQ ID NO: 516287 - RNA, 23 nt, Chlamydophila pneumoniae CWL029
augaagagaguucucucuucacu

SEQ ID NO: 516288 - RNA, 19 nt, Chlamydophila pneumoniae CWL029
augaagagugguuccugaa

SEQ ID NO: 516289 - RNA, 16 nt, Chlamydophila pneumoniae CWL029
augacaacagagacaa

SEQ ID NO: 516290 - RNA, 20 nt, Chlamydophila pneumoniae CWL029
augacaaaggguuucuuucc

SEQ ID NO: 516291 - RNA, 20 nt, Chlamydophila pneumoniae CWL029
augaauaccagaagcaaagg

SEQ ID NO: 516292 - RNA, 15 nt, Chlamydophila pneumoniae CWL029
aucuuucucuaaaau

SEQ ID NO: 516293 - RNA, 17 nt, Chlamydophila pneumoniae CWL029
aucuuuggcacaauccu

SEQ ID NO: 516294 - RNA, 20 nt, Chlamydophila pneumoniae CWL029
aucuuuggguucuuccauaa

SEQ ID NO: 516295 - RNA, 17 nt, Chlamydophila pneumoniae CWL029
aucuuuggguucuucca

SEQ ID NO: 516296 - RNA, 14 nt, Chlamydophila pneumoniae CWL029
aucuuuucuacuuc

SEQ ID NO: 516297 - RNA, 13 nt, Chlamydophila pneumoniae CWL029
aucuuuucuagaa

SEQ ID NO: 516298 - RNA, 15 nt, Chlamydophila pneumoniae CWL029
aucuuuucuagaaaa

SEQ ID NO: 516299 - RNA, 22 nt, Chlamydophila pneumoniae CWL029
aucuuuucuagaaaacgccaac

SEQ ID NO: 516300 - RNA, 22 nt, Chlamydophila pneumoniae CWL029
aucuuuucuuguaagacuaaaa

SEQ ID NO: 516301 - RNA, 23 nt, Chlamydophila pneumoniae CWL029
aucuuuugauuaggcuucagaga

SEQ ID NO: 516302 - RNA, 23 nt, Chlamydophila pneumoniae CWL029
aucuuuugguugugucaacccuu

SEQ ID NO: 516303 - RNA, 16 nt, Chlamydophila pneumoniae CWL029
aucuuuuuuaaagcua

SEQ ID NO: 516304 - RNA, 12 nt, Chlamydophila pneumoniae CWL029
aucuuuuuuaaa

SEQ ID NO: 516305 - RNA, 14 nt, Chlamydophila pneumoniae CWL029
aucuuuagaauaag

SEQ ID NO: 516306 - RNA, 14 nt, Chlamydophila pneumoniae CWL029
aucuuuagaaucaa

SEQ ID NO: 516307 - RNA, 21 nt, Chlamydophila pneumoniae CWL029
aucuuuaagauuuuuagaaua

SEQ ID NO: 516308 - RNA, 16 nt, Chlamydophila pneumoniae CWL029
aucuuuaagauuuuua

SEQ ID NO: 516309 - RNA, 17 nt, Chlamydophila pneumoniae CWL029
aucuuuaagauuuuuag

SEQ ID NO: 516310 - RNA, 11 nt, Chlamydophila pneumoniae CWL029
aucuuguugua

SEQ ID NO: 516311 - RNA, 23 nt, Chlamydophila pneumoniae CWL029
aucuuuaaauucgccaaacgaau

SEQ ID NO: 516312 - RNA, 19 nt, Chlamydophila pneumoniae CWL029
aucuugagccacuuuuaau

SEQ ID NO: 516313 - RNA, 16 nt, Chlamydophila pneumoniae CWL029
aucuugauaaaagaua

SEQ ID NO: 516314 - RNA, 21 nt, Chlamydophila pneumoniae CWL029
aucuugauauugaaagaucau

SEQ ID NO: 516315 - RNA, 14 nt, Chlamydophila pneumoniae CWL029
aucuugauuaggaa

SEQ ID NO: 516316 - RNA, 23 nt, Chlamydophila pneumoniae CWL029
aucuucuucuggcugagagaagc

SEQ ID NO: 516317 - RNA, 21 nt, Chlamydophila pneumoniae CWL029
aucuucuuagccaaaauuucc

SEQ ID NO: 516318 - RNA, 14 nt, Chlamydophila pneumoniae CWL029
aucuugagaaaaga

SEQ ID NO: 516319 - RNA, 16 nt, Chlamydophila pneumoniae CWL029
aucuugagaaaagaac

SEQ ID NO: 516320 - RNA, 13 nt, Chlamydophila pneumoniae CWL029
aucuugaaaagau

SEQ ID NO: 516321 - RNA, 15 nt, Chlamydophila pneumoniae CWL029
aucuugaacagagac

SEQ ID NO: 516322 - RNA, 15 nt, Chlamydophila pneumoniae CWL029
aucuucugaaaucaa

SEQ ID NO: 516323 - RNA, 16 nt, Chlamydophila pneumoniae CWL029
aucuucugaaaucaaa

SEQ ID NO: 516324 - RNA, 11 nt, Chlamydophila pneumoniae CWL029
aucuucucuau

SEQ ID NO: 516325 - RNA, 15 nt, Chlamydophila pneumoniae CWL029
aucuguuaaaaacaa

SEQ ID NO: 516326 - RNA, 16 nt, Chlamydophila pneumoniae CWL029
aucucaaaaucaaaua

SEQ ID NO: 516327 - RNA, 13 nt, Chlamydophila pneumoniae CWL029
aucucaaaaucaa

SEQ ID NO: 516328 - RNA, 21 nt, Chlamydophila pneumoniae CWL029
aucucaagaguaggcaauaca

SEQ ID NO: 516329 - RNA, 17 nt, Chlamydophila pneumoniae CWL029
aucucccaagacgagaa

SEQ ID NO: 516330 - RNA, 21 nt, Chlamydophila pneumoniae CWL029
aucucaaugcgauaaccacua

SEQ ID NO: 516331 - RNA, 23 nt, Chlamydophila pneumoniae CWL029
aucuccagguagcagaguuuuuc

SEQ ID NO: 516332 - RNA, 20 nt, Chlamydophila pneumoniae CWL029
aucuccccauucacaaaucu

SEQ ID NO: 516333 - RNA, 15 nt, Chlamydophila pneumoniae CWL029
aucucuaguucuaga

SEQ ID NO: 516334 - RNA, 17 nt, Chlamydophila pneumoniae CWL029
aucucuuaaaacaugag

SEQ ID NO: 516335 - RNA, 13 nt, Chlamydophila pneumoniae CWL029
aucucuuaaaaua

SEQ ID NO: 516336 - RNA, 16 nt, Chlamydophila pneumoniae CWL029
aucucuuaaaauauua

SEQ ID NO: 516337 - RNA, 22 nt, Chlamydophila pneumoniae CWL029
aucucuuaaaauauuaaauuca

SEQ ID NO: 516338 - RNA, 16 nt, Chlamydophila pneumoniae CWL029
aucucugugguuccug

SEQ ID NO: 516339 - RNA, 18 nt, Chlamydophila pneumoniae CWL029
aucucgggagaacaugcc

SEQ ID NO: 516340 - RNA, 20 nt, Chlamydophila pneumoniae CWL029
aucucguacguggaaaguag

SEQ ID NO: 516341 - RNA, 22 nt, Chlamydophila pneumoniae CWL029
aucucguagcucaggaaaacuu

SEQ ID NO: 516342 - RNA, 12 nt, Chlamydophila pneumoniae CWL029
aucugcauucca

SEQ ID NO: 516343 - RNA, 15 nt, Chlamydophila pneumoniae CWL029
aucugagcacauuuu

SEQ ID NO: 516344 - RNA, 18 nt, Chlamydophila pneumoniae CWL029
aucugagcacauuuuucu

SEQ ID NO: 516345 - RNA, 18 nt, Chlamydophila pneumoniae CWL029
aucugaugcaccauaaua

SEQ ID NO: 516346 - RNA, 14 nt, Chlamydophila pneumoniae CWL029
aucugauagaacag

SEQ ID NO: 516347 - RNA, 19 nt, Chlamydophila pneumoniae CWL029
aucugcagguaagggaugc

SEQ ID NO: 516348 - RNA, 17 nt, Chlamydophila pneumoniae CWL029
aucugcauaauuuuucu

SEQ ID NO: 516349 - RNA, 21 nt, Chlamydophila pneumoniae CWL029
aucugcagcguuucuagggac

SEQ ID NO: 516350 - RNA, 15 nt, Chlamydophila pneumoniae CWL029
aucuacgagcauuca

SEQ ID NO: 516351 - RNA, 15 nt, Chlamydophila pneumoniae CWL029
aucuaccgugaagau

SEQ ID NO: 516352 - RNA, 21 nt, Chlamydophila pneumoniae CWL029
aucuacauauucguguaaauc

SEQ ID NO: 516353 - RNA, 23 nt, Chlamydophila pneumoniae CWL029
aucuaagaugguuauuauugcuu

SEQ ID NO: 516354 - RNA, 16 nt, Chlamydophila pneumoniae CWL029
aucuaaggcuuugccu

SEQ ID NO: 516355 - RNA, 14 nt, Chlamydophila pneumoniae CWL029
aucuagaaaaugaa

SEQ ID NO: 516356 - RNA, 14 nt, Chlamydophila pneumoniae CWL029
aucuagaaagauuu

SEQ ID NO: 516357 - RNA, 14 nt, Chlamydophila pneumoniae CWL029
aucuaaagaaaugu

SEQ ID NO: 516358 - RNA, 15 nt, Chlamydophila pneumoniae CWL029
aucuaaagaaaugua

SEQ ID NO: 516359 - RNA, 19 nt, Chlamydophila pneumoniae CWL029
aucuaaaagcacuuaaaaa

SEQ ID NO: 516360 - RNA, 16 nt, Chlamydophila pneumoniae CWL029
aucuaacgucagcugu

SEQ ID NO: 516361 - RNA, 21 nt, Chlamydophila pneumoniae CWL029
aucuaacuucaccauauaaua

SEQ ID NO: 516362 - RNA, 20 nt, Chlamydophila pneumoniae CWL029
aucuaaaaacuucccaucuu

SEQ ID NO: 516363 - RNA, 20 nt, Chlamydophila pneumoniae CWL029
aucguuuuguggcuuuucua

SEQ ID NO: 516364 - RNA, 15 nt, Chlamydophila pneumoniae CWL029
aucguuaucaaaagg

SEQ ID NO: 516365 - RNA, 21 nt, Chlamydophila pneumoniae CWL029
aucguguuuuccugagcuuuu

SEQ ID NO: 516366 - RNA, 22 nt, Chlamydophila pneumoniae CWL029
aucgugacucuuaucuggagau

SEQ ID NO: 516367 - RNA, 20 nt, Chlamydophila pneumoniae CWL029
aucgugauugcugucagaac

SEQ ID NO: 516368 - RNA, 23 nt, Chlamydophila pneumoniae CWL029
aucgugauugcugucagaacaag

SEQ ID NO: 516369 - RNA, 18 nt, Chlamydophila pneumoniae CWL029
aucggaguuaucaaaagg

SEQ ID NO: 516370 - RNA, 15 nt, Chlamydophila pneumoniae CWL029
aucggaucuuuucuu

SEQ ID NO: 516371 - RNA, 20 nt, Chlamydophila pneumoniae CWL029
aucggauuuuacucccugaa

SEQ ID NO: 516372 - RNA, 12 nt, Chlamydophila pneumoniae CWL029
aucggauuuuac

SEQ ID NO: 516373 - RNA, 17 nt, Chlamydophila pneumoniae CWL029
aucgucgccuuuuccua

SEQ ID NO: 516374 - RNA, 15 nt, Chlamydophila pneumoniae CWL029
aucgucggaagacuu

SEQ ID NO: 516375 - RNA, 19 nt, Chlamydophila pneumoniae CWL029
aucgcuguaaauucaguga

SEQ ID NO: 516376 - RNA, 18 nt, Chlamydophila pneumoniae CWL029
aucgccuuccuuaacaac

SEQ ID NO: 516377 - RNA, 12 nt, Chlamydophila pneumoniae CWL029
aucgcacuucua

SEQ ID NO: 516378 - RNA, 19 nt, Chlamydophila pneumoniae CWL029
aucgcacuucuauuucugc

SEQ ID NO: 516379 - RNA, 12 nt, Chlamydophila pneumoniae CWL029
aucgcaucaaaa

SEQ ID NO: 516380 - RNA, 20 nt, Chlamydophila pneumoniae CWL029
aucgcaucaaaaaauacaua

SEQ ID NO: 516381 - RNA, 14 nt, Chlamydophila pneumoniae CWL029
aucgaucucugugg

SEQ ID NO: 516382 - RNA, 15 nt, Chlamydophila pneumoniae CWL029
aucgaaaaauaccuc

SEQ ID NO: 516383 - RNA, 19 nt, Chlamydophila pneumoniae CWL029
auccuuucacaaagaauuc

SEQ ID NO: 516384 - RNA, 18 nt, Chlamydophila pneumoniae CWL029
auccuuuccaagaaguca

SEQ ID NO: 516385 - RNA, 16 nt, Chlamydophila pneumoniae CWL029
auccuuucacaaagaa

SEQ ID NO: 516386 - RNA, 17 nt, Chlamydophila pneumoniae CWL029
auccuuucacaaagaau

SEQ ID NO: 516387 - RNA, 18 nt, Chlamydophila pneumoniae CWL029
auccuuucacaaagaauu

SEQ ID NO: 516388 - RNA, 15 nt, Chlamydophila pneumoniae CWL029
auccuuccaagugcu

SEQ ID NO: 516389 - RNA, 18 nt, Chlamydophila pneumoniae CWL029
auccugaguaaaaucaua

SEQ ID NO: 516390 - RNA, 19 nt, Chlamydophila pneumoniae CWL029
auccugcaaagcccccucc

SEQ ID NO: 516391 - RNA, 22 nt, Chlamydophila pneumoniae CWL029
auccugaacaucuccagcagca

SEQ ID NO: 516392 - RNA, 14 nt, Chlamydophila pneumoniae CWL029
auccugaaaguaca

SEQ ID NO: 516393 - RNA, 19 nt, Chlamydophila pneumoniae CWL029
auccucggcaucuuuggca

SEQ ID NO: 516394 - RNA, 13 nt, Chlamydophila pneumoniae CWL029
auccucggaagau

SEQ ID NO: 516395 - RNA, 23 nt, Chlamydophila pneumoniae CWL029
auccucugcugcgacacgaauuu

SEQ ID NO: 516396 - RNA, 13 nt, Chlamydophila pneumoniae CWL029
auccucaucauca

SEQ ID NO: 516397 - RNA, 16 nt, Chlamydophila pneumoniae CWL029
auccucaucaucagaa

SEQ ID NO: 516398 - RNA, 12 nt, Chlamydophila pneumoniae CWL029
auccucaaagag

SEQ ID NO: 516399 - RNA, 18 nt, Chlamydophila pneumoniae CWL029
auccucaggaccuaaggg

SEQ ID NO: 516400 - RNA, 12 nt, Chlamydophila pneumoniae CWL029
auccuaaaaagg

SEQ ID NO: 516401 - RNA, 15 nt, Chlamydophila pneumoniae CWL029
auccuaauuccuuca

SEQ ID NO: 516402 - RNA, 19 nt, Chlamydophila pneumoniae CWL029
auccuacgagcgcuuucuu

SEQ ID NO: 516403 - RNA, 22 nt, Chlamydophila pneumoniae CWL029
auccuagagaaugugcucggca

SEQ ID NO: 516404 - RNA, 17 nt, Chlamydophila pneumoniae CWL029
auccuauaguaauuucu

SEQ ID NO: 516405 - RNA, 17 nt, Chlamydophila pneumoniae CWL029
auccuaaauuaaauauc

SEQ ID NO: 516406 - RNA, 22 nt, Chlamydophila pneumoniae CWL029
auccguagugagguuugcaauu

SEQ ID NO: 516407 - RNA, 18 nt, Chlamydophila pneumoniae CWL029
aucccgaagcaauccagu

SEQ ID NO: 516408 - RNA, 15 nt, Chlamydophila pneumoniae CWL029
aucccgaguccuaaa

SEQ ID NO: 516409 - RNA, 23 nt, Chlamydophila pneumoniae CWL029
aucccaagggagaggucugcucu

SEQ ID NO: 516410 - RNA, 16 nt, Chlamydophila pneumoniae CWL029
aucccaaguauggucc

SEQ ID NO: 516411 - RNA, 21 nt, Chlamydophila pneumoniae CWL029
auccaucggcauuucuccaca

SEQ ID NO: 516412 - RNA, 16 nt, Chlamydophila pneumoniae CWL029
aucccacagaaauguc

SEQ ID NO: 516413 - RNA, 19 nt, Chlamydophila pneumoniae CWL029
auccaguagaucuucugaa

SEQ ID NO: 516414 - RNA, 14 nt, Chlamydophila pneumoniae CWL029
auccagcuccauaa

SEQ ID NO: 516415 - RNA, 21 nt, Chlamydophila pneumoniae CWL029
auccaaacgguuaaugaacuc

SEQ ID NO: 516416 - RNA, 13 nt, Chlamydophila pneumoniae CWL029
auccaaagccuga

SEQ ID NO: 516417 - RNA, 19 nt, Chlamydophila pneumoniae CWL029
auccaaagccugaaaaaua

SEQ ID NO: 516418 - RNA, 19 nt, Chlamydophila pneumoniae CWL029
auccaaagcuauuucucua

SEQ ID NO: 516419 - RNA, 18 nt, Chlamydophila pneumoniae CWL029
auccacauccuuguagaa

SEQ ID NO: 516420 - RNA, 23 nt, Chlamydophila pneumoniae CWL029
auccacagacugcaggaaauuau

SEQ ID NO: 516421 - RNA, 13 nt, Chlamydophila pneumoniae CWL029
auccacagauacg

SEQ ID NO: 516422 - RNA, 13 nt, Chlamydophila pneumoniae CWL029
aaaagaauaaaaa

SEQ ID NO: 516423 - RNA, 15 nt, Chlamydophila pneumoniae CWL029
aaaagaauaaaaaua

SEQ ID NO: 516424 - RNA, 14 nt, Chlamydophila pneumoniae CWL029
aaaagaaucucuga

SEQ ID NO: 516425 - RNA, 22 nt, Chlamydophila pneumoniae CWL029
aaaagaauuccuaaaacgagca

SEQ ID NO: 516426 - RNA, 11 nt, Chlamydophila pneumoniae CWL029
aucauucuuua

SEQ ID NO: 516427 - RNA, 23 nt, Chlamydophila pneumoniae CWL029
aaaagaaccuaggaaauccuccu

SEQ ID NO: 516428 - RNA, 19 nt, Chlamydophila pneumoniae CWL029
aaaacugcgcuaucaucau

SEQ ID NO: 516429 - RNA, 20 nt, Chlamydophila pneumoniae CWL029
aaaacugcgcuaucaucauu

SEQ ID NO: 516430 - RNA, 19 nt, Chlamydophila pneumoniae CWL029
aaaacuguguucaauagca

SEQ ID NO: 516431 - RNA, 20 nt, Chlamydophila pneumoniae CWL029
aucauggacaagcaaaagca

SEQ ID NO: 516432 - RNA, 19 nt, Chlamydophila pneumoniae CWL029
aaaacuccacgccaaagua

SEQ ID NO: 516433 - RNA, 13 nt, Chlamydophila pneumoniae CWL029
aucauaccgacaa

SEQ ID NO: 516434 - RNA, 16 nt, Chlamydophila pneumoniae CWL029
aucauaccgacaagca

SEQ ID NO: 516435 - RNA, 10 nt, Chlamydophila pneumoniae CWL029
aucaucuccc

SEQ ID NO: 516436 - RNA, 17 nt, Chlamydophila pneumoniae CWL029
aucaugcaauacuuuuc

SEQ ID NO: 516437 - RNA, 15 nt, Chlamydophila pneumoniae CWL029
aucaugauaaaaauu

SEQ ID NO: 516438 - RNA, 16 nt, Chlamydophila pneumoniae CWL029
aucaugauauugcguu

SEQ ID NO: 516439 - RNA, 16 nt, Chlamydophila pneumoniae CWL029
aucaugagaauuuuca

SEQ ID NO: 516440 - RNA, 14 nt, Chlamydophila pneumoniae CWL029
aucaugaaaaggau

SEQ ID NO: 516441 - RNA, 22 nt, Chlamydophila pneumoniae CWL029
caaaauguuuaucgacucuucc

SEQ ID NO: 516442 - RNA, 21 nt, Chlamydophila pneumoniae CWL029
caaaauuaccguuuccuccuc

SEQ ID NO: 516443 - RNA, 12 nt, Chlamydophila pneumoniae CWL029
caaaaucucuau

SEQ ID NO: 516444 - RNA, 17 nt, Chlamydophila pneumoniae CWL029
caaaauuauguauaaac

SEQ ID NO: 516445 - RNA, 20 nt, Chlamydophila pneumoniae CWL029
caaaaguaaucacuucagca

SEQ ID NO: 516446 - RNA, 17 nt, Chlamydophila pneumoniae CWL029
caaaagccauuccauau

SEQ ID NO: 516447 - RNA, 21 nt, Chlamydophila pneumoniae CWL029
caaaagccauuccauauccau

SEQ ID NO: 516448 - RNA, 18 nt, Chlamydophila pneumoniae CWL029
caaaagcucuacaagcuc

SEQ ID NO: 516449 - RNA, 20 nt, Chlamydophila pneumoniae CWL029
caaaaggcacaacaaugaca

SEQ ID NO: 516450 - RNA, 15 nt, Chlamydophila pneumoniae CWL029
caaaaaauuuuauag

SEQ ID NO: 516451 - RNA, 21 nt, Chlamydophila pneumoniae CWL029
caaaacgauccuguuccccug

SEQ ID NO: 516452 - RNA, 22 nt, Chlamydophila pneumoniae CWL029
caaaaccuggauugauccacag

SEQ ID NO: 516453 - RNA, 11 nt, Chlamydophila pneumoniae CWL029
caaaagaaaag

SEQ ID NO: 516454 - RNA, 19 nt, Chlamydophila pneumoniae CWL029
caaaagaaaucaaacauua

SEQ ID NO: 516455 - RNA, 13 nt, Chlamydophila pneumoniae CWL029
caaaagaccaaaa

SEQ ID NO: 516456 - RNA, 14 nt, Chlamydophila pneumoniae CWL029
caaaagaccaaaaa

SEQ ID NO: 516457 - RNA, 16 nt, Chlamydophila pneumoniae CWL029
caaaagaauuccuaaa

SEQ ID NO: 516458 - RNA, 23 nt, Chlamydophila pneumoniae CWL029
caaaagaauuccuaaaacgagca

SEQ ID NO: 516459 - RNA, 12 nt, Chlamydophila pneumoniae CWL029
caaagcaaagag

SEQ ID NO: 516460 - RNA, 15 nt, Chlamydophila pneumoniae CWL029
caaagcaaagagcaa

SEQ ID NO: 516461 - RNA, 14 nt, Chlamydophila pneumoniae CWL029
caaagcaaagagca

SEQ ID NO: 516462 - RNA, 12 nt, Chlamydophila pneumoniae CWL029
caaagauugcua

SEQ ID NO: 516463 - RNA, 12 nt, Chlamydophila pneumoniae CWL029
caaagauuccua

SEQ ID NO: 516464 - RNA, 20 nt, Chlamydophila pneumoniae CWL029
caaagauuucugcuguguua

SEQ ID NO: 516465 - RNA, 21 nt, Chlamydophila pneumoniae CWL029
caaagauuucugcuguguuau

SEQ ID NO: 516466 - RNA, 14 nt, Chlamydophila pneumoniae CWL029
caaagccugaaaaa

SEQ ID NO: 516467 - RNA, 17 nt, Chlamydophila pneumoniae CWL029
caaagccggcccacuca

SEQ ID NO: 516468 - RNA, 20 nt, Chlamydophila pneumoniae CWL029
caaagccggcccacucaaaa

SEQ ID NO: 516469 - RNA, 21 nt, Chlamydophila pneumoniae CWL029
caaaggcaauagcagcagcgu

SEQ ID NO: 516470 - RNA, 15 nt, Chlamydophila pneumoniae CWL029
caaaggagaaagaau

SEQ ID NO: 516471 - RNA, 19 nt, Chlamydophila pneumoniae CWL029
caaaggaccacaauuccua

SEQ ID NO: 516472 - RNA, 11 nt, Chlamydophila pneumoniae CWL029
caaaggaaggg

SEQ ID NO: 516473 - RNA, 13 nt, Chlamydophila pneumoniae CWL029
caaagacaggcuc

SEQ ID NO: 516474 - RNA, 17 nt, Chlamydophila pneumoniae CWL029
caaagaacucaacuuuu

SEQ ID NO: 516475 - RNA, 19 nt, Chlamydophila pneumoniae CWL029
caaagaacucaacuuuuuu

SEQ ID NO: 516476 - RNA, 21 nt, Chlamydophila pneumoniae CWL029
caaagaacuuaaaauucaaau

SEQ ID NO: 516477 - RNA, 19 nt, Chlamydophila pneumoniae CWL029
caaagaaaauucucagauu

SEQ ID NO: 516478 - RNA, 19 nt, Chlamydophila pneumoniae CWL029
caaagaacacccccgcagc

SEQ ID NO: 516479 - RNA, 15 nt, Chlamydophila pneumoniae CWL029
caaagaacagcacuc

SEQ ID NO: 516480 - RNA, 20 nt, Chlamydophila pneumoniae CWL029
caaagaacagcacucucugc

SEQ ID NO: 516481 - RNA, 20 nt, Chlamydophila pneumoniae CWL029
caaagaugcagauacuaaac

SEQ ID NO: 516482 - RNA, 16 nt, Chlamydophila pneumoniae CWL029
caaagaugcgcucgga

SEQ ID NO: 516483 - RNA, 13 nt, Chlamydophila pneumoniae CWL029
caaagauuccuaa

SEQ ID NO: 516484 - RNA, 23 nt, Chlamydophila pneumoniae CWL029
caaagaucaguuuuuucuucuga

SEQ ID NO: 516485 - RNA, 13 nt, Chlamydophila pneumoniae CWL029
caaagaucacuga

SEQ ID NO: 516486 - RNA, 18 nt, Chlamydophila pneumoniae CWL029
caaagacuagagucacua

SEQ ID NO: 516487 - RNA, 23 nt, Chlamydophila pneumoniae CWL029
caaagacuagagucacuagcaga

SEQ ID NO: 516488 - RNA, 14 nt, Chlamydophila pneumoniae CWL029
caaaccuccuagaa

SEQ ID NO: 516489 - RNA, 13 nt, Chlamydophila pneumoniae CWL029
caaaccucuaaaa

SEQ ID NO: 516490 - RNA, 19 nt, Chlamydophila pneumoniae CWL029
caaaccauccgacuuuccu

SEQ ID NO: 516491 - RNA, 23 nt, Chlamydophila pneumoniae CWL029
caaaccaucugcguuuaaggguu

SEQ ID NO: 516492 - RNA, 21 nt, Chlamydophila pneumoniae CWL029
caaaccacggauuuucucuac

SEQ ID NO: 516493 - RNA, 13 nt, Chlamydophila pneumoniae CWL029
caaacaagaagcg

SEQ ID NO: 516494 - RNA, 18 nt, Chlamydophila pneumoniae CWL029
caaacuuguuuucguaag

SEQ ID NO: 516495 - RNA, 23 nt, Chlamydophila pneumoniae CWL029
caaacuuguuuucguaagagaau

SEQ ID NO: 516496 - RNA, 21 nt, Chlamydophila pneumoniae CWL029
caaacuuucuuuucuauauuc

SEQ ID NO: 516497 - RNA, 12 nt, Chlamydophila pneumoniae CWL029
caaacgaauuuc

SEQ ID NO: 516498 - RNA, 20 nt, Chlamydophila pneumoniae CWL029
caaacgaauuucuuguucca

SEQ ID NO: 516499 - RNA, 18 nt, Chlamydophila pneumoniae CWL029
caaacggaacuaaagaga

SEQ ID NO: 516500 - RNA, 15 nt, Chlamydophila pneumoniae CWL029
caacaguaauuauuu

SEQ ID NO: 516501 - RNA, 16 nt, Chlamydophila pneumoniae CWL029
caacagcuaauacauc

SEQ ID NO: 516502 - RNA, 15 nt, Chlamydophila pneumoniae CWL029
caacaguucuuucug

SEQ ID NO: 516503 - RNA, 12 nt, Chlamydophila pneumoniae CWL029
caacaucaugaa

SEQ ID NO: 516504 - RNA, 12 nt, Chlamydophila pneumoniae CWL029
caacauaaagaa

SEQ ID NO: 516505 - RNA, 17 nt, Chlamydophila pneumoniae CWL029
caacauaacaugagaaa

SEQ ID NO: 516506 - RNA, 12 nt, Chlamydophila pneumoniae CWL029
caacauccauuc

SEQ ID NO: 516507 - RNA, 21 nt, Chlamydophila pneumoniae CWL029
caacaaaggcuccaaacgcaa

SEQ ID NO: 516508 - RNA, 17 nt, Chlamydophila pneumoniae CWL029
caacacccggcuuuucc

SEQ ID NO: 516509 - RNA, 15 nt, Chlamydophila pneumoniae CWL029
caacagcaacacucg

SEQ ID NO: 516510 - RNA, 16 nt, Chlamydophila pneumoniae CWL029
caaccaguugagucaa

SEQ ID NO: 516511 - RNA, 18 nt, Chlamydophila pneumoniae CWL029
caacaugcgcguauaagg

SEQ ID NO: 516512 - RNA, 21 nt, Chlamydophila pneumoniae CWL029
caaaucauuuaaagcugaaau

SEQ ID NO: 516513 - RNA, 13 nt, Chlamydophila pneumoniae CWL029
caaaucaucaaaa

SEQ ID NO: 516514 - RNA, 14 nt, Chlamydophila pneumoniae CWL029
caaaguauauauuu

SEQ ID NO: 516515 - RNA, 20 nt, Chlamydophila pneumoniae CWL029
caaagucaaauacuucuccu

SEQ ID NO: 516516 - RNA, 20 nt, Chlamydophila pneumoniae CWL029
caaauauaguuuucauaauc

SEQ ID NO: 516517 - RNA, 18 nt, Chlamydophila pneumoniae CWL029
caaauauugcgaacuuuu

SEQ ID NO: 516518 - RNA, 22 nt, Chlamydophila pneumoniae CWL029
caaauguucucuccagcugugg

SEQ ID NO: 516519 - RNA, 14 nt, Chlamydophila pneumoniae CWL029
caaaugaaaagaga

SEQ ID NO: 516520 - RNA, 19 nt, Chlamydophila pneumoniae CWL029
caaaucuuccccuaaaaau

SEQ ID NO: 516521 - RNA, 21 nt, Chlamydophila pneumoniae CWL029
caaaucuaucugcacuuucuu

SEQ ID NO: 516522 - RNA, 15 nt, Chlamydophila pneumoniae CWL029
caaaucuaaaaccug

SEQ ID NO: 516523 - RNA, 23 nt, Chlamydophila pneumoniae CWL029
caaauuccuucucagaaagauau

SEQ ID NO: 516524 - RNA, 13 nt, Chlamydophila pneumoniae CWL029
caaauguucucuc

SEQ ID NO: 516525 - RNA, 19 nt, Chlamydophila pneumoniae CWL029
caaauuucauuuagacaau

SEQ ID NO: 516526 - RNA, 19 nt, Chlamydophila pneumoniae CWL029
caaauuuaucggcuaaaga

SEQ ID NO: 516527 - RNA, 23 nt, Chlamydophila pneumoniae CWL029
caaauuuaucggcuaaagaaaag

SEQ ID NO: 516528 - RNA, 22 nt, Chlamydophila pneumoniae CWL029
caagcauccuagaacuugggau

SEQ ID NO: 516529 - RNA, 14 nt, Chlamydophila pneumoniae CWL029
caagcauccuagaa

SEQ ID NO: 516530 - RNA, 14 nt, Chlamydophila pneumoniae CWL029
caagcauaaacucc

SEQ ID NO: 516531 - RNA, 23 nt, Chlamydophila pneumoniae CWL029
caagcaggugugugguaaaaaua

SEQ ID NO: 516532 - RNA, 16 nt, Chlamydophila pneumoniae CWL029
caagcaguaacugcaa

SEQ ID NO: 516533 - RNA, 23 nt, Chlamydophila pneumoniae CWL029
caagcaguaacugcaaagagaau

SEQ ID NO: 516534 - RNA, 16 nt, Chlamydophila pneumoniae CWL029
caagauggcaacaacu

SEQ ID NO: 516535 - RNA, 14 nt, Chlamydophila pneumoniae CWL029
caagaucuccgccu

SEQ ID NO: 516536 - RNA, 15 nt, Chlamydophila pneumoniae CWL029
caagaugucuccaaa

SEQ ID NO: 516537 - RNA, 14 nt, Chlamydophila pneumoniae CWL029
caagauuaucuuua

SEQ ID NO: 516538 - RNA, 22 nt, Chlamydophila pneumoniae CWL029
caagauuaucuuuacgaaucac

SEQ ID NO: 516539 - RNA, 22 nt, Chlamydophila pneumoniae CWL029
caagcucuggauugaaagagcu

SEQ ID NO: 516540 - RNA, 14 nt, Chlamydophila pneumoniae CWL029
caagcucaagagca

SEQ ID NO: 516541 - RNA, 19 nt, Chlamydophila pneumoniae CWL029
caagcucaagagcaugcuu

SEQ ID NO: 516542 - RNA, 17 nt, Chlamydophila pneumoniae CWL029
caagagacaagaaaaua

SEQ ID NO: 516543 - RNA, 17 nt, Chlamydophila pneumoniae CWL029
caagauacuacuuacaa

SEQ ID NO: 516544 - RNA, 20 nt, Chlamydophila pneumoniae CWL029
caagauacuacuuacaagaa

SEQ ID NO: 516545 - RNA, 16 nt, Chlamydophila pneumoniae CWL029
caagauaaaucccacu

SEQ ID NO: 516546 - RNA, 14 nt, Chlamydophila pneumoniae CWL029
caagaucaaacgaa

SEQ ID NO: 516547 - RNA, 22 nt, Chlamydophila pneumoniae CWL029
caagauagugguagcaaucugu

SEQ ID NO: 516548 - RNA, 17 nt, Chlamydophila pneumoniae CWL029
caagaauuucuucuuuc

SEQ ID NO: 516549 - RNA, 24 nt, Chlamydophila pneumoniae CWL029
caagaauuucuucuuuccauagau

SEQ ID NO: 516550 - RNA, 13 nt, Chlamydophila pneumoniae CWL029
caagacaaaguug

SEQ ID NO: 516551 - RNA, 15 nt, Chlamydophila pneumoniae CWL029
caagacaauaaaaaa

SEQ ID NO: 516552 - RNA, 16 nt, Chlamydophila pneumoniae CWL029
caagacaauaaaaaag

SEQ ID NO: 516553 - RNA, 18 nt, Chlamydophila pneumoniae CWL029
caagaaucacugcgugau

SEQ ID NO: 516554 - RNA, 18 nt, Chlamydophila pneumoniae CWL029
caagaauagcaggaagga

SEQ ID NO: 516555 - RNA, 15 nt, Chlamydophila pneumoniae CWL029
caacucuugacaacg

SEQ ID NO: 516556 - RNA, 13 nt, Chlamydophila pneumoniae CWL029
caacucuuuaauu

SEQ ID NO: 516557 - RNA, 14 nt, Chlamydophila pneumoniae CWL029
caacucuuuaauug

SEQ ID NO: 516558 - RNA, 20 nt, Chlamydophila pneumoniae CWL029
caacucuuuaggucuugucu

SEQ ID NO: 516559 - RNA, 23 nt, Chlamydophila pneumoniae CWL029
caacucucuuuaaaccuggcauu

SEQ ID NO: 516560 - RNA, 13 nt, Chlamydophila pneumoniae CWL029
caacucuccaucc

SEQ ID NO: 516561 - RNA, 15 nt, Chlamydophila pneumoniae CWL029
caacucuccauccuc

SEQ ID NO: 516562 - RNA, 22 nt, Chlamydophila pneumoniae CWL029
caacucucccauguaguaaauu

SEQ ID NO: 516563 - RNA, 15 nt, Chlamydophila pneumoniae CWL029
caacucguuucagca

SEQ ID NO: 516564 - RNA, 16 nt, Chlamydophila pneumoniae CWL029
caacuagaccaauaaa

SEQ ID NO: 516565 - RNA, 13 nt, Chlamydophila pneumoniae CWL029
caaccucugcaug

SEQ ID NO: 516566 - RNA, 13 nt, Chlamydophila pneumoniae CWL029
caacgcuucuuuu

SEQ ID NO: 516567 - RNA, 19 nt, Chlamydophila pneumoniae CWL029
caacgcuucuuuuuggaua

SEQ ID NO: 516568 - RNA, 15 nt, Chlamydophila pneumoniae CWL029
caaucgcaucaaaaa

SEQ ID NO: 516569 - RNA, 20 nt, Chlamydophila pneumoniae CWL029
caaucccgaguccuaaaauu

SEQ ID NO: 516570 - RNA, 22 nt, Chlamydophila pneumoniae CWL029
caaucucaaaaucaaauagauu

SEQ ID NO: 516571 - RNA, 16 nt, Chlamydophila pneumoniae CWL029
caaucugcugaaggga

SEQ ID NO: 516572 - RNA, 20 nt, Chlamydophila pneumoniae CWL029
caaucugagcacauuuuucu

SEQ ID NO: 516573 - RNA, 19 nt, Chlamydophila pneumoniae CWL029
caaucuaaagguuuuaaau

SEQ ID NO: 516574 - RNA, 21 nt, Chlamydophila pneumoniae CWL029
caaucuaaaaucacacuaaau

SEQ ID NO: 516575 - RNA, 19 nt, Chlamydophila pneumoniae CWL029
caauccaguagaucuucug

SEQ ID NO: 516576 - RNA, 17 nt, Chlamydophila pneumoniae CWL029
caaucccccagcauuca

SEQ ID NO: 516577 - RNA, 13 nt, Chlamydophila pneumoniae CWL029
caaucagugcugc

SEQ ID NO: 516578 - RNA, 16 nt, Chlamydophila pneumoniae CWL029
caauccaacaaagaug

SEQ ID NO: 516579 - RNA, 18 nt, Chlamydophila pneumoniae CWL029
caauccaacaaagaugac

SEQ ID NO: 516580 - RNA, 18 nt, Chlamydophila pneumoniae CWL029
caaucaacauucuucugu

SEQ ID NO: 516581 - RNA, 13 nt, Chlamydophila pneumoniae CWL029
caaucaauaaaau

SEQ ID NO: 516582 - RNA, 15 nt, Chlamydophila pneumoniae CWL029
caaucacacuacauu

SEQ ID NO: 516583 - RNA, 17 nt, Chlamydophila pneumoniae CWL029
caauacuaaaacuacaa

SEQ ID NO: 516584 - RNA, 17 nt, Chlamydophila pneumoniae CWL029
caauacuaagaagcuca

SEQ ID NO: 516585 - RNA, 20 nt, Chlamydophila pneumoniae CWL029
caauauagaagcugcugcua

SEQ ID NO: 516586 - RNA, 13 nt, Chlamydophila pneumoniae CWL029
caauauagagaac

SEQ ID NO: 516587 - RNA, 21 nt, Chlamydophila pneumoniae CWL029
caauauagagaacuccauuca

SEQ ID NO: 516588 - RNA, 22 nt, Chlamydophila pneumoniae CWL029
caauauagagaacuccauucag

SEQ ID NO: 516589 - RNA, 16 nt, Chlamydophila pneumoniae CWL029
caaguccgugagagga

SEQ ID NO: 516590 - RNA, 20 nt, Chlamydophila pneumoniae CWL029
caaguccugcguuaaacccu

SEQ ID NO: 516591 - RNA, 18 nt, Chlamydophila pneumoniae CWL029
caagugcucaguaaauau

SEQ ID NO: 516592 - RNA, 19 nt, Chlamydophila pneumoniae CWL029
caagugugcggucucaugu

SEQ ID NO: 516593 - RNA, 21 nt, Chlamydophila pneumoniae CWL029
caagugugcggucucauguaa

SEQ ID NO: 516594 - RNA, 22 nt, Chlamydophila pneumoniae CWL029
caaggcaucuucuuugccaaug

SEQ ID NO: 516595 - RNA, 17 nt, Chlamydophila pneumoniae CWL029
caaguaugguccauaau

SEQ ID NO: 516596 - RNA, 14 nt, Chlamydophila pneumoniae CWL029
caaggcaaaaaguu

SEQ ID NO: 516597 - RNA, 19 nt, Chlamydophila pneumoniae CWL029
caaggauuaugaauccuug

SEQ ID NO: 516598 - RNA, 20 nt, Chlamydophila pneumoniae CWL029
caaggaucuuauauaaaacu

SEQ ID NO: 516599 - RNA, 18 nt, Chlamydophila pneumoniae CWL029
caaggagcuuuucguaua

SEQ ID NO: 516600 - RNA, 16 nt, Chlamydophila pneumoniae CWL029
caaguuuuuucaaucc

SEQ ID NO: 516601 - RNA, 22 nt, Chlamydophila pneumoniae CWL029
caauaaaaggguagcgaaugaa

SEQ ID NO: 516602 - RNA, 23 nt, Chlamydophila pneumoniae CWL029
caauaaaaggguagcgaaugaaa

SEQ ID NO: 516603 - RNA, 19 nt, Chlamydophila pneumoniae CWL029
caauaagcuugccagcaga

SEQ ID NO: 516604 - RNA, 21 nt, Chlamydophila pneumoniae CWL029
caauaagcuugccagcagaag

SEQ ID NO: 516605 - RNA, 17 nt, Chlamydophila pneumoniae CWL029
caauacagauaucaaag

SEQ ID NO: 516606 - RNA, 15 nt, Chlamydophila pneumoniae CWL029
caauacagauguaaa

SEQ ID NO: 516607 - RNA, 16 nt, Chlamydophila pneumoniae CWL029
caauacagauguaaau

SEQ ID NO: 516608 - RNA, 20 nt, Chlamydophila pneumoniae CWL029
aaaauaguacgcuuuuuacu

SEQ ID NO: 516609 - RNA, 20 nt, Chlamydophila pneumoniae CWL029
aaaauaggugacuucuuugc

SEQ ID NO: 516610 - RNA, 21 nt, Chlamydophila pneumoniae CWL029
cacgggucaggagguggugga

SEQ ID NO: 516611 - RNA, 18 nt, Chlamydophila pneumoniae CWL029
cacgccuccuucaaagau

SEQ ID NO: 516612 - RNA, 19 nt, Chlamydophila pneumoniae CWL029
cacgccuccuucaaagaua

SEQ ID NO: 516613 - RNA, 20 nt, Chlamydophila pneumoniae CWL029
cacgccuccuucaaagauau

SEQ ID NO: 516614 - RNA, 23 nt, Chlamydophila pneumoniae CWL029
aaaauacauagguaaaaccagca

SEQ ID NO: 516615 - RNA, 15 nt, Chlamydophila pneumoniae CWL029
cacgacauacaucaa

SEQ ID NO: 516616 - RNA, 17 nt, Chlamydophila pneumoniae CWL029
cacgagucccuucuuuc

SEQ ID NO: 516617 - RNA, 17 nt, Chlamydophila pneumoniae CWL029
cacgaggccauccuuuu

SEQ ID NO: 516618 - RNA, 13 nt, Chlamydophila pneumoniae CWL029
aaaauagauaagu

SEQ ID NO: 516619 - RNA, 13 nt, Chlamydophila pneumoniae CWL029
aaaauagauccug

SEQ ID NO: 516620 - RNA, 22 nt, Chlamydophila pneumoniae CWL029
cacgaauccguaccagcugaua

SEQ ID NO: 516621 - RNA, 17 nt, Chlamydophila pneumoniae CWL029
aaaauaaagaucuucau

SEQ ID NO: 516622 - RNA, 14 nt, Chlamydophila pneumoniae CWL029
aaaauaaauuuuau

SEQ ID NO: 516623 - RNA, 12 nt, Chlamydophila pneumoniae CWL029
aaaauaaacucu

SEQ ID NO: 516624 - RNA, 18 nt, Chlamydophila pneumoniae CWL029
caccuaaaguuugagcua

SEQ ID NO: 516625 - RNA, 22 nt, Chlamydophila pneumoniae CWL029
caccuaauaaagaagguugaga

SEQ ID NO: 516626 - RNA, 17 nt, Chlamydophila pneumoniae CWL029
aaaauaaacauauucuc

SEQ ID NO: 516627 - RNA, 16 nt, Chlamydophila pneumoniae CWL029
caccacgaccuauacc

SEQ ID NO: 516628 - RNA, 17 nt, Chlamydophila pneumoniae CWL029
cacauuccaagaaaaau

SEQ ID NO: 516629 - RNA, 15 nt, Chlamydophila pneumoniae CWL029
caccaaaaauuccgu

SEQ ID NO: 516630 - RNA, 15 nt, Chlamydophila pneumoniae CWL029
caccaaaagaauacu

SEQ ID NO: 516631 - RNA, 22 nt, Chlamydophila pneumoniae CWL029
cacauccuuguagaacuucuca

SEQ ID NO: 516632 - RNA, 17 nt, Chlamydophila pneumoniae CWL029
cacaucauuaucauaaa

SEQ ID NO: 516633 - RNA, 14 nt, Chlamydophila pneumoniae CWL029
cacagcuguacaga

SEQ ID NO: 516634 - RNA, 20 nt, Chlamydophila pneumoniae CWL029
cacauacaguacgcaaagua

SEQ ID NO: 516635 - RNA, 17 nt, Chlamydophila pneumoniae CWL029
cacauagaaacagucua

SEQ ID NO: 516636 - RNA, 18 nt, Chlamydophila pneumoniae CWL029
cacagcuaaucauagcca

SEQ ID NO: 516637 - RNA, 20 nt, Chlamydophila pneumoniae CWL029
cacagaaugauaagaaagcu

SEQ ID NO: 516638 - RNA, 15 nt, Chlamydophila pneumoniae CWL029
cacagaaugauaaga

SEQ ID NO: 516639 - RNA, 15 nt, Chlamydophila pneumoniae CWL029
cacagauaggaacca

SEQ ID NO: 516640 - RNA, 23 nt, Chlamydophila pneumoniae CWL029
cacagaucguaaucuguauaugc

SEQ ID NO: 516641 - RNA, 19 nt, Chlamydophila pneumoniae CWL029
cacagauguaaucuugauc

SEQ ID NO: 516642 - RNA, 15 nt, Chlamydophila pneumoniae CWL029
cacagcauuuucucu

SEQ ID NO: 516643 - RNA, 23 nt, Chlamydophila pneumoniae CWL029
cacagcauuuucucugagcagcu

SEQ ID NO: 516644 - RNA, 16 nt, Chlamydophila pneumoniae CWL029
cacaaucuaaauaaga

SEQ ID NO: 516645 - RNA, 15 nt, Chlamydophila pneumoniae CWL029
cacacgucuccaagc

SEQ ID NO: 516646 - RNA, 22 nt, Chlamydophila pneumoniae CWL029
cacaauccucacuauuaauacu

SEQ ID NO: 516647 - RNA, 21 nt, Chlamydophila pneumoniae CWL029
cacaagcuuuucgcagauacu

SEQ ID NO: 516648 - RNA, 21 nt, Chlamydophila pneumoniae CWL029
cacaagggauucuuguuggau

SEQ ID NO: 516649 - RNA, 15 nt, Chlamydophila pneumoniae CWL029
cacaacucuuuaauu

SEQ ID NO: 516650 - RNA, 15 nt, Chlamydophila pneumoniae CWL029
cacaacucauccuaa

SEQ ID NO: 516651 - RNA, 15 nt, Chlamydophila pneumoniae CWL029
caauuugcuccucca

SEQ ID NO: 516652 - RNA, 16 nt, Chlamydophila pneumoniae CWL029
caauuuggauuuaugu

SEQ ID NO: 516653 - RNA, 21 nt, Chlamydophila pneumoniae CWL029
cacaacccuuuaucaagcuau

SEQ ID NO: 516654 - RNA, 20 nt, Chlamydophila pneumoniae CWL029
caauugguggagcucauuua

SEQ ID NO: 516655 - RNA, 20 nt, Chlamydophila pneumoniae CWL029
caauugcucguauuagaguu

SEQ ID NO: 516656 - RNA, 22 nt, Chlamydophila pneumoniae CWL029
caauuccguacgcuauaaauaa

SEQ ID NO: 516657 - RNA, 21 nt, Chlamydophila pneumoniae CWL029
caauuccuuucuccagcauuu

SEQ ID NO: 516658 - RNA, 14 nt, Chlamydophila pneumoniae CWL029
caauucgcucagaa

SEQ ID NO: 516659 - RNA, 18 nt, Chlamydophila pneumoniae CWL029
caauucuguaucgauagu

SEQ ID NO: 516660 - RNA, 15 nt, Chlamydophila pneumoniae CWL029
caauucuuaaaaagc

SEQ ID NO: 516661 - RNA, 18 nt, Chlamydophila pneumoniae CWL029
caauuccuaaaacaagaa

SEQ ID NO: 516662 - RNA, 20 nt, Chlamydophila pneumoniae CWL029
caauuccgaagaagaaagga

SEQ ID NO: 516663 - RNA, 20 nt, Chlamydophila pneumoniae CWL029
caauuccauagguuagaaau

SEQ ID NO: 516664 - RNA, 20 nt, Chlamydophila pneumoniae CWL029
caauguuaaucuaauuuuag

SEQ ID NO: 516665 - RNA, 17 nt, Chlamydophila pneumoniae CWL029
caaucugguuaagcacc

SEQ ID NO: 516666 - RNA, 21 nt, Chlamydophila pneumoniae CWL029
caaugacaauccgcauauuga

SEQ ID NO: 516667 - RNA, 20 nt, Chlamydophila pneumoniae CWL029
caaugcuugucgcgacaaga

SEQ ID NO: 516668 - RNA, 21 nt, Chlamydophila pneumoniae CWL029
caaugcuugucgcgacaagac

SEQ ID NO: 516669 - RNA, 15 nt, Chlamydophila pneumoniae CWL029
caauggaaauagaga

SEQ ID NO: 516670 - RNA, 16 nt, Chlamydophila pneumoniae CWL029
caaugcuaucuccaga

SEQ ID NO: 516671 - RNA, 21 nt, Chlamydophila pneumoniae CWL029
caaugacuguaggaccugugu

SEQ ID NO: 516672 - RNA, 20 nt, Chlamydophila pneumoniae CWL029
caauggcuuuuuuuguccca

SEQ ID NO: 516673 - RNA, 13 nt, Chlamydophila pneumoniae CWL029
auuuuuccagaaa

SEQ ID NO: 516674 - RNA, 15 nt, Chlamydophila pneumoniae CWL029
auuuuucaagaacuc

SEQ ID NO: 516675 - RNA, 22 nt, Chlamydophila pneumoniae CWL029
auuuuucaagaacuccuuugag

SEQ ID NO: 516676 - RNA, 15 nt, Chlamydophila pneumoniae CWL029
auuuucuaaagauuu

SEQ ID NO: 516677 - RNA, 20 nt, Chlamydophila pneumoniae CWL029
auuuucuagaaacaacugaa

SEQ ID NO: 516678 - RNA, 13 nt, Chlamydophila pneumoniae CWL029
caaaaaaguaacu

SEQ ID NO: 516679 - RNA, 23 nt, Chlamydophila pneumoniae CWL029
auuuuuccauggcuauuuuuaaa

SEQ ID NO: 516680 - RNA, 19 nt, Chlamydophila pneumoniae CWL029
auuuuuuacguucuuucuu

SEQ ID NO: 516681 - RNA, 20 nt, Chlamydophila pneumoniae CWL029
auuuuucuuuuagagaaauc

SEQ ID NO: 516682 - RNA, 15 nt, Chlamydophila pneumoniae CWL029
auuuuugaauaugau

SEQ ID NO: 516683 - RNA, 19 nt, Chlamydophila pneumoniae CWL029
auuuucaugauauuuuuau

SEQ ID NO: 516684 - RNA, 15 nt, Chlamydophila pneumoniae CWL029
auuuucauagcagcu

SEQ ID NO: 516685 - RNA, 22 nt, Chlamydophila pneumoniae CWL029
auuuuaucugcgacaaaaaugc

SEQ ID NO: 516686 - RNA, 14 nt, Chlamydophila pneumoniae CWL029
auuuuagcauaauc

SEQ ID NO: 516687 - RNA, 22 nt, Chlamydophila pneumoniae CWL029
auuuuagauacgcuuacaaaua

SEQ ID NO: 516688 - RNA, 19 nt, Chlamydophila pneumoniae CWL029
auuuuagaacuucaaugaa

SEQ ID NO: 516689 - RNA, 22 nt, Chlamydophila pneumoniae CWL029
auuuuagcuccgaggcuucuga

SEQ ID NO: 516690 - RNA, 17 nt, Chlamydophila pneumoniae CWL029
auuuuaguaagaucgcu

SEQ ID NO: 516691 - RNA, 13 nt, Chlamydophila pneumoniae CWL029
auuuuaguuuuca

SEQ ID NO: 516692 - RNA, 14 nt, Chlamydophila pneumoniae CWL029
auuuuaauucaaaa

SEQ ID NO: 516693 - RNA, 20 nt, Chlamydophila pneumoniae CWL029
auuuuacgaaucuuuuucau

SEQ ID NO: 516694 - RNA, 22 nt, Chlamydophila pneumoniae CWL029
auuuuacuugcgauacaauaaa

SEQ ID NO: 516695 - RNA, 13 nt, Chlamydophila pneumoniae CWL029
auuuuaaauuuug

SEQ ID NO: 516696 - RNA, 15 nt, Chlamydophila pneumoniae CWL029
auuuuaaauuuuguu

SEQ ID NO: 516697 - RNA, 19 nt, Chlamydophila pneumoniae CWL029
auuucuucaauaggaauua

SEQ ID NO: 516698 - RNA, 21 nt, Chlamydophila pneumoniae CWL029
auuucuucaauaggaauuaga

SEQ ID NO: 516699 - RNA, 14 nt, Chlamydophila pneumoniae CWL029
auuucuucuagcuc

SEQ ID NO: 516700 - RNA, 17 nt, Chlamydophila pneumoniae CWL029
auuucuucuuagaaaca

SEQ ID NO: 516701 - RNA, 21 nt, Chlamydophila pneumoniae CWL029
auuucuucuuagaaacacagu

SEQ ID NO: 516702 - RNA, 22 nt, Chlamydophila pneumoniae CWL029
auuucuucuuagaaacacaguu

SEQ ID NO: 516703 - RNA, 13 nt, Chlamydophila pneumoniae CWL029
auuucuucuucua

SEQ ID NO: 516704 - RNA, 14 nt, Chlamydophila pneumoniae CWL029
auuucuucuuucca

SEQ ID NO: 516705 - RNA, 20 nt, Chlamydophila pneumoniae CWL029
auuucuguaguucuugccaa

SEQ ID NO: 516706 - RNA, 15 nt, Chlamydophila pneumoniae CWL029
auuucuguucugcuu

SEQ ID NO: 516707 - RNA, 14 nt, Chlamydophila pneumoniae CWL029
auuucuuaauuucc

SEQ ID NO: 516708 - RNA, 19 nt, Chlamydophila pneumoniae CWL029
auuucuugagucugaacau

SEQ ID NO: 516709 - RNA, 21 nt, Chlamydophila pneumoniae CWL029
auuucuuuuugccaauuuuca

SEQ ID NO: 516710 - RNA, 18 nt, Chlamydophila pneumoniae CWL029
auuucuguaguucuugcc

SEQ ID NO: 516711 - RNA, 21 nt, Chlamydophila pneumoniae CWL029
auuucuggagaaugccccuuc

SEQ ID NO: 516712 - RNA, 14 nt, Chlamydophila pneumoniae CWL029
auuucucuccacag

SEQ ID NO: 516713 - RNA, 17 nt, Chlamydophila pneumoniae CWL029
auuucgucaaagguuuu

SEQ ID NO: 516714 - RNA, 17 nt, Chlamydophila pneumoniae CWL029
auuucccauauagcucg

SEQ ID NO: 516715 - RNA, 18 nt, Chlamydophila pneumoniae CWL029
auuucggacgauauuuag

SEQ ID NO: 516716 - RNA, 19 nt, Chlamydophila pneumoniae CWL029
auuuccggguucauuucca

SEQ ID NO: 516717 - RNA, 20 nt, Chlamydophila pneumoniae CWL029
auuucagcguagguuugcug

SEQ ID NO: 516718 - RNA, 16 nt, Chlamydophila pneumoniae CWL029
auuuauuaucuuguuu

SEQ ID NO: 516719 - RNA, 20 nt, Chlamydophila pneumoniae CWL029
auuuauuuugucuuuuuaag

SEQ ID NO: 516720 - RNA, 15 nt, Chlamydophila pneumoniae CWL029
auuucaaagaagaca

SEQ ID NO: 516721 - RNA, 19 nt, Chlamydophila pneumoniae CWL029
auuguuggaauugcauuaa

SEQ ID NO: 516722 - RNA, 17 nt, Chlamydophila pneumoniae CWL029
auuuaaagcugaaauuc

SEQ ID NO: 516723 - RNA, 20 nt, Chlamydophila pneumoniae CWL029
auuuaaaugccuuaaaugua

SEQ ID NO: 516724 - RNA, 21 nt, Chlamydophila pneumoniae CWL029
auuuaaaugccuuaaauguau

SEQ ID NO: 516725 - RNA, 19 nt, Chlamydophila pneumoniae CWL029
auugucucaacauuucuca

SEQ ID NO: 516726 - RNA, 15 nt, Chlamydophila pneumoniae CWL029
auuguguguuuucau

SEQ ID NO: 516727 - RNA, 14 nt, Chlamydophila pneumoniae CWL029
auuguuaucaggaa

SEQ ID NO: 516728 - RNA, 13 nt, Chlamydophila pneumoniae CWL029
auuguagagauua

SEQ ID NO: 516729 - RNA, 16 nt, Chlamydophila pneumoniae CWL029
auugggagguucgcag

SEQ ID NO: 516730 - RNA, 13 nt, Chlamydophila pneumoniae CWL029
auugcugucagaa

SEQ ID NO: 516731 - RNA, 13 nt, Chlamydophila pneumoniae CWL029
auugcugcugcua

SEQ ID NO: 516732 - RNA, 15 nt, Chlamydophila pneumoniae CWL029
auugcuaagcauuuu

SEQ ID NO: 516733 - RNA, 14 nt, Chlamydophila pneumoniae CWL029
auugcuaagcauuu

SEQ ID NO: 516734 - RNA, 17 nt, Chlamydophila pneumoniae CWL029
auugcggaaauugaaua

SEQ ID NO: 516735 - RNA, 14 nt, Chlamydophila pneumoniae CWL029
auugcauucuuaau

SEQ ID NO: 516736 - RNA, 22 nt, Chlamydophila pneumoniae CWL029
auugcauuuaaacuaagaauac

SEQ ID NO: 516737 - RNA, 19 nt, Chlamydophila pneumoniae CWL029
auugcauuaagauaaacau

SEQ ID NO: 516738 - RNA, 18 nt, Chlamydophila pneumoniae CWL029
auugcacucaucuugagu

SEQ ID NO: 516739 - RNA, 12 nt, Chlamydophila pneumoniae CWL029
auugcaauacau

SEQ ID NO: 516740 - RNA, 23 nt, Chlamydophila pneumoniae CWL029
auugcaauacaucuuaagagcaa

SEQ ID NO: 516741 - RNA, 22 nt, Chlamydophila pneumoniae CWL029
auugcaaucugguuaagcacca

SEQ ID NO: 516742 - RNA, 21 nt, Chlamydophila pneumoniae CWL029
auugcaaauuucauuuagaca

SEQ ID NO: 516743 - RNA, 17 nt, Chlamydophila pneumoniae CWL029
auugcaauuuucuaaag

SEQ ID NO: 516744 - RNA, 19 nt, Chlamydophila pneumoniae CWL029
auugcaauuuucuaaagau

SEQ ID NO: 516745 - RNA, 15 nt, Chlamydophila pneumoniae CWL029
auucuuuaaucuauc

SEQ ID NO: 516746 - RNA, 20 nt, Chlamydophila pneumoniae CWL029
auucuuuuucuauuaaaaau

SEQ ID NO: 516747 - RNA, 15 nt, Chlamydophila pneumoniae CWL029
auugaaacuuuuuuu

SEQ ID NO: 516748 - RNA, 20 nt, Chlamydophila pneumoniae CWL029
auugaaagagcuuugauuca

SEQ ID NO: 516749 - RNA, 17 nt, Chlamydophila pneumoniae CWL029
auugcaaaaaugaaaga

SEQ ID NO: 516750 - RNA, 15 nt, Chlamydophila pneumoniae CWL029
auugauguuccuuga

SEQ ID NO: 516751 - RNA, 17 nt, Chlamydophila pneumoniae CWL029
auugaugcuuaagaguu

SEQ ID NO: 516752 - RNA, 17 nt, Chlamydophila pneumoniae CWL029
auucuuguuggauugaa

SEQ ID NO: 516753 - RNA, 17 nt, Chlamydophila pneumoniae CWL029
auucuucugucuguauu

SEQ ID NO: 516754 - RNA, 12 nt, Chlamydophila pneumoniae CWL029
auucuucugucu

SEQ ID NO: 516755 - RNA, 14 nt, Chlamydophila pneumoniae CWL029
auucuucgagagca

SEQ ID NO: 516756 - RNA, 15 nt, Chlamydophila pneumoniae CWL029
auucuucgagagcau

SEQ ID NO: 516757 - RNA, 12 nt, Chlamydophila pneumoniae CWL029
auucucuucacu

SEQ ID NO: 516758 - RNA, 16 nt, Chlamydophila pneumoniae CWL029
auucugaagagagaau

SEQ ID NO: 516759 - RNA, 18 nt, Chlamydophila pneumoniae CWL029
auucugcaaggcaaugau

SEQ ID NO: 516760 - RNA, 21 nt, Chlamydophila pneumoniae CWL029
auucugauucuccgucccccg

SEQ ID NO: 516761 - RNA, 19 nt, Chlamydophila pneumoniae CWL029
auucugaagauauauuuuu

SEQ ID NO: 516762 - RNA, 14 nt, Chlamydophila pneumoniae CWL029
auucugaagcugca

SEQ ID NO: 516763 - RNA, 21 nt, Chlamydophila pneumoniae CWL029
auucugaagcugcaaacugau

SEQ ID NO: 516764 - RNA, 21 nt, Chlamydophila pneumoniae CWL029
auucugagaaagaaguccuag

SEQ ID NO: 516765 - RNA, 16 nt, Chlamydophila pneumoniae CWL029
auuccuucucagaaag

SEQ ID NO: 516766 - RNA, 18 nt, Chlamydophila pneumoniae CWL029
auuccuucauacguuuuu

SEQ ID NO: 516767 - RNA, 14 nt, Chlamydophila pneumoniae CWL029
auuccuuucuccag

SEQ ID NO: 516768 - RNA, 16 nt, Chlamydophila pneumoniae CWL029
auucgcuauagccuug

SEQ ID NO: 516769 - RNA, 15 nt, Chlamydophila pneumoniae CWL029
auucuaagagauccu

SEQ ID NO: 516770 - RNA, 18 nt, Chlamydophila pneumoniae CWL029
auucuaagcgcucuucaa

SEQ ID NO: 516771 - RNA, 20 nt, Chlamydophila pneumoniae CWL029
auucuccgccagaguuuaaa

SEQ ID NO: 516772 - RNA, 22 nt, Chlamydophila pneumoniae CWL029
auucuccgccguggaauagcuu

SEQ ID NO: 516773 - RNA, 13 nt, Chlamydophila pneumoniae CWL029
auucucgaaaaau

SEQ ID NO: 516774 - RNA, 17 nt, Chlamydophila pneumoniae CWL029
auucucgagcagcugca

SEQ ID NO: 516775 - RNA, 19 nt, Chlamydophila pneumoniae CWL029
auuccuaaguuagagacac

SEQ ID NO: 516776 - RNA, 12 nt, Chlamydophila pneumoniae CWL029
auuccuacaucu

SEQ ID NO: 516777 - RNA, 16 nt, Chlamydophila pneumoniae CWL029
auuccuaaaacaagaa

SEQ ID NO: 516778 - RNA, 13 nt, Chlamydophila pneumoniae CWL029
auuccuaaaauuu

SEQ ID NO: 516779 - RNA, 23 nt, Chlamydophila pneumoniae CWL029
auuccuucauacguuuuuuuccu

SEQ ID NO: 516780 - RNA, 22 nt, Chlamydophila pneumoniae CWL029
auucccggaggcaaagaucagu

SEQ ID NO: 516781 - RNA, 17 nt, Chlamydophila pneumoniae CWL029
auucccgggaugugguu

SEQ ID NO: 516782 - RNA, 19 nt, Chlamydophila pneumoniae CWL029
auuccccuuuaaagccugu

SEQ ID NO: 516783 - RNA, 14 nt, Chlamydophila pneumoniae CWL029
auucccaagaacuu

SEQ ID NO: 516784 - RNA, 15 nt, Chlamydophila pneumoniae CWL029
auuccaauuuuugca

SEQ ID NO: 516785 - RNA, 14 nt, Chlamydophila pneumoniae CWL029
auuccaacuacaua

SEQ ID NO: 516786 - RNA, 16 nt, Chlamydophila pneumoniae CWL029
auuccaacuacauaau

SEQ ID NO: 516787 - RNA, 14 nt, Chlamydophila pneumoniae CWL029
auucauuuuuuaau

SEQ ID NO: 516788 - RNA, 17 nt, Chlamydophila pneumoniae CWL029
auucauuuuuuaauaaa

SEQ ID NO: 516789 - RNA, 16 nt, Chlamydophila pneumoniae CWL029
auuccaaagcuaggcg

SEQ ID NO: 516790 - RNA, 15 nt, Chlamydophila pneumoniae CWL029
auuccagaaaaagaa

SEQ ID NO: 516791 - RNA, 12 nt, Chlamydophila pneumoniae CWL029
auuccauggaua

SEQ ID NO: 516792 - RNA, 18 nt, Chlamydophila pneumoniae CWL029
auuccauuauacuuuuuu

SEQ ID NO: 516793 - RNA, 20 nt, Chlamydophila pneumoniae CWL029
auucaugccgcauuucuuca

SEQ ID NO: 516794 - RNA, 13 nt, Chlamydophila pneumoniae CWL029
auucaugcaaaac

SEQ ID NO: 516795 - RNA, 16 nt, Chlamydophila pneumoniae CWL029
auucauuaagaacauc

SEQ ID NO: 516796 - RNA, 19 nt, Chlamydophila pneumoniae CWL029
auucauuaagauccuuuaa

SEQ ID NO: 516797 - RNA, 13 nt, Chlamydophila pneumoniae CWL029
auucauccagauu

SEQ ID NO: 516798 - RNA, 22 nt, Chlamydophila pneumoniae CWL029
auucaugaaaugcuuucagugc

SEQ ID NO: 516799 - RNA, 17 nt, Chlamydophila pneumoniae CWL029
aaaaggaggauguuccu

SEQ ID NO: 516800 - RNA, 17 nt, Chlamydophila pneumoniae CWL029
aaaaggauucuaugagg

SEQ ID NO: 516801 - RNA, 14 nt, Chlamydophila pneumoniae CWL029
aaaagcuucuuucu

SEQ ID NO: 516802 - RNA, 16 nt, Chlamydophila pneumoniae CWL029
aaaagcuucuuucuua

SEQ ID NO: 516803 - RNA, 21 nt, Chlamydophila pneumoniae CWL029
aaaagcuucuuucuuacuaaa

SEQ ID NO: 516804 - RNA, 22 nt, Chlamydophila pneumoniae CWL029
aaaagcuucuuucuuacuaaag

SEQ ID NO: 516805 - RNA, 18 nt, Chlamydophila pneumoniae CWL029
aaaagcuucuuucuuacu

SEQ ID NO: 516806 - RNA, 17 nt, Chlamydophila pneumoniae CWL029
aaaagcuuuuuucucuu

SEQ ID NO: 516807 - RNA, 16 nt, Chlamydophila pneumoniae CWL029
auuaaggauuccuuga

SEQ ID NO: 516808 - RNA, 15 nt, Chlamydophila pneumoniae CWL029
auuaaggcuccagca

SEQ ID NO: 516809 - RNA, 20 nt, Chlamydophila pneumoniae CWL029
auuaagaagaaccucauuuu

SEQ ID NO: 516810 - RNA, 14 nt, Chlamydophila pneumoniae CWL029
auuaagaagaagcu

SEQ ID NO: 516811 - RNA, 11 nt, Chlamydophila pneumoniae CWL029
auuaagaagau

SEQ ID NO: 516812 - RNA, 18 nt, Chlamydophila pneumoniae CWL029
auuaagaacaucuuccca

SEQ ID NO: 516813 - RNA, 15 nt, Chlamydophila pneumoniae CWL029
auuaagaauggaugu

SEQ ID NO: 516814 - RNA, 12 nt, Chlamydophila pneumoniae CWL029
auuaagaggagu

SEQ ID NO: 516815 - RNA, 20 nt, Chlamydophila pneumoniae CWL029
auuaagauaaacagcacagg

SEQ ID NO: 516816 - RNA, 18 nt, Chlamydophila pneumoniae CWL029
auuaagauaaacauuaag

SEQ ID NO: 516817 - RNA, 19 nt, Chlamydophila pneumoniae CWL029
auuaagauagacucucacu

SEQ ID NO: 516818 - RNA, 18 nt, Chlamydophila pneumoniae CWL029
auuaagauccuuuaaaga

SEQ ID NO: 516819 - RNA, 19 nt, Chlamydophila pneumoniae CWL029
auuaacuaagauauguccg

SEQ ID NO: 516820 - RNA, 18 nt, Chlamydophila pneumoniae CWL029
auuaaaucguacuucacu

SEQ ID NO: 516821 - RNA, 19 nt, Chlamydophila pneumoniae CWL029
auuaaaucguacuucacuu

SEQ ID NO: 516822 - RNA, 22 nt, Chlamydophila pneumoniae CWL029
auuaaaucguacuucacuucug

SEQ ID NO: 516823 - RNA, 21 nt, Chlamydophila pneumoniae CWL029
auguuuguaguguugaauaag

SEQ ID NO: 516824 - RNA, 14 nt, Chlamydophila pneumoniae CWL029
auguuuugacauag

SEQ ID NO: 516825 - RNA, 21 nt, Chlamydophila pneumoniae CWL029
auguuccuuuuuuuuuucuuc

SEQ ID NO: 516826 - RNA, 13 nt, Chlamydophila pneumoniae CWL029
auguuaugaguuu

SEQ ID NO: 516827 - RNA, 17 nt, Chlamydophila pneumoniae CWL029
auguguuuccuuuucuc

SEQ ID NO: 516828 - RNA, 21 nt, Chlamydophila pneumoniae CWL029
auguguuuccuuuucuccuuc

SEQ ID NO: 516829 - RNA, 19 nt, Chlamydophila pneumoniae CWL029
auguuaauaagcauauuua

SEQ ID NO: 516830 - RNA, 23 nt, Chlamydophila pneumoniae CWL029
auguuaauaagcauauuuaaaua

SEQ ID NO: 516831 - RNA, 13 nt, Chlamydophila pneumoniae CWL029
auguggcagaguc

SEQ ID NO: 516832 - RNA, 14 nt, Chlamydophila pneumoniae CWL029
augugcugaagacc

SEQ ID NO: 516833 - RNA, 21 nt, Chlamydophila pneumoniae CWL029
augugcagaagguuccacaga

SEQ ID NO: 516834 - RNA, 16 nt, Chlamydophila pneumoniae CWL029
augugaagccauuuuc

SEQ ID NO: 516835 - RNA, 13 nt, Chlamydophila pneumoniae CWL029
augucuccauaca

SEQ ID NO: 516836 - RNA, 19 nt, Chlamydophila pneumoniae CWL029
augucuucauaugcucucc

SEQ ID NO: 516837 - RNA, 15 nt, Chlamydophila pneumoniae CWL029
augucuuugaauaua

SEQ ID NO: 516838 - RNA, 14 nt, Chlamydophila pneumoniae CWL029
augucgucucagaa

SEQ ID NO: 516839 - RNA, 16 nt, Chlamydophila pneumoniae CWL029
augucgcgaaaguaaa

SEQ ID NO: 516840 - RNA, 16 nt, Chlamydophila pneumoniae CWL029
auguacaguaaaguau

SEQ ID NO: 516841 - RNA, 16 nt, Chlamydophila pneumoniae CWL029
auguacauagaggaga

SEQ ID NO: 516842 - RNA, 21 nt, Chlamydophila pneumoniae CWL029
auuaccguucccuaaaguaac

SEQ ID NO: 516843 - RNA, 22 nt, Chlamydophila pneumoniae CWL029
auuaccugcuaaacuuuuuuuc

SEQ ID NO: 516844 - RNA, 23 nt, Chlamydophila pneumoniae CWL029
auuaccugcuaaacuuuuuuuca

SEQ ID NO: 516845 - RNA, 17 nt, Chlamydophila pneumoniae CWL029
auuacaucuaacucuaa

SEQ ID NO: 516846 - RNA, 18 nt, Chlamydophila pneumoniae CWL029
auuacaggaaacucuauc

SEQ ID NO: 516847 - RNA, 12 nt, Chlamydophila pneumoniae CWL029
auuacagggaaa

SEQ ID NO: 516848 - RNA, 14 nt, Chlamydophila pneumoniae CWL029
auuaauacuuugcc

SEQ ID NO: 516849 - RNA, 14 nt, Chlamydophila pneumoniae CWL029
auuagaaguaucuu

SEQ ID NO: 516850 - RNA, 21 nt, Chlamydophila pneumoniae CWL029
auuagaaguaucuugauguuu

SEQ ID NO: 516851 - RNA, 20 nt, Chlamydophila pneumoniae CWL029
auuagaaaagauaaaacauu

SEQ ID NO: 516852 - RNA, 13 nt, Chlamydophila pneumoniae CWL029
aaaagccuuucuu

SEQ ID NO: 516853 - RNA, 22 nt, Chlamydophila pneumoniae CWL029
auuagcccuacgaauccaaaaa

SEQ ID NO: 516854 - RNA, 13 nt, Chlamydophila pneumoniae CWL029
auuagagaauccg

SEQ ID NO: 516855 - RNA, 20 nt, Chlamydophila pneumoniae CWL029
aaaagcuuaucccauaaaug

SEQ ID NO: 516856 - RNA, 13 nt, Chlamydophila pneumoniae CWL029
auucaaaauagaa

SEQ ID NO: 516857 - RNA, 16 nt, Chlamydophila pneumoniae CWL029
auucaaacuccuuuua

SEQ ID NO: 516858 - RNA, 13 nt, Chlamydophila pneumoniae CWL029
auuauuuuaaagu

SEQ ID NO: 516859 - RNA, 18 nt, Chlamydophila pneumoniae CWL029
auuauuuguuucuuccau

SEQ ID NO: 516860 - RNA, 11 nt, Chlamydophila pneumoniae CWL029
auuauuuuaaa

SEQ ID NO: 516861 - RNA, 22 nt, Chlamydophila pneumoniae CWL029
auuauauauaagaucuuucauu

SEQ ID NO: 516862 - RNA, 12 nt, Chlamydophila pneumoniae CWL029
aaaagcuaaaca

SEQ ID NO: 516863 - RNA, 18 nt, Chlamydophila pneumoniae CWL029
auuauuaaacgaauacug

SEQ ID NO: 516864 - RNA, 15 nt, Chlamydophila pneumoniae CWL029
auuauguagaucaua

SEQ ID NO: 516865 - RNA, 17 nt, Chlamydophila pneumoniae CWL029
auuauguagaucuacaa

SEQ ID NO: 516866 - RNA, 11 nt, Chlamydophila pneumoniae CWL029
auuaucuacag

SEQ ID NO: 516867 - RNA, 18 nt, Chlamydophila pneumoniae CWL029
auuaucuccaaagaucau

SEQ ID NO: 516868 - RNA, 12 nt, Chlamydophila pneumoniae CWL029
auguaauuuuuu

SEQ ID NO: 516869 - RNA, 18 nt, Chlamydophila pneumoniae CWL029
augguugcuucuaagaaa

SEQ ID NO: 516870 - RNA, 14 nt, Chlamydophila pneumoniae CWL029
augguacaauacug

SEQ ID NO: 516871 - RNA, 15 nt, Chlamydophila pneumoniae CWL029
augguacaauacugg

SEQ ID NO: 516872 - RNA, 16 nt, Chlamydophila pneumoniae CWL029
auggugagauuucuaa

SEQ ID NO: 516873 - RNA, 22 nt, Chlamydophila pneumoniae CWL029
augguguucuucagcccacugu

SEQ ID NO: 516874 - RNA, 19 nt, Chlamydophila pneumoniae CWL029
augggcuuugcuaacagaa

SEQ ID NO: 516875 - RNA, 18 nt, Chlamydophila pneumoniae CWL029
auggcugucacggaagaa

SEQ ID NO: 516876 - RNA, 22 nt, Chlamydophila pneumoniae CWL029
auggcucugucacuagagaaaa

SEQ ID NO: 516877 - RNA, 19 nt, Chlamydophila pneumoniae CWL029
auggcagccuggaaagcuu

SEQ ID NO: 516878 - RNA, 21 nt, Chlamydophila pneumoniae CWL029
auggcagcuuggaugggaauc

SEQ ID NO: 516879 - RNA, 18 nt, Chlamydophila pneumoniae CWL029
auggcauagcgaaaguca

SEQ ID NO: 516880 - RNA, 16 nt, Chlamydophila pneumoniae CWL029
auggcuauuuuuaaaa

SEQ ID NO: 516881 - RNA, 16 nt, Chlamydophila pneumoniae CWL029
auggcucaacuuaagu

SEQ ID NO: 516882 - RNA, 15 nt, Chlamydophila pneumoniae CWL029
auggcacuugagcac

SEQ ID NO: 516883 - RNA, 14 nt, Chlamydophila pneumoniae CWL029
auggaugcuaaauu

SEQ ID NO: 516884 - RNA, 19 nt, Chlamydophila pneumoniae CWL029
auggauuaucuuagggaau

SEQ ID NO: 516885 - RNA, 15 nt, Chlamydophila pneumoniae CWL029
auggaucccuguagu

SEQ ID NO: 516886 - RNA, 20 nt, Chlamydophila pneumoniae CWL029
auggauccuucaucagcuuc

SEQ ID NO: 516887 - RNA, 14 nt, Chlamydophila pneumoniae CWL029
auggaaauagagaa

SEQ ID NO: 516888 - RNA, 16 nt, Chlamydophila pneumoniae CWL029
auggaaauagagaaac

SEQ ID NO: 516889 - RNA, 16 nt, Chlamydophila pneumoniae CWL029
auggaagagagcaaga

SEQ ID NO: 516890 - RNA, 15 nt, Chlamydophila pneumoniae CWL029
augcuguugauucaa

SEQ ID NO: 516891 - RNA, 16 nt, Chlamydophila pneumoniae CWL029
augcuuagccauggca

SEQ ID NO: 516892 - RNA, 13 nt, Chlamydophila pneumoniae CWL029
augcuuaucuauc

SEQ ID NO: 516893 - RNA, 15 nt, Chlamydophila pneumoniae CWL029
augcuuggcaauagc

SEQ ID NO: 516894 - RNA, 20 nt, Chlamydophila pneumoniae CWL029
augcuugucgcgacaagaca

SEQ ID NO: 516895 - RNA, 16 nt, Chlamydophila pneumoniae CWL029
augcugcacaguucac

SEQ ID NO: 516896 - RNA, 20 nt, Chlamydophila pneumoniae CWL029
augcuccugcaaaaaaccag

SEQ ID NO: 516897 - RNA, 17 nt, Chlamydophila pneumoniae CWL029
augcgaagggaggagaa

SEQ ID NO: 516898 - RNA, 22 nt, Chlamydophila pneumoniae CWL029
augccucuuucauacuaaaauc

SEQ ID NO: 516899 - RNA, 13 nt, Chlamydophila pneumoniae CWL029
augccucuuucau

SEQ ID NO: 516900 - RNA, 20 nt, Chlamydophila pneumoniae CWL029
augccucuuucauacuaaaa

SEQ ID NO: 516901 - RNA, 23 nt, Chlamydophila pneumoniae CWL029
augccuggccaucaucaccagaa

SEQ ID NO: 516902 - RNA, 17 nt, Chlamydophila pneumoniae CWL029
augccuuaaauguauug

SEQ ID NO: 516903 - RNA, 22 nt, Chlamydophila pneumoniae CWL029
augccuaaauagcucaguuggu

SEQ ID NO: 516904 - RNA, 21 nt, Chlamydophila pneumoniae CWL029
augccuacaggcaaggagagc

SEQ ID NO: 516905 - RNA, 21 nt, Chlamydophila pneumoniae CWL029
augccuauuaagucaccuuaa

SEQ ID NO: 516906 - RNA, 15 nt, Chlamydophila pneumoniae CWL029
augccucaggucugc

SEQ ID NO: 516907 - RNA, 23 nt, Chlamydophila pneumoniae CWL029
augccucaggucugcugaggaga

SEQ ID NO: 516908 - RNA, 16 nt, Chlamydophila pneumoniae CWL029
augccaguuccuaaag

SEQ ID NO: 516909 - RNA, 15 nt, Chlamydophila pneumoniae CWL029
augccaguuccuaaa

SEQ ID NO: 516910 - RNA, 16 nt, Chlamydophila pneumoniae CWL029
augcccuuuagggaau

SEQ ID NO: 516911 - RNA, 17 nt, Chlamydophila pneumoniae CWL029
augccauugaucagaau

SEQ ID NO: 516912 - RNA, 19 nt, Chlamydophila pneumoniae CWL029
augccauugaucagaaucu

SEQ ID NO: 516913 - RNA, 12 nt, Chlamydophila pneumoniae CWL029
augcagaucaua

SEQ ID NO: 516914 - RNA, 16 nt, Chlamydophila pneumoniae CWL029
augcaccauaauauaa

SEQ ID NO: 516915 - RNA, 22 nt, Chlamydophila pneumoniae CWL029
augcagccugcgacuacaagau

SEQ ID NO: 516916 - RNA, 18 nt, Chlamydophila pneumoniae CWL029
augcaaauccuguagaaa

SEQ ID NO: 516917 - RNA, 21 nt, Chlamydophila pneumoniae CWL029
augcaaauuccagaaaaagaa

SEQ ID NO: 516918 - RNA, 17 nt, Chlamydophila pneumoniae CWL029
augcaaaauaauuacuu

SEQ ID NO: 516919 - RNA, 15 nt, Chlamydophila pneumoniae CWL029
augcaaaccaaaaaa

SEQ ID NO: 516920 - RNA, 16 nt, Chlamydophila pneumoniae CWL029
augcaauacuuuucuc

SEQ ID NO: 516921 - RNA, 22 nt, Chlamydophila pneumoniae CWL029
augauuucuuuagcuuuauuga

SEQ ID NO: 516922 - RNA, 18 nt, Chlamydophila pneumoniae CWL029
augauuuucgguuacuuu

SEQ ID NO: 516923 - RNA, 15 nt, Chlamydophila pneumoniae CWL029
augauuacaucuaac

SEQ ID NO: 516924 - RNA, 14 nt, Chlamydophila pneumoniae CWL029
augauguguugauu

SEQ ID NO: 516925 - RNA, 20 nt, Chlamydophila pneumoniae CWL029
augaugccauugaucagaau

SEQ ID NO: 516926 - RNA, 18 nt, Chlamydophila pneumoniae CWL029
augaugagaacguccuca

SEQ ID NO: 516927 - RNA, 19 nt, Chlamydophila pneumoniae CWL029
augaucucuucaugaaaaa

SEQ ID NO: 516928 - RNA, 23 nt, Chlamydophila pneumoniae CWL029
augagcaucugagucauaagcuc

SEQ ID NO: 516929 - RNA, 23 nt, Chlamydophila pneumoniae CWL029
aaaauucgaauucucagaaagcc

SEQ ID NO: 516930 - RNA, 23 nt, Chlamydophila pneumoniae CWL029
aaaauucgguaguggugaacuaa

SEQ ID NO: 516931 - RNA, 19 nt, Chlamydophila pneumoniae CWL029
aaaauucuaaugguuuccc

SEQ ID NO: 516932 - RNA, 20 nt, Chlamydophila pneumoniae CWL029
cagcguugcuaagcauagcc

SEQ ID NO: 516933 - RNA, 15 nt, Chlamydophila pneumoniae CWL029
aaaauucaugcaaaa

SEQ ID NO: 516934 - RNA, 22 nt, Chlamydophila pneumoniae CWL029
cagcgugaauaucaucacuaag

SEQ ID NO: 516935 - RNA, 19 nt, Chlamydophila pneumoniae CWL029
cagcgguugccuuucucuu

SEQ ID NO: 516936 - RNA, 13 nt, Chlamydophila pneumoniae CWL029
cagcguauaggaa

SEQ ID NO: 516937 - RNA, 14 nt, Chlamydophila pneumoniae CWL029
aaaauuauuaaacu

SEQ ID NO: 516938 - RNA, 19 nt, Chlamydophila pneumoniae CWL029
aaaauuaucuccaaagauc

SEQ ID NO: 516939 - RNA, 16 nt, Chlamydophila pneumoniae CWL029
aaaauuaagaacccga

SEQ ID NO: 516940 - RNA, 20 nt, Chlamydophila pneumoniae CWL029
aaaauuaaagugaaagcaac

SEQ ID NO: 516941 - RNA, 12 nt, Chlamydophila pneumoniae CWL029
cagcggcacccu

SEQ ID NO: 516942 - RNA, 13 nt, Chlamydophila pneumoniae CWL029
cagcccccaggcu

SEQ ID NO: 516943 - RNA, 11 nt, Chlamydophila pneumoniae CWL029
cagccagcaga

SEQ ID NO: 516944 - RNA, 13 nt, Chlamydophila pneumoniae CWL029
cagccagcagaag

SEQ ID NO: 516945 - RNA, 20 nt, Chlamydophila pneumoniae CWL029
cagccuugauugaacagucu

SEQ ID NO: 516946 - RNA, 13 nt, Chlamydophila pneumoniae CWL029
cagcgaggagaag

SEQ ID NO: 516947 - RNA, 17 nt, Chlamydophila pneumoniae CWL029
cagcgaggaguuuucca

SEQ ID NO: 516948 - RNA, 18 nt, Chlamydophila pneumoniae CWL029
cagcgauauaagacucca

SEQ ID NO: 516949 - RNA, 21 nt, Chlamydophila pneumoniae CWL029
cagguaagggaugcucuagaa

SEQ ID NO: 516950 - RNA, 21 nt, Chlamydophila pneumoniae CWL029
cagguagauccuauaguaauu

SEQ ID NO: 516951 - RNA, 19 nt, Chlamydophila pneumoniae CWL029
cagguagagugucuuccuu

SEQ ID NO: 516952 - RNA, 22 nt, Chlamydophila pneumoniae CWL029
caggguuucucggauccuccaa

SEQ ID NO: 516953 - RNA, 16 nt, Chlamydophila pneumoniae CWL029
aaacaaaagccauucc

SEQ ID NO: 516954 - RNA, 22 nt, Chlamydophila pneumoniae CWL029
cagggccugagaccauaaaauc

SEQ ID NO: 516955 - RNA, 14 nt, Chlamydophila pneumoniae CWL029
cagggaucuucauc

SEQ ID NO: 516956 - RNA, 18 nt, Chlamydophila pneumoniae CWL029
caggauucuaaaaagaaa

SEQ ID NO: 516957 - RNA, 19 nt, Chlamydophila pneumoniae CWL029
caggauucuauaacuacaa

SEQ ID NO: 516958 - RNA, 15 nt, Chlamydophila pneumoniae CWL029
caggauugauaaaua

SEQ ID NO: 516959 - RNA, 17 nt, Chlamydophila pneumoniae CWL029
caggaguuuuccuaaau

SEQ ID NO: 516960 - RNA, 22 nt, Chlamydophila pneumoniae CWL029
caggaucccaaguaugguccau

SEQ ID NO: 516961 - RNA, 20 nt, Chlamydophila pneumoniae CWL029
caggaggugguggagcuugu

SEQ ID NO: 516962 - RNA, 16 nt, Chlamydophila pneumoniae CWL029
caggagcuagaagagc

SEQ ID NO: 516963 - RNA, 17 nt, Chlamydophila pneumoniae CWL029
caggagcuccugcggau

SEQ ID NO: 516964 - RNA, 17 nt, Chlamydophila pneumoniae CWL029
caggaccugugaguaaa

SEQ ID NO: 516965 - RNA, 20 nt, Chlamydophila pneumoniae CWL029
caggaccugugaguaaaaug

SEQ ID NO: 516966 - RNA, 18 nt, Chlamydophila pneumoniae CWL029
caggaauucucaucggca

SEQ ID NO: 516967 - RNA, 21 nt, Chlamydophila pneumoniae CWL029
caggaaauaauuuguuuagaa

SEQ ID NO: 516968 - RNA, 23 nt, Chlamydophila pneumoniae CWL029
caggaaauaauuuguuuagaaaa

SEQ ID NO: 516969 - RNA, 18 nt, Chlamydophila pneumoniae CWL029
caggaaacguucuuucaa

SEQ ID NO: 516970 - RNA, 22 nt, Chlamydophila pneumoniae CWL029
cagcuuuaucaggaucuugauu

SEQ ID NO: 516971 - RNA, 17 nt, Chlamydophila pneumoniae CWL029
cagcuuuagcuuuuacu

SEQ ID NO: 516972 - RNA, 20 nt, Chlamydophila pneumoniae CWL029
cagcuuguuuuugcaaggca

SEQ ID NO: 516973 - RNA, 14 nt, Chlamydophila pneumoniae CWL029
caggaaaagcaaaa

SEQ ID NO: 516974 - RNA, 20 nt, Chlamydophila pneumoniae CWL029
caggaaaacgcccucuagaa

SEQ ID NO: 516975 - RNA, 14 nt, Chlamydophila pneumoniae CWL029
caggaagaaaggau

SEQ ID NO: 516976 - RNA, 17 nt, Chlamydophila pneumoniae CWL029
cagcuucuggagaaaaa

SEQ ID NO: 516977 - RNA, 22 nt, Chlamydophila pneumoniae CWL029
cagcuucuggagaaaaaauauc

SEQ ID NO: 516978 - RNA, 21 nt, Chlamydophila pneumoniae CWL029
cagcuucucuaguuguaauuu

SEQ ID NO: 516979 - RNA, 11 nt, Chlamydophila pneumoniae CWL029
cagcuucuuga

SEQ ID NO: 516980 - RNA, 20 nt, Chlamydophila pneumoniae CWL029
cagcugagcuaucuucaagu

SEQ ID NO: 516981 - RNA, 15 nt, Chlamydophila pneumoniae CWL029
aaaauucuuaaaacu

SEQ ID NO: 516982 - RNA, 13 nt, Chlamydophila pneumoniae CWL029
aaaauugaaaucu

SEQ ID NO: 516983 - RNA, 22 nt, Chlamydophila pneumoniae CWL029
aaaauugaaaucuuuagaauua

SEQ ID NO: 516984 - RNA, 14 nt, Chlamydophila pneumoniae CWL029
cagcguuucuaggg

SEQ ID NO: 516985 - RNA, 14 nt, Chlamydophila pneumoniae CWL029
cagcagcauuuucu

SEQ ID NO: 516986 - RNA, 15 nt, Chlamydophila pneumoniae CWL029
cagcacucuuuuucu

SEQ ID NO: 516987 - RNA, 22 nt, Chlamydophila pneumoniae CWL029
aaaauggugaagaauaauagca

SEQ ID NO: 516988 - RNA, 14 nt, Chlamydophila pneumoniae CWL029
aaaauguaaaaaau

SEQ ID NO: 516989 - RNA, 18 nt, Chlamydophila pneumoniae CWL029
cagcacgaauaaagcccu

SEQ ID NO: 516990 - RNA, 21 nt, Chlamydophila pneumoniae CWL029
cagcaccuuuaggaagcugua

SEQ ID NO: 516991 - RNA, 19 nt, Chlamydophila pneumoniae CWL029
cagcaaucacaucaguucc

SEQ ID NO: 516992 - RNA, 20 nt, Chlamydophila pneumoniae CWL029
cagcaaucacaucaguucca

SEQ ID NO: 516993 - RNA, 21 nt, Chlamydophila pneumoniae CWL029
aaaaugcgcacggauucuaaa

SEQ ID NO: 516994 - RNA, 18 nt, Chlamydophila pneumoniae CWL029
aaaaugcuccugcaaaaa

SEQ ID NO: 516995 - RNA, 19 nt, Chlamydophila pneumoniae CWL029
aaaaugcuccugcaaaaaa

SEQ ID NO: 516996 - RNA, 21 nt, Chlamydophila pneumoniae CWL029
aaaaugaggacacaacucuuu

SEQ ID NO: 516997 - RNA, 23 nt, Chlamydophila pneumoniae CWL029
cagcaaagcgaccugcaaaugaa

SEQ ID NO: 516998 - RNA, 22 nt, Chlamydophila pneumoniae CWL029
aaaaucuucuuagccaaaauuu

SEQ ID NO: 516999 - RNA, 18 nt, Chlamydophila pneumoniae CWL029
aaaaucgugcuuagagcc

SEQ ID NO: 517000 - RNA, 21 nt, Chlamydophila pneumoniae CWL029
aaaaucguuuuauuuuaggag

SEQ ID NO: 517001 - RNA, 20 nt, Chlamydophila pneumoniae CWL029
aaaaucuacauguaaagcaa

SEQ ID NO: 517002 - RNA, 11 nt, Chlamydophila pneumoniae CWL029
cagauccugcu

SEQ ID NO: 517003 - RNA, 20 nt, Chlamydophila pneumoniae CWL029
cagaucauaucggcagcagc

SEQ ID NO: 517004 - RNA, 15 nt, Chlamydophila pneumoniae CWL029
cagauugcacuugcg

SEQ ID NO: 517005 - RNA, 22 nt, Chlamydophila pneumoniae CWL029
cagauugaugcugacagcucca

SEQ ID NO: 517006 - RNA, 16 nt, Chlamydophila pneumoniae CWL029
cagauucugaagagag

SEQ ID NO: 517007 - RNA, 18 nt, Chlamydophila pneumoniae CWL029
aaaaucuucuggagggag

SEQ ID NO: 517008 - RNA, 21 nt, Chlamydophila pneumoniae CWL029
aaaaucugcuauaaccaacuu

SEQ ID NO: 517009 - RNA, 23 nt, Chlamydophila pneumoniae CWL029
aaaaucugcucucugaagcuaaa

SEQ ID NO: 517010 - RNA, 18 nt, Chlamydophila pneumoniae CWL029
cagauaccaucaccuucg

SEQ ID NO: 517011 - RNA, 15 nt, Chlamydophila pneumoniae CWL029
cagauacuaaacucc

SEQ ID NO: 517012 - RNA, 20 nt, Chlamydophila pneumoniae CWL029
cagauacuaaacuccauugu

SEQ ID NO: 517013 - RNA, 21 nt, Chlamydophila pneumoniae CWL029
cagauacguuucccccauaaa

SEQ ID NO: 517014 - RNA, 16 nt, Chlamydophila pneumoniae CWL029
cagauacuucuuccac

SEQ ID NO: 517015 - RNA, 18 nt, Chlamydophila pneumoniae CWL029
cagauagagcuucuuuau

SEQ ID NO: 517016 - RNA, 15 nt, Chlamydophila pneumoniae CWL029
cagauagcuuacaga

SEQ ID NO: 517017 - RNA, 20 nt, Chlamydophila pneumoniae CWL029
cagauaggauggaguacuuc

SEQ ID NO: 517018 - RNA, 15 nt, Chlamydophila pneumoniae CWL029
cagauaucaaagcau

SEQ ID NO: 517019 - RNA, 19 nt, Chlamydophila pneumoniae CWL029
cagauaucaaagcauugca

SEQ ID NO: 517020 - RNA, 14 nt, Chlamydophila pneumoniae CWL029
cagaucaaugccuu

SEQ ID NO: 517021 - RNA, 19 nt, Chlamydophila pneumoniae CWL029
cagaucaaugccuugcguu

SEQ ID NO: 517022 - RNA, 16 nt, Chlamydophila pneumoniae CWL029
cagauaggguaagauu

SEQ ID NO: 517023 - RNA, 12 nt, Chlamydophila pneumoniae CWL029
cagagaaaauca

SEQ ID NO: 517024 - RNA, 14 nt, Chlamydophila pneumoniae CWL029
cagagaaaaucaac

SEQ ID NO: 517025 - RNA, 15 nt, Chlamydophila pneumoniae CWL029
cagagaaaaucaacu

SEQ ID NO: 517026 - RNA, 24 nt, Chlamydophila pneumoniae CWL029
aaaaucaagaagagaaaagauagu

SEQ ID NO: 517027 - RNA, 18 nt, Chlamydophila pneumoniae CWL029
aaaaucaagccacagaga

SEQ ID NO: 517028 - RNA, 15 nt, Chlamydophila pneumoniae CWL029
aaaaucaaucuugau

SEQ ID NO: 517029 - RNA, 22 nt, Chlamydophila pneumoniae CWL029
aaaaucacacuuucauccaaac

SEQ ID NO: 517030 - RNA, 17 nt, Chlamydophila pneumoniae CWL029
cagagaugcuaacaacu

SEQ ID NO: 517031 - RNA, 13 nt, Chlamydophila pneumoniae CWL029
cagagauucuuca

SEQ ID NO: 517032 - RNA, 14 nt, Chlamydophila pneumoniae CWL029
cagagauuuuaaag

SEQ ID NO: 517033 - RNA, 17 nt, Chlamydophila pneumoniae CWL029
cagaggcuagaaaauca

SEQ ID NO: 517034 - RNA, 20 nt, Chlamydophila pneumoniae CWL029
cagagggcuucauuccuaca

SEQ ID NO: 517035 - RNA, 16 nt, Chlamydophila pneumoniae CWL029
cagagccucacuaacg

SEQ ID NO: 517036 - RNA, 14 nt, Chlamydophila pneumoniae CWL029
cagagcgccuccac

SEQ ID NO: 517037 - RNA, 13 nt, Chlamydophila pneumoniae CWL029
cagagcgccucca

SEQ ID NO: 517038 - RNA, 20 nt, Chlamydophila pneumoniae CWL029
cagagucagaagcuauucca

SEQ ID NO: 517039 - RNA, 15 nt, Chlamydophila pneumoniae CWL029
cagaguuuaaagcuu

SEQ ID NO: 517040 - RNA, 17 nt, Chlamydophila pneumoniae CWL029
cagaguuuuaaacugcu

SEQ ID NO: 517041 - RNA, 16 nt, Chlamydophila pneumoniae CWL029
cagaguuuuucccucg

SEQ ID NO: 517042 - RNA, 14 nt, Chlamydophila pneumoniae CWL029
cagauaaaaagaag

SEQ ID NO: 517043 - RNA, 21 nt, Chlamydophila pneumoniae CWL029
cagauaaaaagaaguaaucgu

SEQ ID NO: 517044 - RNA, 20 nt, Chlamydophila pneumoniae CWL029
cagaggucgauuugaacaug

SEQ ID NO: 517045 - RNA, 21 nt, Chlamydophila pneumoniae CWL029
cagaguacgugaucucacgaa

SEQ ID NO: 517046 - RNA, 22 nt, Chlamydophila pneumoniae CWL029
cagacucgccgaaaguaucuuc

SEQ ID NO: 517047 - RNA, 14 nt, Chlamydophila pneumoniae CWL029
cagacugaagagca

SEQ ID NO: 517048 - RNA, 22 nt, Chlamydophila pneumoniae CWL029
cagacugaagucguuuagauuu

SEQ ID NO: 517049 - RNA, 19 nt, Chlamydophila pneumoniae CWL029
cagaccucucccuugggau

SEQ ID NO: 517050 - RNA, 13 nt, Chlamydophila pneumoniae CWL029
cagaccuaaaaag

SEQ ID NO: 517051 - RNA, 22 nt, Chlamydophila pneumoniae CWL029
cagaccuaaaaaggucagcccu

SEQ ID NO: 517052 - RNA, 23 nt, Chlamydophila pneumoniae CWL029
cagaccuaaaaaggucagcccug

SEQ ID NO: 517053 - RNA, 13 nt, Chlamydophila pneumoniae CWL029
cagaauccugagu

SEQ ID NO: 517054 - RNA, 14 nt, Chlamydophila pneumoniae CWL029
cagaaucccgugcu

SEQ ID NO: 517055 - RNA, 20 nt, Chlamydophila pneumoniae CWL029
cagaauccugaguaaaauca

SEQ ID NO: 517056 - RNA, 18 nt, Chlamydophila pneumoniae CWL029
cagaaucauaaucugcgu

SEQ ID NO: 517057 - RNA, 21 nt, Chlamydophila pneumoniae CWL029
cagaauauagacuuguauucu

SEQ ID NO: 517058 - RNA, 18 nt, Chlamydophila pneumoniae CWL029
cagaaucuaaguaaaacu

SEQ ID NO: 517059 - RNA, 15 nt, Chlamydophila pneumoniae CWL029
cagaaucuaugagag

SEQ ID NO: 517060 - RNA, 13 nt, Chlamydophila pneumoniae CWL029
cagaaucuccauu

SEQ ID NO: 517061 - RNA, 12 nt, Chlamydophila pneumoniae CWL029
cagaauuuucug

SEQ ID NO: 517062 - RNA, 14 nt, Chlamydophila pneumoniae CWL029
cagaaguuccuacu

SEQ ID NO: 517063 - RNA, 13 nt, Chlamydophila pneumoniae CWL029
cagaaguuccuuc

SEQ ID NO: 517064 - RNA, 17 nt, Chlamydophila pneumoniae CWL029
cagaaguccuaucaaag

SEQ ID NO: 517065 - RNA, 17 nt, Chlamydophila pneumoniae CWL029
cagaagugaucuugaga

SEQ ID NO: 517066 - RNA, 15 nt, Chlamydophila pneumoniae CWL029
cagaaggcuuguuuc

SEQ ID NO: 517067 - RNA, 20 nt, Chlamydophila pneumoniae CWL029
cagaaggacccuccuuugua

SEQ ID NO: 517068 - RNA, 15 nt, Chlamydophila pneumoniae CWL029
cagaagguaaauuuu

SEQ ID NO: 517069 - RNA, 20 nt, Chlamydophila pneumoniae CWL029
cagaagguuccacagagacc

SEQ ID NO: 517070 - RNA, 13 nt, Chlamydophila pneumoniae CWL029
cagaacuucucca

SEQ ID NO: 517071 - RNA, 15 nt, Chlamydophila pneumoniae CWL029
cagaaaggcuuuucu

SEQ ID NO: 517072 - RNA, 20 nt, Chlamydophila pneumoniae CWL029
cagaaaggcuuuucuuuuuc

SEQ ID NO: 517073 - RNA, 19 nt, Chlamydophila pneumoniae CWL029
cagaaaauguaaaaaauua

SEQ ID NO: 517074 - RNA, 22 nt, Chlamydophila pneumoniae CWL029
cagaaaauguaaaaaauuauuu

SEQ ID NO: 517075 - RNA, 17 nt, Chlamydophila pneumoniae CWL029
cagaaacuuuaaaagca

SEQ ID NO: 517076 - RNA, 21 nt, Chlamydophila pneumoniae CWL029
cagaaagaaggucuuccaucu

SEQ ID NO: 517077 - RNA, 22 nt, Chlamydophila pneumoniae CWL029
cagaaagauugugcucacgaau

SEQ ID NO: 517078 - RNA, 15 nt, Chlamydophila pneumoniae CWL029
cacuuuguuuuucaa

SEQ ID NO: 517079 - RNA, 13 nt, Chlamydophila pneumoniae CWL029
cacuuugaauaau

SEQ ID NO: 517080 - RNA, 22 nt, Chlamydophila pneumoniae CWL029
aaaauaucuccguuaccaaaaa

SEQ ID NO: 517081 - RNA, 19 nt, Chlamydophila pneumoniae CWL029
aaaauauuaaauucaaaau

SEQ ID NO: 517082 - RNA, 20 nt, Chlamydophila pneumoniae CWL029
aaaauauuaaauucaaaauc

SEQ ID NO: 517083 - RNA, 19 nt, Chlamydophila pneumoniae CWL029
cacuuguuuuuucuucugu

SEQ ID NO: 517084 - RNA, 15 nt, Chlamydophila pneumoniae CWL029
aaaauauccuaaaua

SEQ ID NO: 517085 - RNA, 18 nt, Chlamydophila pneumoniae CWL029
cacuucucuguaucgaua

SEQ ID NO: 517086 - RNA, 18 nt, Chlamydophila pneumoniae CWL029
cacuucucagcaucucga

SEQ ID NO: 517087 - RNA, 18 nt, Chlamydophila pneumoniae CWL029
cacuucuuuuucuucaau

SEQ ID NO: 517088 - RNA, 18 nt, Chlamydophila pneumoniae CWL029
cacuugcgguuuuggaua

SEQ ID NO: 517089 - RNA, 18 nt, Chlamydophila pneumoniae CWL029
cacuugcucuuuaggaua

SEQ ID NO: 517090 - RNA, 15 nt, Chlamydophila pneumoniae CWL029
cacuguuuugcuucu

SEQ ID NO: 517091 - RNA, 18 nt, Chlamydophila pneumoniae CWL029
cacuguuuuccagaaauc

SEQ ID NO: 517092 - RNA, 14 nt, Chlamydophila pneumoniae CWL029
cacuuaaagguaaa

SEQ ID NO: 517093 - RNA, 18 nt, Chlamydophila pneumoniae CWL029
cacuuaaagguaaaacua

SEQ ID NO: 517094 - RNA, 16 nt, Chlamydophila pneumoniae CWL029
cacuuaacccuauggu

SEQ ID NO: 517095 - RNA, 23 nt, Chlamydophila pneumoniae CWL029
cacuguugcauuagauacgcucu

SEQ ID NO: 517096 - RNA, 23 nt, Chlamydophila pneumoniae CWL029
cacuuaauaauguuuuaauagcu

SEQ ID NO: 517097 - RNA, 17 nt, Chlamydophila pneumoniae CWL029
cacuuacuucaagaaaa

SEQ ID NO: 517098 - RNA, 16 nt, Chlamydophila pneumoniae CWL029
cacuuaggguucucaa

SEQ ID NO: 517099 - RNA, 21 nt, Chlamydophila pneumoniae CWL029
cacuuaguccgguuucuucua

SEQ ID NO: 517100 - RNA, 13 nt, Chlamydophila pneumoniae CWL029
cacuuauguucua

SEQ ID NO: 517101 - RNA, 18 nt, Chlamydophila pneumoniae CWL029
cacuguaucagcaagccc

SEQ ID NO: 517102 - RNA, 20 nt, Chlamydophila pneumoniae CWL029
cacuggggcauaagaacucu

SEQ ID NO: 517103 - RNA, 13 nt, Chlamydophila pneumoniae CWL029
cacugcgagagaa

SEQ ID NO: 517104 - RNA, 14 nt, Chlamydophila pneumoniae CWL029
cacuccugaaggga

SEQ ID NO: 517105 - RNA, 12 nt, Chlamydophila pneumoniae CWL029
cacucccuaggu

SEQ ID NO: 517106 - RNA, 18 nt, Chlamydophila pneumoniae CWL029
cacucgauuauuucuugu

SEQ ID NO: 517107 - RNA, 20 nt, Chlamydophila pneumoniae CWL029
cacugaacgccaucuccaca

SEQ ID NO: 517108 - RNA, 18 nt, Chlamydophila pneumoniae CWL029
cacugaacgccaucucca

SEQ ID NO: 517109 - RNA, 22 nt, Chlamydophila pneumoniae CWL029
cacugaacgccaucuccacagc

SEQ ID NO: 517110 - RNA, 12 nt, Chlamydophila pneumoniae CWL029
cacucuuuucua

SEQ ID NO: 517111 - RNA, 12 nt, Chlamydophila pneumoniae CWL029
cacucuuuaaaa

SEQ ID NO: 517112 - RNA, 17 nt, Chlamydophila pneumoniae CWL029
cacucuuucagaaagaa

SEQ ID NO: 517113 - RNA, 18 nt, Chlamydophila pneumoniae CWL029
cacucguugccaaucuuu

SEQ ID NO: 517114 - RNA, 13 nt, Chlamydophila pneumoniae CWL029
cacucuaagcgaa

SEQ ID NO: 517115 - RNA, 14 nt, Chlamydophila pneumoniae CWL029
cacucuagaaaaua

SEQ ID NO: 517116 - RNA, 17 nt, Chlamydophila pneumoniae CWL029
cacuacauuauaaucac

SEQ ID NO: 517117 - RNA, 14 nt, Chlamydophila pneumoniae CWL029
cacuaaaagggaag

SEQ ID NO: 517118 - RNA, 22 nt, Chlamydophila pneumoniae CWL029
cacuaaagauacuuaucuuuaa

SEQ ID NO: 517119 - RNA, 15 nt, Chlamydophila pneumoniae CWL029
cacuaaccgaugaua

SEQ ID NO: 517120 - RNA, 17 nt, Chlamydophila pneumoniae CWL029
cacuaagauaucuccag

SEQ ID NO: 517121 - RNA, 17 nt, Chlamydophila pneumoniae CWL029
cacguuugacaaauuua

SEQ ID NO: 517122 - RNA, 22 nt, Chlamydophila pneumoniae CWL029
cacuccagaaaguauuccucuu

SEQ ID NO: 517123 - RNA, 13 nt, Chlamydophila pneumoniae CWL029
cacuccaaaacuc

SEQ ID NO: 517124 - RNA, 14 nt, Chlamydophila pneumoniae CWL029
cacuccaaaacuca

SEQ ID NO: 517125 - RNA, 14 nt, Chlamydophila pneumoniae CWL029
cacucagcucccau

SEQ ID NO: 517126 - RNA, 12 nt, Chlamydophila pneumoniae CWL029
cacuauuaauac

SEQ ID NO: 517127 - RNA, 16 nt, Chlamydophila pneumoniae CWL029
cacuauuaucugcaga

SEQ ID NO: 517128 - RNA, 19 nt, Chlamydophila pneumoniae CWL029
cacuauuaucugcagaaac

SEQ ID NO: 517129 - RNA, 20 nt, Chlamydophila pneumoniae CWL029
cacuauguguuuccuuuucu

SEQ ID NO: 517130 - RNA, 12 nt, Chlamydophila pneumoniae CWL029
cacuaucuucua

SEQ ID NO: 517131 - RNA, 21 nt, Chlamydophila pneumoniae CWL029
cacuauccggaaggaguucuu

SEQ ID NO: 517132 - RNA, 17 nt, Chlamydophila pneumoniae CWL029
cacuauacccucugcuu

SEQ ID NO: 517133 - RNA, 12 nt, Chlamydophila pneumoniae CWL029
cacuagcagaag

SEQ ID NO: 517134 - RNA, 11 nt, Chlamydophila pneumoniae CWL029
caucucucucc

SEQ ID NO: 517135 - RNA, 13 nt, Chlamydophila pneumoniae CWL029
caucucucuuuaa

SEQ ID NO: 517136 - RNA, 22 nt, Chlamydophila pneumoniae CWL029
caucucguugggcucauaaccc

SEQ ID NO: 517137 - RNA, 18 nt, Chlamydophila pneumoniae CWL029
caucucgcaguccaaaga

SEQ ID NO: 517138 - RNA, 18 nt, Chlamydophila pneumoniae CWL029
caucugauacuguuuuuu

SEQ ID NO: 517139 - RNA, 21 nt, Chlamydophila pneumoniae CWL029
caucugucauuaaaaauuuaa

SEQ ID NO: 517140 - RNA, 14 nt, Chlamydophila pneumoniae CWL029
caucugucauuaaa

SEQ ID NO: 517141 - RNA, 22 nt, Chlamydophila pneumoniae CWL029
caucuagaaagauuuauuuugu

SEQ ID NO: 517142 - RNA, 20 nt, Chlamydophila pneumoniae CWL029
caucuaauuuuaaauuuugu

SEQ ID NO: 517143 - RNA, 15 nt, Chlamydophila pneumoniae CWL029
caucuaacucuaauc

SEQ ID NO: 517144 - RNA, 13 nt, Chlamydophila pneumoniae CWL029
caucuaagccaga

SEQ ID NO: 517145 - RNA, 19 nt, Chlamydophila pneumoniae CWL029
caucuacgauguuuucuua

SEQ ID NO: 517146 - RNA, 21 nt, Chlamydophila pneumoniae CWL029
caucuacgauguuuucuuauc

SEQ ID NO: 517147 - RNA, 22 nt, Chlamydophila pneumoniae CWL029
caucuacgauguuuucuuaucc

SEQ ID NO: 517148 - RNA, 15 nt, Chlamydophila pneumoniae CWL029
caucuccaagauaau

SEQ ID NO: 517149 - RNA, 16 nt, Chlamydophila pneumoniae CWL029
caucucauaguuucua

SEQ ID NO: 517150 - RNA, 20 nt, Chlamydophila pneumoniae CWL029
caucuaacgucagcuguccu

SEQ ID NO: 517151 - RNA, 14 nt, Chlamydophila pneumoniae CWL029
caucuaaaaaugca

SEQ ID NO: 517152 - RNA, 19 nt, Chlamydophila pneumoniae CWL029
cauccugucuauuucuuaa

SEQ ID NO: 517153 - RNA, 14 nt, Chlamydophila pneumoniae CWL029
cauccucagucucu

SEQ ID NO: 517154 - RNA, 21 nt, Chlamydophila pneumoniae CWL029
cauccucaucaucagaaauca

SEQ ID NO: 517155 - RNA, 14 nt, Chlamydophila pneumoniae CWL029
cauccugaucuucu

SEQ ID NO: 517156 - RNA, 21 nt, Chlamydophila pneumoniae CWL029
cauccugaacggcucuuucua

SEQ ID NO: 517157 - RNA, 12 nt, Chlamydophila pneumoniae CWL029
caucccuucuuc

SEQ ID NO: 517158 - RNA, 17 nt, Chlamydophila pneumoniae CWL029
caucccuucuucuuuua

SEQ ID NO: 517159 - RNA, 22 nt, Chlamydophila pneumoniae CWL029
caucccuagggaaagcaucuuu

SEQ ID NO: 517160 - RNA, 19 nt, Chlamydophila pneumoniae CWL029
caucaguggauucgugcuu

SEQ ID NO: 517161 - RNA, 20 nt, Chlamydophila pneumoniae CWL029
caucaguggcgacugcaaca

SEQ ID NO: 517162 - RNA, 13 nt, Chlamydophila pneumoniae CWL029
caucaguuccauu

SEQ ID NO: 517163 - RNA, 12 nt, Chlamydophila pneumoniae CWL029
caucaucgagcu

SEQ ID NO: 517164 - RNA, 14 nt, Chlamydophila pneumoniae CWL029
caucaucagaagcu

SEQ ID NO: 517165 - RNA, 17 nt, Chlamydophila pneumoniae CWL029
caucaucagaagcuccu

SEQ ID NO: 517166 - RNA, 18 nt, Chlamydophila pneumoniae CWL029
caucacgaggagcuuuua

SEQ ID NO: 517167 - RNA, 18 nt, Chlamydophila pneumoniae CWL029
caucagaaguggccuugc

SEQ ID NO: 517168 - RNA, 21 nt, Chlamydophila pneumoniae CWL029
caucagaaguggccuugccag

SEQ ID NO: 517169 - RNA, 17 nt, Chlamydophila pneumoniae CWL029
caucagacugaagagca

SEQ ID NO: 517170 - RNA, 18 nt, Chlamydophila pneumoniae CWL029
caucagagaacucuuaaa

SEQ ID NO: 517171 - RNA, 16 nt, Chlamydophila pneumoniae CWL029
cauauuuauuuaaacc

SEQ ID NO: 517172 - RNA, 21 nt, Chlamydophila pneumoniae CWL029
caucaaccgaagauccuagag

SEQ ID NO: 517173 - RNA, 18 nt, Chlamydophila pneumoniae CWL029
cauauuuacgaaaacauc

SEQ ID NO: 517174 - RNA, 13 nt, Chlamydophila pneumoniae CWL029
cauauuuaaauau

SEQ ID NO: 517175 - RNA, 22 nt, Chlamydophila pneumoniae CWL029
cauauggauugucgaugaggga

SEQ ID NO: 517176 - RNA, 17 nt, Chlamydophila pneumoniae CWL029
cauaugggacuucaagc

SEQ ID NO: 517177 - RNA, 15 nt, Chlamydophila pneumoniae CWL029
cauaguauggcauuc

SEQ ID NO: 517178 - RNA, 14 nt, Chlamydophila pneumoniae CWL029
cauacgguauacca

SEQ ID NO: 517179 - RNA, 16 nt, Chlamydophila pneumoniae CWL029
cauacuacucucauca

SEQ ID NO: 517180 - RNA, 17 nt, Chlamydophila pneumoniae CWL029
cauagucguuuucucga

SEQ ID NO: 517181 - RNA, 18 nt, Chlamydophila pneumoniae CWL029
cauagucgucuuuuaaag

SEQ ID NO: 517182 - RNA, 15 nt, Chlamydophila pneumoniae CWL029
cauaguggcucagug

SEQ ID NO: 517183 - RNA, 14 nt, Chlamydophila pneumoniae CWL029
cauaguguuccaaa

SEQ ID NO: 517184 - RNA, 19 nt, Chlamydophila pneumoniae CWL029
cauaucuccuuuaaauaaa

SEQ ID NO: 517185 - RNA, 20 nt, Chlamydophila pneumoniae CWL029
cauaucuccuuuaaauaaaa

SEQ ID NO: 517186 - RNA, 19 nt, Chlamydophila pneumoniae CWL029
cauaucaucgauaucuaag

SEQ ID NO: 517187 - RNA, 18 nt, Chlamydophila pneumoniae CWL029
cauacccuucuucuucag

SEQ ID NO: 517188 - RNA, 13 nt, Chlamydophila pneumoniae CWL029
cauacccaaauuu

SEQ ID NO: 517189 - RNA, 13 nt, Chlamydophila pneumoniae CWL029
cauacgacaguaa

SEQ ID NO: 517190 - RNA, 21 nt, Chlamydophila pneumoniae CWL029
cauacgccgugccuauagaaa

SEQ ID NO: 517191 - RNA, 23 nt, Chlamydophila pneumoniae CWL029
cauacgccgugccuauagaaauu

SEQ ID NO: 517192 - RNA, 17 nt, Chlamydophila pneumoniae CWL029
cauacaccccaguuucu

SEQ ID NO: 517193 - RNA, 17 nt, Chlamydophila pneumoniae CWL029
cauacacaaaucauuua

SEQ ID NO: 517194 - RNA, 14 nt, Chlamydophila pneumoniae CWL029
cauaauuuuucuua

SEQ ID NO: 517195 - RNA, 18 nt, Chlamydophila pneumoniae CWL029
cauacaucguauccaaau

SEQ ID NO: 517196 - RNA, 15 nt, Chlamydophila pneumoniae CWL029
cauacauucuauucu

SEQ ID NO: 517197 - RNA, 20 nt, Chlamydophila pneumoniae CWL029
cauaauauaauaguggcuau

SEQ ID NO: 517198 - RNA, 20 nt, Chlamydophila pneumoniae CWL029
cauaauaagcaggaaaagca

SEQ ID NO: 517199 - RNA, 21 nt, Chlamydophila pneumoniae CWL029
cauaauaagcaggaaaagcaa

SEQ ID NO: 517200 - RNA, 20 nt, Chlamydophila pneumoniae CWL029
cauaauccugaauggcucug

SEQ ID NO: 517201 - RNA, 12 nt, Chlamydophila pneumoniae CWL029
cauaauccaaga

SEQ ID NO: 517202 - RNA, 17 nt, Chlamydophila pneumoniae CWL029
cauaauagucucuguaa

SEQ ID NO: 517203 - RNA, 16 nt, Chlamydophila pneumoniae CWL029
cauaauuagagagaau

SEQ ID NO: 517204 - RNA, 15 nt, Chlamydophila pneumoniae CWL029
cauaaucucaccaga

SEQ ID NO: 517205 - RNA, 12 nt, Chlamydophila pneumoniae CWL029
cauaaucuccaa

SEQ ID NO: 517206 - RNA, 20 nt, Chlamydophila pneumoniae CWL029
cauaaucucaccagaagcaa

SEQ ID NO: 517207 - RNA, 17 nt, Chlamydophila pneumoniae CWL029
cauaaugagacagacag

SEQ ID NO: 517208 - RNA, 14 nt, Chlamydophila pneumoniae CWL029
cauaaaaauuucau

SEQ ID NO: 517209 - RNA, 16 nt, Chlamydophila pneumoniae CWL029
cauaaaaauucucaua

SEQ ID NO: 517210 - RNA, 15 nt, Chlamydophila pneumoniae CWL029
cauaaacaauucaug

SEQ ID NO: 517211 - RNA, 16 nt, Chlamydophila pneumoniae CWL029
cauaaagacccuucuu

SEQ ID NO: 517212 - RNA, 23 nt, Chlamydophila pneumoniae CWL029
cauaaagaccgagaagcuucaau

SEQ ID NO: 517213 - RNA, 22 nt, Chlamydophila pneumoniae CWL029
cauaaaggcgucgccccaugaa

SEQ ID NO: 517214 - RNA, 19 nt, Chlamydophila pneumoniae CWL029
cauaaaggcucuuuuagag

SEQ ID NO: 517215 - RNA, 22 nt, Chlamydophila pneumoniae CWL029
cauaaagccccacccacuccag

SEQ ID NO: 517216 - RNA, 22 nt, Chlamydophila pneumoniae CWL029
cauaaagaucgugaucaaagaa

SEQ ID NO: 517217 - RNA, 21 nt, Chlamydophila pneumoniae CWL029
cauaaagaucuuuauuuuuaa

SEQ ID NO: 517218 - RNA, 21 nt, Chlamydophila pneumoniae CWL029
cauaaaguucggcgccuucaa

SEQ ID NO: 517219 - RNA, 19 nt, Chlamydophila pneumoniae CWL029
cauaaauacgugcuugaau

SEQ ID NO: 517220 - RNA, 21 nt, Chlamydophila pneumoniae CWL029
cauaaauguauaggcauuaau

SEQ ID NO: 517221 - RNA, 21 nt, Chlamydophila pneumoniae CWL029
cauaaauaggcucuacaggag

SEQ ID NO: 517222 - RNA, 19 nt, Chlamydophila pneumoniae CWL029
cauaaccugggcaauauuu

SEQ ID NO: 517223 - RNA, 20 nt, Chlamydophila pneumoniae CWL029
cauaacgacaugccuuggua

SEQ ID NO: 517224 - RNA, 17 nt, Chlamydophila pneumoniae CWL029
cauaaccaaguaaauca

SEQ ID NO: 517225 - RNA, 12 nt, Chlamydophila pneumoniae CWL029
cauaacccaaag

SEQ ID NO: 517226 - RNA, 22 nt, Chlamydophila pneumoniae CWL029
cauaacauuuagauaaagaaag

SEQ ID NO: 517227 - RNA, 19 nt, Chlamydophila pneumoniae CWL029
cauaagaacucuauuuggc

SEQ ID NO: 517228 - RNA, 11 nt, Chlamydophila pneumoniae CWL029
cauaagaacuc

SEQ ID NO: 517229 - RNA, 14 nt, Chlamydophila pneumoniae CWL029
cauaacuugaagaa

SEQ ID NO: 517230 - RNA, 19 nt, Chlamydophila pneumoniae CWL029
cauaagagacauuucuuga

SEQ ID NO: 517231 - RNA, 20 nt, Chlamydophila pneumoniae CWL029
cauaagauugccauguacau

SEQ ID NO: 517232 - RNA, 21 nt, Chlamydophila pneumoniae CWL029
cauaagauugccauguacaug

SEQ ID NO: 517233 - RNA, 15 nt, Chlamydophila pneumoniae CWL029
cauaagcucuauuuc

SEQ ID NO: 517234 - RNA, 17 nt, Chlamydophila pneumoniae CWL029
cauaagcuuuucuucca

SEQ ID NO: 517235 - RNA, 17 nt, Chlamydophila pneumoniae CWL029
caguuguacaauuugcu

SEQ ID NO: 517236 - RNA, 22 nt, Chlamydophila pneumoniae CWL029
caguuguauccagcucaaggca

SEQ ID NO: 517237 - RNA, 12 nt, Chlamydophila pneumoniae CWL029
caguuguuucua

SEQ ID NO: 517238 - RNA, 18 nt, Chlamydophila pneumoniae CWL029
caguuuuuuucuaaauuu

SEQ ID NO: 517239 - RNA, 14 nt, Chlamydophila pneumoniae CWL029
cauaaaaaaagcua

SEQ ID NO: 517240 - RNA, 21 nt, Chlamydophila pneumoniae CWL029
caguuuuaucggcaauuguua

SEQ ID NO: 517241 - RNA, 22 nt, Chlamydophila pneumoniae CWL029
caguuuuaucggcaauuguuaa

SEQ ID NO: 517242 - RNA, 15 nt, Chlamydophila pneumoniae CWL029
caguuuuccauccac

SEQ ID NO: 517243 - RNA, 18 nt, Chlamydophila pneumoniae CWL029
caguuggcguuuucuaga

SEQ ID NO: 517244 - RNA, 13 nt, Chlamydophila pneumoniae CWL029
caguugcggagau

SEQ ID NO: 517245 - RNA, 22 nt, Chlamydophila pneumoniae CWL029
caguucuuguuaaaguaaaaaa

SEQ ID NO: 517246 - RNA, 22 nt, Chlamydophila pneumoniae CWL029
caguucuucauuccaggauucu

SEQ ID NO: 517247 - RNA, 21 nt, Chlamydophila pneumoniae CWL029
caguucuugaaacucuaucag

SEQ ID NO: 517248 - RNA, 16 nt, Chlamydophila pneumoniae CWL029
caguugaugagaaaaa

SEQ ID NO: 517249 - RNA, 20 nt, Chlamydophila pneumoniae CWL029
caguugaugagaaaaagaau

SEQ ID NO: 517250 - RNA, 23 nt, Chlamydophila pneumoniae CWL029
caguugaugagaaaaagaaucuc

SEQ ID NO: 517251 - RNA, 13 nt, Chlamydophila pneumoniae CWL029
caguuccuauuuu

SEQ ID NO: 517252 - RNA, 16 nt, Chlamydophila pneumoniae CWL029
caguuccuauuuuuug

SEQ ID NO: 517253 - RNA, 15 nt, Chlamydophila pneumoniae CWL029
caguuccauagcuaa

SEQ ID NO: 517254 - RNA, 17 nt, Chlamydophila pneumoniae CWL029
caguuccgauaaagaua

SEQ ID NO: 517255 - RNA, 20 nt, Chlamydophila pneumoniae CWL029
caguuccuaaagcuuuugcu

SEQ ID NO: 517256 - RNA, 15 nt, Chlamydophila pneumoniae CWL029
caguuccuaaauuca

SEQ ID NO: 517257 - RNA, 16 nt, Chlamydophila pneumoniae CWL029
caguucaucuagauga

SEQ ID NO: 517258 - RNA, 14 nt, Chlamydophila pneumoniae CWL029
caguuaaagagcau

SEQ ID NO: 517259 - RNA, 18 nt, Chlamydophila pneumoniae CWL029
caguguauuguuugcuau

SEQ ID NO: 517260 - RNA, 21 nt, Chlamydophila pneumoniae CWL029
caguguuauuuggacguacua

SEQ ID NO: 517261 - RNA, 22 nt, Chlamydophila pneumoniae CWL029
ccacuaaguuuaggcaggaagu

SEQ ID NO: 517262 - RNA, 13 nt, Chlamydophila pneumoniae CWL029
ccacuacugagcu

SEQ ID NO: 517263 - RNA, 20 nt, Chlamydophila pneumoniae CWL029
ccacuacugagcuucuauuu

SEQ ID NO: 517264 - RNA, 18 nt, Chlamydophila pneumoniae CWL029
ccacucaaaagaagaguu

SEQ ID NO: 517265 - RNA, 15 nt, Chlamydophila pneumoniae CWL029
ccacgggucaggagg

SEQ ID NO: 517266 - RNA, 22 nt, Chlamydophila pneumoniae CWL029
ccacgaguucgcggaucuucuu

SEQ ID NO: 517267 - RNA, 18 nt, Chlamydophila pneumoniae CWL029
ccaccaggagcuccuccu

SEQ ID NO: 517268 - RNA, 23 nt, Chlamydophila pneumoniae CWL029
ccaaugggaauuugauuuuucaa

SEQ ID NO: 517269 - RNA, 19 nt, Chlamydophila pneumoniae CWL029
ccaauguggugauuucuuu

SEQ ID NO: 517270 - RNA, 13 nt, Chlamydophila pneumoniae CWL029
ccaaucuuccuua

SEQ ID NO: 517271 - RNA, 20 nt, Chlamydophila pneumoniae CWL029
ccaaucugagcacauuuuuc

SEQ ID NO: 517272 - RNA, 12 nt, Chlamydophila pneumoniae CWL029
ccaaucugcuga

SEQ ID NO: 517273 - RNA, 13 nt, Chlamydophila pneumoniae CWL029
ccaauuuuuuccc

SEQ ID NO: 517274 - RNA, 20 nt, Chlamydophila pneumoniae CWL029
ccaauugcagucacuacugu

SEQ ID NO: 517275 - RNA, 23 nt, Chlamydophila pneumoniae CWL029
ccaauuguaucuguauccuuccu

SEQ ID NO: 517276 - RNA, 21 nt, Chlamydophila pneumoniae CWL029
ccacagcccucuacgcucuua

SEQ ID NO: 517277 - RNA, 14 nt, Chlamydophila pneumoniae CWL029
ccacaggaaugaaa

SEQ ID NO: 517278 - RNA, 13 nt, Chlamydophila pneumoniae CWL029
ccacagcuucuuc

SEQ ID NO: 517279 - RNA, 16 nt, Chlamydophila pneumoniae CWL029
ccacagacugcaggaa

SEQ ID NO: 517280 - RNA, 17 nt, Chlamydophila pneumoniae CWL029
ccacacaggauuguuau

SEQ ID NO: 517281 - RNA, 20 nt, Chlamydophila pneumoniae CWL029
ccaauauagaagcugcugcu

SEQ ID NO: 517282 - RNA, 17 nt, Chlamydophila pneumoniae CWL029
ccaauaugcucugccau

SEQ ID NO: 517283 - RNA, 21 nt, Chlamydophila pneumoniae CWL029
ccaauaugcucugccauuucu

SEQ ID NO: 517284 - RNA, 19 nt, Chlamydophila pneumoniae CWL029
ccaaucgauaacguugccu

SEQ ID NO: 517285 - RNA, 19 nt, Chlamydophila pneumoniae CWL029
ccaagucagccaagacaaa

SEQ ID NO: 517286 - RNA, 13 nt, Chlamydophila pneumoniae CWL029
ccaauacagcaua

SEQ ID NO: 517287 - RNA, 14 nt, Chlamydophila pneumoniae CWL029
ccaauacuaaaacu

SEQ ID NO: 517288 - RNA, 15 nt, Chlamydophila pneumoniae CWL029
ccaauauagaagcug

SEQ ID NO: 517289 - RNA, 19 nt, Chlamydophila pneumoniae CWL029
ccaacaucagcuguugcgu

SEQ ID NO: 517290 - RNA, 12 nt, Chlamydophila pneumoniae CWL029
ccaacugagcua

SEQ ID NO: 517291 - RNA, 15 nt, Chlamydophila pneumoniae CWL029
ccaacugagcuauuu

SEQ ID NO: 517292 - RNA, 15 nt, Chlamydophila pneumoniae CWL029
ccaaggaaaaacaaa

SEQ ID NO: 517293 - RNA, 14 nt, Chlamydophila pneumoniae CWL029
ccaagcaagaagug

SEQ ID NO: 517294 - RNA, 20 nt, Chlamydophila pneumoniae CWL029
ccaagcuuccaacuuuugaa

SEQ ID NO: 517295 - RNA, 22 nt, Chlamydophila pneumoniae CWL029
ccaagagucuuugaugcuaaac

SEQ ID NO: 517296 - RNA, 17 nt, Chlamydophila pneumoniae CWL029
ccaacaagggaaagaaa

SEQ ID NO: 517297 - RNA, 15 nt, Chlamydophila pneumoniae CWL029
ccaacaguguagccu

SEQ ID NO: 517298 - RNA, 16 nt, Chlamydophila pneumoniae CWL029
ccaacaguucuuucug

SEQ ID NO: 517299 - RNA, 15 nt, Chlamydophila pneumoniae CWL029
ccaacaguucuuucu

SEQ ID NO: 517300 - RNA, 23 nt, Chlamydophila pneumoniae CWL029
ccaaaucucaaucgauaaucaaa

SEQ ID NO: 517301 - RNA, 12 nt, Chlamydophila pneumoniae CWL029
ccaaauccuccg

SEQ ID NO: 517302 - RNA, 13 nt, Chlamydophila pneumoniae CWL029
ccaaauccuccgc

SEQ ID NO: 517303 - RNA, 13 nt, Chlamydophila pneumoniae CWL029
ccaacaaagauga

SEQ ID NO: 517304 - RNA, 20 nt, Chlamydophila pneumoniae CWL029
cauuuucaggcugaaccaaa

SEQ ID NO: 517305 - RNA, 18 nt, Chlamydophila pneumoniae CWL029
cauuuucaggcugaacca

SEQ ID NO: 517306 - RNA, 20 nt, Chlamydophila pneumoniae CWL029
cauuuuaugaucucuucaug

SEQ ID NO: 517307 - RNA, 18 nt, Chlamydophila pneumoniae CWL029
ccaaagucacucaaaccc

SEQ ID NO: 517308 - RNA, 21 nt, Chlamydophila pneumoniae CWL029
ccaaagucacucaaacccucu

SEQ ID NO: 517309 - RNA, 23 nt, Chlamydophila pneumoniae CWL029
ccaaagugacuuccuccaaaauu

SEQ ID NO: 517310 - RNA, 15 nt, Chlamydophila pneumoniae CWL029
ccaaaggaaaauaau

SEQ ID NO: 517311 - RNA, 17 nt, Chlamydophila pneumoniae CWL029
ccaaagcuauuucucua

SEQ ID NO: 517312 - RNA, 23 nt, Chlamydophila pneumoniae CWL029
ccaaagcuauuucucuaucauca

SEQ ID NO: 517313 - RNA, 19 nt, Chlamydophila pneumoniae CWL029
cauuuaucugcguuucuuu

SEQ ID NO: 517314 - RNA, 16 nt, Chlamydophila pneumoniae CWL029
cauuuagaaguaaucc

SEQ ID NO: 517315 - RNA, 16 nt, Chlamydophila pneumoniae CWL029
cauuuagacaagacac

SEQ ID NO: 517316 - RNA, 17 nt, Chlamydophila pneumoniae CWL029
cauuuagacaaucuacg

SEQ ID NO: 517317 - RNA, 18 nt, Chlamydophila pneumoniae CWL029
cauuucgauaacacuucu

SEQ ID NO: 517318 - RNA, 23 nt, Chlamydophila pneumoniae CWL029
cauuucgauaacacuucuuucuu

SEQ ID NO: 517319 - RNA, 14 nt, Chlamydophila pneumoniae CWL029
cauuugcuauuuuc

SEQ ID NO: 517320 - RNA, 14 nt, Chlamydophila pneumoniae CWL029
cauuugcuuuaaca

SEQ ID NO: 517321 - RNA, 15 nt, Chlamydophila pneumoniae CWL029
cauuugauucauaaa

SEQ ID NO: 517322 - RNA, 17 nt, Chlamydophila pneumoniae CWL029
cauuugauucauaaaga

SEQ ID NO: 517323 - RNA, 21 nt, Chlamydophila pneumoniae CWL029
cauuucguuuuuucuuaucug

SEQ ID NO: 517324 - RNA, 18 nt, Chlamydophila pneumoniae CWL029
cauuucuacacgccacaa

SEQ ID NO: 517325 - RNA, 22 nt, Chlamydophila pneumoniae CWL029
cauuucuaucaguucauuuugg

SEQ ID NO: 517326 - RNA, 18 nt, Chlamydophila pneumoniae CWL029
cauuucucaccacggaag

SEQ ID NO: 517327 - RNA, 22 nt, Chlamydophila pneumoniae CWL029
cauuucuucuuagaaacacagu

SEQ ID NO: 517328 - RNA, 18 nt, Chlamydophila pneumoniae CWL029
cauuuaaacuaagaauac

SEQ ID NO: 517329 - RNA, 14 nt, Chlamydophila pneumoniae CWL029
cauuuaaagcugaa

SEQ ID NO: 517330 - RNA, 15 nt, Chlamydophila pneumoniae CWL029
cauuuaaauggaugc

SEQ ID NO: 517331 - RNA, 20 nt, Chlamydophila pneumoniae CWL029
cauuguggaacgcauaagag

SEQ ID NO: 517332 - RNA, 17 nt, Chlamydophila pneumoniae CWL029
cauugucucuuuuaaag

SEQ ID NO: 517333 - RNA, 22 nt, Chlamydophila pneumoniae CWL029
cauucuaacgcuuuuucaaacu

SEQ ID NO: 517334 - RNA, 23 nt, Chlamydophila pneumoniae CWL029
cauugcaaauaagccaguacuaa

SEQ ID NO: 517335 - RNA, 12 nt, Chlamydophila pneumoniae CWL029
cauuccugcagu

SEQ ID NO: 517336 - RNA, 15 nt, Chlamydophila pneumoniae CWL029
cauucaauaauuuca

SEQ ID NO: 517337 - RNA, 15 nt, Chlamydophila pneumoniae CWL029
cauuagggcauucug

SEQ ID NO: 517338 - RNA, 19 nt, Chlamydophila pneumoniae CWL029
cauuagggcauucuguaau

SEQ ID NO: 517339 - RNA, 16 nt, Chlamydophila pneumoniae CWL029
cauuagcuaaaucaaa

SEQ ID NO: 517340 - RNA, 15 nt, Chlamydophila pneumoniae CWL029
cauuauacuuuuuuu

SEQ ID NO: 517341 - RNA, 23 nt, Chlamydophila pneumoniae CWL029
cauuagaguuugguuuguuugau

SEQ ID NO: 517342 - RNA, 23 nt, Chlamydophila pneumoniae CWL029
cauuacggaggcauaaucuccaa

SEQ ID NO: 517343 - RNA, 22 nt, Chlamydophila pneumoniae CWL029
cauuacgguuucugggaugcac

SEQ ID NO: 517344 - RNA, 20 nt, Chlamydophila pneumoniae CWL029
cauuaccguucccuaaagua

SEQ ID NO: 517345 - RNA, 22 nt, Chlamydophila pneumoniae CWL029
cauuaccugcuaaacuuuuuuu

SEQ ID NO: 517346 - RNA, 15 nt, Chlamydophila pneumoniae CWL029
cauuaauaucccagu

SEQ ID NO: 517347 - RNA, 16 nt, Chlamydophila pneumoniae CWL029
cauuaauaauaucuaa

SEQ ID NO: 517348 - RNA, 13 nt, Chlamydophila pneumoniae CWL029
cauuaaggaaucc

SEQ ID NO: 517349 - RNA, 12 nt, Chlamydophila pneumoniae CWL029
cauuaaguacug

SEQ ID NO: 517350 - RNA, 15 nt, Chlamydophila pneumoniae CWL029
caugugcugaagacc

SEQ ID NO: 517351 - RNA, 13 nt, Chlamydophila pneumoniae CWL029
caugugcugaaga

SEQ ID NO: 517352 - RNA, 14 nt, Chlamydophila pneumoniae CWL029
caugugcugaagac

SEQ ID NO: 517353 - RNA, 21 nt, Chlamydophila pneumoniae CWL029
cauguccuccauggaaagaaa

SEQ ID NO: 517354 - RNA, 13 nt, Chlamydophila pneumoniae CWL029
cauggcuauuuuu

SEQ ID NO: 517355 - RNA, 17 nt, Chlamydophila pneumoniae CWL029
cauggcuggaaagccaa

SEQ ID NO: 517356 - RNA, 15 nt, Chlamydophila pneumoniae CWL029
cauggcuggaaagcc

SEQ ID NO: 517357 - RNA, 22 nt, Chlamydophila pneumoniae CWL029
caucuucacuaaaugacgcaca

SEQ ID NO: 517358 - RNA, 14 nt, Chlamydophila pneumoniae CWL029
cauggagguucuca

SEQ ID NO: 517359 - RNA, 15 nt, Chlamydophila pneumoniae CWL029
cauggauauggaaug

SEQ ID NO: 517360 - RNA, 19 nt, Chlamydophila pneumoniae CWL029
cauggacaagcaaaagcaa

SEQ ID NO: 517361 - RNA, 20 nt, Chlamydophila pneumoniae CWL029
cauggauucacaucuuaaaa

SEQ ID NO: 517362 - RNA, 22 nt, Chlamydophila pneumoniae CWL029
cauggaagugcggcucucuuca

SEQ ID NO: 517363 - RNA, 13 nt, Chlamydophila pneumoniae CWL029
caugcuugaggaa

SEQ ID NO: 517364 - RNA, 20 nt, Chlamydophila pneumoniae CWL029
caugcuugaggaauucuuua

SEQ ID NO: 517365 - RNA, 15 nt, Chlamydophila pneumoniae CWL029
caugcuuuccuucca

SEQ ID NO: 517366 - RNA, 18 nt, Chlamydophila pneumoniae CWL029
cgaauaaggcuugaggau

SEQ ID NO: 517367 - RNA, 14 nt, Chlamydophila pneumoniae CWL029
cgaaguccuggauu

SEQ ID NO: 517368 - RNA, 19 nt, Chlamydophila pneumoniae CWL029
cgaagcggagcaucuuuuc

SEQ ID NO: 517369 - RNA, 20 nt, Chlamydophila pneumoniae CWL029
cgaagacuuguucuucauua

SEQ ID NO: 517370 - RNA, 22 nt, Chlamydophila pneumoniae CWL029
cgaagacuuguucuucauuauu

SEQ ID NO: 517371 - RNA, 17 nt, Chlamydophila pneumoniae CWL029
cgaagacucaaagaacu

SEQ ID NO: 517372 - RNA, 22 nt, Chlamydophila pneumoniae CWL029
cgaagagcccucuucacuuaua

SEQ ID NO: 517373 - RNA, 21 nt, Chlamydophila pneumoniae CWL029
cgaagacaaugucgucucaga

SEQ ID NO: 517374 - RNA, 18 nt, Chlamydophila pneumoniae CWL029
cgaacaguucauguugcu

SEQ ID NO: 517375 - RNA, 18 nt, Chlamydophila pneumoniae CWL029
cgaacaguuccuauuuuu

SEQ ID NO: 517376 - RNA, 14 nt, Chlamydophila pneumoniae CWL029
cgaacaugccugaa

SEQ ID NO: 517377 - RNA, 15 nt, Chlamydophila pneumoniae CWL029
cgaacagcuccugga

SEQ ID NO: 517378 - RNA, 13 nt, Chlamydophila pneumoniae CWL029
cgaaauccuaaaa

SEQ ID NO: 517379 - RNA, 21 nt, Chlamydophila pneumoniae CWL029
cgaaauccuaaaaaggguucc

SEQ ID NO: 517380 - RNA, 13 nt, Chlamydophila pneumoniae CWL029
cgaaagaucagag

SEQ ID NO: 517381 - RNA, 20 nt, Chlamydophila pneumoniae CWL029
cgaaagucccgcaacuaaac

SEQ ID NO: 517382 - RNA, 19 nt, Chlamydophila pneumoniae CWL029
cgaaaccggacugacuucu

SEQ ID NO: 517383 - RNA, 15 nt, Chlamydophila pneumoniae CWL029
cgaaaccacagcaaa

SEQ ID NO: 517384 - RNA, 20 nt, Chlamydophila pneumoniae CWL029
cgaaaccacagcaaagacua

SEQ ID NO: 517385 - RNA, 13 nt, Chlamydophila pneumoniae CWL029
cgaaaaucuacac

SEQ ID NO: 517386 - RNA, 15 nt, Chlamydophila pneumoniae CWL029
cgaaaaaccuucucc

SEQ ID NO: 517387 - RNA, 13 nt, Chlamydophila pneumoniae CWL029
ccuuuucuccuuc

SEQ ID NO: 517388 - RNA, 16 nt, Chlamydophila pneumoniae CWL029
ccuuuucuccuucugg

SEQ ID NO: 517389 - RNA, 19 nt, Chlamydophila pneumoniae CWL029
ccuuuuucugcuucuccaa

SEQ ID NO: 517390 - RNA, 19 nt, Chlamydophila pneumoniae CWL029
ccuuucuccagcauuuuug

SEQ ID NO: 517391 - RNA, 18 nt, Chlamydophila pneumoniae CWL029
ccuuggguuugucuccaa

SEQ ID NO: 517392 - RNA, 19 nt, Chlamydophila pneumoniae CWL029
ccuuugagucuuuuucaga

SEQ ID NO: 517393 - RNA, 17 nt, Chlamydophila pneumoniae CWL029
ccuuucuuuugcuuuuc

SEQ ID NO: 517394 - RNA, 18 nt, Chlamydophila pneumoniae CWL029
ccuuucuuuugcuuuucc

SEQ ID NO: 517395 - RNA, 17 nt, Chlamydophila pneumoniae CWL029
ccuuuuccuaaaucugc

SEQ ID NO: 517396 - RNA, 20 nt, Chlamydophila pneumoniae CWL029
ccuugcauuagauucagcac

SEQ ID NO: 517397 - RNA, 13 nt, Chlamydophila pneumoniae CWL029
ccuugcagcccug

SEQ ID NO: 517398 - RNA, 21 nt, Chlamydophila pneumoniae CWL029
ccuugagcuaacgacauugaa

SEQ ID NO: 517399 - RNA, 22 nt, Chlamydophila pneumoniae CWL029
ccuucuggaugcccuggauagc

SEQ ID NO: 517400 - RNA, 15 nt, Chlamydophila pneumoniae CWL029
ccuucugcaaucagu

SEQ ID NO: 517401 - RNA, 22 nt, Chlamydophila pneumoniae CWL029
ccuuacucccaugggauaggaa

SEQ ID NO: 517402 - RNA, 15 nt, Chlamydophila pneumoniae CWL029
ccuuaacaacaucac

SEQ ID NO: 517403 - RNA, 18 nt, Chlamydophila pneumoniae CWL029
ccuuaacaaccgccuuua

SEQ ID NO: 517404 - RNA, 14 nt, Chlamydophila pneumoniae CWL029
ccuuccaagugcuc

SEQ ID NO: 517405 - RNA, 14 nt, Chlamydophila pneumoniae CWL029
ccuuauaguccaua

SEQ ID NO: 517406 - RNA, 23 nt, Chlamydophila pneumoniae CWL029
ccuuccauacggacaacaacagc

SEQ ID NO: 517407 - RNA, 12 nt, Chlamydophila pneumoniae CWL029
ccuuccaauacu

SEQ ID NO: 517408 - RNA, 14 nt, Chlamydophila pneumoniae CWL029
ccuucucagaaaga

SEQ ID NO: 517409 - RNA, 18 nt, Chlamydophila pneumoniae CWL029
ccuucuacagauugaugc

SEQ ID NO: 517410 - RNA, 23 nt, Chlamydophila pneumoniae CWL029
ccuucguaacgcuuuucuaauag

SEQ ID NO: 517411 - RNA, 22 nt, Chlamydophila pneumoniae CWL029
ccuguuuucuuuucugaagauu

SEQ ID NO: 517412 - RNA, 19 nt, Chlamydophila pneumoniae CWL029
ccuuaaagagaaucuccuc

SEQ ID NO: 517413 - RNA, 21 nt, Chlamydophila pneumoniae CWL029
ccuguugucacuaagauaucu

SEQ ID NO: 517414 - RNA, 16 nt, Chlamydophila pneumoniae CWL029
ccuguuuuauugggaa

SEQ ID NO: 517415 - RNA, 18 nt, Chlamydophila pneumoniae CWL029
ccuguucuagcaaaucua

SEQ ID NO: 517416 - RNA, 20 nt, Chlamydophila pneumoniae CWL029
ccugugagucugaugcccac

SEQ ID NO: 517417 - RNA, 19 nt, Chlamydophila pneumoniae CWL029
ccugugauagguagcagcc

SEQ ID NO: 517418 - RNA, 16 nt, Chlamydophila pneumoniae CWL029
ccuguguguuuuuucc

SEQ ID NO: 517419 - RNA, 15 nt, Chlamydophila pneumoniae CWL029
ccuguaacacccucc

SEQ ID NO: 517420 - RNA, 19 nt, Chlamydophila pneumoniae CWL029
ccuguaguaaaauaagaaa

SEQ ID NO: 517421 - RNA, 23 nt, Chlamydophila pneumoniae CWL029
ccuguaguuucuaaaacagaaau

SEQ ID NO: 517422 - RNA, 23 nt, Chlamydophila pneumoniae CWL029
ccuguauauucugaaauuucuga

SEQ ID NO: 517423 - RNA, 19 nt, Chlamydophila pneumoniae CWL029
ccugguuugacuccucgcu

SEQ ID NO: 517424 - RNA, 23 nt, Chlamydophila pneumoniae CWL029
ccugcaaaaaaccagccaauaac

SEQ ID NO: 517425 - RNA, 16 nt, Chlamydophila pneumoniae CWL029
ccugcaaacuccccag

SEQ ID NO: 517426 - RNA, 14 nt, Chlamydophila pneumoniae CWL029
ccugaucuucuuga

SEQ ID NO: 517427 - RNA, 13 nt, Chlamydophila pneumoniae CWL029
ccugaugccuuuu

SEQ ID NO: 517428 - RNA, 17 nt, Chlamydophila pneumoniae CWL029
ccugauuccauccuguc

SEQ ID NO: 517429 - RNA, 15 nt, Chlamydophila pneumoniae CWL029
ccugauguugcccua

SEQ ID NO: 517430 - RNA, 13 nt, Chlamydophila pneumoniae CWL029
ccugcauggcuuu

SEQ ID NO: 517431 - RNA, 15 nt, Chlamydophila pneumoniae CWL029
ccugcauucauaaaa

SEQ ID NO: 517432 - RNA, 23 nt, Chlamydophila pneumoniae CWL029
ccugagaccauaaaaucaacaag

SEQ ID NO: 517433 - RNA, 21 nt, Chlamydophila pneumoniae CWL029
ccugaggcuauagaauacaca

SEQ ID NO: 517434 - RNA, 14 nt, Chlamydophila pneumoniae CWL029
ccugaguaaaauca

SEQ ID NO: 517435 - RNA, 22 nt, Chlamydophila pneumoniae CWL029
ccugaguauuuugcaaaugaaa

SEQ ID NO: 517436 - RNA, 23 nt, Chlamydophila pneumoniae CWL029
ccugacgcauagcacuaugaauu

SEQ ID NO: 517437 - RNA, 12 nt, Chlamydophila pneumoniae CWL029
ccugaagaugag

SEQ ID NO: 517438 - RNA, 13 nt, Chlamydophila pneumoniae CWL029
ccugaaaguacag

SEQ ID NO: 517439 - RNA, 23 nt, Chlamydophila pneumoniae CWL029
ccugaaaguacagaaaggaccuc

SEQ ID NO: 517440 - RNA, 16 nt, Chlamydophila pneumoniae CWL029
ccugaacaucuccagc

SEQ ID NO: 517441 - RNA, 17 nt, Chlamydophila pneumoniae CWL029
ccugaaauccugggcaa

SEQ ID NO: 517442 - RNA, 19 nt, Chlamydophila pneumoniae CWL029
ccucuucaauuucuucauc

SEQ ID NO: 517443 - RNA, 22 nt, Chlamydophila pneumoniae CWL029
ccucugggaagacucucaucag

SEQ ID NO: 517444 - RNA, 19 nt, Chlamydophila pneumoniae CWL029
ccucuuuuauauaccacua

SEQ ID NO: 517445 - RNA, 20 nt, Chlamydophila pneumoniae CWL029
ccucuugaggaccuuccuua

SEQ ID NO: 517446 - RNA, 18 nt, Chlamydophila pneumoniae CWL029
ccucuauccaucaucgaa

SEQ ID NO: 517447 - RNA, 18 nt, Chlamydophila pneumoniae CWL029
ccucucacauuugcagac

SEQ ID NO: 517448 - RNA, 23 nt, Chlamydophila pneumoniae CWL029
ccucucaugaaauuuucuaagag

SEQ ID NO: 517449 - RNA, 19 nt, Chlamydophila pneumoniae CWL029
ccucuaaugacagcugaga

SEQ ID NO: 517450 - RNA, 15 nt, Chlamydophila pneumoniae CWL029
ccucuacgcucuuaa

SEQ ID NO: 517451 - RNA, 15 nt, Chlamydophila pneumoniae CWL029
ccucuagaagacaca

SEQ ID NO: 517452 - RNA, 19 nt, Chlamydophila pneumoniae CWL029
ccucugauuauuucuaaaa

SEQ ID NO: 517453 - RNA, 14 nt, Chlamydophila pneumoniae CWL029
ccucucccuuggga

SEQ ID NO: 517454 - RNA, 15 nt, Chlamydophila pneumoniae CWL029
ccucuccuugaaaau

SEQ ID NO: 517455 - RNA, 18 nt, Chlamydophila pneumoniae CWL029
ccucuaaggacaaaucuc

SEQ ID NO: 517456 - RNA, 20 nt, Chlamydophila pneumoniae CWL029
ccucuaaggacaaaucuccc

SEQ ID NO: 517457 - RNA, 22 nt, Chlamydophila pneumoniae CWL029
ccucuaaggacaaaucucccaa

SEQ ID NO: 517458 - RNA, 16 nt, Chlamydophila pneumoniae CWL029
ccucgucaccugagcu

SEQ ID NO: 517459 - RNA, 13 nt, Chlamydophila pneumoniae CWL029
ccucgccaaacca

SEQ ID NO: 517460 - RNA, 16 nt, Chlamydophila pneumoniae CWL029
ccuccucuucuucauc

SEQ ID NO: 517461 - RNA, 21 nt, Chlamydophila pneumoniae CWL029
ccucgguuauuuuuccagaaa

SEQ ID NO: 517462 - RNA, 15 nt, Chlamydophila pneumoniae CWL029
aaacgcccuucagga

SEQ ID NO: 517463 - RNA, 21 nt, Chlamydophila pneumoniae CWL029
ccuccgauugcuaaucccuuc

SEQ ID NO: 517464 - RNA, 22 nt, Chlamydophila pneumoniae CWL029
ccucaaagccgaggauucgcua

SEQ ID NO: 517465 - RNA, 12 nt, Chlamydophila pneumoniae CWL029
ccuaugauaaag

SEQ ID NO: 517466 - RNA, 16 nt, Chlamydophila pneumoniae CWL029
ccuaugauaaagccug

SEQ ID NO: 517467 - RNA, 19 nt, Chlamydophila pneumoniae CWL029
ccuauggcagcaggaauaa

SEQ ID NO: 517468 - RNA, 20 nt, Chlamydophila pneumoniae CWL029
ccuaugacggauccuagaau

SEQ ID NO: 517469 - RNA, 23 nt, Chlamydophila pneumoniae CWL029
ccuauggcagcaggaauaaucaa

SEQ ID NO: 517470 - RNA, 14 nt, Chlamydophila pneumoniae CWL029
ccgugaacaaaaac

SEQ ID NO: 517471 - RNA, 17 nt, Chlamydophila pneumoniae CWL029
ccgugacuccagaaggu

SEQ ID NO: 517472 - RNA, 17 nt, Chlamydophila pneumoniae CWL029
ccgugagauacuuuaaa

SEQ ID NO: 517473 - RNA, 18 nt, Chlamydophila pneumoniae CWL029
ccgucauauuuaaaaggc

SEQ ID NO: 517474 - RNA, 20 nt, Chlamydophila pneumoniae CWL029
aaaccuuuuuuuaaaaauau

SEQ ID NO: 517475 - RNA, 14 nt, Chlamydophila pneumoniae CWL029
aaaccuucucucuu

SEQ ID NO: 517476 - RNA, 12 nt, Chlamydophila pneumoniae CWL029
aaacgaauacug

SEQ ID NO: 517477 - RNA, 15 nt, Chlamydophila pneumoniae CWL029
aaacgaaagcagugu

SEQ ID NO: 517478 - RNA, 12 nt, Chlamydophila pneumoniae CWL029
aaacgaaagcag

SEQ ID NO: 517479 - RNA, 21 nt, Chlamydophila pneumoniae CWL029
ccguaggguagccauccacga

SEQ ID NO: 517480 - RNA, 14 nt, Chlamydophila pneumoniae CWL029
ccguaaaagaacgu

SEQ ID NO: 517481 - RNA, 14 nt, Chlamydophila pneumoniae CWL029
ccguaacugaggca

SEQ ID NO: 517482 - RNA, 16 nt, Chlamydophila pneumoniae CWL029
aaaccguaacugaggc

SEQ ID NO: 517483 - RNA, 15 nt, Chlamydophila pneumoniae CWL029
aaaccguaggauucu

SEQ ID NO: 517484 - RNA, 17 nt, Chlamydophila pneumoniae CWL029
ccggcuuguaggaucug

SEQ ID NO: 517485 - RNA, 15 nt, Chlamydophila pneumoniae CWL029
ccggaaggaguucuu

SEQ ID NO: 517486 - RNA, 19 nt, Chlamydophila pneumoniae CWL029
aaacccucuccagaagucg

SEQ ID NO: 517487 - RNA, 17 nt, Chlamydophila pneumoniae CWL029
aaacccucaaagaauac

SEQ ID NO: 517488 - RNA, 15 nt, Chlamydophila pneumoniae CWL029
ccgagcuuuuugcuu

SEQ ID NO: 517489 - RNA, 15 nt, Chlamydophila pneumoniae CWL029
ccgaguccuaaaauu

SEQ ID NO: 517490 - RNA, 22 nt, Chlamydophila pneumoniae CWL029
ccgacaagcuucguccugacac

SEQ ID NO: 517491 - RNA, 16 nt, Chlamydophila pneumoniae CWL029
aaaccaauugagcucu

SEQ ID NO: 517492 - RNA, 17 nt, Chlamydophila pneumoniae CWL029
aaaccaaaaaaguaacu

SEQ ID NO: 517493 - RNA, 19 nt, Chlamydophila pneumoniae CWL029
aaacauuuuuaaggaaagu

SEQ ID NO: 517494 - RNA, 19 nt, Chlamydophila pneumoniae CWL029
aaacaucggagaacuuccu

SEQ ID NO: 517495 - RNA, 20 nt, Chlamydophila pneumoniae CWL029
aaacaucggagaacuuccug

SEQ ID NO: 517496 - RNA, 19 nt, Chlamydophila pneumoniae CWL029
aaacaguaggcgaugcaaa

SEQ ID NO: 517497 - RNA, 14 nt, Chlamydophila pneumoniae CWL029
aaacagaaauugcu

SEQ ID NO: 517498 - RNA, 20 nt, Chlamydophila pneumoniae CWL029
cccuuugucuaugauugcua

SEQ ID NO: 517499 - RNA, 12 nt, Chlamydophila pneumoniae CWL029
ccgaacagagcg

SEQ ID NO: 517500 - RNA, 16 nt, Chlamydophila pneumoniae CWL029
cccuugggauuccuua

SEQ ID NO: 517501 - RNA, 15 nt, Chlamydophila pneumoniae CWL029
cccuucuucuucagc

SEQ ID NO: 517502 - RNA, 18 nt, Chlamydophila pneumoniae CWL029
cccugcaccaauugcagu

SEQ ID NO: 517503 - RNA, 16 nt, Chlamydophila pneumoniae CWL029
cccugcaucucugcau

SEQ ID NO: 517504 - RNA, 16 nt, Chlamydophila pneumoniae CWL029
cccugcggacagaaac

SEQ ID NO: 517505 - RNA, 23 nt, Chlamydophila pneumoniae CWL029
cccuggauagcauacgacaguaa

SEQ ID NO: 517506 - RNA, 18 nt, Chlamydophila pneumoniae CWL029
aaacacugcgcaaagaac

SEQ ID NO: 517507 - RNA, 19 nt, Chlamydophila pneumoniae CWL029
aaacacugcgcaaagaacu

SEQ ID NO: 517508 - RNA, 17 nt, Chlamydophila pneumoniae CWL029
aaacacugaacgccauc

SEQ ID NO: 517509 - RNA, 16 nt, Chlamydophila pneumoniae CWL029
aaacacucaugaaagu

SEQ ID NO: 517510 - RNA, 22 nt, Chlamydophila pneumoniae CWL029
aaacaccguuaauuuuugcuaa

SEQ ID NO: 517511 - RNA, 12 nt, Chlamydophila pneumoniae CWL029
cccgcagcuucu

SEQ ID NO: 517512 - RNA, 21 nt, Chlamydophila pneumoniae CWL029
ccccuggcguucaggauuuag

SEQ ID NO: 517513 - RNA, 15 nt, Chlamydophila pneumoniae CWL029
ccccuccaacaaaca

SEQ ID NO: 517514 - RNA, 14 nt, Chlamydophila pneumoniae CWL029
ccccuacagcagaa

SEQ ID NO: 517515 - RNA, 11 nt, Chlamydophila pneumoniae CWL029
ccccgcagcuu

SEQ ID NO: 517516 - RNA, 12 nt, Chlamydophila pneumoniae CWL029
cccauuccugca

SEQ ID NO: 517517 - RNA, 17 nt, Chlamydophila pneumoniae CWL029
ccccaagcucucuccau

SEQ ID NO: 517518 - RNA, 20 nt, Chlamydophila pneumoniae CWL029
cccacggcaaguuguggcau

SEQ ID NO: 517519 - RNA, 11 nt, Chlamydophila pneumoniae CWL029
cccaccagaag

SEQ ID NO: 517520 - RNA, 15 nt, Chlamydophila pneumoniae CWL029
cccaauauccagaaa

SEQ ID NO: 517521 - RNA, 16 nt, Chlamydophila pneumoniae CWL029
cccaaguuuguauuuu

SEQ ID NO: 517522 - RNA, 23 nt, Chlamydophila pneumoniae CWL029
cccaauucuuaaaaagcuaaaca

SEQ ID NO: 517523 - RNA, 13 nt, Chlamydophila pneumoniae CWL029
ccauuucauguaa

SEQ ID NO: 517524 - RNA, 18 nt, Chlamydophila pneumoniae CWL029
ccauuucauguaagaaug

SEQ ID NO: 517525 - RNA, 14 nt, Chlamydophila pneumoniae CWL029
ccauuuagacaaga

SEQ ID NO: 517526 - RNA, 16 nt, Chlamydophila pneumoniae CWL029
ccauuuagacaagaca

SEQ ID NO: 517527 - RNA, 19 nt, Chlamydophila pneumoniae CWL029
cccaaauagcuacagcgcu

SEQ ID NO: 517528 - RNA, 20 nt, Chlamydophila pneumoniae CWL029
ccaucucuuucuauuucguc

SEQ ID NO: 517529 - RNA, 15 nt, Chlamydophila pneumoniae CWL029
ccaugagcucaggca

SEQ ID NO: 517530 - RNA, 20 nt, Chlamydophila pneumoniae CWL029
ccaucucaugcggacuuuau

SEQ ID NO: 517531 - RNA, 17 nt, Chlamydophila pneumoniae CWL029
ccaucaucgaagaacuu

SEQ ID NO: 517532 - RNA, 18 nt, Chlamydophila pneumoniae CWL029
ccaucaucgaagaacuua

SEQ ID NO: 517533 - RNA, 15 nt, Chlamydophila pneumoniae CWL029
aaacaagaagaucaa

SEQ ID NO: 517534 - RNA, 19 nt, Chlamydophila pneumoniae CWL029
aaacaagaagaucaaagau

SEQ ID NO: 517535 - RNA, 17 nt, Chlamydophila pneumoniae CWL029
ccaucacauaaaucaac

SEQ ID NO: 517536 - RNA, 16 nt, Chlamydophila pneumoniae CWL029
ccauaucaaagaucug

SEQ ID NO: 517537 - RNA, 15 nt, Chlamydophila pneumoniae CWL029
ccauauaauagauau

SEQ ID NO: 517538 - RNA, 15 nt, Chlamydophila pneumoniae CWL029
ccauaagaucaauau

SEQ ID NO: 517539 - RNA, 19 nt, Chlamydophila pneumoniae CWL029
ccauaagaucaauauagag

SEQ ID NO: 517540 - RNA, 17 nt, Chlamydophila pneumoniae CWL029
ccauaagcuuuucuucc

SEQ ID NO: 517541 - RNA, 20 nt, Chlamydophila pneumoniae CWL029
ccauaagcuuuucuuccaaa

SEQ ID NO: 517542 - RNA, 19 nt, Chlamydophila pneumoniae CWL029
ccauaaggagauuccuaaa

SEQ ID NO: 517543 - RNA, 17 nt, Chlamydophila pneumoniae CWL029
ccauagaguucgcacua

SEQ ID NO: 517544 - RNA, 16 nt, Chlamydophila pneumoniae CWL029
ccauaaagaauucccc

SEQ ID NO: 517545 - RNA, 20 nt, Chlamydophila pneumoniae CWL029
ccauaaagccccacccacuc

SEQ ID NO: 517546 - RNA, 21 nt, Chlamydophila pneumoniae CWL029
ccauaaauacaggccugaugu

SEQ ID NO: 517547 - RNA, 10 nt, Chlamydophila pneumoniae CWL029
ccauaacagu

SEQ ID NO: 517548 - RNA, 22 nt, Chlamydophila pneumoniae CWL029
ccaggagacuaaaagaauaaua

SEQ ID NO: 517549 - RNA, 17 nt, Chlamydophila pneumoniae CWL029
ccaggacguaaaaagaa

SEQ ID NO: 517550 - RNA, 15 nt, Chlamydophila pneumoniae CWL029
ccagcugugguggug

SEQ ID NO: 517551 - RNA, 16 nt, Chlamydophila pneumoniae CWL029
ccagcuguggugguga

SEQ ID NO: 517552 - RNA, 22 nt, Chlamydophila pneumoniae CWL029
ccaggaaguccgauagcaauga

SEQ ID NO: 517553 - RNA, 17 nt, Chlamydophila pneumoniae CWL029
ccaggaauagaaagaca

SEQ ID NO: 517554 - RNA, 14 nt, Chlamydophila pneumoniae CWL029
ccagcuccuuuuga

SEQ ID NO: 517555 - RNA, 17 nt, Chlamydophila pneumoniae CWL029
ccagcucgagaucuuuu

SEQ ID NO: 517556 - RNA, 15 nt, Chlamydophila pneumoniae CWL029
ccacugaccugauac

SEQ ID NO: 517557 - RNA, 23 nt, Chlamydophila pneumoniae CWL029
ccacuccagaaaguauuccucuu

SEQ ID NO: 517558 - RNA, 13 nt, Chlamydophila pneumoniae CWL029
aaacgcucuccua

SEQ ID NO: 517559 - RNA, 22 nt, Chlamydophila pneumoniae CWL029
cgagcgggagaaucaauaaaag

SEQ ID NO: 517560 - RNA, 14 nt, Chlamydophila pneumoniae CWL029
cgagcucacaaccc

SEQ ID NO: 517561 - RNA, 20 nt, Chlamydophila pneumoniae CWL029
cgagcuaccagaacaccauc

SEQ ID NO: 517562 - RNA, 19 nt, Chlamydophila pneumoniae CWL029
cgaggaaaaaggaggaugu

SEQ ID NO: 517563 - RNA, 10 nt, Chlamydophila pneumoniae CWL029
cgagcuucca

SEQ ID NO: 517564 - RNA, 15 nt, Chlamydophila pneumoniae CWL029
cgauaggaucuucua

SEQ ID NO: 517565 - RNA, 19 nt, Chlamydophila pneumoniae CWL029
cgaguucgcggaucuucuu

SEQ ID NO: 517566 - RNA, 15 nt, Chlamydophila pneumoniae CWL029
cgauaacacuucuuu

SEQ ID NO: 517567 - RNA, 19 nt, Chlamydophila pneumoniae CWL029
cgauaacacuucuuucuug

SEQ ID NO: 517568 - RNA, 22 nt, Chlamydophila pneumoniae CWL029
cgagucccuucuuucaauagcu

SEQ ID NO: 517569 - RNA, 15 nt, Chlamydophila pneumoniae CWL029
cgagugccuucuuca

SEQ ID NO: 517570 - RNA, 18 nt, Chlamydophila pneumoniae CWL029
cgaggucuuuucuuuuua

SEQ ID NO: 517571 - RNA, 17 nt, Chlamydophila pneumoniae CWL029
cgagcauuuccaaaccc

SEQ ID NO: 517572 - RNA, 23 nt, Chlamydophila pneumoniae CWL029
aaacgcuccguauacugcugcua

SEQ ID NO: 517573 - RNA, 16 nt, Chlamydophila pneumoniae CWL029
cgagcagaaacuccaa

SEQ ID NO: 517574 - RNA, 16 nt, Chlamydophila pneumoniae CWL029
cgagaucauuagcauc

SEQ ID NO: 517575 - RNA, 16 nt, Chlamydophila pneumoniae CWL029
cgagaugaacauaauu

SEQ ID NO: 517576 - RNA, 15 nt, Chlamydophila pneumoniae CWL029
cgagauaucgauagu

SEQ ID NO: 517577 - RNA, 15 nt, Chlamydophila pneumoniae CWL029
cgagauaugaagaga

SEQ ID NO: 517578 - RNA, 17 nt, Chlamydophila pneumoniae CWL029
cgagacugcaaaggaag

SEQ ID NO: 517579 - RNA, 18 nt, Chlamydophila pneumoniae CWL029
cgagaguugccaggaaac

SEQ ID NO: 517580 - RNA, 16 nt, Chlamydophila pneumoniae CWL029
cgagaagcuucaauga

SEQ ID NO: 517581 - RNA, 18 nt, Chlamydophila pneumoniae CWL029
cgacuucaccuugaaguu

SEQ ID NO: 517582 - RNA, 22 nt, Chlamydophila pneumoniae CWL029
cgacuguacaaaugcaucucua

SEQ ID NO: 517583 - RNA, 19 nt, Chlamydophila pneumoniae CWL029
cgacuugccaaucuuccuu

SEQ ID NO: 517584 - RNA, 13 nt, Chlamydophila pneumoniae CWL029
cgacuugccaauc

SEQ ID NO: 517585 - RNA, 23 nt, Chlamydophila pneumoniae CWL029
cgacuuccuccaauaaucacugu

SEQ ID NO: 517586 - RNA, 14 nt, Chlamydophila pneumoniae CWL029
cgagaacguagcag

SEQ ID NO: 517587 - RNA, 18 nt, Chlamydophila pneumoniae CWL029
cgagaacguagcagaggc

SEQ ID NO: 517588 - RNA, 17 nt, Chlamydophila pneumoniae CWL029
cgaauagcucuggagau

SEQ ID NO: 517589 - RNA, 22 nt, Chlamydophila pneumoniae CWL029
cgaauaggcauuacacaacucu

SEQ ID NO: 517590 - RNA, 18 nt, Chlamydophila pneumoniae CWL029
cgacguuugaucuucucu

SEQ ID NO: 517591 - RNA, 21 nt, Chlamydophila pneumoniae CWL029
cgacguuuugcuguggaauuu

SEQ ID NO: 517592 - RNA, 16 nt, Chlamydophila pneumoniae CWL029
cgacuacaucuuguuc

SEQ ID NO: 517593 - RNA, 18 nt, Chlamydophila pneumoniae CWL029
cgacuacaucuuguucug

SEQ ID NO: 517594 - RNA, 18 nt, Chlamydophila pneumoniae CWL029
cgacuguacaaaugcauc

SEQ ID NO: 517595 - RNA, 16 nt, Chlamydophila pneumoniae CWL029
cgcauaugcuccagaa

SEQ ID NO: 517596 - RNA, 17 nt, Chlamydophila pneumoniae CWL029
cgcaucacgaaaaggag

SEQ ID NO: 517597 - RNA, 16 nt, Chlamydophila pneumoniae CWL029
cgcaucuuaagagaaa

SEQ ID NO: 517598 - RNA, 16 nt, Chlamydophila pneumoniae CWL029
cgcauuuccuagugcu

SEQ ID NO: 517599 - RNA, 20 nt, Chlamydophila pneumoniae CWL029
cgcagaaacacugaacgcca

SEQ ID NO: 517600 - RNA, 24 nt, Chlamydophila pneumoniae CWL029
cgcaagcacuuguuuuuucuucug

SEQ ID NO: 517601 - RNA, 22 nt, Chlamydophila pneumoniae CWL029
cgcaacuuaagauacuucucca

SEQ ID NO: 517602 - RNA, 21 nt, Chlamydophila pneumoniae CWL029
cgcaagagacaagaaaauauc

SEQ ID NO: 517603 - RNA, 16 nt, Chlamydophila pneumoniae CWL029
cgcaaaucuuacauaa

SEQ ID NO: 517604 - RNA, 18 nt, Chlamydophila pneumoniae CWL029
cgcaacaucucacagaua

SEQ ID NO: 517605 - RNA, 14 nt, Chlamydophila pneumoniae CWL029
cgauguuccuuuuu

SEQ ID NO: 517606 - RNA, 22 nt, Chlamydophila pneumoniae CWL029
cgauucucguguagaauucacu

SEQ ID NO: 517607 - RNA, 13 nt, Chlamydophila pneumoniae CWL029
cgaugucuuucca

SEQ ID NO: 517608 - RNA, 18 nt, Chlamydophila pneumoniae CWL029
cgauuugaucuugcucag

SEQ ID NO: 517609 - RNA, 16 nt, Chlamydophila pneumoniae CWL029
cgauuguaauuucuag

SEQ ID NO: 517610 - RNA, 22 nt, Chlamydophila pneumoniae CWL029
cgauuguaaaaguagcauccug

SEQ ID NO: 517611 - RNA, 19 nt, Chlamydophila pneumoniae CWL029
cgcaaaaagcuucuuucuu

SEQ ID NO: 517612 - RNA, 12 nt, Chlamydophila pneumoniae CWL029
cgcaaagaacuc

SEQ ID NO: 517613 - RNA, 23 nt, Chlamydophila pneumoniae CWL029
cgcaaaccgagacuauuuuggaa

SEQ ID NO: 517614 - RNA, 17 nt, Chlamydophila pneumoniae CWL029
cgcaaaccaucugcguu

SEQ ID NO: 517615 - RNA, 17 nt, Chlamydophila pneumoniae CWL029
cgauaucuauaaaugua

SEQ ID NO: 517616 - RNA, 21 nt, Chlamydophila pneumoniae CWL029
cgauaucucuaccgaacagag

SEQ ID NO: 517617 - RNA, 19 nt, Chlamydophila pneumoniae CWL029
cgauaugggcuuugcuaac

SEQ ID NO: 517618 - RNA, 12 nt, Chlamydophila pneumoniae CWL029
cgcguauuuucg

SEQ ID NO: 517619 - RNA, 22 nt, Chlamydophila pneumoniae CWL029
cgcguuccuguaguuugcagag

SEQ ID NO: 517620 - RNA, 12 nt, Chlamydophila pneumoniae CWL029
cgcgaccuguga

SEQ ID NO: 517621 - RNA, 17 nt, Chlamydophila pneumoniae CWL029
cgccuuucuacccuucc

SEQ ID NO: 517622 - RNA, 19 nt, Chlamydophila pneumoniae CWL029
cgccuuggguuugucucca

SEQ ID NO: 517623 - RNA, 15 nt, Chlamydophila pneumoniae CWL029
cgcccgagcuuccau

SEQ ID NO: 517624 - RNA, 20 nt, Chlamydophila pneumoniae CWL029
cggauuuuacucccugaagu

SEQ ID NO: 517625 - RNA, 14 nt, Chlamydophila pneumoniae CWL029
cggauuucaugauu

SEQ ID NO: 517626 - RNA, 15 nt, Chlamydophila pneumoniae CWL029
cggcaacauaaucau

SEQ ID NO: 517627 - RNA, 22 nt, Chlamydophila pneumoniae CWL029
cggaugugccgugacuccagaa

SEQ ID NO: 517628 - RNA, 20 nt, Chlamydophila pneumoniae CWL029
cggaucuuaggauucuuauc

SEQ ID NO: 517629 - RNA, 19 nt, Chlamydophila pneumoniae CWL029
cggaucuuuucuuucuaag

SEQ ID NO: 517630 - RNA, 16 nt, Chlamydophila pneumoniae CWL029
cggauccuagaauagg

SEQ ID NO: 517631 - RNA, 14 nt, Chlamydophila pneumoniae CWL029
cggaguuaucaaaa

SEQ ID NO: 517632 - RNA, 16 nt, Chlamydophila pneumoniae CWL029
cggaguuaucaaaagg

SEQ ID NO: 517633 - RNA, 22 nt, Chlamydophila pneumoniae CWL029
cggagcaucuuuucaaaagaaa

SEQ ID NO: 517634 - RNA, 17 nt, Chlamydophila pneumoniae CWL029
cggagaacuuccugauu

SEQ ID NO: 517635 - RNA, 17 nt, Chlamydophila pneumoniae CWL029
cggagacucagagaaaa

SEQ ID NO: 517636 - RNA, 15 nt, Chlamydophila pneumoniae CWL029
cggacgcuagagaca

SEQ ID NO: 517637 - RNA, 22 nt, Chlamydophila pneumoniae CWL029
cggacuccgucuccuaucagag

SEQ ID NO: 517638 - RNA, 14 nt, Chlamydophila pneumoniae CWL029
cggaacucauuaag

SEQ ID NO: 517639 - RNA, 17 nt, Chlamydophila pneumoniae CWL029
cggaacaacuuugaggc

SEQ ID NO: 517640 - RNA, 13 nt, Chlamydophila pneumoniae CWL029
cgcuuuuuacuga

SEQ ID NO: 517641 - RNA, 22 nt, Chlamydophila pneumoniae CWL029
cgcuuuuucuugaaaaauccug

SEQ ID NO: 517642 - RNA, 16 nt, Chlamydophila pneumoniae CWL029
cgcuuucgggaauaau

SEQ ID NO: 517643 - RNA, 14 nt, Chlamydophila pneumoniae CWL029
cgcuaaacaaucuu

SEQ ID NO: 517644 - RNA, 22 nt, Chlamydophila pneumoniae CWL029
cggcauuucuccacaugccugc

SEQ ID NO: 517645 - RNA, 22 nt, Human
uguuuucaggcuagauguaugu

SEQ ID NO: 517646 - RNA, 19 nt, Human
uuacaaaugggaaacaaaa

SEQ ID NO: 517647 - RNA, 15 nt, Human
uccaccuuacuucuu

SEQ ID NO: 517648 - RNA, 21 nt, Human
ucaugcugucuacacuaagag

SEQ ID NO: 517649 - RNA, 18 nt, Human
ugcaugguuuagaaagcu

SEQ ID NO: 517650 - RNA, 21 nt, Human
uggccuucggccuccauccug

SEQ ID NO: 517651 - RNA, 14 nt, Human
uguuucaaacauau

SEQ ID NO: 517652 - RNA, 16 nt, Human
gccccgucccccucug

SEQ ID NO: 517653 - RNA, 20 nt, Human
gcccagcuugaaaccuucac

SEQ ID NO: 517654 - RNA, 13 nt, Human
gagccccaaaagg

SEQ ID NO: 517655 - RNA, 13 nt, Human
gaggacgcucucu

SEQ ID NO: 517656 - RNA, 23 nt, Human
gauggcuaguaucaaaagaaaga

SEQ ID NO: 517657 - RNA, 15 nt, Human
gaguuuuucuuuuca

SEQ ID NO: 517658 - RNA, 14 nt, Human
gaaacccugucucu

SEQ ID NO: 517659 - RNA, 22 nt, Human
gaauuuaaaaauccuacuuuca

SEQ ID NO: 517660 - RNA, 14 nt, Human
cuuagaugcaguuc

SEQ ID NO: 517661 - RNA, 16 nt, Human
cuucacuguaaaauaa

SEQ ID NO: 517662 - RNA, 16 nt, Human
cuaguguucugauauu

SEQ ID NO: 517663 - RNA, 14 nt, Human
cucugagccuuggg

SEQ ID NO: 517664 - RNA, 16 nt, Human
cuaagucuuauauauu

SEQ ID NO: 517665 - RNA, 14 nt, Human
cuaauuccacagcu

SEQ ID NO: 517666 - RNA, 18 nt, Human
cuagaacucccuuucaac

SEQ ID NO: 517667 - RNA, 16 nt, Human
ccucagaaaacaagga

SEQ ID NO: 517668 - RNA, 22 nt, Human
cccuauccuacuuccccuuccu

SEQ ID NO: 517669 - RNA, 17 nt, Human
uucccuugaugaagaag

SEQ ID NO: 517670 - RNA, 21 nt, Human
uucuuuccacagaagcuccag

SEQ ID NO: 517671 - RNA, 12 nt, Human
aaauuuuuucuc

SEQ ID NO: 517672 - RNA, 19 nt, Human
aacacaacuauauuguuug

SEQ ID NO: 517673 - RNA, 16 nt, Human
aacacaugauccugca

SEQ ID NO: 517674 - RNA, 21 nt, Human
aaaaaucucaauauuucagau

SEQ ID NO: 517675 - RNA, 15 nt, Human
aaauauuuauuuuaa

SEQ ID NO: 517676 - RNA, 22 nt, Human
aacagugauuaccagggacuga

SEQ ID NO: 517677 - RNA, 13 nt, Human
aacgauaaaagac

SEQ ID NO: 517678 - RNA, 14 nt, Human
aacucguuaauuug

SEQ ID NO: 517679 - RNA, 16 nt, Human
aagagaacuuccagau

SEQ ID NO: 517680 - RNA, 16 nt, Human
aaguguuugaaagcuu

SEQ ID NO: 517681 - RNA, 20 nt, Human
aaguugauaugccuuuuccc

SEQ ID NO: 517682 - RNA, 12 nt, Human
aaauaacaauaa

SEQ ID NO: 517683 - RNA, 13 nt, Human
aaauaauuuuuau

SEQ ID NO: 517684 - RNA, 19 nt, Human
ugccuuuucccaacuccag

SEQ ID NO: 517685 - RNA, 20 nt, Human
ucuuuccacagaagcuccag

SEQ ID NO: 517686 - RNA, 23 nt, Human
uggaaaucaggguuaguauuguc

SEQ ID NO: 517687 - RNA, 14 nt, Human
uguuucuacuacau

SEQ ID NO: 517688 - RNA, 18 nt, Human
ggagccugaucaccugcc

SEQ ID NO: 517689 - RNA, 15 nt, Human
uauaaauaaaaauaa

SEQ ID NO: 517690 - RNA, 19 nt, Human
uauaacaaugcuguauuuu

SEQ ID NO: 517691 - RNA, 15 nt, Human
uauuuuugugauuuu

SEQ ID NO: 517692 - RNA, 14 nt, Human
gacacuuaaaaaug

SEQ ID NO: 517693 - RNA, 13 nt, Human
gacacugauaugg

SEQ ID NO: 517694 - RNA, 21 nt, Human
gagccgagauugugccccugc

SEQ ID NO: 517695 - RNA, 21 nt, Human
gagccugaucaccugcccugc

SEQ ID NO: 517696 - RNA, 14 nt, Human
gagcucagcccugg

SEQ ID NO: 517697 - RNA, 19 nt, Human
gccccgucccccucuggcu

SEQ ID NO: 517698 - RNA, 14 nt, Human
gaguugaaaaucuu

SEQ ID NO: 517699 - RNA, 13 nt, Human
cuacuuccccuuc

SEQ ID NO: 517700 - RNA, 17 nt, Human
cuaauuccacagcugcu

SEQ ID NO: 517701 - RNA, 13 nt, Human
cguaacuaauuuu

SEQ ID NO: 517702 - RNA, 12 nt, Human
cuguaaucacag

SEQ ID NO: 517703 - RNA, 17 nt, Human
cugucuacacuaagaga

SEQ ID NO: 517704 - RNA, 14 nt, Human
cuugaguuuaaauu

SEQ ID NO: 517705 - RNA, 19 nt, Human
gaaucaccuuuuggucugg

SEQ ID NO: 517706 - RNA, 20 nt, Human
ccaugaagauguagaggaga

SEQ ID NO: 517707 - RNA, 15 nt, Human
ccacagcuguaugau

SEQ ID NO: 517708 - RNA, 14 nt, Human
cgagaaaacaauaa

SEQ ID NO: 517709 - RNA, 19 nt, Human
ccuaacgaaguauccuuca

SEQ ID NO: 517710 - RNA, 18 nt, Human
ccucuggcuccagcuggc

SEQ ID NO: 517711 - RNA, 21 nt, Human
cagcagcugcagcucaugagu

SEQ ID NO: 517712 - RNA, 16 nt, Human
caaugcuguauuuuaa

SEQ ID NO: 517713 - RNA, 21 nt, Human
caauuuuguuauguauauuuu

SEQ ID NO: 517714 - RNA, 16 nt, Human
auuaaguuuuuuuuua

SEQ ID NO: 517715 - RNA, 17 nt, Human
caaauuuacagagacag

SEQ ID NO: 517716 - RNA, 14 nt, Human
auguucuaagaagu

SEQ ID NO: 517717 - RNA, 16 nt, Human
auguugacaugggaca

SEQ ID NO: 517718 - RNA, 21 nt, Human
cauguucacuuccaagagccu

SEQ ID NO: 517719 - RNA, 12 nt, Human
cauuuauauuuu

SEQ ID NO: 517720 - RNA, 18 nt, Human
augagguacugagaguga

SEQ ID NO: 517721 - RNA, 16 nt, Human
auccaaugaaaugagu

SEQ ID NO: 517722 - RNA, 17 nt, Human
auccccaagccuggcaa

SEQ ID NO: 517723 - RNA, 23 nt, Human
auggcuaguaucaaaagaaagaa

SEQ ID NO: 517724 - RNA, 15 nt, Human
auauuugaaauauug

SEQ ID NO: 517725 - RNA, 19 nt, Human
aucaaggguacacugccuu

SEQ ID NO: 517726 - RNA, 22 nt, Human
auauuauguuaaaacugggaca

SEQ ID NO: 517727 - RNA, 17 nt, Human
agugagacucugucuca

SEQ ID NO: 517728 - RNA, 14 nt, Human
agucuuauauauug

SEQ ID NO: 517729 - RNA, 22 nt, Human
aguauccuucagccugaaagag

SEQ ID NO: 517730 - RNA, 12 nt, Human
aguaauuggaaa

SEQ ID NO: 517731 - RNA, 14 nt, Human
agaaguaaaaacac

SEQ ID NO: 517732 - RNA, 20 nt, Human
agacaaggaaaaaauaacaa

SEQ ID NO: 517733 - RNA, 17 nt, Human
agacccaaaaggcagaa

SEQ ID NO: 517734 - RNA, 17 nt, Human
agacugcauuauauuua

SEQ ID NO: 517735 - RNA, 18 nt, Human
agacugcauuauauuuau

SEQ ID NO: 517736 - RNA, 16 nt, Human
agauaggccaugggca

SEQ ID NO: 517737 - RNA, 14 nt, Human
acgauaaaagacag

SEQ ID NO: 517738 - RNA, 12 nt, Human
acaacaaaagcg

SEQ ID NO: 517739 - RNA, 14 nt, Human
acaacacacagauu

SEQ ID NO: 517740 - RNA, 14 nt, Human
acaacuauauuguu

SEQ ID NO: 517741 - RNA, 12 nt, Human
accuuacuucuu

SEQ ID NO: 517742 - RNA, 19 nt, Human
aagcagggacuugaaccca

SEQ ID NO: 517743 - RNA, 18 nt, Human
aaccauuuuuacuugggu

SEQ ID NO: 517744 - RNA, 16 nt, Human
aacaaggaugaauuaa

SEQ ID NO: 517745 - RNA, 15 nt, Human
aagaagacugcauua

SEQ ID NO: 517746 - RNA, 22 nt, Human
aagaaaauaucacuugucaaua

SEQ ID NO: 517747 - RNA, 13 nt, Human
aagacccaaaagg

SEQ ID NO: 517748 - RNA, 17 nt, Human
uuuuugaaaaaaagcuu

SEQ ID NO: 517749 - RNA, 18 nt, Human
uuucucuaggaaauauuu

SEQ ID NO: 517750 - RNA, 17 nt, Human
uuuuccugaaaacccuu

SEQ ID NO: 517751 - RNA, 20 nt, Human
ucuucucauacuauuuaaga

SEQ ID NO: 517752 - RNA, 16 nt, Human
ucuacuaaaaauacaa

SEQ ID NO: 517753 - RNA, 17 nt, Human
ucuuucacauuuaaaua

SEQ ID NO: 517754 - RNA, 12 nt, Human
ugaaagaaaaua

SEQ ID NO: 517755 - RNA, 16 nt, Human
ugaaauuguauuacaa

SEQ ID NO: 517756 - RNA, 19 nt, Human
uuuagaaacacaacuauau

SEQ ID NO: 517757 - RNA, 11 nt, Human
uucugaagaag

SEQ ID NO: 517758 - RNA, 21 nt, Human
uucagccugaaagaggaauga

SEQ ID NO: 517759 - RNA, 15 nt, Human
uucaucaaugaauga

SEQ ID NO: 517760 - RNA, 21 nt, Human
uauuuuauagcuacuaauuuu

SEQ ID NO: 517761 - RNA, 18 nt, Human
uauuuucaguuauuauau

SEQ ID NO: 517762 - RNA, 13 nt, Human
gugaaagaaaaua

SEQ ID NO: 517763 - RNA, 13 nt, Human
gugagaugcuaga

SEQ ID NO: 517764 - RNA, 15 nt, Human
gugccuguaaucaca

SEQ ID NO: 517765 - RNA, 16 nt, Human
gucucuacuaaaaaua

SEQ ID NO: 517766 - RNA, 19 nt, Human
ggagcucugcccauccugc

SEQ ID NO: 517767 - RNA, 14 nt, Human
guacuuuauuuucu

SEQ ID NO: 517768 - RNA, 22 nt, Human
guauagguugauggugguaugu

SEQ ID NO: 517769 - RNA, 13 nt, Human
ggcucacagaauu

SEQ ID NO: 517770 - RNA, 15 nt, Human
aaauaacgauaaaag

SEQ ID NO: 517771 - RNA, 20 nt, Human
cacuccagccugagcgacag

SEQ ID NO: 517772 - RNA, 11 nt, Human
cacugaagaag

SEQ ID NO: 517773 - RNA, 16 nt, Human
cacuccagugagacag

SEQ ID NO: 517774 - RNA, 15 nt, Human
cacuaaacaaagagu

SEQ ID NO: 517775 - RNA, 18 nt, Human
auuuuuagugaaauauua

SEQ ID NO: 517776 - RNA, 17 nt, Human
auuuaggccaugggaca

SEQ ID NO: 517777 - RNA, 17 nt, Human
auuccacagcugcucaa

SEQ ID NO: 517778 - RNA, 15 nt, Human
auagcuacuaauuuu

SEQ ID NO: 517779 - RNA, 15 nt, Human
aucuuuauaguucua

SEQ ID NO: 517780 - RNA, 18 nt, Human
agcuucacuguaaaauaa

SEQ ID NO: 517781 - RNA, 14 nt, Human
aggauguugaaaaa

SEQ ID NO: 517782 - RNA, 18 nt, Human
aguuuuugugaaaagcuc

SEQ ID NO: 517783 - RNA, 14 nt, Human
agcuugcagagaug

SEQ ID NO: 517784 - RNA, 18 nt, Human
auaacaaugcuguauuuu

SEQ ID NO: 517785 - RNA, 15 nt, Human
auaauuuuuauauuu

SEQ ID NO: 517786 - RNA, 19 nt, Human
agcccuccuuaucaaagga

SEQ ID NO: 517787 - RNA, 13 nt, Human
accccugagcuug

SEQ ID NO: 517788 - RNA, 14 nt, Human
agccuggcaaggga

SEQ ID NO: 517789 - RNA, 12 nt, Human
agcuacuuggga

SEQ ID NO: 517790 - RNA, 20 nt, Human
acagcuacuugggaggcuga

SEQ ID NO: 517791 - RNA, 17 nt, Human
aaucaggguuaguauug

SEQ ID NO: 517792 - RNA, 17 nt, Human
aauccuugaagauuuac

SEQ ID NO: 517793 - RNA, 21 nt, Human
acuugaacccgggaggcagag

SEQ ID NO: 517794 - RNA, 12 nt, Human
agaaaacaauaa

SEQ ID NO: 517795 - RNA, 23 nt, Human
agaaugagagacacacugaagaa

SEQ ID NO: 517796 - RNA, 17 nt, Human
agacaaggaaaaaauaa

SEQ ID NO: 517797 - RNA, 22 nt, Human
acgaugggcuuucccaacagcu

SEQ ID NO: 517798 - RNA, 21 nt, Human
accauuucuugagguaaaagc

SEQ ID NO: 517799 - RNA, 13 nt, Human
acuaguauuucua

SEQ ID NO: 517800 - RNA, 16 nt, Human
aaugauuaugaauuac

SEQ ID NO: 517801 - RNA, 16 nt, Human
acacagauuugagcuc

SEQ ID NO: 517802 - RNA, 18 nt, Human
acauccuacaagacacag

SEQ ID NO: 517803 - RNA, 22 nt, Human
aaucacaauacaucccuuaccu

SEQ ID NO: 517804 - RNA, 15 nt, Human
aaucacuugaacccg

SEQ ID NO: 517805 - RNA, 17 nt, Human
aaucaugaauuaguuuu

SEQ ID NO: 517806 - RNA, 23 nt, Human
aauaauuuuuauauuugaaauau

SEQ ID NO: 517807 - RNA, 14 nt, Human
aauaacgauaaaag

SEQ ID NO: 517808 - RNA, 23 nt, Human
aaggguacacugccuucucaacu

SEQ ID NO: 517809 - RNA, 20 nt, Human
aagcuuguauuccuuuuucu

SEQ ID NO: 517810 - RNA, 20 nt, Human
cccagcuugaaaccuucacu

SEQ ID NO: 517811 - RNA, 12 nt, Human
cccaaauguuca

SEQ ID NO: 517812 - RNA, 17 nt, Human
caugaguaacugauuug

SEQ ID NO: 517813 - RNA, 23 nt, Human
ccaaauauaaauaaaaauaaucc

SEQ ID NO: 517814 - RNA, 16 nt, Human
caggaaguagaggagg

SEQ ID NO: 517815 - RNA, 18 nt, Human
cauagguuuaauaauuuu

SEQ ID NO: 517816 - RNA, 15 nt, Human
cagucaggaaagaga

SEQ ID NO: 517817 - RNA, 19 nt, Human
cagugaaagaaaauaacaa

SEQ ID NO: 517818 - RNA, 15 nt, Human
caguuauuauauuua

SEQ ID NO: 517819 - RNA, 16 nt, Human
caccugccuauauuuu

SEQ ID NO: 517820 - RNA, 17 nt, Human
cacagauuugagcucag

SEQ ID NO: 517821 - RNA, 15 nt, Human
caauaacgauaaaag

SEQ ID NO: 517822 - RNA, 14 nt, Human
caaucaugaauuag

SEQ ID NO: 517823 - RNA, 13 nt, Human
caaugcuguauuu

SEQ ID NO: 517824 - RNA, 14 nt, Human
cacaacuauauugu

SEQ ID NO: 517825 - RNA, 12 nt, Human
caacaaacauaa

SEQ ID NO: 517826 - RNA, 18 nt, Human
auuuguaguguuggagaa

SEQ ID NO: 517827 - RNA, 21 nt, Human
auuuuaaucaccaaggcugau

SEQ ID NO: 517828 - RNA, 23 nt, Human
auuuucuauaauuuaaauauaug

SEQ ID NO: 517829 - RNA, 13 nt, Human
caaaaggauaaug

SEQ ID NO: 517830 - RNA, 19 nt, Human
auucacucaacaaacauaa

SEQ ID NO: 517831 - RNA, 15 nt, Human
auuuagauguauagg

SEQ ID NO: 517832 - RNA, 17 nt, Human
auuucuaugaaauauua

SEQ ID NO: 517833 - RNA, 15 nt, Human
auuugguaaggggaa

SEQ ID NO: 517834 - RNA, 21 nt, Human
auccaacuuauauuucugcuu

SEQ ID NO: 517835 - RNA, 18 nt, Human
aucaggguuaguauuguc

SEQ ID NO: 517836 - RNA, 21 nt, Human
auaguucuacuccauuaaaua

SEQ ID NO: 517837 - RNA, 15 nt, Human
aguuuagcuggaaaa

SEQ ID NO: 517838 - RNA, 16 nt, Human
aucuuucacaggggac

SEQ ID NO: 517839 - RNA, 20 nt, Human
aucuuauaauuuaaaauaug

SEQ ID NO: 517840 - RNA, 13 nt, Human
augguauuaaaga

SEQ ID NO: 517841 - RNA, 23 nt, Human
auguacuggcaagaccugauuuc

SEQ ID NO: 517842 - RNA, 23 nt, Human
aguaauuccguagguuauuuuca

SEQ ID NO: 517843 - RNA, 13 nt, Human
aggcuagauguau

SEQ ID NO: 517844 - RNA, 18 nt, Human
agcucugcccauccugcc

SEQ ID NO: 517845 - RNA, 17 nt, Human
uuucuauaauuuaaaua

SEQ ID NO: 517846 - RNA, 19 nt, Human
uuucugagcauuuaauaug

SEQ ID NO: 517847 - RNA, 23 nt, Human
uuugcuaagcauuccaacuaucu

SEQ ID NO: 517848 - RNA, 21 nt, Human
uuuguacauagugaggagcuu

SEQ ID NO: 517849 - RNA, 20 nt, Human
uuuagcuggaaaaguauguu

SEQ ID NO: 517850 - RNA, 16 nt, Human
uuuccaucaaggguac

SEQ ID NO: 517851 - RNA, 21 nt, Human
uagaaacacaacuauauuguu

SEQ ID NO: 517852 - RNA, 21 nt, Human
ucaacucccugccccccagcc

SEQ ID NO: 517853 - RNA, 17 nt, Human
uacagagacagaaagca

SEQ ID NO: 517854 - RNA, 14 nt, Human
ucauggaauuggag

SEQ ID NO: 517855 - RNA, 15 nt, Human
gguauuuuaaucacc

SEQ ID NO: 517856 - RNA, 19 nt, Human
guaacuaauuuuaacucua

SEQ ID NO: 517857 - RNA, 16 nt, Human
ggcuagaaccaccugc

SEQ ID NO: 517858 - RNA, 12 nt, Human
cugaugcaguug

SEQ ID NO: 517859 - RNA, 14 nt, Human
agacagugaaagaa

SEQ ID NO: 517860 - RNA, 19 nt, Human
agacagugaaagaaaauaa

SEQ ID NO: 517861 - RNA, 17 nt, Human
agauccccaagccuggc

SEQ ID NO: 517862 - RNA, 18 nt, Human
agaugcaguucugaagaa

SEQ ID NO: 517863 - RNA, 22 nt, Human
agaugguaccaccagucugacu

SEQ ID NO: 517864 - RNA, 16 nt, Human
cuccacuuggucugug

SEQ ID NO: 517865 - RNA, 17 nt, Human
caggcuagauguaugua

SEQ ID NO: 517866 - RNA, 12 nt, Human
gaaaaaaagcuu

SEQ ID NO: 517867 - RNA, 16 nt, Human
gaaacauuugguaagg

SEQ ID NO: 517868 - RNA, 15 nt, Human
agcauuuagauguau

SEQ ID NO: 517869 - RNA, 18 nt, Human
cuuguauuccuuuuucuc

SEQ ID NO: 517870 - RNA, 15 nt, Human
gaaagaaaauaacga

SEQ ID NO: 517871 - RNA, 19 nt, Human
gcaauguaagacucgggau

SEQ ID NO: 517872 - RNA, 14 nt, Human
gauguugaaaaagu

SEQ ID NO: 517873 - RNA, 13 nt, Human
gagauacagaauu

SEQ ID NO: 517874 - RNA, 15 nt, Human
uugcucauggaauug

SEQ ID NO: 517875 - RNA, 12 nt, Human
gguauuuuaauc

SEQ ID NO: 517876 - RNA, 16 nt, Human
aaaugggaaacaaaag

SEQ ID NO: 517877 - RNA, 15 nt, Human
uaaaagacaaggaaa

SEQ ID NO: 517878 - RNA, 21 nt, Human
aggacagcccuucuuuccaca

SEQ ID NO: 517879 - RNA, 23 nt, Human
cacaagaaaugaaagcagggacu

SEQ ID NO: 517880 - RNA, 18 nt, Human
gcccuggugggcagagag

SEQ ID NO: 517881 - RNA, 16 nt, Human
aagagaacaagcaaau

SEQ ID NO: 517882 - RNA, 17 nt, Human
ccucuggcuccagcugg

SEQ ID NO: 517883 - RNA, 18 nt, Human
aucuacacuccagugaga

SEQ ID NO: 517884 - RNA, 17 nt, Human
ccuauccuacuuccccu

SEQ ID NO: 517885 - RNA, 18 nt, Human
cccaggcugagccucagu

SEQ ID NO: 517886 - RNA, 13 nt, Human
uaauuuuuauauu

SEQ ID NO: 517887 - RNA, 14 nt, Human
auuucuaugaaaua

SEQ ID NO: 517888 - RNA, 24 nt, Human
cauaugaaaaggcuaagcuucacu

SEQ ID NO: 517889 - RNA, 18 nt, Human
acaagccuccuuuuaaag

SEQ ID NO: 517890 - RNA, 21 nt, Human
agccucuuagaugcaguucug

SEQ ID NO: 517891 - RNA, 19 nt, Human
gugacuuaaugccacuaaa

SEQ ID NO: 517892 - RNA, 18 nt, Human
aaagaaaaucaggcuggc

SEQ ID NO: 517893 - RNA, 14 nt, Human
aauauuuauuuuaa

SEQ ID NO: 517894 - RNA, 13 nt, Human
agcccagcuugaa

SEQ ID NO: 517895 - RNA, 23 nt, Human
ugaauuauguuugcauguucacu

SEQ ID NO: 517896 - RNA, 14 nt, Human
aagaagugaaaauc

SEQ ID NO: 517897 - RNA, 12 nt, Human
agugcagccccg

SEQ ID NO: 517898 - RNA, 14 nt, Human
cuuucauaauaagu

SEQ ID NO: 517899 - RNA, 16 nt, Human
uguccccuauccuacu

SEQ ID NO: 517900 - RNA, 16 nt, Human
aacaauaaaagacaag

SEQ ID NO: 517901 - RNA, 13 nt, Human
acacacaugaagu

SEQ ID NO: 517902 - RNA, 17 nt, Human
agucugacuguuuccau

SEQ ID NO: 517903 - RNA, 13 nt, Human
guaacuaauuuua

SEQ ID NO: 517904 - RNA, 17 nt, Human
aaaaauccuacuuucau

SEQ ID NO: 517905 - RNA, 17 nt, Human
aggcuagaaccaccugc

SEQ ID NO: 517906 - RNA, 16 nt, Human
uuucacauuuaaauaa

SEQ ID NO: 517907 - RNA, 20 nt, Human
uuaaauggucaauuuuguua

SEQ ID NO: 517908 - RNA, 22 nt, Human
ucuagcaugucgucaaagcuga

SEQ ID NO: 517909 - RNA, 21 nt, Human
uccuacaagacacagugacca

SEQ ID NO: 517910 - RNA, 19 nt, Human
uggaacaguuaccucugcc

SEQ ID NO: 517911 - RNA, 16 nt, Human
acagagacagaaagca

SEQ ID NO: 517912 - RNA, 17 nt, Human
auguuuacagaucccca

SEQ ID NO: 517913 - RNA, 23 nt, Human
aucaccaaggcugauuaaaccaa

SEQ ID NO: 517914 - RNA, 16 nt, Human
auuuuaauaauguuuc

SEQ ID NO: 517915 - RNA, 22 nt, Human
aguauguuagugcaaauuguca

SEQ ID NO: 517916 - RNA, 16 nt, Human
uaggauguugaaaaag

SEQ ID NO: 517917 - RNA, 13 nt, Human
cacaacacacaga

SEQ ID NO: 517918 - RNA, 19 nt, Human
uggcaagcucuaucaccaa

SEQ ID NO: 517919 - RNA, 16 nt, Human
gaaucacuugaacccg

SEQ ID NO: 517920 - RNA, 19 nt, Human
guacugagagugaacaaau

SEQ ID NO: 517921 - RNA, 20 nt, Human
aaucuuucacaggggacagg

SEQ ID NO: 517922 - RNA, 16 nt, Human
aaauaguuuaugauuc

SEQ ID NO: 517923 - RNA, 19 nt, Human
aauguuuacagauccccaa

SEQ ID NO: 517924 - RNA, 14 nt, Human
cucugccucagaaa

SEQ ID NO: 517925 - RNA, 23 nt, Human
aaagcccagcuugaaaccuucac

SEQ ID NO: 517926 - RNA, 15 nt, Human
auauuuuuuguuaaa

SEQ ID NO: 517927 - RNA, 22 nt, Human
auaucuuuuuuuuaauaaacca

SEQ ID NO: 517928 - RNA, 18 nt, Human
ccaaccuggaguugaaaa

SEQ ID NO: 517929 - RNA, 13 nt, Human
cuuaucaaaggac

SEQ ID NO: 517930 - RNA, 15 nt, Human
gacagggaggacgcu

SEQ ID NO: 517931 - RNA, 18 nt, Human
gccuucggccuccauccu

SEQ ID NO: 517932 - RNA, 17 nt, Human
cuaagcuucacuguaaa

SEQ ID NO: 517933 - RNA, 17 nt, Human
agcucugcccauccugc

SEQ ID NO: 517934 - RNA, 21 nt, Human
cuauguucuaagaagugaaaa

SEQ ID NO: 517935 - RNA, 21 nt, Human
cagugagacagcucugcauac

SEQ ID NO: 517936 - RNA, 19 nt, Human
aaaauaacgauaaaagaca

SEQ ID NO: 517937 - RNA, 15 nt, Human
ccaaggagccaaaca

SEQ ID NO: 517938 - RNA, 17 nt, Human
aaagaaacauuugguaa

SEQ ID NO: 517939 - RNA, 21 nt, Human
cucuucuggguuccuuccucu

SEQ ID NO: 517940 - RNA, 18 nt, Human
aguucuccacuagcuaug

SEQ ID NO: 517941 - RNA, 17 nt, Human
cccacuggacucaccuc

SEQ ID NO: 517942 - RNA, 12 nt, Human
auaacuggaaac

SEQ ID NO: 517943 - RNA, 13 nt, Human
aagcauuccaacu

SEQ ID NO: 517944 - RNA, 12 nt, Human
uaauuccacagc

SEQ ID NO: 517945 - RNA, 23 nt, Human
auaucuuuuuuuuaauaaaccau

SEQ ID NO: 517946 - RNA, 15 nt, Human
gaaagaaaauaacga

SEQ ID NO: 517947 - RNA, 17 nt, Human
uccacaacacacagauu

SEQ ID NO: 517948 - RNA, 16 nt, Human
cauuuguauaaaauaa

SEQ ID NO: 517949 - RNA, 23 nt, Human
cucuacuaaaaauacaaaaaaaa

SEQ ID NO: 517950 - RNA, 19 nt, Human
uaguuuaugauuccaccua

SEQ ID NO: 517951 - RNA, 22 nt, Human
uaaaacaagcacuaaacaaaga

SEQ ID NO: 517952 - RNA, 14 nt, Human
auuugaaauuguau

SEQ ID NO: 517953 - RNA, 13 nt, Human
ucucccucccuug

SEQ ID NO: 517954 - RNA, 15 nt, Human
uuaagagaacaagca

SEQ ID NO: 517955 - RNA, 20 nt, Human
agccuaguugaucagcuuau

SEQ ID NO: 517956 - RNA, 20 nt, Human
acuaaauugacacuuaaaaa

SEQ ID NO: 517957 - RNA, 16 nt, Human
gagcucgugggacagu

SEQ ID NO: 517958 - RNA, 17 nt, Human
caaaagcgauuauuauu

SEQ ID NO: 517959 - RNA, 21 nt, Human
cagcaacuuguguuccuaaca

SEQ ID NO: 517960 - RNA, 23 nt, Human
cacuggacucaccucccccaucu

SEQ ID NO: 517961 - RNA, 16 nt, Human
aaauaacaaugaaagu

SEQ ID NO: 517962 - RNA, 13 nt, Human
agacacagugacc

SEQ ID NO: 517963 - RNA, 20 nt, Human
aaacuuuaugcuaagugaaa

SEQ ID NO: 517964 - RNA, 19 nt, Human
auaaaagacaaggaaaaaa

SEQ ID NO: 517965 - RNA, 18 nt, Human
ugccauaauuacuauguc

SEQ ID NO: 517966 - RNA, 22 nt, Human
ggcagcuuuccucaaaacuuca

SEQ ID NO: 517967 - RNA, 21 nt, Human
uauuacuguaagaaaauauca

SEQ ID NO: 517968 - RNA, 13 nt, Human
ccucuggcuccag

SEQ ID NO: 517969 - RNA, 20 nt, Human
agaugcaguucugaagaaga

SEQ ID NO: 517970 - RNA, 21 nt, Human
gcacuguggguagacacacau

SEQ ID NO: 517971 - RNA, 17 nt, Human
uuuuuaauuauauggcu

SEQ ID NO: 517972 - RNA, 12 nt, Human
acucccugcccc

SEQ ID NO: 517973 - RNA, 13 nt, Human
uggacgagaaaac

SEQ ID NO: 517974 - RNA, 16 nt, Human
ugccucaccccuugcc

SEQ ID NO: 517975 - RNA, 19 nt, Human
cuggccuucggccuccauc

SEQ ID NO: 517976 - RNA, 18 nt, Human
ccuucggccuccauccug

SEQ ID NO: 517977 - RNA, 14 nt, Human
agagacagaaagca

SEQ ID NO: 517978 - RNA, 22 nt, Human
cuccugccuaagugcagccccg

SEQ ID NO: 517979 - RNA, 17 nt, Human
agaacucccuuucaaca

SEQ ID NO: 517980 - RNA, 22 nt, Human
uugacccacaagaaaugaaagc

SEQ ID NO: 517981 - RNA, 15 nt, Human
auaaauaaaaauaau

SEQ ID NO: 517982 - RNA, 21 nt, Human
augaauacuuuauaaaggauu

SEQ ID NO: 517983 - RNA, 15 nt, Human
cugaaagaggaauga

SEQ ID NO: 517984 - RNA, 15 nt, Human
uucugcacacagcac

SEQ ID NO: 517985 - RNA, 23 nt, Human
uuuaagagaacaagcaaauauaa

SEQ ID NO: 517986 - RNA, 14 nt, Human
cagauccccaagcc

SEQ ID NO: 517987 - RNA, 15 nt, Human
cuaguaauuggaaag

SEQ ID NO: 517988 - RNA, 19 nt, Human
auaauuuuuauauuugaaa

SEQ ID NO: 517989 - RNA, 16 nt, Human
ccugaucaccugcccu

SEQ ID NO: 517990 - RNA, 22 nt, Human
caguauggcagcuuuccucaaa

SEQ ID NO: 517991 - RNA, 20 nt, Human
caagagccuuuuuuugaaaa

SEQ ID NO: 517992 - RNA, 23 nt, Human
cuugauaaauggcuuccuggcaa

SEQ ID NO: 517993 - RNA, 19 nt, Human
agauuugagcucagcccug

SEQ ID NO: 517994 - RNA, 17 nt, Human
cauuuguauaaaauaau

SEQ ID NO: 517995 - RNA, 17 nt, Human
augccccgucccccucu

SEQ ID NO: 517996 - RNA, 18 nt, Human
caguuguugcccacagcu

SEQ ID NO: 517997 - RNA, 22 nt, Human
gaauuaaguuuuuuuuuaaaaa

SEQ ID NO: 517998 - RNA, 14 nt, Human
gaaaacaauaacga

SEQ ID NO: 517999 - RNA, 17 nt, Human
acucaccucccccaucu

SEQ ID NO: 518000 - RNA, 18 nt, Human
aaguugauaugccuuuuc

SEQ ID NO: 518001 - RNA, 14 nt, Human
agagguccacaaca

SEQ ID NO: 518002 - RNA, 17 nt, Human
uccagcuggccgggagc

SEQ ID NO: 518003 - RNA, 15 nt, Human
aaaaaauaacaauga

SEQ ID NO: 518004 - RNA, 19 nt, Human
uccccuauccuacuucccc

SEQ ID NO: 518005 - RNA, 21 nt, Human
uauaaaauaauuuuuauauuu

SEQ ID NO: 518006 - RNA, 17 nt, Human
auggcuaguaucaaaag

SEQ ID NO: 518007 - RNA, 18 nt, Human
uugaaaaugguauuaaag

SEQ ID NO: 518008 - RNA, 17 nt, Human
aaacauccuacaagaca

SEQ ID NO: 518009 - RNA, 24 nt, Human
uaauuuaaaauaugcucuaaacau

SEQ ID NO: 518010 - RNA, 22 nt, Human
acagauuugagcucagcccugg

SEQ ID NO: 518011 - RNA, 13 nt, Human
aaacauccuacaa

SEQ ID NO: 518012 - RNA, 17 nt, Human
cucuuuugggauuuuug

SEQ ID NO: 518013 - RNA, 16 nt, Human
cugagcgacagugaga

SEQ ID NO: 518014 - RNA, 21 nt, Human
auuuguauaaaauaauuuuua

SEQ ID NO: 518015 - RNA, 21 nt, Human
auguuuaauucugaaagcaac

SEQ ID NO: 518016 - RNA, 14 nt, Human
ccaaauauaaauaa

SEQ ID NO: 518017 - RNA, 15 nt, Human
uccauccugaggcuc

SEQ ID NO: 518018 - RNA, 22 nt, Human
uacugagagugaacaaauuuac

SEQ ID NO: 518019 - RNA, 13 nt, Human
cgggaggcagagg

SEQ ID NO: 518020 - RNA, 11 nt, Human
aauuccacagc

SEQ ID NO: 518021 - RNA, 17 nt, Human
aaucuuauaauuuaaaa

SEQ ID NO: 518022 - RNA, 17 nt, Human
cuacacuccagugagac

SEQ ID NO: 518023 - RNA, 14 nt, Human
acaaauccaaugaa

SEQ ID NO: 518024 - RNA, 18 nt, Human
ccauccugccccugagcc

SEQ ID NO: 518025 - RNA, 17 nt, Human
guguccccuauccuacu

SEQ ID NO: 518026 - RNA, 14 nt, Human
uugugauugauuau

SEQ ID NO: 518027 - RNA, 21 nt, Human
aauaauguuucaaacauauau

SEQ ID NO: 518028 - RNA, 18 nt, Human
uaagcuucacuguaaaau

SEQ ID NO: 518029 - RNA, 20 nt, Human
acuuuauuuucuauaauuua

SEQ ID NO: 518030 - RNA, 23 nt, Human
gggagccugaucaccugcccugc

SEQ ID NO: 518031 - RNA, 18 nt, Human
acuggacucaccuccccc

SEQ ID NO: 518032 - RNA, 17 nt, Human
aguugauaaguacauga

SEQ ID NO: 518033 - RNA, 20 nt, Human
ggccaugggacagggaggac

SEQ ID NO: 518034 - RNA, 18 nt, Human
uauagcuacuaauuuuaa

SEQ ID NO: 518035 - RNA, 21 nt, Human
aagacucgggauuaguacaca

SEQ ID NO: 518036 - RNA, 16 nt, Human
cagaagcaacccaaau

SEQ ID NO: 518037 - RNA, 14 nt, Human
cucccugcccccca

SEQ ID NO: 518038 - RNA, 17 nt, Human
guauuauuuuuuaaaaa

SEQ ID NO: 518039 - RNA, 22 nt, Human
uauuucuaugaaauauuauguu

SEQ ID NO: 518040 - RNA, 16 nt, Human
cuccauccugaggcuc

SEQ ID NO: 518041 - RNA, 22 nt, Human
cuaagcuucacuguaaaauaau

SEQ ID NO: 518042 - RNA, 22 nt, Human
gugaacaaauuuacagagacag

SEQ ID NO: 518043 - RNA, 16 nt, Human
aaauauuuauuuuaau

SEQ ID NO: 518044 - RNA, 15 nt, Human
aaugauuaugaauua

SEQ ID NO: 518045 - RNA, 18 nt, Human
ugugaccacugcagaaga

SEQ ID NO: 518046 - RNA, 21 nt, Human
cugauauuggacaguaaaauc

SEQ ID NO: 518047 - RNA, 17 nt, Human
cccaggcugagccucag

SEQ ID NO: 518048 - RNA, 12 nt, Human
acagagacagaa

SEQ ID NO: 518049 - RNA, 17 nt, Human
auaucaauuuaaaaaaa

SEQ ID NO: 518050 - RNA, 12 nt, Human
aagaaaauaaca

SEQ ID NO: 518051 - RNA, 18 nt, Human
cagcugcucaauaaagua

SEQ ID NO: 518052 - RNA, 20 nt, Human
aaagacaaggaaaaaauaac

SEQ ID NO: 518053 - RNA, 21 nt, Human
aaaugucuugcuugauuguau

SEQ ID NO: 518054 - RNA, 22 nt, Human
ccaaacauccuacaagacacag

SEQ ID NO: 518055 - RNA, 15 nt, Human
cauguccacugguuc

SEQ ID NO: 518056 - RNA, 17 nt, Human
agacacacugaagaagc

SEQ ID NO: 518057 - RNA, 19 nt, Human
uagugagcagucaggaaag

SEQ ID NO: 518058 - RNA, 23 nt, Human
auuauauggcuugaguuuaaauu

SEQ ID NO: 518059 - RNA, 22 nt, Human
caagcacuaaacaaagagugaa

SEQ ID NO: 518060 - RNA, 16 nt, Human
ucuuggucucaguguc

SEQ ID NO: 518061 - RNA, 20 nt, Human
auuacuguaagaaaauauca

SEQ ID NO: 518062 - RNA, 19 nt, Human
guaguccuguaauggaagc

SEQ ID NO: 518063 - RNA, 17 nt, Human
agcuucacuguaaaaua

SEQ ID NO: 518064 - RNA, 13 nt, Human
cauuuguauaaaa

SEQ ID NO: 518065 - RNA, 16 nt, Human
auuuuuagugaaauau

SEQ ID NO: 518066 - RNA, 11 nt, Human
ucaccugcccu

SEQ ID NO: 518067 - RNA, 21 nt, Human
auuccuuuuucucuccucucc

SEQ ID NO: 518068 - RNA, 17 nt, Human
caagacccaaaaggcag

SEQ ID NO: 518069 - RNA, 19 nt, Human
uacuucuuaggguuaugau

SEQ ID NO: 518070 - RNA, 14 nt, Human
ccugccccugagcc

SEQ ID NO: 518071 - RNA, 11 nt, Human
auuuaaaaauc

SEQ ID NO: 518072 - RNA, 15 nt, Human
uauuuauuuuaauaa

SEQ ID NO: 518073 - RNA, 16 nt, Human
uuuuagugaaauauua

SEQ ID NO: 518074 - RNA, 16 nt, Human
gaauggcuaagcaaaa

SEQ ID NO: 518075 - RNA, 21 nt, Human
uguaaaauggugugaccacug

SEQ ID NO: 518076 - RNA, 18 nt, Human
aagucuuucacauuuaaa

SEQ ID NO: 518077 - RNA, 18 nt, Human
acugccuucucaacucca

SEQ ID NO: 518078 - RNA, 18 nt, Human
cuccauccugaggcucca

SEQ ID NO: 518079 - RNA, 20 nt, Human
ccagcuggccgggagccuga

SEQ ID NO: 518080 - RNA, 20 nt, Human
agcuacuaauuuuaaaaugu

SEQ ID NO: 518081 - RNA, 12 nt, Human
gcaaagcccagc

SEQ ID NO: 518082 - RNA, 21 nt, Human
acagugauuaccagggacuga

SEQ ID NO: 518083 - RNA, 17 nt, Human
cugagcgacagugagac

SEQ ID NO: 518084 - RNA, 15 nt, Human
ucagucucccucccu

SEQ ID NO: 518085 - RNA, 15 nt, Human
acauccuacaagaca

SEQ ID NO: 518086 - RNA, 22 nt, Human
ugucucuacuaaaaauacaaaa

SEQ ID NO: 518087 - RNA, 21 nt, Human
caauuuuguuauguauauuuu

SEQ ID NO: 518088 - RNA, 20 nt, Human
gaccauacuaauuauacccc

SEQ ID NO: 518089 - RNA, 19 nt, Human
ucaccaaggcugauuaaac

SEQ ID NO: 518090 - RNA, 22 nt, Human
aaacaaggaugaauuaaguuuu

SEQ ID NO: 518091 - RNA, 17 nt, Human
ucuuucacauuuaaaua

SEQ ID NO: 518092 - RNA, 18 nt, Human
aaacagcaacuuguguuc

SEQ ID NO: 518093 - RNA, 23 nt, Human
uaauuuguaguguuggagaagaa

SEQ ID NO: 518094 - RNA, 18 nt, Human
uucugauauuggacagua

SEQ ID NO: 518095 - RNA, 14 nt, Human
cacaacacacagau

SEQ ID NO: 518096 - RNA, 15 nt, Human
guucugcagauaaac

SEQ ID NO: 518097 - RNA, 21 nt, Human
ugaaauggacuuuuguacaua

SEQ ID NO: 518098 - RNA, 20 nt, Human
cuggccuucggccuccaucc

SEQ ID NO: 518099 - RNA, 21 nt, Human
caucuagcaugucgucaaagc

SEQ ID NO: 518100 - RNA, 14 nt, Human
cauagaaguaaaaa

SEQ ID NO: 518101 - RNA, 19 nt, Human
cugcaaagcccagcuugaa

SEQ ID NO: 518102 - RNA, 21 nt, Human
caaggaaaaaauaacaaugaa

SEQ ID NO: 518103 - RNA, 22 nt, Human
agccaaacauccuacaagacac

SEQ ID NO: 518104 - RNA, 18 nt, Human
cuuucacauuuaaauaaa

SEQ ID NO: 518105 - RNA, 21 nt, Human
gauaaaagacagugaaagaaa

SEQ ID NO: 518106 - RNA, 14 nt, Human
guaacugauuugua

SEQ ID NO: 518107 - RNA, 17 nt, Human
aagacagugaaagaaaa

SEQ ID NO: 518108 - RNA, 20 nt, Human
uccuaacaggaauuuucauu

SEQ ID NO: 518109 - RNA, 12 nt, Human
aaauauaaagca

SEQ ID NO: 518110 - RNA, 17 nt, Human
gaagcaccaaucaugaa

SEQ ID NO: 518111 - RNA, 22 nt, Human
agcuuguauuccuuuuucucuc

SEQ ID NO: 518112 - RNA, 18 nt, Human
agaagcaacccaaauguu

SEQ ID NO: 518113 - RNA, 15 nt, Human
ccuggugggcagaga

SEQ ID NO: 518114 - RNA, 18 nt, Human
agcaaaauuuuuucucua

SEQ ID NO: 518115 - RNA, 13 nt, Human
gaagaacugaaau

SEQ ID NO: 518116 - RNA, 22 nt, Human
aacucccugccccccagcccuc

SEQ ID NO: 518117 - RNA, 21 nt, Human
agcccuucuuuccacagaagc

SEQ ID NO: 518118 - RNA, 21 nt, Human
aggcucuuuugggauuuuuga

SEQ ID NO: 518119 - RNA, 20 nt, Human
cugcacacagcacgggggcc

SEQ ID NO: 518120 - RNA, 17 nt, Human
agaaucacuugaacccg

SEQ ID NO: 518121 - RNA, 16 nt, Human
caugguuuagaaagcu

SEQ ID NO: 518122 - RNA, 17 nt, Human
aagaaucuuuauaguuc

SEQ ID NO: 518123 - RNA, 20 nt, Human
aaaaucuuauaauuuaaaau

SEQ ID NO: 518124 - RNA, 12 nt, Human
ggcugaugcagu

SEQ ID NO: 518125 - RNA, 18 nt, Human
uaguaucaaaagaaagaa

SEQ ID NO: 518126 - RNA, 23 nt, Human
gaccccugagcuugcagagauga

SEQ ID NO: 518127 - RNA, 14 nt, Human
cuaagucuuauaua

SEQ ID NO: 518128 - RNA, 16 nt, Human
uuguaaaggaauuuaa

SEQ ID NO: 518129 - RNA, 22 nt, Human
ucaacuccaaacugacucuuaa

SEQ ID NO: 518130 - RNA, 21 nt, Human
aaucaccaaggcugauuaaac

SEQ ID NO: 518131 - RNA, 16 nt, Human
auccaaugaaaugagu

SEQ ID NO: 518132 - RNA, 16 nt, Human
ugacuuaaugccacua

SEQ ID NO: 518133 - RNA, 20 nt, Human
aaaagacagugaaagaaaau

SEQ ID NO: 518134 - RNA, 23 nt, Human
gaggcauuuaggccaugggacag

SEQ ID NO: 518135 - RNA, 18 nt, Human
cuccauuuuuagugaaau

SEQ ID NO: 518136 - RNA, 18 nt, Human
cucuauguucuaagaagu

SEQ ID NO: 518137 - RNA, 19 nt, Human
auuaaauauaaagcaagau

SEQ ID NO: 518138 - RNA, 20 nt, Human
ucaauaaaauccauacauuu

SEQ ID NO: 518139 - RNA, 18 nt, Human
auccuucagccugaaaga

SEQ ID NO: 518140 - RNA, 18 nt, Human
auuaaguuuuuuuuuaaa

SEQ ID NO: 518141 - RNA, 21 nt, Human
gaaauguuuacagauccccaa

SEQ ID NO: 518142 - RNA, 14 nt, Human
auaaaauaauuuuu

SEQ ID NO: 518143 - RNA, 22 nt, Human
aauugacccacaagaaaugaaa

SEQ ID NO: 518144 - RNA, 18 nt, Human
ccuuccuaauuccacagc

SEQ ID NO: 518145 - RNA, 21 nt, Human
gaaaaaaagcuuuuuuugaau

SEQ ID NO: 518146 - RNA, 19 nt, Human
aaagacagugaaagaaaau

SEQ ID NO: 518147 - RNA, 18 nt, Human
uaaaauccauacauuugu

SEQ ID NO: 518148 - RNA, 21 nt, Human
ccauccugccccugagcccau

SEQ ID NO: 518149 - RNA, 21 nt, Human
caagacugcacaucaaaauau

SEQ ID NO: 518150 - RNA, 17 nt, Human
agaaaugaaagcaggga

SEQ ID NO: 518151 - RNA, 14 nt, Human
auuuauguuuaauu

SEQ ID NO: 518152 - RNA, 14 nt, Human
aguuuuuuuuuaaa

SEQ ID NO: 518153 - RNA, 14 nt, Human
aaaggaauuuaaaa

SEQ ID NO: 518154 - RNA, 21 nt, Human
gcccugcugagucccaggcug

SEQ ID NO: 518155 - RNA, 15 nt, Human
aaaguuaagaaucuu

SEQ ID NO: 518156 - RNA, 16 nt, Human
cuucuggguuccuucc

SEQ ID NO: 518157 - RNA, 15 nt, Human
gaaaacaaggaugaa

SEQ ID NO: 518158 - RNA, 23 nt, Human
ucaauaucuuuuuuuuaauaaac

SEQ ID NO: 518159 - RNA, 19 nt, Human
auuuucuauaauuuaaaua

SEQ ID NO: 518160 - RNA, 14 nt, Human
augauguuuagaaa

SEQ ID NO: 518161 - RNA, 15 nt, Human
accaaggcugauuaa

SEQ ID NO: 518162 - RNA, 17 nt, Human
aauucuugccaaauaua

SEQ ID NO: 518163 - RNA, 19 nt, Human
aggucuaccaaaaaucuca

SEQ ID NO: 518164 - RNA, 18 nt, Human
ggaggacgcucucuggcc

SEQ ID NO: 518165 - RNA, 23 nt, Human
caucucuucuggguuccuuccuc

SEQ ID NO: 518166 - RNA, 22 nt, Human
ugggcacuguggguagacacac

SEQ ID NO: 518167 - RNA, 21 nt, Human
acaguuaccucugccucagaa

SEQ ID NO: 518168 - RNA, 15 nt, Human
gaaaugaaagcaggg

SEQ ID NO: 518169 - RNA, 13 nt, Human
aacacaacuauau

SEQ ID NO: 518170 - RNA, 20 nt, Human
auaaauggcuuccuggcaau

SEQ ID NO: 518171 - RNA, 16 nt, Human
uaucaaaagaaagaaa

SEQ ID NO: 518172 - RNA, 13 nt, Human
auugucuagugaa

SEQ ID NO: 518173 - RNA, 13 nt, Human
gcagaacagugau

SEQ ID NO: 518174 - RNA, 13 nt, Human
cucaccuccccca

SEQ ID NO: 518175 - RNA, 14 nt, Human
uccacuuggucugu

SEQ ID NO: 518176 - RNA, 14 nt, Human
cugagucccaggcu

SEQ ID NO: 518177 - RNA, 22 nt, Human
agacccacuggacucaccuccc

SEQ ID NO: 518178 - RNA, 16 nt, Human
cugagcauuuaauaug

SEQ ID NO: 518179 - RNA, 23 nt, Human
ggcuaagcuucacuguaaaauaa

SEQ ID NO: 518180 - RNA, 19 nt, Human
ggacucaccucccccaucu

SEQ ID NO: 518181 - RNA, 16 nt, Human
uaaaggaauuuaaaaa

SEQ ID NO: 518182 - RNA, 17 nt, Human
uucucuaggaaauauuu

SEQ ID NO: 518183 - RNA, 17 nt, Human
ccaaaagguauuuuaau

SEQ ID NO: 518184 - RNA, 21 nt, Human
acagugaaagaaaauaacaau

SEQ ID NO: 518185 - RNA, 20 nt, Human
uuaaugccacuaaauugaca

SEQ ID NO: 518186 - RNA, 14 nt, Human
cacuaaacaaagag

SEQ ID NO: 518187 - RNA, 18 nt, Human
cugagucccaggcugagc

SEQ ID NO: 518188 - RNA, 21 nt, Human
ucacaugaacuuguaaaggaa

SEQ ID NO: 518189 - RNA, 19 nt, Human
caacaaaagcgauuauuau

SEQ ID NO: 518190 - RNA, 23 nt, Human
cuacacgagauacagaauuuuau

SEQ ID NO: 518191 - RNA, 17 nt, Human
augcagagguccacaac

SEQ ID NO: 518192 - RNA, 17 nt, Human
gacagugaaagaaaaua

SEQ ID NO: 518193 - RNA, 23 nt, Human
gggccuaugcagagguccacaac

SEQ ID NO: 518194 - RNA, 13 nt, Human
agccucagucucc

SEQ ID NO: 518195 - RNA, 16 nt, Human
auaauccuaaacauau

SEQ ID NO: 518196 - RNA, 18 nt, Human
auccccaagccuggcaag

SEQ ID NO: 518197 - RNA, 23 nt, Human
agaaugauuaugaauuacauuug

SEQ ID NO: 518198 - RNA, 17 nt, Human
gugccuguaaucacagc

SEQ ID NO: 518199 - RNA, 23 nt, Human
uauaguucuacuccauuaaauau

SEQ ID NO: 518200 - RNA, 19 nt, Human
cugccccccagcccuccuu

SEQ ID NO: 518201 - RNA, 15 nt, Human
agugacaagcucaca

SEQ ID NO: 518202 - RNA, 13 nt, Human
uccuacuuccccu

SEQ ID NO: 518203 - RNA, 19 nt, Human
aaacaaaaggauaaugaau

SEQ ID NO: 518204 - RNA, 17 nt, Human
ccugccccccagcccuc

SEQ ID NO: 518205 - RNA, 20 nt, Human
ggagccugaucaccugcccu

SEQ ID NO: 518206 - RNA, 22 nt, Human
aaagagugaaggauuuauguuu

SEQ ID NO: 518207 - RNA, 19 nt, Human
aagcuuguauuccuuuuuc

SEQ ID NO: 518208 - RNA, 13 nt, Human
caacaucuaguga

SEQ ID NO: 518209 - RNA, 13 nt, Human
aggauuugaaauu

SEQ ID NO: 518210 - RNA, 20 nt, Human
cucuguucugcacacagcac

SEQ ID NO: 518211 - RNA, 20 nt, Human
accucugccucagaaaacaa

SEQ ID NO: 518212 - RNA, 21 nt, Human
caaagcccagcuugaaaccuu

SEQ ID NO: 518213 - RNA, 14 nt, Human
uuuuaaaaaagaaa

SEQ ID NO: 518214 - RNA, 11 nt, Human
caucuagugag

SEQ ID NO: 518215 - RNA, 12 nt, Human
aagagcuuaaca

SEQ ID NO: 518216 - RNA, 14 nt, Human
gcuggagcucugcc

SEQ ID NO: 518217 - RNA, 21 nt, Human
auuauauuuauuacuguaaga

SEQ ID NO: 518218 - RNA, 23 nt, Human
cugaaaucauacuucuuaggguu

SEQ ID NO: 518219 - RNA, 23 nt, Human
uuguaacaagccuccuuuuaaag

SEQ ID NO: 518220 - RNA, 14 nt, Human
ugagacucugucuc

SEQ ID NO: 518221 - RNA, 22 nt, Human
cacuaguauuucuaugaaauau

SEQ ID NO: 518222 - RNA, 18 nt, Human
uccagcuggccgggagcc

SEQ ID NO: 518223 - RNA, 17 nt, Human
agagacagaaagcagaa

SEQ ID NO: 518224 - RNA, 20 nt, Human
gccgggcgugguggugagug

SEQ ID NO: 518225 - RNA, 15 nt, Human
uuaauuuguaguguu

SEQ ID NO: 518226 - RNA, 15 nt, Human
caagcucacagaccu

SEQ ID NO: 518227 - RNA, 12 nt, Human
ccccuugccaua

SEQ ID NO: 518228 - RNA, 23 nt, Human
caacggggugaaacccugucucu

SEQ ID NO: 518229 - RNA, 13 nt, Human
ugaaauuguauua

SEQ ID NO: 518230 - RNA, 20 nt, Human
acaugagguacugagaguga

SEQ ID NO: 518231 - RNA, 16 nt, Human
ccuccuuaucaaagga

SEQ ID NO: 518232 - RNA, 23 nt, Human
ucuaccaaaaaucucaauauuuc

SEQ ID NO: 518233 - RNA, 15 nt, Human
uugacccacaagaaa

SEQ ID NO: 518234 - RNA, 15 nt, Human
agaauaccacaggaa

SEQ ID NO: 518235 - RNA, 16 nt, Human
cuccaccuuacuucuu

SEQ ID NO: 518236 - RNA, 17 nt, Human
aggguguguaaguagau

SEQ ID NO: 518237 - RNA, 20 nt, Human
ugagucccaggcugagccuc

SEQ ID NO: 518238 - RNA, 15 nt, Human
ggcaagcucuaucac

SEQ ID NO: 518239 - RNA, 22 nt, Human
uauuucagauaaucacaauaca

SEQ ID NO: 518240 - RNA, 18 nt, Human
agagaaugagagacacac

SEQ ID NO: 518241 - RNA, 19 nt, Human
augaaagcagggacuugaa

SEQ ID NO: 518242 - RNA, 18 nt, Human
guauuauuuuuuaaaaaa

SEQ ID NO: 518243 - RNA, 19 nt, Human
gucaaucagccuaguugau

SEQ ID NO: 518244 - RNA, 13 nt, Human
agaaaugaaagca

SEQ ID NO: 518245 - RNA, 14 nt, Human
cuggccgggagccu

SEQ ID NO: 518246 - RNA, 11 nt, Human
uuauauuuauu

SEQ ID NO: 518247 - RNA, 14 nt, Human
ugcuggagcucugc

SEQ ID NO: 518248 - RNA, 21 nt, Human
aggguuaugauuaaguaauga

SEQ ID NO: 518249 - RNA, 15 nt, Human
acaagacccaaaagg

SEQ ID NO: 518250 - RNA, 16 nt, Human
acuaaacaaagaguga

SEQ ID NO: 518251 - RNA, 18 nt, Human
aacaaugcuguauuuuaa

SEQ ID NO: 518252 - RNA, 16 nt, Human
uggggauagugaggca

SEQ ID NO: 518253 - RNA, 19 nt, Human
guuguauuauuuuuuaaaa

SEQ ID NO: 518254 - RNA, 14 nt, Human
aaugauuaugaauu

SEQ ID NO: 518255 - RNA, 16 nt, Human
cuuuaugcuaagugaa

SEQ ID NO: 518256 - RNA, 17 nt, Human
uucacuguaaaauaaua

SEQ ID NO: 518257 - RNA, 23 nt, Human
uguugcccacagcuguaugauuc

SEQ ID NO: 518258 - RNA, 13 nt, Human
uacuuuauuuucu

SEQ ID NO: 518259 - RNA, 16 nt, Human
caaauauaaacagcaa

SEQ ID NO: 518260 - RNA, 14 nt, Human
agucucccucccuu

SEQ ID NO: 518261 - RNA, 22 nt, Human
ggguuccuuccucugagccuug

SEQ ID NO: 518262 - RNA, 15 nt, Human
uccaccuuacuucuu

SEQ ID NO: 518263 - RNA, 15 nt, Human
uucacuguaaaauaa

SEQ ID NO: 518264 - RNA, 12 nt, Human
cauuauauuuau

SEQ ID NO: 518265 - RNA, 20 nt, Human
acggacgaaccuugaaaacu

SEQ ID NO: 518266 - RNA, 19 nt, Human
aaaaucuuauaauuuaaaa

SEQ ID NO: 518267 - RNA, 18 nt, Human
auagcuacuaauuuuaaa

SEQ ID NO: 518268 - RNA, 13 nt, Human
aagacaaggaaaa

SEQ ID NO: 518269 - RNA, 16 nt, Human
cagcuuuccucaaaac

SEQ ID NO: 518270 - RNA, 16 nt, Human
auuccaccuacaugag

SEQ ID NO: 518271 - RNA, 21 nt, Human
ccucuguucugcacacagcac

SEQ ID NO: 518272 - RNA, 19 nt, Human
ccccugagcuugcagagau

SEQ ID NO: 518273 - RNA, 16 nt, Human
gacaaggaaaaaauaa

SEQ ID NO: 518274 - RNA, 15 nt, Human
ucacaggacagcccu

SEQ ID NO: 518275 - RNA, 14 nt, Human
ggccuucggccucc

SEQ ID NO: 518276 - RNA, 18 nt, Human
acauguuacaacacggac

SEQ ID NO: 518277 - RNA, 18 nt, Human
ccacuuggucugugagau

SEQ ID NO: 518278 - RNA, 17 nt, Human
agacagugaaagaaaau

SEQ ID NO: 518279 - RNA, 12 nt, Human
gaauuggagcuc

SEQ ID NO: 518280 - RNA, 14 nt, Human
aaauauuauuuuau

SEQ ID NO: 518281 - RNA, 20 nt, Human
aauaauuuuuauauuugaaa

SEQ ID NO: 518282 - RNA, 20 nt, Human
ugagagugaacaaauuuaca

SEQ ID NO: 518283 - RNA, 20 nt, Human
gaaacauuugguaaggggaa

SEQ ID NO: 518284 - RNA, 23 nt, Human
gauagauaggucagugcaaauac

SEQ ID NO: 518285 - RNA, 21 nt, Human
ugaacaaauuuacagagacag

SEQ ID NO: 518286 - RNA, 11 nt, Human
accauuuuuac

SEQ ID NO: 518287 - RNA, 22 nt, Human
aucaccaaggcugauuaaacca

SEQ ID NO: 518288 - RNA, 17 nt, Human
gccuccuuuuaaaguaa

SEQ ID NO: 518289 - RNA, 19 nt, Human
gguuccuuccucugagccu

SEQ ID NO: 518290 - RNA, 17 nt, Human
uugccaaauauaaauaa

SEQ ID NO: 518291 - RNA, 14 nt, Human
uauguauauuuuau

SEQ ID NO: 518292 - RNA, 13 nt, Human
aaaauaacgauaa

SEQ ID NO: 518293 - RNA, 22 nt, Human
caaggaugccccgucccccucu

SEQ ID NO: 518294 - RNA, 18 nt, Human
cucccuuggggccuaugc

SEQ ID NO: 518295 - RNA, 18 nt, Human
aaauauaaauaaaaauaa

SEQ ID NO: 518296 - RNA, 15 nt, Human
gcaagcucuaucacc

SEQ ID NO: 518297 - RNA, 16 nt, Human
auccuacaagacacag

SEQ ID NO: 518298 - RNA, 20 nt, Human
agccuuggggcugaugcagu

SEQ ID NO: 518299 - RNA, 15 nt, Human
cacuuggucugugag

SEQ ID NO: 518300 - RNA, 20 nt, Human
uggaauaauccuaaacauau

SEQ ID NO: 518301 - RNA, 14 nt, Human
acagaauuuuaugc

SEQ ID NO: 518302 - RNA, 13 nt, Human
auuggacaguaaa

SEQ ID NO: 518303 - RNA, 19 nt, Human
gucuuucacauuuaaauaa

SEQ ID NO: 518304 - RNA, 16 nt, Human
uuaauaauuuuuaauu

SEQ ID NO: 518305 - RNA, 16 nt, Human
acaugaacuuguaaag

SEQ ID NO: 518306 - RNA, 23 nt, Human
acguaaucguguccccuauccua

SEQ ID NO: 518307 - RNA, 14 nt, Human
gauuaguacacacu

SEQ ID NO: 518308 - RNA, 15 nt, Human
cugcacuccagccug

SEQ ID NO: 518309 - RNA, 22 nt, Human
aaugggcacaggguuuauguuu

SEQ ID NO: 518310 - RNA, 22 nt, Human
ucuacuaaaaauacaaaaaaaa

SEQ ID NO: 518311 - RNA, 18 nt, Human
auguuaaaacugggacag

SEQ ID NO: 518312 - RNA, 12 nt, Human
auuuuaaaagaa

SEQ ID NO: 518313 - RNA, 16 nt, Human
agggaggacgcucucu

SEQ ID NO: 518314 - RNA, 15 nt, Human
gcacagccucuuaga

SEQ ID NO: 518315 - RNA, 20 nt, Human
auaagccagacaucaacaga

SEQ ID NO: 518316 - RNA, 18 nt, Human
aaaaugguauuaaagauc

SEQ ID NO: 518317 - RNA, 16 nt, Human
ccuggugggcagagag

SEQ ID NO: 518318 - RNA, 14 nt, Human
ugcuguauuuuaaa

SEQ ID NO: 518319 - RNA, 10 nt, Human
accugagccc

SEQ ID NO: 518320 - RNA, 17 nt, Human
gcaagcucuaucaccaa

SEQ ID NO: 518321 - RNA, 18 nt, Human
uacuuuauuuucuauaau

SEQ ID NO: 518322 - RNA, 17 nt, Human
cccccugcaaagcccag

SEQ ID NO: 518323 - RNA, 20 nt, Human
guaucaaaagaaagaaaauc

SEQ ID NO: 518324 - RNA, 22 nt, Human
gaugcaguuguugcccacagcu

SEQ ID NO: 518325 - RNA, 19 nt, Human
cgcccacuagacccacugg

SEQ ID NO: 518326 - RNA, 17 nt, Human
gacagucaccucaugga

SEQ ID NO: 518327 - RNA, 18 nt, Human
uuggggccuaugcagagg

SEQ ID NO: 518328 - RNA, 23 nt, Human
cuucaacucccugccccccagcc

SEQ ID NO: 518329 - RNA, 21 nt, Human
auaauuuuuauauuugaaaua

SEQ ID NO: 518330 - RNA, 22 nt, Human
uagacacacaugaaguccaagc

SEQ ID NO: 518331 - RNA, 20 nt, Human
uaggaauugacccacaagaa

SEQ ID NO: 518332 - RNA, 16 nt, Human
aauauaaauaaaaaua

SEQ ID NO: 518333 - RNA, 22 nt, Human
gaugcaguucugaagaagaugg

SEQ ID NO: 518334 - RNA, 18 nt, Human
uucucuaggaaauauuua

SEQ ID NO: 518335 - RNA, 23 nt, Human
ucuuagaugcaguucugaagaag

SEQ ID NO: 518336 - RNA, 16 nt, Human
ccacuuggucugugag

SEQ ID NO: 518337 - RNA, 21 nt, Human
gaagugaaaaucuacacucca

SEQ ID NO: 518338 - RNA, 20 nt, Human
ggccuaugcagagguccaca

SEQ ID NO: 518339 - RNA, 17 nt, Human
ucuuauaauuuaaaaua

SEQ ID NO: 518340 - RNA, 13 nt, Human
uuauucacaagac

SEQ ID NO: 518341 - RNA, 20 nt, Human
agcaucucauuuauaaugua

SEQ ID NO: 518342 - RNA, 19 nt, Human
gcuuguauuccuuuuucuc

SEQ ID NO: 518343 - RNA, 13 nt, Human
ccccagcccuccu

SEQ ID NO: 518344 - RNA, 22 nt, Human
gcuugcagagaugaggccgcca

SEQ ID NO: 518345 - RNA, 14 nt, Human
aauggcuaagcaaa

SEQ ID NO: 518346 - RNA, 21 nt, Human
aaugaauggcuaagcaaaaug

SEQ ID NO: 518347 - RNA, 15 nt, Human
ggccuucggccucca

SEQ ID NO: 518348 - RNA, 17 nt, Human
ccucagucucccucccu

SEQ ID NO: 518349 - RNA, 15 nt, Human
aagcacuaaacaaag

SEQ ID NO: 518350 - RNA, 12 nt, Human
aucguguccccu

SEQ ID NO: 518351 - RNA, 14 nt, Human
agguugcagugagc

SEQ ID NO: 518352 - RNA, 15 nt, Human
cuuacuucuucucau

SEQ ID NO: 518353 - RNA, 16 nt, Human
ugcuguauuuuaaaag

SEQ ID NO: 518354 - RNA, 18 nt, Human
aaauaacgauaaaagaca

SEQ ID NO: 518355 - RNA, 14 nt, Human
uaguaucaaaagaa

SEQ ID NO: 518356 - RNA, 17 nt, Human
uccucugagccuuggga

SEQ ID NO: 518357 - RNA, 16 nt, Human
cuucacuguaaaauaa

SEQ ID NO: 518358 - RNA, 19 nt, Human
agagccuuuuuuugaaaaa

SEQ ID NO: 518359 - RNA, 15 nt, Human
aaaaaagaaacauuu

SEQ ID NO: 518360 - RNA, 12 nt, Human
agacagugaaag

SEQ ID NO: 518361 - RNA, 14 nt, Human
aucaaaagaaagaa

SEQ ID NO: 518362 - RNA, 13 nt, Human
uaacgauaaaaga

SEQ ID NO: 518363 - RNA, 14 nt, Human
acuggacucaccuc

SEQ ID NO: 518364 - RNA, 23 nt, Human
aauuuucauuguucuauaacaac

SEQ ID NO: 518365 - RNA, 21 nt, Human
uauuauuuuauagcuacuaau

SEQ ID NO: 518366 - RNA, 23 nt, Human
ggaggcagagguugcagugagcc

SEQ ID NO: 518367 - RNA, 14 nt, Human
uucuggaauaaucc

SEQ ID NO: 518368 - RNA, 14 nt, Human
gaaaaaauaacaau

SEQ ID NO: 518369 - RNA, 18 nt, Human
uaaauugacacuuaaaaa

SEQ ID NO: 518370 - RNA, 13 nt, Human
aacucuauaaugu

SEQ ID NO: 518371 - RNA, 18 nt, Human
gccccgucccccucuggc

SEQ ID NO: 518372 - RNA, 13 nt, Human
ucuaagaagugaa

SEQ ID NO: 518373 - RNA, 15 nt, Human
uccaagccucauguc

SEQ ID NO: 518374 - RNA, 18 nt, Human
ucaaggguacacugccuu

SEQ ID NO: 518375 - RNA, 12 nt, Human
cagugaaagaaa

SEQ ID NO: 518376 - RNA, 15 nt, Human
ccuugccaugugcua

SEQ ID NO: 518377 - RNA, 20 nt, Human
ccauuguggucacaggaagu

SEQ ID NO: 518378 - RNA, 20 nt, Human
ucugcaacuacuauccaacu

SEQ ID NO: 518379 - RNA, 17 nt, Human
ucucuggccuucggccu

SEQ ID NO: 518380 - RNA, 20 nt, Human
cccugcacuccagccugagc

SEQ ID NO: 518381 - RNA, 14 nt, Human
guauuuuaaaagaa

SEQ ID NO: 518382 - RNA, 19 nt, Human
augaaguacucauacaugu

SEQ ID NO: 518383 - RNA, 23 nt, Human
aaauuuacagagacagaaagcag

SEQ ID NO: 518384 - RNA, 19 nt, Human
uggugaacuugguuuuaau

SEQ ID NO: 518385 - RNA, 16 nt, Human
cuagaacucccuuuca

SEQ ID NO: 518386 - RNA, 16 nt, Human
gccucagucucccucc

SEQ ID NO: 518387 - RNA, 22 nt, Human
aauuacauuuguauaaaauaau

SEQ ID NO: 518388 - RNA, 23 nt, Human
agccuugggaccccugagcuugc

SEQ ID NO: 518389 - RNA, 17 nt, Human
ugaaggauuuauguuua

SEQ ID NO: 518390 - RNA, 17 nt, Human
gaagaccucauuuugaa

SEQ ID NO: 518391 - RNA, 15 nt, Human
aaaauaacaaugaaa

SEQ ID NO: 518392 - RNA, 19 nt, Human
uggugagugccuguaauca

SEQ ID NO: 518393 - RNA, 23 nt, Human
gaaaaucuuauaauuuaaaauau

SEQ ID NO: 518394 - RNA, 18 nt, Human
cuggaaacuucagcgguu

SEQ ID NO: 518395 - RNA, 22 nt, Human
ccauuucuugagguaaaagcau

SEQ ID NO: 518396 - RNA, 15 nt, Human
aagaaaauaacaaua

SEQ ID NO: 518397 - RNA, 14 nt, Human
uugacccacaagaa

SEQ ID NO: 518398 - RNA, 15 nt, Human
auaaaguguuugaaa

SEQ ID NO: 518399 - RNA, 13 nt, Human
aguuaccucugcc

SEQ ID NO: 518400 - RNA, 18 nt, Human
uguggucacaggaaguag

SEQ ID NO: 518401 - RNA, 21 nt, Human
cugagccucagucucccuccc

SEQ ID NO: 518402 - RNA, 15 nt, Human
ugcuucuguuuuaua

SEQ ID NO: 518403 - RNA, 14 nt, Human
aauaguuuaugauu

SEQ ID NO: 518404 - RNA, 16 nt, Human
cugcucucaguucacu

SEQ ID NO: 518405 - RNA, 22 nt, Human
ugaauggcuaagcaaaauguga

SEQ ID NO: 518406 - RNA, 17 nt, Human
aaucuuucacaggggac

SEQ ID NO: 518407 - RNA, 14 nt, Human
gaaugauuaugaau

SEQ ID NO: 518408 - RNA, 13 nt, Human
ccaccugccuaua

SEQ ID NO: 518409 - RNA, 21 nt, Human
aagucuuucacauuuaaauaa

SEQ ID NO: 518410 - RNA, 17 nt, Human
cuucacuguaaaauaau

SEQ ID NO: 518411 - RNA, 15 nt, Human
cuuuucccaacucca

SEQ ID NO: 518412 - RNA, 18 nt, Human
gaauaauccuaaacauau

SEQ ID NO: 518413 - RNA, 23 nt, Human
uuuccaucaaggguacacugccu

SEQ ID NO: 518414 - RNA, 15 nt, Human
augaauuaaguuuuu

SEQ ID NO: 518415 - RNA, 20 nt, Human
agcuuauugucuagugaaac

SEQ ID NO: 518416 - RNA, 17 nt, Human
ccaacuuauauuucugc

SEQ ID NO: 518417 - RNA, 17 nt, Human
uauauuguagauaauac

SEQ ID NO: 518418 - RNA, 18 nt, Human
cuuccucugagccuuggg

SEQ ID NO: 518419 - RNA, 22 nt, Human
cuggguuccuuccucugagccu

SEQ ID NO: 518420 - RNA, 16 nt, Human
gugagacagcucugca

SEQ ID NO: 518421 - RNA, 14 nt, Human
gucccaggcugagc

SEQ ID NO: 518422 - RNA, 15 nt, Human
gucaaugcagccccc

SEQ ID NO: 518423 - RNA, 17 nt, Human
cuuccuaauuccacagc

SEQ ID NO: 518424 - RNA, 23 nt, Human
cuagacccacuggacucaccucc

SEQ ID NO: 518425 - RNA, 22 nt, Human
aauuuuuucucuaggaaauauu

SEQ ID NO: 518426 - RNA, 17 nt, Human
aauaaaguguuugaaag

SEQ ID NO: 518427 - RNA, 15 nt, Human
aguucugaagaagau

SEQ ID NO: 518428 - RNA, 19 nt, Human
gagccucagucucccuccc

SEQ ID NO: 518429 - RNA, 20 nt, Human
acagcccuucuuuccacaga

SEQ ID NO: 518430 - RNA, 15 nt, Human
gccucagucucccuc

SEQ ID NO: 518431 - RNA, 15 nt, Human
ucaaaggacaccauu

SEQ ID NO: 518432 - RNA, 19 nt, Human
uaucucauuuccaagcaag

SEQ ID NO: 518433 - RNA, 20 nt, Human
agcccuggugggcagagagg

SEQ ID NO: 518434 - RNA, 22 nt, Human
uugaaaaucuuauaauuuaaaa

SEQ ID NO: 518435 - RNA, 14 nt, Human
caaggcuagaacca

SEQ ID NO: 518436 - RNA, 18 nt, Human
aaauauuuauuuuaauaa

SEQ ID NO: 518437 - RNA, 22 nt, Human
ccacagcuguaugauucccagc

SEQ ID NO: 518438 - RNA, 19 nt, Human
augaguaacugauuuguaa

SEQ ID NO: 518439 - RNA, 16 nt, Human
ugugagaugcuagaac

SEQ ID NO: 518440 - RNA, 15 nt, Human
aacgauaaaagacag

SEQ ID NO: 518441 - RNA, 21 nt, Human
aaugugacuuaaugccacuaa

SEQ ID NO: 518442 - RNA, 20 nt, Human
uuaaguuuuuuuuuaaaaaa

SEQ ID NO: 518443 - RNA, 16 nt, Human
uagcuacuaauuuuaa

SEQ ID NO: 518444 - RNA, 15 nt, Human
ugagcgcccacuaga

SEQ ID NO: 518445 - RNA, 12 nt, Human
cuucaacucccu

SEQ ID NO: 518446 - RNA, 12 nt, Human
gaaaauaacaau

SEQ ID NO: 518447 - RNA, 22 nt, Human
gcacagccucuuagaugcaguu

SEQ ID NO: 518448 - RNA, 16 nt, Human
agaugcuagaacuccc

SEQ ID NO: 518449 - RNA, 17 nt, Human
cucguggaacaguuacc

SEQ ID NO: 518450 - RNA, 14 nt, Human
cguguccccuaucc

SEQ ID NO: 518451 - RNA, 17 nt, Human
cucgugggacagucacc

SEQ ID NO: 518452 - RNA, 16 nt, Human
ugcacaucaaaauaug

SEQ ID NO: 518453 - RNA, 13 nt, Human
cccaaaaggcaga

SEQ ID NO: 518454 - RNA, 11 nt, Human
ggucacaggaa

SEQ ID NO: 518455 - RNA, 14 nt, Human
aucaccaaggcuga

SEQ ID NO: 518456 - RNA, 16 nt, Human
ugcaaauugucacagg

SEQ ID NO: 518457 - RNA, 20 nt, Human
aaagagugaaggauuuaugu

SEQ ID NO: 518458 - RNA, 13 nt, Human
ccagcacagccuc

SEQ ID NO: 518459 - RNA, 16 nt, Human
uaacaauaaaagacaa

SEQ ID NO: 518460 - RNA, 23 nt, Human
ggucuaucuuugagcgcccacua

SEQ ID NO: 518461 - RNA, 15 nt, Human
auuucuaugaaauau

SEQ ID NO: 518462 - RNA, 17 nt, Human
gauaaaagacagugaaa

SEQ ID NO: 518463 - RNA, 13 nt, Human
caguuauuauauu

SEQ ID NO: 518464 - RNA, 12 nt, Human
agggauggggcu

SEQ ID NO: 518465 - RNA, 13 nt, Human
aauuuuuauauuu

SEQ ID NO: 518466 - RNA, 21 nt, Human
aauaauccucaguuuuuguga

SEQ ID NO: 518467 - RNA, 16 nt, Human
uauccuacuuccccuu

SEQ ID NO: 518468 - RNA, 14 nt, Human
aagcucuaucacca

SEQ ID NO: 518469 - RNA, 12 nt, Human
cuacaagacaca

SEQ ID NO: 518470 - RNA, 19 nt, Human
cagcacgggggccaaggau

SEQ ID NO: 518471 - RNA, 15 nt, Human
caaauccaaugaaau

SEQ ID NO: 518472 - RNA, 14 nt, Human
aaaacuucagacau

SEQ ID NO: 518473 - RNA, 14 nt, Human
uaaauaguuuauga

SEQ ID NO: 518474 - RNA, 19 nt, Human
uuugccaaguucuccacua

SEQ ID NO: 518475 - RNA, 19 nt, Human
caacuuauauuucugcuuu

SEQ ID NO: 518476 - RNA, 16 nt, Human
caauaacgauaaaaga

SEQ ID NO: 518477 - RNA, 22 nt, Human
uaauaggcguaacuaauuuuaa

SEQ ID NO: 518478 - RNA, 22 nt, Human
uuuaauaauguuucaaacauau

SEQ ID NO: 518479 - RNA, 15 nt, Human
uuuagugaaauauua

SEQ ID NO: 518480 - RNA, 19 nt, Human
cugagccucagucucccuc

SEQ ID NO: 518481 - RNA, 21 nt, Human
cauuucuugagguaaaagcau

SEQ ID NO: 518482 - RNA, 14 nt, Human
aaaagaaagaaaau

SEQ ID NO: 518483 - RNA, 20 nt, Human
ccccuauccuacuuccccuu

SEQ ID NO: 518484 - RNA, 15 nt, Human
uacuaauuuuaaaau

SEQ ID NO: 518485 - RNA, 17 nt, Human
uggcuaagcaaaaugug

SEQ ID NO: 518486 - RNA, 13 nt, Human
aaaaauccuacuu

SEQ ID NO: 518487 - RNA, 22 nt, Human
aggacaccauuuuggcaagcuc

SEQ ID NO: 518488 - RNA, 23 nt, Human
acaacaaaagcgauuauuauuuu

SEQ ID NO: 518489 - RNA, 17 nt, Human
cguaaucguguccccua

SEQ ID NO: 518490 - RNA, 18 nt, Human
gaugcaguucugaagaag

SEQ ID NO: 518491 - RNA, 17 nt, Human
agggcauagaaguaaaa

SEQ ID NO: 518492 - RNA, 15 nt, Human
cagccagcacagccu

SEQ ID NO: 518493 - RNA, 13 nt, Human
auaacuggaaacu

SEQ ID NO: 518494 - RNA, 14 nt, Human
uaguuucccuugca

SEQ ID NO: 518495 - RNA, 22 nt, Human
caagcucuaucaccaaggagcc

SEQ ID NO: 518496 - RNA, 21 nt, Human
gccugaucaccugcccugcug

SEQ ID NO: 518497 - RNA, 19 nt, Human
ucugagcauuuaauaugga

SEQ ID NO: 518498 - RNA, 19 nt, Human
caaauauaaacagcaacuu

SEQ ID NO: 518499 - RNA, 12 nt, Human
uucucuaggaaa

SEQ ID NO: 518500 - RNA, 12 nt, Human
gacagugaaaga

SEQ ID NO: 518501 - RNA, 14 nt, Human
aauauuauuuuaua

SEQ ID NO: 518502 - RNA, 22 nt, Human
accauuucuugagguaaaagca

SEQ ID NO: 518503 - RNA, 19 nt, Human
acauuuguauaaaauaauu

SEQ ID NO: 518504 - RNA, 16 nt, Human
ccauuuuuagugaaau

SEQ ID NO: 518505 - RNA, 22 nt, Human
cagcccuggugggcagagaggu

SEQ ID NO: 518506 - RNA, 17 nt, Human
aaauaacaauaaaagac

SEQ ID NO: 518507 - RNA, 21 nt, Human
acagcccuucuuuccacagaa

SEQ ID NO: 518508 - RNA, 16 nt, Human
augcuaagugaaauaa

SEQ ID NO: 518509 - RNA, 18 nt, Human
auagaauuaacacaugau

SEQ ID NO: 518510 - RNA, 15 nt, Human
ucugcagauaaacag

SEQ ID NO: 518511 - RNA, 15 nt, Human
aucuuauaauuuaaa

SEQ ID NO: 518512 - RNA, 15 nt, Human
aaggaaaaaauaaca

SEQ ID NO: 518513 - RNA, 23 nt, Human
uagauguauagguugaugguggu

SEQ ID NO: 518514 - RNA, 15 nt, Human
ccucagucucccucc

SEQ ID NO: 518515 - RNA, 20 nt, Human
caagcucuaucaccaaggag

SEQ ID NO: 518516 - RNA, 19 nt, Human
uguaguguuggagaagaac

SEQ ID NO: 518517 - RNA, 15 nt, Human
cuacaagacacagug

SEQ ID NO: 518518 - RNA, 15 nt, Human
auaauuuugugaagc

SEQ ID NO: 518519 - RNA, 16 nt, Human
aucaaaagaaagaaaa

SEQ ID NO: 518520 - RNA, 19 nt, Human
aauauuauguuaaaacugg

SEQ ID NO: 518521 - RNA, 13 nt, Human
aucucaauauuuc

SEQ ID NO: 518522 - RNA, 22 nt, Human
ccucccuuggggccuaugcaga

SEQ ID NO: 518523 - RNA, 22 nt, Human
agcagcauaaauguugacaugg

SEQ ID NO: 518524 - RNA, 22 nt, Human
cugaggcuccacuuggucugug

SEQ ID NO: 518525 - RNA, 13 nt, Human
aacaagccuccuu

SEQ ID NO: 518526 - RNA, 15 nt, Human
ugagcucagcccugg

SEQ ID NO: 518527 - RNA, 12 nt, Human
acaagaaaugaa

SEQ ID NO: 518528 - RNA, 13 nt, Human
ggaaguagaggag

SEQ ID NO: 518529 - RNA, 20 nt, Human
aauuuuuucucuaggaaaua

SEQ ID NO: 518530 - RNA, 17 nt, Human
aaagacaaggaaaaaau

SEQ ID NO: 518531 - RNA, 18 nt, Human
auaauccuaaacauauga

SEQ ID NO: 518532 - RNA, 22 nt, Human
ccauacuaauuauacccccugc

SEQ ID NO: 518533 - RNA, 13 nt, Human
uuuugaaucauca

SEQ ID NO: 518534 - RNA, 20 nt, Human
ugaaaaucuuauaauuuaaa

SEQ ID NO: 518535 - RNA, 22 nt, Human
ucuggguuccuuccucugagcc

SEQ ID NO: 518536 - RNA, 22 nt, Human
ugaccauacuaauuauaccccc

SEQ ID NO: 518537 - RNA, 14 nt, Human
uugccaugugcuag

SEQ ID NO: 518538 - RNA, 13 nt, Human
cucugagccuugg

SEQ ID NO: 518539 - RNA, 11 nt, Human
ugcagugagcc

SEQ ID NO: 518540 - RNA, 20 nt, Human
guuccuuccucugagccuug

SEQ ID NO: 518541 - RNA, 19 nt, Human
ugaaauggacuuuuguaca

SEQ ID NO: 518542 - RNA, 13 nt, Human
uucuauaauuuaa

SEQ ID NO: 518543 - RNA, 19 nt, Human
auaaaagacagugaaagaa

SEQ ID NO: 518544 - RNA, 17 nt, Human
ccacugcagaagacagu

SEQ ID NO: 518545 - RNA, 22 nt, Human
aucaucaagucuuucacauuua

SEQ ID NO: 518546 - RNA, 19 nt, Human
uccagaaagugacaagcuc

SEQ ID NO: 518547 - RNA, 21 nt, Human
cucagugucaaugcagccccc

SEQ ID NO: 518548 - RNA, 13 nt, Human
cugagagugaaca

SEQ ID NO: 518549 - RNA, 14 nt, Human
ggacucaccucccc

SEQ ID NO: 518550 - RNA, 18 nt, Human
ucuaugaaauauuauguu

SEQ ID NO: 518551 - RNA, 19 nt, Human
acuggacucaccuccccca

SEQ ID NO: 518552 - RNA, 23 nt, Human
agaguuuagcuggaaaaguaugu

SEQ ID NO: 518553 - RNA, 19 nt, Human
aaucuacacuccagugaga

SEQ ID NO: 518554 - RNA, 17 nt, Human
aguauuucuaugaaaua

SEQ ID NO: 518555 - RNA, 13 nt, Human
cacauuuaaauaa

SEQ ID NO: 518556 - RNA, 16 nt, Human
uucuauaauuuaaaua

SEQ ID NO: 518557 - RNA, 11 nt, Human
gagguaaaagc

SEQ ID NO: 518558 - RNA, 22 nt, Human
auauaaauaaaaauaauccuca

SEQ ID NO: 518559 - RNA, 12 nt, Human
cagaacagugau

SEQ ID NO: 518560 - RNA, 13 nt, Human
ccagcccuccuua

SEQ ID NO: 518561 - RNA, 23 nt, Human
auucaauaucuuuuuuuuaauaa

SEQ ID NO: 518562 - RNA, 19 nt, Human
uagcagcucauaaaugaaa

SEQ ID NO: 518563 - RNA, 21 nt, Human
cgaaguauccuucagccugaa

SEQ ID NO: 518564 - RNA, 18 nt, Human
gagcgacagugagacucu

SEQ ID NO: 518565 - RNA, 21 nt, Human
uuuauauaagcuuguauuccu

SEQ ID NO: 518566 - RNA, 16 nt, Human
ugcaugguuuagaaag

SEQ ID NO: 518567 - RNA, 23 nt, Human
uuagaugcaguucugaagaagau

SEQ ID NO: 518568 - RNA, 16 nt, Human
auacuauuuaagagaa

SEQ ID NO: 518569 - RNA, 14 nt, Human
agcucauaaaugaa

SEQ ID NO: 518570 - RNA, 20 nt, Human
aagggcuguuauaaucuuuc

SEQ ID NO: 518571 - RNA, 15 nt, Human
gaagauguagaggag

SEQ ID NO: 518572 - RNA, 23 nt, Human
caucaacagauaaauaguuuaug

SEQ ID NO: 518573 - RNA, 13 nt, Human
uauuuauuuuaau

SEQ ID NO: 518574 - RNA, 18 nt, Human
auggcuugaguuuaaauu

SEQ ID NO: 518575 - RNA, 20 nt, Human
gaaaauaacaauaaaagaca

SEQ ID NO: 518576 - RNA, 14 nt, Human
acuacuauccaacu

SEQ ID NO: 518577 - RNA, 18 nt, Human
acugacucuuaagaagac

SEQ ID NO: 518578 - RNA, 20 nt, Human
gagccucagucucccucccu

SEQ ID NO: 518579 - RNA, 18 nt, Human
aagaccucauuuugaagg

SEQ ID NO: 518580 - RNA, 21 nt, Human
aagcuccauuuuuagugaaau

SEQ ID NO: 518581 - RNA, 14 nt, Human
cagauuugagcuca

SEQ ID NO: 518582 - RNA, 14 nt, Human
acaagcaaauauaa

SEQ ID NO: 518583 - RNA, 17 nt, Human
ucagacauagaauuaac

SEQ ID NO: 518584 - RNA, 17 nt, Human
agucccaggcugagccu

SEQ ID NO: 518585 - RNA, 17 nt, Human
uaaaagacaaggaaaaa

SEQ ID NO: 518586 - RNA, 14 nt, Human
uugaaauuguauua

SEQ ID NO: 518587 - RNA, 19 nt, Human
uggaaauguuuacagaucc

SEQ ID NO: 518588 - RNA, 23 nt, Human
cuuaagaagacugcauuauauuu

SEQ ID NO: 518589 - RNA, 16 nt, Human
cuagaaccaccugccu

SEQ ID NO: 518590 - RNA, 11 nt, Human
uucacagggga

SEQ ID NO: 518591 - RNA, 15 nt, Human
gcaacccaaauguuc

SEQ ID NO: 518592 - RNA, 19 nt, Human
guccaggucuaccaaaaau

SEQ ID NO: 518593 - RNA, 16 nt, Human
ugaaguccaagcauuu

SEQ ID NO: 518594 - RNA, 21 nt, Human
auuuuuucucuaggaaauauu

SEQ ID NO: 518595 - RNA, 13 nt, Human
gauuguaaaaugg

SEQ ID NO: 518596 - RNA, 17 nt, Human
uuucacauuuaaauaaa

SEQ ID NO: 518597 - RNA, 16 nt, Human
gacauuugcucaugga

SEQ ID NO: 518598 - RNA, 21 nt, Human
uuacauuuguauaaaauaauu

SEQ ID NO: 518599 - RNA, 15 nt, Human
cauuccaagccucau

SEQ ID NO: 518600 - RNA, 15 nt, Human
cuggacucaccuccc

SEQ ID NO: 518601 - RNA, 18 nt, Human
accaccugccuauauuuu

SEQ ID NO: 518602 - RNA, 14 nt, Human
uuaugauuaaguaa

SEQ ID NO: 518603 - RNA, 13 nt, Human
uuaaaaaagaaac

SEQ ID NO: 518604 - RNA, 13 nt, Human
cacacugaagaag

SEQ ID NO: 518605 - RNA, 16 nt, Human
aaagacaaggaaaaaa

SEQ ID NO: 518606 - RNA, 21 nt, Human
cccccauuguggucacaggaa

SEQ ID NO: 518607 - RNA, 17 nt, Human
aaccuagggugauauua

SEQ ID NO: 518608 - RNA, 20 nt, Human
uagaugcaguucugaagaag

SEQ ID NO: 518609 - RNA, 17 nt, Human
ccacuggacucaccucc

SEQ ID NO: 518610 - RNA, 20 nt, Human
gcuugcagagaugaggccgc

SEQ ID NO: 518611 - RNA, 15 nt, Human
cucgugggacaguca

SEQ ID NO: 518612 - RNA, 19 nt, Human
uauacugugugcuaaaaca

SEQ ID NO: 518613 - RNA, 19 nt, Human
cuagaguuuagcuggaaaa

SEQ ID NO: 518614 - RNA, 18 nt, Human
caaggcuagaaccaccug

SEQ ID NO: 518615 - RNA, 19 nt, Human
ccccucuggcuccagcugg

SEQ ID NO: 518616 - RNA, 21 nt, Human
aaacaauaacgauaaaagaca

SEQ ID NO: 518617 - RNA, 12 nt, Human
cuccauuuuuag

SEQ ID NO: 518618 - RNA, 16 nt, Human
uucccaacuccagaaa

SEQ ID NO: 518619 - RNA, 13 nt, Human
uauuucuaugaaa

SEQ ID NO: 518620 - RNA, 16 nt, Human
agguugcagugagccg

SEQ ID NO: 518621 - RNA, 16 nt, Human
cugagccucagucucc

SEQ ID NO: 518622 - RNA, 15 nt, Human
uuaauucugaaagca

SEQ ID NO: 518623 - RNA, 14 nt, Human
cccugccccccagc

SEQ ID NO: 518624 - RNA, 15 nt, Human
uugacacuuaaaaau

SEQ ID NO: 518625 - RNA, 16 nt, Human
ggccuccauccugagg

SEQ ID NO: 518626 - RNA, 16 nt, Human
cuacacuccagugaga

SEQ ID NO: 518627 - RNA, 18 nt, Human
gacccacuggacucaccu

SEQ ID NO: 518628 - RNA, 20 nt, Human
aauuuugugaagcaaaauuu

SEQ ID NO: 518629 - RNA, 15 nt, Human
aaauauaaauaaaaa

SEQ ID NO: 518630 - RNA, 17 nt, Human
acaaaugcauuucuaaa

SEQ ID NO: 518631 - RNA, 21 nt, Human
auaguuguaccgcaaugugac

SEQ ID NO: 518632 - RNA, 23 nt, Human
uccaacuaucucauuuccaagca

SEQ ID NO: 518633 - RNA, 15 nt, Human
aaaagacaaggaaaa

SEQ ID NO: 518634 - RNA, 22 nt, Human
gugccucaccccuugccauaau

SEQ ID NO: 518635 - RNA, 17 nt, Human
auuuucuauaauuuaaa

SEQ ID NO: 518636 - RNA, 17 nt, Human
uaaaagacagugaaaga

SEQ ID NO: 518637 - RNA, 19 nt, Human
aauuuuguuauguauauuu

SEQ ID NO: 518638 - RNA, 17 nt, Human
caaauauaaauaaaaau

SEQ ID NO: 518639 - RNA, 19 nt, Human
cacaggaaccacaagacug

SEQ ID NO: 518640 - RNA, 14 nt, Human
aaagagaacuucca

SEQ ID NO: 518641 - RNA, 16 nt, Human
aaaauaacaauaaaag

SEQ ID NO: 518642 - RNA, 19 nt, Human
cuuccagauccuggaaauc

SEQ ID NO: 518643 - RNA, 17 nt, Human
ucauacuucuuaggguu

SEQ ID NO: 518644 - RNA, 23 nt, Human
ggaacaguuaccucugccucaga

SEQ ID NO: 518645 - RNA, 12 nt, Human
aagaaaauaacg

SEQ ID NO: 518646 - RNA, 15 nt, Human
ccagcacagccucuu

SEQ ID NO: 518647 - RNA, 14 nt, Human
acauagugaggagc

SEQ ID NO: 518648 - RNA, 17 nt, Human
ugaccacugcagaagac

SEQ ID NO: 518649 - RNA, 13 nt, Human
ucuauaauuuaaa

SEQ ID NO: 518650 - RNA, 22 nt, Human
cccaugauguuuagaaacacaa

SEQ ID NO: 518651 - RNA, 22 nt, Human
uacaugagguacugagagugaa

SEQ ID NO: 518652 - RNA, 17 nt, Human
cuggacucaccuccccc

SEQ ID NO: 518653 - RNA, 12 nt, Human
gcugaugcaguu

SEQ ID NO: 518654 - RNA, 16 nt, Human
aucaauuuaaaaaaaa

SEQ ID NO: 518655 - RNA, 13 nt, Human
acggggugaaacc

SEQ ID NO: 518656 - RNA, 19 nt, Human
cuucuggguuccuuccucu

SEQ ID NO: 518657 - RNA, 18 nt, Human
auuuguauaaaauaauuu

SEQ ID NO: 518658 - RNA, 21 nt, Human
uuuucaggcuagauguaugua

SEQ ID NO: 518659 - RNA, 16 nt, Human
caggcugagccucagu

SEQ ID NO: 518660 - RNA, 19 nt, Human
gccugaucaccugcccugc

SEQ ID NO: 518661 - RNA, 19 nt, Human
aaacaauaacgauaaaaga

SEQ ID NO: 518662 - RNA, 16 nt, Human
ucuugagguaaaagca

SEQ ID NO: 518663 - RNA, 23 nt, Human
uccagguagaggguguguaagua

SEQ ID NO: 518664 - RNA, 19 nt, Human
uauauuuuugugauuuugu

SEQ ID NO: 518665 - RNA, 21 nt, Human
acuauuuaagagaacaagcaa

SEQ ID NO: 518666 - RNA, 16 nt, Human
auuuguauaaaauaau

SEQ ID NO: 518667 - RNA, 23 nt, Human
gcccuggugccucaccccuugcc

SEQ ID NO: 518668 - RNA, 14 nt, Human
cucccucccuuggg

SEQ ID NO: 518669 - RNA, 14 nt, Human
cgucccccucuggc

SEQ ID NO: 518670 - RNA, 19 nt, Human
ucaguccaugaagauguag

SEQ ID NO: 518671 - RNA, 21 nt, Human
cuaguaucaaaagaaagaaaa

SEQ ID NO: 518672 - RNA, 18 nt, Human
cuccagccugagcgacag

SEQ ID NO: 518673 - RNA, 17 nt, Human
uuauaucaauuuaaaaa

SEQ ID NO: 518674 - RNA, 13 nt, Human
caccaaggagcca

SEQ ID NO: 518675 - RNA, 18 nt, Human
uuuuagugaaauauuauu

SEQ ID NO: 518676 - RNA, 15 nt, Human
aaauauuuauuuuaa

SEQ ID NO: 518677 - RNA, 22 nt, Human
gaacaagcaaauauaaacagca

SEQ ID NO: 518678 - RNA, 22 nt, Human
ugauaguuguaccgcaauguga

SEQ ID NO: 518679 - RNA, 22 nt, Human
caucgcaauguaagacucggga

SEQ ID NO: 518680 - RNA, 19 nt, Human
agaacaagcaaauauaaac

SEQ ID NO: 518681 - RNA, 22 nt, Human
auauauaacaaugcuguauuuu

SEQ ID NO: 518682 - RNA, 18 nt, Human
acauuuauauuuuuguga

SEQ ID NO: 518683 - RNA, 21 nt, Human
cucaguccaugaagauguaga

SEQ ID NO: 518684 - RNA, 20 nt, Human
acuagaguuuagcuggaaaa

SEQ ID NO: 518685 - RNA, 18 nt, Human
uuuuauaucaauuuaaaa

SEQ ID NO: 518686 - RNA, 19 nt, Human
ucagugucaaugcagcccc

SEQ ID NO: 518687 - RNA, 15 nt, Human
ucuuauaauuuaaaa

SEQ ID NO: 518688 - RNA, 14 nt, Human
agaugcuagaacuc

SEQ ID NO: 518689 - RNA, 20 nt, Human
uacuucuucucauacuauuu

SEQ ID NO: 518690 - RNA, 16 nt, Human
ugaaguacucauacau

SEQ ID NO: 518691 - RNA, 21 nt, Human
acgcucucuggccuucggccu

SEQ ID NO: 518692 - RNA, 13 nt, Human
ugcauuucuaaag

SEQ ID NO: 518693 - RNA, 20 nt, Human
ugauuucugagcauuuaaua

SEQ ID NO: 518694 - RNA, 21 nt, Human
aauuuucauuguucuauaaca

SEQ ID NO: 518695 - RNA, 18 nt, Human
uccuaauuccacagcugc

SEQ ID NO: 518696 - RNA, 22 nt, Human
gacucaccucccccaucucuuc

SEQ ID NO: 518697 - RNA, 15 nt, Human
auauaaauaaaaaua

SEQ ID NO: 518698 - RNA, 22 nt, Human
uguauacugugugcuaaaacaa

SEQ ID NO: 518699 - RNA, 12 nt, Human
ucuuaagaagac

SEQ ID NO: 518700 - RNA, 18 nt, Human
uuuugugaagcaaaauuu

SEQ ID NO: 518701 - RNA, 18 nt, Human
cuacuccauuaaauauaa

SEQ ID NO: 518702 - RNA, 22 nt, Human
aauaugccccauucaacaucua

SEQ ID NO: 518703 - RNA, 12 nt, Human
cuauaacaacaa

SEQ ID NO: 518704 - RNA, 20 nt, Human
aaugaauacuuuauaaagga

SEQ ID NO: 518705 - RNA, 15 nt, Human
aaggguacacugccu

SEQ ID NO: 518706 - RNA, 17 nt, Human
uuccaagccucaugucc

SEQ ID NO: 518707 - RNA, 20 nt, Human
cuaaaugucaaucagccuag

SEQ ID NO: 518708 - RNA, 19 nt, Human
agcucugcccauccugccc

SEQ ID NO: 518709 - RNA, 21 nt, Human
caccagucugacuguuuccau

SEQ ID NO: 518710 - RNA, 16 nt, Human
uauaugucacuuugcu

SEQ ID NO: 518711 - RNA, 14 nt, Human
gagagugaacaaau

SEQ ID NO: 518712 - RNA, 18 nt, Human
uacauuuguauaaaauaa

SEQ ID NO: 518713 - RNA, 14 nt, Human
aauauuauguuaaa

SEQ ID NO: 518714 - RNA, 20 nt, Human
guauuauuuuuuaaaaaaau

SEQ ID NO: 518715 - RNA, 17 nt, Human
cugaucaccugcccugc

SEQ ID NO: 518716 - RNA, 17 nt, Human
gaaaaucaggcuggcca

SEQ ID NO: 518717 - RNA, 13 nt, Human
gcucucuggccuu

SEQ ID NO: 518718 - RNA, 23 nt, Human
gucucccucccuuggggccuaug

SEQ ID NO: 518719 - RNA, 19 nt, Human
cccccucuggcuccagcug

SEQ ID NO: 518720 - RNA, 19 nt, Human
gcacacagcacgggggcca

SEQ ID NO: 518721 - RNA, 21 nt, Human
guccccuauccuacuuccccu

SEQ ID NO: 518722 - RNA, 23 nt, Human
uggaaauguuuacagauccccaa

SEQ ID NO: 518723 - RNA, 24 nt, Human
cauucuggaauaauccuaaacaua

SEQ ID NO: 518724 - RNA, 14 nt, Human
cucccuuggggccu

SEQ ID NO: 518725 - RNA, 18 nt, Human
caacuuguguuccuaaca

SEQ ID NO: 518726 - RNA, 11 nt, Human
ucaccuccccc

SEQ ID NO: 518727 - RNA, 17 nt, Human
cuaucucauuuccaagc

SEQ ID NO: 518728 - RNA, 22 nt, Human
augcagagguccacaacacaca

SEQ ID NO: 518729 - RNA, 15 nt, Human
cgggagccugaucac

SEQ ID NO: 518730 - RNA, 15 nt, Human
gccccauucaacauc

SEQ ID NO: 518731 - RNA, 20 nt, Human
guucugcagauaaacaguag

SEQ ID NO: 518732 - RNA, 18 nt, Human
uagugaaauauuauuuua

SEQ ID NO: 518733 - RNA, 17 nt, Human
uaacugauuuguaacaa

SEQ ID NO: 518734 - RNA, 21 nt, Human
gcugagucccaggcugagccu

SEQ ID NO: 518735 - RNA, 16 nt, Human
uaaaagacaaggaaaa

SEQ ID NO: 518736 - RNA, 13 nt, Human
acaagaaaugaaa

SEQ ID NO: 518737 - RNA, 17 nt, Human
augauuaaguaaugaua

SEQ ID NO: 518738 - RNA, 14 nt, Human
accauuuuuacuug

SEQ ID NO: 518739 - RNA, 15 nt, Human
ccugccccccagccc

SEQ ID NO: 518740 - RNA, 20 nt, Human
uugaacccgggaggcagagg

SEQ ID NO: 518741 - RNA, 16 nt, Human
ccugagcuugcagaga

SEQ ID NO: 518742 - RNA, 16 nt, Human
aacuugguuuuaauua

SEQ ID NO: 518743 - RNA, 20 nt, Human
uuacaaauccaaugaaauga

SEQ ID NO: 518744 - RNA, 18 nt, Human
agcaaauauaaacagcaa

SEQ ID NO: 518745 - RNA, 15 nt, Human
cuucucuucacaguc

SEQ ID NO: 518746 - RNA, 16 nt, Human
uuuauauuugaaauau

SEQ ID NO: 518747 - RNA, 14 nt, Human
aagaaucuuuauag

SEQ ID NO: 518748 - RNA, 19 nt, Human
acuucagcgguuuauauaa

SEQ ID NO: 518749 - RNA, 21 nt, Human
aacuuguaaaggaauuuaaaa

SEQ ID NO: 518750 - RNA, 17 nt, Human
acaaaugggaaacaaaa

SEQ ID NO: 518751 - RNA, 16 nt, Human
cauuucuaaagccauu

SEQ ID NO: 518752 - RNA, 17 nt, Human
ucuauaauuuaaauaua

SEQ ID NO: 518753 - RNA, 13 nt, Human
cccugcacuccag

SEQ ID NO: 518754 - RNA, 19 nt, Human
acuaucucauuuccaagca

SEQ ID NO: 518755 - RNA, 13 nt, Human
gaaccuaggguga

SEQ ID NO: 518756 - RNA, 14 nt, Human
cuccagugagacag

SEQ ID NO: 518757 - RNA, 22 nt, Human
cucugagccuugggaccccuga

SEQ ID NO: 518758 - RNA, 14 nt, Human
caguucugaagaag

SEQ ID NO: 518759 - RNA, 17 nt, Human
uuauauuugaaauauug

SEQ ID NO: 518760 - RNA, 18 nt, Human
caugaagauguagaggag

SEQ ID NO: 518761 - RNA, 20 nt, Human
uaacgauaaaagacagugaa

SEQ ID NO: 518762 - RNA, 13 nt, Human
aaaauaacaauga

SEQ ID NO: 518763 - RNA, 15 nt, Human
gccuaagugcagccc

SEQ ID NO: 518764 - RNA, 15 nt, Human
uuuaauaauuuuuaa

SEQ ID NO: 518765 - RNA, 16 nt, Human
agccucagucucccuc

SEQ ID NO: 518766 - RNA, 16 nt, Human
ucuuauaauuuaaaau

SEQ ID NO: 518767 - RNA, 20 nt, Human
ucuucuggguuccuuccucu

SEQ ID NO: 518768 - RNA, 19 nt, Human
caucaaggguacacugccu

SEQ ID NO: 518769 - RNA, 20 nt, Human
agcuucacuguaaaauaaua

SEQ ID NO: 518770 - RNA, 16 nt, Human
acuaguuucccuugca

SEQ ID NO: 518771 - RNA, 13 nt, Human
ccucccccaucuc

SEQ ID NO: 518772 - RNA, 10 nt, Human
caacucccug

SEQ ID NO: 518773 - RNA, 20 nt, Human
aaauaauuuuuauauuugaa

SEQ ID NO: 518774 - RNA, 14 nt, Human
ggcuccagcuggcc

SEQ ID NO: 518775 - RNA, 23 nt, Human
uagacacacaugaaguccaagca

SEQ ID NO: 518776 - RNA, 15 nt, Human
aauaacgauaaaaga

SEQ ID NO: 518777 - RNA, 19 nt, Human
gugaacuugguuuuaauua

SEQ ID NO: 518778 - RNA, 20 nt, Human
caaauguucaucaaugaaug

SEQ ID NO: 518779 - RNA, 21 nt, Human
auuuuccugaaaacccuugcc

SEQ ID NO: 518780 - RNA, 21 nt, Human
cacaugaacuuguaaaggaau

SEQ ID NO: 518781 - RNA, 17 nt, Human
cuuccucugagccuugg

SEQ ID NO: 518782 - RNA, 18 nt, Human
gaaaugaaagcagggacu

SEQ ID NO: 518783 - RNA, 13 nt, Human
uuuuaaaaaagaa

SEQ ID NO: 518784 - RNA, 22 nt, Human
accuaacgaaguauccuucagc

SEQ ID NO: 518785 - RNA, 15 nt, Human
ccgucccccucuggc

SEQ ID NO: 518786 - RNA, 18 nt, Human
ccucuggcuccagcuggc

SEQ ID NO: 518787 - RNA, 16 nt, Human
ccugcaaagcccagcu

SEQ ID NO: 518788 - RNA, 12 nt, Human
gguuuauauaag

SEQ ID NO: 518789 - RNA, 14 nt, Human
cucagucucccucc

SEQ ID NO: 518790 - RNA, 17 nt, Human
uaaaugaaauugaaaau

SEQ ID NO: 518791 - RNA, 15 nt, Human
cuugaaaacuuuaug

SEQ ID NO: 518792 - RNA, 18 nt, Human
uaucaaaagaaagaaaau

SEQ ID NO: 518793 - RNA, 16 nt, Human
ccugccccccagcccu

SEQ ID NO: 518794 - RNA, 15 nt, Human
ugccccccagcccuc

SEQ ID NO: 518795 - RNA, 22 nt, Human
caugaguaacugauuuguaaca

SEQ ID NO: 518796 - RNA, 20 nt, Human
ggguuccuuccucugagccu

SEQ ID NO: 518797 - RNA, 20 nt, Human
gaauucauucacucaacaaa

SEQ ID NO: 518798 - RNA, 16 nt, Human
augccccgucccccuc

SEQ ID NO: 518799 - RNA, 14 nt, Human
agcucguggaacag

SEQ ID NO: 518800 - RNA, 14 nt, Human
caaggaaaaaauaa

SEQ ID NO: 518801 - RNA, 16 nt, Human
auaucaauuuaaaaaa

SEQ ID NO: 518802 - RNA, 14 nt, Human
aauuguauuacaaa

SEQ ID NO: 518803 - RNA, 11 nt, Human
cuguuuuauaa

SEQ ID NO: 518804 - RNA, 19 nt, Human
uguuggacgagaaaacaau

SEQ ID NO: 518805 - RNA, 14 nt, Human
cacaagaaaugaaa

SEQ ID NO: 518806 - RNA, 13 nt, Human
ccugagcuugcag

SEQ ID NO: 518807 - RNA, 19 nt, Human
aaaagacagugaaagaaaa

SEQ ID NO: 518808 - RNA, 13 nt, Human
aacaauaaaagac

SEQ ID NO: 518809 - RNA, 16 nt, Human
cacgggggccaaggau

SEQ ID NO: 518810 - RNA, 17 nt, Human
ugaaauaagccagacau

SEQ ID NO: 518811 - RNA, 15 nt, Human
aaacauaugaauuau

SEQ ID NO: 518812 - RNA, 19 nt, Human
gaggcagagguugcaguga

SEQ ID NO: 518813 - RNA, 15 nt, Human
aaggaauuuaaaaau

SEQ ID NO: 518814 - RNA, 23 nt, Human
cccacuggacucaccucccccau

SEQ ID NO: 518815 - RNA, 23 nt, Human
caccucauggaauuggagcucgu

SEQ ID NO: 518816 - RNA, 23 nt, Human
auaauguguucauucuggaauaa

SEQ ID NO: 518817 - RNA, 15 nt, Human
ccacaggaaccacaa

SEQ ID NO: 518818 - RNA, 21 nt, Human
aaguuuaugguuguauuauuu

SEQ ID NO: 518819 - RNA, 18 nt, Human
acauuugcucauggaauu

SEQ ID NO: 518820 - RNA, 15 nt, Human
gagaugcuagaacuc

SEQ ID NO: 518821 - RNA, 16 nt, Human
ccacuuauaggaauug

SEQ ID NO: 518822 - RNA, 22 nt, Human
cagcacgggggccaaggaugcc

SEQ ID NO: 518823 - RNA, 23 nt, Human
aacuuguaaaggaauuuaaaaau

SEQ ID NO: 518824 - RNA, 22 nt, Human
caaaugggaaacaaaaggauaa

SEQ ID NO: 518825 - RNA, 18 nt, Human
gacauuugcucauggaau

SEQ ID NO: 518826 - RNA, 17 nt, Human
uguaaaggaauuuaaaa

SEQ ID NO: 518827 - RNA, 15 nt, Human
uacaggauuugaaau

SEQ ID NO: 518828 - RNA, 16 nt, Human
augcuguauuuuaaaa

SEQ ID NO: 518829 - RNA, 18 nt, Human
cagucucccucccuuggg

SEQ ID NO: 518830 - RNA, 13 nt, Human
aacaacaacaaca

SEQ ID NO: 518831 - RNA, 14 nt, Human
cuacaagacacagu

SEQ ID NO: 518832 - RNA, 22 nt, Human
agugagcagucaggaaagagaa

SEQ ID NO: 518833 - RNA, 18 nt, Human
uguacuuuauuuucuaua

SEQ ID NO: 518834 - RNA, 18 nt, Human
auaaaguguuugaaagcu

SEQ ID NO: 518835 - RNA, 13 nt, Human
cuucucaacucca

SEQ ID NO: 518836 - RNA, 18 nt, Human
ccugccuaagugcagccc

SEQ ID NO: 518837 - RNA, 19 nt, Human
auccuacaagacacaguga

SEQ ID NO: 518838 - RNA, 18 nt, Human
ugagcucagcccuggugg

SEQ ID NO: 518839 - RNA, 15 nt, Human
uucaaaguuaagaau

SEQ ID NO: 518840 - RNA, 19 nt, Human
gcacuaguauuucuaugaa

SEQ ID NO: 518841 - RNA, 12 nt, Human
aaaauaacaaua

SEQ ID NO: 518842 - RNA, 18 nt, Human
uauuuucuauaauuuaaa

SEQ ID NO: 518843 - RNA, 21 nt, Human
ccuuuuuuugaaaaaaagcuu

SEQ ID NO: 518844 - RNA, 16 nt, Human
cauagaaguaaaaaca

SEQ ID NO: 518845 - RNA, 19 nt, Human
auguuuacagauccccaag

SEQ ID NO: 518846 - RNA, 18 nt, Human
cauagguuuaauaauuuu

SEQ ID NO: 518847 - RNA, 19 nt, Human
agcaucucauuuauaaugu

SEQ ID NO: 518848 - RNA, 13 nt, Human
agagguccacaac

SEQ ID NO: 518849 - RNA, 18 nt, Human
ugggcacaggguuuaugu

SEQ ID NO: 518850 - RNA, 16 nt, Human
cccuauccuacuuccc

SEQ ID NO: 518851 - RNA, 13 nt, Human
ccaaggaugcccc

SEQ ID NO: 518852 - RNA, 18 nt, Human
gaaaauaucacuugucaa

SEQ ID NO: 518853 - RNA, 22 nt, Human
acuccauuaaauauaaagcaag

SEQ ID NO: 518854 - RNA, 19 nt, Human
cucauggaauuggagcucg

SEQ ID NO: 518855 - RNA, 13 nt, Human
caagcaaauauaa

SEQ ID NO: 518856 - RNA, 14 nt, Human
auuguccaggucua

SEQ ID NO: 518857 - RNA, 18 nt, Human
gccccugcacuccagccu

SEQ ID NO: 518858 - RNA, 13 nt, Human
ucuacuaaaaaua

SEQ ID NO: 518859 - RNA, 13 nt, Human
uacagagacagaa

SEQ ID NO: 518860 - RNA, 21 nt, Human
cagagguccacaacacacaga

SEQ ID NO: 518861 - RNA, 18 nt, Human
cagggaggacgcucucug

SEQ ID NO: 518862 - RNA, 14 nt, Human
uauaaauaaaaaua

SEQ ID NO: 518863 - RNA, 19 nt, Human
guuauuauauuuacaaaug

SEQ ID NO: 518864 - RNA, 20 nt, Human
ccauacuaauuauacccccu

SEQ ID NO: 518865 - RNA, 16 nt, Human
ucuucaacucccugcc

SEQ ID NO: 518866 - RNA, 17 nt, Human
gacgagaaaacaauaac

SEQ ID NO: 518867 - RNA, 20 nt, Human
augucgucaaagcugaaaug

SEQ ID NO: 518868 - RNA, 14 nt, Human
gcugauuaaaccaa

SEQ ID NO: 518869 - RNA, 18 nt, Human
acaaauccaaugaaauga

SEQ ID NO: 518870 - RNA, 22 nt, Human
uuugaaacgaggauugggaaaa

SEQ ID NO: 518871 - RNA, 18 nt, Human
auuuauuacuguaagaaa

SEQ ID NO: 518872 - RNA, 15 nt, Human
gugaacuugguuuua

SEQ ID NO: 518873 - RNA, 16 nt, Human
uaaauaaaaauaaucc

SEQ ID NO: 518874 - RNA, 18 nt, Human
agccugaucaccugcccu

SEQ ID NO: 518875 - RNA, 15 nt, Human
uagauaggccauggg

SEQ ID NO: 518876 - RNA, 15 nt, Human
uggacucaccucccc

SEQ ID NO: 518877 - RNA, 21 nt, Human
ccaagaagauaaucuccaaag

SEQ ID NO: 518878 - RNA, 12 nt, Human
cucccugccccc

SEQ ID NO: 518879 - RNA, 12 nt, Human
aguguuugaaag

SEQ ID NO: 518880 - RNA, 12 nt, Human
ucugcacacagc

SEQ ID NO: 518881 - RNA, 21 nt, Human
ugccuguaaucacagcuacuu

SEQ ID NO: 518882 - RNA, 16 nt, Human
caugggacagggagga

SEQ ID NO: 518883 - RNA, 23 nt, Human
caugcugucuacacuaagagaga

SEQ ID NO: 518884 - RNA, 20 nt, Human
uaaaagacaaggaaaaaaua

SEQ ID NO: 518885 - RNA, 21 nt, Human
cccuauccuacuuccccuucc

SEQ ID NO: 518886 - RNA, 20 nt, Human
uccagccugagcgacaguga

SEQ ID NO: 518887 - RNA, 14 nt, Human
acgagaaaacaaua

SEQ ID NO: 518888 - RNA, 15 nt, Human
ugauuucauucaaua

SEQ ID NO: 518889 - RNA, 15 nt, Human
acaggguuuauguuu

SEQ ID NO: 518890 - RNA, 19 nt, Human
cucugccucagaaaacaag

SEQ ID NO: 518891 - RNA, 13 nt, Human
aguguuugaaagc

SEQ ID NO: 518892 - RNA, 12 nt, Human
acaugagguacu

SEQ ID NO: 518893 - RNA, 19 nt, Human
ccaccugccuauauuuuuu

SEQ ID NO: 518894 - RNA, 21 nt, Human
ugcccauccugccccugagcc

SEQ ID NO: 518895 - RNA, 20 nt, Human
uaugaaaaggcuaagcuuca

SEQ ID NO: 518896 - RNA, 12 nt, Human
acaagacacagu

SEQ ID NO: 518897 - RNA, 20 nt, Human
cuacuuccccuuccuaauuc

SEQ ID NO: 518898 - RNA, 22 nt, Human
accccugagcuugcagagauga

SEQ ID NO: 518899 - RNA, 19 nt, Human
acagucaccucauggaauu

SEQ ID NO: 518900 - RNA, 20 nt, Human
uuucuucaacucccugcccc

SEQ ID NO: 518901 - RNA, 21 nt, Human
gaaagcagggacuugaaccca

SEQ ID NO: 518902 - RNA, 16 nt, Human
uguucuaagaagugaa

SEQ ID NO: 518903 - RNA, 15 nt, Human
aaaauacaaaaaaaa

SEQ ID NO: 518904 - RNA, 22 nt, Human
cugggacaggggagaaccuagg

SEQ ID NO: 518905 - RNA, 19 nt, Human
ucaguuauuauauuuacaa

SEQ ID NO: 518906 - RNA, 23 nt, Human
ugaaaugaguuuuucuuuucauu

SEQ ID NO: 518907 - RNA, 20 nt, Human
acuccagugagacagcucug

SEQ ID NO: 518908 - RNA, 23 nt, Human
ugcagagguccacaacacacaga

SEQ ID NO: 518909 - RNA, 20 nt, Human
aauucuugccaaauauaaau

SEQ ID NO: 518910 - RNA, 11 nt, Human
auuuuugaagc

SEQ ID NO: 518911 - RNA, 17 nt, Human
aaauguucaucaaugaa

SEQ ID NO: 518912 - RNA, 21 nt, Human
uuauguuuaauucugaaagca

SEQ ID NO: 518913 - RNA, 19 nt, Human
uacaaaaaaaaaaaaaaau

SEQ ID NO: 518914 - RNA, 18 nt, Human
cccacuggacucaccucc

SEQ ID NO: 518915 - RNA, 19 nt, Human
auagcuacuaauuuuaaaa

SEQ ID NO: 518916 - RNA, 13 nt, Human
cccuccuuaucaa

SEQ ID NO: 518917 - RNA, 15 nt, Human
ggccuccauccugag

SEQ ID NO: 518918 - RNA, 18 nt, Human
acaaaaggauaaugaaua

SEQ ID NO: 518919 - RNA, 14 nt, Human
uaaauaaaaauaau

SEQ ID NO: 518920 - RNA, 18 nt, Human
guuaguauuguccagguc

SEQ ID NO: 518921 - RNA, 17 nt, Human
ggagcucguggaacagu

SEQ ID NO: 518922 - RNA, 12 nt, Human
aauaaaguacaa

SEQ ID NO: 518923 - RNA, 23 nt, Human
auguuaaaacugggacaggggag

SEQ ID NO: 518924 - RNA, 21 nt, Human
ucaagucuuucacauuuaaau

SEQ ID NO: 518925 - RNA, 18 nt, Human
uaaaagacagugaaagaa

SEQ ID NO: 518926 - RNA, 20 nt, Human
ccugccuaagugcagccccg

SEQ ID NO: 518927 - RNA, 14 nt, Human
uucuaugaaauauu

SEQ ID NO: 518928 - RNA, 17 nt, Human
aaagcagggacuugaac

SEQ ID NO: 518929 - RNA, 22 nt, Human
cuucagccugaaagaggaauga

SEQ ID NO: 518930 - RNA, 21 nt, Human
cuuguuggacgagaaaacaau

SEQ ID NO: 518931 - RNA, 22 nt, Human
gugugaccacugcagaagacag

SEQ ID NO: 518932 - RNA, 21 nt, Human
acaugagguacugagagugaa

SEQ ID NO: 518933 - RNA, 15 nt, Human
auuucauucaauauc

SEQ ID NO: 518934 - RNA, 23 nt, Human
uaggauggcuaguaucaaaagaa

SEQ ID NO: 518935 - RNA, 16 nt, Human
uucucuaggaaauauu

SEQ ID NO: 518936 - RNA, 18 nt, Human
uuuguuaaaugauuucau

SEQ ID NO: 518937 - RNA, 14 nt, Human
cuuggucugugaga

SEQ ID NO: 518938 - RNA, 19 nt, Human
uucauuguucuauaacaac

SEQ ID NO: 518939 - RNA, 15 nt, Human
ucccccaucucuucu

SEQ ID NO: 518940 - RNA, 23 nt, Human
gaaugagagacacacugaagaag

SEQ ID NO: 518941 - RNA, 19 nt, Human
cggccuccauccugaggcu

SEQ ID NO: 518942 - RNA, 14 nt, Human
ccaugggacaggga

SEQ ID NO: 518943 - RNA, 13 nt, Human
acagcccuucuuu

SEQ ID NO: 518944 - RNA, 22 nt, Human
aaccuacacgagauacagaauu

SEQ ID NO: 518945 - RNA, 14 nt, Human
ugcuucuguuuuau

SEQ ID NO: 518946 - RNA, 18 nt, Human
ugaacuugguuuuaauua

SEQ ID NO: 518947 - RNA, 23 nt, Human
uggcuugaguuuaaauuguaaua

SEQ ID NO: 518948 - RNA, 17 nt, Human
acacuaagagagaauga

SEQ ID NO: 518949 - RNA, 14 nt, Human
ugcuaagucuuaua

SEQ ID NO: 518950 - RNA, 20 nt, Human
aauuaaguuuuuuuuuaaaa

SEQ ID NO: 518951 - RNA, 16 nt, Human
uggucugugagaugcu

SEQ ID NO: 518952 - RNA, 23 nt, Human
agcucugcccauccugccccuga

SEQ ID NO: 518953 - RNA, 21 nt, Human
auuuacaaaugggaaacaaaa

SEQ ID NO: 518954 - RNA, 16 nt, Human
agugaaggauuuaugu

SEQ ID NO: 518955 - RNA, 19 nt, Human
ccugccuaagugcagcccc

SEQ ID NO: 518956 - RNA, 19 nt, Human
aaauaugccccauucaaca

SEQ ID NO: 518957 - RNA, 19 nt, Human
uacuauccaacuuauauuu

SEQ ID NO: 518958 - RNA, 16 nt, Human
aauugacccacaagaa

SEQ ID NO: 518959 - RNA, 15 nt, Human
ucuaugaaauauuau

SEQ ID NO: 518960 - RNA, 13 nt, Human
aagacagugaaag

SEQ ID NO: 518961 - RNA, 18 nt, Human
aggaaaaaauaacaauga

SEQ ID NO: 518962 - RNA, 17 nt, Human
gaaugagagacacacug

SEQ ID NO: 518963 - RNA, 13 nt, Human
gcuggagcucugc

SEQ ID NO: 518964 - RNA, 11 nt, Human
cauaugaaaag

SEQ ID NO: 518965 - RNA, 12 nt, Human
acacugaagaag

SEQ ID NO: 518966 - RNA, 15 nt, Human
gucccaggcugagcc

SEQ ID NO: 518967 - RNA, 15 nt, Human
accucccccaucucu

SEQ ID NO: 518968 - RNA, 22 nt, Human
agacucugucucaguccaugaa

SEQ ID NO: 518969 - RNA, 14 nt, Human
ggcaauagucaaau

SEQ ID NO: 518970 - RNA, 13 nt, Human
uuggacgagaaaa

SEQ ID NO: 518971 - RNA, 22 nt, Human
gagccucagucucccucccuug

SEQ ID NO: 518972 - RNA, 12 nt, Human
gcucagcccugg

SEQ ID NO: 518973 - RNA, 18 nt, Human
gagccucagucucccucc

SEQ ID NO: 518974 - RNA, 14 nt, Human
uuauuauauuuaca

SEQ ID NO: 518975 - RNA, 12 nt, Human
gccccugagccc

SEQ ID NO: 518976 - RNA, 22 nt, Human
uauuuaagagaacaagcaaaua

SEQ ID NO: 518977 - RNA, 13 nt, Human
auaaauaaaaaua

SEQ ID NO: 518978 - RNA, 15 nt, Human
uacaaaugcauuucu

SEQ ID NO: 518979 - RNA, 22 nt, Human
gaauuucuucaacucccugccc

SEQ ID NO: 518980 - RNA, 17 nt, Human
cgauaaaagacagugaa

SEQ ID NO: 518981 - RNA, 16 nt, Human
cugaucaccugcccug

SEQ ID NO: 518982 - RNA, 21 nt, Human
auuauauggcuugaguuuaaa

SEQ ID NO: 518983 - RNA, 23 nt, Human
cacagauuugagcucagcccugg

SEQ ID NO: 518984 - RNA, 13 nt, Human
uuuagugaaauau

SEQ ID NO: 518985 - RNA, 16 nt, Human
ugagaugcuagaacuc

SEQ ID NO: 518986 - RNA, 14 nt, Human
uccagauccuggaa

SEQ ID NO: 518987 - RNA, 22 nt, Human
aaagacagugaaagaaaauaac

SEQ ID NO: 518988 - RNA, 18 nt, Human
uggagggaagccuugggg

SEQ ID NO: 518989 - RNA, 14 nt, Human
aacaacaacaacaa

SEQ ID NO: 518990 - RNA, 21 nt, Human
cuggccuucggccuccauccu

SEQ ID NO: 518991 - RNA, 22 nt, Human
uucauucacucaacaaacauaa

SEQ ID NO: 518992 - RNA, 19 nt, Human
agacucgggauuaguacac

SEQ ID NO: 518993 - RNA, 20 nt, Human
uuaacacaugauccugcaau

SEQ ID NO: 518994 - RNA, 16 nt, Human
aauaaaguguuugaaa

SEQ ID NO: 518995 - RNA, 21 nt, Human
auguuuacagauccccaagcc

SEQ ID NO: 518996 - RNA, 16 nt, Human
uaaaugaaauugaaaa

SEQ ID NO: 518997 - RNA, 17 nt, Human
aauaacaauaaaagaca

SEQ ID NO: 518998 - RNA, 22 nt, Human
guacacugccuucucaacucca

SEQ ID NO: 518999 - RNA, 20 nt, Human
auauuuuauaucaauuuaaa

SEQ ID NO: 519000 - RNA, 21 nt, Human
ugaccauacuaauuauacccc

SEQ ID NO: 519001 - RNA, 11 nt, Human
caacucccugc

SEQ ID NO: 519002 - RNA, 17 nt, Human
cugcacuccagccugag

SEQ ID NO: 519003 - RNA, 20 nt, Human
gcagagaugaggccgccaug

SEQ ID NO: 519004 - RNA, 19 nt, Human
ugcacacagcacgggggcc

SEQ ID NO: 519005 - RNA, 17 nt, Human
aggccaugggacaggga

SEQ ID NO: 519006 - RNA, 16 nt, Human
acauuugcucauggaa

SEQ ID NO: 519007 - RNA, 17 nt, Human
aaauccuacuuucauaa

SEQ ID NO: 519008 - RNA, 15 nt, Human
agagacagaaagcag

SEQ ID NO: 519009 - RNA, 11 nt, Human
aauuuaaauau

SEQ ID NO: 519010 - RNA, 21 nt, Human
aucuuuuuuuuaauaaaccau

SEQ ID NO: 519011 - RNA, 23 nt, Human
aauaauccucaguuuuugugaaa

SEQ ID NO: 519012 - RNA, 15 nt, Human
cccugcaaagcccag

SEQ ID NO: 519013 - RNA, 19 nt, Human
acgaugggcuuucccaaca

SEQ ID NO: 519014 - RNA, 18 nt, Human
gagucccaggcugagccu

SEQ ID NO: 519015 - RNA, 17 nt, Human
agcgacagugagacucu

SEQ ID NO: 519016 - RNA, 21 nt, Human
auggcagcuuuccucaaaacu

SEQ ID NO: 519017 - RNA, 22 nt, Human
uuuauagcuacuaauuuuaaaa

SEQ ID NO: 519018 - RNA, 11 nt, Human
gccaugggaca

SEQ ID NO: 519019 - RNA, 17 nt, Human
uucugagcauuuaauau

SEQ ID NO: 519020 - RNA, 18 nt, Human
cuucucacauuuauauuu

SEQ ID NO: 519021 - RNA, 18 nt, Human
uuacaaaugggaaacaaa

SEQ ID NO: 519022 - RNA, 21 nt, Human
aauauaaagcaagauaauaaa

SEQ ID NO: 519023 - RNA, 14 nt, Human
cuucucuucacagu

SEQ ID NO: 519024 - RNA, 15 nt, Human
uguuaaaugauuuca

SEQ ID NO: 519025 - RNA, 19 nt, Human
caugaguaacugauuugua

SEQ ID NO: 519026 - RNA, 23 nt, Human
gggaaacaaaaggauaaugaaua

SEQ ID NO: 519027 - RNA, 16 nt, Human
cugagcuugcagagau

SEQ ID NO: 519028 - RNA, 14 nt, Human
agaauucauucacu

SEQ ID NO: 519029 - RNA, 16 nt, Human
gaagauguagaggaga

SEQ ID NO: 519030 - RNA, 20 nt, Human
agaagaacugaaaucauacu

SEQ ID NO: 519031 - RNA, 21 nt, Human
gucucagugucaaugcagccc

SEQ ID NO: 519032 - RNA, 22 nt, Human
cugcucaauaaaguacaagagc

SEQ ID NO: 519033 - RNA, 14 nt, Human
uugggaaaaaguaa

SEQ ID NO: 519034 - RNA, 19 nt, Human
cucacauuuauauuuuugu

SEQ ID NO: 519035 - RNA, 20 nt, Human
uaauaaguugcauagguuua

SEQ ID NO: 519036 - RNA, 12 nt, Human
cauagaaguaaa

SEQ ID NO: 519037 - RNA, 20 nt, Human
uaagaaucuuuauaguucua

SEQ ID NO: 519038 - RNA, 21 nt, Human
ugaaacgaggauugggaaaaa

SEQ ID NO: 519039 - RNA, 23 nt, Human
cgauuauuauuuuagagcaucuc

SEQ ID NO: 519040 - RNA, 15 nt, Human
uaacgauaaaagaca

SEQ ID NO: 519041 - RNA, 14 nt, Human
guaacuaauuuuaa

SEQ ID NO: 519042 - RNA, 19 nt, Human
agccugaucaccugcccug

SEQ ID NO: 519043 - RNA, 19 nt, Human
auugaggacacugauaugg

SEQ ID NO: 519044 - RNA, 22 nt, Human
aucucuucuggguuccuuccuc

SEQ ID NO: 519045 - RNA, 16 nt, Human
gccaugugcuaguaau

SEQ ID NO: 519046 - RNA, 15 nt, Human
ccugcaaagcccagc

SEQ ID NO: 519047 - RNA, 15 nt, Human
aaugaauggcuaagc

SEQ ID NO: 519048 - RNA, 20 nt, Human
acuucuuaggguuaugauua

SEQ ID NO: 519049 - RNA, 21 nt, Human
auccccaagccuggcaaggga

SEQ ID NO: 519050 - RNA, 19 nt, Human
uaucacuugucaauaaaau

SEQ ID NO: 519051 - RNA, 12 nt, Human
aaggaugccccg

SEQ ID NO: 519052 - RNA, 18 nt, Human
auucuugccaaauauaaa

SEQ ID NO: 519053 - RNA, 22 nt, Human
ugagacucugucucaguccaug

SEQ ID NO: 519054 - RNA, 21 nt, Human
uuauuuucuauaauuuaaaua

SEQ ID NO: 519055 - RNA, 20 nt, Human
augcaguuguugcccacagc

SEQ ID NO: 519056 - RNA, 22 nt, Human
caaauuuacagagacagaaagc

SEQ ID NO: 519057 - RNA, 16 nt, Human
uauuuuugugauuuug

SEQ ID NO: 519058 - RNA, 19 nt, Human
agaugcuagaacucccuuu

SEQ ID NO: 519059 - RNA, 22 nt, Human
gaagugaaaaucuacacuccag

SEQ ID NO: 519060 - RNA, 16 nt, Human
ucugcagauaaacagu

SEQ ID NO: 519061 - RNA, 14 nt, Human
agcucuaucaccaa

SEQ ID NO: 519062 - RNA, 20 nt, Human
ugauuauaugucacuuugcu

SEQ ID NO: 519063 - RNA, 23 nt, Human
cccagcccuccuuaucaaaggac

SEQ ID NO: 519064 - RNA, 17 nt, Human
uccauccugaggcucca

SEQ ID NO: 519065 - RNA, 15 nt, Human
gauccugcaauucca

SEQ ID NO: 519066 - RNA, 14 nt, Human
accacaagacugca

SEQ ID NO: 519067 - RNA, 16 nt, Human
ucucuaggaaauauuu

SEQ ID NO: 519068 - RNA, 15 nt, Human
cuaagugcagccccg

SEQ ID NO: 519069 - RNA, 14 nt, Human
aagagugaaggauu

SEQ ID NO: 519070 - RNA, 18 nt, Human
uuauuacuguaagaaaau

SEQ ID NO: 519071 - RNA, 16 nt, Human
ugcauagguuuaauaa

SEQ ID NO: 519072 - RNA, 13 nt, Human
aaaguguuugaaa

SEQ ID NO: 519073 - RNA, 20 nt, Human
uugauaaguacaugauaagc

SEQ ID NO: 519074 - RNA, 18 nt, Human
cagugaaagaaaauaaca

SEQ ID NO: 519075 - RNA, 13 nt, Human
ugggaggcugaga

SEQ ID NO: 519076 - RNA, 21 nt, Human
gacagugaaagaaaauaacaa

SEQ ID NO: 519077 - RNA, 12 nt, Human
cuuccucugagc

SEQ ID NO: 519078 - RNA, 20 nt, Human
ucaaaacuucagacauagaa

SEQ ID NO: 519079 - RNA, 19 nt, Human
uuggcaagcucuaucacca

SEQ ID NO: 519080 - RNA, 19 nt, Human
cuaagcuucacuguaaaau

SEQ ID NO: 519081 - RNA, 17 nt, Human
caaacauauauaacaau

SEQ ID NO: 519082 - RNA, 13 nt, Human
auuuuuuaaaaaa

SEQ ID NO: 519083 - RNA, 14 nt, Human
acuaauuuuaaaau

SEQ ID NO: 519084 - RNA, 18 nt, Human
cuuuccacagaagcucca

SEQ ID NO: 519085 - RNA, 23 nt, Human
augaauuaaguuuuuuuuuaaaa

SEQ ID NO: 519086 - RNA, 13 nt, Human
aacucccugcccc

SEQ ID NO: 519087 - RNA, 21 nt, Human
aaaaaguucugcagauaaaca

SEQ ID NO: 519088 - RNA, 21 nt, Human
ccccugcaaagcccagcuuga

SEQ ID NO: 519089 - RNA, 19 nt, Human
agugaggagcuuugaaacg

SEQ ID NO: 519090 - RNA, 15 nt, Human
uguauuuuaaaagaa

SEQ ID NO: 519091 - RNA, 13 nt, Human
aaaaaugguuuaa

SEQ ID NO: 519092 - RNA, 14 nt, Human
uauuuauuuuaaua

SEQ ID NO: 519093 - RNA, 14 nt, Human
ccuuaucaaaggac

SEQ ID NO: 519094 - RNA, 22 nt, Human
agaaaacaauaacgauaaaaga

SEQ ID NO: 519095 - RNA, 21 nt, Human
guauacugugugcuaaaacaa

SEQ ID NO: 519096 - RNA, 20 nt, Human
caaauauaaauaaaaauaau

SEQ ID NO: 519097 - RNA, 17 nt, Human
gcaugguuuagaaagcu

SEQ ID NO: 519098 - RNA, 14 nt, Human
cuguaaucacagcu

SEQ ID NO: 519099 - RNA, 22 nt, Human
acaagcaaauauaaacagcaac

SEQ ID NO: 519100 - RNA, 24 nt, Human
ccccugagcuugcagagaugaggc

SEQ ID NO: 519101 - RNA, 22 nt, Human
agucuuucacauuuaaauaaag

SEQ ID NO: 519102 - RNA, 16 nt, Human
ccucaaaacuucagac

SEQ ID NO: 519103 - RNA, 21 nt, Human
agcaaauauaaacagcaacuu

SEQ ID NO: 519104 - RNA, 23 nt, Human
ucuccauguacuggcaagaccug

SEQ ID NO: 519105 - RNA, 14 nt, Human
gauaaaagacagug

SEQ ID NO: 519106 - RNA, 19 nt, Human
cagaaagcagaacagugau

SEQ ID NO: 519107 - RNA, 17 nt, Human
cagacaucaacagauaa

SEQ ID NO: 519108 - RNA, 14 nt, Human
uaaaggaauuuaaa

SEQ ID NO: 519109 - RNA, 18 nt, Human
uaauuuuaacucuauaau

SEQ ID NO: 519110 - RNA, 21 nt, Human
agucucccucccuuggggccu

SEQ ID NO: 519111 - RNA, 19 nt, Human
auagugaggagcuuugaaa

SEQ ID NO: 519112 - RNA, 20 nt, Human
ccaaauguucaucaaugaau

SEQ ID NO: 519113 - RNA, 18 nt, Human
ccugaaagaggaaugaag

SEQ ID NO: 519114 - RNA, 17 nt, Human
cagugaaagaaaauaac

SEQ ID NO: 519115 - RNA, 15 nt, Human
uuacagagacagaaa

SEQ ID NO: 519116 - RNA, 19 nt, Human
gagccugaucaccugcccu

SEQ ID NO: 519117 - RNA, 13 nt, Human
agcgacagugaga

SEQ ID NO: 519118 - RNA, 18 nt, Human
acugugugcuaaaacaag

SEQ ID NO: 519119 - RNA, 15 nt, Human
agccucagucucccu

SEQ ID NO: 519120 - RNA, 13 nt, Human
ccacaacacacag

SEQ ID NO: 519121 - RNA, 13 nt, Human
uuuaaaaaagaaa

SEQ ID NO: 519122 - RNA, 22 nt, Human
aggcuccacuuggucugugaga

SEQ ID NO: 519123 - RNA, 16 nt, Human
uaaaauccauacauuu

SEQ ID NO: 519124 - RNA, 17 nt, Human
uuaauaauuuuuaauua

SEQ ID NO: 519125 - RNA, 15 nt, Human
ccagauccuggaaau

SEQ ID NO: 519126 - RNA, 18 nt, Human
auuauuuuuuaaaaaaau

SEQ ID NO: 519127 - RNA, 15 nt, Human
cagaauucauucacu

SEQ ID NO: 519128 - RNA, 22 nt, Human
cuuuccacagaagcuccaggua

SEQ ID NO: 519129 - RNA, 23 nt, Human
cagagguugcagugagccgagau

SEQ ID NO: 519130 - RNA, 22 nt, Human
aggauggcuaguaucaaaagaa

SEQ ID NO: 519131 - RNA, 16 nt, Human
uugucaauaaaaucca

SEQ ID NO: 519132 - RNA, 22 nt, Human
cccccugcaaagcccagcuuga

SEQ ID NO: 519133 - RNA, 15 nt, Human
cugcagauaaacagu

SEQ ID NO: 519134 - RNA, 19 nt, Human
aaguugcauagguuuaaua

SEQ ID NO: 519135 - RNA, 16 nt, Human
acauccuacaagacac

SEQ ID NO: 519136 - RNA, 17 nt, Human
ugaacuugguuuuaauu

SEQ ID NO: 519137 - RNA, 22 nt, Human
acaccuuguacuuuauuuucua

SEQ ID NO: 519138 - RNA, 22 nt, Human
ggacaguaaaauccacagacca

SEQ ID NO: 519139 - RNA, 20 nt, Human
cucccugccccccagcccuc

SEQ ID NO: 519140 - RNA, 19 nt, Human
caauucuugccaaauauaa

SEQ ID NO: 519141 - RNA, 14 nt, Human
ucuaggaaauauuu

SEQ ID NO: 519142 - RNA, 12 nt, Human
ccuucagccuga

SEQ ID NO: 519143 - RNA, 18 nt, Human
gcuccauuuuuagugaaa

SEQ ID NO: 519144 - RNA, 20 nt, Human
ucaagucuuucacauuuaaa

SEQ ID NO: 519145 - RNA, 19 nt, Human
auuucuucaacucccugcc

SEQ ID NO: 519146 - RNA, 20 nt, Human
gaugggcuuucccaacagcu

SEQ ID NO: 519147 - RNA, 18 nt, Human
gaaaauaacaauaaaaga

SEQ ID NO: 519148 - RNA, 16 nt, Human
aaaauaauccucaguu

SEQ ID NO: 519149 - RNA, 14 nt, Human
aauauaaauaaaaa

SEQ ID NO: 519150 - RNA, 22 nt, Human
caccagucugacuguuuccauc

SEQ ID NO: 519151 - RNA, 17 nt, Human
uugugaagcaaaauuuu

SEQ ID NO: 519152 - RNA, 19 nt, Human
acaaauuuacagagacaga

SEQ ID NO: 519153 - RNA, 13 nt, Human
cuaugaaauauua

SEQ ID NO: 519154 - RNA, 16 nt, Human
cuucaacucccugccc

SEQ ID NO: 519155 - RNA, 18 nt, Human
uaaauauaaagcaagaua

SEQ ID NO: 519156 - RNA, 15 nt, Human
uucggccuccauccu

SEQ ID NO: 519157 - RNA, 12 nt, Human
ucuacacuccag

SEQ ID NO: 519158 - RNA, 19 nt, Human
ugggacaggggagaaccua

SEQ ID NO: 519159 - RNA, 22 nt, Human
uauccuacuuccccuuccuaau

SEQ ID NO: 519160 - RNA, 16 nt, Human
guucugcacacagcac

SEQ ID NO: 519161 - RNA, 18 nt, Human
uucaauaucuuuuuuuua

SEQ ID NO: 519162 - RNA, 17 nt, Human
cccacuagacccacugg

SEQ ID NO: 519163 - RNA, 23 nt, Human
gaaauugaaaaugguauuaaaga

SEQ ID NO: 519164 - RNA, 23 nt, Human
auuucugagcauuuaauauggau

SEQ ID NO: 519165 - RNA, 17 nt, Human
ggaaauauuuauuuuaa

SEQ ID NO: 519166 - RNA, 21 nt, Human
ucauucacucaacaaacauaa

SEQ ID NO: 519167 - RNA, 14 nt, Human
cugcaaagcccagc

SEQ ID NO: 519168 - RNA, 15 nt, Human
aauugacccacaaga

SEQ ID NO: 519169 - RNA, 16 nt, Human
cagucucccucccuug

SEQ ID NO: 519170 - RNA, 13 nt, Human
augcuagaacucc

SEQ ID NO: 519171 - RNA, 16 nt, Human
cagggcucacagaauu

SEQ ID NO: 519172 - RNA, 17 nt, Human
caagaaaugaaagcagg

SEQ ID NO: 519173 - RNA, 18 nt, Human
acagaaagcagaacagug

SEQ ID NO: 519174 - RNA, 14 nt, Human
ccuugaugaagaag

SEQ ID NO: 519175 - RNA, 10 nt, Human
ccugagcccc

SEQ ID NO: 519176 - RNA, 16 nt, Human
ccuacaugagguacug

SEQ ID NO: 519177 - RNA, 11 nt, Human
augggacaggg

SEQ ID NO: 519178 - RNA, 16 nt, Human
agagaacaagcaaaua

SEQ ID NO: 519179 - RNA, 17 nt, Human
cugagaugggagaauca

SEQ ID NO: 519180 - RNA, 22 nt, Human
augguuguauuauuuuuuaaaa

SEQ ID NO: 519181 - RNA, 21 nt, Human
augucauuugcuggagcucug

SEQ ID NO: 519182 - RNA, 19 nt, Human
ugaaauuguauuacaaauc

SEQ ID NO: 519183 - RNA, 15 nt, Human
cuaucuuugagcgcc

SEQ ID NO: 519184 - RNA, 16 nt, Human
uuuucucuaggaaaua

SEQ ID NO: 519185 - RNA, 15 nt, Human
gcagagguugcagug

SEQ ID NO: 519186 - RNA, 22 nt, Human
cuuccuaauuccacagcugcuc

SEQ ID NO: 519187 - RNA, 15 nt, Human
cugacucuuaagaag

SEQ ID NO: 519188 - RNA, 15 nt, Human
ugcagauaaacagua

SEQ ID NO: 519189 - RNA, 13 nt, Human
ccaggcugagccu

SEQ ID NO: 519190 - RNA, 16 nt, Human
aaaagcuccauuuuua

SEQ ID NO: 519191 - RNA, 20 nt, Human
gagccugaucaccugcccug

SEQ ID NO: 519192 - RNA, 12 nt, Human
ggaggcugagau

SEQ ID NO: 519193 - RNA, 17 nt, Human
ccccaguuguuucuacu

SEQ ID NO: 519194 - RNA, 14 nt, Human
uucagccugaaaga

SEQ ID NO: 519195 - RNA, 20 nt, Human
gacauuugcucauggaauug

SEQ ID NO: 519196 - RNA, 19 nt, Human
ccauccugccccugagccc

SEQ ID NO: 519197 - RNA, 12 nt, Human
gacgagaaaaca

SEQ ID NO: 519198 - RNA, 14 nt, Human
aaauauaaauaaaa

SEQ ID NO: 519199 - RNA, 14 nt, Human
auaaauaaaaauaa

SEQ ID NO: 519200 - RNA, 21 nt, Human
ccaaauauaaauaaaaauaau

SEQ ID NO: 519201 - RNA, 15 nt, Human
caaggaaaaaauaac

SEQ ID NO: 519202 - RNA, 20 nt, Human
agaggagaaacuggaacucu

SEQ ID NO: 519203 - RNA, 22 nt, Human
agaauuuuaugcggcauuuucu

SEQ ID NO: 519204 - RNA, 17 nt, Human
auguugacaugggacau

SEQ ID NO: 519205 - RNA, 22 nt, Human
gaugguucccuugaugaagaag

SEQ ID NO: 519206 - RNA, 14 nt, Human
uuucuaugaaauau

SEQ ID NO: 519207 - RNA, 13 nt, Human
auaacgauaaaag

SEQ ID NO: 519208 - RNA, 16 nt, Human
accucugccucagaaa

SEQ ID NO: 519209 - RNA, 17 nt, Human
guugcugggggggauug

SEQ ID NO: 519210 - RNA, 22 nt, Human
aggaugccccgucccccucugg

SEQ ID NO: 519211 - RNA, 15 nt, Human
aaagaaagaaaauca

SEQ ID NO: 519212 - RNA, 17 nt, Human
ccaaaaaucucaauauu

SEQ ID NO: 519213 - RNA, 20 nt, Human
cccuuccuaauuccacagcu

SEQ ID NO: 519214 - RNA, 17 nt, Human
ccugagcuugcagagau

SEQ ID NO: 519215 - RNA, 20 nt, Human
uccaagccucauguccacug

SEQ ID NO: 519216 - RNA, 14 nt, Human
acacugaagaagca

SEQ ID NO: 519217 - RNA, 19 nt, Human
augcagagguccacaacac

SEQ ID NO: 519218 - RNA, 12 nt, Human
auucugaaagca

SEQ ID NO: 519219 - RNA, 23 nt, Human
uacaaaugggaaacaaaaggaua

SEQ ID NO: 519220 - RNA, 17 nt, Human
cucagucucccucccuu

SEQ ID NO: 519221 - RNA, 19 nt, Human
uguauacugugugcuaaaa

SEQ ID NO: 519222 - RNA, 18 nt, Human
gccugagcgacagugaga

SEQ ID NO: 519223 - RNA, 19 nt, Human
auuuugugaagcaaaauuu

SEQ ID NO: 519224 - RNA, 15 nt, Human
acuuuauaaaggauu

SEQ ID NO: 519225 - RNA, 19 nt, Human
uuuccugaaaacccuugcc

SEQ ID NO: 519226 - RNA, 12 nt, Human
aaugcagccccc

SEQ ID NO: 519227 - RNA, 16 nt, Human
agugaaagaaaauaac

SEQ ID NO: 519228 - RNA, 20 nt, Human
aacaagccuccuuuuaaagu

SEQ ID NO: 519229 - RNA, 18 nt, Human
auuuaggccaugggacag

SEQ ID NO: 519230 - RNA, 12 nt, Human
guagacacacau

SEQ ID NO: 519231 - RNA, 14 nt, Human
gugagcuacaaaug

SEQ ID NO: 519232 - RNA, 16 nt, Human
acaugaaguccaagca

SEQ ID NO: 519233 - RNA, 19 nt, Human
cuuggggccuaugcagagg

SEQ ID NO: 519234 - RNA, 16 nt, Human
auaacuggaaacuuca

SEQ ID NO: 519235 - RNA, 13 nt, Human
auauaaagcaaga

SEQ ID NO: 519236 - RNA, 22 nt, Human
cuucaacucccugccccccagc

SEQ ID NO: 519237 - RNA, 18 nt, Human
cacuccagugagacagcu

SEQ ID NO: 519238 - RNA, 19 nt, Human
augaauuacauuuguauaa

SEQ ID NO: 519239 - RNA, 22 nt, Human
uuaccucugccucagaaaacaa

SEQ ID NO: 519240 - RNA, 15 nt, Human
ugguuuagaaagcuu

SEQ ID NO: 519241 - RNA, 16 nt, Human
cucaauaaaguacaag

SEQ ID NO: 519242 - RNA, 18 nt, Human
cuuuucccaacuccagaa

SEQ ID NO: 519243 - RNA, 23 nt, Human
ugcauagguuuaauaauuuuuaa

SEQ ID NO: 519244 - RNA, 16 nt, Human
ggaugccccguccccc

SEQ ID NO: 519245 - RNA, 19 nt, Human
caaggaugccccguccccc

SEQ ID NO: 519246 - RNA, 19 nt, Human
auuuacagagacagaaagc

SEQ ID NO: 519247 - RNA, 17 nt, Human
uuaaauggucaauuuug

SEQ ID NO: 519248 - RNA, 23 nt, Human
aguaauuggaaaggcagcucuaa

SEQ ID NO: 519249 - RNA, 14 nt, Human
auuuucuauaauuu

SEQ ID NO: 519250 - RNA, 16 nt, Human
cacuuaaaaaugguuu

SEQ ID NO: 519251 - RNA, 22 nt, Human
cuccagccugagcgacagugag

SEQ ID NO: 519252 - RNA, 14 nt, Human
aacgauaaaagaca

SEQ ID NO: 519253 - RNA, 19 nt, Human
gacagucaccucauggaau

SEQ ID NO: 519254 - RNA, 23 nt, Human
uagauaggucagugcaaauacuc

SEQ ID NO: 519255 - RNA, 16 nt, Human
agugaaauauuauuuu

SEQ ID NO: 519256 - RNA, 20 nt, Human
acaagacccaaaaggcagaa

SEQ ID NO: 519257 - RNA, 15 nt, Human
agaaaacaauaacga

SEQ ID NO: 519258 - RNA, 16 nt, Human
ccccugcacuccagcc

SEQ ID NO: 519259 - RNA, 13 nt, Human
auugauuauaugu

SEQ ID NO: 519260 - RNA, 18 nt, Human
auuuuuagugaaauauua

SEQ ID NO: 519261 - RNA, 18 nt, Human
aaggaugccccguccccc

SEQ ID NO: 519262 - RNA, 22 nt, Human
uuguaacaagccuccuuuuaaa

SEQ ID NO: 519263 - RNA, 14 nt, Human
agcaaguauuagaa

SEQ ID NO: 519264 - RNA, 14 nt, Human
cuaaacauaugaau

SEQ ID NO: 519265 - RNA, 14 nt, Human
ccucagucucccuc

SEQ ID NO: 519266 - RNA, 17 nt, Human
aaagcuccauuuuuagu

SEQ ID NO: 519267 - RNA, 22 nt, Human
cauuuaaauaaaguguuugaaa

SEQ ID NO: 519268 - RNA, 22 nt, Human
uggaaaguuuaugguuguauua

SEQ ID NO: 519269 - RNA, 16 nt, Human
cuuauaauuuaaaaua

SEQ ID NO: 519270 - RNA, 14 nt, Human
auacaaaaaaaaaa

SEQ ID NO: 519271 - RNA, 14 nt, Human
aaaagaaacauuug

SEQ ID NO: 519272 - RNA, 15 nt, Human
agucaccucauggaa

SEQ ID NO: 519273 - RNA, 20 nt, Human
cugagccucagucucccucc

SEQ ID NO: 519274 - RNA, 17 nt, Human
gccccccagcccuccuu

SEQ ID NO: 519275 - RNA, 16 nt, Human
aagcuucacuguaaaa

SEQ ID NO: 519276 - RNA, 23 nt, Human
aggaugguucccuugaugaagaa

SEQ ID NO: 519277 - RNA, 12 nt, Human
accccugagcuu

SEQ ID NO: 519278 - RNA, 19 nt, Human
agcagcuuauucacaagac

SEQ ID NO: 519279 - RNA, 13 nt, Human
uuaaauuguaaua

SEQ ID NO: 519280 - RNA, 20 nt, Human
ccagugagacagcucugcau

SEQ ID NO: 519281 - RNA, 18 nt, Human
aaaaguucugcagauaaa

SEQ ID NO: 519282 - RNA, 21 nt, Human
cccacuggacucaccuccccc

SEQ ID NO: 519283 - RNA, 16 nt, Human
auaaugaauacuuuau

SEQ ID NO: 519284 - RNA, 15 nt, Human
aaauaauuuuuauau

SEQ ID NO: 519285 - RNA, 21 nt, Human
cuaaauugacacuuaaaaaug

SEQ ID NO: 519286 - RNA, 13 nt, Human
uaaacauguuuau

SEQ ID NO: 519287 - RNA, 16 nt, Human
cucagcccuggugggc

SEQ ID NO: 519288 - RNA, 19 nt, Human
auuuaagagaacaagcaaa

SEQ ID NO: 519289 - RNA, 20 nt, Human
auuuucaguuauuauauuua

SEQ ID NO: 519290 - RNA, 19 nt, Human
agaaaauaacgauaaaaga

SEQ ID NO: 519291 - RNA, 18 nt, Human
ugaaaaaguucugcagau

SEQ ID NO: 519292 - RNA, 15 nt, Human
cuaagcaaaauguga

SEQ ID NO: 519293 - RNA, 17 nt, Human
gccugagcgacagugag

SEQ ID NO: 519294 - RNA, 22 nt, Human
ggacagcccuucuuuccacaga

SEQ ID NO: 519295 - RNA, 21 nt, Human
cuccagcuggccgggagccug

SEQ ID NO: 519296 - RNA, 15 nt, Human
ccauuaaauauaaag

SEQ ID NO: 519297 - RNA, 12 nt, Human
aauuuuaaaaug

SEQ ID NO: 519298 - RNA, 22 nt, Human
caccucccccaucucuucuggg

SEQ ID NO: 519299 - RNA, 16 nt, Human
ccaggcugagccucag

SEQ ID NO: 519300 - RNA, 15 nt, Human
cucccuuggggccua

SEQ ID NO: 519301 - RNA, 21 nt, Human
ccucccuuggggccuaugcag

SEQ ID NO: 519302 - RNA, 13 nt, Human
ccucauggaauug

SEQ ID NO: 519303 - RNA, 19 nt, Human
uccauccugaggcuccacu

SEQ ID NO: 519304 - RNA, 14 nt, Human
uauuugaaauauug

SEQ ID NO: 519305 - RNA, 15 nt, Human
uuagugaaauauuau

SEQ ID NO: 519306 - RNA, 15 nt, Human
aauacuuuauaaagg

SEQ ID NO: 519307 - RNA, 16 nt, Human
cuuuauaguucuacuc

SEQ ID NO: 519308 - RNA, 19 nt, Human
aagucuuucacauuuaaau

SEQ ID NO: 519309 - RNA, 15 nt, Human
uggacgagaaaacaa

SEQ ID NO: 519310 - RNA, 15 nt, Human
aaauauaaagcaaga

SEQ ID NO: 519311 - RNA, 15 nt, Human
augguuguauuauuu

SEQ ID NO: 519312 - RNA, 16 nt, Human
gagaaacuggaacucu

SEQ ID NO: 519313 - RNA, 16 nt, Human
gccuaagugcagcccc

SEQ ID NO: 519314 - RNA, 18 nt, Human
acaaaugggaaacaaaag

SEQ ID NO: 519315 - RNA, 12 nt, Human
uuuuuuuuaaaa

SEQ ID NO: 519316 - RNA, 15 nt, Human
ugcaauuccacuuau

SEQ ID NO: 519317 - RNA, 17 nt, Human
aacaguuaccucugccu

SEQ ID NO: 519318 - RNA, 14 nt, Human
uggacucaccuccc

SEQ ID NO: 519319 - RNA, 20 nt, Human
aaaacaagcacuaaacaaag

SEQ ID NO: 519320 - RNA, 20 nt, Human
auaacaaugcuguauuuuaa

SEQ ID NO: 519321 - RNA, 16 nt, Human
uauguucuaagaagug

SEQ ID NO: 519322 - RNA, 14 nt, Human
ccaaugaaaugagu

SEQ ID NO: 519323 - RNA, 22 nt, Human
aaacauccuacaagacacagug

SEQ ID NO: 519324 - RNA, 20 nt, Human
gggaggcagagguugcagug

SEQ ID NO: 519325 - RNA, 18 nt, Human
aaaucuuauaauuuaaaa

SEQ ID NO: 519326 - RNA, 15 nt, Human
ggacucaccuccccc

SEQ ID NO: 519327 - RNA, 16 nt, Human
acaaauccaaugaaau

SEQ ID NO: 519328 - RNA, 20 nt, Human
ugagcgcccacuagacccac

SEQ ID NO: 519329 - RNA, 14 nt, Human
caugaacuuguaaa

SEQ ID NO: 519330 - RNA, 22 nt, Human
auaacaaugcuguauuuuaaaa

SEQ ID NO: 519331 - RNA, 19 nt, Human
cucuguucugcacacagca

SEQ ID NO: 519332 - RNA, 11 nt, Human
auaauuuaaau

SEQ ID NO: 519333 - RNA, 22 nt, Human
uuccccuuccuaauuccacagc

SEQ ID NO: 519334 - RNA, 17 nt, Human
aaaguacaagagcuuaa

SEQ ID NO: 519335 - RNA, 20 nt, Human
aguuuuuuuuuaaaaaagaa

SEQ ID NO: 519336 - RNA, 17 nt, Human
uuauaaucuuucacagg

SEQ ID NO: 519337 - RNA, 14 nt, Human
auaaagcaagauaa

SEQ ID NO: 519338 - RNA, 12 nt, Human
gucccaggcuga

SEQ ID NO: 519339 - RNA, 17 nt, Human
agguccacaacacacag

SEQ ID NO: 519340 - RNA, 21 nt, Human
uauacugugugcuaaaacaag

SEQ ID NO: 519341 - RNA, 14 nt, Human
ugcuagaacucccu

SEQ ID NO: 519342 - RNA, 19 nt, Human
ucaauucuugccaaauaua

SEQ ID NO: 519343 - RNA, 17 nt, Human
accugagccccaaaagg

SEQ ID NO: 519344 - RNA, 14 nt, Human
cuugagguaaaagc

SEQ ID NO: 519345 - RNA, 15 nt, Human
cuuaagaagacugca

SEQ ID NO: 519346 - RNA, 21 nt, Human
ccaaggaugccccgucccccu

SEQ ID NO: 519347 - RNA, 14 nt, Human
aauauaaagcaaga

SEQ ID NO: 519348 - RNA, 17 nt, Human
uacaaaugcauuucuaa

SEQ ID NO: 519349 - RNA, 16 nt, Human
uucacauuuaaauaaa

SEQ ID NO: 519350 - RNA, 20 nt, Human
cagugaaagaaaauaacgau

SEQ ID NO: 519351 - RNA, 23 nt, Human
uaaaagacagugaaagaaaauaa

SEQ ID NO: 519352 - RNA, 22 nt, Human
uguugcccacagcuguaugauu

SEQ ID NO: 519353 - RNA, 18 nt, Human
aagggaauuucuucaacu

SEQ ID NO: 519354 - RNA, 19 nt, Human
ugagucccaggcugagccu

SEQ ID NO: 519355 - RNA, 12 nt, Human
uaguacacacuu

SEQ ID NO: 519356 - RNA, 18 nt, Human
cuucacuguaaaauaaua

SEQ ID NO: 519357 - RNA, 23 nt, Human
gaaaaaguucugcagauaaacag

SEQ ID NO: 519358 - RNA, 17 nt, Human
gccuaagugcagccccg

SEQ ID NO: 519359 - RNA, 23 nt, Human
gcaacuuguguuccuaacaggaa

SEQ ID NO: 519360 - RNA, 15 nt, Human
auagaaguaaaaaca

SEQ ID NO: 519361 - RNA, 17 nt, Human
gucaaagcugaaaugga

SEQ ID NO: 519362 - RNA, 17 nt, Human
gccaugggacagggagg

SEQ ID NO: 519363 - RNA, 14 nt, Human
ugagaugcuagaac

SEQ ID NO: 519364 - RNA, 13 nt, Human
cucagaaaacaag

SEQ ID NO: 519365 - RNA, 19 nt, Human
uuccucccuucucuucaca

SEQ ID NO: 519366 - RNA, 17 nt, Human
caccucccccaucucuu

SEQ ID NO: 519367 - RNA, 17 nt, Human
agugauuaccagggacu

SEQ ID NO: 519368 - RNA, 21 nt, Human
uuuuauggcacuaguauuucu

SEQ ID NO: 519369 - RNA, 23 nt, Human
ugaauuacauuuguauaaaauaa

SEQ ID NO: 519370 - RNA, 19 nt, Human
gaaagaaaauaacaauaaa

SEQ ID NO: 519371 - RNA, 19 nt, Human
uucccuugaugaagaaguu

SEQ ID NO: 519372 - RNA, 22 nt, Human
caucucuucuggguuccuuccu

SEQ ID NO: 519373 - RNA, 21 nt, Human
cucaaaacuucagacauagaa

SEQ ID NO: 519374 - RNA, 14 nt, Human
uauaauuuaaauau

SEQ ID NO: 519375 - RNA, 16 nt, Human
aaugaaagcagggacu

SEQ ID NO: 519376 - RNA, 14 nt, Human
uaacaacaacaaca

SEQ ID NO: 519377 - RNA, 20 nt, Human
uaaaacaagcacuaaacaaa

SEQ ID NO: 519378 - RNA, 18 nt, Human
gaagcaccaaucaugaau

SEQ ID NO: 519379 - RNA, 16 nt, Human
caaaaggauaaugaau

SEQ ID NO: 519380 - RNA, 19 nt, Human
cuccagcuggccgggagcc

SEQ ID NO: 519381 - RNA, 15 nt, Human
auuauuuuuuaaaaa

SEQ ID NO: 519382 - RNA, 14 nt, Human
ccacuggacucacc

SEQ ID NO: 519383 - RNA, 23 nt, Human
caaagcugaaauggacuuuugua

SEQ ID NO: 519384 - RNA, 13 nt, Human
agcucugcccauc

SEQ ID NO: 519385 - RNA, 21 nt, Human
gccuuuucccaacuccagaaa

SEQ ID NO: 519386 - RNA, 19 nt, Human
ccuccauccugaggcucca

SEQ ID NO: 519387 - RNA, 17 nt, Human
uguucuaagaagugaaa

SEQ ID NO: 519388 - RNA, 20 nt, Human
aauaucuuuuuuuuaauaaa

SEQ ID NO: 519389 - RNA, 15 nt, Human
aagccuccuuuuaaa

SEQ ID NO: 519390 - RNA, 16 nt, Human
uuaagagaacaagcaa

SEQ ID NO: 519391 - RNA, 17 nt, Human
ucugugagaugcuagaa

SEQ ID NO: 519392 - RNA, 19 nt, Human
aagcauuccaacuaucuca

SEQ ID NO: 519393 - RNA, 20 nt, Human
auacugugugcuaaaacaag

SEQ ID NO: 519394 - RNA, 17 nt, Human
uaauuccacagcugcuc

SEQ ID NO: 519395 - RNA, 13 nt, Human
auuuuaaaagaau

SEQ ID NO: 519396 - RNA, 23 nt, Human
ggccuccauccugaggcuccacu

SEQ ID NO: 519397 - RNA, 14 nt, Human
uccauuaaauauaa

SEQ ID NO: 519398 - RNA, 12 nt, Human
caacccaaaugu

SEQ ID NO: 519399 - RNA, 22 nt, Human
aaauaacaaugaaaguugauaa

SEQ ID NO: 519400 - RNA, 16 nt, Human
aggguguguaaguaga

SEQ ID NO: 519401 - RNA, 22 nt, Human
gauaaaagacagugaaagaaaa

SEQ ID NO: 519402 - RNA, 15 nt, Human
augauaacuggaaac

SEQ ID NO: 519403 - RNA, 17 nt, Human
uuacagagacagaaagc

SEQ ID NO: 519404 - RNA, 15 nt, Human
cccugccccccagcc

SEQ ID NO: 519405 - RNA, 19 nt, Human
ugaacaaauuuacagagac

SEQ ID NO: 519406 - RNA, 20 nt, Human
ugagagacacacugaagaag

SEQ ID NO: 519407 - RNA, 16 nt, Human
uguaguccuguaaugg

SEQ ID NO: 519408 - RNA, 19 nt, Human
auucccagccagcacagcc

SEQ ID NO: 519409 - RNA, 21 nt, Human
uuccuaauuccacagcugcuc

SEQ ID NO: 519410 - RNA, 18 nt, Human
aucuuauaauuuaaaaua

SEQ ID NO: 519411 - RNA, 19 nt, Human
uauauuuuuuguuaaauga

SEQ ID NO: 519412 - RNA, 13 nt, Human
uuauguuuaauuc

SEQ ID NO: 519413 - RNA, 16 nt, Human
uacaaaugggaaacaa

SEQ ID NO: 519414 - RNA, 19 nt, Human
cuuccuaauuccacagcug

SEQ ID NO: 519415 - RNA, 16 nt, Human
aggccaugggacaggg

SEQ ID NO: 519416 - RNA, 14 nt, Human
cugucucaguccau

SEQ ID NO: 519417 - RNA, 15 nt, Human
gccccugcacuccag

SEQ ID NO: 519418 - RNA, 17 nt, Human
guuuaauucugaaagca

SEQ ID NO: 519419 - RNA, 12 nt, Human
aaaugaaagcag

SEQ ID NO: 519420 - RNA, 14 nt, Human
uugcuggagcucug

SEQ ID NO: 519421 - RNA, 22 nt, Human
uauuccuuuuucucuccucucc

SEQ ID NO: 519422 - RNA, 21 nt, Human
ugggaggcugagaugggagaa

SEQ ID NO: 519423 - RNA, 14 nt, Human
ugagcuugcagaga

SEQ ID NO: 519424 - RNA, 15 nt, Human
agaacaagcaaauau

SEQ ID NO: 519425 - RNA, 16 nt, Human
aauuccacagcugcuc

SEQ ID NO: 519426 - RNA, 19 nt, Human
agacagugaaagaaaauaa

SEQ ID NO: 519427 - RNA, 22 nt, Human
uguucugauauuggacaguaaa

SEQ ID NO: 519428 - RNA, 18 nt, Human
guuuaugguuguauuauu

SEQ ID NO: 519429 - RNA, 13 nt, Human
uaagugcagcccc

SEQ ID NO: 519430 - RNA, 16 nt, Human
agguacuucaaauccu

SEQ ID NO: 519431 - RNA, 14 nt, Human
ucccuugaugaaga

SEQ ID NO: 519432 - RNA, 21 nt, Human
uaauaggcguaacuaauuuua

SEQ ID NO: 519433 - RNA, 22 nt, Human
cucuggccuucggccuccaucc

SEQ ID NO: 519434 - RNA, 16 nt, Human
cccccagcccuccuua

SEQ ID NO: 519435 - RNA, 22 nt, Human
aagacccaaaaggcagaagcaa

SEQ ID NO: 519436 - RNA, 17 nt, Human
cuauccuacuuccccuu

SEQ ID NO: 519437 - RNA, 13 nt, Human
cuuacuucuucuc

SEQ ID NO: 519438 - RNA, 22 nt, Human
guguccccuauccuacuucccc

SEQ ID NO: 519439 - RNA, 20 nt, Human
ccuccugccuaagugcagcc

SEQ ID NO: 519440 - RNA, 22 nt, Human
auggaaauguuuacagaucccc

SEQ ID NO: 519441 - RNA, 15 nt, Human
auuugguaaggggaa

SEQ ID NO: 519442 - RNA, 23 nt, Human
uauguuaaaacugggacagggga

SEQ ID NO: 519443 - RNA, 15 nt, Human
ugucaauaaaaucca

SEQ ID NO: 519444 - RNA, 22 nt, Human
gcagagagguagggauggggcu

SEQ ID NO: 519445 - RNA, 20 nt, Human
agccuuuuuuugaaaaaaag

SEQ ID NO: 519446 - RNA, 14 nt, Human
auauuugaaauauu

SEQ ID NO: 519447 - RNA, 17 nt, Human
aucaaggguacacugcc

SEQ ID NO: 519448 - RNA, 14 nt, Human
cugaggcuccacuu

SEQ ID NO: 519449 - RNA, 14 nt, Human
agaaaauaacaaua

SEQ ID NO: 519450 - RNA, 16 nt, Human
uugccauaauuacuau

SEQ ID NO: 519451 - RNA, 19 nt, Human
accccugagcuugcagaga

SEQ ID NO: 519452 - RNA, 20 nt, Human
caggcugagccucagucucc

SEQ ID NO: 519453 - RNA, 13 nt, Human
auccugaggcucc

SEQ ID NO: 519454 - RNA, 16 nt, Human
aauuuuuaauuauaug

SEQ ID NO: 519455 - RNA, 14 nt, Human
ucaaugcagccccc

SEQ ID NO: 519456 - RNA, 14 nt, Human
agcaaauauaaaca

SEQ ID NO: 519457 - RNA, 21 nt, Human
aauuaaguuuuuuuuuaaaaa

SEQ ID NO: 519458 - RNA, 20 nt, Human
accugauuucugagcauuua

SEQ ID NO: 519459 - RNA, 23 nt, Human
uccaaacugacucuuaagaagac

SEQ ID NO: 519460 - RNA, 15 nt, Human
uuaaauauaaagcaa

SEQ ID NO: 519461 - RNA, 14 nt, Human
acccgggaggcaga

SEQ ID NO: 519462 - RNA, 14 nt, Human
ccccugagcuugca

SEQ ID NO: 519463 - RNA, 15 nt, Human
caggaaguagaggag

SEQ ID NO: 519464 - RNA, 15 nt, Human
acaucaacagauaaa

SEQ ID NO: 519465 - RNA, 21 nt, Human
gggagccugaucaccugcccu

SEQ ID NO: 519466 - RNA, 22 nt, Human
uuuauggcacuaguauuucuau

SEQ ID NO: 519467 - RNA, 21 nt, Human
aguuguugcccacagcuguau

SEQ ID NO: 519468 - RNA, 15 nt, Human
gacucaccuccccca

SEQ ID NO: 519469 - RNA, 19 nt, Human
cccauggcacucuauguuc

SEQ ID NO: 519470 - RNA, 16 nt, Human
caggaaguagaggagg

SEQ ID NO: 519471 - RNA, 23 nt, Human
ggaugaauuaaguuuuuuuuuaa

SEQ ID NO: 519472 - RNA, 15 nt, Human
auuuuaaaagaauga

SEQ ID NO: 519473 - RNA, 15 nt, Human
aagccagauuuuccu

SEQ ID NO: 519474 - RNA, 19 nt, Human
accauuuuggcaagcucua

SEQ ID NO: 519475 - RNA, 19 nt, Human
aguauuucuaugaaauauu

SEQ ID NO: 519476 - RNA, 12 nt, Human
agaaaacaauaa

SEQ ID NO: 519477 - RNA, 20 nt, Human
augcuucuguuuuauaauuu

SEQ ID NO: 519478 - RNA, 21 nt, Human
aauucauucacucaacaaaca

SEQ ID NO: 519479 - RNA, 14 nt, Human
cuggagcucugccc

SEQ ID NO: 519480 - RNA, 14 nt, Human
cugccccccagccc

SEQ ID NO: 519481 - RNA, 17 nt, Human
auaaguacaugauaagc

SEQ ID NO: 519482 - RNA, 19 nt, Human
gaaaauaacgauaaaagac

SEQ ID NO: 519483 - RNA, 20 nt, Human
agcaacuuguguuccuaaca

SEQ ID NO: 519484 - RNA, 15 nt, Human
ugaaauuguauuaca

SEQ ID NO: 519485 - RNA, 17 nt, Human
caauaacgauaaaagac

SEQ ID NO: 519486 - RNA, 16 nt, Human
uacauuuguauaaaau

SEQ ID NO: 519487 - RNA, 13 nt, Human
uuuaaaaauccua

SEQ ID NO: 519488 - RNA, 21 nt, Human
gacagaaagcagaacagugau

SEQ ID NO: 519489 - RNA, 15 nt, Human
acgagauacagaauu

SEQ ID NO: 519490 - RNA, 20 nt, Human
aaauccuugaagauuuacca

SEQ ID NO: 519491 - RNA, 18 nt, Human
agguccacaacacacaga

SEQ ID NO: 519492 - RNA, 13 nt, Human
ccaacuuauauuu

SEQ ID NO: 519493 - RNA, 15 nt, Human
cuucaacucccugcc

SEQ ID NO: 519494 - RNA, 23 nt, Human
aucucuucuggguuccuuccucu

SEQ ID NO: 519495 - RNA, 14 nt, Human
gccucagucucccu

SEQ ID NO: 519496 - RNA, 20 nt, Human
auaauccuaaacauaugaau

SEQ ID NO: 519497 - RNA, 11 nt, Human
ccugagcccca

SEQ ID NO: 519498 - RNA, 17 nt, Human
acaagaaaugaaagcag

SEQ ID NO: 519499 - RNA, 15 nt, Human
agcucuaucaccaag

SEQ ID NO: 519500 - RNA, 19 nt, Human
uuauggcacuaguauuucu

SEQ ID NO: 519501 - RNA, 16 nt, Human
uuucuauaauuuaaau

SEQ ID NO: 519502 - RNA, 23 nt, Human
uaaguuuuuuuuuaaaaaagaaa

SEQ ID NO: 519503 - RNA, 14 nt, Human
gagcccauggcacu

SEQ ID NO: 519504 - RNA, 14 nt, Human
ugugaaaagcucca

SEQ ID NO: 519505 - RNA, 13 nt, Human
aaauaaaaauaau

SEQ ID NO: 519506 - RNA, 15 nt, Human
cuggguuccuuccuc

SEQ ID NO: 519507 - RNA, 23 nt, Human
cucagcccuggugggcagagagg

SEQ ID NO: 519508 - RNA, 21 nt, Human
agggugauauuaaccaggggc

SEQ ID NO: 519509 - RNA, 19 nt, Human
gucaaauugugugaaaggu

SEQ ID NO: 519510 - RNA, 20 nt, Human
ugccccccagcccuccuuau

SEQ ID NO: 519511 - RNA, 14 nt, Human
caaaguuaagaauc

SEQ ID NO: 519512 - RNA, 20 nt, Human
gaaacgaggauugggaaaaa

SEQ ID NO: 519513 - RNA, 23 nt, Human
cuggccgggagccugaucaccug

SEQ ID NO: 519514 - RNA, 19 nt, Human
cuaguaucaaaagaaagaa

SEQ ID NO: 519515 - RNA, 23 nt, Human
aucacagcuacuugggaggcuga

SEQ ID NO: 519516 - RNA, 17 nt, Human
agaugggagaaucacuu

SEQ ID NO: 519517 - RNA, 20 nt, Human
gauugugccccugcacucca

SEQ ID NO: 519518 - RNA, 23 nt, Human
aaaauaucacuugucaauaaaau

SEQ ID NO: 519519 - RNA, 23 nt, Human
aagagccuuuuuuugaaaaaaag

SEQ ID NO: 519520 - RNA, 20 nt, Human
cagccugagcgacagugaga

SEQ ID NO: 519521 - RNA, 23 nt, Human
acugucuuguuggacgagaaaac

SEQ ID NO: 519522 - RNA, 20 nt, Human
cacuagacccacuggacuca

SEQ ID NO: 519523 - RNA, 16 nt, Human
aaauauaaauaaaaau

SEQ ID NO: 519524 - RNA, 16 nt, Human
ucagucucccucccuu

SEQ ID NO: 519525 - RNA, 15 nt, Human
ucugucucaguccau

SEQ ID NO: 519526 - RNA, 15 nt, Human
aauucugaaagcaac

SEQ ID NO: 519527 - RNA, 20 nt, Human
ucauucacucaacaaacaua

SEQ ID NO: 519528 - RNA, 14 nt, Human
ggaaguagaggagg

SEQ ID NO: 519529 - RNA, 23 nt, Human
uuuguauaaaauaauuuuuauau

SEQ ID NO: 519530 - RNA, 14 nt, Human
acaagagcuuaaca

SEQ ID NO: 519531 - RNA, 21 nt, Human
cgacagugagacucugucuca

SEQ ID NO: 519532 - RNA, 17 nt, Human
acuugaacccauauuug

SEQ ID NO: 519533 - RNA, 22 nt, Human
ugaaaaaguucugcagauaaac

SEQ ID NO: 519534 - RNA, 18 nt, Human
cccacuagacccacugga

SEQ ID NO: 519535 - RNA, 13 nt, Human
uuccucugagccu

SEQ ID NO: 519536 - RNA, 12 nt, Human
cucauggaauug

SEQ ID NO: 519537 - RNA, 23 nt, Human
uguagguagaucuggucuuuaga

SEQ ID NO: 519538 - RNA, 22 nt, Human
caaugcuguauuuuaaaagaau

SEQ ID NO: 519539 - RNA, 17 nt, Human
cauuaaauauaaagcaa

SEQ ID NO: 519540 - RNA, 15 nt, Human
aagccuggcaaggga

SEQ ID NO: 519541 - RNA, 13 nt, Human
acacuuaaaaaug

SEQ ID NO: 519542 - RNA, 13 nt, Human
uggcuccagcugg

SEQ ID NO: 519543 - RNA, 20 nt, Human
cugcacuccagccugagcga

SEQ ID NO: 519544 - RNA, 14 nt, Human
ugaagauguagagg

SEQ ID NO: 519545 - RNA, 16 nt, Human
aagcaagauaauaaaa

SEQ ID NO: 519546 - RNA, 15 nt, Human
uauaaagcaagauaa

SEQ ID NO: 519547 - RNA, 18 nt, Human
uuuuaaaaaagaaacauu

SEQ ID NO: 519548 - RNA, 23 nt, Human
ugucaauucuugccaaauauaaa

SEQ ID NO: 519549 - RNA, 21 nt, Human
ccugaucaccugcccugcuga

SEQ ID NO: 519550 - RNA, 17 nt, Human
ugaaaaucuuauaauuu

SEQ ID NO: 519551 - RNA, 19 nt, Human
ggaaaaaauaacaaugaaa

SEQ ID NO: 519552 - RNA, 19 nt, Human
ggaauuucuucaacucccu

SEQ ID NO: 519553 - RNA, 14 nt, Human
ucagucucccuccc

SEQ ID NO: 519554 - RNA, 15 nt, Human
augggacagggagga

SEQ ID NO: 519555 - RNA, 21 nt, Human
aaagcugaaauggacuuuugu

SEQ ID NO: 519556 - RNA, 17 nt, Human
uaauuuuuauauuugaa

SEQ ID NO: 519557 - RNA, 17 nt, Human
aagcuuuuuuugaauca

SEQ ID NO: 519558 - RNA, 20 nt, Human
cccugccccccagcccuccu

SEQ ID NO: 519559 - RNA, 18 nt, Human
uauuuucaguuauuauau

SEQ ID NO: 519560 - RNA, 16 nt, Human
aaaauccauacauuug

SEQ ID NO: 519561 - RNA, 12 nt, Human
caugggaaguga

SEQ ID NO: 519562 - RNA, 20 nt, Human
aauaagccagacaucaacag

SEQ ID NO: 519563 - RNA, 12 nt, Human
auauaaauaaaa

SEQ ID NO: 519564 - RNA, 22 nt, Human
agaagcaccaaucaugaauuag

SEQ ID NO: 519565 - RNA, 15 nt, Human
cagugaaagaaaaua

SEQ ID NO: 519566 - RNA, 15 nt, Human
uuauagcuacuaauu

SEQ ID NO: 519567 - RNA, 20 nt, Human
uguuggugaacuugguuuua

SEQ ID NO: 519568 - RNA, 15 nt, Human
gcccacuagacccac

SEQ ID NO: 519569 - RNA, 18 nt, Human
uuuauguuuaauucugaa

SEQ ID NO: 519570 - RNA, 12 nt, Human
uauaacaacaac

SEQ ID NO: 519571 - RNA, 18 nt, Human
gaaacaaaaggauaauga

SEQ ID NO: 519572 - RNA, 14 nt, Human
ccagcuggccggga

SEQ ID NO: 519573 - RNA, 20 nt, Human
uuaagagaacaagcaaauau

SEQ ID NO: 519574 - RNA, 16 nt, Human
uaaugaauacuuuaua

SEQ ID NO: 519575 - RNA, 20 nt, Human
aguuguuucuacuacaugga

SEQ ID NO: 519576 - RNA, 23 nt, Human
cauuguggucacaggaaguagag

SEQ ID NO: 519577 - RNA, 19 nt, Human
uuuauaucaauuuaaaaaa

SEQ ID NO: 519578 - RNA, 20 nt, Human
uuuaaauaaaguguuugaaa

SEQ ID NO: 519579 - RNA, 13 nt, Human
ugaaaaucuuaua

SEQ ID NO: 519580 - RNA, 15 nt, Human
aauauaaauaaaaau

SEQ ID NO: 519581 - RNA, 15 nt, Human
uauaaauaaaaauaa

SEQ ID NO: 519582 - RNA, 16 nt, Human
guuccuuccucugagc

SEQ ID NO: 519583 - RNA, 18 nt, Human
uaaguuuuuuuuuaaaaa

SEQ ID NO: 519584 - RNA, 18 nt, Human
cugagggcauagaaguaa

SEQ ID NO: 519585 - RNA, 19 nt, Human
caacucccugccccccagc

SEQ ID NO: 519586 - RNA, 22 nt, Human
uuuuauagcuacuaauuuuaaa

SEQ ID NO: 519587 - RNA, 11 nt, Human
cccaacagcuc

SEQ ID NO: 519588 - RNA, 13 nt, Human
uuaugcuaaguga

SEQ ID NO: 519589 - RNA, 19 nt, Human
auuggagcucgugggacag

SEQ ID NO: 519590 - RNA, 19 nt, Human
gccccccagcccuccuuau

SEQ ID NO: 519591 - RNA, 18 nt, Human
agcugcucaauaaaguac

SEQ ID NO: 519592 - RNA, 16 nt, Human
augaauacuuuauaaa

SEQ ID NO: 519593 - RNA, 17 nt, Human
ugguucccuugaugaag

SEQ ID NO: 519594 - RNA, 22 nt, Human
auuacuguaagaaaauaucacu

SEQ ID NO: 519595 - RNA, 21 nt, Human
ccuggugccucaccccuugcc

SEQ ID NO: 519596 - RNA, 21 nt, Human
accaccugccuauauuuuuug

SEQ ID NO: 519597 - RNA, 17 nt, Human
auuauuuuuuaaaaaaa

SEQ ID NO: 519598 - RNA, 22 nt, Human
gaaaacaauaacgauaaaagac

SEQ ID NO: 519599 - RNA, 22 nt, Human
ccgggagccugaucaccugccc

SEQ ID NO: 519600 - RNA, 16 nt, Human
gaaaaaauaacaauga

SEQ ID NO: 519601 - RNA, 16 nt, Human
aagaaaauaacaauaa

SEQ ID NO: 519602 - RNA, 13 nt, Human
aucaggcuggcca

SEQ ID NO: 519603 - RNA, 16 nt, Human
aauuacauuuguauaa

SEQ ID NO: 519604 - RNA, 17 nt, Human
ucgggauuaguacacac

SEQ ID NO: 519605 - RNA, 21 nt, Human
gccaaauauaaauaaaaauaa

SEQ ID NO: 519606 - RNA, 18 nt, Human
caugaauuaguuuuauau

SEQ ID NO: 519607 - RNA, 20 nt, Human
aaggaugccccgucccccuc

SEQ ID NO: 519608 - RNA, 16 nt, Human
acauuuauauuuuugu

SEQ ID NO: 519609 - RNA, 11 nt, Human
auaacaacaac

SEQ ID NO: 519610 - RNA, 12 nt, Human
uaagaagacugc

SEQ ID NO: 519611 - RNA, 19 nt, Human
ugagcgcccacuagaccca

SEQ ID NO: 519612 - RNA, 13 nt, Human
uguauauuuuaua

SEQ ID NO: 519613 - RNA, 13 nt, Human
ccaaaagguauuu

SEQ ID NO: 519614 - RNA, 17 nt, Human
uaugcuaagugaaauaa

SEQ ID NO: 519615 - RNA, 13 nt, Human
uaugaaauauuau

SEQ ID NO: 519616 - RNA, 21 nt, Human
acuccauuaaauauaaagcaa

SEQ ID NO: 519617 - RNA, 19 nt, Human
aauuuuuauauuugaaaua

SEQ ID NO: 519618 - RNA, 22 nt, Human
uaagagaacaagcaaauauaaa

SEQ ID NO: 519619 - RNA, 12 nt, Human
aauuuaaauaua

SEQ ID NO: 519620 - RNA, 13 nt, Human
ucacuguaaaaua

SEQ ID NO: 519621 - RNA, 14 nt, Human
agaaaugaaagcag

SEQ ID NO: 519622 - RNA, 18 nt, Human
uaaaagacaaggaaaaaa

SEQ ID NO: 519623 - RNA, 21 nt, Human
aauuuacagagacagaaagca

SEQ ID NO: 519624 - RNA, 20 nt, Human
cuuauucacaagacccaaaa

SEQ ID NO: 519625 - RNA, 20 nt, Human
aacaaugcuguauuuuaaaa

SEQ ID NO: 519626 - RNA, 19 nt, Human
ugaucaccugcccugcuga

SEQ ID NO: 519627 - RNA, 15 nt, Human
aagcaagauaauaaa

SEQ ID NO: 519628 - RNA, 23 nt, Human
caauaacgauaaaagacagugaa

SEQ ID NO: 519629 - RNA, 18 nt, Human
acuuuaugcuaagugaaa

SEQ ID NO: 519630 - RNA, 17 nt, Human
uccugccccugagccca

SEQ ID NO: 519631 - RNA, 14 nt, Human
uggcuugaguuuaa

SEQ ID NO: 519632 - RNA, 22 nt, Human
ccccuuccuaauuccacagcug

SEQ ID NO: 519633 - RNA, 15 nt, Human
acaaggaaaaaauaa

SEQ ID NO: 519634 - RNA, 18 nt, Human
cucuggccuucggccucc

SEQ ID NO: 519635 - RNA, 15 nt, Human
aaaaauaacaaugaa

SEQ ID NO: 519636 - RNA, 18 nt, Human
gccuuggggcugaugcag

SEQ ID NO: 519637 - RNA, 21 nt, Human
ucuucaacucccugcccccca

SEQ ID NO: 519638 - RNA, 14 nt, Human
cacuuauaggaauu

SEQ ID NO: 519639 - RNA, 20 nt, Human
aagcuucacuguaaaauaau

SEQ ID NO: 519640 - RNA, 16 nt, Human
auuauacccccugcaa

SEQ ID NO: 519641 - RNA, 21 nt, Human
uagggugauauuaaccagggg

SEQ ID NO: 519642 - RNA, 23 nt, Human
acucuauguucuaagaagugaaa

SEQ ID NO: 519643 - RNA, 19 nt, Human
uauuuuaauaauguuucaa

SEQ ID NO: 519644 - RNA, 17 nt, Human
ggccaugggacagggag

SEQ ID NO: 519645 - RNA, 14 nt, Human
caaaugcauuucua

SEQ ID NO: 519646 - RNA, 18 nt, Human
cagcuuauugucuaguga

SEQ ID NO: 519647 - RNA, 18 nt, Human
ucuucucauacuauuuaa

SEQ ID NO: 519648 - RNA, 17 nt, Human
ugaaauauuauuuuaua

SEQ ID NO: 519649 - RNA, 16 nt, Human
ccuccuuuuaaaguaa

SEQ ID NO: 519650 - RNA, 23 nt, Human
agcccuccuuaucaaaggacacc

SEQ ID NO: 519651 - RNA, 14 nt, Human
gcaaagcccagcuu

SEQ ID NO: 519652 - RNA, 16 nt, Human
aaauauuauguuaaaa

SEQ ID NO: 519653 - RNA, 22 nt, Human
cccuauccuacuuccccuuccu

SEQ ID NO: 519654 - RNA, 13 nt, Human
gguccacaacaca

SEQ ID NO: 519655 - RNA, 20 nt, Human
aagucuuucacauuuaaaua

SEQ ID NO: 519656 - RNA, 13 nt, Human
cacaacuauauug

SEQ ID NO: 519657 - RNA, 18 nt, Human
auuugcuggagcucugcc

SEQ ID NO: 519658 - RNA, 19 nt, Human
gagguacugagagugaaca

SEQ ID NO: 519659 - RNA, 22 nt, Human
acauccuacaagacacagugac

SEQ ID NO: 519660 - RNA, 22 nt, Human
uggacgagaaaacaauaacgau

SEQ ID NO: 519661 - RNA, 23 nt, Human
ggucucagugucaaugcagcccc

SEQ ID NO: 519662 - RNA, 19 nt, Human
agaguuuagcuggaaaagu

SEQ ID NO: 519663 - RNA, 14 nt, Human
gagcucagcccugg

SEQ ID NO: 519664 - RNA, 21 nt, Human
cauuuucuucucacauuuaua

SEQ ID NO: 519665 - RNA, 21 nt, Human
uccauccugaggcuccacuug

SEQ ID NO: 519666 - RNA, 19 nt, Human
cucaccucccccaucucuu

SEQ ID NO: 519667 - RNA, 19 nt, Human
ccccugcaaagcccagcuu

SEQ ID NO: 519668 - RNA, 13 nt, Human
cacgaugggcuuu

SEQ ID NO: 519669 - RNA, 11 nt, Human
acugggacagg

SEQ ID NO: 519670 - RNA, 20 nt, Human
uguaauaggcguaacuaauu

SEQ ID NO: 519671 - RNA, 14 nt, Human
uaugaauuacauuu

SEQ ID NO: 519672 - RNA, 15 nt, Human
acucaacaaacauaa

SEQ ID NO: 519673 - RNA, 22 nt, Human
cccagcccuccuuaucaaagga

SEQ ID NO: 519674 - RNA, 11 nt, Human
cgauaaaagac

SEQ ID NO: 519675 - RNA, 17 nt, Human
uccuacaagacacagug

SEQ ID NO: 519676 - RNA, 21 nt, Human
uccuucagccugaaagaggaa

SEQ ID NO: 519677 - RNA, 14 nt, Human
ucuauaauuuaaau

SEQ ID NO: 519678 - RNA, 20 nt, Human
uauaugcuaagucuuauaua

SEQ ID NO: 519679 - RNA, 15 nt, Human
ccccugagcuugcag

SEQ ID NO: 519680 - RNA, 14 nt, Human
aaaauacaaaaaaa

SEQ ID NO: 519681 - RNA, 19 nt, Human
gcucauggaauuggagcuc

SEQ ID NO: 519682 - RNA, 22 nt, Human
cacagauuugagcucagcccug

SEQ ID NO: 519683 - RNA, 15 nt, Human
uucacauuuaaauaa

SEQ ID NO: 519684 - RNA, 17 nt, Human
caagccuccuuuuaaag

SEQ ID NO: 519685 - RNA, 15 nt, Human
uaggaaauauuuauu

SEQ ID NO: 519686 - RNA, 21 nt, Human
ugcucaauaaaguacaagagc

SEQ ID NO: 519687 - RNA, 17 nt, Human
aaauaacgauaaaagac

SEQ ID NO: 519688 - RNA, 12 nt, Human
cccccagcccuc

SEQ ID NO: 519689 - RNA, 15 nt, Human
ugaaacccugucucu

SEQ ID NO: 519690 - RNA, 17 nt, Human
cugccucagaaaacaag

SEQ ID NO: 519691 - RNA, 22 nt, Human
ucuacuccauuaaauauaaagc

SEQ ID NO: 519692 - RNA, 21 nt, Human
aauuuuuauauuugaaauauu

SEQ ID NO: 519693 - RNA, 15 nt, Human
guuuuucuuuucauu

SEQ ID NO: 519694 - RNA, 14 nt, Human
uuuguauaaaauaa

SEQ ID NO: 519695 - RNA, 21 nt, Human
aaagaaaauaacgauaaaaga

SEQ ID NO: 519696 - RNA, 23 nt, Human
ucggccuccauccugaggcucca

SEQ ID NO: 519697 - RNA, 23 nt, Human
auauaacaaugcuguauuuuaaa

SEQ ID NO: 519698 - RNA, 16 nt, Human
agcuugaaaccuucac

SEQ ID NO: 519699 - RNA, 16 nt, Human
uuaaauuguaauaggc

SEQ ID NO: 519700 - RNA, 15 nt, Human
guaaggggaauugag

SEQ ID NO: 519701 - RNA, 14 nt, Human
cagagguugcagug

SEQ ID NO: 519702 - RNA, 19 nt, Human
cucugcauacucauuagga

SEQ ID NO: 519703 - RNA, 18 nt, Human
uguaaaggaauuuaaaaa

SEQ ID NO: 519704 - RNA, 14 nt, Human
auccuugaagauuu

SEQ ID NO: 519705 - RNA, 15 nt, Human
ccacaagaaaugaaa

SEQ ID NO: 519706 - RNA, 13 nt, Human
acaauaaaagaca

SEQ ID NO: 519707 - RNA, 17 nt, Human
aaaaugguauuaaagau

SEQ ID NO: 519708 - RNA, 16 nt, Human
aaaguguuugaaagcu

SEQ ID NO: 519709 - RNA, 14 nt, Human
aagcaacccaaaug

SEQ ID NO: 519710 - RNA, 20 nt, Human
agagacacacugaagaagca

SEQ ID NO: 519711 - RNA, 15 nt, Human
agacagcucugcaua

SEQ ID NO: 519712 - RNA, 18 nt, Human
acaugaacuuguaaagga

SEQ ID NO: 519713 - RNA, 21 nt, Human
uacaugagguacugagaguga

SEQ ID NO: 519714 - RNA, 12 nt, Human
aaaagaaagaaa

SEQ ID NO: 519715 - RNA, 16 nt, Human
ugcaacuacuauccaa

SEQ ID NO: 519716 - RNA, 14 nt, Human
ugaucaccugcccu

SEQ ID NO: 519717 - RNA, 13 nt, Human
aucaaugaaugaa

SEQ ID NO: 519718 - RNA, 23 nt, Human
caaaagcgauuauuauuuuagag

SEQ ID NO: 519719 - RNA, 13 nt, Human
ccugccccccagc

SEQ ID NO: 519720 - RNA, 18 nt, Human
ccuugggaccccugagcu

SEQ ID NO: 519721 - RNA, 21 nt, Human
accaaggagccaaacauccua

SEQ ID NO: 519722 - RNA, 17 nt, Human
ucuauaauguguucauu

SEQ ID NO: 519723 - RNA, 17 nt, Human
uuauuacuguaagaaaa

SEQ ID NO: 519724 - RNA, 13 nt, Human
uuuucuuuucauu

SEQ ID NO: 519725 - RNA, 15 nt, Human
auccugccccugagc

SEQ ID NO: 519726 - RNA, 15 nt, Human
gccuugggaccccug

SEQ ID NO: 519727 - RNA, 16 nt, Human
uccuguaauggaagca

SEQ ID NO: 519728 - RNA, 20 nt, Human
cugauauuggacaguaaaau

SEQ ID NO: 519729 - RNA, 18 nt, Human
uaauaauguuucaaacau

SEQ ID NO: 519730 - RNA, 21 nt, Human
caagacccaaaaggcagaagc

SEQ ID NO: 519731 - RNA, 14 nt, Human
agauguagaggaga

SEQ ID NO: 519732 - RNA, 22 nt, Human
aaaucaggguuaguauugucca

SEQ ID NO: 519733 - RNA, 22 nt, Human
aaacauguuuaucguauuugau

SEQ ID NO: 519734 - RNA, 13 nt, Human
aucuacacuccag

SEQ ID NO: 519735 - RNA, 14 nt, Human
auuuaaauauaugc

SEQ ID NO: 519736 - RNA, 16 nt, Human
aagacugcacaucaaa

SEQ ID NO: 519737 - RNA, 13 nt, Human
aagcaaauauaaa

SEQ ID NO: 519738 - RNA, 16 nt, Human
aagcauuuagauguau

SEQ ID NO: 519739 - RNA, 17 nt, Human
uaucuuuuuuuuaauaa

SEQ ID NO: 519740 - RNA, 14 nt, Human
cucaacaaacauaa

SEQ ID NO: 519741 - RNA, 20 nt, Human
ccagcuugaaaccuucacuu

SEQ ID NO: 519742 - RNA, 12 nt, Human
acugaaaucaua

SEQ ID NO: 519743 - RNA, 20 nt, Human
gcccauccugccccugagcc

SEQ ID NO: 519744 - RNA, 22 nt, Human
ccgggaggcagagguugcagug

SEQ ID NO: 519745 - RNA, 14 nt, Human
ucuuuuuuuuaaua

SEQ ID NO: 519746 - RNA, 20 nt, Human
uugaaaaugguauuaaagau

SEQ ID NO: 519747 - RNA, 17 nt, Human
auuuuaauaauguuuca

SEQ ID NO: 519748 - RNA, 14 nt, Human
cuaagcauuccaac

SEQ ID NO: 519749 - RNA, 12 nt, Human
cuggcuccagcu

SEQ ID NO: 519750 - RNA, 20 nt, Human
uuccacagaagcuccaggua

SEQ ID NO: 519751 - RNA, 22 nt, Human
auauuuacaaaugggaaacaaa

SEQ ID NO: 519752 - RNA, 16 nt, Human
uuauaauuuaaaauau

SEQ ID NO: 519753 - RNA, 13 nt, Human
aaauauaaacagc

SEQ ID NO: 519754 - RNA, 18 nt, Human
cauggaauuggagcucgu

SEQ ID NO: 519755 - RNA, 14 nt, Human
acccaaaaggcaga

SEQ ID NO: 519756 - RNA, 22 nt, Human
agcacagccucuuagaugcagu

SEQ ID NO: 519757 - RNA, 16 nt, Human
gacauagaauuaacac

SEQ ID NO: 519758 - RNA, 19 nt, Human
cagagaugaggccgccaug

SEQ ID NO: 519759 - RNA, 11 nt, Human
caauaaaagac

SEQ ID NO: 519760 - RNA, 13 nt, Human
ugagcgacaguga

SEQ ID NO: 519761 - RNA, 20 nt, Human
aagacagugaaagaaaauaa

SEQ ID NO: 519762 - RNA, 17 nt, Human
gacucaccucccccauc

SEQ ID NO: 519763 - RNA, 22 nt, Human
cauacuauuuaagagaacaagc

SEQ ID NO: 519764 - RNA, 12 nt, Human
aauaauuuuuaa

SEQ ID NO: 519765 - RNA, 21 nt, Human
aagagaacaagcaaauauaaa

SEQ ID NO: 519766 - RNA, 12 nt, Human
ccaggcugagcc

SEQ ID NO: 519767 - RNA, 16 nt, Human
cugcacuccagccuga

SEQ ID NO: 519768 - RNA, 20 nt, Human
uaugcuucuguuuuauaauu

SEQ ID NO: 519769 - RNA, 13 nt, Human
ugaaagaaaauaa

SEQ ID NO: 519770 - RNA, 21 nt, Human
caacacacagauuugagcuca

SEQ ID NO: 519771 - RNA, 22 nt, Human
gaaaaucuuauaauuuaaaaua

SEQ ID NO: 519772 - RNA, 12 nt, Human
uguuugaaagcu

SEQ ID NO: 519773 - RNA, 19 nt, Human
ccgggcgugguggugagug

SEQ ID NO: 519774 - RNA, 22 nt, Human
aaaaaaccugagccccaaaagg

SEQ ID NO: 519775 - RNA, 22 nt, Human
cucagcccuggugggcagagag

SEQ ID NO: 519776 - RNA, 14 nt, Human
uccacaacacacag

SEQ ID NO: 519777 - RNA, 14 nt, Human
auuuguauaaaaua

SEQ ID NO: 519778 - RNA, 21 nt, Human
uuauagcuacuaauuuuaaaa

SEQ ID NO: 519779 - RNA, 16 nt, Human
ugaauuaguuuuauau

SEQ ID NO: 519780 - RNA, 19 nt, Human
cccacuggacucaccuccc

SEQ ID NO: 519781 - RNA, 19 nt, Human
cauggaauuggagcucgug

SEQ ID NO: 519782 - RNA, 18 nt, Human
ugcauagguuuaauaauu

SEQ ID NO: 519783 - RNA, 16 nt, Human
cagauccccaagccug

SEQ ID NO: 519784 - RNA, 16 nt, Human
ucaucaaugaaugaau

SEQ ID NO: 519785 - RNA, 22 nt, Human
accaaucaugaauuaguuuuau

SEQ ID NO: 519786 - RNA, 13 nt, Human
augauuccaccua

SEQ ID NO: 519787 - RNA, 17 nt, Human
acccacuggacucaccu

SEQ ID NO: 519788 - RNA, 18 nt, Human
cagagacagaaagcagaa

SEQ ID NO: 519789 - RNA, 20 nt, Human
cuugccauaauuacuauguc

SEQ ID NO: 519790 - RNA, 12 nt, Human
aauacuuuauaa

SEQ ID NO: 519791 - RNA, 16 nt, Human
ccccaucucuucuggg

SEQ ID NO: 519792 - RNA, 20 nt, Human
ugaggcuccacuuggucugu

SEQ ID NO: 519793 - RNA, 19 nt, Human
auuauuuuuuaaaaaaauu

SEQ ID NO: 519794 - RNA, 20 nt, Human
uguaaaggaauuuaaaaauc

SEQ ID NO: 519795 - RNA, 14 nt, Human
acuuggucugugag

SEQ ID NO: 519796 - RNA, 16 nt, Human
guuuuuuuuuaaaaaa

SEQ ID NO: 519797 - RNA, 18 nt, Human
auuuuaacucuauaaugu

SEQ ID NO: 519798 - RNA, 14 nt, Human
gcaagauaauaaaa

SEQ ID NO: 519799 - RNA, 14 nt, Human
ggccgggagccuga

SEQ ID NO: 519800 - RNA, 14 nt, Human
uuagagcaucucau

SEQ ID NO: 519801 - RNA, 22 nt, Human
ugaguuuuucuuuucauuuacc

SEQ ID NO: 519802 - RNA, 13 nt, Human
aaaugaaagcagg

SEQ ID NO: 519803 - RNA, 13 nt, Human
ucuuauaauuuaa

SEQ ID NO: 519804 - RNA, 15 nt, Human
acaaaugggaaacaa

SEQ ID NO: 519805 - RNA, 11 nt, Human
gcaugguuuag

SEQ ID NO: 519806 - RNA, 22 nt, Human
auuuucuucucacauuuauauu

SEQ ID NO: 519807 - RNA, 17 nt, Human
caaauccaaugaaauga

SEQ ID NO: 519808 - RNA, 13 nt, Human
aggcuagauguau

SEQ ID NO: 519809 - RNA, 14 nt, Human
cucaccccuugcca

SEQ ID NO: 519810 - RNA, 23 nt, Human
uuuuauagcuacuaauuuuaaaa

SEQ ID NO: 519811 - RNA, 20 nt, Human
guccccuauccuacuucccc

SEQ ID NO: 519812 - RNA, 23 nt, Human
aauauuuauuuuaauaauguuuc

SEQ ID NO: 519813 - RNA, 20 nt, Human
gaaaauaacgauaaaagaca

SEQ ID NO: 519814 - RNA, 22 nt, Human
acaugagguacugagagugaac

SEQ ID NO: 519815 - RNA, 16 nt, Human
aaagaucugcaacuac

SEQ ID NO: 519816 - RNA, 21 nt, Human
gcccauccugccccugagccc

SEQ ID NO: 519817 - RNA, 23 nt, Human
uaacgauaaaagacagugaaaga

SEQ ID NO: 519818 - RNA, 17 nt, Human
ugaucaccugcccugcu

SEQ ID NO: 519819 - RNA, 13 nt, Human
aaaugggaaacaa

SEQ ID NO: 519820 - RNA, 12 nt, Human
ucccccucuggc

SEQ ID NO: 519821 - RNA, 23 nt, Human
aguacucauacauguuacaacac

SEQ ID NO: 519822 - RNA, 16 nt, Human
ucccugccccccagcc

SEQ ID NO: 519823 - RNA, 20 nt, Human
aggcugagaugggagaauca

SEQ ID NO: 519824 - RNA, 20 nt, Human
accuacacgagauacagaau

SEQ ID NO: 519825 - RNA, 12 nt, Human
ugagagacacac

SEQ ID NO: 519826 - RNA, 15 nt, Human
ucaguuuuugugaaa

SEQ ID NO: 519827 - RNA, 16 nt, Human
gccaaggaugccccgu

SEQ ID NO: 519828 - RNA, 13 nt, Human
aaauauaaagcaa

SEQ ID NO: 519829 - RNA, 14 nt, Human
uaaaauccauacau

SEQ ID NO: 519830 - RNA, 14 nt, Human
aaaagacagugaaa

SEQ ID NO: 519831 - RNA, 16 nt, Human
uccugcaauuccacuu

SEQ ID NO: 519832 - RNA, 23 nt, Human
gauauuaaccaggggccaugaau

SEQ ID NO: 519833 - RNA, 22 nt, Human
aauuuaaaaaaaaaccugagcc

SEQ ID NO: 519834 - RNA, 18 nt, Human
cccucuggcuccagcugg

SEQ ID NO: 519835 - RNA, 14 nt, Human
uauaauuuaaaaua

SEQ ID NO: 519836 - RNA, 14 nt, Human
auuauuuuuuaaaa

SEQ ID NO: 519837 - RNA, 16 nt, Human
ccugagcgacagugag

SEQ ID NO: 519838 - RNA, 16 nt, Human
aaaaugugauauguac

SEQ ID NO: 519839 - RNA, 13 nt, Human
aggaaaaaauaac

SEQ ID NO: 519840 - RNA, 21 nt, Human
ugagcucagcccuggugggca

SEQ ID NO: 519841 - RNA, 22 nt, Human
uaaaauaauuuuuauauuugaa

SEQ ID NO: 519842 - RNA, 15 nt, Human
cuacuaauuuuaaaa

SEQ ID NO: 519843 - RNA, 19 nt, Human
cagcuacuugggaggcuga

SEQ ID NO: 519844 - RNA, 20 nt, Human
caaacauccuacaagacaca

SEQ ID NO: 519845 - RNA, 19 nt, Human
aaugaauggcuaagcaaaa

SEQ ID NO: 519846 - RNA, 18 nt, Human
agauccccaagccuggca

SEQ ID NO: 519847 - RNA, 21 nt, Human
aaaauaugccccauucaacau

SEQ ID NO: 519848 - RNA, 14 nt, Human
auccaaugaaauga

SEQ ID NO: 519849 - RNA, 16 nt, Human
gucuaucuuugagcgc

SEQ ID NO: 519850 - RNA, 14 nt, Human
aaucucaauauuuc

SEQ ID NO: 519851 - RNA, 20 nt, Human
caagccuccuuuuaaaguaa

SEQ ID NO: 519852 - RNA, 18 nt, Human
aaaagacaaggaaaaaau

SEQ ID NO: 519853 - RNA, 14 nt, Human
gcaaauauaaacag

SEQ ID NO: 519854 - RNA, 16 nt, Human
ucaaaagaaagaaaau

SEQ ID NO: 519855 - RNA, 10 nt, Human
auguuuucag

SEQ ID NO: 519856 - RNA, 12 nt, Human
cuugguuuuaau

SEQ ID NO: 519857 - RNA, 15 nt, Human
aaucucaauauuuca

SEQ ID NO: 519858 - RNA, 20 nt, Human
aaucuuuauaguucuacucc

SEQ ID NO: 519859 - RNA, 20 nt, Human
gaacguaaucguguccccua

SEQ ID NO: 519860 - RNA, 18 nt, Human
caaggcugauuaaaccaa

SEQ ID NO: 519861 - RNA, 20 nt, Human
cacuguggguagacacacau

SEQ ID NO: 519862 - RNA, 22 nt, Human
gaggggagcaugggaagugacg

SEQ ID NO: 519863 - RNA, 14 nt, Human
agacaucaacagau

SEQ ID NO: 519864 - RNA, 21 nt, Human
aaaagguauuuuaaucaccaa

SEQ ID NO: 519865 - RNA, 15 nt, Human
cucaacaaacauaau

SEQ ID NO: 519866 - RNA, 20 nt, Human
uauacugugugcuaaaacaa

SEQ ID NO: 519867 - RNA, 16 nt, Human
ugaaauuguauuacaa

SEQ ID NO: 519868 - RNA, 20 nt, Human
uaacaagccuccuuuuaaag

SEQ ID NO: 519869 - RNA, 18 nt, Human
auagucaaauugugugaa

SEQ ID NO: 519870 - RNA, 14 nt, Human
cagugaaagaaaau

SEQ ID NO: 519871 - RNA, 21 nt, Human
aaauaauuuuuauauuugaaa

SEQ ID NO: 519872 - RNA, 18 nt, Human
auaacaacaacaacaaaa

SEQ ID NO: 519873 - RNA, 12 nt, Human
gaagaccucauu

SEQ ID NO: 519874 - RNA, 22 nt, Human
gcuaaaacaagcacuaaacaaa

SEQ ID NO: 519875 - RNA, 18 nt, Human
uuuucucuccucucccca

SEQ ID NO: 519876 - RNA, 14 nt, Human
caagcaaauauaaa

SEQ ID NO: 519877 - RNA, 18 nt, Human
uuuauggcacuaguauuu

SEQ ID NO: 519878 - RNA, 21 nt, Human
auauaugcuaagucuuauaua

SEQ ID NO: 519879 - RNA, 23 nt, Human
cucagucucccucccuuggggcc

SEQ ID NO: 519880 - RNA, 16 nt, Human
aaaaauuccaagugau

SEQ ID NO: 519881 - RNA, 15 nt, Human
gccucuuagaugcag

SEQ ID NO: 519882 - RNA, 20 nt, Human
uauuuauuacuguaagaaaa

SEQ ID NO: 519883 - RNA, 16 nt, Human
uguucuauaacaacaa

SEQ ID NO: 519884 - RNA, 15 nt, Human
acucaccucccccau

SEQ ID NO: 519885 - RNA, 22 nt, Human
cuuguaaaggaauuuaaaaauc

SEQ ID NO: 519886 - RNA, 15 nt, Human
agacaaggaaaaaau

SEQ ID NO: 519887 - RNA, 22 nt, Human
aauaauccuaaacauaugaauu

SEQ ID NO: 519888 - RNA, 23 nt, Human
aauguagcagcucauaaaugaaa

SEQ ID NO: 519889 - RNA, 21 nt, Human
cuaccaaaaaucucaauauuu

SEQ ID NO: 519890 - RNA, 22 nt, Human
ggcauuuaggccaugggacagg

SEQ ID NO: 519891 - RNA, 19 nt, Human
cccugccccccagcccucc

SEQ ID NO: 519892 - RNA, 17 nt, Human
cuaacaggaauuuucau

SEQ ID NO: 519893 - RNA, 22 nt, Human
cuacuauccaacuuauauuucu

SEQ ID NO: 519894 - RNA, 18 nt, Human
uuacuguaagaaaauauc

SEQ ID NO: 519895 - RNA, 20 nt, Human
uaaaagacagugaaagaaaa

SEQ ID NO: 519896 - RNA, 12 nt, Human
ucaccccuugcc

SEQ ID NO: 519897 - RNA, 15 nt, Human
aagaagugaaaaucu

SEQ ID NO: 519898 - RNA, 22 nt, Human
uuuccaagcaaguauuagaaua

SEQ ID NO: 519899 - RNA, 18 nt, Human
ccaagccuggcaagggaa

SEQ ID NO: 519900 - RNA, 15 nt, Human
cagucucccucccuu

SEQ ID NO: 519901 - RNA, 15 nt, Human
uccagauccuggaaa

SEQ ID NO: 519902 - RNA, 21 nt, Human
aaacgaggauugggaaaaagu

SEQ ID NO: 519903 - RNA, 18 nt, Human
gaaaauaacgauaaaaga

SEQ ID NO: 519904 - RNA, 18 nt, Human
ucuucuggguuccuuccu

SEQ ID NO: 519905 - RNA, 20 nt, Human
auucccagccagcacagccu

SEQ ID NO: 519906 - RNA, 21 nt, Human
gaaaaguauguuagugcaaau

SEQ ID NO: 519907 - RNA, 21 nt, Human
cuucucacauuuauauuuuug

SEQ ID NO: 519908 - RNA, 20 nt, Human
uguaagaaaauaucacuugu

SEQ ID NO: 519909 - RNA, 23 nt, Human
cuaguaauuggaaaggcagcucu

SEQ ID NO: 519910 - RNA, 12 nt, Human
uuaauaaaccau

SEQ ID NO: 519911 - RNA, 18 nt, Human
gaugccccgucccccucu

SEQ ID NO: 519912 - RNA, 18 nt, Human
ccugcaaagcccagcuug

SEQ ID NO: 519913 - RNA, 19 nt, Human
agcuacuaauuuuaaaaug

SEQ ID NO: 519914 - RNA, 13 nt, Human
gagacagcucugc

SEQ ID NO: 519915 - RNA, 21 nt, Human
gacagucaccucauggaauug

SEQ ID NO: 519916 - RNA, 21 nt, Human
auaugcucuaaacauguuuau

SEQ ID NO: 519917 - RNA, 20 nt, Human
cagcuggccgggagccugau

SEQ ID NO: 519918 - RNA, 22 nt, Human
ugaagcaaaauuuuuucucuag

SEQ ID NO: 519919 - RNA, 16 nt, Human
acaaggaugaauuaag

SEQ ID NO: 519920 - RNA, 21 nt, Human
auucauagcagcuuauucaca

SEQ ID NO: 519921 - RNA, 17 nt, Human
cuccuuaucaaaggaca

SEQ ID NO: 519922 - RNA, 14 nt, Human
cagucucccucccu

SEQ ID NO: 519923 - RNA, 15 nt, Human
cucccugccccccag

SEQ ID NO: 519924 - RNA, 17 nt, Human
ugcacaucaaaauaugc

SEQ ID NO: 519925 - RNA, 20 nt, Human
aaagacagugaaagaaaaua

SEQ ID NO: 519926 - RNA, 13 nt, Human
ugauuauauguca

SEQ ID NO: 519927 - RNA, 14 nt, Human
cuggaaaucagggu

SEQ ID NO: 519928 - RNA, 22 nt, Human
aaauguugacaugggacauuug

SEQ ID NO: 519929 - RNA, 12 nt, Human
uucagccugaaa

SEQ ID NO: 519930 - RNA, 16 nt, Human
cagggacuugaaccca

SEQ ID NO: 519931 - RNA, 16 nt, Human
aauuucuucaacuccc

SEQ ID NO: 519932 - RNA, 21 nt, Human
cacuugaacccgggaggcaga

SEQ ID NO: 519933 - RNA, 15 nt, Human
uccuacaagacacag

SEQ ID NO: 519934 - RNA, 13 nt, Human
cugcacuccagcc

SEQ ID NO: 519935 - RNA, 19 nt, Human
acagugauuaccagggacu

SEQ ID NO: 519936 - RNA, 19 nt, Human
caagaagauaaucuccaaa

SEQ ID NO: 519937 - RNA, 14 nt, Human
cagauccuggaaau

SEQ ID NO: 519938 - RNA, 17 nt, Human
agcagcucauaaaugaa

SEQ ID NO: 519939 - RNA, 15 nt, Human
ugggacagggaggac

SEQ ID NO: 519940 - RNA, 16 nt, Human
ggcugagccucagucu

SEQ ID NO: 519941 - RNA, 15 nt, Human
uauaauuuaaauaua

SEQ ID NO: 519942 - RNA, 18 nt, Human
cccaagccuggcaaggga

SEQ ID NO: 519943 - RNA, 15 nt, Human
ugcuguauuuuaaaa

SEQ ID NO: 519944 - RNA, 18 nt, Human
aaagagugaaggauuuau

SEQ ID NO: 519945 - RNA, 16 nt, Human
cccacuggacucaccu

SEQ ID NO: 519946 - RNA, 20 nt, Human
aagaugguaccaccagucug

SEQ ID NO: 519947 - RNA, 15 nt, Human
aucaaaggacaccau

SEQ ID NO: 519948 - RNA, 16 nt, Human
cuggccuucggccucc

SEQ ID NO: 519949 - RNA, 17 nt, Human
cuuucccaacagcucca

SEQ ID NO: 519950 - RNA, 18 nt, Human
aaaaucuuauaauuuaaa

SEQ ID NO: 519951 - RNA, 15 nt, Human
acugaagaagcacca

SEQ ID NO: 519952 - RNA, 19 nt, Human
agucaaauugugugaaagg

SEQ ID NO: 519953 - RNA, 16 nt, Human
ugacaagcucacagac

SEQ ID NO: 519954 - RNA, 16 nt, Human
ugacacuuaaaaaugg

SEQ ID NO: 519955 - RNA, 20 nt, Human
augguuuagaaagcuugccc

SEQ ID NO: 519956 - RNA, 22 nt, Human
cacuuccaagagccuuuuuuug

SEQ ID NO: 519957 - RNA, 17 nt, Human
ccaaggaugccccgucc

SEQ ID NO: 519958 - RNA, 21 nt, Human
uuucauuguucuauaacaaca

SEQ ID NO: 519959 - RNA, 18 nt, Human
aaaguaacccuacaaaac

SEQ ID NO: 519960 - RNA, 19 nt, Human
acaauaacgauaaaagaca

SEQ ID NO: 519961 - RNA, 14 nt, Human
cucuggcuccagcu

SEQ ID NO: 519962 - RNA, 16 nt, Human
ccuaugcagaggucca

SEQ ID NO: 519963 - RNA, 17 nt, Human
auaauuuaaauauaugc

SEQ ID NO: 519964 - RNA, 16 nt, Human
uucaguuauuauauuu

SEQ ID NO: 519965 - RNA, 21 nt, Human
uguauaaaauaauuuuuauau

SEQ ID NO: 519966 - RNA, 15 nt, Human
auaauccuaaacaua

SEQ ID NO: 519967 - RNA, 19 nt, Human
ccccuauccuacuuccccu

SEQ ID NO: 519968 - RNA, 19 nt, Human
cccugcaaagcccagcuug

SEQ ID NO: 519969 - RNA, 17 nt, Human
agugagacagcucugca

SEQ ID NO: 519970 - RNA, 19 nt, Human
acucugucucaguccauga

SEQ ID NO: 519971 - RNA, 23 nt, Human
uuauagcuacuaauuuuaaaaug

SEQ ID NO: 519972 - RNA, 15 nt, Human
ccucauguccacugg

SEQ ID NO: 519973 - RNA, 18 nt, Human
cugagccuugggaccccu

SEQ ID NO: 519974 - RNA, 16 nt, Human
accuuacuucuucuca

SEQ ID NO: 519975 - RNA, 15 nt, Human
uaacaauaaaagaca

SEQ ID NO: 519976 - RNA, 14 nt, Human
auuuauuuuaauaa

SEQ ID NO: 519977 - RNA, 15 nt, Human
aucaauuuaaaaaaa

SEQ ID NO: 519978 - RNA, 23 nt, Human
ucuagcaugucgucaaagcugaa

SEQ ID NO: 519979 - RNA, 14 nt, Human
acauauauaacaau

SEQ ID NO: 519980 - RNA, 20 nt, Human
aaaaaccugagccccaaaag

SEQ ID NO: 519981 - RNA, 20 nt, Human
cacagcacgggggccaagga

SEQ ID NO: 519982 - RNA, 21 nt, Human
gaaaacaauaacgauaaaaga

SEQ ID NO: 519983 - RNA, 13 nt, Human
agaaguaaaaaca

SEQ ID NO: 519984 - RNA, 22 nt, Human
agacucgggauuaguacacacu

SEQ ID NO: 519985 - RNA, 17 nt, Human
gcaaauugucacaggac

SEQ ID NO: 519986 - RNA, 22 nt, Human
uucaauaucuuuuuuuuaauaa

SEQ ID NO: 519987 - RNA, 20 nt, Human
cuucaacucccugcccccca

SEQ ID NO: 519988 - RNA, 23 nt, Human
ugaaaaucuuauaauuuaaaaua

SEQ ID NO: 519989 - RNA, 19 nt, Human
ggagccugaucaccugccc

SEQ ID NO: 519990 - RNA, 22 nt, Human
aagagccuuuuuuugaaaaaaa

SEQ ID NO: 519991 - RNA, 18 nt, Human
cuuugagcgcccacuaga

SEQ ID NO: 519992 - RNA, 13 nt, Human
gacaaggaaaaaa

SEQ ID NO: 519993 - RNA, 17 nt, Human
aauaugcucuaaacaug

SEQ ID NO: 519994 - RNA, 15 nt, Human
auaucaauuuaaaaa

SEQ ID NO: 519995 - RNA, 16 nt, Human
auccuugaagauuuac

SEQ ID NO: 519996 - RNA, 16 nt, Human
gacaagcucacagacc

SEQ ID NO: 519997 - RNA, 16 nt, Human
ccucagucucccuccc

SEQ ID NO: 519998 - RNA, 18 nt, Human
gcaaagcccagcuugaaa

SEQ ID NO: 519999 - RNA, 16 nt, Human
auugucuagugaaacu

SEQ ID NO: 520000 - RNA, 13 nt, Human
cugccuucucaac

SEQ ID NO: 520001 - RNA, 18 nt, Human
cagccucuuagaugcagu

SEQ ID NO: 520002 - RNA, 13 nt, Human
acuaauuuuaaaa

SEQ ID NO: 520003 - RNA, 12 nt, Human
caggacagcccu

SEQ ID NO: 520004 - RNA, 20 nt, Human
auuacauuuguauaaaauaa

SEQ ID NO: 520005 - RNA, 18 nt, Human
guuucaaacauauauaac

SEQ ID NO: 520006 - RNA, 14 nt, Human
uaaaagacaaggaa

SEQ ID NO: 520007 - RNA, 15 nt, Human
gugaccacugcagaa

SEQ ID NO: 520008 - RNA, 17 nt, Human
guuuaauaauuuuuaau

SEQ ID NO: 520009 - RNA, 19 nt, Human
aaaauaacaauaaaagaca

SEQ ID NO: 520010 - RNA, 21 nt, Human
ucuuaggguuaugauuaagua

SEQ ID NO: 520011 - RNA, 23 nt, Human
ggaugguucccuugaugaagaag

SEQ ID NO: 520012 - RNA, 21 nt, Human
uuuguauaaaauaauuuuuau

SEQ ID NO: 520013 - RNA, 19 nt, Human
cagauccccaagccuggca

SEQ ID NO: 520014 - RNA, 19 nt, Human
cuggacucaccucccccau

SEQ ID NO: 520015 - RNA, 14 nt, Human
aauugaaaauggua

SEQ ID NO: 520016 - RNA, 17 nt, Human
cuggagggaagccuugg

SEQ ID NO: 520017 - RNA, 16 nt, Human
agugucaaugcagccc

SEQ ID NO: 520018 - RNA, 18 nt, Human
uguauuauuuuuuaaaaa

SEQ ID NO: 520019 - RNA, 20 nt, Human
uuugcaagccagauuuuccu

SEQ ID NO: 520020 - RNA, 18 nt, Human
gaccccugagcuugcaga

SEQ ID NO: 520021 - RNA, 21 nt, Human
cccccucuggcuccagcuggc

SEQ ID NO: 520022 - RNA, 14 nt, Human
ccugccccccagcc

SEQ ID NO: 520023 - RNA, 16 nt, Human
cacuaguauuucuaug

SEQ ID NO: 520024 - RNA, 16 nt, Human
cuucggccuccauccu

SEQ ID NO: 520025 - RNA, 14 nt, Human
uacuaauuuuaaaa

SEQ ID NO: 520026 - RNA, 17 nt, Human
uaacgauaaaagacagu

SEQ ID NO: 520027 - RNA, 14 nt, Human
uaacuaauuuuaac

SEQ ID NO: 520028 - RNA, 18 nt, Human
caagccucauguccacug

SEQ ID NO: 520029 - RNA, 22 nt, Human
ugguuguauuauuuuuuaaaaa

SEQ ID NO: 520030 - RNA, 20 nt, Human
ugguuguauuauuuuuuaaa

SEQ ID NO: 520031 - RNA, 14 nt, Human
cugcugagucccag

SEQ ID NO: 520032 - RNA, 18 nt, Human
gaagcaaaauuuuuucuc

SEQ ID NO: 520033 - RNA, 23 nt, Human
ccccucuggcuccagcuggccgg

SEQ ID NO: 520034 - RNA, 15 nt, Human
aagugaaaaucuaca

SEQ ID NO: 520035 - RNA, 11 nt, Human
aaccugagccc

SEQ ID NO: 520036 - RNA, 14 nt, Human
aauauaaacagcaa

SEQ ID NO: 520037 - RNA, 23 nt, Human
gcuuuggucuaucuuugagcgcc

SEQ ID NO: 520038 - RNA, 22 nt, Human
ggcuaagcuucacuguaaaaua

SEQ ID NO: 520039 - RNA, 16 nt, Human
auacauguuacaacac

SEQ ID NO: 520040 - RNA, 17 nt, Human
acuuccagauccuggaa

SEQ ID NO: 520041 - RNA, 14 nt, Human
uuaaagaucugcaa

SEQ ID NO: 520042 - RNA, 15 nt, Human
gcuguauuuuaaaag

SEQ ID NO: 520043 - RNA, 15 nt, Human
agggcucacagaauu

SEQ ID NO: 520044 - RNA, 19 nt, Human
uugugccccugcacuccag

SEQ ID NO: 520045 - RNA, 20 nt, Human
uauaaagcaagauaauaaaa

SEQ ID NO: 520046 - RNA, 13 nt, Human
aaauccuugaaga

SEQ ID NO: 520047 - RNA, 22 nt, Human
agcccuccuuaucaaaggacac

SEQ ID NO: 520048 - RNA, 18 nt, Human
acucuuaagaagacugca

SEQ ID NO: 520049 - RNA, 20 nt, Human
acaagacacagugaccauac

SEQ ID NO: 520050 - RNA, 14 nt, Human
uucacauuuaaaua

SEQ ID NO: 520051 - RNA, 18 nt, Human
gaggcuccacuuggucug

SEQ ID NO: 520052 - RNA, 20 nt, Human
uacaucccuuaccugggaaa

SEQ ID NO: 520053 - RNA, 23 nt, Human
guaauuccguagguuauuuucag

SEQ ID NO: 520054 - RNA, 18 nt, Human
uauaacaaugcuguauuu

SEQ ID NO: 520055 - RNA, 19 nt, Human
acuccauuaaauauaaagc

SEQ ID NO: 520056 - RNA, 21 nt, Human
uaaaagacagugaaagaaaau

SEQ ID NO: 520057 - RNA, 13 nt, Human
caacucccugccc

SEQ ID NO: 520058 - RNA, 18 nt, Human
gcacuccagccugagcga

SEQ ID NO: 520059 - RNA, 15 nt, Human
cacaggacagcccuu

SEQ ID NO: 520060 - RNA, 13 nt, Human
aagaaaauaacga

SEQ ID NO: 520061 - RNA, 23 nt, Human
caccaaggagccaaacauccuac

SEQ ID NO: 520062 - RNA, 22 nt, Human
gaaauaagccagacaucaacag

SEQ ID NO: 520063 - RNA, 19 nt, Human
auuguaguccuguaaugga

SEQ ID NO: 520064 - RNA, 18 nt, Human
cagauuugagcucagccc

SEQ ID NO: 520065 - RNA, 14 nt, Human
aagcaucacaugaa

SEQ ID NO: 520066 - RNA, 21 nt, Human
uaguauuucuaugaaauauua

SEQ ID NO: 520067 - RNA, 15 nt, Human
uaucaauuuaaaaaa

SEQ ID NO: 520068 - RNA, 12 nt, Human
uuuuauauuuga

SEQ ID NO: 520069 - RNA, 13 nt, Human
agacagcucugca

SEQ ID NO: 520070 - RNA, 15 nt, Human
auccaacuuauauuu

SEQ ID NO: 520071 - RNA, 23 nt, Human
uuuauaugcuucuguuuuauaau

SEQ ID NO: 520072 - RNA, 21 nt, Human
cugcccugcugagucccaggc

SEQ ID NO: 520073 - RNA, 17 nt, Human
auauuugaaauauugac

SEQ ID NO: 520074 - RNA, 24 nt, Human
uggccgggagccugaucaccugcc

SEQ ID NO: 520075 - RNA, 20 nt, Human
cuuauauuucugcuuucaaa

SEQ ID NO: 520076 - RNA, 20 nt, Human
accucauggaauuggagcuc

SEQ ID NO: 520077 - RNA, 12 nt, Human
gauaaaagacag

SEQ ID NO: 520078 - RNA, 15 nt, Human
cuguaaaauaauaac

SEQ ID NO: 520079 - RNA, 14 nt, Human
auugucuagugaaa

SEQ ID NO: 520080 - RNA, 21 nt, Human
gcaaaauuuuuucucuaggaa

SEQ ID NO: 520081 - RNA, 17 nt, Human
agcuacuaauuuuaaaa

SEQ ID NO: 520082 - RNA, 19 nt, Human
guacaagagcuuaacagug

SEQ ID NO: 520083 - RNA, 22 nt, Human
aauguagcagcucauaaaugaa

SEQ ID NO: 520084 - RNA, 13 nt, Human
cacuguaaaauaa

SEQ ID NO: 520085 - RNA, 14 nt, Human
ugagcucagcccug

SEQ ID NO: 520086 - RNA, 18 nt, Human
agugucaaugcagccccc

SEQ ID NO: 520087 - RNA, 13 nt, Human
acaaggaaaaaau

SEQ ID NO: 520088 - RNA, 21 nt, Human
caacaacaaaagcgauuauua

SEQ ID NO: 520089 - RNA, 16 nt, Human
ugcuaagucuuauaua

SEQ ID NO: 520090 - RNA, 17 nt, Human
uaucaauuuaaaaaaaa

SEQ ID NO: 520091 - RNA, 20 nt, Human
auuuugugauugauuauaug

SEQ ID NO: 520092 - RNA, 18 nt, Human
uuguaaaggaauuuaaaa

SEQ ID NO: 520093 - RNA, 17 nt, Human
aaauauaaauaaaaaua

SEQ ID NO: 520094 - RNA, 16 nt, Human
ccuaagugcagccccg

SEQ ID NO: 520095 - RNA, 14 nt, Human
agucugacuguuuc

SEQ ID NO: 520096 - RNA, 18 nt, Human
acagagacagaaagcaga

SEQ ID NO: 520097 - RNA, 13 nt, Human
ccuccuuuuaaag

SEQ ID NO: 520098 - RNA, 23 nt, Human
auuuuauagcuacuaauuuuaaa

SEQ ID NO: 520099 - RNA, 16 nt, Human
ugagcucagcccuggu

SEQ ID NO: 520100 - RNA, 23 nt, Human
agcaugucgucaaagcugaaaug

SEQ ID NO: 520101 - RNA, 15 nt, Human
ucauaauaaguugca

SEQ ID NO: 520102 - RNA, 15 nt, Human
ugccccgucccccuc

SEQ ID NO: 520103 - RNA, 19 nt, Human
gguuuaauaauuuuuaauu

SEQ ID NO: 520104 - RNA, 14 nt, Human
uauaauguagcagc

SEQ ID NO: 520105 - RNA, 17 nt, Human
aauaacgauaaaagaca

SEQ ID NO: 520106 - RNA, 12 nt, Human
uauuauuuuuua

SEQ ID NO: 520107 - RNA, 12 nt, Human
uauaauuuaaaa

SEQ ID NO: 520108 - RNA, 14 nt, Human
ugcucauggaauug

SEQ ID NO: 520109 - RNA, 17 nt, Human
aagacaaggaaaaaaua

SEQ ID NO: 520110 - RNA, 22 nt, Human
uggguuccuuccucugagccuu

SEQ ID NO: 520111 - RNA, 16 nt, Human
ucaguuuuugugaaaa

SEQ ID NO: 520112 - RNA, 14 nt, Human
ugguauguuuucag

SEQ ID NO: 520113 - RNA, 15 nt, Human
agccugaaagaggaa

SEQ ID NO: 520114 - RNA, 18 nt, Human
acaaaugcauuucuaaag

SEQ ID NO: 520115 - RNA, 14 nt, Human
ugacacuuaaaaau

SEQ ID NO: 520116 - RNA, 13 nt, Human
aagugcagccccg

SEQ ID NO: 520117 - RNA, 15 nt, Human
uaaaugaaauugaaa

SEQ ID NO: 520118 - RNA, 19 nt, Human
auuuucaguuauuauauuu

SEQ ID NO: 520119 - RNA, 16 nt, Human
ggcagagagguaggga

SEQ ID NO: 520120 - RNA, 23 nt, Human
gaaaacaauaacgauaaaagaca

SEQ ID NO: 520121 - RNA, 22 nt, Human
caauaaaagacaaggaaaaaau

SEQ ID NO: 520122 - RNA, 18 nt, Human
cugcucaauaaaguacaa

SEQ ID NO: 520123 - RNA, 20 nt, Human
uaagugaaauaagccagaca

SEQ ID NO: 520124 - RNA, 17 nt, Human
uuccaagugauugaaac

SEQ ID NO: 520125 - RNA, 15 nt, Human
gaccacugcagaaga

SEQ ID NO: 520126 - RNA, 16 nt, Human
auuugaugcuacagga

SEQ ID NO: 520127 - RNA, 15 nt, Human
uuuaugguuguauua

SEQ ID NO: 520128 - RNA, 22 nt, Human
agaaugagagacacacugaaga

SEQ ID NO: 520129 - RNA, 19 nt, Human
auacuaauuauacccccug

SEQ ID NO: 520130 - RNA, 17 nt, Human
gacaaggaaaaaauaac

SEQ ID NO: 520131 - RNA, 13 nt, Human
acuguaaaauaau

SEQ ID NO: 520132 - RNA, 23 nt, Human
cucauacuauuuaagagaacaag

SEQ ID NO: 520133 - RNA, 13 nt, Human
ucuauaacaacaa

SEQ ID NO: 520134 - RNA, 21 nt, Human
ugaugcuacaggauuugaaau

SEQ ID NO: 520135 - RNA, 15 nt, Human
auauugacuuuuuau

SEQ ID NO: 520136 - RNA, 16 nt, Human
agagguccacaacaca

SEQ ID NO: 520137 - RNA, 13 nt, Human
uuuaaaaaaaaac

SEQ ID NO: 520138 - RNA, 21 nt, Human
gaaaugaguuuuucuuuucau

SEQ ID NO: 520139 - RNA, 22 nt, Human
agaaagugacaagcucacagac

SEQ ID NO: 520140 - RNA, 23 nt, Human
aguucuacuccauuaaauauaaa

SEQ ID NO: 520141 - RNA, 15 nt, Human
cccccagcccuccuu

SEQ ID NO: 520142 - RNA, 16 nt, Human
cugcugagucccaggc

SEQ ID NO: 520143 - RNA, 21 nt, Human
aaaauuuuuucucuaggaaau

SEQ ID NO: 520144 - RNA, 22 nt, Human
gucacaggaaguagaggaggcc

SEQ ID NO: 520145 - RNA, 14 nt, Human
aaccugagccccaa

SEQ ID NO: 520146 - RNA, 14 nt, Human
auauuuauuuuaau

SEQ ID NO: 520147 - RNA, 17 nt, Human
ccuacuuccccuuccua

SEQ ID NO: 520148 - RNA, 14 nt, Human
gaaagcagaacagu

SEQ ID NO: 520149 - RNA, 16 nt, Human
cacuggacucaccucc

SEQ ID NO: 520150 - RNA, 19 nt, Human
agaaaauaacaauaaaaga

SEQ ID NO: 520151 - RNA, 13 nt, Human
acaagagcuuaac

SEQ ID NO: 520152 - RNA, 20 nt, Human
ucacaugaacuuguaaagga

SEQ ID NO: 520153 - RNA, 18 nt, Human
uaaugaauacuuuauaaa

SEQ ID NO: 520154 - RNA, 15 nt, Human
gacaguauggcagcu

SEQ ID NO: 520155 - RNA, 16 nt, Human
agugagacagcucugc

SEQ ID NO: 520156 - RNA, 17 nt, Human
auaaaguacaagagcuu

SEQ ID NO: 520157 - RNA, 20 nt, Human
acaagcaaauauaaacagca

SEQ ID NO: 520158 - RNA, 16 nt, Human
gcuucacuguaaaaua

SEQ ID NO: 520159 - RNA, 14 nt, Human
augggccauaugaa

SEQ ID NO: 520160 - RNA, 23 nt, Human
cucauguccacugguucuucuug

SEQ ID NO: 520161 - RNA, 23 nt, Human
acgaggauugggaaaaaguaauu

SEQ ID NO: 520162 - RNA, 15 nt, Human
ggcaauagucaaauu

SEQ ID NO: 520163 - RNA, 18 nt, Human
uggucaauuuuguuaugu

SEQ ID NO: 520164 - RNA, 15 nt, Human
aauauaaacagcaac

SEQ ID NO: 520165 - RNA, 23 nt, Human
gccccugcacuccagccugagcg

SEQ ID NO: 520166 - RNA, 22 nt, Human
uuugaugcuacaggauuugaaa

SEQ ID NO: 520167 - RNA, 23 nt, Human
augucaauucuugccaaauauaa

SEQ ID NO: 520168 - RNA, 14 nt, Human
aaagaggaaugaag

SEQ ID NO: 520169 - RNA, 12 nt, Human
uauucacaagac

SEQ ID NO: 520170 - RNA, 15 nt, Human
acagugaaagaaaau

SEQ ID NO: 520171 - RNA, 15 nt, Human
cucguggaacaguua

SEQ ID NO: 520172 - RNA, 21 nt, Human
augcuacaggauuugaaauug

SEQ ID NO: 520173 - RNA, 15 nt, Human
ccaccuuacuucuuc

SEQ ID NO: 520174 - RNA, 23 nt, Human
aaguauccuucagccugaaagag

SEQ ID NO: 520175 - RNA, 22 nt, Human
gagucccaggcugagccucagu

SEQ ID NO: 520176 - RNA, 12 nt, Human
cagauuuuccug

SEQ ID NO: 520177 - RNA, 15 nt, Human
uagggugauauuaac

SEQ ID NO: 520178 - RNA, 19 nt, Human
auuaaguuuuuuuuuaaaa

SEQ ID NO: 520179 - RNA, 12 nt, Human
cuaagaagugaa

SEQ ID NO: 520180 - RNA, 12 nt, Human
acacuuaaaaau

SEQ ID NO: 520181 - RNA, 20 nt, Human
auuuaagagaacaagcaaau

SEQ ID NO: 520182 - RNA, 16 nt, Human
aaaagcaucacaugaa

SEQ ID NO: 520183 - RNA, 16 nt, Human
gaaaaugguauuaaag

SEQ ID NO: 520184 - RNA, 21 nt, Human
cuaagcuucacuguaaaauaa

SEQ ID NO: 520185 - RNA, 16 nt, Human
uauaucaauuuaaaaa

SEQ ID NO: 520186 - RNA, 18 nt, Human
ucucuaggaaauauuuau

SEQ ID NO: 520187 - RNA, 22 nt, Human
auauaugcuaagucuuauauau

SEQ ID NO: 520188 - RNA, 20 nt, Human
aaggagccaaacauccuaca

SEQ ID NO: 520189 - RNA, 18 nt, Human
ucuucaacucccugcccc

SEQ ID NO: 520190 - RNA, 22 nt, Human
cauaaauguugacaugggacau

SEQ ID NO: 520191 - RNA, 16 nt, Human
uggcaagcucuaucac

SEQ ID NO: 520192 - RNA, 12 nt, Human
cacaacacacag

SEQ ID NO: 520193 - RNA, 13 nt, Human
uaacaauaaaaga

SEQ ID NO: 520194 - RNA, 22 nt, Human
gucucuacuaaaaauacaaaaa

SEQ ID NO: 520195 - RNA, 18 nt, Human
cagaaagcagaacaguga

SEQ ID NO: 520196 - RNA, 14 nt, Human
uaauccuaaacaua

SEQ ID NO: 520197 - RNA, 15 nt, Human
ucuggcuccagcugg

SEQ ID NO: 520198 - RNA, 16 nt, Chlamydophila pneumoniae J138
uuuuuggaaauccgua

SEQ ID NO: 520199 - RNA, 20 nt, Chlamydophila pneumoniae J138
uuuuugaaaauuuucccauu

SEQ ID NO: 520200 - RNA, 20 nt, Chlamydophila pneumoniae J138
uuucgcagauacuucuucca

SEQ ID NO: 520201 - RNA, 16 nt, Chlamydophila pneumoniae J138
uuuucucgaagaaaau

SEQ ID NO: 520202 - RNA, 14 nt, Chlamydophila pneumoniae J138
uuuucaagucugua

SEQ ID NO: 520203 - RNA, 19 nt, Chlamydophila pneumoniae J138
uuuuagguuugucgagcuu

SEQ ID NO: 520204 - RNA, 15 nt, Chlamydophila pneumoniae J138
uuuuauauuaagaau

SEQ ID NO: 520205 - RNA, 20 nt, Chlamydophila pneumoniae J138
uuuuauaaagaucgggucua

SEQ ID NO: 520206 - RNA, 19 nt, Chlamydophila pneumoniae J138
uuuuaauauuugagaagau

SEQ ID NO: 520207 - RNA, 15 nt, Chlamydophila pneumoniae J138
uuggucgaucaaggu

SEQ ID NO: 520208 - RNA, 16 nt, Chlamydophila pneumoniae J138
uuguuugcuauacaga

SEQ ID NO: 520209 - RNA, 19 nt, Chlamydophila pneumoniae J138
uuuccuugguaucccaauc

SEQ ID NO: 520210 - RNA, 18 nt, Chlamydophila pneumoniae J138
uuuaagaaaugcaaacca

SEQ ID NO: 520211 - RNA, 13 nt, Chlamydophila pneumoniae J138
uugauauccaggg

SEQ ID NO: 520212 - RNA, 17 nt, Chlamydophila pneumoniae J138
uugcaugcaacggagaa

SEQ ID NO: 520213 - RNA, 22 nt, Chlamydophila pneumoniae J138
uugcauguccauuaauauccca

SEQ ID NO: 520214 - RNA, 16 nt, Chlamydophila pneumoniae J138
uugcuugcgcaucagc

SEQ ID NO: 520215 - RNA, 14 nt, Chlamydophila pneumoniae J138
uugcuucuaagaaa

SEQ ID NO: 520216 - RNA, 18 nt, Chlamydophila pneumoniae J138
uugcuucuuccaagcagg

SEQ ID NO: 520217 - RNA, 22 nt, Chlamydophila pneumoniae J138
uugcugcagcaaaacuaggaaa

SEQ ID NO: 520218 - RNA, 21 nt, Chlamydophila pneumoniae J138
uggcauaaagaccgagaagcu

SEQ ID NO: 520219 - RNA, 15 nt, Chlamydophila pneumoniae J138
uggcaaugauauccu

SEQ ID NO: 520220 - RNA, 17 nt, Chlamydophila pneumoniae J138
uggcaaucuuuucuugu

SEQ ID NO: 520221 - RNA, 17 nt, Chlamydophila pneumoniae J138
uggaagcaaagaaaauu

SEQ ID NO: 520222 - RNA, 23 nt, Chlamydophila pneumoniae J138
uggcaaaggaccacaauuccuaa

SEQ ID NO: 520223 - RNA, 18 nt, Chlamydophila pneumoniae J138
uggaucuugauaaaagau

SEQ ID NO: 520224 - RNA, 19 nt, Chlamydophila pneumoniae J138
uggauaacacgaguuucga

SEQ ID NO: 520225 - RNA, 17 nt, Chlamydophila pneumoniae J138
uggcuggaaagccaagc

SEQ ID NO: 520226 - RNA, 18 nt, Chlamydophila pneumoniae J138
ugggaagacucucaucag

SEQ ID NO: 520227 - RNA, 19 nt, Chlamydophila pneumoniae J138
ugguaacacgagugccuuc

SEQ ID NO: 520228 - RNA, 15 nt, Chlamydophila pneumoniae J138
ugguaaggagagucu

SEQ ID NO: 520229 - RNA, 20 nt, Chlamydophila pneumoniae J138
ugucauuaaaaauuuaaaag

SEQ ID NO: 520230 - RNA, 22 nt, Chlamydophila pneumoniae J138
uguugcaauucuucaugcugcu

SEQ ID NO: 520231 - RNA, 15 nt, Chlamydophila pneumoniae J138
uguucuuuacuacau

SEQ ID NO: 520232 - RNA, 14 nt, Chlamydophila pneumoniae J138
uguugaauaagauu

SEQ ID NO: 520233 - RNA, 18 nt, Chlamydophila pneumoniae J138
uguucccaaauagaaaau

SEQ ID NO: 520234 - RNA, 20 nt, Chlamydophila pneumoniae J138
uguuagugagaucaaaaaua

SEQ ID NO: 520235 - RNA, 12 nt, Chlamydophila pneumoniae J138
uuaauuuuucua

SEQ ID NO: 520236 - RNA, 15 nt, Chlamydophila pneumoniae J138
uuaaccucuuuucuu

SEQ ID NO: 520237 - RNA, 14 nt, Chlamydophila pneumoniae J138
uuauauaaagaucu

SEQ ID NO: 520238 - RNA, 17 nt, Chlamydophila pneumoniae J138
uuauaggaauaacacca

SEQ ID NO: 520239 - RNA, 17 nt, Chlamydophila pneumoniae J138
uuaggagcauagacucu

SEQ ID NO: 520240 - RNA, 17 nt, Chlamydophila pneumoniae J138
uuaucuggagaugcgcu

SEQ ID NO: 520241 - RNA, 22 nt, Chlamydophila pneumoniae J138
uuaucacagauguaaucuugau

SEQ ID NO: 520242 - RNA, 16 nt, Chlamydophila pneumoniae J138
uucauauuuacgaaaa

SEQ ID NO: 520243 - RNA, 21 nt, Chlamydophila pneumoniae J138
uucauaacuugagccaacagg

SEQ ID NO: 520244 - RNA, 13 nt, Chlamydophila pneumoniae J138
uuccccugaaaau

SEQ ID NO: 520245 - RNA, 23 nt, Chlamydophila pneumoniae J138
uucacucguugccaaucuuucau

SEQ ID NO: 520246 - RNA, 23 nt, Chlamydophila pneumoniae J138
guuccagccugugagcucucgac

SEQ ID NO: 520247 - RNA, 23 nt, Chlamydophila pneumoniae J138
guguuccagaucaaugccuugcg

SEQ ID NO: 520248 - RNA, 13 nt, Chlamydophila pneumoniae J138
guguugaauaaga

SEQ ID NO: 520249 - RNA, 19 nt, Chlamydophila pneumoniae J138
guucccuaaaguaacgaua

SEQ ID NO: 520250 - RNA, 18 nt, Chlamydophila pneumoniae J138
guugggagcuuccuccaa

SEQ ID NO: 520251 - RNA, 14 nt, Chlamydophila pneumoniae J138
guugcuaagaucuu

SEQ ID NO: 520252 - RNA, 15 nt, Chlamydophila pneumoniae J138
guuuaauaaaucuau

SEQ ID NO: 520253 - RNA, 13 nt, Chlamydophila pneumoniae J138
uaaaguaggaauu

SEQ ID NO: 520254 - RNA, 23 nt, Chlamydophila pneumoniae J138
uaaagauuccccauaaccaauaa

SEQ ID NO: 520255 - RNA, 19 nt, Chlamydophila pneumoniae J138
uaaagaucuucauaaccaa

SEQ ID NO: 520256 - RNA, 19 nt, Chlamydophila pneumoniae J138
uaaagauguagaauaacgc

SEQ ID NO: 520257 - RNA, 21 nt, Chlamydophila pneumoniae J138
uaaagagaaucuccucaucag

SEQ ID NO: 520258 - RNA, 15 nt, Chlamydophila pneumoniae J138
uaaagagaaucuccu

SEQ ID NO: 520259 - RNA, 20 nt, Chlamydophila pneumoniae J138
uaaacuaaaaugguaaaccu

SEQ ID NO: 520260 - RNA, 17 nt, Chlamydophila pneumoniae J138
uaaacuucaaugaagaa

SEQ ID NO: 520261 - RNA, 15 nt, Chlamydophila pneumoniae J138
uaaaaucauaggcua

SEQ ID NO: 520262 - RNA, 15 nt, Chlamydophila pneumoniae J138
uaaaauaaagagcug

SEQ ID NO: 520263 - RNA, 16 nt, Chlamydophila pneumoniae J138
uaaaacacaaauagca

SEQ ID NO: 520264 - RNA, 17 nt, Chlamydophila pneumoniae J138
uaaaacaauuuccugca

SEQ ID NO: 520265 - RNA, 24 nt, Chlamydophila pneumoniae J138
uaaaagcccuaauucauauuuacg

SEQ ID NO: 520266 - RNA, 19 nt, Chlamydophila pneumoniae J138
uaauuaaauauauaaagaa

SEQ ID NO: 520267 - RNA, 14 nt, Chlamydophila pneumoniae J138
uaauuaaauauaua

SEQ ID NO: 520268 - RNA, 12 nt, Chlamydophila pneumoniae J138
uaauuacaauuu

SEQ ID NO: 520269 - RNA, 22 nt, Chlamydophila pneumoniae J138
uaauucauauuuacgaaaacau

SEQ ID NO: 520270 - RNA, 12 nt, Chlamydophila pneumoniae J138
uaauuucuuaca

SEQ ID NO: 520271 - RNA, 14 nt, Chlamydophila pneumoniae J138
uaaucauaaaaaaa

SEQ ID NO: 520272 - RNA, 10 nt, Chlamydophila pneumoniae J138
uaauccugca

SEQ ID NO: 520273 - RNA, 22 nt, Chlamydophila pneumoniae J138
uaauccuccucgaauggagugc

SEQ ID NO: 520274 - RNA, 14 nt, Chlamydophila pneumoniae J138
uaagccaaauacca

SEQ ID NO: 520275 - RNA, 15 nt, Chlamydophila pneumoniae J138
uaacuggcaaucuaa

SEQ ID NO: 520276 - RNA, 15 nt, Chlamydophila pneumoniae J138
uaacugaaaguacgc

SEQ ID NO: 520277 - RNA, 15 nt, Chlamydophila pneumoniae J138
uaaguuagagacaca

SEQ ID NO: 520278 - RNA, 13 nt, Chlamydophila pneumoniae J138
uaccguaaagaaa

SEQ ID NO: 520279 - RNA, 19 nt, Chlamydophila pneumoniae J138
uacccuuccggggugcgac

SEQ ID NO: 520280 - RNA, 14 nt, Chlamydophila pneumoniae J138
uacaucaaaaugcu

SEQ ID NO: 520281 - RNA, 18 nt, Chlamydophila pneumoniae J138
uaccaagaugaagaaacu

SEQ ID NO: 520282 - RNA, 21 nt, Chlamydophila pneumoniae J138
uagagaaagagugccaagagc

SEQ ID NO: 520283 - RNA, 14 nt, Chlamydophila pneumoniae J138
uagacgugcucucu

SEQ ID NO: 520284 - RNA, 20 nt, Chlamydophila pneumoniae J138
uacuucuguaguuuguucac

SEQ ID NO: 520285 - RNA, 15 nt, Chlamydophila pneumoniae J138
uacuacucucaucaa

SEQ ID NO: 520286 - RNA, 19 nt, Chlamydophila pneumoniae J138
uagcauuucuuucucuucg

SEQ ID NO: 520287 - RNA, 16 nt, Chlamydophila pneumoniae J138
uagcauccuguagagc

SEQ ID NO: 520288 - RNA, 14 nt, Chlamydophila pneumoniae J138
uagccaaagacucu

SEQ ID NO: 520289 - RNA, 17 nt, Chlamydophila pneumoniae J138
uagauaagaucucuccg

SEQ ID NO: 520290 - RNA, 16 nt, Chlamydophila pneumoniae J138
uagagugacucaucag

SEQ ID NO: 520291 - RNA, 23 nt, Chlamydophila pneumoniae J138
uaugccucaggucugcugaggag

SEQ ID NO: 520292 - RNA, 17 nt, Chlamydophila pneumoniae J138
uaugcacaaaauaaaac

SEQ ID NO: 520293 - RNA, 19 nt, Chlamydophila pneumoniae J138
uaucuccguuaccaaaaac

SEQ ID NO: 520294 - RNA, 18 nt, Chlamydophila pneumoniae J138
uauuuauuuuauuaguuu

SEQ ID NO: 520295 - RNA, 17 nt, Chlamydophila pneumoniae J138
uauuuagagagaaacau

SEQ ID NO: 520296 - RNA, 20 nt, Chlamydophila pneumoniae J138
ucaaaaguuccccaauuucu

SEQ ID NO: 520297 - RNA, 13 nt, Chlamydophila pneumoniae J138
ucaaaaauucuuc

SEQ ID NO: 520298 - RNA, 13 nt, Chlamydophila pneumoniae J138
ucaaaaaaaacgc

SEQ ID NO: 520299 - RNA, 23 nt, Chlamydophila pneumoniae J138
uaugcuguugcuccaagaguucu

SEQ ID NO: 520300 - RNA, 17 nt, Chlamydophila pneumoniae J138
uauggaagauaaacaua

SEQ ID NO: 520301 - RNA, 18 nt, Chlamydophila pneumoniae J138
uaugcgcucuaagagccc

SEQ ID NO: 520302 - RNA, 15 nt, Chlamydophila pneumoniae J138
uauucugaaauuucu

SEQ ID NO: 520303 - RNA, 17 nt, Chlamydophila pneumoniae J138
ucaaacaucacucagga

SEQ ID NO: 520304 - RNA, 18 nt, Chlamydophila pneumoniae J138
ucaaacuccuuuuaaaau

SEQ ID NO: 520305 - RNA, 17 nt, Chlamydophila pneumoniae J138
ucaaauucaaaauagaa

SEQ ID NO: 520306 - RNA, 20 nt, Chlamydophila pneumoniae J138
ucaaauaggaucucucuuuc

SEQ ID NO: 520307 - RNA, 23 nt, Chlamydophila pneumoniae J138
ucaacauuuugccuuuagggaaa

SEQ ID NO: 520308 - RNA, 22 nt, Chlamydophila pneumoniae J138
ucaccagaagcaacuaaacucu

SEQ ID NO: 520309 - RNA, 16 nt, Chlamydophila pneumoniae J138
ucaccagaagcauuga

SEQ ID NO: 520310 - RNA, 20 nt, Chlamydophila pneumoniae J138
ucacacuuaaagguaaaacu

SEQ ID NO: 520311 - RNA, 16 nt, Chlamydophila pneumoniae J138
ucacagagucugggau

SEQ ID NO: 520312 - RNA, 16 nt, Chlamydophila pneumoniae J138
ucacacucguagccuu

SEQ ID NO: 520313 - RNA, 13 nt, Chlamydophila pneumoniae J138
ucacaucuuucuc

SEQ ID NO: 520314 - RNA, 14 nt, Chlamydophila pneumoniae J138
ucacaucuaaagau

SEQ ID NO: 520315 - RNA, 21 nt, Chlamydophila pneumoniae J138
ucacauaguuuaauaaaucua

SEQ ID NO: 520316 - RNA, 20 nt, Chlamydophila pneumoniae J138
ucacaauuuuaaaaucuccu

SEQ ID NO: 520317 - RNA, 19 nt, Chlamydophila pneumoniae J138
ucacaauaccaucucuuuc

SEQ ID NO: 520318 - RNA, 14 nt, Chlamydophila pneumoniae J138
ucaccugagcuaua

SEQ ID NO: 520319 - RNA, 14 nt, Chlamydophila pneumoniae J138
ucagaaauuccuaa

SEQ ID NO: 520320 - RNA, 18 nt, Chlamydophila pneumoniae J138
ucagaggaaucuaagaac

SEQ ID NO: 520321 - RNA, 21 nt, Chlamydophila pneumoniae J138
ucagaaugcccuuuagggaau

SEQ ID NO: 520322 - RNA, 18 nt, Chlamydophila pneumoniae J138
ucauggauuacugaagau

SEQ ID NO: 520323 - RNA, 18 nt, Chlamydophila pneumoniae J138
ucauccccucagaaagga

SEQ ID NO: 520324 - RNA, 13 nt, Chlamydophila pneumoniae J138
ucauauuuaaaag

SEQ ID NO: 520325 - RNA, 21 nt, Chlamydophila pneumoniae J138
ucauauuuauuuaaaccagga

SEQ ID NO: 520326 - RNA, 14 nt, Chlamydophila pneumoniae J138
ucaucuagaaagau

SEQ ID NO: 520327 - RNA, 23 nt, Chlamydophila pneumoniae J138
uccacgaguucgcggaucuucuu

SEQ ID NO: 520328 - RNA, 15 nt, Chlamydophila pneumoniae J138
uccacgccaaaguac

SEQ ID NO: 520329 - RNA, 19 nt, Chlamydophila pneumoniae J138
uccagaaaguauuccucuu

SEQ ID NO: 520330 - RNA, 14 nt, Chlamydophila pneumoniae J138
uccagacuuuccuc

SEQ ID NO: 520331 - RNA, 18 nt, Chlamydophila pneumoniae J138
uccaauaauuuucccaau

SEQ ID NO: 520332 - RNA, 17 nt, Chlamydophila pneumoniae J138
uccaaugagagagagac

SEQ ID NO: 520333 - RNA, 13 nt, Chlamydophila pneumoniae J138
uccaguucuucau

SEQ ID NO: 520334 - RNA, 19 nt, Chlamydophila pneumoniae J138
uccaguagaucuucugaaa

SEQ ID NO: 520335 - RNA, 16 nt, Chlamydophila pneumoniae J138
uccccagggagaucua

SEQ ID NO: 520336 - RNA, 20 nt, Chlamydophila pneumoniae J138
uccccauaaccaauaaacuu

SEQ ID NO: 520337 - RNA, 14 nt, Chlamydophila pneumoniae J138
uccccauucacaaa

SEQ ID NO: 520338 - RNA, 12 nt, Chlamydophila pneumoniae J138
uccauagagaac

SEQ ID NO: 520339 - RNA, 17 nt, Chlamydophila pneumoniae J138
ucccccagaccuaaaaa

SEQ ID NO: 520340 - RNA, 15 nt, Chlamydophila pneumoniae J138
ucgaggccuaaaauc

SEQ ID NO: 520341 - RNA, 18 nt, Chlamydophila pneumoniae J138
ucggaccuacguuuucuc

SEQ ID NO: 520342 - RNA, 19 nt, Chlamydophila pneumoniae J138
ucgugcaggagaacaauau

SEQ ID NO: 520343 - RNA, 21 nt, Chlamydophila pneumoniae J138
ucucauuucguagacgcucua

SEQ ID NO: 520344 - RNA, 18 nt, Chlamydophila pneumoniae J138
ucucauccagacaggaca

SEQ ID NO: 520345 - RNA, 15 nt, Chlamydophila pneumoniae J138
ucucaucggcauaac

SEQ ID NO: 520346 - RNA, 16 nt, Chlamydophila pneumoniae J138
ucucaucagcaaaacu

SEQ ID NO: 520347 - RNA, 19 nt, Chlamydophila pneumoniae J138
ucuauauuuuuucccacaa

SEQ ID NO: 520348 - RNA, 15 nt, Chlamydophila pneumoniae J138
ucuaagaauauggac

SEQ ID NO: 520349 - RNA, 23 nt, Chlamydophila pneumoniae J138
ucuaagcugugcauuuucuucuu

SEQ ID NO: 520350 - RNA, 22 nt, Chlamydophila pneumoniae J138
ucuagccaauauagaagcugcu

SEQ ID NO: 520351 - RNA, 16 nt, Chlamydophila pneumoniae J138
ugaaaguacagaaagg

SEQ ID NO: 520352 - RNA, 15 nt, Chlamydophila pneumoniae J138
ucuuucauucccuuu

SEQ ID NO: 520353 - RNA, 18 nt, Chlamydophila pneumoniae J138
ucucccgugaacaaaaac

SEQ ID NO: 520354 - RNA, 17 nt, Chlamydophila pneumoniae J138
ucuccagcuucuuucua

SEQ ID NO: 520355 - RNA, 12 nt, Chlamydophila pneumoniae J138
ucuuucuuggau

SEQ ID NO: 520356 - RNA, 21 nt, Chlamydophila pneumoniae J138
ucuuugaacaaaaaggacucu

SEQ ID NO: 520357 - RNA, 20 nt, Chlamydophila pneumoniae J138
ucuuuccucucaugaaauuu

SEQ ID NO: 520358 - RNA, 19 nt, Chlamydophila pneumoniae J138
ucucccuguauuaaagaau

SEQ ID NO: 520359 - RNA, 12 nt, Chlamydophila pneumoniae J138
ugaaauuuucua

SEQ ID NO: 520360 - RNA, 23 nt, Chlamydophila pneumoniae J138
ugaaauccugggcaaugaucaaa

SEQ ID NO: 520361 - RNA, 15 nt, Chlamydophila pneumoniae J138
ugaaguuuuuucucu

SEQ ID NO: 520362 - RNA, 14 nt, Chlamydophila pneumoniae J138
ugaauaucaucacu

SEQ ID NO: 520363 - RNA, 16 nt, Chlamydophila pneumoniae J138
ugaauaccguuucagg

SEQ ID NO: 520364 - RNA, 12 nt, Chlamydophila pneumoniae J138
ugaauuaguuuc

SEQ ID NO: 520365 - RNA, 18 nt, Chlamydophila pneumoniae J138
ugaccugcuuuuuuucua

SEQ ID NO: 520366 - RNA, 22 nt, Chlamydophila pneumoniae J138
ugacgcaagagacaagaaaaua

SEQ ID NO: 520367 - RNA, 14 nt, Chlamydophila pneumoniae J138
ugagguaucaauaa

SEQ ID NO: 520368 - RNA, 18 nt, Chlamydophila pneumoniae J138
ugacucuuuuaagacaau

SEQ ID NO: 520369 - RNA, 18 nt, Chlamydophila pneumoniae J138
ugaguuuuuaauuuucug

SEQ ID NO: 520370 - RNA, 13 nt, Chlamydophila pneumoniae J138
ugaucugaaguug

SEQ ID NO: 520371 - RNA, 12 nt, Chlamydophila pneumoniae J138
ugcaauuuucua

SEQ ID NO: 520372 - RNA, 21 nt, Chlamydophila pneumoniae J138
ugcaagagccggaacuucagg

SEQ ID NO: 520373 - RNA, 22 nt, Chlamydophila pneumoniae J138
ugauuuguuuagcauagagcuc

SEQ ID NO: 520374 - RNA, 16 nt, Chlamydophila pneumoniae J138
ugcaugccuauuaagu

SEQ ID NO: 520375 - RNA, 17 nt, Chlamydophila pneumoniae J138
ugcauacccuucuucuu

SEQ ID NO: 520376 - RNA, 23 nt, Chlamydophila pneumoniae J138
gccugucacaauaccaucucuuu

SEQ ID NO: 520377 - RNA, 17 nt, Chlamydophila pneumoniae J138
gcuccuaagugauaagg

SEQ ID NO: 520378 - RNA, 21 nt, Chlamydophila pneumoniae J138
gcuacaaaauuauuaaacucg

SEQ ID NO: 520379 - RNA, 17 nt, Chlamydophila pneumoniae J138
gcucccguuccuuuagc

SEQ ID NO: 520380 - RNA, 21 nt, Chlamydophila pneumoniae J138
gcucuaccccacgcuaaacua

SEQ ID NO: 520381 - RNA, 22 nt, Chlamydophila pneumoniae J138
gcuguaaucgagagaagaaauu

SEQ ID NO: 520382 - RNA, 19 nt, Chlamydophila pneumoniae J138
gcuguggaauuuuccugag

SEQ ID NO: 520383 - RNA, 19 nt, Chlamydophila pneumoniae J138
gcuugucgcgacaagacaa

SEQ ID NO: 520384 - RNA, 12 nt, Chlamydophila pneumoniae J138
ggaaugaucccu

SEQ ID NO: 520385 - RNA, 17 nt, Chlamydophila pneumoniae J138
gcuaacaccucuucaaa

SEQ ID NO: 520386 - RNA, 16 nt, Chlamydophila pneumoniae J138
gcgguugccuuucucu

SEQ ID NO: 520387 - RNA, 14 nt, Chlamydophila pneumoniae J138
ggauguugcguuag

SEQ ID NO: 520388 - RNA, 21 nt, Chlamydophila pneumoniae J138
ggagaccuuuauagauaugcc

SEQ ID NO: 520389 - RNA, 24 nt, Chlamydophila pneumoniae J138
ggagacuugaucuacaaaaacuag

SEQ ID NO: 520390 - RNA, 19 nt, Chlamydophila pneumoniae J138
ggcaaugauagauaaaucc

SEQ ID NO: 520391 - RNA, 21 nt, Chlamydophila pneumoniae J138
gggaauuaaacuuucuucucu

SEQ ID NO: 520392 - RNA, 14 nt, Chlamydophila pneumoniae J138
ggucuguauuuucu

SEQ ID NO: 520393 - RNA, 16 nt, Chlamydophila pneumoniae J138
gguaaauuuuuaaaac

SEQ ID NO: 520394 - RNA, 14 nt, Chlamydophila pneumoniae J138
guaacgcuuuucua

SEQ ID NO: 520395 - RNA, 15 nt, Chlamydophila pneumoniae J138
guaccacauacucuu

SEQ ID NO: 520396 - RNA, 18 nt, Chlamydophila pneumoniae J138
guacacuuucaagauugu

SEQ ID NO: 520397 - RNA, 16 nt, Chlamydophila pneumoniae J138
guagucaaaaauucuu

SEQ ID NO: 520398 - RNA, 19 nt, Chlamydophila pneumoniae J138
guaguugauuuagaaucuu

SEQ ID NO: 520399 - RNA, 19 nt, Chlamydophila pneumoniae J138
guaucgagcucuuuaagaa

SEQ ID NO: 520400 - RNA, 14 nt, Chlamydophila pneumoniae J138
guacgaaaaucuac

SEQ ID NO: 520401 - RNA, 21 nt, Chlamydophila pneumoniae J138
guccuggacgauauaaucacg

SEQ ID NO: 520402 - RNA, 20 nt, Chlamydophila pneumoniae J138
guccuccauguacaguuugu

SEQ ID NO: 520403 - RNA, 15 nt, Chlamydophila pneumoniae J138
gucuugaguucuuuu

SEQ ID NO: 520404 - RNA, 12 nt, Chlamydophila pneumoniae J138
gucuucuucgcc

SEQ ID NO: 520405 - RNA, 14 nt, Chlamydophila pneumoniae J138
cguauccuugauuu

SEQ ID NO: 520406 - RNA, 14 nt, Chlamydophila pneumoniae J138
cgucuauuagauuu

SEQ ID NO: 520407 - RNA, 20 nt, Chlamydophila pneumoniae J138
cgucaucaaccgaagauccu

SEQ ID NO: 520408 - RNA, 21 nt, Chlamydophila pneumoniae J138
cuaaaauggugaagaauaaua

SEQ ID NO: 520409 - RNA, 21 nt, Chlamydophila pneumoniae J138
cuaaaaguuuuuuauuuucug

SEQ ID NO: 520410 - RNA, 14 nt, Chlamydophila pneumoniae J138
cuaaaacaagaaga

SEQ ID NO: 520411 - RNA, 20 nt, Chlamydophila pneumoniae J138
cuaacaacuucugacaauaa

SEQ ID NO: 520412 - RNA, 17 nt, Chlamydophila pneumoniae J138
cuaaauucuuaacaaua

SEQ ID NO: 520413 - RNA, 21 nt, Chlamydophila pneumoniae J138
cuaaaucaacuacacuuaugu

SEQ ID NO: 520414 - RNA, 13 nt, Chlamydophila pneumoniae J138
cuaaacucuccaa

SEQ ID NO: 520415 - RNA, 11 nt, Chlamydophila pneumoniae J138
cuaucuccaga

SEQ ID NO: 520416 - RNA, 14 nt, Chlamydophila pneumoniae J138
cuaucuaucuauag

SEQ ID NO: 520417 - RNA, 17 nt, Chlamydophila pneumoniae J138
cuauuauuuuaaaguca

SEQ ID NO: 520418 - RNA, 19 nt, Chlamydophila pneumoniae J138
cuacaaucgccuuacaauu

SEQ ID NO: 520419 - RNA, 16 nt, Chlamydophila pneumoniae J138
cuaagauaucuccagg

SEQ ID NO: 520420 - RNA, 13 nt, Chlamydophila pneumoniae J138
cuaagcaauauuu

SEQ ID NO: 520421 - RNA, 12 nt, Chlamydophila pneumoniae J138
cuaagccaaaua

SEQ ID NO: 520422 - RNA, 21 nt, Chlamydophila pneumoniae J138
cuaagaguuccaagacaauaa

SEQ ID NO: 520423 - RNA, 22 nt, Chlamydophila pneumoniae J138
cuaagagcccuugaaucauaga

SEQ ID NO: 520424 - RNA, 13 nt, Chlamydophila pneumoniae J138
cuaauaauuccug

SEQ ID NO: 520425 - RNA, 18 nt, Chlamydophila pneumoniae J138
cuaagguuuccaugagaa

SEQ ID NO: 520426 - RNA, 23 nt, Chlamydophila pneumoniae J138
cuauuuuugaggaacgcacgcca

SEQ ID NO: 520427 - RNA, 18 nt, Chlamydophila pneumoniae J138
cucccaugggauaggaau

SEQ ID NO: 520428 - RNA, 22 nt, Chlamydophila pneumoniae J138
cucauaaccuaaggcauggcac

SEQ ID NO: 520429 - RNA, 21 nt, Chlamydophila pneumoniae J138
cuccguauacugcugcuaagc

SEQ ID NO: 520430 - RNA, 18 nt, Chlamydophila pneumoniae J138
cuccgucuccuaucagag

SEQ ID NO: 520431 - RNA, 18 nt, Chlamydophila pneumoniae J138
cucgacacuauguguuuc

SEQ ID NO: 520432 - RNA, 12 nt, Chlamydophila pneumoniae J138
cuccuaaggaaa

SEQ ID NO: 520433 - RNA, 20 nt, Chlamydophila pneumoniae J138
cuccugcagguuugggugcu

SEQ ID NO: 520434 - RNA, 15 nt, Chlamydophila pneumoniae J138
cucucccgaccaaga

SEQ ID NO: 520435 - RNA, 13 nt, Chlamydophila pneumoniae J138
cucucaucagcaa

SEQ ID NO: 520436 - RNA, 20 nt, Chlamydophila pneumoniae J138
cucuccgucauauuuaaaag

SEQ ID NO: 520437 - RNA, 12 nt, Chlamydophila pneumoniae J138
cucucuaaggga

SEQ ID NO: 520438 - RNA, 13 nt, Chlamydophila pneumoniae J138
cucuucauccgaa

SEQ ID NO: 520439 - RNA, 12 nt, Chlamydophila pneumoniae J138
cugagagaagca

SEQ ID NO: 520440 - RNA, 17 nt, Chlamydophila pneumoniae J138
cugagcuucuauuucua

SEQ ID NO: 520441 - RNA, 22 nt, Chlamydophila pneumoniae J138
cugacgugcauugaauccuucu

SEQ ID NO: 520442 - RNA, 17 nt, Chlamydophila pneumoniae J138
cugaagauauauuuuua

SEQ ID NO: 520443 - RNA, 16 nt, Chlamydophila pneumoniae J138
cugaugccuuuuucuu

SEQ ID NO: 520444 - RNA, 13 nt, Chlamydophila pneumoniae J138
cugauaaaauaaa

SEQ ID NO: 520445 - RNA, 12 nt, Chlamydophila pneumoniae J138
cugcaaucagug

SEQ ID NO: 520446 - RNA, 22 nt, Chlamydophila pneumoniae J138
cugcucuauagcauuauucccu

SEQ ID NO: 520447 - RNA, 15 nt, Chlamydophila pneumoniae J138
cugucagaacaagaa

SEQ ID NO: 520448 - RNA, 16 nt, Chlamydophila pneumoniae J138
cugucacuaucuucua

SEQ ID NO: 520449 - RNA, 23 nt, Chlamydophila pneumoniae J138
cugucuauaagauagcucuugcg

SEQ ID NO: 520450 - RNA, 22 nt, Chlamydophila pneumoniae J138
cuuacggccccuggaauuucuc

SEQ ID NO: 520451 - RNA, 20 nt, Chlamydophila pneumoniae J138
cuucaaugauguguugauuu

SEQ ID NO: 520452 - RNA, 18 nt, Chlamydophila pneumoniae J138
cuucaauagguaaggaaa

SEQ ID NO: 520453 - RNA, 16 nt, Chlamydophila pneumoniae J138
cuucaagccaaaacca

SEQ ID NO: 520454 - RNA, 19 nt, Chlamydophila pneumoniae J138
cuucaaaacauaaccuccu

SEQ ID NO: 520455 - RNA, 23 nt, Chlamydophila pneumoniae J138
cuucgcccauuaacuaagauaug

SEQ ID NO: 520456 - RNA, 23 nt, Chlamydophila pneumoniae J138
cuucuuuuauauuaagaauggau

SEQ ID NO: 520457 - RNA, 14 nt, Chlamydophila pneumoniae J138
cuucucaaagacaa

SEQ ID NO: 520458 - RNA, 19 nt, Chlamydophila pneumoniae J138
cuucucagaaagauauccc

SEQ ID NO: 520459 - RNA, 16 nt, Chlamydophila pneumoniae J138
cuugcaaagauaacca

SEQ ID NO: 520460 - RNA, 23 nt, Chlamydophila pneumoniae J138
cuugauguacaguaaaguaugca

SEQ ID NO: 520461 - RNA, 23 nt, Chlamydophila pneumoniae J138
cuugauggggaguuaggaucccu

SEQ ID NO: 520462 - RNA, 16 nt, Chlamydophila pneumoniae J138
cuugaaguuuuuucuc

SEQ ID NO: 520463 - RNA, 18 nt, Chlamydophila pneumoniae J138
cuuggauuucuucuucua

SEQ ID NO: 520464 - RNA, 14 nt, Chlamydophila pneumoniae J138
cuuguagaacuucu

SEQ ID NO: 520465 - RNA, 13 nt, Chlamydophila pneumoniae J138
cuuguacgaaaau

SEQ ID NO: 520466 - RNA, 13 nt, Chlamydophila pneumoniae J138
cuuuccuaaaaua

SEQ ID NO: 520467 - RNA, 14 nt, Chlamydophila pneumoniae J138
cuuugggauaaaaa

SEQ ID NO: 520468 - RNA, 21 nt, Chlamydophila pneumoniae J138
gaaaaagccuaugggaggaau

SEQ ID NO: 520469 - RNA, 18 nt, Chlamydophila pneumoniae J138
gaaaaauaucggaagaga

SEQ ID NO: 520470 - RNA, 20 nt, Chlamydophila pneumoniae J138
gaaaaagaucuaagucgaau

SEQ ID NO: 520471 - RNA, 15 nt, Chlamydophila pneumoniae J138
gaaacagugguaugc

SEQ ID NO: 520472 - RNA, 14 nt, Chlamydophila pneumoniae J138
gaaaaucaacucuc

SEQ ID NO: 520473 - RNA, 17 nt, Chlamydophila pneumoniae J138
gaacgugcaucucuuca

SEQ ID NO: 520474 - RNA, 17 nt, Chlamydophila pneumoniae J138
gaagcaacuaaacucuc

SEQ ID NO: 520475 - RNA, 18 nt, Chlamydophila pneumoniae J138
gaagcagaaacuuuaaaa

SEQ ID NO: 520476 - RNA, 21 nt, Chlamydophila pneumoniae J138
gaagcucuaucuuugguaugc

SEQ ID NO: 520477 - RNA, 17 nt, Chlamydophila pneumoniae J138
gaaguccuaucaaagca

SEQ ID NO: 520478 - RNA, 20 nt, Chlamydophila pneumoniae J138
gaauguugggggagcucgcu

SEQ ID NO: 520479 - RNA, 17 nt, Chlamydophila pneumoniae J138
gacaaauaaguccuguu

SEQ ID NO: 520480 - RNA, 15 nt, Chlamydophila pneumoniae J138
gacaccuauaccaaa

SEQ ID NO: 520481 - RNA, 20 nt, Chlamydophila pneumoniae J138
gagccgucuacuuuugugaa

SEQ ID NO: 520482 - RNA, 19 nt, Chlamydophila pneumoniae J138
gagccuagagaguucuugu

SEQ ID NO: 520483 - RNA, 20 nt, Chlamydophila pneumoniae J138
gagccuccauaaugcugaga

SEQ ID NO: 520484 - RNA, 13 nt, Chlamydophila pneumoniae J138
gagcucuugagaa

SEQ ID NO: 520485 - RNA, 18 nt, Chlamydophila pneumoniae J138
gagcucucgacgaacaug

SEQ ID NO: 520486 - RNA, 18 nt, Chlamydophila pneumoniae J138
gagcgguucuuucuagaa

SEQ ID NO: 520487 - RNA, 16 nt, Chlamydophila pneumoniae J138
gaggauugacaaucgc

SEQ ID NO: 520488 - RNA, 23 nt, Chlamydophila pneumoniae J138
gaguagccccagcaacccgaauu

SEQ ID NO: 520489 - RNA, 16 nt, Chlamydophila pneumoniae J138
gaggcuguccuugcag

SEQ ID NO: 520490 - RNA, 17 nt, Chlamydophila pneumoniae J138
gauacguuuuucccuuu

SEQ ID NO: 520491 - RNA, 23 nt, Chlamydophila pneumoniae J138
gaguucuuccuucuucuucaaag

SEQ ID NO: 520492 - RNA, 18 nt, Chlamydophila pneumoniae J138
gaguucgcggaucuucuu

SEQ ID NO: 520493 - RNA, 22 nt, Chlamydophila pneumoniae J138
gauaagaagcucguacuguucc

SEQ ID NO: 520494 - RNA, 16 nt, Chlamydophila pneumoniae J138
gaucuucucauccaga

SEQ ID NO: 520495 - RNA, 22 nt, Chlamydophila pneumoniae J138
gaucuuuugauaacuuugcaug

SEQ ID NO: 520496 - RNA, 21 nt, Chlamydophila pneumoniae J138
gaucuagaaaaugaagagcuu

SEQ ID NO: 520497 - RNA, 17 nt, Chlamydophila pneumoniae J138
gaucuacagauagggua

SEQ ID NO: 520498 - RNA, 21 nt, Chlamydophila pneumoniae J138
gaugcauauugccuucuucuu

SEQ ID NO: 520499 - RNA, 14 nt, Chlamydophila pneumoniae J138
gauggaaucaggga

SEQ ID NO: 520500 - RNA, 15 nt, Chlamydophila pneumoniae J138
gauguugcccuacaa

SEQ ID NO: 520501 - RNA, 19 nt, Chlamydophila pneumoniae J138
gauguauaaaguuuguaaa

SEQ ID NO: 520502 - RNA, 21 nt, Chlamydophila pneumoniae J138
gauugauaaauuugcuuccaa

SEQ ID NO: 520503 - RNA, 17 nt, Chlamydophila pneumoniae J138
gauugcacucaucuuga

SEQ ID NO: 520504 - RNA, 15 nt, Chlamydophila pneumoniae J138
gauucaaagaagucg

SEQ ID NO: 520505 - RNA, 16 nt, Chlamydophila pneumoniae J138
gcaaaaaacugcaaaa

SEQ ID NO: 520506 - RNA, 18 nt, Chlamydophila pneumoniae J138
gcacggauauucuuuagg

SEQ ID NO: 520507 - RNA, 16 nt, Chlamydophila pneumoniae J138
gcacauucaagauucc

SEQ ID NO: 520508 - RNA, 21 nt, Chlamydophila pneumoniae J138
gcacauaagaugaaguuuaau

SEQ ID NO: 520509 - RNA, 21 nt, Chlamydophila pneumoniae J138
gcaguaacugcaaagagaauu

SEQ ID NO: 520510 - RNA, 23 nt, Chlamydophila pneumoniae J138
gccauccuuuuuguaguaagauu

SEQ ID NO: 520511 - RNA, 13 nt, Chlamydophila pneumoniae J138
cggcaagaaucgc

SEQ ID NO: 520512 - RNA, 17 nt, Chlamydophila pneumoniae J138
ccgucaagaacaagagc

SEQ ID NO: 520513 - RNA, 20 nt, Chlamydophila pneumoniae J138
ccguauuuuuuacguucuuu

SEQ ID NO: 520514 - RNA, 20 nt, Chlamydophila pneumoniae J138
ccuaccucugggaagacucu

SEQ ID NO: 520515 - RNA, 17 nt, Chlamydophila pneumoniae J138
ccuccaacaaacaauuc

SEQ ID NO: 520516 - RNA, 12 nt, Chlamydophila pneumoniae J138
ccuccaauaauc

SEQ ID NO: 520517 - RNA, 20 nt, Chlamydophila pneumoniae J138
ccucugcauauaaagacucu

SEQ ID NO: 520518 - RNA, 19 nt, Chlamydophila pneumoniae J138
ccucucaugaaauuuucua

SEQ ID NO: 520519 - RNA, 16 nt, Chlamydophila pneumoniae J138
cgaaaugucgcuacca

SEQ ID NO: 520520 - RNA, 23 nt, Chlamydophila pneumoniae J138
cgaauucucagaaagccuuugcu

SEQ ID NO: 520521 - RNA, 19 nt, Chlamydophila pneumoniae J138
ccuguaguaaaauaagaaa

SEQ ID NO: 520522 - RNA, 19 nt, Chlamydophila pneumoniae J138
cgaucuaaggcuuugccuu

SEQ ID NO: 520523 - RNA, 20 nt, Chlamydophila pneumoniae J138
cagauuagaaaagauaaaac

SEQ ID NO: 520524 - RNA, 19 nt, Chlamydophila pneumoniae J138
cagaaguuccuucaggauu

SEQ ID NO: 520525 - RNA, 18 nt, Chlamydophila pneumoniae J138
cagaaauuacugugguau

SEQ ID NO: 520526 - RNA, 17 nt, Chlamydophila pneumoniae J138
cacugacuuuaugaucu

SEQ ID NO: 520527 - RNA, 13 nt, Chlamydophila pneumoniae J138
caggaagaacaag

SEQ ID NO: 520528 - RNA, 16 nt, Chlamydophila pneumoniae J138
caguaauuccaaaaua

SEQ ID NO: 520529 - RNA, 20 nt, Chlamydophila pneumoniae J138
caguugcgcgcccucuucua

SEQ ID NO: 520530 - RNA, 17 nt, Chlamydophila pneumoniae J138
caguggcucuauagggg

SEQ ID NO: 520531 - RNA, 24 nt, Chlamydophila pneumoniae J138
cauaagaguagacaagagagagcu

SEQ ID NO: 520532 - RNA, 18 nt, Chlamydophila pneumoniae J138
cauaguuuuuauuuuuaa

SEQ ID NO: 520533 - RNA, 20 nt, Chlamydophila pneumoniae J138
cauagaauaaagauuuuagg

SEQ ID NO: 520534 - RNA, 23 nt, Chlamydophila pneumoniae J138
cauacucgucaaauucauuaaga

SEQ ID NO: 520535 - RNA, 17 nt, Chlamydophila pneumoniae J138
cauccaagccucccgaa

SEQ ID NO: 520536 - RNA, 14 nt, Chlamydophila pneumoniae J138
caucaaagaauuau

SEQ ID NO: 520537 - RNA, 22 nt, Chlamydophila pneumoniae J138
caugaaucuuaugggagaagcu

SEQ ID NO: 520538 - RNA, 14 nt, Chlamydophila pneumoniae J138
caugaaagauaaug

SEQ ID NO: 520539 - RNA, 13 nt, Chlamydophila pneumoniae J138
caugaaaauacaa

SEQ ID NO: 520540 - RNA, 12 nt, Chlamydophila pneumoniae J138
cauuccaagauu

SEQ ID NO: 520541 - RNA, 23 nt, Chlamydophila pneumoniae J138
cauugcuauugaaaaaucccugu

SEQ ID NO: 520542 - RNA, 22 nt, Chlamydophila pneumoniae J138
ccacuccagaaaguauuccucu

SEQ ID NO: 520543 - RNA, 15 nt, Chlamydophila pneumoniae J138
ccagaugcuaaagag

SEQ ID NO: 520544 - RNA, 14 nt, Chlamydophila pneumoniae J138
ccaucuaauccugu

SEQ ID NO: 520545 - RNA, 20 nt, Chlamydophila pneumoniae J138
ccauuucuaggaauugcugu

SEQ ID NO: 520546 - RNA, 14 nt, Chlamydophila pneumoniae J138
cccaaacauggaca

SEQ ID NO: 520547 - RNA, 15 nt, Chlamydophila pneumoniae J138
cccauaaugguacaa

SEQ ID NO: 520548 - RNA, 16 nt, Chlamydophila pneumoniae J138
aucaucuccugaagcc

SEQ ID NO: 520549 - RNA, 16 nt, Chlamydophila pneumoniae J138
aucaugccgagauuuu

SEQ ID NO: 520550 - RNA, 22 nt, Chlamydophila pneumoniae J138
auccacauccuuguagaacuuc

SEQ ID NO: 520551 - RNA, 21 nt, Chlamydophila pneumoniae J138
aucauugcuauugaaaaaucc

SEQ ID NO: 520552 - RNA, 14 nt, Chlamydophila pneumoniae J138
auauugcucuugua

SEQ ID NO: 520553 - RNA, 18 nt, Chlamydophila pneumoniae J138
auccccgggauuguucuu

SEQ ID NO: 520554 - RNA, 15 nt, Chlamydophila pneumoniae J138
auccccuucauucuu

SEQ ID NO: 520555 - RNA, 15 nt, Chlamydophila pneumoniae J138
aucucuuuaaauguu

SEQ ID NO: 520556 - RNA, 15 nt, Chlamydophila pneumoniae J138
aucgcgaagcuuucc

SEQ ID NO: 520557 - RNA, 14 nt, Chlamydophila pneumoniae J138
augcacacgcuugu

SEQ ID NO: 520558 - RNA, 19 nt, Chlamydophila pneumoniae J138
aucucuuucacaaaggcga

SEQ ID NO: 520559 - RNA, 21 nt, Chlamydophila pneumoniae J138
augagaauuuucaugauauuu

SEQ ID NO: 520560 - RNA, 19 nt, Chlamydophila pneumoniae J138
augaugcaagcagauagag

SEQ ID NO: 520561 - RNA, 18 nt, Chlamydophila pneumoniae J138
auggcuacuuuaagaccu

SEQ ID NO: 520562 - RNA, 11 nt, Chlamydophila pneumoniae J138
auguuucuaag

SEQ ID NO: 520563 - RNA, 17 nt, Chlamydophila pneumoniae J138
auuaucaagaaauucuu

SEQ ID NO: 520564 - RNA, 15 nt, Chlamydophila pneumoniae J138
auuauacuuuuuuua

SEQ ID NO: 520565 - RNA, 17 nt, Chlamydophila pneumoniae J138
auuauaaauagaaaucu

SEQ ID NO: 520566 - RNA, 18 nt, Chlamydophila pneumoniae J138
auuaguaacuaaauucuu

SEQ ID NO: 520567 - RNA, 23 nt, Chlamydophila pneumoniae J138
auuagagagugcguacucuucuu

SEQ ID NO: 520568 - RNA, 14 nt, Chlamydophila pneumoniae J138
auuccagcaucuuc

SEQ ID NO: 520569 - RNA, 12 nt, Chlamydophila pneumoniae J138
auuccagaaaaa

SEQ ID NO: 520570 - RNA, 15 nt, Chlamydophila pneumoniae J138
auuaucuuagggaau

SEQ ID NO: 520571 - RNA, 18 nt, Chlamydophila pneumoniae J138
auucccggaggcaaagau

SEQ ID NO: 520572 - RNA, 13 nt, Chlamydophila pneumoniae J138
auuuaguucacca

SEQ ID NO: 520573 - RNA, 21 nt, Chlamydophila pneumoniae J138
auuuagaaucuuuucuagaaa

SEQ ID NO: 520574 - RNA, 19 nt, Chlamydophila pneumoniae J138
auuucuucuucuauacgaa

SEQ ID NO: 520575 - RNA, 18 nt, Chlamydophila pneumoniae J138
auuucuuuuucagcuucu

SEQ ID NO: 520576 - RNA, 15 nt, Chlamydophila pneumoniae J138
auuucugaucguaca

SEQ ID NO: 520577 - RNA, 16 nt, Chlamydophila pneumoniae J138
auuuccuuauccguca

SEQ ID NO: 520578 - RNA, 22 nt, Chlamydophila pneumoniae J138
auuugcaacaaucuuucuucua

SEQ ID NO: 520579 - RNA, 13 nt, Chlamydophila pneumoniae J138
auuugauuuuuca

SEQ ID NO: 520580 - RNA, 17 nt, Chlamydophila pneumoniae J138
auuuguuuagcauagag

SEQ ID NO: 520581 - RNA, 12 nt, Chlamydophila pneumoniae J138
auuuucaagcuu

SEQ ID NO: 520582 - RNA, 14 nt, Chlamydophila pneumoniae J138
auuuucagcacuga

SEQ ID NO: 520583 - RNA, 16 nt, Chlamydophila pneumoniae J138
auuuuugggaaaagaa

SEQ ID NO: 520584 - RNA, 16 nt, Chlamydophila pneumoniae J138
auuuuucuuuuagaga

SEQ ID NO: 520585 - RNA, 19 nt, Chlamydophila pneumoniae J138
caaaaauaaacauauucuc

SEQ ID NO: 520586 - RNA, 20 nt, Chlamydophila pneumoniae J138
caaaacucaaggaguuuuaa

SEQ ID NO: 520587 - RNA, 15 nt, Chlamydophila pneumoniae J138
caaagccugaaaaau

SEQ ID NO: 520588 - RNA, 15 nt, Chlamydophila pneumoniae J138
caaagagucucuugc

SEQ ID NO: 520589 - RNA, 22 nt, Chlamydophila pneumoniae J138
caacaguucgacaaccaaaaca

SEQ ID NO: 520590 - RNA, 15 nt, Chlamydophila pneumoniae J138
caacaguucuuucug

SEQ ID NO: 520591 - RNA, 16 nt, Chlamydophila pneumoniae J138
caaagucaaauacuuc

SEQ ID NO: 520592 - RNA, 15 nt, Chlamydophila pneumoniae J138
caagacaaaaaaggg

SEQ ID NO: 520593 - RNA, 21 nt, Chlamydophila pneumoniae J138
caagacaaaaaagggaucucc

SEQ ID NO: 520594 - RNA, 18 nt, Chlamydophila pneumoniae J138
caagaaugaaucgaagaa

SEQ ID NO: 520595 - RNA, 17 nt, Chlamydophila pneumoniae J138
caacuuuguuaauagaa

SEQ ID NO: 520596 - RNA, 18 nt, Chlamydophila pneumoniae J138
caacuucuccaacuaaac

SEQ ID NO: 520597 - RNA, 23 nt, Chlamydophila pneumoniae J138
caagagcuccgcuagaggaucuu

SEQ ID NO: 520598 - RNA, 21 nt, Chlamydophila pneumoniae J138
caagaguuucgaauucaauga

SEQ ID NO: 520599 - RNA, 22 nt, Chlamydophila pneumoniae J138
caaggauuaugaauccuugaaa

SEQ ID NO: 520600 - RNA, 20 nt, Chlamydophila pneumoniae J138
caauguuuguaguguugaau

SEQ ID NO: 520601 - RNA, 16 nt, Chlamydophila pneumoniae J138
caauuccgaagaagaa

SEQ ID NO: 520602 - RNA, 22 nt, Chlamydophila pneumoniae J138
caauucuguaucgauaguuuuu

SEQ ID NO: 520603 - RNA, 18 nt, Chlamydophila pneumoniae J138
caauuuuuauaauauuuu

SEQ ID NO: 520604 - RNA, 14 nt, Chlamydophila pneumoniae J138
cacagcauuuucuc

SEQ ID NO: 520605 - RNA, 21 nt, Chlamydophila pneumoniae J138
cacauaguuuaauaaaucuau

SEQ ID NO: 520606 - RNA, 19 nt, Chlamydophila pneumoniae J138
cacagcuguacagaacaau

SEQ ID NO: 520607 - RNA, 20 nt, Chlamydophila pneumoniae J138
caccaucuguugaucuucua

SEQ ID NO: 520608 - RNA, 15 nt, Chlamydophila pneumoniae J138
agcuuucuuggagaa

SEQ ID NO: 520609 - RNA, 17 nt, Chlamydophila pneumoniae J138
agcuugcuguacgauag

SEQ ID NO: 520610 - RNA, 19 nt, Chlamydophila pneumoniae J138
aggaaauuacaaucucuag

SEQ ID NO: 520611 - RNA, 18 nt, Chlamydophila pneumoniae J138
aggaagguucucaaagcu

SEQ ID NO: 520612 - RNA, 14 nt, Chlamydophila pneumoniae J138
aggaaucccaaggg

SEQ ID NO: 520613 - RNA, 13 nt, Chlamydophila pneumoniae J138
agcuuauuucugu

SEQ ID NO: 520614 - RNA, 16 nt, Chlamydophila pneumoniae J138
agcuguacagaacaau

SEQ ID NO: 520615 - RNA, 13 nt, Chlamydophila pneumoniae J138
agcugcugcuacg

SEQ ID NO: 520616 - RNA, 20 nt, Chlamydophila pneumoniae J138
aggagcaucauuaauuccau

SEQ ID NO: 520617 - RNA, 13 nt, Chlamydophila pneumoniae J138
aggagcuccuccu

SEQ ID NO: 520618 - RNA, 20 nt, Chlamydophila pneumoniae J138
aggaguuccgcggccaucau

SEQ ID NO: 520619 - RNA, 22 nt, Chlamydophila pneumoniae J138
aggaucccugauuccuuggcau

SEQ ID NO: 520620 - RNA, 16 nt, Chlamydophila pneumoniae J138
aggaccacaauuccua

SEQ ID NO: 520621 - RNA, 16 nt, Chlamydophila pneumoniae J138
aggaccuacugggaaa

SEQ ID NO: 520622 - RNA, 17 nt, Chlamydophila pneumoniae J138
aggagaguaaggucauu

SEQ ID NO: 520623 - RNA, 22 nt, Chlamydophila pneumoniae J138
aggagagcuugguuuucuccuu

SEQ ID NO: 520624 - RNA, 21 nt, Chlamydophila pneumoniae J138
aggagauaaagauguagaaua

SEQ ID NO: 520625 - RNA, 23 nt, Chlamydophila pneumoniae J138
aggaugacacucacuauccggaa

SEQ ID NO: 520626 - RNA, 21 nt, Chlamydophila pneumoniae J138
aggguuuugaaauaauuuuca

SEQ ID NO: 520627 - RNA, 12 nt, Chlamydophila pneumoniae J138
agguauuucucu

SEQ ID NO: 520628 - RNA, 14 nt, Chlamydophila pneumoniae J138
aguauuaaucuuau

SEQ ID NO: 520629 - RNA, 16 nt, Chlamydophila pneumoniae J138
agucaaauacuucucc

SEQ ID NO: 520630 - RNA, 11 nt, Chlamydophila pneumoniae J138
agucaaagggc

SEQ ID NO: 520631 - RNA, 17 nt, Chlamydophila pneumoniae J138
aguacgcaguaucguaa

SEQ ID NO: 520632 - RNA, 20 nt, Chlamydophila pneumoniae J138
agucguuuagcuauuugaaa

SEQ ID NO: 520633 - RNA, 15 nt, Chlamydophila pneumoniae J138
agucuucgacaagga

SEQ ID NO: 520634 - RNA, 21 nt, Chlamydophila pneumoniae J138
agugauuacggcgugccuuuu

SEQ ID NO: 520635 - RNA, 23 nt, Chlamydophila pneumoniae J138
auaacgggguugucucuacaggg

SEQ ID NO: 520636 - RNA, 17 nt, Chlamydophila pneumoniae J138
auaacauugcuugcuau

SEQ ID NO: 520637 - RNA, 19 nt, Chlamydophila pneumoniae J138
auaagugacuuuucuucuu

SEQ ID NO: 520638 - RNA, 11 nt, Chlamydophila pneumoniae J138
auaaguucuuc

SEQ ID NO: 520639 - RNA, 20 nt, Chlamydophila pneumoniae J138
auaaguuuugauuuugcagu

SEQ ID NO: 520640 - RNA, 21 nt, Chlamydophila pneumoniae J138
auaauacguaccguauccucu

SEQ ID NO: 520641 - RNA, 22 nt, Chlamydophila pneumoniae J138
auacgccgggccacuucaucuu

SEQ ID NO: 520642 - RNA, 17 nt, Chlamydophila pneumoniae J138
auacaaaacaaaagcca

SEQ ID NO: 520643 - RNA, 19 nt, Chlamydophila pneumoniae J138
auaccacuacugagcuucu

SEQ ID NO: 520644 - RNA, 18 nt, Chlamydophila pneumoniae J138
auagaaaacauagagauu

SEQ ID NO: 520645 - RNA, 18 nt, Chlamydophila pneumoniae J138
auagguacgcuuuuucuu

SEQ ID NO: 520646 - RNA, 22 nt, Chlamydophila pneumoniae J138
auaggguugugucucugaagac

SEQ ID NO: 520647 - RNA, 21 nt, Chlamydophila pneumoniae J138
auaggguuucacuuucugaug

SEQ ID NO: 520648 - RNA, 23 nt, Chlamydophila pneumoniae J138
auaguguucgagcaucucaagag

SEQ ID NO: 520649 - RNA, 16 nt, Chlamydophila pneumoniae J138
auaguuuuuauuuuua

SEQ ID NO: 520650 - RNA, 16 nt, Chlamydophila pneumoniae J138
auaucuauaaauguag

SEQ ID NO: 520651 - RNA, 22 nt, Chlamydophila pneumoniae J138
auaucgaguucuuuuugcagau

SEQ ID NO: 520652 - RNA, 19 nt, Chlamydophila pneumoniae J138
auauaggcgugugaaaucu

SEQ ID NO: 520653 - RNA, 22 nt, Chlamydophila pneumoniae J138
auauaggguugugucucugaag

SEQ ID NO: 520654 - RNA, 21 nt, Chlamydophila pneumoniae J138
agauugcagguagauccuaua

SEQ ID NO: 520655 - RNA, 20 nt, Chlamydophila pneumoniae J138
agcacuuguuuuuucuucug

SEQ ID NO: 520656 - RNA, 18 nt, Chlamydophila pneumoniae J138
agaacaagaaguaggaaa

SEQ ID NO: 520657 - RNA, 12 nt, Chlamydophila pneumoniae J138
agaaauuccuaa

SEQ ID NO: 520658 - RNA, 17 nt, Chlamydophila pneumoniae J138
agaaauucaugccuuug

SEQ ID NO: 520659 - RNA, 20 nt, Chlamydophila pneumoniae J138
agaacaccaucacauccugu

SEQ ID NO: 520660 - RNA, 14 nt, Chlamydophila pneumoniae J138
agaacguggggaaa

SEQ ID NO: 520661 - RNA, 20 nt, Chlamydophila pneumoniae J138
agaacguauacgucccacaa

SEQ ID NO: 520662 - RNA, 19 nt, Chlamydophila pneumoniae J138
agaacgaauuucaacagcu

SEQ ID NO: 520663 - RNA, 14 nt, Chlamydophila pneumoniae J138
agaauaucuuuuga

SEQ ID NO: 520664 - RNA, 21 nt, Chlamydophila pneumoniae J138
agaaugacacagagaacaaua

SEQ ID NO: 520665 - RNA, 18 nt, Chlamydophila pneumoniae J138
agaauccuuuuuaggaaa

SEQ ID NO: 520666 - RNA, 19 nt, Chlamydophila pneumoniae J138
agaauguacauagaggaga

SEQ ID NO: 520667 - RNA, 14 nt, Chlamydophila pneumoniae J138
agaaguuccuucag

SEQ ID NO: 520668 - RNA, 17 nt, Chlamydophila pneumoniae J138
agacaaguucaucaaau

SEQ ID NO: 520669 - RNA, 21 nt, Chlamydophila pneumoniae J138
agaauuuucaugauauuuuua

SEQ ID NO: 520670 - RNA, 14 nt, Chlamydophila pneumoniae J138
agaccauacacaaa

SEQ ID NO: 520671 - RNA, 14 nt, Chlamydophila pneumoniae J138
agauagagauaagu

SEQ ID NO: 520672 - RNA, 16 nt, Chlamydophila pneumoniae J138
agauacuuaucuuuaa

SEQ ID NO: 520673 - RNA, 23 nt, Chlamydophila pneumoniae J138
agauaaaggcauaacugugcucc

SEQ ID NO: 520674 - RNA, 13 nt, Chlamydophila pneumoniae J138
agauaaacauuaa

SEQ ID NO: 520675 - RNA, 17 nt, Chlamydophila pneumoniae J138
agagucucuugcuuuug

SEQ ID NO: 520676 - RNA, 15 nt, Chlamydophila pneumoniae J138
agagcccccauagga

SEQ ID NO: 520677 - RNA, 22 nt, Chlamydophila pneumoniae J138
agacuugaucuacaaaaacuag

SEQ ID NO: 520678 - RNA, 17 nt, Chlamydophila pneumoniae J138
agacuuugccauuucua

SEQ ID NO: 520679 - RNA, 16 nt, Chlamydophila pneumoniae J138
gugcuaggcucucgac

SEQ ID NO: 520680 - RNA, 17 nt, Chlamydophila pneumoniae J138
gugcucucuucuucuca

SEQ ID NO: 520681 - RNA, 14 nt, Chlamydophila pneumoniae J138
aagugcguuccuau

SEQ ID NO: 520682 - RNA, 18 nt, Chlamydophila pneumoniae J138
guucggucucuucucugu

SEQ ID NO: 520683 - RNA, 20 nt, Chlamydophila pneumoniae J138
guuggaauugcauuaagaua

SEQ ID NO: 520684 - RNA, 15 nt, Chlamydophila pneumoniae J138
guugccuuucucuuc

SEQ ID NO: 520685 - RNA, 18 nt, Chlamydophila pneumoniae J138
guuguugauaauuacaga

SEQ ID NO: 520686 - RNA, 22 nt, Chlamydophila pneumoniae J138
guuuaaagcauauucuaagcuu

SEQ ID NO: 520687 - RNA, 16 nt, Chlamydophila pneumoniae J138
uaacaccaaaagaaua

SEQ ID NO: 520688 - RNA, 19 nt, Chlamydophila pneumoniae J138
uaacaacuucugacaauaa

SEQ ID NO: 520689 - RNA, 21 nt, Chlamydophila pneumoniae J138
uaacacuuccuacggcaagaa

SEQ ID NO: 520690 - RNA, 13 nt, Chlamydophila pneumoniae J138
uaaccuccucuuc

SEQ ID NO: 520691 - RNA, 13 nt, Chlamydophila pneumoniae J138
uaaauaaaaccac

SEQ ID NO: 520692 - RNA, 20 nt, Chlamydophila pneumoniae J138
uaaagugaaagcaacuccau

SEQ ID NO: 520693 - RNA, 15 nt, Chlamydophila pneumoniae J138
uaaagcuucuuucuc

SEQ ID NO: 520694 - RNA, 14 nt, Chlamydophila pneumoniae J138
uaaaagaggaagau

SEQ ID NO: 520695 - RNA, 21 nt, Chlamydophila pneumoniae J138
uaaaagcaaguuguugauaau

SEQ ID NO: 520696 - RNA, 22 nt, Chlamydophila pneumoniae J138
uaacgaagugaggagaauagca

SEQ ID NO: 520697 - RNA, 22 nt, Chlamydophila pneumoniae J138
uaagacauuauagaggucuuug

SEQ ID NO: 520698 - RNA, 15 nt, Chlamydophila pneumoniae J138
uaagacaauauaagc

SEQ ID NO: 520699 - RNA, 15 nt, Chlamydophila pneumoniae J138
uaagaaaucaguccu

SEQ ID NO: 520700 - RNA, 24 nt, Chlamydophila pneumoniae J138
uaagaaaggcacuccaaaacucaa

SEQ ID NO: 520701 - RNA, 18 nt, Chlamydophila pneumoniae J138
uaagaaucuauagaacua

SEQ ID NO: 520702 - RNA, 19 nt, Chlamydophila pneumoniae J138
uaagaagguuuauuagaag

SEQ ID NO: 520703 - RNA, 23 nt, Chlamydophila pneumoniae J138
uaagaucuuuagaauaagagcua

SEQ ID NO: 520704 - RNA, 20 nt, Chlamydophila pneumoniae J138
uaagcaagcaacugauguuu

SEQ ID NO: 520705 - RNA, 13 nt, Chlamydophila pneumoniae J138
uaagcaauaucua

SEQ ID NO: 520706 - RNA, 15 nt, Chlamydophila pneumoniae J138
uaagcacugaugaaa

SEQ ID NO: 520707 - RNA, 15 nt, Chlamydophila pneumoniae J138
uaaggaucccaucau

SEQ ID NO: 520708 - RNA, 20 nt, Chlamydophila pneumoniae J138
uaauaauguuuuaauagcua

SEQ ID NO: 520709 - RNA, 21 nt, Chlamydophila pneumoniae J138
uaaucucgcaguccuugagcu

SEQ ID NO: 520710 - RNA, 14 nt, Chlamydophila pneumoniae J138
uaauacguuuuuag

SEQ ID NO: 520711 - RNA, 18 nt, Chlamydophila pneumoniae J138
uaauacggacuucacaaa

SEQ ID NO: 520712 - RNA, 15 nt, Chlamydophila pneumoniae J138
uaauccuucuuucug

SEQ ID NO: 520713 - RNA, 17 nt, Chlamydophila pneumoniae J138
uaaugccaauaugguag

SEQ ID NO: 520714 - RNA, 16 nt, Chlamydophila pneumoniae J138
uaaugacucuagagua

SEQ ID NO: 520715 - RNA, 21 nt, Chlamydophila pneumoniae J138
uaauuucuccgucaagaacaa

SEQ ID NO: 520716 - RNA, 20 nt, Chlamydophila pneumoniae J138
uacgcucguagguaugagcu

SEQ ID NO: 520717 - RNA, 12 nt, Chlamydophila pneumoniae J138
uacccaucuaga

SEQ ID NO: 520718 - RNA, 16 nt, Chlamydophila pneumoniae J138
uagagucgauaaaaac

SEQ ID NO: 520719 - RNA, 18 nt, Chlamydophila pneumoniae J138
uagaucuucugaaaucaa

SEQ ID NO: 520720 - RNA, 18 nt, Chlamydophila pneumoniae J138
uagagcuuucagaaaaga

SEQ ID NO: 520721 - RNA, 21 nt, Chlamydophila pneumoniae J138
uagaguacacagcacaagaac

SEQ ID NO: 520722 - RNA, 19 nt, Chlamydophila pneumoniae J138
uagaacuucucaagaaucu

SEQ ID NO: 520723 - RNA, 18 nt, Chlamydophila pneumoniae J138
uagaauccaaagacuuuu

SEQ ID NO: 520724 - RNA, 22 nt, Chlamydophila pneumoniae J138
uagacgggcuuauaaacuucaa

SEQ ID NO: 520725 - RNA, 16 nt, Chlamydophila pneumoniae J138
uacuguagaguuuucu

SEQ ID NO: 520726 - RNA, 17 nt, Chlamydophila pneumoniae J138
uacuguccauccaaaua

SEQ ID NO: 520727 - RNA, 13 nt, Chlamydophila pneumoniae J138
uacucgcuuccga

SEQ ID NO: 520728 - RNA, 14 nt, Chlamydophila pneumoniae J138
uagcaucaucuccu

SEQ ID NO: 520729 - RNA, 12 nt, Chlamydophila pneumoniae J138
uagccaaaauuu

SEQ ID NO: 520730 - RNA, 18 nt, Chlamydophila pneumoniae J138
uagcuuacagagaaauuu

SEQ ID NO: 520731 - RNA, 16 nt, Chlamydophila pneumoniae J138
aaguugaccuuuuuca

SEQ ID NO: 520732 - RNA, 20 nt, Chlamydophila pneumoniae J138
uagcuuuaugcacgcuuucg

SEQ ID NO: 520733 - RNA, 15 nt, Chlamydophila pneumoniae J138
uagucaaaaauucuu

SEQ ID NO: 520734 - RNA, 15 nt, Chlamydophila pneumoniae J138
uagguuugcugcucu

SEQ ID NO: 520735 - RNA, 18 nt, Chlamydophila pneumoniae J138
uagguuaagccaaucccu

SEQ ID NO: 520736 - RNA, 12 nt, Chlamydophila pneumoniae J138
uaguuguaauuu

SEQ ID NO: 520737 - RNA, 21 nt, Chlamydophila pneumoniae J138
uaguucaccacuaccgaauuu

SEQ ID NO: 520738 - RNA, 16 nt, Chlamydophila pneumoniae J138
uaguguucgagcaucu

SEQ ID NO: 520739 - RNA, 22 nt, Chlamydophila pneumoniae J138
uaucauggacaagcaaaagcaa

SEQ ID NO: 520740 - RNA, 21 nt, Chlamydophila pneumoniae J138
uauccacaaucucuuuaaaaa

SEQ ID NO: 520741 - RNA, 16 nt, Chlamydophila pneumoniae J138
uauccagaaagauucu

SEQ ID NO: 520742 - RNA, 13 nt, Chlamydophila pneumoniae J138
uaucgaagagccc

SEQ ID NO: 520743 - RNA, 12 nt, Chlamydophila pneumoniae J138
uauccuuuucaa

SEQ ID NO: 520744 - RNA, 16 nt, Chlamydophila pneumoniae J138
uaucaaccauaaagaa

SEQ ID NO: 520745 - RNA, 22 nt, Chlamydophila pneumoniae J138
uauagcuggcaaugauauccuc

SEQ ID NO: 520746 - RNA, 20 nt, Chlamydophila pneumoniae J138
uauagcuuacuuagaacuau

SEQ ID NO: 520747 - RNA, 16 nt, Chlamydophila pneumoniae J138
uauagagaagauuucu

SEQ ID NO: 520748 - RNA, 14 nt, Chlamydophila pneumoniae J138
uauaaucacguccu

SEQ ID NO: 520749 - RNA, 14 nt, Chlamydophila pneumoniae J138
uauaacaucaagaa

SEQ ID NO: 520750 - RNA, 17 nt, Chlamydophila pneumoniae J138
uaucgauaacgauuucu

SEQ ID NO: 520751 - RNA, 15 nt, Chlamydophila pneumoniae J138
uauggcaaauaaaac

SEQ ID NO: 520752 - RNA, 20 nt, Chlamydophila pneumoniae J138
uauuguucuugguguauagu

SEQ ID NO: 520753 - RNA, 15 nt, Chlamydophila pneumoniae J138
uauuuaagaaaugca

SEQ ID NO: 520754 - RNA, 20 nt, Chlamydophila pneumoniae J138
uauuuuuacuucacucuuuc

SEQ ID NO: 520755 - RNA, 12 nt, Chlamydophila pneumoniae J138
uauuuuuaaaua

SEQ ID NO: 520756 - RNA, 23 nt, Chlamydophila pneumoniae J138
uauuuugcaaaugaaaagagacu

SEQ ID NO: 520757 - RNA, 16 nt, Chlamydophila pneumoniae J138
ucaacacaccauuuuu

SEQ ID NO: 520758 - RNA, 17 nt, Chlamydophila pneumoniae J138
aauacaggaaucuccuc

SEQ ID NO: 520759 - RNA, 14 nt, Chlamydophila pneumoniae J138
aauacaaacaagaa

SEQ ID NO: 520760 - RNA, 13 nt, Chlamydophila pneumoniae J138
aauacauuccuag

SEQ ID NO: 520761 - RNA, 14 nt, Chlamydophila pneumoniae J138
aauacaaaaaauaa

SEQ ID NO: 520762 - RNA, 15 nt, Chlamydophila pneumoniae J138
ucagacuuaaaguac

SEQ ID NO: 520763 - RNA, 16 nt, Chlamydophila pneumoniae J138
ucagaaugcaucuuga

SEQ ID NO: 520764 - RNA, 20 nt, Chlamydophila pneumoniae J138
ucaccacaaaccucuaaaaa

SEQ ID NO: 520765 - RNA, 20 nt, Chlamydophila pneumoniae J138
ucacauuugcuuuaacagaa

SEQ ID NO: 520766 - RNA, 21 nt, Chlamydophila pneumoniae J138
uccacgaguucgcggaucuuc

SEQ ID NO: 520767 - RNA, 18 nt, Chlamydophila pneumoniae J138
uccaggacguaaaaagaa

SEQ ID NO: 520768 - RNA, 16 nt, Chlamydophila pneumoniae J138
uccaggaccaaacuuc

SEQ ID NO: 520769 - RNA, 16 nt, Chlamydophila pneumoniae J138
uccagcuugaucagga

SEQ ID NO: 520770 - RNA, 23 nt, Chlamydophila pneumoniae J138
uccaaaauuaccguuuccuccuc

SEQ ID NO: 520771 - RNA, 15 nt, Chlamydophila pneumoniae J138
uccaacaaacaauuc

SEQ ID NO: 520772 - RNA, 17 nt, Chlamydophila pneumoniae J138
uccacgagauucugcuu

SEQ ID NO: 520773 - RNA, 19 nt, Chlamydophila pneumoniae J138
uccaccaggagcuccuccu

SEQ ID NO: 520774 - RNA, 15 nt, Chlamydophila pneumoniae J138
ucaguaaaacacaaa

SEQ ID NO: 520775 - RNA, 21 nt, Chlamydophila pneumoniae J138
ucaguaaacccucagaacacg

SEQ ID NO: 520776 - RNA, 15 nt, Chlamydophila pneumoniae J138
ucaucuuugaacaac

SEQ ID NO: 520777 - RNA, 21 nt, Chlamydophila pneumoniae J138
ucaucggaucuuuucuuucua

SEQ ID NO: 520778 - RNA, 16 nt, Chlamydophila pneumoniae J138
ucccuguauuaaagaa

SEQ ID NO: 520779 - RNA, 13 nt, Chlamydophila pneumoniae J138
ucccuucuuucaa

SEQ ID NO: 520780 - RNA, 15 nt, Chlamydophila pneumoniae J138
ucccucgcuaaagua

SEQ ID NO: 520781 - RNA, 14 nt, Chlamydophila pneumoniae J138
ucccucuagagcuu

SEQ ID NO: 520782 - RNA, 18 nt, Chlamydophila pneumoniae J138
ucccauagcaaugccuac

SEQ ID NO: 520783 - RNA, 22 nt, Chlamydophila pneumoniae J138
uccagguagcagaguuuuuccc

SEQ ID NO: 520784 - RNA, 15 nt, Chlamydophila pneumoniae J138
ucccacgggucagga

SEQ ID NO: 520785 - RNA, 14 nt, Chlamydophila pneumoniae J138
uccaggcucuagga

SEQ ID NO: 520786 - RNA, 20 nt, Chlamydophila pneumoniae J138
ucgacuucaccuugaaguuu

SEQ ID NO: 520787 - RNA, 21 nt, Chlamydophila pneumoniae J138
ucgauaacacuucuuucuugc

SEQ ID NO: 520788 - RNA, 17 nt, Chlamydophila pneumoniae J138
uccugaaaguacagaaa

SEQ ID NO: 520789 - RNA, 16 nt, Chlamydophila pneumoniae J138
uccucguuaauaagaa

SEQ ID NO: 520790 - RNA, 17 nt, Chlamydophila pneumoniae J138
uccucuuaggagagcuu

SEQ ID NO: 520791 - RNA, 14 nt, Chlamydophila pneumoniae J138
uccuuuuuaggaaa

SEQ ID NO: 520792 - RNA, 13 nt, Chlamydophila pneumoniae J138
uccuguagggaaa

SEQ ID NO: 520793 - RNA, 15 nt, Chlamydophila pneumoniae J138
ucgcgacaagacaau

SEQ ID NO: 520794 - RNA, 17 nt, Chlamydophila pneumoniae J138
ucguagcaggcaucacu

SEQ ID NO: 520795 - RNA, 18 nt, Chlamydophila pneumoniae J138
ucgguucggucucuucuc

SEQ ID NO: 520796 - RNA, 23 nt, Chlamydophila pneumoniae J138
ucgguuacuuuaaucaagccuaa

SEQ ID NO: 520797 - RNA, 23 nt, Chlamydophila pneumoniae J138
ucguauauaagauaauagagaag

SEQ ID NO: 520798 - RNA, 21 nt, Chlamydophila pneumoniae J138
ucgugacucuuaucuggagau

SEQ ID NO: 520799 - RNA, 15 nt, Chlamydophila pneumoniae J138
ucuccaaaagcucua

SEQ ID NO: 520800 - RNA, 21 nt, Chlamydophila pneumoniae J138
ucuccgauagagauucuuucu

SEQ ID NO: 520801 - RNA, 19 nt, Chlamydophila pneumoniae J138
ucuccgucauauuuaaaag

SEQ ID NO: 520802 - RNA, 18 nt, Chlamydophila pneumoniae J138
ucucucuccaaagagucu

SEQ ID NO: 520803 - RNA, 17 nt, Chlamydophila pneumoniae J138
ucucuaggaagauuuau

SEQ ID NO: 520804 - RNA, 17 nt, Chlamydophila pneumoniae J138
ucucuaaauggaugauc

SEQ ID NO: 520805 - RNA, 22 nt, Chlamydophila pneumoniae J138
ucugaauagcucuuuucaugau

SEQ ID NO: 520806 - RNA, 17 nt, Chlamydophila pneumoniae J138
ucugaugaccucaucuc

SEQ ID NO: 520807 - RNA, 16 nt, Chlamydophila pneumoniae J138
ucugauccgaaaagaa

SEQ ID NO: 520808 - RNA, 23 nt, Chlamydophila pneumoniae J138
ucuuaucugcuauguaggcagau

SEQ ID NO: 520809 - RNA, 14 nt, Chlamydophila pneumoniae J138
ucuucaaagaacuu

SEQ ID NO: 520810 - RNA, 21 nt, Chlamydophila pneumoniae J138
ucuucaauccccugcaucucu

SEQ ID NO: 520811 - RNA, 19 nt, Chlamydophila pneumoniae J138
ucuucaauagaacgaauuu

SEQ ID NO: 520812 - RNA, 19 nt, Chlamydophila pneumoniae J138
ucugcugcgacacgaauuu

SEQ ID NO: 520813 - RNA, 19 nt, Chlamydophila pneumoniae J138
ucuucugaaaucaaaaaaa

SEQ ID NO: 520814 - RNA, 14 nt, Chlamydophila pneumoniae J138
ucuuucaauagcuu

SEQ ID NO: 520815 - RNA, 14 nt, Chlamydophila pneumoniae J138
ucuuuauuuaaaua

SEQ ID NO: 520816 - RNA, 16 nt, Chlamydophila pneumoniae J138
ucuuucugcucuucua

SEQ ID NO: 520817 - RNA, 20 nt, Chlamydophila pneumoniae J138
ucuuucuaagauaucuugua

SEQ ID NO: 520818 - RNA, 22 nt, Chlamydophila pneumoniae J138
ucuuugaggauacgaauaaguu

SEQ ID NO: 520819 - RNA, 14 nt, Chlamydophila pneumoniae J138
ugaaagagcuuuga

SEQ ID NO: 520820 - RNA, 20 nt, Chlamydophila pneumoniae J138
ugauaaagggaauuuucuca

SEQ ID NO: 520821 - RNA, 16 nt, Chlamydophila pneumoniae J138
ugaggauacacuucua

SEQ ID NO: 520822 - RNA, 18 nt, Chlamydophila pneumoniae J138
ugaguuaagcaauaucug

SEQ ID NO: 520823 - RNA, 20 nt, Chlamydophila pneumoniae J138
ugaucuacaaaaacuagaau

SEQ ID NO: 520824 - RNA, 18 nt, Chlamydophila pneumoniae J138
ugcauaauuuuucuuagu

SEQ ID NO: 520825 - RNA, 18 nt, Chlamydophila pneumoniae J138
ugcauaaucucaccagaa

SEQ ID NO: 520826 - RNA, 15 nt, Chlamydophila pneumoniae J138
ugaugcuucuuucaa

SEQ ID NO: 520827 - RNA, 21 nt, Chlamydophila pneumoniae J138
aauguugggaugaucucguag

SEQ ID NO: 520828 - RNA, 24 nt, Chlamydophila pneumoniae J138
acaaacccauauuugaauaaagga

SEQ ID NO: 520829 - RNA, 21 nt, Chlamydophila pneumoniae J138
acaaaugcgguaucuccggaa

SEQ ID NO: 520830 - RNA, 19 nt, Chlamydophila pneumoniae J138
acaagaaccuguuuuucua

SEQ ID NO: 520831 - RNA, 16 nt, Chlamydophila pneumoniae J138
acaacuugguaagcaa

SEQ ID NO: 520832 - RNA, 21 nt, Chlamydophila pneumoniae J138
acaagauggugagauuucuaa

SEQ ID NO: 520833 - RNA, 19 nt, Chlamydophila pneumoniae J138
acaaugcuaucuccagaaa

SEQ ID NO: 520834 - RNA, 14 nt, Chlamydophila pneumoniae J138
acauccuuguagaa

SEQ ID NO: 520835 - RNA, 18 nt, Chlamydophila pneumoniae J138
acauaguuuaauaaaucu

SEQ ID NO: 520836 - RNA, 23 nt, Chlamydophila pneumoniae J138
acauccauucuuaauauaaaaga

SEQ ID NO: 520837 - RNA, 12 nt, Chlamydophila pneumoniae J138
acagucauaaaa

SEQ ID NO: 520838 - RNA, 20 nt, Chlamydophila pneumoniae J138
acauaaccucggucucgcug

SEQ ID NO: 520839 - RNA, 22 nt, Chlamydophila pneumoniae J138
accaacuccucaaaagauaucg

SEQ ID NO: 520840 - RNA, 14 nt, Chlamydophila pneumoniae J138
acaucuccuuucaa

SEQ ID NO: 520841 - RNA, 12 nt, Chlamydophila pneumoniae J138
acaucucuuuaa

SEQ ID NO: 520842 - RNA, 22 nt, Chlamydophila pneumoniae J138
acaucucuuuaacuucuaaaag

SEQ ID NO: 520843 - RNA, 20 nt, Chlamydophila pneumoniae J138
acauucuaacgcuuuuucaa

SEQ ID NO: 520844 - RNA, 18 nt, Chlamydophila pneumoniae J138
acauugaagagcuugcug

SEQ ID NO: 520845 - RNA, 23 nt, Chlamydophila pneumoniae J138
accgccugacgauaguacuuauc

SEQ ID NO: 520846 - RNA, 21 nt, Chlamydophila pneumoniae J138
acccucggagacucagagaaa

SEQ ID NO: 520847 - RNA, 14 nt, Chlamydophila pneumoniae J138
accgaaaaaccuuc

SEQ ID NO: 520848 - RNA, 13 nt, Chlamydophila pneumoniae J138
acccaucuagaaa

SEQ ID NO: 520849 - RNA, 14 nt, Chlamydophila pneumoniae J138
accucgaauuccuc

SEQ ID NO: 520850 - RNA, 23 nt, Chlamydophila pneumoniae J138
accucaucagaaguggccuugcc

SEQ ID NO: 520851 - RNA, 14 nt, Chlamydophila pneumoniae J138
accuauauuuuuua

SEQ ID NO: 520852 - RNA, 14 nt, Chlamydophila pneumoniae J138
accuguuuuucuaa

SEQ ID NO: 520853 - RNA, 19 nt, Chlamydophila pneumoniae J138
accuugugagagggucuca

SEQ ID NO: 520854 - RNA, 11 nt, Chlamydophila pneumoniae J138
acgcagagaug

SEQ ID NO: 520855 - RNA, 16 nt, Chlamydophila pneumoniae J138
acgaugaacguauagg

SEQ ID NO: 520856 - RNA, 20 nt, Chlamydophila pneumoniae J138
acggccgacucuacaucuuc

SEQ ID NO: 520857 - RNA, 21 nt, Chlamydophila pneumoniae J138
acggauaggaucauugaguuc

SEQ ID NO: 520858 - RNA, 14 nt, Chlamydophila pneumoniae J138
acuagagaaaaagc

SEQ ID NO: 520859 - RNA, 12 nt, Chlamydophila pneumoniae J138
acuacugaaaca

SEQ ID NO: 520860 - RNA, 13 nt, Chlamydophila pneumoniae J138
acuaaaucucgag

SEQ ID NO: 520861 - RNA, 22 nt, Chlamydophila pneumoniae J138
acugaugugaagccauuuucua

SEQ ID NO: 520862 - RNA, 20 nt, Chlamydophila pneumoniae J138
acucuuuaggucuugucuau

SEQ ID NO: 520863 - RNA, 13 nt, Chlamydophila pneumoniae J138
acucuugcuugcu

SEQ ID NO: 520864 - RNA, 20 nt, Chlamydophila pneumoniae J138
acuccgcacuugcucuuuaa

SEQ ID NO: 520865 - RNA, 19 nt, Chlamydophila pneumoniae J138
aauagcaagagcuauaccu

SEQ ID NO: 520866 - RNA, 16 nt, Chlamydophila pneumoniae J138
aauaggaacaaagcuc

SEQ ID NO: 520867 - RNA, 13 nt, Chlamydophila pneumoniae J138
aauagcuaaagug

SEQ ID NO: 520868 - RNA, 20 nt, Chlamydophila pneumoniae J138
ugcgcacaagggauucuugu

SEQ ID NO: 520869 - RNA, 16 nt, Chlamydophila pneumoniae J138
ugcgccagcaaagauu

SEQ ID NO: 520870 - RNA, 16 nt, Chlamydophila pneumoniae J138
ugcuguuccauaauuu

SEQ ID NO: 520871 - RNA, 23 nt, Chlamydophila pneumoniae J138
ugcuuaaggaaacagugguaugc

SEQ ID NO: 520872 - RNA, 13 nt, Chlamydophila pneumoniae J138
ugcuccucuucuu

SEQ ID NO: 520873 - RNA, 22 nt, Chlamydophila pneumoniae J138
ugcugcagcaaaacuaggaaaa

SEQ ID NO: 520874 - RNA, 13 nt, Chlamydophila pneumoniae J138
uggaauuuuccug

SEQ ID NO: 520875 - RNA, 13 nt, Chlamydophila pneumoniae J138
uggugauuucuuu

SEQ ID NO: 520876 - RNA, 13 nt, Chlamydophila pneumoniae J138
uguacagaaaaua

SEQ ID NO: 520877 - RNA, 20 nt, Chlamydophila pneumoniae J138
ugggggacuucaaaugaaau

SEQ ID NO: 520878 - RNA, 20 nt, Chlamydophila pneumoniae J138
uggggauuaguagcuauucu

SEQ ID NO: 520879 - RNA, 23 nt, Chlamydophila pneumoniae J138
uucuucaauaggaauuagagaaa

SEQ ID NO: 520880 - RNA, 22 nt, Chlamydophila pneumoniae J138
uucuguagugagauacggagga

SEQ ID NO: 520881 - RNA, 19 nt, Chlamydophila pneumoniae J138
uucuggauacguuuuuccc

SEQ ID NO: 520882 - RNA, 18 nt, Chlamydophila pneumoniae J138
uucuucaucuucuaaauc

SEQ ID NO: 520883 - RNA, 15 nt, Chlamydophila pneumoniae J138
uucuuccuucuucuu

SEQ ID NO: 520884 - RNA, 14 nt, Chlamydophila pneumoniae J138
uugcaugaggagac

SEQ ID NO: 520885 - RNA, 19 nt, Chlamydophila pneumoniae J138
uuguauuccuuggauuucu

SEQ ID NO: 520886 - RNA, 14 nt, Chlamydophila pneumoniae J138
uuguuuuaauugua

SEQ ID NO: 520887 - RNA, 14 nt, Chlamydophila pneumoniae J138
uuucgcuaacuuau

SEQ ID NO: 520888 - RNA, 21 nt, Chlamydophila pneumoniae J138
uuuccggggagaacuucaaca

SEQ ID NO: 520889 - RNA, 14 nt, Chlamydophila pneumoniae J138
uuucuuccacacaa

SEQ ID NO: 520890 - RNA, 12 nt, Chlamydophila pneumoniae J138
uuucuuuagaga

SEQ ID NO: 520891 - RNA, 16 nt, Chlamydophila pneumoniae J138
uuucguagacgcucua

SEQ ID NO: 520892 - RNA, 16 nt, Chlamydophila pneumoniae J138
uuuacaauuagagauu

SEQ ID NO: 520893 - RNA, 13 nt, Chlamydophila pneumoniae J138
uuugccugaaauc

SEQ ID NO: 520894 - RNA, 19 nt, Chlamydophila pneumoniae J138
uuugcgauaucuauaaaug

SEQ ID NO: 520895 - RNA, 17 nt, Chlamydophila pneumoniae J138
uuugaucaggagucucu

SEQ ID NO: 520896 - RNA, 14 nt, Chlamydophila pneumoniae J138
uuugcuaagagcuc

SEQ ID NO: 520897 - RNA, 14 nt, Chlamydophila pneumoniae J138
uuuggaaagcucuu

SEQ ID NO: 520898 - RNA, 18 nt, Chlamydophila pneumoniae J138
uuuguuaaauucccaaaa

SEQ ID NO: 520899 - RNA, 19 nt, Chlamydophila pneumoniae J138
uuuguagcucccauaaguu

SEQ ID NO: 520900 - RNA, 19 nt, Chlamydophila pneumoniae J138
uuuuagagccuuuucagau

SEQ ID NO: 520901 - RNA, 16 nt, Chlamydophila pneumoniae J138
uuuuauaaagaagaaa

SEQ ID NO: 520902 - RNA, 21 nt, Chlamydophila pneumoniae J138
uuuuugcuguuucuucugaau

SEQ ID NO: 520903 - RNA, 21 nt, Chlamydophila pneumoniae J138
aauggguuuuguuucaucuuc

SEQ ID NO: 520904 - RNA, 23 nt, Chlamydophila pneumoniae J138
aaugagcuucacaucuuucucua

SEQ ID NO: 520905 - RNA, 18 nt, Chlamydophila pneumoniae J138
aaugaggacacaacucuu

SEQ ID NO: 520906 - RNA, 23 nt, Chlamydophila pneumoniae J138
aaugccucuuucauacuaaaauc

SEQ ID NO: 520907 - RNA, 21 nt, Chlamydophila pneumoniae J138
uguucaaaaauagauaagauc

SEQ ID NO: 520908 - RNA, 23 nt, Chlamydophila pneumoniae J138
ugugauaccuccuccaaucugcu

SEQ ID NO: 520909 - RNA, 22 nt, Chlamydophila pneumoniae J138
ugucuugaagagauugauuucu

SEQ ID NO: 520910 - RNA, 15 nt, Chlamydophila pneumoniae J138
ugucuuaaagcacua

SEQ ID NO: 520911 - RNA, 14 nt, Chlamydophila pneumoniae J138
uuaaagcaaaaauu

SEQ ID NO: 520912 - RNA, 22 nt, Chlamydophila pneumoniae J138
uuaaaucguacuucacuucuga

SEQ ID NO: 520913 - RNA, 15 nt, Chlamydophila pneumoniae J138
uuaaugaacucaggc

SEQ ID NO: 520914 - RNA, 19 nt, Chlamydophila pneumoniae J138
uuacacugcuucaaaacau

SEQ ID NO: 520915 - RNA, 16 nt, Chlamydophila pneumoniae J138
uuacauguaaacaaaa

SEQ ID NO: 520916 - RNA, 18 nt, Chlamydophila pneumoniae J138
uuaaauuuuguuuuucca

SEQ ID NO: 520917 - RNA, 20 nt, Chlamydophila pneumoniae J138
uuagcuucuuuuuuuuucuu

SEQ ID NO: 520918 - RNA, 17 nt, Chlamydophila pneumoniae J138
uuacuaggaaggaaauc

SEQ ID NO: 520919 - RNA, 15 nt, Chlamydophila pneumoniae J138
uuacgugagaacuca

SEQ ID NO: 520920 - RNA, 15 nt, Chlamydophila pneumoniae J138
uuagcaagagcucuu

SEQ ID NO: 520921 - RNA, 14 nt, Chlamydophila pneumoniae J138
uuagaggagacucu

SEQ ID NO: 520922 - RNA, 15 nt, Chlamydophila pneumoniae J138
uuagcauagagcucu

SEQ ID NO: 520923 - RNA, 20 nt, Chlamydophila pneumoniae J138
uuagcaucgcuuaacaaacu

SEQ ID NO: 520924 - RNA, 21 nt, Chlamydophila pneumoniae J138
uucauuuccaaauucuugcau

SEQ ID NO: 520925 - RNA, 23 nt, Chlamydophila pneumoniae J138
uuccgaauugcgaauccugagga

SEQ ID NO: 520926 - RNA, 12 nt, Chlamydophila pneumoniae J138
uucccuuuaaaa

SEQ ID NO: 520927 - RNA, 12 nt, Chlamydophila pneumoniae J138
uucccucuucuu

SEQ ID NO: 520928 - RNA, 14 nt, Chlamydophila pneumoniae J138
uuccgaagaagaaa

SEQ ID NO: 520929 - RNA, 15 nt, Chlamydophila pneumoniae J138
uucccuaccugagga

SEQ ID NO: 520930 - RNA, 20 nt, Chlamydophila pneumoniae J138
uuccauccugucuauuucuu

SEQ ID NO: 520931 - RNA, 19 nt, Chlamydophila pneumoniae J138
uuccaggaccaaacuucga

SEQ ID NO: 520932 - RNA, 14 nt, Chlamydophila pneumoniae J138
uucaucaaaacaua

SEQ ID NO: 520933 - RNA, 20 nt, Chlamydophila pneumoniae J138
uucauaugaaugacugcaga

SEQ ID NO: 520934 - RNA, 22 nt, Chlamydophila pneumoniae J138
uuauccccuauaguagaagaaa

SEQ ID NO: 520935 - RNA, 21 nt, Chlamydophila pneumoniae J138
uucacgauaucuaccaaaguc

SEQ ID NO: 520936 - RNA, 23 nt, Chlamydophila pneumoniae J138
uucacuugguagcgucucuucuu

SEQ ID NO: 520937 - RNA, 16 nt, Chlamydophila pneumoniae J138
uucguggagugcucua

SEQ ID NO: 520938 - RNA, 13 nt, Chlamydophila pneumoniae J138
uucguuacuagga

SEQ ID NO: 520939 - RNA, 17 nt, Chlamydophila pneumoniae J138
uucuaagcaauauuucu

SEQ ID NO: 520940 - RNA, 13 nt, Chlamydophila pneumoniae J138
uucuaagauuccu

SEQ ID NO: 520941 - RNA, 13 nt, Chlamydophila pneumoniae J138
uucuaagauaucu

SEQ ID NO: 520942 - RNA, 13 nt, Chlamydophila pneumoniae J138
uucuaaagauuuu

SEQ ID NO: 520943 - RNA, 15 nt, Chlamydophila pneumoniae J138
uucuaaaacuucagu

SEQ ID NO: 520944 - RNA, 17 nt, Chlamydophila pneumoniae J138
uucuaauccuccaaacg

SEQ ID NO: 520945 - RNA, 19 nt, Chlamydophila pneumoniae J138
uucuaagagguucuugcuu

SEQ ID NO: 520946 - RNA, 18 nt, Chlamydophila pneumoniae J138
uucuacaccauagaacug

SEQ ID NO: 520947 - RNA, 14 nt, Chlamydophila pneumoniae J138
aaucagaggagccu

SEQ ID NO: 520948 - RNA, 21 nt, Chlamydophila pneumoniae J138
uucucgaggggacggaaaauc

SEQ ID NO: 520949 - RNA, 14 nt, Chlamydophila pneumoniae J138
uucuccucuuucuu

SEQ ID NO: 520950 - RNA, 18 nt, Chlamydophila pneumoniae J138
uucuccggaguauccucc

SEQ ID NO: 520951 - RNA, 14 nt, Chlamydophila pneumoniae J138
uucgaauucucaga

SEQ ID NO: 520952 - RNA, 18 nt, Chlamydophila pneumoniae J138
uuccuuagcauuaggaaa

SEQ ID NO: 520953 - RNA, 22 nt, Chlamydophila pneumoniae J138
aaacuugcuuuuuugaaagcug

SEQ ID NO: 520954 - RNA, 20 nt, Chlamydophila pneumoniae J138
aaacuucccaucuuguucua

SEQ ID NO: 520955 - RNA, 16 nt, Chlamydophila pneumoniae J138
aaagauaugucuugcu

SEQ ID NO: 520956 - RNA, 22 nt, Chlamydophila pneumoniae J138
aaagaucgaucucugugguucc

SEQ ID NO: 520957 - RNA, 14 nt, Chlamydophila pneumoniae J138
aaacuauaaaagcc

SEQ ID NO: 520958 - RNA, 13 nt, Chlamydophila pneumoniae J138
aaacucucuuccu

SEQ ID NO: 520959 - RNA, 23 nt, Chlamydophila pneumoniae J138
aaaaaccccuagaacuuuacaau

SEQ ID NO: 520960 - RNA, 22 nt, Chlamydophila pneumoniae J138
aaaaauggcacuugagcacauu

SEQ ID NO: 520961 - RNA, 20 nt, Chlamydophila pneumoniae J138
aaaaauaccaagaugucucc

SEQ ID NO: 520962 - RNA, 22 nt, Chlamydophila pneumoniae J138
aaaaauucuagaccugccaaga

SEQ ID NO: 520963 - RNA, 12 nt, Chlamydophila pneumoniae J138
aaagcuaaaaug

SEQ ID NO: 520964 - RNA, 15 nt, Chlamydophila pneumoniae J138
aaauaggagaagccc

SEQ ID NO: 520965 - RNA, 20 nt, Chlamydophila pneumoniae J138
aaaguuagguagauagaaau

SEQ ID NO: 520966 - RNA, 14 nt, Chlamydophila pneumoniae J138
aaauaccaaggcug

SEQ ID NO: 520967 - RNA, 19 nt, Chlamydophila pneumoniae J138
aaaacgauccuguuccccu

SEQ ID NO: 520968 - RNA, 21 nt, Chlamydophila pneumoniae J138
aaaagcacuuaaaaaacuucc

SEQ ID NO: 520969 - RNA, 17 nt, Chlamydophila pneumoniae J138
aaaugccuuaaauguau

SEQ ID NO: 520970 - RNA, 13 nt, Chlamydophila pneumoniae J138
aaaugcuccugca

SEQ ID NO: 520971 - RNA, 22 nt, Chlamydophila pneumoniae J138
aaaugcgcacggauucuaaaag

SEQ ID NO: 520972 - RNA, 15 nt, Chlamydophila pneumoniae J138
aacaagaagaucaaa

SEQ ID NO: 520973 - RNA, 15 nt, Chlamydophila pneumoniae J138
aacagagcgccucca

SEQ ID NO: 520974 - RNA, 22 nt, Chlamydophila pneumoniae J138
aacaguguagccuuucuuuuua

SEQ ID NO: 520975 - RNA, 21 nt, Chlamydophila pneumoniae J138
aagauugcagguagauccuau

SEQ ID NO: 520976 - RNA, 15 nt, Chlamydophila pneumoniae J138
aagaugaauaccaga

SEQ ID NO: 520977 - RNA, 19 nt, Chlamydophila pneumoniae J138
aacuaguaacuuaaucaau

SEQ ID NO: 520978 - RNA, 18 nt, Chlamydophila pneumoniae J138
aacuacuuaaauccuaag

SEQ ID NO: 520979 - RNA, 22 nt, Chlamydophila pneumoniae J138
aagagcucguaauccuucuuuc

SEQ ID NO: 520980 - RNA, 17 nt, Chlamydophila pneumoniae J138
aagagccggaacuucag

SEQ ID NO: 520981 - RNA, 13 nt, Chlamydophila pneumoniae J138
aagaggucgaaga

SEQ ID NO: 520982 - RNA, 11 nt, Chlamydophila pneumoniae J138
aacuacauaua

SEQ ID NO: 520983 - RNA, 19 nt, Chlamydophila pneumoniae J138
aacgugauugcugcugcua

SEQ ID NO: 520984 - RNA, 17 nt, Chlamydophila pneumoniae J138
aagccuucauuccauga

SEQ ID NO: 520985 - RNA, 16 nt, Chlamydophila pneumoniae J138
aagcauagcccgaaau

SEQ ID NO: 520986 - RNA, 16 nt, Chlamydophila pneumoniae J138
aagcggagcaucuuuu

SEQ ID NO: 520987 - RNA, 17 nt, Chlamydophila pneumoniae J138
aagcucgcguauuuucg

SEQ ID NO: 520988 - RNA, 13 nt, Chlamydophila pneumoniae J138
aagcuaaaaugcg

SEQ ID NO: 520989 - RNA, 13 nt, Chlamydophila pneumoniae J138
aagcucuaagucc

SEQ ID NO: 520990 - RNA, 18 nt, Chlamydophila pneumoniae J138
aagcuucuuuaauuccaa

SEQ ID NO: 520991 - RNA, 21 nt, Chlamydophila pneumoniae J138
aaggaccuccucacauguuuc

SEQ ID NO: 520992 - RNA, 23 nt, Chlamydophila pneumoniae J138
aaggaagaucuugaacagagacu

SEQ ID NO: 520993 - RNA, 21 nt, Chlamydophila pneumoniae J138
aagcuuuuacgagcuuuuuua

SEQ ID NO: 520994 - RNA, 19 nt, Chlamydophila pneumoniae J138
aagggaucuccuucaugca

SEQ ID NO: 520995 - RNA, 14 nt, Chlamydophila pneumoniae J138
aagggccagaaacg

SEQ ID NO: 520996 - RNA, 17 nt, Chlamydophila pneumoniae J138
aaggcuuuucuuuuucu

SEQ ID NO: 520997 - RNA, 15 nt, Chlamydophila pneumoniae J138
aagguugcuuuucua

SEQ ID NO: 520998 - RNA, 19 nt, Chlamydophila pneumoniae J138
aaggggaguuuucuuaacu

SEQ ID NO: 520999 - RNA, 15 nt, Chlamydophila pneumoniae J138
aaguagaauccuucu

SEQ ID NO: 521000 - RNA, 19 nt, Chlamydophila pneumoniae J138
aaguacgaccaacuccuca

SEQ ID NO: 521001 - RNA, 17 nt, Chlamydophila pneumoniae J138
aaguauucgauuccuga

SEQ ID NO: 521002 - RNA, 20 nt, Chlamydophila pneumoniae J138
aauacaucuuaagagcaaac

SEQ ID NO: 521003 - RNA, 19 nt, Chlamydophila pneumoniae J138
aauacaucaccacugcucc

SEQ ID NO: 521004 - RNA, 19 nt, Chlamydophila pneumoniae J138
aauacauagguaaaaccag

SEQ ID NO: 521005 - RNA, 23 nt, Chlamydophila pneumoniae J138
aauaauagcaaguagcucucucc

SEQ ID NO: 521006 - RNA, 14 nt, Chlamydophila pneumoniae J138
aauaauagcaagua

SEQ ID NO: 521007 - RNA, 23 nt, Chlamydophila pneumoniae J138
aagucacggcgaaagcuacagcu

SEQ ID NO: 521008 - RNA, 18 nt, Chlamydophila pneumoniae J138
aaguccaagaucaaacga

SEQ ID NO: 521009 - RNA, 15 nt, Chlamydophila pneumoniae J138
aaguccuaucaaagc

SEQ ID NO: 521010 - RNA, 15 nt, Chlamydophila pneumoniae J138
aauaagcaggaaaag

SEQ ID NO: 521011 - RNA, 17 nt, Chlamydophila pneumoniae J138
aaucacuuaauaauguu

SEQ ID NO: 521012 - RNA, 17 nt, Chlamydophila pneumoniae J138
aauagcucuuuucauga

SEQ ID NO: 521013 - RNA, 15 nt, Chlamydophila pneumoniae J138
aauccaacaaagaug

SEQ ID NO: 521014 - RNA, 20 nt, Chlamydophila pneumoniae J138
aaucauuagaguuugguuug

SEQ ID NO: 521015 - RNA, 19 nt, Chlamydophila pneumoniae J138
aaucuaauuuuagaacuuc

SEQ ID NO: 521016 - RNA, 14 nt, Chlamydophila pneumoniae J138
aauccuaauuccuu

SEQ ID NO: 521017 - RNA, 24 nt, Chlamydophila pneumoniae J138
aaucugacgugcauugaauccuuc

SEQ ID NO: 521018 - RNA, 12 nt, Chlamydophila pneumoniae J138
aauucuuuuccu

SEQ ID NO: 521019 - RNA, 23 nt, Chlamydophila pneumoniae J138
aaugucguaccccgcagcaaaaa

SEQ ID NO: 521020 - RNA, 15 nt, Chlamydophila pneumoniae J138
acaaacccauauuug

SEQ ID NO: 521021 - RNA, 22 nt, Chlamydophila pneumoniae J138
acauuaagcucaaaauuuccuc

SEQ ID NO: 521022 - RNA, 21 nt, Chlamydophila pneumoniae J138
acauuuguugucagcuuugcu

SEQ ID NO: 521023 - RNA, 16 nt, Chlamydophila pneumoniae J138
accaaaaauaaacaua

SEQ ID NO: 521024 - RNA, 19 nt, Chlamydophila pneumoniae J138
accaacuccucaaaagaua

SEQ ID NO: 521025 - RNA, 21 nt, Chlamydophila pneumoniae J138
accaaggcugcugauccaaaa

SEQ ID NO: 521026 - RNA, 20 nt, Chlamydophila pneumoniae J138
accaauaaauccaaaaaaug

SEQ ID NO: 521027 - RNA, 13 nt, Chlamydophila pneumoniae J138
accaccuaaaaug

SEQ ID NO: 521028 - RNA, 19 nt, Chlamydophila pneumoniae J138
accacauacucuucauccu

SEQ ID NO: 521029 - RNA, 15 nt, Chlamydophila pneumoniae J138
accagaugcuaaaga

SEQ ID NO: 521030 - RNA, 17 nt, Chlamydophila pneumoniae J138
accacuaccgaauuuuc

SEQ ID NO: 521031 - RNA, 12 nt, Chlamydophila pneumoniae J138
accagaagacuc

SEQ ID NO: 521032 - RNA, 19 nt, Chlamydophila pneumoniae J138
accacuuuagaauuuucuu

SEQ ID NO: 521033 - RNA, 22 nt, Chlamydophila pneumoniae J138
accgagaagcuucaaugaugug

SEQ ID NO: 521034 - RNA, 19 nt, Chlamydophila pneumoniae J138
acccugggcucacucuaag

SEQ ID NO: 521035 - RNA, 22 nt, Chlamydophila pneumoniae J138
acgaucaaauuccuucucagaa

SEQ ID NO: 521036 - RNA, 15 nt, Chlamydophila pneumoniae J138
acgaucaaauuccuu

SEQ ID NO: 521037 - RNA, 18 nt, Chlamydophila pneumoniae J138
acucacgcucucgcuaag

SEQ ID NO: 521038 - RNA, 18 nt, Chlamydophila pneumoniae J138
acuaugguaagcauuucu

SEQ ID NO: 521039 - RNA, 23 nt, Chlamydophila pneumoniae J138
acucccuagguuuuaucuuuaga

SEQ ID NO: 521040 - RNA, 18 nt, Chlamydophila pneumoniae J138
acucaggauauauagagc

SEQ ID NO: 521041 - RNA, 15 nt, Chlamydophila pneumoniae J138
acucuaguuuuucuu

SEQ ID NO: 521042 - RNA, 20 nt, Chlamydophila pneumoniae J138
acucguugccaaucuuucau

SEQ ID NO: 521043 - RNA, 13 nt, Chlamydophila pneumoniae J138
acuguaauuggag

SEQ ID NO: 521044 - RNA, 16 nt, Chlamydophila pneumoniae J138
acuucaccuugaaguu

SEQ ID NO: 521045 - RNA, 23 nt, Chlamydophila pneumoniae J138
acuucaggacgcacauuuagaag

SEQ ID NO: 521046 - RNA, 22 nt, Chlamydophila pneumoniae J138
acuucuuguccuguuaagaugu

SEQ ID NO: 521047 - RNA, 13 nt, Chlamydophila pneumoniae J138
acuucuuucuugc

SEQ ID NO: 521048 - RNA, 15 nt, Chlamydophila pneumoniae J138
aaaccacagcaaaga

SEQ ID NO: 521049 - RNA, 21 nt, Chlamydophila pneumoniae J138
agcagauccugcuucuauaga

SEQ ID NO: 521050 - RNA, 23 nt, Chlamydophila pneumoniae J138
agcagauccugcuucuauagaga

SEQ ID NO: 521051 - RNA, 22 nt, Chlamydophila pneumoniae J138
agcaacuucccgaacagcggca

SEQ ID NO: 521052 - RNA, 18 nt, Chlamydophila pneumoniae J138
agcaauuaccugcccuug

SEQ ID NO: 521053 - RNA, 15 nt, Chlamydophila pneumoniae J138
agcaucguauuuucc

SEQ ID NO: 521054 - RNA, 19 nt, Chlamydophila pneumoniae J138
agcaucaggauucucucug

SEQ ID NO: 521055 - RNA, 18 nt, Chlamydophila pneumoniae J138
agcucuaaaaaagauaaa

SEQ ID NO: 521056 - RNA, 24 nt, Chlamydophila pneumoniae J138
agcucuuucccucguugcuuagcg

SEQ ID NO: 521057 - RNA, 15 nt, Chlamydophila pneumoniae J138
agcugaucuucuaaa

SEQ ID NO: 521058 - RNA, 19 nt, Chlamydophila pneumoniae J138
agcuauuuuacuuacuaaa

SEQ ID NO: 521059 - RNA, 23 nt, Chlamydophila pneumoniae J138
agcuccauaagcuuuucuuccaa

SEQ ID NO: 521060 - RNA, 17 nt, Chlamydophila pneumoniae J138
aggcccccuacagcaga

SEQ ID NO: 521061 - RNA, 21 nt, Chlamydophila pneumoniae J138
aggggcucccaagguuccucg

SEQ ID NO: 521062 - RNA, 22 nt, Chlamydophila pneumoniae J138
agggucuaguucaauuucuaua

SEQ ID NO: 521063 - RNA, 13 nt, Chlamydophila pneumoniae J138
aguauaagaugcu

SEQ ID NO: 521064 - RNA, 20 nt, Chlamydophila pneumoniae J138
aguaaucacuucagcacgaa

SEQ ID NO: 521065 - RNA, 16 nt, Chlamydophila pneumoniae J138
agguuguccuauagag

SEQ ID NO: 521066 - RNA, 18 nt, Chlamydophila pneumoniae J138
agguuuuaaauuuagagg

SEQ ID NO: 521067 - RNA, 15 nt, Chlamydophila pneumoniae J138
agucucucuaaggga

SEQ ID NO: 521068 - RNA, 14 nt, Chlamydophila pneumoniae J138
agugaaugagcuuc

SEQ ID NO: 521069 - RNA, 16 nt, Chlamydophila pneumoniae J138
aguuccaagacaauaa

SEQ ID NO: 521070 - RNA, 21 nt, Chlamydophila pneumoniae J138
aguucaucauauuuuucuuga

SEQ ID NO: 521071 - RNA, 18 nt, Chlamydophila pneumoniae J138
aguguauaucagcaaaaa

SEQ ID NO: 521072 - RNA, 20 nt, Chlamydophila pneumoniae J138
agugucauacgcagcacgca

SEQ ID NO: 521073 - RNA, 20 nt, Chlamydophila pneumoniae J138
auaaccaggggcuuuccuuc

SEQ ID NO: 521074 - RNA, 12 nt, Chlamydophila pneumoniae J138
auaaccugagag

SEQ ID NO: 521075 - RNA, 11 nt, Chlamydophila pneumoniae J138
auaagaucaau

SEQ ID NO: 521076 - RNA, 20 nt, Chlamydophila pneumoniae J138
aguuuguuuuaauuguagag

SEQ ID NO: 521077 - RNA, 23 nt, Chlamydophila pneumoniae J138
aguuugccuucuuaucuucuaaa

SEQ ID NO: 521078 - RNA, 23 nt, Chlamydophila pneumoniae J138
aguuugucguaauugcugaaaau

SEQ ID NO: 521079 - RNA, 16 nt, Chlamydophila pneumoniae J138
aguuuuuauuuuuaaa

SEQ ID NO: 521080 - RNA, 13 nt, Chlamydophila pneumoniae J138
aguuuuuuucuaa

SEQ ID NO: 521081 - RNA, 13 nt, Chlamydophila pneumoniae J138
auacaaaaaauaa

SEQ ID NO: 521082 - RNA, 14 nt, Chlamydophila pneumoniae J138
auaccaaaauacca

SEQ ID NO: 521083 - RNA, 15 nt, Chlamydophila pneumoniae J138
auaauagagaagaag

SEQ ID NO: 521084 - RNA, 15 nt, Chlamydophila pneumoniae J138
auacgaacacagaua

SEQ ID NO: 521085 - RNA, 20 nt, Chlamydophila pneumoniae J138
auagagaacuccauucagau

SEQ ID NO: 521086 - RNA, 16 nt, Chlamydophila pneumoniae J138
auacgucccacaaaau

SEQ ID NO: 521087 - RNA, 23 nt, Chlamydophila pneumoniae J138
auacggccgacucuacaucuucu

SEQ ID NO: 521088 - RNA, 14 nt, Chlamydophila pneumoniae J138
auagcuuugaagag

SEQ ID NO: 521089 - RNA, 22 nt, Chlamydophila pneumoniae J138
auaguuuuugcuguuucuucug

SEQ ID NO: 521090 - RNA, 21 nt, Chlamydophila pneumoniae J138
auaguugcaugacuauuuuca

SEQ ID NO: 521091 - RNA, 18 nt, Chlamydophila pneumoniae J138
auaguugcaugacuauuu

SEQ ID NO: 521092 - RNA, 20 nt, Chlamydophila pneumoniae J138
auaggcauuacacaacucuu

SEQ ID NO: 521093 - RNA, 12 nt, Chlamydophila pneumoniae J138
auauagagaucu

SEQ ID NO: 521094 - RNA, 20 nt, Chlamydophila pneumoniae J138
auaucuaauaaaauuggcuu

SEQ ID NO: 521095 - RNA, 13 nt, Chlamydophila pneumoniae J138
auaugcuuuucaa

SEQ ID NO: 521096 - RNA, 14 nt, Chlamydophila pneumoniae J138
aucaauuuuaccac

SEQ ID NO: 521097 - RNA, 16 nt, Chlamydophila pneumoniae J138
aucaagagcucguaau

SEQ ID NO: 521098 - RNA, 22 nt, Chlamydophila pneumoniae J138
aucagagggacuccugugauag

SEQ ID NO: 521099 - RNA, 21 nt, Chlamydophila pneumoniae J138
aucuauauccacaaucucuuu

SEQ ID NO: 521100 - RNA, 17 nt, Chlamydophila pneumoniae J138
aucuauaaauguaggga

SEQ ID NO: 521101 - RNA, 22 nt, Chlamydophila pneumoniae J138
aucucacaaaagucucuaggga

SEQ ID NO: 521102 - RNA, 17 nt, Chlamydophila pneumoniae J138
aucuacgauguuuucuu

SEQ ID NO: 521103 - RNA, 14 nt, Chlamydophila pneumoniae J138
aucuaacgcacguu

SEQ ID NO: 521104 - RNA, 14 nt, Chlamydophila pneumoniae J138
aucugcguuucuuu

SEQ ID NO: 521105 - RNA, 16 nt, Chlamydophila pneumoniae J138
aucuguggcguaagca

SEQ ID NO: 521106 - RNA, 17 nt, Chlamydophila pneumoniae J138
aucuucacgacauacau

SEQ ID NO: 521107 - RNA, 17 nt, Chlamydophila pneumoniae J138
aucuucuaaaacuucag

SEQ ID NO: 521108 - RNA, 14 nt, Chlamydophila pneumoniae J138
aucuuucuucuaga

SEQ ID NO: 521109 - RNA, 16 nt, Chlamydophila pneumoniae J138
aucuuucauucccuuu

SEQ ID NO: 521110 - RNA, 16 nt, Chlamydophila pneumoniae J138
augaauauaauuccaa

SEQ ID NO: 521111 - RNA, 19 nt, Chlamydophila pneumoniae J138
augaaugauuuccauagag

SEQ ID NO: 521112 - RNA, 19 nt, Chlamydophila pneumoniae J138
augauccacugcuuuaggc

SEQ ID NO: 521113 - RNA, 23 nt, Chlamydophila pneumoniae J138
aucgagaaaugcucuucugcagc

SEQ ID NO: 521114 - RNA, 12 nt, Chlamydophila pneumoniae J138
augggaaucuug

SEQ ID NO: 521115 - RNA, 13 nt, Chlamydophila pneumoniae J138
auggacaauauag

SEQ ID NO: 521116 - RNA, 13 nt, Chlamydophila pneumoniae J138
auguacagaaaau

SEQ ID NO: 521117 - RNA, 14 nt, Chlamydophila pneumoniae J138
augucuccauacag

SEQ ID NO: 521118 - RNA, 22 nt, Chlamydophila pneumoniae J138
auguccguucgagagguucccu

SEQ ID NO: 521119 - RNA, 14 nt, Chlamydophila pneumoniae J138
augcuaaagagucu

SEQ ID NO: 521120 - RNA, 21 nt, Chlamydophila pneumoniae J138
augcuuucagugcugcuuucg

SEQ ID NO: 521121 - RNA, 13 nt, Chlamydophila pneumoniae J138
augccucuuucau

SEQ ID NO: 521122 - RNA, 14 nt, Chlamydophila pneumoniae J138
auuaagaagaagcu

SEQ ID NO: 521123 - RNA, 20 nt, Chlamydophila pneumoniae J138
auuauaaagauaaucuguaa

SEQ ID NO: 521124 - RNA, 13 nt, Chlamydophila pneumoniae J138
augugcugaagac

SEQ ID NO: 521125 - RNA, 13 nt, Chlamydophila pneumoniae J138
auguucucuccag

SEQ ID NO: 521126 - RNA, 14 nt, Chlamydophila pneumoniae J138
auuccuaaaccuaa

SEQ ID NO: 521127 - RNA, 17 nt, Chlamydophila pneumoniae J138
auucuugcauagcggca

SEQ ID NO: 521128 - RNA, 22 nt, Chlamydophila pneumoniae J138
auucugcuagagcuuucagaaa

SEQ ID NO: 521129 - RNA, 15 nt, Chlamydophila pneumoniae J138
auugcugucagaaca

SEQ ID NO: 521130 - RNA, 14 nt, Chlamydophila pneumoniae J138
auugcuaucaaaga

SEQ ID NO: 521131 - RNA, 20 nt, Chlamydophila pneumoniae J138
auugcaauacaucuuaagag

SEQ ID NO: 521132 - RNA, 15 nt, Chlamydophila pneumoniae J138
auuguauagcuuacu

SEQ ID NO: 521133 - RNA, 23 nt, Chlamydophila pneumoniae J138
cacauacucuucauccugaucuu

SEQ ID NO: 521134 - RNA, 15 nt, Chlamydophila pneumoniae J138
caacccgaauuccuc

SEQ ID NO: 521135 - RNA, 17 nt, Chlamydophila pneumoniae J138
auuuagaaucuuuucua

SEQ ID NO: 521136 - RNA, 16 nt, Chlamydophila pneumoniae J138
auuuacgaaaacaucu

SEQ ID NO: 521137 - RNA, 19 nt, Chlamydophila pneumoniae J138
auuuacguguuucugaaag

SEQ ID NO: 521138 - RNA, 17 nt, Chlamydophila pneumoniae J138
caacaaaagcuauauag

SEQ ID NO: 521139 - RNA, 17 nt, Chlamydophila pneumoniae J138
caaaugcagucucagga

SEQ ID NO: 521140 - RNA, 22 nt, Chlamydophila pneumoniae J138
caaauaggaucucucuuuccuu

SEQ ID NO: 521141 - RNA, 14 nt, Chlamydophila pneumoniae J138
caacucuccauccu

SEQ ID NO: 521142 - RNA, 19 nt, Chlamydophila pneumoniae J138
caaguaaucaugauaaaaa

SEQ ID NO: 521143 - RNA, 22 nt, Chlamydophila pneumoniae J138
caauaggccagaauguacauag

SEQ ID NO: 521144 - RNA, 12 nt, Chlamydophila pneumoniae J138
caaucccucuac

SEQ ID NO: 521145 - RNA, 14 nt, Chlamydophila pneumoniae J138
caaucuuccuuaac

SEQ ID NO: 521146 - RNA, 19 nt, Chlamydophila pneumoniae J138
cacgcuuucgucuaaaaua

SEQ ID NO: 521147 - RNA, 18 nt, Chlamydophila pneumoniae J138
aaacuuuuuuucuucucu

SEQ ID NO: 521148 - RNA, 14 nt, Chlamydophila pneumoniae J138
aaacuuucuucucu

SEQ ID NO: 521149 - RNA, 15 nt, Chlamydophila pneumoniae J138
aaacuguguuuucua

SEQ ID NO: 521150 - RNA, 17 nt, Chlamydophila pneumoniae J138
cagaaguuccuucagga

SEQ ID NO: 521151 - RNA, 23 nt, Chlamydophila pneumoniae J138
cagaaguuccuacuucugcagga

SEQ ID NO: 521152 - RNA, 15 nt, Chlamydophila pneumoniae J138
cagaaagacgaucuu

SEQ ID NO: 521153 - RNA, 20 nt, Chlamydophila pneumoniae J138
cagagcgaucgcaaucagca

SEQ ID NO: 521154 - RNA, 12 nt, Chlamydophila pneumoniae J138
aaagaaauguaa

SEQ ID NO: 521155 - RNA, 18 nt, Chlamydophila pneumoniae J138
cagcaacccgaauuccuc

SEQ ID NO: 521156 - RNA, 17 nt, Chlamydophila pneumoniae J138
cagauaccaaaauacca

SEQ ID NO: 521157 - RNA, 15 nt, Chlamydophila pneumoniae J138
aaagcagauccugcu

SEQ ID NO: 521158 - RNA, 16 nt, Chlamydophila pneumoniae J138
caggagagagaaggcu

SEQ ID NO: 521159 - RNA, 21 nt, Chlamydophila pneumoniae J138
cagcuauagauuuaagagucu

SEQ ID NO: 521160 - RNA, 15 nt, Chlamydophila pneumoniae J138
cagugaauccuucca

SEQ ID NO: 521161 - RNA, 17 nt, Chlamydophila pneumoniae J138
caucgacaaguaccuuc

SEQ ID NO: 521162 - RNA, 15 nt, Chlamydophila pneumoniae J138
cauaggggaugauuu

SEQ ID NO: 521163 - RNA, 20 nt, Chlamydophila pneumoniae J138
cauuccaagauugaauucau

SEQ ID NO: 521164 - RNA, 19 nt, Chlamydophila pneumoniae J138
cauuaucaagaaauucuuc

SEQ ID NO: 521165 - RNA, 14 nt, Chlamydophila pneumoniae J138
cauucuuucgauau

SEQ ID NO: 521166 - RNA, 17 nt, Chlamydophila pneumoniae J138
cauguaguaaauuccuc

SEQ ID NO: 521167 - RNA, 22 nt, Chlamydophila pneumoniae J138
cauuuguaagaaucauaacaag

SEQ ID NO: 521168 - RNA, 20 nt, Chlamydophila pneumoniae J138
cauuucgauaacacuucuuu

SEQ ID NO: 521169 - RNA, 19 nt, Chlamydophila pneumoniae J138
ccaaaaauucccauagcau

SEQ ID NO: 521170 - RNA, 17 nt, Chlamydophila pneumoniae J138
ccaagcuuccaacuuuu

SEQ ID NO: 521171 - RNA, 24 nt, Chlamydophila pneumoniae J138
ccacaauguuuagaauuuguccuu

SEQ ID NO: 521172 - RNA, 14 nt, Chlamydophila pneumoniae J138
ccagagauucuuca

SEQ ID NO: 521173 - RNA, 21 nt, Chlamydophila pneumoniae J138
aaauaaagagcugauccagcu

SEQ ID NO: 521174 - RNA, 14 nt, Chlamydophila pneumoniae J138
aaauaaccccucca

SEQ ID NO: 521175 - RNA, 21 nt, Chlamydophila pneumoniae J138
aaauaccccaucuaauccugu

SEQ ID NO: 521176 - RNA, 19 nt, Chlamydophila pneumoniae J138
aaauaauuucccuaaaaug

SEQ ID NO: 521177 - RNA, 17 nt, Chlamydophila pneumoniae J138
aaauauccuaaauauau

SEQ ID NO: 521178 - RNA, 12 nt, Chlamydophila pneumoniae J138
ccauaaauguau

SEQ ID NO: 521179 - RNA, 13 nt, Chlamydophila pneumoniae J138
ccauaauuucuuu

SEQ ID NO: 521180 - RNA, 16 nt, Chlamydophila pneumoniae J138
ccaguucuugaaacuc

SEQ ID NO: 521181 - RNA, 14 nt, Chlamydophila pneumoniae J138
cccucauaagauuu

SEQ ID NO: 521182 - RNA, 18 nt, Chlamydophila pneumoniae J138
ccgcaaauacagacagau

SEQ ID NO: 521183 - RNA, 17 nt, Chlamydophila pneumoniae J138
aaauuaagaacccgaua

SEQ ID NO: 521184 - RNA, 17 nt, Chlamydophila pneumoniae J138
aaauuaucagagacaag

SEQ ID NO: 521185 - RNA, 21 nt, Chlamydophila pneumoniae J138
aaauucaagacuauagaaaag

SEQ ID NO: 521186 - RNA, 20 nt, Chlamydophila pneumoniae J138
aaaugauaccaccuaaaaug

SEQ ID NO: 521187 - RNA, 20 nt, Chlamydophila pneumoniae J138
ccgcgcauagcaacuacaga

SEQ ID NO: 521188 - RNA, 13 nt, Chlamydophila pneumoniae J138
ccguaacugaggc

SEQ ID NO: 521189 - RNA, 13 nt, Chlamydophila pneumoniae J138
ccuaaaacaagaa

SEQ ID NO: 521190 - RNA, 18 nt, Chlamydophila pneumoniae J138
ccuaagcucauaagaaau

SEQ ID NO: 521191 - RNA, 17 nt, Chlamydophila pneumoniae J138
ccuaagugauaaggaag

SEQ ID NO: 521192 - RNA, 15 nt, Chlamydophila pneumoniae J138
ccuaauucauauuua

SEQ ID NO: 521193 - RNA, 15 nt, Chlamydophila pneumoniae J138
ccuagagaguucuug

SEQ ID NO: 521194 - RNA, 18 nt, Chlamydophila pneumoniae J138
ccuagauagcaaaucaau

SEQ ID NO: 521195 - RNA, 13 nt, Chlamydophila pneumoniae J138
ccuauagcaaaga

SEQ ID NO: 521196 - RNA, 19 nt, Chlamydophila pneumoniae J138
ccuaugggaggaauuccuc

SEQ ID NO: 521197 - RNA, 13 nt, Chlamydophila pneumoniae J138
ccuucuaaggaaa

SEQ ID NO: 521198 - RNA, 23 nt, Chlamydophila pneumoniae J138
ccuucauucuuucgauaucucua

SEQ ID NO: 521199 - RNA, 19 nt, Chlamydophila pneumoniae J138
cgaaaaacgguaaauaucu

SEQ ID NO: 521200 - RNA, 15 nt, Chlamydophila pneumoniae J138
cgaaauucauuaaaa

SEQ ID NO: 521201 - RNA, 20 nt, Chlamydophila pneumoniae J138
cgacaugcaggccaacucuc

SEQ ID NO: 521202 - RNA, 18 nt, Chlamydophila pneumoniae J138
aacaaucuuucuucuaga

SEQ ID NO: 521203 - RNA, 14 nt, Chlamydophila pneumoniae J138
aacaagucggcagg

SEQ ID NO: 521204 - RNA, 23 nt, Chlamydophila pneumoniae J138
cgaggagcgauagcucagcucua

SEQ ID NO: 521205 - RNA, 22 nt, Chlamydophila pneumoniae J138
cgauacgguuuuuaucccagau

SEQ ID NO: 521206 - RNA, 18 nt, Chlamydophila pneumoniae J138
aacagagcgucuauuaga

SEQ ID NO: 521207 - RNA, 19 nt, Chlamydophila pneumoniae J138
cggagacucagagaaaauc

SEQ ID NO: 521208 - RNA, 18 nt, Chlamydophila pneumoniae J138
aacaguaauuauuuucua

SEQ ID NO: 521209 - RNA, 21 nt, Chlamydophila pneumoniae J138
aacaugacggugcuguuguaa

SEQ ID NO: 521210 - RNA, 23 nt, Chlamydophila pneumoniae J138
aacaugagaaauacgcuuuucuu

SEQ ID NO: 521211 - RNA, 20 nt, Chlamydophila pneumoniae J138
ggaauauagguuuagauugc

SEQ ID NO: 521212 - RNA, 15 nt, Chlamydophila pneumoniae J138
ggaagcuuuuacgag

SEQ ID NO: 521213 - RNA, 23 nt, Chlamydophila pneumoniae J138
ggaagcuguacuugauauuguuc

SEQ ID NO: 521214 - RNA, 11 nt, Chlamydophila pneumoniae J138
ggacuucaaau

SEQ ID NO: 521215 - RNA, 18 nt, Chlamydophila pneumoniae J138
ggagacucagagaaaauc

SEQ ID NO: 521216 - RNA, 14 nt, Chlamydophila pneumoniae J138
aaggagauuccuaa

SEQ ID NO: 521217 - RNA, 22 nt, Chlamydophila pneumoniae J138
aaggaucccaucaucgagcuga

SEQ ID NO: 521218 - RNA, 18 nt, Chlamydophila pneumoniae J138
aaggaucugauagaacag

SEQ ID NO: 521219 - RNA, 21 nt, Chlamydophila pneumoniae J138
aaggcccccuacagcagaaac

SEQ ID NO: 521220 - RNA, 16 nt, Chlamydophila pneumoniae J138
aagguauuucucucca

SEQ ID NO: 521221 - RNA, 15 nt, Chlamydophila pneumoniae J138
aagggaucuccuuca

SEQ ID NO: 521222 - RNA, 12 nt, Chlamydophila pneumoniae J138
aaggcuuuucug

SEQ ID NO: 521223 - RNA, 16 nt, Chlamydophila pneumoniae J138
ggucuuggguuuuaaa

SEQ ID NO: 521224 - RNA, 13 nt, Chlamydophila pneumoniae J138
ggugccaaaaaau

SEQ ID NO: 521225 - RNA, 14 nt, Chlamydophila pneumoniae J138
guaucuagggacuu

SEQ ID NO: 521226 - RNA, 13 nt, Chlamydophila pneumoniae J138
guaucuaaaacuu

SEQ ID NO: 521227 - RNA, 22 nt, Chlamydophila pneumoniae J138
gucacauuuguugucagcuuug

SEQ ID NO: 521228 - RNA, 23 nt, Chlamydophila pneumoniae J138
gucacggaagaacccauugaauu

SEQ ID NO: 521229 - RNA, 16 nt, Chlamydophila pneumoniae J138
guaacuaguaacuuaa

SEQ ID NO: 521230 - RNA, 20 nt, Chlamydophila pneumoniae J138
guagugauacuuuagaaucc

SEQ ID NO: 521231 - RNA, 21 nt, Chlamydophila pneumoniae J138
aagucacucaaacccucucca

SEQ ID NO: 521232 - RNA, 21 nt, Chlamydophila pneumoniae J138
guacgucuuucaccaacuccu

SEQ ID NO: 521233 - RNA, 16 nt, Chlamydophila pneumoniae J138
guagcaucucucucca

SEQ ID NO: 521234 - RNA, 17 nt, Chlamydophila pneumoniae J138
guagcucaggaaaacuu

SEQ ID NO: 521235 - RNA, 15 nt, Chlamydophila pneumoniae J138
aagccauuccauauc

SEQ ID NO: 521236 - RNA, 22 nt, Chlamydophila pneumoniae J138
aagcauauacuguuaacaagua

SEQ ID NO: 521237 - RNA, 23 nt, Chlamydophila pneumoniae J138
gccggcccacucaaaagaagagu

SEQ ID NO: 521238 - RNA, 15 nt, Chlamydophila pneumoniae J138
aagcuucaucaaaac

SEQ ID NO: 521239 - RNA, 15 nt, Chlamydophila pneumoniae J138
gcuaauaagauccaa

SEQ ID NO: 521240 - RNA, 14 nt, Chlamydophila pneumoniae J138
gcuaagaucuuuag

SEQ ID NO: 521241 - RNA, 17 nt, Chlamydophila pneumoniae J138
gcuauuccauaaaaaug

SEQ ID NO: 521242 - RNA, 16 nt, Chlamydophila pneumoniae J138
gcuauuuuacuuacua

SEQ ID NO: 521243 - RNA, 19 nt, Chlamydophila pneumoniae J138
gcucgugcgacugcucuuu

SEQ ID NO: 521244 - RNA, 19 nt, Chlamydophila pneumoniae J138
gcucuucuaugguaaucac

SEQ ID NO: 521245 - RNA, 14 nt, Chlamydophila pneumoniae J138
aagcugcuuuuucu

SEQ ID NO: 521246 - RNA, 15 nt, Chlamydophila pneumoniae J138
aagcugcuuuuucua

SEQ ID NO: 521247 - RNA, 20 nt, Chlamydophila pneumoniae J138
aagcugcaaucucaaaauca

SEQ ID NO: 521248 - RNA, 24 nt, Chlamydophila pneumoniae J138
aagcugagguagcaucucucucca

SEQ ID NO: 521249 - RNA, 19 nt, Chlamydophila pneumoniae J138
aagcucugagaaagaauag

SEQ ID NO: 521250 - RNA, 15 nt, Chlamydophila pneumoniae J138
aagcuagucuuucua

SEQ ID NO: 521251 - RNA, 14 nt, Chlamydophila pneumoniae J138
aagacucaucuuug

SEQ ID NO: 521252 - RNA, 17 nt, Chlamydophila pneumoniae J138
aagaggaagaugauauu

SEQ ID NO: 521253 - RNA, 23 nt, Chlamydophila pneumoniae J138
aagagcucaucggaucuuuucuu

SEQ ID NO: 521254 - RNA, 20 nt, Chlamydophila pneumoniae J138
aagagcaauuaagaaacuag

SEQ ID NO: 521255 - RNA, 19 nt, Chlamydophila pneumoniae J138
aagagucuuccuagaccua

SEQ ID NO: 521256 - RNA, 20 nt, Chlamydophila pneumoniae J138
aagagucucacucuuuucua

SEQ ID NO: 521257 - RNA, 20 nt, Chlamydophila pneumoniae J138
aagagucucuugcuuuugua

SEQ ID NO: 521258 - RNA, 13 nt, Chlamydophila pneumoniae J138
aagaugagaaaau

SEQ ID NO: 521259 - RNA, 17 nt, Chlamydophila pneumoniae J138
gccgcauuucuucaaua

SEQ ID NO: 521260 - RNA, 15 nt, Chlamydophila pneumoniae J138
aagaauaaaauagga

SEQ ID NO: 521261 - RNA, 18 nt, Chlamydophila pneumoniae J138
gauuccugucauuccuaa

SEQ ID NO: 521262 - RNA, 13 nt, Chlamydophila pneumoniae J138
gauuggaucuuga

SEQ ID NO: 521263 - RNA, 20 nt, Chlamydophila pneumoniae J138
gauugcuugaaguuugucgu

SEQ ID NO: 521264 - RNA, 13 nt, Chlamydophila pneumoniae J138
gauugaaacuuuu

SEQ ID NO: 521265 - RNA, 23 nt, Chlamydophila pneumoniae J138
gauugaaacuuuuuuucuucucu

SEQ ID NO: 521266 - RNA, 18 nt, Chlamydophila pneumoniae J138
gcaagagacaagaaaaua

SEQ ID NO: 521267 - RNA, 13 nt, Chlamydophila pneumoniae J138
gcagauccugcuu

SEQ ID NO: 521268 - RNA, 17 nt, Chlamydophila pneumoniae J138
gacucuaguuuuucuuu

SEQ ID NO: 521269 - RNA, 17 nt, Chlamydophila pneumoniae J138
gacugaagagcaauuaa

SEQ ID NO: 521270 - RNA, 11 nt, Chlamydophila pneumoniae J138
gagaacuucaa

SEQ ID NO: 521271 - RNA, 17 nt, Chlamydophila pneumoniae J138
gagcaugagagucgaaa

SEQ ID NO: 521272 - RNA, 17 nt, Chlamydophila pneumoniae J138
gagcauagacucuuccu

SEQ ID NO: 521273 - RNA, 18 nt, Chlamydophila pneumoniae J138
gagaauccuuuuuaggaa

SEQ ID NO: 521274 - RNA, 13 nt, Chlamydophila pneumoniae J138
gagaaucaauaaa

SEQ ID NO: 521275 - RNA, 17 nt, Chlamydophila pneumoniae J138
gagaaugaacaauagaa

SEQ ID NO: 521276 - RNA, 18 nt, Chlamydophila pneumoniae J138
gagagcuugguuuucucc

SEQ ID NO: 521277 - RNA, 21 nt, Chlamydophila pneumoniae J138
gagagagcuggacuucugguu

SEQ ID NO: 521278 - RNA, 22 nt, Chlamydophila pneumoniae J138
gagcacuuuuaauauuugagaa

SEQ ID NO: 521279 - RNA, 16 nt, Chlamydophila pneumoniae J138
gagauucuugaggacc

SEQ ID NO: 521280 - RNA, 21 nt, Chlamydophila pneumoniae J138
gagaucuuuuuauuaaaaucu

SEQ ID NO: 521281 - RNA, 12 nt, Chlamydophila pneumoniae J138
gauaucucuacc

SEQ ID NO: 521282 - RNA, 20 nt, Chlamydophila pneumoniae J138
gauagugguagcaaucugua

SEQ ID NO: 521283 - RNA, 18 nt, Chlamydophila pneumoniae J138
gaguucuuccuucuucuu

SEQ ID NO: 521284 - RNA, 21 nt, Chlamydophila pneumoniae J138
gagcuuuuugcuuuucccuuu

SEQ ID NO: 521285 - RNA, 14 nt, Chlamydophila pneumoniae J138
gaguguauuguaaa

SEQ ID NO: 521286 - RNA, 17 nt, Chlamydophila pneumoniae J138
gagucucacucuuuucu

SEQ ID NO: 521287 - RNA, 20 nt, Chlamydophila pneumoniae J138
gagucucuugcuuuuguaga

SEQ ID NO: 521288 - RNA, 20 nt, Chlamydophila pneumoniae J138
cugccuuaugcucauuaaua

SEQ ID NO: 521289 - RNA, 18 nt, Chlamydophila pneumoniae J138
cugcgauaggaucuucua

SEQ ID NO: 521290 - RNA, 16 nt, Chlamydophila pneumoniae J138
cuguuccaagagucuu

SEQ ID NO: 521291 - RNA, 20 nt, Chlamydophila pneumoniae J138
cuguccaacuaaaacagccu

SEQ ID NO: 521292 - RNA, 16 nt, Chlamydophila pneumoniae J138
cuucacaaucuaaaua

SEQ ID NO: 521293 - RNA, 15 nt, Chlamydophila pneumoniae J138
cuuaccaauaugcuc

SEQ ID NO: 521294 - RNA, 21 nt, Chlamydophila pneumoniae J138
cuuagccccuccaacaaacaa

SEQ ID NO: 521295 - RNA, 20 nt, Chlamydophila pneumoniae J138
cuuacaauuuaaaucugcaa

SEQ ID NO: 521296 - RNA, 16 nt, Chlamydophila pneumoniae J138
cuucucaaagacaaug

SEQ ID NO: 521297 - RNA, 22 nt, Chlamydophila pneumoniae J138
cuucugaacuguucauaaucca

SEQ ID NO: 521298 - RNA, 15 nt, Chlamydophila pneumoniae J138
cuucuuucaaagccu

SEQ ID NO: 521299 - RNA, 19 nt, Chlamydophila pneumoniae J138
cuugcgauacaauaaacaa

SEQ ID NO: 521300 - RNA, 20 nt, Chlamydophila pneumoniae J138
cuugauuugggaugaucucu

SEQ ID NO: 521301 - RNA, 17 nt, Chlamydophila pneumoniae J138
cuugcaaaacagcauca

SEQ ID NO: 521302 - RNA, 13 nt, Chlamydophila pneumoniae J138
cuuguuaugaaaa

SEQ ID NO: 521303 - RNA, 17 nt, Chlamydophila pneumoniae J138
cuugugcuaaagcagga

SEQ ID NO: 521304 - RNA, 18 nt, Chlamydophila pneumoniae J138
gaaaggagggcuucaaca

SEQ ID NO: 521305 - RNA, 22 nt, Chlamydophila pneumoniae J138
gaaacuuuugucgcaauaacaa

SEQ ID NO: 521306 - RNA, 13 nt, Chlamydophila pneumoniae J138
gaacaggaggugu

SEQ ID NO: 521307 - RNA, 18 nt, Chlamydophila pneumoniae J138
gaacaugccaaauaucuc

SEQ ID NO: 521308 - RNA, 19 nt, Chlamydophila pneumoniae J138
gaacauuguuagcaucgcu

SEQ ID NO: 521309 - RNA, 14 nt, Chlamydophila pneumoniae J138
gaagaaaaaucuac

SEQ ID NO: 521310 - RNA, 23 nt, Chlamydophila pneumoniae J138
gaagaaaauaaagaucuucauaa

SEQ ID NO: 521311 - RNA, 23 nt, Chlamydophila pneumoniae J138
gaacugugccauaacgcaucgcu

SEQ ID NO: 521312 - RNA, 20 nt, Chlamydophila pneumoniae J138
gaagcaacuaaacucuccaa

SEQ ID NO: 521313 - RNA, 17 nt, Chlamydophila pneumoniae J138
gaagcagaaacuuuaaa

SEQ ID NO: 521314 - RNA, 22 nt, Chlamydophila pneumoniae J138
gaagcacaccaaguacaguauc

SEQ ID NO: 521315 - RNA, 22 nt, Chlamydophila pneumoniae J138
gaagaugagcgagguauucucu

SEQ ID NO: 521316 - RNA, 20 nt, Chlamydophila pneumoniae J138
gaagagaguauagucugguu

SEQ ID NO: 521317 - RNA, 21 nt, Chlamydophila pneumoniae J138
gaagcuuccaucguuagauuu

SEQ ID NO: 521318 - RNA, 15 nt, Chlamydophila pneumoniae J138
gaaugaagagaguuc

SEQ ID NO: 521319 - RNA, 20 nt, Chlamydophila pneumoniae J138
aacgacuuagaucuuuucua

SEQ ID NO: 521320 - RNA, 14 nt, Chlamydophila pneumoniae J138
aacgcagcuuuccu

SEQ ID NO: 521321 - RNA, 14 nt, Chlamydophila pneumoniae J138
aacgauuucuucuu

SEQ ID NO: 521322 - RNA, 22 nt, Chlamydophila pneumoniae J138
gaccagguguagguuccugcuu

SEQ ID NO: 521323 - RNA, 17 nt, Chlamydophila pneumoniae J138
gaccuuuagcugcugaa

SEQ ID NO: 521324 - RNA, 19 nt, Chlamydophila pneumoniae J138
cgucaucauaggaaacgcc

SEQ ID NO: 521325 - RNA, 22 nt, Chlamydophila pneumoniae J138
cggucucgcuguuucaacaccu

SEQ ID NO: 521326 - RNA, 12 nt, Chlamydophila pneumoniae J138
cuccgaagacua

SEQ ID NO: 521327 - RNA, 13 nt, Chlamydophila pneumoniae J138
cuccagcauaagg

SEQ ID NO: 521328 - RNA, 12 nt, Chlamydophila pneumoniae J138
cuagucuuucua

SEQ ID NO: 521329 - RNA, 23 nt, Chlamydophila pneumoniae J138
cuccuuuuuaggacgcuauccua

SEQ ID NO: 521330 - RNA, 19 nt, Chlamydophila pneumoniae J138
cuccuuuuaaaauuuugau

SEQ ID NO: 521331 - RNA, 19 nt, Chlamydophila pneumoniae J138
cuccucgucuaaagaagau

SEQ ID NO: 521332 - RNA, 22 nt, Chlamydophila pneumoniae J138
cucgcuaaaguagaauccuucu

SEQ ID NO: 521333 - RNA, 14 nt, Chlamydophila pneumoniae J138
cguuucaaauagga

SEQ ID NO: 521334 - RNA, 23 nt, Chlamydophila pneumoniae J138
cuaaaaaggucagcccugccuca

SEQ ID NO: 521335 - RNA, 15 nt, Chlamydophila pneumoniae J138
cuaaaguaacgauaa

SEQ ID NO: 521336 - RNA, 20 nt, Chlamydophila pneumoniae J138
cuaaauacuuaggaauuuuu

SEQ ID NO: 521337 - RNA, 18 nt, Chlamydophila pneumoniae J138
cuaaaggaagauauccuu

SEQ ID NO: 521338 - RNA, 16 nt, Chlamydophila pneumoniae J138
cuaauucuucuacaga

SEQ ID NO: 521339 - RNA, 15 nt, Chlamydophila pneumoniae J138
cuaauucauauuuac

SEQ ID NO: 521340 - RNA, 23 nt, Chlamydophila pneumoniae J138
cuaaguaacaguccucucccuua

SEQ ID NO: 521341 - RNA, 15 nt, Chlamydophila pneumoniae J138
cuaagugauaaggaa

SEQ ID NO: 521342 - RNA, 17 nt, Chlamydophila pneumoniae J138
cuaagcgaaccaaaguc

SEQ ID NO: 521343 - RNA, 20 nt, Chlamydophila pneumoniae J138
cuacauaguuuuuauuuuua

SEQ ID NO: 521344 - RNA, 14 nt, Chlamydophila pneumoniae J138
cuacaggagaagcg

SEQ ID NO: 521345 - RNA, 22 nt, Chlamydophila pneumoniae J138
cuacagauaugcugaauuccuc

SEQ ID NO: 521346 - RNA, 19 nt, Chlamydophila pneumoniae J138
cuaccuacguagcauuaaa

SEQ ID NO: 521347 - RNA, 17 nt, Chlamydophila pneumoniae J138
cuacccucaucauccuc

SEQ ID NO: 521348 - RNA, 17 nt, Chlamydophila pneumoniae J138
cuaggguuucuacagga

SEQ ID NO: 521349 - RNA, 21 nt, Chlamydophila pneumoniae J138
cuagaagacauucauuuuuua

SEQ ID NO: 521350 - RNA, 20 nt, Chlamydophila pneumoniae J138
cuagaaaacgcucuccuaga

SEQ ID NO: 521351 - RNA, 21 nt, Chlamydophila pneumoniae J138
cuacuuaaagcuugagaaaag

SEQ ID NO: 521352 - RNA, 20 nt, Chlamydophila pneumoniae J138
uuuugguugugucaacccuu

SEQ ID NO: 521353 - RNA, 13 nt, Chlamydophila pneumoniae J138
uuuugcugaagau

SEQ ID NO: 521354 - RNA, 13 nt, Chlamydophila pneumoniae J138
uuuuaaagcaaaa

SEQ ID NO: 521355 - RNA, 21 nt, Chlamydophila pneumoniae J138
uuucucggauccuccaagauc

SEQ ID NO: 521356 - RNA, 16 nt, Chlamydophila pneumoniae J138
uuucuguacaacaaaa

SEQ ID NO: 521357 - RNA, 22 nt, Chlamydophila pneumoniae J138
uuucuuacuaaagaaagagucu

SEQ ID NO: 521358 - RNA, 17 nt, Chlamydophila pneumoniae J138
uuucuaauccuccaaac

SEQ ID NO: 521359 - RNA, 14 nt, Chlamydophila pneumoniae J138
uuucccuuuaaaag

SEQ ID NO: 521360 - RNA, 21 nt, Chlamydophila pneumoniae J138
uuucccucgcuaaaguagaau

SEQ ID NO: 521361 - RNA, 21 nt, Chlamydophila pneumoniae J138
uuugauuauucccaagaacuu

SEQ ID NO: 521362 - RNA, 21 nt, Chlamydophila pneumoniae J138
uuugaugugcggcgagcucua

SEQ ID NO: 521363 - RNA, 14 nt, Chlamydophila pneumoniae J138
uuugauuucagaag

SEQ ID NO: 521364 - RNA, 15 nt, Chlamydophila pneumoniae J138
uuucuuuugcaaauc

SEQ ID NO: 521365 - RNA, 13 nt, Chlamydophila pneumoniae J138
uuugaggauuucu

SEQ ID NO: 521366 - RNA, 22 nt, Chlamydophila pneumoniae J138
uuuaucuccccauucacaaauc

SEQ ID NO: 521367 - RNA, 13 nt, Chlamydophila pneumoniae J138
uuuaucugcuucu

SEQ ID NO: 521368 - RNA, 20 nt, Chlamydophila pneumoniae J138
uuuaucauugcuauugaaaa

SEQ ID NO: 521369 - RNA, 14 nt, Chlamydophila pneumoniae J138
uuuacguucuuucu

SEQ ID NO: 521370 - RNA, 13 nt, Chlamydophila pneumoniae J138
uuguuguaacggg

SEQ ID NO: 521371 - RNA, 15 nt, Chlamydophila pneumoniae J138
uucuuuucugaagau

SEQ ID NO: 521372 - RNA, 19 nt, Chlamydophila pneumoniae J138
uuguccugcaagcauuguu

SEQ ID NO: 521373 - RNA, 21 nt, Chlamydophila pneumoniae J138
uugucgagcuuuaagaagaag

SEQ ID NO: 521374 - RNA, 19 nt, Chlamydophila pneumoniae J138
uuguaacucaagguauugu

SEQ ID NO: 521375 - RNA, 17 nt, Chlamydophila pneumoniae J138
uggggcauaagaacucu

SEQ ID NO: 521376 - RNA, 14 nt, Chlamydophila pneumoniae J138
uggaaauagagaaa

SEQ ID NO: 521377 - RNA, 20 nt, Chlamydophila pneumoniae J138
uguaaaaacuguguuuucua

SEQ ID NO: 521378 - RNA, 13 nt, Chlamydophila pneumoniae J138
uggucuagagauu

SEQ ID NO: 521379 - RNA, 19 nt, Chlamydophila pneumoniae J138
uguccaugcacgagauucu

SEQ ID NO: 521380 - RNA, 21 nt, Chlamydophila pneumoniae J138
ugucccauggcuggaaagcca

SEQ ID NO: 521381 - RNA, 22 nt, Chlamydophila pneumoniae J138
uguauaugcuuggcaauagcuu

SEQ ID NO: 521382 - RNA, 14 nt, Chlamydophila pneumoniae J138
uguagguuuuucca

SEQ ID NO: 521383 - RNA, 16 nt, Chlamydophila pneumoniae J138
uguaucuguauccuuc

SEQ ID NO: 521384 - RNA, 12 nt, Chlamydophila pneumoniae J138
uguauuuaaauu

SEQ ID NO: 521385 - RNA, 19 nt, Chlamydophila pneumoniae J138
uguaagaaggcagagaacu

SEQ ID NO: 521386 - RNA, 22 nt, Chlamydophila pneumoniae J138
ugucuuccacgaaggaaucuga

SEQ ID NO: 521387 - RNA, 14 nt, Chlamydophila pneumoniae J138
ugugccagaauaua

SEQ ID NO: 521388 - RNA, 17 nt, Chlamydophila pneumoniae J138
ugugaaaauuuucuugc

SEQ ID NO: 521389 - RNA, 18 nt, Chlamydophila pneumoniae J138
uuagagucgauaaaaacu

SEQ ID NO: 521390 - RNA, 23 nt, Chlamydophila pneumoniae J138
uuagcauaaggggagucuuggau

SEQ ID NO: 521391 - RNA, 15 nt, Chlamydophila pneumoniae J138
uuaauaaaucuauau

SEQ ID NO: 521392 - RNA, 17 nt, Chlamydophila pneumoniae J138
uuaagguugcuuuucua

SEQ ID NO: 521393 - RNA, 20 nt, Chlamydophila pneumoniae J138
uucaaacugauuaguuuguu

SEQ ID NO: 521394 - RNA, 13 nt, Chlamydophila pneumoniae J138
uucaaugaagaaa

SEQ ID NO: 521395 - RNA, 18 nt, Chlamydophila pneumoniae J138
uucagcagguucuugaau

SEQ ID NO: 521396 - RNA, 18 nt, Chlamydophila pneumoniae J138
uuccauacccaaauuucu

SEQ ID NO: 521397 - RNA, 14 nt, Chlamydophila pneumoniae J138
uucccaauauccuc

SEQ ID NO: 521398 - RNA, 16 nt, Chlamydophila pneumoniae J138
uucccaccauauucuc

SEQ ID NO: 521399 - RNA, 18 nt, Chlamydophila pneumoniae J138
uucaggacccuuuuccuc

SEQ ID NO: 521400 - RNA, 15 nt, Chlamydophila pneumoniae J138
uucgcacuacagcuu

SEQ ID NO: 521401 - RNA, 20 nt, Chlamydophila pneumoniae J138
uuccuucaggauuacggaaa

SEQ ID NO: 521402 - RNA, 17 nt, Chlamydophila pneumoniae J138
uuccugaagaugagaaa

SEQ ID NO: 521403 - RNA, 16 nt, Chlamydophila pneumoniae J138
uuccuuuuugcauagc

SEQ ID NO: 521404 - RNA, 20 nt, Chlamydophila pneumoniae J138
uucgauaacacuucuuucuu

SEQ ID NO: 521405 - RNA, 20 nt, Chlamydophila pneumoniae J138
uucuagagcuucaaguuucu

SEQ ID NO: 521406 - RNA, 22 nt, Chlamydophila pneumoniae J138
uucuacugaaaccuucucucuu

SEQ ID NO: 521407 - RNA, 19 nt, Chlamydophila pneumoniae J138
uucuaagaaacuuccaaaa

SEQ ID NO: 521408 - RNA, 22 nt, Chlamydophila pneumoniae J138
uucuaagauuccuaacuucuga

SEQ ID NO: 521409 - RNA, 23 nt, Chlamydophila pneumoniae J138
uucguauagagcgguucuuucua

SEQ ID NO: 521410 - RNA, 19 nt, Chlamydophila pneumoniae J138
uucgugagcgaguaccuca

SEQ ID NO: 521411 - RNA, 17 nt, Chlamydophila pneumoniae J138
uucuauguguucucgaa

SEQ ID NO: 521412 - RNA, 16 nt, Chlamydophila pneumoniae J138
uucuauagcaagacga

SEQ ID NO: 521413 - RNA, 22 nt, Chlamydophila pneumoniae J138
uucugauuagagccccaacccu

SEQ ID NO: 521414 - RNA, 22 nt, Chlamydophila pneumoniae J138
uucucugguauagaaacaccgu

SEQ ID NO: 521415 - RNA, 21 nt, Chlamydophila pneumoniae J138
uucucuaucuuuauuuaaaua

SEQ ID NO: 521416 - RNA, 16 nt, Chlamydophila pneumoniae J138
uucucuucauuuucuu

SEQ ID NO: 521417 - RNA, 15 nt, Chlamydophila pneumoniae J138
uucuguaaagauucu

SEQ ID NO: 521418 - RNA, 22 nt, Chlamydophila pneumoniae J138
uucuucuagcucauuaucaaga

SEQ ID NO: 521419 - RNA, 15 nt, Chlamydophila pneumoniae J138
uucuucucuaagaaa

SEQ ID NO: 521420 - RNA, 18 nt, Chlamydophila pneumoniae J138
uucuucuucggaucugua

SEQ ID NO: 521421 - RNA, 17 nt, Chlamydophila pneumoniae J138
uucuucuuguucuucuu

SEQ ID NO: 521422 - RNA, 20 nt, Chlamydophila pneumoniae J138
uucuucuuguucuucuugau

SEQ ID NO: 521423 - RNA, 16 nt, Chlamydophila pneumoniae J138
uucuugauuagagaau

SEQ ID NO: 521424 - RNA, 15 nt, Chlamydophila pneumoniae J138
uucuuagaagagaaa

SEQ ID NO: 521425 - RNA, 15 nt, Chlamydophila pneumoniae J138
uucuuauuacagaaa

SEQ ID NO: 521426 - RNA, 21 nt, Chlamydophila pneumoniae J138
guugauuucgugaacaaaauc

SEQ ID NO: 521427 - RNA, 21 nt, Chlamydophila pneumoniae J138
guucuaugccauaaauacagg

SEQ ID NO: 521428 - RNA, 22 nt, Chlamydophila pneumoniae J138
guuuacagaugcaugauccuau

SEQ ID NO: 521429 - RNA, 20 nt, Chlamydophila pneumoniae J138
guuuagacgaggagaagucg

SEQ ID NO: 521430 - RNA, 15 nt, Chlamydophila pneumoniae J138
guuuagcauagagcu

SEQ ID NO: 521431 - RNA, 18 nt, Chlamydophila pneumoniae J138
guuguauuuccuucuuuu

SEQ ID NO: 521432 - RNA, 18 nt, Chlamydophila pneumoniae J138
guuguagugaaugagcuu

SEQ ID NO: 521433 - RNA, 19 nt, Chlamydophila pneumoniae J138
guuucuagaaaaucucuaa

SEQ ID NO: 521434 - RNA, 14 nt, Chlamydophila pneumoniae J138
guuucuaaaacaga

SEQ ID NO: 521435 - RNA, 18 nt, Chlamydophila pneumoniae J138
guuuggcaguucacugag

SEQ ID NO: 521436 - RNA, 11 nt, Chlamydophila pneumoniae J138
uaaaagaacgu

SEQ ID NO: 521437 - RNA, 21 nt, Chlamydophila pneumoniae J138
uaaaaucuccucucucaauaa

SEQ ID NO: 521438 - RNA, 16 nt, Chlamydophila pneumoniae J138
guuuuuccaacuucaa

SEQ ID NO: 521439 - RNA, 23 nt, Chlamydophila pneumoniae J138
uaaaaaaaagagaagcaguguca

SEQ ID NO: 521440 - RNA, 22 nt, Chlamydophila pneumoniae J138
uaaaaaacuuccuaacuaucuc

SEQ ID NO: 521441 - RNA, 13 nt, Chlamydophila pneumoniae J138
uaaaaaauaccua

SEQ ID NO: 521442 - RNA, 18 nt, Chlamydophila pneumoniae J138
uaaacgaucaaauuccuu

SEQ ID NO: 521443 - RNA, 16 nt, Chlamydophila pneumoniae J138
uaaauuaguaaaugcc

SEQ ID NO: 521444 - RNA, 15 nt, Chlamydophila pneumoniae J138
uaaauuaaauaucua

SEQ ID NO: 521445 - RNA, 21 nt, Chlamydophila pneumoniae J138
uaaauauuuuaccauugagau

SEQ ID NO: 521446 - RNA, 17 nt, Chlamydophila pneumoniae J138
uaacaucaagaauuucu

SEQ ID NO: 521447 - RNA, 19 nt, Chlamydophila pneumoniae J138
uaacaugaaaagcuagucu

SEQ ID NO: 521448 - RNA, 15 nt, Chlamydophila pneumoniae J138
uaacacccucccuca

SEQ ID NO: 521449 - RNA, 22 nt, Chlamydophila pneumoniae J138
uaacauuuagauaaagaaagcg

SEQ ID NO: 521450 - RNA, 22 nt, Chlamydophila pneumoniae J138
uaacauuggagucuaaaaaaua

SEQ ID NO: 521451 - RNA, 12 nt, Chlamydophila pneumoniae J138
uaauaaaaugcg

SEQ ID NO: 521452 - RNA, 22 nt, Chlamydophila pneumoniae J138
uaauaaaauuuaaaaaaaucuu

SEQ ID NO: 521453 - RNA, 16 nt, Chlamydophila pneumoniae J138
uaagacuucuggaagc

SEQ ID NO: 521454 - RNA, 18 nt, Chlamydophila pneumoniae J138
uaagauccaaaaauucua

SEQ ID NO: 521455 - RNA, 22 nt, Chlamydophila pneumoniae J138
uaagaucuuuagaauaagagcu

SEQ ID NO: 521456 - RNA, 18 nt, Chlamydophila pneumoniae J138
uaauaagcggaguccuuc

SEQ ID NO: 521457 - RNA, 18 nt, Chlamydophila pneumoniae J138
uaauacaaaaaauaaaau

SEQ ID NO: 521458 - RNA, 20 nt, Chlamydophila pneumoniae J138
uaaucuggaagcaaucugua

SEQ ID NO: 521459 - RNA, 18 nt, Chlamydophila pneumoniae J138
uaaugguacaauacugga

SEQ ID NO: 521460 - RNA, 18 nt, Chlamydophila pneumoniae J138
uaaucuuuuuuaaagcua

SEQ ID NO: 521461 - RNA, 21 nt, Chlamydophila pneumoniae J138
uacaaguaauuccccuuuaaa

SEQ ID NO: 521462 - RNA, 20 nt, Chlamydophila pneumoniae J138
uacaagcaauacuaagaagc

SEQ ID NO: 521463 - RNA, 14 nt, Chlamydophila pneumoniae J138
uacuuacaagaaca

SEQ ID NO: 521464 - RNA, 21 nt, Chlamydophila pneumoniae J138
uagaaacaacugaaaaaccau

SEQ ID NO: 521465 - RNA, 23 nt, Chlamydophila pneumoniae J138
uacuucggaugagauccaaagcc

SEQ ID NO: 521466 - RNA, 20 nt, Chlamydophila pneumoniae J138
uagaaauucuguagauacua

SEQ ID NO: 521467 - RNA, 12 nt, Chlamydophila pneumoniae J138
uacguuuucucu

SEQ ID NO: 521468 - RNA, 20 nt, Chlamydophila pneumoniae J138
uagcuaaaccuucagauccg

SEQ ID NO: 521469 - RNA, 24 nt, Chlamydophila pneumoniae J138
uagauuuuucuuuuagagaaaucu

SEQ ID NO: 521470 - RNA, 18 nt, Chlamydophila pneumoniae J138
uagcaaaggcaacaacgc

SEQ ID NO: 521471 - RNA, 22 nt, Chlamydophila pneumoniae J138
uagauuaaaggcauagauacaa

SEQ ID NO: 521472 - RNA, 13 nt, Chlamydophila pneumoniae J138
uagcucuggagau

SEQ ID NO: 521473 - RNA, 16 nt, Chlamydophila pneumoniae J138
uagcuguuccaagagu

SEQ ID NO: 521474 - RNA, 22 nt, Chlamydophila pneumoniae J138
uaggggagguaaaauaaagagc

SEQ ID NO: 521475 - RNA, 12 nt, Chlamydophila pneumoniae J138
uagggaauuucg

SEQ ID NO: 521476 - RNA, 19 nt, Chlamydophila pneumoniae J138
uauccuauuggaaggucua

SEQ ID NO: 521477 - RNA, 17 nt, Chlamydophila pneumoniae J138
uauccguauggauuucu

SEQ ID NO: 521478 - RNA, 14 nt, Chlamydophila pneumoniae J138
uaucuuugguaugc

SEQ ID NO: 521479 - RNA, 18 nt, Chlamydophila pneumoniae J138
uaucuacagagagaaacu

SEQ ID NO: 521480 - RNA, 13 nt, Chlamydophila pneumoniae J138
uauuaaagaaucu

SEQ ID NO: 521481 - RNA, 15 nt, Chlamydophila pneumoniae J138
uauguuuaaagcaua

SEQ ID NO: 521482 - RNA, 18 nt, Chlamydophila pneumoniae J138
uaugauagaacucuccuc

SEQ ID NO: 521483 - RNA, 21 nt, Chlamydophila pneumoniae J138
uagucucgguuuccugaagau

SEQ ID NO: 521484 - RNA, 14 nt, Chlamydophila pneumoniae J138
uagguagagaaucc

SEQ ID NO: 521485 - RNA, 19 nt, Chlamydophila pneumoniae J138
uaggugccugaagauggca

SEQ ID NO: 521486 - RNA, 14 nt, Chlamydophila pneumoniae J138
uaguaacuaaauuc

SEQ ID NO: 521487 - RNA, 12 nt, Chlamydophila pneumoniae J138
uauaaacuccac

SEQ ID NO: 521488 - RNA, 23 nt, Chlamydophila pneumoniae J138
uauagcuccuuggcuauggaaag

SEQ ID NO: 521489 - RNA, 13 nt, Chlamydophila pneumoniae J138
uauaggauuugca

SEQ ID NO: 521490 - RNA, 21 nt, Chlamydophila pneumoniae J138
uauagaaaaggaugcaucucu

SEQ ID NO: 521491 - RNA, 22 nt, Chlamydophila pneumoniae J138
uauaucgccguuaaagacuucu

SEQ ID NO: 521492 - RNA, 23 nt, Chlamydophila pneumoniae J138
uauauccacaaucucuuuaaaaa

SEQ ID NO: 521493 - RNA, 17 nt, Chlamydophila pneumoniae J138
uauaggaagcucuucua

SEQ ID NO: 521494 - RNA, 18 nt, Chlamydophila pneumoniae J138
uauaguuuucaaaaaucg

SEQ ID NO: 521495 - RNA, 23 nt, Chlamydophila pneumoniae J138
ucaggaaagguaguuuucuucuu

SEQ ID NO: 521496 - RNA, 14 nt, Chlamydophila pneumoniae J138
ucacucuuuaaaaa

SEQ ID NO: 521497 - RNA, 15 nt, Chlamydophila pneumoniae J138
uauuucuaaaaaaua

SEQ ID NO: 521498 - RNA, 18 nt, Chlamydophila pneumoniae J138
ucaucauaacuaggguac

SEQ ID NO: 521499 - RNA, 15 nt, Chlamydophila pneumoniae J138
ucaguuaaagagcau

SEQ ID NO: 521500 - RNA, 18 nt, Chlamydophila pneumoniae J138
ucauuccagcaucuucuc

SEQ ID NO: 521501 - RNA, 17 nt, Chlamydophila pneumoniae J138
uccaacuuccauaugag

SEQ ID NO: 521502 - RNA, 20 nt, Chlamydophila pneumoniae J138
uccacauccuuguagaacuu

SEQ ID NO: 521503 - RNA, 16 nt, Chlamydophila pneumoniae J138
uccacggcggaucucu

SEQ ID NO: 521504 - RNA, 17 nt, Chlamydophila pneumoniae J138
uccagaaaguauuccuc

SEQ ID NO: 521505 - RNA, 18 nt, Chlamydophila pneumoniae J138
uccaucaucgaagaacuu

SEQ ID NO: 521506 - RNA, 12 nt, Chlamydophila pneumoniae J138
ucccaaaaaaug

SEQ ID NO: 521507 - RNA, 16 nt, Chlamydophila pneumoniae J138
uccauggcuuccuacg

SEQ ID NO: 521508 - RNA, 17 nt, Chlamydophila pneumoniae J138
ucccucuccuugaaaau

SEQ ID NO: 521509 - RNA, 20 nt, Chlamydophila pneumoniae J138
uccgucaagaacaagagcuu

SEQ ID NO: 521510 - RNA, 19 nt, Chlamydophila pneumoniae J138
uccuagguucuuuucggau

SEQ ID NO: 521511 - RNA, 22 nt, Chlamydophila pneumoniae J138
uccuagaccuaugacggauccu

SEQ ID NO: 521512 - RNA, 11 nt, Chlamydophila pneumoniae J138
uccuagagaac

SEQ ID NO: 521513 - RNA, 16 nt, Chlamydophila pneumoniae J138
uccuagggagugagga

SEQ ID NO: 521514 - RNA, 18 nt, Chlamydophila pneumoniae J138
uccuacgagcgcuuucuu

SEQ ID NO: 521515 - RNA, 18 nt, Chlamydophila pneumoniae J138
uccuaucaaagcaaaagu

SEQ ID NO: 521516 - RNA, 18 nt, Chlamydophila pneumoniae J138
uccugaacaucuccagca

SEQ ID NO: 521517 - RNA, 13 nt, Chlamydophila pneumoniae J138
uccugaagaugag

SEQ ID NO: 521518 - RNA, 19 nt, Chlamydophila pneumoniae J138
uccugcuucuauagagaca

SEQ ID NO: 521519 - RNA, 15 nt, Chlamydophila pneumoniae J138
uccuugaauuaguuu

SEQ ID NO: 521520 - RNA, 11 nt, Chlamydophila pneumoniae J138
uccuucuucuu

SEQ ID NO: 521521 - RNA, 16 nt, Chlamydophila pneumoniae J138
uccuucuugcaaagau

SEQ ID NO: 521522 - RNA, 21 nt, Chlamydophila pneumoniae J138
uccuuaacaaccgccuuuaua

SEQ ID NO: 521523 - RNA, 17 nt, Chlamydophila pneumoniae J138
uccuuggauuucuucuu

SEQ ID NO: 521524 - RNA, 14 nt, Chlamydophila pneumoniae J138
uccuuguagaacuu

SEQ ID NO: 521525 - RNA, 18 nt, Chlamydophila pneumoniae J138
ucgaaaccacagcaaaga

SEQ ID NO: 521526 - RNA, 22 nt, Chlamydophila pneumoniae J138
ucgaagaucuucgucccuagaa

SEQ ID NO: 521527 - RNA, 21 nt, Chlamydophila pneumoniae J138
ucggauuuagauuaaagagac

SEQ ID NO: 521528 - RNA, 13 nt, Chlamydophila pneumoniae J138
ucggcuaaagaaa

SEQ ID NO: 521529 - RNA, 22 nt, Chlamydophila pneumoniae J138
ucguacaaauaauuucccuaaa

SEQ ID NO: 521530 - RNA, 23 nt, Chlamydophila pneumoniae J138
ucguaacgcuuuucuaauaguga

SEQ ID NO: 521531 - RNA, 14 nt, Chlamydophila pneumoniae J138
ucuauuuucaggag

SEQ ID NO: 521532 - RNA, 14 nt, Chlamydophila pneumoniae J138
ucuaucuugaaagu

SEQ ID NO: 521533 - RNA, 15 nt, Chlamydophila pneumoniae J138
ucuacaugcucaaga

SEQ ID NO: 521534 - RNA, 23 nt, Chlamydophila pneumoniae J138
ucuacgauguuuucuuauccuug

SEQ ID NO: 521535 - RNA, 16 nt, Chlamydophila pneumoniae J138
ucuacgauguuuucuu

SEQ ID NO: 521536 - RNA, 17 nt, Chlamydophila pneumoniae J138
ucuccgucauauuuaaa

SEQ ID NO: 521537 - RNA, 17 nt, Chlamydophila pneumoniae J138
ucuccugaaccgcaaaa

SEQ ID NO: 521538 - RNA, 17 nt, Chlamydophila pneumoniae J138
ucuccuuuaaauaaaau

SEQ ID NO: 521539 - RNA, 15 nt, Chlamydophila pneumoniae J138
ucucuaugcgcucua

SEQ ID NO: 521540 - RNA, 12 nt, Chlamydophila pneumoniae J138
ucugaagcugca

SEQ ID NO: 521541 - RNA, 18 nt, Chlamydophila pneumoniae J138
ucugauuauuucuaaaaa

SEQ ID NO: 521542 - RNA, 22 nt, Chlamydophila pneumoniae J138
ucugcuucuccaaauaaagcaa

SEQ ID NO: 521543 - RNA, 12 nt, Chlamydophila pneumoniae J138
ucuguuuucucu

SEQ ID NO: 521544 - RNA, 15 nt, Chlamydophila pneumoniae J138
ucuuagggaaucucu

SEQ ID NO: 521545 - RNA, 18 nt, Chlamydophila pneumoniae J138
ucuucaaaaguaaucacu

SEQ ID NO: 521546 - RNA, 17 nt, Chlamydophila pneumoniae J138
ucuuaucaugaaaagga

SEQ ID NO: 521547 - RNA, 19 nt, Chlamydophila pneumoniae J138
ucuucacuuauaagcugcu

SEQ ID NO: 521548 - RNA, 22 nt, Chlamydophila pneumoniae J138
ucuucaaugacuucuggaucuu

SEQ ID NO: 521549 - RNA, 19 nt, Chlamydophila pneumoniae J138
ucuuccaucucuuuaaaug

SEQ ID NO: 521550 - RNA, 16 nt, Chlamydophila pneumoniae J138
ucuuccaucucuuuaa

SEQ ID NO: 521551 - RNA, 19 nt, Chlamydophila pneumoniae J138
ucuucauugcaaaaaugaa

SEQ ID NO: 521552 - RNA, 18 nt, Chlamydophila pneumoniae J138
ucuucauuccaggauucu

SEQ ID NO: 521553 - RNA, 15 nt, Chlamydophila pneumoniae J138
ucuucuuguucuucu

SEQ ID NO: 521554 - RNA, 18 nt, Chlamydophila pneumoniae J138
ucuugacggcaggacucu

SEQ ID NO: 521555 - RNA, 23 nt, Chlamydophila pneumoniae J138
ucuugagaguccugggguucucu

SEQ ID NO: 521556 - RNA, 21 nt, Chlamydophila pneumoniae J138
ucuucuguaggaacaaucgua

SEQ ID NO: 521557 - RNA, 14 nt, Chlamydophila pneumoniae J138
ucuucugaaaucaa

SEQ ID NO: 521558 - RNA, 16 nt, Chlamydophila pneumoniae J138
ucuucuaaagcagaau

SEQ ID NO: 521559 - RNA, 16 nt, Chlamydophila pneumoniae J138
ucuuuaaaaggccgau

SEQ ID NO: 521560 - RNA, 16 nt, Chlamydophila pneumoniae J138
ucuuguaaacgagcuu

SEQ ID NO: 521561 - RNA, 21 nt, Chlamydophila pneumoniae J138
ucuuguauuccuuggauuucu

SEQ ID NO: 521562 - RNA, 23 nt, Chlamydophila pneumoniae J138
ucuuuuagacgugcucucuucuu

SEQ ID NO: 521563 - RNA, 18 nt, Chlamydophila pneumoniae J138
ucuuuagaauaagagcua

SEQ ID NO: 521564 - RNA, 19 nt, Chlamydophila pneumoniae J138
ucuuuuuuuugaagugcuu

SEQ ID NO: 521565 - RNA, 23 nt, Chlamydophila pneumoniae J138
ucuuuuucuauuaaaaauagcuu

SEQ ID NO: 521566 - RNA, 13 nt, Chlamydophila pneumoniae J138
ucuuuuucagaaa

SEQ ID NO: 521567 - RNA, 22 nt, Chlamydophila pneumoniae J138
ucuuuugcaaaucuucgaauuu

SEQ ID NO: 521568 - RNA, 18 nt, Chlamydophila pneumoniae J138
ugaagcagggaaaaugcg

SEQ ID NO: 521569 - RNA, 19 nt, Chlamydophila pneumoniae J138
ugagaucgaaucuuuauuu

SEQ ID NO: 521570 - RNA, 17 nt, Chlamydophila pneumoniae J138
ugagagggucucagcau

SEQ ID NO: 521571 - RNA, 15 nt, Chlamydophila pneumoniae J138
ugagagauuuuuuca

SEQ ID NO: 521572 - RNA, 21 nt, Chlamydophila pneumoniae J138
ugacuuuauguuagcuagagc

SEQ ID NO: 521573 - RNA, 17 nt, Chlamydophila pneumoniae J138
ugacuuuaugaucuccc

SEQ ID NO: 521574 - RNA, 19 nt, Chlamydophila pneumoniae J138
ugauauuuuuauuuaaaau

SEQ ID NO: 521575 - RNA, 13 nt, Chlamydophila pneumoniae J138
ugauauugcguuu

SEQ ID NO: 521576 - RNA, 13 nt, Chlamydophila pneumoniae J138
ugauauccaccuu

SEQ ID NO: 521577 - RNA, 19 nt, Chlamydophila pneumoniae J138
ugauaucaccagguccuuc

SEQ ID NO: 521578 - RNA, 19 nt, Chlamydophila pneumoniae J138
ugauuucuuuauucccuuu

SEQ ID NO: 521579 - RNA, 12 nt, Chlamydophila pneumoniae J138
ugccaaaaaauu

SEQ ID NO: 521580 - RNA, 22 nt, Chlamydophila pneumoniae J138
ugcauuugccccuaacuggcua

SEQ ID NO: 521581 - RNA, 15 nt, Chlamydophila pneumoniae J138
ugccuuugaucagga

SEQ ID NO: 521582 - RNA, 20 nt, Chlamydophila pneumoniae J138
ugccuuuuuuucuauagagu

SEQ ID NO: 521583 - RNA, 22 nt, Chlamydophila pneumoniae J138
ugcgaacgaagacuuguucuuc

SEQ ID NO: 521584 - RNA, 20 nt, Chlamydophila pneumoniae J138
ugcgcacggauucuaaaaga

SEQ ID NO: 521585 - RNA, 15 nt, Chlamydophila pneumoniae J138
ugcgcagaauaaaau

SEQ ID NO: 521586 - RNA, 23 nt, Chlamydophila pneumoniae J138
ugcucaauacagauaucaaagca

SEQ ID NO: 521587 - RNA, 15 nt, Chlamydophila pneumoniae J138
ugcuccaauuuucuu

SEQ ID NO: 521588 - RNA, 14 nt, Chlamydophila pneumoniae J138
ugcuaucuccagaa

SEQ ID NO: 521589 - RNA, 21 nt, Chlamydophila pneumoniae J138
ugcuaucaaagacucaugaaa

SEQ ID NO: 521590 - RNA, 17 nt, Chlamydophila pneumoniae J138
ugcuauagggaucuccu

SEQ ID NO: 521591 - RNA, 19 nt, Chlamydophila pneumoniae J138
ugcuacuguccauccaaau

SEQ ID NO: 521592 - RNA, 17 nt, Chlamydophila pneumoniae J138
ugcuaaacuuuuuuuca

SEQ ID NO: 521593 - RNA, 18 nt, Chlamydophila pneumoniae J138
ugcucggacagaaagauu

SEQ ID NO: 521594 - RNA, 20 nt, Chlamydophila pneumoniae J138
ugcugaagauuuuuucuugg

SEQ ID NO: 521595 - RNA, 14 nt, Chlamydophila pneumoniae J138
ugcuucuaaacaau

SEQ ID NO: 521596 - RNA, 21 nt, Chlamydophila pneumoniae J138
ugcuugucgcgacaagacaau

SEQ ID NO: 521597 - RNA, 21 nt, Chlamydophila pneumoniae J138
gccuccauuuagacaagacac

SEQ ID NO: 521598 - RNA, 21 nt, Chlamydophila pneumoniae J138
gcuaucccacuaacaagauaa

SEQ ID NO: 521599 - RNA, 14 nt, Chlamydophila pneumoniae J138
gcuauaaauaauua

SEQ ID NO: 521600 - RNA, 16 nt, Chlamydophila pneumoniae J138
gcuagaucacaagaaa

SEQ ID NO: 521601 - RNA, 16 nt, Chlamydophila pneumoniae J138
gcucacucuuuaaaaa

SEQ ID NO: 521602 - RNA, 18 nt, Chlamydophila pneumoniae J138
gcucucuuuaaaaaauuc

SEQ ID NO: 521603 - RNA, 13 nt, Chlamydophila pneumoniae J138
gcuguuucucugu

SEQ ID NO: 521604 - RNA, 18 nt, Chlamydophila pneumoniae J138
gcuguuuacuuuucucuu

SEQ ID NO: 521605 - RNA, 16 nt, Chlamydophila pneumoniae J138
gcuuuugcuacagcuu

SEQ ID NO: 521606 - RNA, 22 nt, Chlamydophila pneumoniae J138
ggaaguccauguacagaaaaua

SEQ ID NO: 521607 - RNA, 14 nt, Chlamydophila pneumoniae J138
gcuuuuuucucuug

SEQ ID NO: 521608 - RNA, 20 nt, Chlamydophila pneumoniae J138
ggaucauauuuauuuaaacc

SEQ ID NO: 521609 - RNA, 21 nt, Chlamydophila pneumoniae J138
ggcauucuguaauuuugagaa

SEQ ID NO: 521610 - RNA, 20 nt, Chlamydophila pneumoniae J138
gggaucacagucuuaaaucc

SEQ ID NO: 521611 - RNA, 12 nt, Chlamydophila pneumoniae J138
ggguaagauugc

SEQ ID NO: 521612 - RNA, 15 nt, Chlamydophila pneumoniae J138
gguucuaagaaaucc

SEQ ID NO: 521613 - RNA, 22 nt, Chlamydophila pneumoniae J138
guaaaaaauacaggaaucuccu

SEQ ID NO: 521614 - RNA, 18 nt, Chlamydophila pneumoniae J138
gguuucuuuuuuuauaaa

SEQ ID NO: 521615 - RNA, 15 nt, Chlamydophila pneumoniae J138
guaauccuaauuccu

SEQ ID NO: 521616 - RNA, 21 nt, Chlamydophila pneumoniae J138
guaauccuaauuccuucaaag

SEQ ID NO: 521617 - RNA, 14 nt, Chlamydophila pneumoniae J138
guagagcaagauuc

SEQ ID NO: 521618 - RNA, 16 nt, Chlamydophila pneumoniae J138
guauucuugagagucc

SEQ ID NO: 521619 - RNA, 13 nt, Chlamydophila pneumoniae J138
gucucugaagacc

SEQ ID NO: 521620 - RNA, 23 nt, Chlamydophila pneumoniae J138
gucugcgauaggaucuucuauuu

SEQ ID NO: 521621 - RNA, 20 nt, Chlamydophila pneumoniae J138
gucuuagaauccaaagacuu

SEQ ID NO: 521622 - RNA, 17 nt, Chlamydophila pneumoniae J138
gugcaggagaacaauau

SEQ ID NO: 521623 - RNA, 19 nt, Chlamydophila pneumoniae J138
gugcaucuauaauuaaucc

SEQ ID NO: 521624 - RNA, 17 nt, Chlamydophila pneumoniae J138
ccuaagucguuaacauc

SEQ ID NO: 521625 - RNA, 16 nt, Chlamydophila pneumoniae J138
ccuaaauuaaauaucu

SEQ ID NO: 521626 - RNA, 17 nt, Chlamydophila pneumoniae J138
ccugcuccaaaauggga

SEQ ID NO: 521627 - RNA, 19 nt, Chlamydophila pneumoniae J138
ccugucuuaucuaaagaaa

SEQ ID NO: 521628 - RNA, 12 nt, Chlamydophila pneumoniae J138
cgacaugccuaa

SEQ ID NO: 521629 - RNA, 17 nt, Chlamydophila pneumoniae J138
cgaggagcuuuuaccuu

SEQ ID NO: 521630 - RNA, 20 nt, Chlamydophila pneumoniae J138
cgauagaucacaucaagaua

SEQ ID NO: 521631 - RNA, 15 nt, Chlamydophila pneumoniae J138
cggaacucauuaaga

SEQ ID NO: 521632 - RNA, 13 nt, Chlamydophila pneumoniae J138
cggaacuaaagag

SEQ ID NO: 521633 - RNA, 15 nt, Chlamydophila pneumoniae J138
cgcgaccugugauuu

SEQ ID NO: 521634 - RNA, 16 nt, Chlamydophila pneumoniae J138
gcaugcacgagagccu

SEQ ID NO: 521635 - RNA, 24 nt, Chlamydophila pneumoniae J138
gccaaagaacagcacucucugcag

SEQ ID NO: 521636 - RNA, 18 nt, Chlamydophila pneumoniae J138
gccaaacgaauuucuugu

SEQ ID NO: 521637 - RNA, 19 nt, Chlamydophila pneumoniae J138
gcauuacgguuucugggau

SEQ ID NO: 521638 - RNA, 15 nt, Chlamydophila pneumoniae J138
gcaugguaggagccg

SEQ ID NO: 521639 - RNA, 21 nt, Chlamydophila pneumoniae J138
gauucuguauaaacaauaaga

SEQ ID NO: 521640 - RNA, 15 nt, Chlamydophila pneumoniae J138
gcaaacuccccaguu

SEQ ID NO: 521641 - RNA, 18 nt, Chlamydophila pneumoniae J138
gauuucuuuauucccuuu

SEQ ID NO: 521642 - RNA, 15 nt, Chlamydophila pneumoniae J138
gcaaguaaagaaauu

SEQ ID NO: 521643 - RNA, 22 nt, Chlamydophila pneumoniae J138
gcaacaguaauuauuuucuaca

SEQ ID NO: 521644 - RNA, 18 nt, Chlamydophila pneumoniae J138
gcaacuaaacucuccaaa

SEQ ID NO: 521645 - RNA, 19 nt, Chlamydophila pneumoniae J138
gaucgucaagcucugagaa

SEQ ID NO: 521646 - RNA, 17 nt, Chlamydophila pneumoniae J138
gaucuguaauagcagga

SEQ ID NO: 521647 - RNA, 20 nt, Chlamydophila pneumoniae J138
gaucauauuuauuuaaacca

SEQ ID NO: 521648 - RNA, 16 nt, Chlamydophila pneumoniae J138
gauacgaauaaguuuu

SEQ ID NO: 521649 - RNA, 14 nt, Chlamydophila pneumoniae J138
gauacuuaucuuua

SEQ ID NO: 521650 - RNA, 21 nt, Chlamydophila pneumoniae J138
gauagcaauucgguagagcua

SEQ ID NO: 521651 - RNA, 22 nt, Chlamydophila pneumoniae J138
gagucugaacauucuuaauauc

SEQ ID NO: 521652 - RNA, 20 nt, Chlamydophila pneumoniae J138
gagguagcaucucucuccaa

SEQ ID NO: 521653 - RNA, 12 nt, Chlamydophila pneumoniae J138
cugggaagacuc

SEQ ID NO: 521654 - RNA, 18 nt, Chlamydophila pneumoniae J138
cugggauguucaaagcca

SEQ ID NO: 521655 - RNA, 17 nt, Chlamydophila pneumoniae J138
cuggucuguauuuucuu

SEQ ID NO: 521656 - RNA, 15 nt, Chlamydophila pneumoniae J138
cugguuuuucgauuu

SEQ ID NO: 521657 - RNA, 17 nt, Chlamydophila pneumoniae J138
cuguucgauaagaacuu

SEQ ID NO: 521658 - RNA, 14 nt, Chlamydophila pneumoniae J138
cugugcauuuucuu

SEQ ID NO: 521659 - RNA, 14 nt, Chlamydophila pneumoniae J138
cuuaaaauuccuga

SEQ ID NO: 521660 - RNA, 14 nt, Chlamydophila pneumoniae J138
cuucaucacaaaau

SEQ ID NO: 521661 - RNA, 14 nt, Chlamydophila pneumoniae J138
cuuccauaucuaga

SEQ ID NO: 521662 - RNA, 20 nt, Chlamydophila pneumoniae J138
cuuauagggaauuuuuucug

SEQ ID NO: 521663 - RNA, 19 nt, Chlamydophila pneumoniae J138
cuucacuuauaagcugcuu

SEQ ID NO: 521664 - RNA, 13 nt, Chlamydophila pneumoniae J138
cuuccugcugcuu

SEQ ID NO: 521665 - RNA, 18 nt, Chlamydophila pneumoniae J138
cuuccauagcuuuagaag

SEQ ID NO: 521666 - RNA, 23 nt, Chlamydophila pneumoniae J138
cuucgauuggaagcaaagaaaau

SEQ ID NO: 521667 - RNA, 13 nt, Chlamydophila pneumoniae J138
cuugcuugcuagg

SEQ ID NO: 521668 - RNA, 17 nt, Chlamydophila pneumoniae J138
cuuuaacgaagaaggga

SEQ ID NO: 521669 - RNA, 16 nt, Chlamydophila pneumoniae J138
cuuuacaauacacuca

SEQ ID NO: 521670 - RNA, 23 nt, Chlamydophila pneumoniae J138
cuuuuccugcagcagccuuggcu

SEQ ID NO: 521671 - RNA, 11 nt, Chlamydophila pneumoniae J138
cuuuugcuaga

SEQ ID NO: 521672 - RNA, 14 nt, Chlamydophila pneumoniae J138
gaaaauuguuggaa

SEQ ID NO: 521673 - RNA, 17 nt, Chlamydophila pneumoniae J138
gaaaaugcgaucuucac

SEQ ID NO: 521674 - RNA, 13 nt, Chlamydophila pneumoniae J138
gaaauauacucuu

SEQ ID NO: 521675 - RNA, 16 nt, Chlamydophila pneumoniae J138
gaaauaagcaucuaga

SEQ ID NO: 521676 - RNA, 16 nt, Chlamydophila pneumoniae J138
gaaaggcacuccaaaa

SEQ ID NO: 521677 - RNA, 19 nt, Chlamydophila pneumoniae J138
gaaagaagccuuccuuguu

SEQ ID NO: 521678 - RNA, 23 nt, Chlamydophila pneumoniae J138
gaaacuucugacccuguagcgaa

SEQ ID NO: 521679 - RNA, 16 nt, Chlamydophila pneumoniae J138
gaaacuccaaaauauu

SEQ ID NO: 521680 - RNA, 23 nt, Chlamydophila pneumoniae J138
gaaauuagagggauuuguaggaa

SEQ ID NO: 521681 - RNA, 18 nt, Chlamydophila pneumoniae J138
gaaaucgcauuacaaaug

SEQ ID NO: 521682 - RNA, 22 nt, Chlamydophila pneumoniae J138
gaacaagucggcaggagaggua

SEQ ID NO: 521683 - RNA, 23 nt, Chlamydophila pneumoniae J138
gaacaggauugauaaauacccuc

SEQ ID NO: 521684 - RNA, 15 nt, Chlamydophila pneumoniae J138
gaacaggggauguga

SEQ ID NO: 521685 - RNA, 22 nt, Chlamydophila pneumoniae J138
gaccuuuaggaacuugaauacc

SEQ ID NO: 521686 - RNA, 23 nt, Chlamydophila pneumoniae J138
gaaucauagagauaucaucaaaa

SEQ ID NO: 521687 - RNA, 22 nt, Chlamydophila pneumoniae J138
gaaucugacgugcauugaaucc

SEQ ID NO: 521688 - RNA, 12 nt, Chlamydophila pneumoniae J138
gaauagaagauc

SEQ ID NO: 521689 - RNA, 16 nt, Chlamydophila pneumoniae J138
gacacagagaacaaua

SEQ ID NO: 521690 - RNA, 16 nt, Chlamydophila pneumoniae J138
gacaaugacuguagga

SEQ ID NO: 521691 - RNA, 23 nt, Chlamydophila pneumoniae J138
gacagucuccuggaacaguauaa

SEQ ID NO: 521692 - RNA, 20 nt, Chlamydophila pneumoniae J138
gacgugguaagguuaucuuu

SEQ ID NO: 521693 - RNA, 20 nt, Chlamydophila pneumoniae J138
gagaugcaaauccuguagaa

SEQ ID NO: 521694 - RNA, 16 nt, Chlamydophila pneumoniae J138
gagaaugacuuuagaa

SEQ ID NO: 521695 - RNA, 15 nt, Chlamydophila pneumoniae J138
gagaccuucucuuca

SEQ ID NO: 521696 - RNA, 20 nt, Chlamydophila pneumoniae J138
gagaguguuguuggagcaga

SEQ ID NO: 521697 - RNA, 15 nt, Chlamydophila pneumoniae J138
gacuuuccucucuuu

SEQ ID NO: 521698 - RNA, 20 nt, Chlamydophila pneumoniae J138
gagaaauacgcuuuucuucu

SEQ ID NO: 521699 - RNA, 18 nt, Chlamydophila pneumoniae J138
gacucuuccaauuguaaa

SEQ ID NO: 521700 - RNA, 20 nt, Chlamydophila pneumoniae J138
gacucggaguguuggugaga

SEQ ID NO: 521701 - RNA, 18 nt, Chlamydophila pneumoniae J138
cguucaucugucauuaaa

SEQ ID NO: 521702 - RNA, 17 nt, Chlamydophila pneumoniae J138
cguucaggauuuagagg

SEQ ID NO: 521703 - RNA, 21 nt, Chlamydophila pneumoniae J138
cgugauugcugucagaacaag

SEQ ID NO: 521704 - RNA, 15 nt, Chlamydophila pneumoniae J138
cgucuucaauagaac

SEQ ID NO: 521705 - RNA, 13 nt, Chlamydophila pneumoniae J138
cucaagaucuuca

SEQ ID NO: 521706 - RNA, 21 nt, Chlamydophila pneumoniae J138
cuagauuuugagaaugaacaa

SEQ ID NO: 521707 - RNA, 14 nt, Chlamydophila pneumoniae J138
cuauagcauagccu

SEQ ID NO: 521708 - RNA, 20 nt, Chlamydophila pneumoniae J138
cuaucuccagaaauuuuuac

SEQ ID NO: 521709 - RNA, 14 nt, Chlamydophila pneumoniae J138
cuagaaaaugaaga

SEQ ID NO: 521710 - RNA, 22 nt, Chlamydophila pneumoniae J138
cuagaaagauuuauuuugucuu

SEQ ID NO: 521711 - RNA, 21 nt, Chlamydophila pneumoniae J138
cuagaaaagauucuaaaucaa

SEQ ID NO: 521712 - RNA, 23 nt, Chlamydophila pneumoniae J138
cuagaacuugggaugcuacuuuc

SEQ ID NO: 521713 - RNA, 12 nt, Chlamydophila pneumoniae J138
cuagaggaucuu

SEQ ID NO: 521714 - RNA, 15 nt, Chlamydophila pneumoniae J138
cuagagauuuuucua

SEQ ID NO: 521715 - RNA, 16 nt, Chlamydophila pneumoniae J138
cuagauagcaaaucaa

SEQ ID NO: 521716 - RNA, 19 nt, Chlamydophila pneumoniae J138
cuacuaggcgcauaugcuc

SEQ ID NO: 521717 - RNA, 17 nt, Chlamydophila pneumoniae J138
cuacgugaucaaaauua

SEQ ID NO: 521718 - RNA, 20 nt, Chlamydophila pneumoniae J138
cuacagaggaaucuauccuu

SEQ ID NO: 521719 - RNA, 17 nt, Chlamydophila pneumoniae J138
cuacauaaaaugagcuc

SEQ ID NO: 521720 - RNA, 15 nt, Chlamydophila pneumoniae J138
cucccaauauccaga

SEQ ID NO: 521721 - RNA, 15 nt, Chlamydophila pneumoniae J138
cuccagcauaaggau

SEQ ID NO: 521722 - RNA, 19 nt, Chlamydophila pneumoniae J138
cucaggcuuuaaguguuuc

SEQ ID NO: 521723 - RNA, 20 nt, Chlamydophila pneumoniae J138
cucaggucugcugaggagag

SEQ ID NO: 521724 - RNA, 17 nt, Chlamydophila pneumoniae J138
cucacagcuaaucauag

SEQ ID NO: 521725 - RNA, 12 nt, Chlamydophila pneumoniae J138
cuccgcucuaag

SEQ ID NO: 521726 - RNA, 18 nt, Chlamydophila pneumoniae J138
cucgaagcuugcugauuu

SEQ ID NO: 521727 - RNA, 15 nt, Chlamydophila pneumoniae J138
cuccuucaaagauau

SEQ ID NO: 521728 - RNA, 13 nt, Chlamydophila pneumoniae J138
cuccuuuuaaaau

SEQ ID NO: 521729 - RNA, 23 nt, Chlamydophila pneumoniae J138
cugcgacacgaauuucuaacuua

SEQ ID NO: 521730 - RNA, 22 nt, Chlamydophila pneumoniae J138
cucugcauguugcaaagcauga

SEQ ID NO: 521731 - RNA, 18 nt, Chlamydophila pneumoniae J138
cucugacaaguguguuuc

SEQ ID NO: 521732 - RNA, 19 nt, Chlamydophila pneumoniae J138
cucucuucccccagaccua

SEQ ID NO: 521733 - RNA, 15 nt, Chlamydophila pneumoniae J138
cugaacauucuuaau

SEQ ID NO: 521734 - RNA, 22 nt, Chlamydophila pneumoniae J138
cucgguuuccugaagaugagaa

SEQ ID NO: 521735 - RNA, 21 nt, Chlamydophila pneumoniae J138
cucuacaguaguaaauaauaa

SEQ ID NO: 521736 - RNA, 15 nt, Chlamydophila pneumoniae J138
cucuagccaccaaca

SEQ ID NO: 521737 - RNA, 21 nt, Chlamydophila pneumoniae J138
cucuagggauaauuaaacucu

SEQ ID NO: 521738 - RNA, 20 nt, Chlamydophila pneumoniae J138
cucuagaaaacgcucuccua

SEQ ID NO: 521739 - RNA, 19 nt, Chlamydophila pneumoniae J138
cacguucccacgagcacaa

SEQ ID NO: 521740 - RNA, 20 nt, Chlamydophila pneumoniae J138
cacuacagcuucauuaucuu

SEQ ID NO: 521741 - RNA, 16 nt, Chlamydophila pneumoniae J138
cacuaaaagggaagcu

SEQ ID NO: 521742 - RNA, 20 nt, Chlamydophila pneumoniae J138
cacgggauagccgagaucuu

SEQ ID NO: 521743 - RNA, 21 nt, Chlamydophila pneumoniae J138
cagaaacuagggagaucuuau

SEQ ID NO: 521744 - RNA, 12 nt, Chlamydophila pneumoniae J138
cagaaacuccag

SEQ ID NO: 521745 - RNA, 19 nt, Chlamydophila pneumoniae J138
cacuucuuuaggagcauag

SEQ ID NO: 521746 - RNA, 19 nt, Chlamydophila pneumoniae J138
cagagaugcuucuaaacaa

SEQ ID NO: 521747 - RNA, 14 nt, Chlamydophila pneumoniae J138
cagagaacuuucgu

SEQ ID NO: 521748 - RNA, 20 nt, Chlamydophila pneumoniae J138
cagagauugccaggagagcu

SEQ ID NO: 521749 - RNA, 22 nt, Chlamydophila pneumoniae J138
cagauaaagcaaagauaaagaa

SEQ ID NO: 521750 - RNA, 23 nt, Chlamydophila pneumoniae J138
cagcgaggaguuuuccaaaguca

SEQ ID NO: 521751 - RNA, 16 nt, Chlamydophila pneumoniae J138
cagcguugcuaagcau

SEQ ID NO: 521752 - RNA, 16 nt, Chlamydophila pneumoniae J138
cagcuccauuuaaaug

SEQ ID NO: 521753 - RNA, 16 nt, Chlamydophila pneumoniae J138
caggaguucuugauuc

SEQ ID NO: 521754 - RNA, 23 nt, Chlamydophila pneumoniae J138
caggauuaguaacuaaauucuua

SEQ ID NO: 521755 - RNA, 21 nt, Chlamydophila pneumoniae J138
cauaaauacgugcuugaauau

SEQ ID NO: 521756 - RNA, 23 nt, Chlamydophila pneumoniae J138
cauaaagccccacccacuccaga

SEQ ID NO: 521757 - RNA, 20 nt, Chlamydophila pneumoniae J138
cauaaauaggcucuacagga

SEQ ID NO: 521758 - RNA, 22 nt, Chlamydophila pneumoniae J138
cauaaucuccaaacauuuuuaa

SEQ ID NO: 521759 - RNA, 14 nt, Chlamydophila pneumoniae J138
cauaauuagaacag

SEQ ID NO: 521760 - RNA, 19 nt, Chlamydophila pneumoniae J138
cagucugugagaaauaggu

SEQ ID NO: 521761 - RNA, 17 nt, Chlamydophila pneumoniae J138
cauagcuuuagaagccc

SEQ ID NO: 521762 - RNA, 16 nt, Chlamydophila pneumoniae J138
cauagccaucauagca

SEQ ID NO: 521763 - RNA, 12 nt, Chlamydophila pneumoniae J138
cauagaggagau

SEQ ID NO: 521764 - RNA, 20 nt, Chlamydophila pneumoniae J138
ccacggauuuucucuacaca

SEQ ID NO: 521765 - RNA, 21 nt, Chlamydophila pneumoniae J138
ccacuugcauggauccuucau

SEQ ID NO: 521766 - RNA, 22 nt, Chlamydophila pneumoniae J138
cauguuaucaagacgacacuca

SEQ ID NO: 521767 - RNA, 17 nt, Chlamydophila pneumoniae J138
caugcuaauaauuccug

SEQ ID NO: 521768 - RNA, 22 nt, Chlamydophila pneumoniae J138
cauuguuuguccuaggagagcu

SEQ ID NO: 521769 - RNA, 12 nt, Chlamydophila pneumoniae J138
ccaaaauaaucu

SEQ ID NO: 521770 - RNA, 20 nt, Chlamydophila pneumoniae J138
cauuuuugggaaaagaaaag

SEQ ID NO: 521771 - RNA, 23 nt, Chlamydophila pneumoniae J138
cauuaauaacuuuagguauuuac

SEQ ID NO: 521772 - RNA, 17 nt, Chlamydophila pneumoniae J138
ccaaggaaauuauggag

SEQ ID NO: 521773 - RNA, 15 nt, Chlamydophila pneumoniae J138
ccauacauagggaaa

SEQ ID NO: 521774 - RNA, 16 nt, Chlamydophila pneumoniae J138
ccauacugauauacag

SEQ ID NO: 521775 - RNA, 15 nt, Chlamydophila pneumoniae J138
ccaucccauauggau

SEQ ID NO: 521776 - RNA, 21 nt, Chlamydophila pneumoniae J138
ccauucaauaauuucaaagau

SEQ ID NO: 521777 - RNA, 12 nt, Chlamydophila pneumoniae J138
cccuaagauucg

SEQ ID NO: 521778 - RNA, 14 nt, Chlamydophila pneumoniae J138
cccuggaauuucuc

SEQ ID NO: 521779 - RNA, 15 nt, Chlamydophila pneumoniae J138
agacuaaaagaauaa

SEQ ID NO: 521780 - RNA, 19 nt, Chlamydophila pneumoniae J138
agagagagucggcuuuaga

SEQ ID NO: 521781 - RNA, 20 nt, Chlamydophila pneumoniae J138
agaaaauaucacauuccaau

SEQ ID NO: 521782 - RNA, 23 nt, Chlamydophila pneumoniae J138
agaaaaucaacucuccauccuca

SEQ ID NO: 521783 - RNA, 23 nt, Chlamydophila pneumoniae J138
agaaacuagggagaucuuauaga

SEQ ID NO: 521784 - RNA, 18 nt, Chlamydophila pneumoniae J138
agaaaggauuggaugaga

SEQ ID NO: 521785 - RNA, 21 nt, Chlamydophila pneumoniae J138
agagcuugguuuucuccuucu

SEQ ID NO: 521786 - RNA, 17 nt, Chlamydophila pneumoniae J138
agauccuuuaaagauuc

SEQ ID NO: 521787 - RNA, 12 nt, Chlamydophila pneumoniae J138
agaucaauauag

SEQ ID NO: 521788 - RNA, 13 nt, Chlamydophila pneumoniae J138
agaucguuaucaa

SEQ ID NO: 521789 - RNA, 22 nt, Chlamydophila pneumoniae J138
agauggucgagaaccuccacca

SEQ ID NO: 521790 - RNA, 13 nt, Chlamydophila pneumoniae J138
agaucucuuuagc

SEQ ID NO: 521791 - RNA, 19 nt, Chlamydophila pneumoniae J138
agaucuuuaucauugcuau

SEQ ID NO: 521792 - RNA, 17 nt, Chlamydophila pneumoniae J138
agcaagagcucuugaga

SEQ ID NO: 521793 - RNA, 15 nt, Chlamydophila pneumoniae J138
agccaucauagcaaa

SEQ ID NO: 521794 - RNA, 23 nt, Chlamydophila pneumoniae J138
agcauccugaacggcucuuucua

SEQ ID NO: 521795 - RNA, 12 nt, Chlamydophila pneumoniae J138
agcaucuucucg

SEQ ID NO: 521796 - RNA, 16 nt, Chlamydophila pneumoniae J138
agcccuacgaauccaa

SEQ ID NO: 521797 - RNA, 18 nt, Chlamydophila pneumoniae J138
agcguuuuuugaaaauuu

SEQ ID NO: 521798 - RNA, 20 nt, Chlamydophila pneumoniae J138
agcuaaaucaaaauuuuuag

SEQ ID NO: 521799 - RNA, 19 nt, Chlamydophila pneumoniae J138
agcuaucgagauaucgaua

SEQ ID NO: 521800 - RNA, 16 nt, Chlamydophila pneumoniae J138
agcucaucuagaaaga

SEQ ID NO: 521801 - RNA, 17 nt, Chlamydophila pneumoniae J138
agcucccucuagagcuu

SEQ ID NO: 521802 - RNA, 14 nt, Chlamydophila pneumoniae J138
agcuccuuggcuau

SEQ ID NO: 521803 - RNA, 22 nt, Chlamydophila pneumoniae J138
agcucuuucauaagauugccau

SEQ ID NO: 521804 - RNA, 17 nt, Chlamydophila pneumoniae J138
agcucucuugcuauacc

SEQ ID NO: 521805 - RNA, 17 nt, Chlamydophila pneumoniae J138
agcucuaaguccaacau

SEQ ID NO: 521806 - RNA, 16 nt, Chlamydophila pneumoniae J138
aggauuccuugacuau

SEQ ID NO: 521807 - RNA, 23 nt, Chlamydophila pneumoniae J138
aggcugcuacgugaucaaaauua

SEQ ID NO: 521808 - RNA, 14 nt, Chlamydophila pneumoniae J138
aggcugcacacauc

SEQ ID NO: 521809 - RNA, 17 nt, Chlamydophila pneumoniae J138
agggacagucuccugga

SEQ ID NO: 521810 - RNA, 18 nt, Chlamydophila pneumoniae J138
aggcgaugcaaauuccag

SEQ ID NO: 521811 - RNA, 18 nt, Chlamydophila pneumoniae J138
aggucugcucuauauauc

SEQ ID NO: 521812 - RNA, 18 nt, Chlamydophila pneumoniae J138
agguuugcugcucuccaa

SEQ ID NO: 521813 - RNA, 22 nt, Chlamydophila pneumoniae J138
agguuuuaaaaugugucuugcu

SEQ ID NO: 521814 - RNA, 16 nt, Chlamydophila pneumoniae J138
aguccugggguucucu

SEQ ID NO: 521815 - RNA, 14 nt, Chlamydophila pneumoniae J138
aguccuugaauuag

SEQ ID NO: 521816 - RNA, 15 nt, Chlamydophila pneumoniae J138
aguauuaaagaugaa

SEQ ID NO: 521817 - RNA, 12 nt, Chlamydophila pneumoniae J138
aguaucuucucu

SEQ ID NO: 521818 - RNA, 19 nt, Chlamydophila pneumoniae J138
aguauagcaugaucuuuag

SEQ ID NO: 521819 - RNA, 23 nt, Chlamydophila pneumoniae J138
aguccuuuuuguucaaagauugc

SEQ ID NO: 521820 - RNA, 16 nt, Chlamydophila pneumoniae J138
aguucaucuagaugau

SEQ ID NO: 521821 - RNA, 14 nt, Chlamydophila pneumoniae J138
aguugauuguagag

SEQ ID NO: 521822 - RNA, 12 nt, Chlamydophila pneumoniae J138
auaaaauagccc

SEQ ID NO: 521823 - RNA, 19 nt, Chlamydophila pneumoniae J138
auaaaucuauauccacaau

SEQ ID NO: 521824 - RNA, 18 nt, Chlamydophila pneumoniae J138
auaaaguuuguaaaaacu

SEQ ID NO: 521825 - RNA, 22 nt, Chlamydophila pneumoniae J138
auacguuuuuuuccuuucuuuu

SEQ ID NO: 521826 - RNA, 17 nt, Chlamydophila pneumoniae J138
auacaucguauccaaau

SEQ ID NO: 521827 - RNA, 16 nt, Chlamydophila pneumoniae J138
auagccaaagacucuu

SEQ ID NO: 521828 - RNA, 16 nt, Chlamydophila pneumoniae J138
auagcaagcacuuucg

SEQ ID NO: 521829 - RNA, 18 nt, Chlamydophila pneumoniae J138
auagagcgguucuuucua

SEQ ID NO: 521830 - RNA, 18 nt, Chlamydophila pneumoniae J138
auagagcuucuuuaucua

SEQ ID NO: 521831 - RNA, 17 nt, Chlamydophila pneumoniae J138
auagauuccccaaacuu

SEQ ID NO: 521832 - RNA, 14 nt, Chlamydophila pneumoniae J138
aucaagaagagaaa

SEQ ID NO: 521833 - RNA, 19 nt, Chlamydophila pneumoniae J138
aucaaaaaaaagaccaaau

SEQ ID NO: 521834 - RNA, 16 nt, Chlamydophila pneumoniae J138
aucacuuauauuuucu

SEQ ID NO: 521835 - RNA, 17 nt, Chlamydophila pneumoniae J138
caaauaauuaaauauau

SEQ ID NO: 521836 - RNA, 16 nt, Chlamydophila pneumoniae J138
caaacuaaaucaacua

SEQ ID NO: 521837 - RNA, 19 nt, Chlamydophila pneumoniae J138
caaacuucgauuggaagca

SEQ ID NO: 521838 - RNA, 21 nt, Chlamydophila pneumoniae J138
auuguuagugagaucaaaaau

SEQ ID NO: 521839 - RNA, 14 nt, Chlamydophila pneumoniae J138
caaaaugcauuugc

SEQ ID NO: 521840 - RNA, 23 nt, Chlamydophila pneumoniae J138
caacuacagagggcuucauuccu

SEQ ID NO: 521841 - RNA, 20 nt, Chlamydophila pneumoniae J138
caagucgagaaacaaaaucu

SEQ ID NO: 521842 - RNA, 12 nt, Chlamydophila pneumoniae J138
caaguaaagaaa

SEQ ID NO: 521843 - RNA, 13 nt, Chlamydophila pneumoniae J138
caauaagaaaauc

SEQ ID NO: 521844 - RNA, 21 nt, Chlamydophila pneumoniae J138
caauauagaagcugcugcuac

SEQ ID NO: 521845 - RNA, 13 nt, Chlamydophila pneumoniae J138
caauaggcaccca

SEQ ID NO: 521846 - RNA, 23 nt, Chlamydophila pneumoniae J138
caaucaccguacuucccucauga

SEQ ID NO: 521847 - RNA, 19 nt, Chlamydophila pneumoniae J138
caauccacgcuccucuaac

SEQ ID NO: 521848 - RNA, 15 nt, Chlamydophila pneumoniae J138
caauggcgauaaaug

SEQ ID NO: 521849 - RNA, 24 nt, Chlamydophila pneumoniae J138
cacaaggagagaaaauaucacauu

SEQ ID NO: 521850 - RNA, 17 nt, Chlamydophila pneumoniae J138
caccagcucgagaucuu

SEQ ID NO: 521851 - RNA, 18 nt, Chlamydophila pneumoniae J138
caccucaauacggacaua

SEQ ID NO: 521852 - RNA, 12 nt, Chlamydophila pneumoniae J138
auggaugaucuc

SEQ ID NO: 521853 - RNA, 13 nt, Chlamydophila pneumoniae J138
auggaacauccuu

SEQ ID NO: 521854 - RNA, 21 nt, Chlamydophila pneumoniae J138
auggauccuucaucagcuucc

SEQ ID NO: 521855 - RNA, 23 nt, Chlamydophila pneumoniae J138
auguuaaaggaauaugcucuccu

SEQ ID NO: 521856 - RNA, 13 nt, Chlamydophila pneumoniae J138
auguguuuccuuu

SEQ ID NO: 521857 - RNA, 17 nt, Chlamydophila pneumoniae J138
augucgucucagaaaaa

SEQ ID NO: 521858 - RNA, 20 nt, Chlamydophila pneumoniae J138
augugaagccauuuucuaag

SEQ ID NO: 521859 - RNA, 16 nt, Chlamydophila pneumoniae J138
auguauuguguucccu

SEQ ID NO: 521860 - RNA, 22 nt, Chlamydophila pneumoniae J138
auguauuguguucccucuucuu

SEQ ID NO: 521861 - RNA, 18 nt, Chlamydophila pneumoniae J138
auuauguagaucauaaac

SEQ ID NO: 521862 - RNA, 14 nt, Chlamydophila pneumoniae J138
auucucgaaaaauu

SEQ ID NO: 521863 - RNA, 23 nt, Chlamydophila pneumoniae J138
auucuauuuauuuuauuaguuuu

SEQ ID NO: 521864 - RNA, 15 nt, Chlamydophila pneumoniae J138
auucucagaaagccu

SEQ ID NO: 521865 - RNA, 21 nt, Chlamydophila pneumoniae J138
auucuggagucgagcagaaau

SEQ ID NO: 521866 - RNA, 15 nt, Chlamydophila pneumoniae J138
auucugcuagagcuu

SEQ ID NO: 521867 - RNA, 12 nt, Chlamydophila pneumoniae J138
auucuaaaucaa

SEQ ID NO: 521868 - RNA, 20 nt, Chlamydophila pneumoniae J138
auuccuucucagaaagauau

SEQ ID NO: 521869 - RNA, 21 nt, Chlamydophila pneumoniae J138
auuccuagccaucgcgaagcu

SEQ ID NO: 521870 - RNA, 20 nt, Chlamydophila pneumoniae J138
auugccaugcccacagacca

SEQ ID NO: 521871 - RNA, 13 nt, Chlamydophila pneumoniae J138
auugauuaccuca

SEQ ID NO: 521872 - RNA, 20 nt, Chlamydophila pneumoniae J138
auugaccugcuuuuuuucua

SEQ ID NO: 521873 - RNA, 12 nt, Chlamydophila pneumoniae J138
auucuucagaau

SEQ ID NO: 521874 - RNA, 13 nt, Chlamydophila pneumoniae J138
auuguaguucuuu

SEQ ID NO: 521875 - RNA, 13 nt, Chlamydophila pneumoniae J138
aucccuucuucuu

SEQ ID NO: 521876 - RNA, 23 nt, Chlamydophila pneumoniae J138
auccucaaagaguuuuuuagagg

SEQ ID NO: 521877 - RNA, 19 nt, Chlamydophila pneumoniae J138
aucgacaccuauaccaaau

SEQ ID NO: 521878 - RNA, 16 nt, Chlamydophila pneumoniae J138
auccucggcaucuuug

SEQ ID NO: 521879 - RNA, 20 nt, Chlamydophila pneumoniae J138
auccugcauacccuucuucu

SEQ ID NO: 521880 - RNA, 14 nt, Chlamydophila pneumoniae J138
augaagaaaaaucu

SEQ ID NO: 521881 - RNA, 16 nt, Chlamydophila pneumoniae J138
aucuuuucuuucuaag

SEQ ID NO: 521882 - RNA, 20 nt, Chlamydophila pneumoniae J138
aucuuuaagauuuuuagaau

SEQ ID NO: 521883 - RNA, 13 nt, Chlamydophila pneumoniae J138
aucuuuauuuaaa

SEQ ID NO: 521884 - RNA, 12 nt, Chlamydophila pneumoniae J138
aucuuucuucua

SEQ ID NO: 521885 - RNA, 18 nt, Chlamydophila pneumoniae J138
aucuuucuucuagagcuu

SEQ ID NO: 521886 - RNA, 22 nt, Chlamydophila pneumoniae J138
aucuuucaaggaacauuugagc

SEQ ID NO: 521887 - RNA, 14 nt, Chlamydophila pneumoniae J138
aucuuuuuuaaagc

SEQ ID NO: 521888 - RNA, 12 nt, Chlamydophila pneumoniae J138
aucuuuuagagu

SEQ ID NO: 521889 - RNA, 19 nt, Chlamydophila pneumoniae J138
augaaguugacaucuguag

SEQ ID NO: 521890 - RNA, 16 nt, Chlamydophila pneumoniae J138
augauccgaaaacucu

SEQ ID NO: 521891 - RNA, 14 nt, Chlamydophila pneumoniae J138
augcaucaagagau

SEQ ID NO: 521892 - RNA, 14 nt, Chlamydophila pneumoniae J138
augcaguucuuguu

SEQ ID NO: 521893 - RNA, 17 nt, Chlamydophila pneumoniae J138
aucuacaaacagauuuu

SEQ ID NO: 521894 - RNA, 21 nt, Chlamydophila pneumoniae J138
aucuacaaacagauuuuucaa

SEQ ID NO: 521895 - RNA, 18 nt, Chlamydophila pneumoniae J138
aucuaagauccugagacc

SEQ ID NO: 521896 - RNA, 22 nt, Chlamydophila pneumoniae J138
aucuaagaacuagaaaaaaucc

SEQ ID NO: 521897 - RNA, 14 nt, Chlamydophila pneumoniae J138
aucuccuucaugca

SEQ ID NO: 521898 - RNA, 17 nt, Chlamydophila pneumoniae J138
aucuccggaacgcagag

SEQ ID NO: 521899 - RNA, 13 nt, Chlamydophila pneumoniae J138
aucuacucuuuaa

SEQ ID NO: 521900 - RNA, 18 nt, Chlamydophila pneumoniae J138
aucuagagucucuuucag

SEQ ID NO: 521901 - RNA, 20 nt, Chlamydophila pneumoniae J138
aucuagggacuucucaaaga

SEQ ID NO: 521902 - RNA, 18 nt, Chlamydophila pneumoniae J138
aucucgcuauuccauaaa

SEQ ID NO: 521903 - RNA, 14 nt, Chlamydophila pneumoniae J138
aucuuguacauccu

SEQ ID NO: 521904 - RNA, 13 nt, Chlamydophila pneumoniae J138
aucuugaaaagau

SEQ ID NO: 521905 - RNA, 16 nt, Chlamydophila pneumoniae J138
aucuguugaucuucua

SEQ ID NO: 521906 - RNA, 23 nt, Chlamydophila pneumoniae J138
aucuucaucacaaaauucaugca

SEQ ID NO: 521907 - RNA, 21 nt, Chlamydophila pneumoniae J138
aucuucagcauagagagaagg

SEQ ID NO: 521908 - RNA, 14 nt, Chlamydophila pneumoniae J138
aauuugcuccucca

SEQ ID NO: 521909 - RNA, 14 nt, Chlamydophila pneumoniae J138
acagcauaaaaauu

SEQ ID NO: 521910 - RNA, 12 nt, Chlamydophila pneumoniae J138
acagauuuuuca

SEQ ID NO: 521911 - RNA, 23 nt, Chlamydophila pneumoniae J138
acaucaagaauuucuucuuucca

SEQ ID NO: 521912 - RNA, 21 nt, Chlamydophila pneumoniae J138
acaugcuaauccagcaacaac

SEQ ID NO: 521913 - RNA, 13 nt, Chlamydophila pneumoniae J138
acagcuucuucgu

SEQ ID NO: 521914 - RNA, 22 nt, Chlamydophila pneumoniae J138
accacgaacuucagcaagaaaa

SEQ ID NO: 521915 - RNA, 21 nt, Chlamydophila pneumoniae J138
accguaacugaggcaaagauu

SEQ ID NO: 521916 - RNA, 20 nt, Chlamydophila pneumoniae J138
accgaugauaccaagaugaa

SEQ ID NO: 521917 - RNA, 18 nt, Chlamydophila pneumoniae J138
acccuucagaauucucaa

SEQ ID NO: 521918 - RNA, 14 nt, Chlamydophila pneumoniae J138
acgaccaacuccuc

SEQ ID NO: 521919 - RNA, 21 nt, Chlamydophila pneumoniae J138
acgcaaaguacuaauuacaga

SEQ ID NO: 521920 - RNA, 20 nt, Chlamydophila pneumoniae J138
acggacuucacaaagaacca

SEQ ID NO: 521921 - RNA, 13 nt, Chlamydophila pneumoniae J138
acgcuuuucuaau

SEQ ID NO: 521922 - RNA, 17 nt, Chlamydophila pneumoniae J138
acucuuaucuggagaug

SEQ ID NO: 521923 - RNA, 15 nt, Chlamydophila pneumoniae J138
acuucggaugagauc

SEQ ID NO: 521924 - RNA, 13 nt, Chlamydophila pneumoniae J138
acuuccucuucaa

SEQ ID NO: 521925 - RNA, 17 nt, Chlamydophila pneumoniae J138
acuuaggaauuuuucua

SEQ ID NO: 521926 - RNA, 23 nt, Chlamydophila pneumoniae J138
acuuauaccaccccaaagcagau

SEQ ID NO: 521927 - RNA, 15 nt, Chlamydophila pneumoniae J138
acuugcccaaaaguu

SEQ ID NO: 521928 - RNA, 23 nt, Chlamydophila pneumoniae J138
acuucuccacagcuucuucguaa

SEQ ID NO: 521929 - RNA, 23 nt, Chlamydophila pneumoniae J138
acuucugcaggacugucuagcag

SEQ ID NO: 521930 - RNA, 12 nt, Chlamydophila pneumoniae J138
acguucuuucaa

SEQ ID NO: 521931 - RNA, 18 nt, Chlamydophila pneumoniae J138
uguuuuagauggaucuau

SEQ ID NO: 521932 - RNA, 15 nt, Chlamydophila pneumoniae J138
uuaaaaauuuaaaag

SEQ ID NO: 521933 - RNA, 18 nt, Chlamydophila pneumoniae J138
uuaaguugaccuuuuuca

SEQ ID NO: 521934 - RNA, 14 nt, Chlamydophila pneumoniae J138
uuaauuccuuggau

SEQ ID NO: 521935 - RNA, 22 nt, Chlamydophila pneumoniae J138
uguuaagauguggucuuccgua

SEQ ID NO: 521936 - RNA, 15 nt, Chlamydophila pneumoniae J138
uguuaauagaagauc

SEQ ID NO: 521937 - RNA, 23 nt, Chlamydophila pneumoniae J138
uguuaacaaguaccaagaaaaua

SEQ ID NO: 521938 - RNA, 15 nt, Chlamydophila pneumoniae J138
uguuaagggaucucc

SEQ ID NO: 521939 - RNA, 17 nt, Chlamydophila pneumoniae J138
uguucauccagaaguau

SEQ ID NO: 521940 - RNA, 19 nt, Chlamydophila pneumoniae J138
uuauuauguagaucauaaa

SEQ ID NO: 521941 - RNA, 15 nt, Chlamydophila pneumoniae J138
uuauucccaagaacu

SEQ ID NO: 521942 - RNA, 21 nt, Chlamydophila pneumoniae J138
uuauguagaucuacaagacua

SEQ ID NO: 521943 - RNA, 16 nt, Chlamydophila pneumoniae J138
uuauacuguuuuucuu

SEQ ID NO: 521944 - RNA, 19 nt, Chlamydophila pneumoniae J138
uucaauagcaaagauuucu

SEQ ID NO: 521945 - RNA, 14 nt, Chlamydophila pneumoniae J138
uucacaucuuucuc

SEQ ID NO: 521946 - RNA, 18 nt, Chlamydophila pneumoniae J138
uucaaaagaaaucaaaca

SEQ ID NO: 521947 - RNA, 14 nt, Chlamydophila pneumoniae J138
uuauuguucuuggu

SEQ ID NO: 521948 - RNA, 17 nt, Chlamydophila pneumoniae J138
uucgauuccaggcucua

SEQ ID NO: 521949 - RNA, 14 nt, Chlamydophila pneumoniae J138
uuccugagcgucgu

SEQ ID NO: 521950 - RNA, 18 nt, Chlamydophila pneumoniae J138
uuccuaaaacaagaagau

SEQ ID NO: 521951 - RNA, 23 nt, Chlamydophila pneumoniae J138
uuccgugcgauuuccccuucaga

SEQ ID NO: 521952 - RNA, 24 nt, Chlamydophila pneumoniae J138
uuccggggugcgaccuaggagaaa

SEQ ID NO: 521953 - RNA, 18 nt, Chlamydophila pneumoniae J138
uucucuaagcagccucuu

SEQ ID NO: 521954 - RNA, 19 nt, Chlamydophila pneumoniae J138
uucuccacaugcccaaaca

SEQ ID NO: 521955 - RNA, 12 nt, Chlamydophila pneumoniae J138
uucucuaaaaua

SEQ ID NO: 521956 - RNA, 15 nt, Chlamydophila pneumoniae J138
uucucuaucuuuauu

SEQ ID NO: 521957 - RNA, 18 nt, Chlamydophila pneumoniae J138
uucucauagcuuccugua

SEQ ID NO: 521958 - RNA, 14 nt, Chlamydophila pneumoniae J138
uucuauuuuagaau

SEQ ID NO: 521959 - RNA, 13 nt, Chlamydophila pneumoniae J138
uucuuuuccugca

SEQ ID NO: 521960 - RNA, 20 nt, Chlamydophila pneumoniae J138
uucuuugccguauagauuuu

SEQ ID NO: 521961 - RNA, 13 nt, Chlamydophila pneumoniae J138
uucuuuuagagaa

SEQ ID NO: 521962 - RNA, 13 nt, Chlamydophila pneumoniae J138
uucuuucaaacca

SEQ ID NO: 521963 - RNA, 23 nt, Chlamydophila pneumoniae J138
uugaacaaaaaggacucuuucua

SEQ ID NO: 521964 - RNA, 14 nt, Chlamydophila pneumoniae J138
uucuugaaaaaucc

SEQ ID NO: 521965 - RNA, 15 nt, Chlamydophila pneumoniae J138
uucuuuaagauuucc

SEQ ID NO: 521966 - RNA, 17 nt, Chlamydophila pneumoniae J138
uucuuuagcuacagaaa

SEQ ID NO: 521967 - RNA, 18 nt, Chlamydophila pneumoniae J138
uucuuuaggguaaagaaa

SEQ ID NO: 521968 - RNA, 10 nt, Chlamydophila pneumoniae J138
uugagcucuc

SEQ ID NO: 521969 - RNA, 23 nt, Chlamydophila pneumoniae J138
uugcgauaucuauaaauguaggg

SEQ ID NO: 521970 - RNA, 11 nt, Chlamydophila pneumoniae J138
uugcugaagau

SEQ ID NO: 521971 - RNA, 23 nt, Chlamydophila pneumoniae J138
uuguaggaacaugccaaauaucu

SEQ ID NO: 521972 - RNA, 22 nt, Chlamydophila pneumoniae J138
uugcuucuccccgagauacggg

SEQ ID NO: 521973 - RNA, 13 nt, Chlamydophila pneumoniae J138
uugcuuuucccuu

SEQ ID NO: 521974 - RNA, 13 nt, Chlamydophila pneumoniae J138
uuuaggaagcugu

SEQ ID NO: 521975 - RNA, 14 nt, Chlamydophila pneumoniae J138
uuuagcuucuuuuu

SEQ ID NO: 521976 - RNA, 16 nt, Chlamydophila pneumoniae J138
uuuagaaaaagaucua

SEQ ID NO: 521977 - RNA, 21 nt, Chlamydophila pneumoniae J138
uuuagcaaucucuuucacaaa

SEQ ID NO: 521978 - RNA, 15 nt, Chlamydophila pneumoniae J138
uuuagauggaucuau

SEQ ID NO: 521979 - RNA, 18 nt, Chlamydophila pneumoniae J138
uuuagagaacggaugucu

SEQ ID NO: 521980 - RNA, 13 nt, Chlamydophila pneumoniae J138
uuuaauguguucu

SEQ ID NO: 521981 - RNA, 23 nt, Chlamydophila pneumoniae J138
aauccuuuaguuaacuccuucaa

SEQ ID NO: 521982 - RNA, 14 nt, Chlamydophila pneumoniae J138
uuuaucaugagaau

SEQ ID NO: 521983 - RNA, 19 nt, Chlamydophila pneumoniae J138
uuuaucugcguuucuuucu

SEQ ID NO: 521984 - RNA, 12 nt, Chlamydophila pneumoniae J138
uuuauuuaaaau

SEQ ID NO: 521985 - RNA, 16 nt, Chlamydophila pneumoniae J138
uuuccaacuucaacuu

SEQ ID NO: 521986 - RNA, 23 nt, Chlamydophila pneumoniae J138
uuuccguaaguaaccaauacagc

SEQ ID NO: 521987 - RNA, 22 nt, Chlamydophila pneumoniae J138
uuuccuccaaauacgaacugua

SEQ ID NO: 521988 - RNA, 15 nt, Chlamydophila pneumoniae J138
uuuccuaguccucua

SEQ ID NO: 521989 - RNA, 20 nt, Chlamydophila pneumoniae J138
uuuccugaagaugagaaaau

SEQ ID NO: 521990 - RNA, 21 nt, Chlamydophila pneumoniae J138
uuuugauucccuccuuccuua

SEQ ID NO: 521991 - RNA, 15 nt, Chlamydophila pneumoniae J138
uuuucuucuucggau

SEQ ID NO: 521992 - RNA, 18 nt, Chlamydophila pneumoniae J138
uuuucuugauuagagaau

SEQ ID NO: 521993 - RNA, 20 nt, Chlamydophila pneumoniae J138
uuuucucaauaguguaacau

SEQ ID NO: 521994 - RNA, 22 nt, Chlamydophila pneumoniae J138
uuuucuauaucauuaagaagau

SEQ ID NO: 521995 - RNA, 12 nt, Chlamydophila pneumoniae J138
uuuucugaagau

SEQ ID NO: 521996 - RNA, 14 nt, Chlamydophila pneumoniae J138
uuuucagaaagcga

SEQ ID NO: 521997 - RNA, 22 nt, Chlamydophila pneumoniae J138
uuucgucaaagguuuuaaaaug

SEQ ID NO: 521998 - RNA, 13 nt, Chlamydophila pneumoniae J138
uuuuaaauacaga

SEQ ID NO: 521999 - RNA, 15 nt, Chlamydophila pneumoniae J138
uuuguuuuaacucua

SEQ ID NO: 522000 - RNA, 22 nt, Chlamydophila pneumoniae J138
uuuugucgcaauaacaaacgcc

SEQ ID NO: 522001 - RNA, 15 nt, Chlamydophila pneumoniae J138
uuuugguucuuggag

SEQ ID NO: 522002 - RNA, 17 nt, Chlamydophila pneumoniae J138
aaucucaaaaucaaaua

SEQ ID NO: 522003 - RNA, 21 nt, Chlamydophila pneumoniae J138
aauugcaaaguacuacaauaa

SEQ ID NO: 522004 - RNA, 15 nt, Chlamydophila pneumoniae J138
aauucgguagagcua

SEQ ID NO: 522005 - RNA, 17 nt, Chlamydophila pneumoniae J138
aauuccuaaaacaagaa

SEQ ID NO: 522006 - RNA, 13 nt, Chlamydophila pneumoniae J138
aauuccaaaauaa

SEQ ID NO: 522007 - RNA, 16 nt, Chlamydophila pneumoniae J138
aauuaguaaaugccuc

SEQ ID NO: 522008 - RNA, 18 nt, Chlamydophila pneumoniae J138
aauuagagaaauuuuuaa

SEQ ID NO: 522009 - RNA, 13 nt, Chlamydophila pneumoniae J138
aauuaauaaaaga

SEQ ID NO: 522010 - RNA, 21 nt, Chlamydophila pneumoniae J138
ugggaauuguucuugaaguuc

SEQ ID NO: 522011 - RNA, 19 nt, Chlamydophila pneumoniae J138
ugggauaaaaaguuuuugu

SEQ ID NO: 522012 - RNA, 13 nt, Chlamydophila pneumoniae J138
uggcguucaggau

SEQ ID NO: 522013 - RNA, 14 nt, Chlamydophila pneumoniae J138
uggcauagcgaaag

SEQ ID NO: 522014 - RNA, 22 nt, Chlamydophila pneumoniae J138
uguaacucuuaagaauaaaaua

SEQ ID NO: 522015 - RNA, 11 nt, Chlamydophila pneumoniae J138
uguaacucaag

SEQ ID NO: 522016 - RNA, 13 nt, Chlamydophila pneumoniae J138
uguauuaaagaau

SEQ ID NO: 522017 - RNA, 18 nt, Chlamydophila pneumoniae J138
uguccagagacaaagcca

SEQ ID NO: 522018 - RNA, 16 nt, Chlamydophila pneumoniae J138
uguccuccgagaaaau

SEQ ID NO: 522019 - RNA, 20 nt, Chlamydophila pneumoniae J138
ugguaacacgagugccuucu

SEQ ID NO: 522020 - RNA, 16 nt, Chlamydophila pneumoniae J138
ugguaagcauuucugu

SEQ ID NO: 522021 - RNA, 19 nt, Chlamydophila pneumoniae J138
ugcgcaaagaacucaacuu

SEQ ID NO: 522022 - RNA, 18 nt, Chlamydophila pneumoniae J138
ugcuaucuccagaaauuu

SEQ ID NO: 522023 - RNA, 17 nt, Chlamydophila pneumoniae J138
ugcgucacauuuguugu

SEQ ID NO: 522024 - RNA, 21 nt, Chlamydophila pneumoniae J138
ugcucuaaguugauacuugua

SEQ ID NO: 522025 - RNA, 17 nt, Chlamydophila pneumoniae J138
ugcucacuguuuuucgu

SEQ ID NO: 522026 - RNA, 22 nt, Chlamydophila pneumoniae J138
guggaucagaaaaaaugcguuu

SEQ ID NO: 522027 - RNA, 22 nt, Chlamydophila pneumoniae J138
guucauacaccccauagagcug

SEQ ID NO: 522028 - RNA, 17 nt, Chlamydophila pneumoniae J138
guuaucucccaagacga

SEQ ID NO: 522029 - RNA, 22 nt, Chlamydophila pneumoniae J138
aaguugaaaugagugagaaugc

SEQ ID NO: 522030 - RNA, 17 nt, Chlamydophila pneumoniae J138
guucuuucaauaacaga

SEQ ID NO: 522031 - RNA, 21 nt, Chlamydophila pneumoniae J138
guuguagugaaugagcuucac

SEQ ID NO: 522032 - RNA, 14 nt, Chlamydophila pneumoniae J138
guuuuaacucuaga

SEQ ID NO: 522033 - RNA, 18 nt, Chlamydophila pneumoniae J138
guuuuaacucuagaucuu

SEQ ID NO: 522034 - RNA, 13 nt, Chlamydophila pneumoniae J138
guuucuuccugaa

SEQ ID NO: 522035 - RNA, 15 nt, Chlamydophila pneumoniae J138
guuuugcucucuaga

SEQ ID NO: 522036 - RNA, 12 nt, Chlamydophila pneumoniae J138
guuuuucccuuu

SEQ ID NO: 522037 - RNA, 22 nt, Chlamydophila pneumoniae J138
guuuuccccuuggaaaucagaa

SEQ ID NO: 522038 - RNA, 14 nt, Chlamydophila pneumoniae J138
guuuuccugagcuu

SEQ ID NO: 522039 - RNA, 17 nt, Chlamydophila pneumoniae J138
guuuucguaagagaauu

SEQ ID NO: 522040 - RNA, 20 nt, Chlamydophila pneumoniae J138
uaaaaccagcauaaucagua

SEQ ID NO: 522041 - RNA, 15 nt, Chlamydophila pneumoniae J138
uaaaccgacauacuc

SEQ ID NO: 522042 - RNA, 20 nt, Chlamydophila pneumoniae J138
uaaacgagcuguccagucua

SEQ ID NO: 522043 - RNA, 23 nt, Chlamydophila pneumoniae J138
uaaccaaaagaauuaagaagaag

SEQ ID NO: 522044 - RNA, 18 nt, Chlamydophila pneumoniae J138
uaaccaaccuuguugaaa

SEQ ID NO: 522045 - RNA, 22 nt, Chlamydophila pneumoniae J138
uaacgauuucuugaagaucucc

SEQ ID NO: 522046 - RNA, 18 nt, Chlamydophila pneumoniae J138
uaauagcgacaugagaaa

SEQ ID NO: 522047 - RNA, 21 nt, Chlamydophila pneumoniae J138
uaauagucucuguaagaacgu

SEQ ID NO: 522048 - RNA, 22 nt, Chlamydophila pneumoniae J138
uacagaaagagcuaaagaaacu

SEQ ID NO: 522049 - RNA, 17 nt, Chlamydophila pneumoniae J138
uacagauaggguaagau

SEQ ID NO: 522050 - RNA, 23 nt, Chlamydophila pneumoniae J138
uacaggagcuagaagagcgucgu

SEQ ID NO: 522051 - RNA, 15 nt, Chlamydophila pneumoniae J138
uacaucuuaagagca

SEQ ID NO: 522052 - RNA, 17 nt, Chlamydophila pneumoniae J138
uacaaucgccuuacaau

SEQ ID NO: 522053 - RNA, 18 nt, Chlamydophila pneumoniae J138
uaauguugaguagagaag

SEQ ID NO: 522054 - RNA, 13 nt, Chlamydophila pneumoniae J138
uacgaauccaaaa

SEQ ID NO: 522055 - RNA, 17 nt, Chlamydophila pneumoniae J138
uacgaauccaaaaaaga

SEQ ID NO: 522056 - RNA, 13 nt, Chlamydophila pneumoniae J138
uagacaagacacc

SEQ ID NO: 522057 - RNA, 23 nt, Chlamydophila pneumoniae J138
uagacgauucuaggccuaaagaa

SEQ ID NO: 522058 - RNA, 17 nt, Chlamydophila pneumoniae J138
uagauuuguuagagcuu

SEQ ID NO: 522059 - RNA, 13 nt, Chlamydophila pneumoniae J138
uagauuuccuccg

SEQ ID NO: 522060 - RNA, 17 nt, Chlamydophila pneumoniae J138
uagcucuggagauugcu

SEQ ID NO: 522061 - RNA, 23 nt, Chlamydophila pneumoniae J138
uagcucauuaucaagaaauucuu

SEQ ID NO: 522062 - RNA, 14 nt, Chlamydophila pneumoniae J138
uagcucuggagauu

SEQ ID NO: 522063 - RNA, 17 nt, Chlamydophila pneumoniae J138
uagcgcuuccagcuucu

SEQ ID NO: 522064 - RNA, 22 nt, Chlamydophila pneumoniae J138
uagccuggaggcgguggcaugc

SEQ ID NO: 522065 - RNA, 13 nt, Chlamydophila pneumoniae J138
uagcgagaacacc

SEQ ID NO: 522066 - RNA, 18 nt, Chlamydophila pneumoniae J138
uaggaacuugaauaccaa

SEQ ID NO: 522067 - RNA, 15 nt, Chlamydophila pneumoniae J138
uaggaacaaagccaa

SEQ ID NO: 522068 - RNA, 14 nt, Chlamydophila pneumoniae J138
uaggauuuagacua

SEQ ID NO: 522069 - RNA, 17 nt, Chlamydophila pneumoniae J138
uaggcacuuaucucuuu

SEQ ID NO: 522070 - RNA, 15 nt, Chlamydophila pneumoniae J138
aauaaaccacgaauu

SEQ ID NO: 522071 - RNA, 14 nt, Chlamydophila pneumoniae J138
aauaaaagaacauu

SEQ ID NO: 522072 - RNA, 20 nt, Chlamydophila pneumoniae J138
uaucagggagcggaauuucu

SEQ ID NO: 522073 - RNA, 22 nt, Chlamydophila pneumoniae J138
uaucagcuggguaaguccacaa

SEQ ID NO: 522074 - RNA, 21 nt, Chlamydophila pneumoniae J138
uagggacuucucaaagacaau

SEQ ID NO: 522075 - RNA, 20 nt, Chlamydophila pneumoniae J138
uauaugcuacaaacucuucc

SEQ ID NO: 522076 - RNA, 15 nt, Chlamydophila pneumoniae J138
uauacgguaaugcca

SEQ ID NO: 522077 - RNA, 14 nt, Chlamydophila pneumoniae J138
uauuacagauuucu

SEQ ID NO: 522078 - RNA, 19 nt, Chlamydophila pneumoniae J138
uauuaaaccguaggauucu

SEQ ID NO: 522079 - RNA, 13 nt, Chlamydophila pneumoniae J138
uaucuuagggaau

SEQ ID NO: 522080 - RNA, 18 nt, Chlamydophila pneumoniae J138
uaucuucucuuaugaagu

SEQ ID NO: 522081 - RNA, 23 nt, Chlamydophila pneumoniae J138
uaucugagcauaacuugaagaag

SEQ ID NO: 522082 - RNA, 19 nt, Chlamydophila pneumoniae J138
uaucucuguuuuuugaaaa

SEQ ID NO: 522083 - RNA, 22 nt, Chlamydophila pneumoniae J138
uaucucuguuuuuugaaaacuu

SEQ ID NO: 522084 - RNA, 14 nt, Chlamydophila pneumoniae J138
uaucuaagacuucu

SEQ ID NO: 522085 - RNA, 17 nt, Chlamydophila pneumoniae J138
uaucuaaagaaauguaa

SEQ ID NO: 522086 - RNA, 16 nt, Chlamydophila pneumoniae J138
uaucgguuuaaacaga

SEQ ID NO: 522087 - RNA, 19 nt, Chlamydophila pneumoniae J138
uauuguguucccucuucuu

SEQ ID NO: 522088 - RNA, 13 nt, Chlamydophila pneumoniae J138
ucaaaauuuccuc

SEQ ID NO: 522089 - RNA, 14 nt, Chlamydophila pneumoniae J138
ucaaagauuccuaa

SEQ ID NO: 522090 - RNA, 14 nt, Chlamydophila pneumoniae J138
ucaagaaauucuuc

SEQ ID NO: 522091 - RNA, 21 nt, Chlamydophila pneumoniae J138
ucaagaacaguuugcucugga

SEQ ID NO: 522092 - RNA, 23 nt, Chlamydophila pneumoniae J138
ucaacucuccauccucagucucu

SEQ ID NO: 522093 - RNA, 15 nt, Chlamydophila pneumoniae J138
ucaaccauaaagaau

SEQ ID NO: 522094 - RNA, 20 nt, Chlamydophila pneumoniae J138
ucaagagcucguaauccuuc

SEQ ID NO: 522095 - RNA, 15 nt, Chlamydophila pneumoniae J138
ucaagacuauagaaa

SEQ ID NO: 522096 - RNA, 13 nt, Chlamydophila pneumoniae J138
ucaauacuucagg

SEQ ID NO: 522097 - RNA, 16 nt, Chlamydophila pneumoniae J138
ucaagucuauuugaaa

SEQ ID NO: 522098 - RNA, 15 nt, Chlamydophila pneumoniae J138
ucaaugagcaucuga

SEQ ID NO: 522099 - RNA, 17 nt, Chlamydophila pneumoniae J138
ucaggacaaugaagaac

SEQ ID NO: 522100 - RNA, 17 nt, Chlamydophila pneumoniae J138
ucagauggucagucucg

SEQ ID NO: 522101 - RNA, 23 nt, Chlamydophila pneumoniae J138
ucacaauuuuaaaaucuccucuc

SEQ ID NO: 522102 - RNA, 16 nt, Chlamydophila pneumoniae J138
ucagaaacaugaaguu

SEQ ID NO: 522103 - RNA, 13 nt, Chlamydophila pneumoniae J138
ucauaagauuucc

SEQ ID NO: 522104 - RNA, 15 nt, Chlamydophila pneumoniae J138
ucauaaccaaaagaa

SEQ ID NO: 522105 - RNA, 18 nt, Chlamydophila pneumoniae J138
uccaaaaacgauucgaaa

SEQ ID NO: 522106 - RNA, 12 nt, Chlamydophila pneumoniae J138
uccaaaaaagag

SEQ ID NO: 522107 - RNA, 12 nt, Chlamydophila pneumoniae J138
uccaagaucucc

SEQ ID NO: 522108 - RNA, 15 nt, Chlamydophila pneumoniae J138
uccaagaguucucuu

SEQ ID NO: 522109 - RNA, 21 nt, Chlamydophila pneumoniae J138
ucauuaagauccuuuaaagau

SEQ ID NO: 522110 - RNA, 14 nt, Chlamydophila pneumoniae J138
ucauuaagaagauu

SEQ ID NO: 522111 - RNA, 13 nt, Chlamydophila pneumoniae J138
uccagcagcaaau

SEQ ID NO: 522112 - RNA, 14 nt, Chlamydophila pneumoniae J138
uccagaauuuucug

SEQ ID NO: 522113 - RNA, 19 nt, Chlamydophila pneumoniae J138
uccacagagaccuucucuu

SEQ ID NO: 522114 - RNA, 19 nt, Chlamydophila pneumoniae J138
uccacaaucucuuuaaaaa

SEQ ID NO: 522115 - RNA, 22 nt, Chlamydophila pneumoniae J138
uccagcuccauaagcuuuucuu

SEQ ID NO: 522116 - RNA, 20 nt, Chlamydophila pneumoniae J138
uccagguuguccuauagaga

SEQ ID NO: 522117 - RNA, 16 nt, Chlamydophila pneumoniae J138
uccauuggcauagagc

SEQ ID NO: 522118 - RNA, 17 nt, Chlamydophila pneumoniae J138
uccauucugagaaagaa

SEQ ID NO: 522119 - RNA, 15 nt, Chlamydophila pneumoniae J138
uccaugucuaaagau

SEQ ID NO: 522120 - RNA, 19 nt, Chlamydophila pneumoniae J138
ucguaaugcccgauauccu

SEQ ID NO: 522121 - RNA, 16 nt, Chlamydophila pneumoniae J138
ucguuuccgaucauuu

SEQ ID NO: 522122 - RNA, 17 nt, Chlamydophila pneumoniae J138
ucuccugacucuuuuaa

SEQ ID NO: 522123 - RNA, 14 nt, Chlamydophila pneumoniae J138
ucuauuagauuucc

SEQ ID NO: 522124 - RNA, 19 nt, Chlamydophila pneumoniae J138
ucuauggacuaaacaagaa

SEQ ID NO: 522125 - RNA, 18 nt, Chlamydophila pneumoniae J138
ucuaugagaguaaguuuu

SEQ ID NO: 522126 - RNA, 17 nt, Chlamydophila pneumoniae J138
ucuaucugcacuuucuu

SEQ ID NO: 522127 - RNA, 19 nt, Chlamydophila pneumoniae J138
ucuagucgugccaaugugc

SEQ ID NO: 522128 - RNA, 20 nt, Chlamydophila pneumoniae J138
ucuaccgaacagagcgucua

SEQ ID NO: 522129 - RNA, 17 nt, Chlamydophila pneumoniae J138
ucuacauagauccccuu

SEQ ID NO: 522130 - RNA, 19 nt, Chlamydophila pneumoniae J138
ucuacaccauagaacugcu

SEQ ID NO: 522131 - RNA, 16 nt, Chlamydophila pneumoniae J138
ucuagagauuuuucua

SEQ ID NO: 522132 - RNA, 17 nt, Chlamydophila pneumoniae J138
ucuacuuuugugaagau

SEQ ID NO: 522133 - RNA, 18 nt, Chlamydophila pneumoniae J138
ucuaaggacaaaucuccc

SEQ ID NO: 522134 - RNA, 23 nt, Chlamydophila pneumoniae J138
ucuaacucuuguagcugagagau

SEQ ID NO: 522135 - RNA, 16 nt, Chlamydophila pneumoniae J138
ucuaaagauuucguau

SEQ ID NO: 522136 - RNA, 18 nt, Chlamydophila pneumoniae J138
ucuaaaagcacuuaaaaa

SEQ ID NO: 522137 - RNA, 21 nt, Chlamydophila pneumoniae J138
ucuaaaauaaccccuccaaaa

SEQ ID NO: 522138 - RNA, 16 nt, Chlamydophila pneumoniae J138
ucuaaaacaucagcaa

SEQ ID NO: 522139 - RNA, 20 nt, Chlamydophila pneumoniae J138
ucuaaaaccugacggaucuu

SEQ ID NO: 522140 - RNA, 17 nt, Chlamydophila pneumoniae J138
ucucgaaauccuaaaaa

SEQ ID NO: 522141 - RNA, 13 nt, Chlamydophila pneumoniae J138
ucuccuggaacag

SEQ ID NO: 522142 - RNA, 14 nt, Chlamydophila pneumoniae J138
ucugggaagacucu

SEQ ID NO: 522143 - RNA, 13 nt, Chlamydophila pneumoniae J138
ucugguagagaac

SEQ ID NO: 522144 - RNA, 19 nt, Chlamydophila pneumoniae J138
aauacguaccguauccucu

SEQ ID NO: 522145 - RNA, 20 nt, Chlamydophila pneumoniae J138
aauacuuaggaauuuuucua

SEQ ID NO: 522146 - RNA, 13 nt, Chlamydophila pneumoniae J138
ugaaaauauccua

SEQ ID NO: 522147 - RNA, 15 nt, Chlamydophila pneumoniae J138
ugaaaauugcauuua

SEQ ID NO: 522148 - RNA, 19 nt, Chlamydophila pneumoniae J138
ucuuugcgaacgaagacuu

SEQ ID NO: 522149 - RNA, 12 nt, Chlamydophila pneumoniae J138
ucuuccauacag

SEQ ID NO: 522150 - RNA, 17 nt, Chlamydophila pneumoniae J138
ucuuccuucuucuucaa

SEQ ID NO: 522151 - RNA, 15 nt, Chlamydophila pneumoniae J138
ucuugauucucuucc

SEQ ID NO: 522152 - RNA, 21 nt, Chlamydophila pneumoniae J138
ucuuguaagacuaaaaaagag

SEQ ID NO: 522153 - RNA, 13 nt, Chlamydophila pneumoniae J138
ucuugaagagauu

SEQ ID NO: 522154 - RNA, 20 nt, Chlamydophila pneumoniae J138
ucuucugaauagcucuuuuc

SEQ ID NO: 522155 - RNA, 17 nt, Chlamydophila pneumoniae J138
ugaagggacagucuccu

SEQ ID NO: 522156 - RNA, 23 nt, Chlamydophila pneumoniae J138
ugaaucacagcgcugugaggaaa

SEQ ID NO: 522157 - RNA, 17 nt, Chlamydophila pneumoniae J138
ugaagaacaaaaaauca

SEQ ID NO: 522158 - RNA, 15 nt, Chlamydophila pneumoniae J138
ugaagccauuuucua

SEQ ID NO: 522159 - RNA, 18 nt, Chlamydophila pneumoniae J138
ugacacagcuaaucaauc

SEQ ID NO: 522160 - RNA, 13 nt, Chlamydophila pneumoniae J138
ugaaucucuucug

SEQ ID NO: 522161 - RNA, 17 nt, Chlamydophila pneumoniae J138
ugacucuuauugcagaa

SEQ ID NO: 522162 - RNA, 11 nt, Chlamydophila pneumoniae J138
ugacugaaacu

SEQ ID NO: 522163 - RNA, 14 nt, Chlamydophila pneumoniae J138
ugacguagacgauu

SEQ ID NO: 522164 - RNA, 20 nt, Chlamydophila pneumoniae J138
ugacuuuuguugcaauucca

SEQ ID NO: 522165 - RNA, 10 nt, Chlamydophila pneumoniae J138
ugagaagaua

SEQ ID NO: 522166 - RNA, 18 nt, Chlamydophila pneumoniae J138
ugagagauagguuuuugu

SEQ ID NO: 522167 - RNA, 16 nt, Chlamydophila pneumoniae J138
ugauguugcccuacaa

SEQ ID NO: 522168 - RNA, 15 nt, Chlamydophila pneumoniae J138
ugaugccaagaaaua

SEQ ID NO: 522169 - RNA, 13 nt, Chlamydophila pneumoniae J138
ugcaaaaaaccag

SEQ ID NO: 522170 - RNA, 16 nt, Chlamydophila pneumoniae J138
ugcaacaaucuuucuu

SEQ ID NO: 522171 - RNA, 13 nt, Chlamydophila pneumoniae J138
ugcaaggcaagau

SEQ ID NO: 522172 - RNA, 18 nt, Chlamydophila pneumoniae J138
ucggaguuuuuuucuuau

SEQ ID NO: 522173 - RNA, 16 nt, Chlamydophila pneumoniae J138
uccucacauguuucac

SEQ ID NO: 522174 - RNA, 15 nt, Chlamydophila pneumoniae J138
uccucacuagagauu

SEQ ID NO: 522175 - RNA, 16 nt, Chlamydophila pneumoniae J138
uccuauaguaauuucu

SEQ ID NO: 522176 - RNA, 11 nt, Chlamydophila pneumoniae J138
uccuagagaau

SEQ ID NO: 522177 - RNA, 18 nt, Chlamydophila pneumoniae J138
uccuccuagguucuuuuu

SEQ ID NO: 522178 - RNA, 21 nt, Chlamydophila pneumoniae J138
uccgcuuuuacgaaugagauc

SEQ ID NO: 522179 - RNA, 16 nt, Chlamydophila pneumoniae J138
uccauuuuuccuccuc

SEQ ID NO: 522180 - RNA, 15 nt, Chlamydophila pneumoniae J138
ucccaauauccagaa

SEQ ID NO: 522181 - RNA, 17 nt, Chlamydophila pneumoniae J138
uccgacggagagagauu

SEQ ID NO: 522182 - RNA, 15 nt, Chlamydophila pneumoniae J138
ucgauaucucuaccg

SEQ ID NO: 522183 - RNA, 15 nt, Chlamydophila pneumoniae J138
ucgauuauuucuugu

SEQ ID NO: 522184 - RNA, 20 nt, Chlamydophila pneumoniae J138
ucgacaacaacauaaagaag

SEQ ID NO: 522185 - RNA, 18 nt, Chlamydophila pneumoniae J138
ucgaagaaaauaaagauc

SEQ ID NO: 522186 - RNA, 13 nt, Chlamydophila pneumoniae J138
ucgaaucuaaaaa

SEQ ID NO: 522187 - RNA, 23 nt, Chlamydophila pneumoniae J138
uccucgcucagcuaauuuaaaug

SEQ ID NO: 522188 - RNA, 15 nt, Chlamydophila pneumoniae J138
uccuucucagaaaga

SEQ ID NO: 522189 - RNA, 18 nt, Chlamydophila pneumoniae J138
uccuucuggagugacacc

SEQ ID NO: 522190 - RNA, 20 nt, Chlamydophila pneumoniae J138
uccuucaaaauguuuaucga

SEQ ID NO: 522191 - RNA, 16 nt, Chlamydophila pneumoniae J138
agccaugacaaagggu

SEQ ID NO: 522192 - RNA, 16 nt, Chlamydophila pneumoniae J138
agauugaaucccauca

SEQ ID NO: 522193 - RNA, 13 nt, Chlamydophila pneumoniae J138
agauuuagggaag

SEQ ID NO: 522194 - RNA, 19 nt, Chlamydophila pneumoniae J138
agauucaccaagaacaaua

SEQ ID NO: 522195 - RNA, 23 nt, Chlamydophila pneumoniae J138
agcauuuucucugagcagcuucg

SEQ ID NO: 522196 - RNA, 20 nt, Chlamydophila pneumoniae J138
agcauaguguuccaaaacag

SEQ ID NO: 522197 - RNA, 18 nt, Chlamydophila pneumoniae J138
agcauaggcuaagacuag

SEQ ID NO: 522198 - RNA, 19 nt, Chlamydophila pneumoniae J138
agccuccauuuagacaaga

SEQ ID NO: 522199 - RNA, 22 nt, Chlamydophila pneumoniae J138
agccuuucuuauuacagaaagg

SEQ ID NO: 522200 - RNA, 19 nt, Chlamydophila pneumoniae J138
agcgaucucucuuccugcu

SEQ ID NO: 522201 - RNA, 21 nt, Chlamydophila pneumoniae J138
agcuguagugauacuuuagaa

SEQ ID NO: 522202 - RNA, 17 nt, Chlamydophila pneumoniae J138
agcuguuuacuuuucuc

SEQ ID NO: 522203 - RNA, 14 nt, Chlamydophila pneumoniae J138
agcuugcguuuccu

SEQ ID NO: 522204 - RNA, 22 nt, Chlamydophila pneumoniae J138
agcuucuuuuccagcaaagcga

SEQ ID NO: 522205 - RNA, 18 nt, Chlamydophila pneumoniae J138
aggaugcuugugagauga

SEQ ID NO: 522206 - RNA, 14 nt, Chlamydophila pneumoniae J138
aggagaagucgaaa

SEQ ID NO: 522207 - RNA, 13 nt, Chlamydophila pneumoniae J138
aggagcuaaagcu

SEQ ID NO: 522208 - RNA, 23 nt, Chlamydophila pneumoniae J138
aggcaagauuaugaugccucauu

SEQ ID NO: 522209 - RNA, 17 nt, Chlamydophila pneumoniae J138
aggauuuuccauuaggg

SEQ ID NO: 522210 - RNA, 23 nt, Chlamydophila pneumoniae J138
agggaauuucggacgauauuuag

SEQ ID NO: 522211 - RNA, 17 nt, Chlamydophila pneumoniae J138
agggagaucuacgccuu

SEQ ID NO: 522212 - RNA, 13 nt, Chlamydophila pneumoniae J138
agggaugguuucc

SEQ ID NO: 522213 - RNA, 17 nt, Chlamydophila pneumoniae J138
agggcgcuucccuauaa

SEQ ID NO: 522214 - RNA, 12 nt, Chlamydophila pneumoniae J138
agggcaucuuuu

SEQ ID NO: 522215 - RNA, 21 nt, Chlamydophila pneumoniae J138
aguacagauuucagauaaucu

SEQ ID NO: 522216 - RNA, 18 nt, Chlamydophila pneumoniae J138
agguuauuaucaaaguga

SEQ ID NO: 522217 - RNA, 22 nt, Chlamydophila pneumoniae J138
agguuccacagagaccuucucu

SEQ ID NO: 522218 - RNA, 17 nt, Chlamydophila pneumoniae J138
agguagagugucuuccu

SEQ ID NO: 522219 - RNA, 14 nt, Chlamydophila pneumoniae J138
agugauuccuguca

SEQ ID NO: 522220 - RNA, 20 nt, Chlamydophila pneumoniae J138
aguccucucccuuaaggaaa

SEQ ID NO: 522221 - RNA, 18 nt, Chlamydophila pneumoniae J138
aguccuguuugaaaauau

SEQ ID NO: 522222 - RNA, 22 nt, Chlamydophila pneumoniae J138
auaaauacgugcuugaauauuu

SEQ ID NO: 522223 - RNA, 21 nt, Chlamydophila pneumoniae J138
auaaagggaauuuucucauag

SEQ ID NO: 522224 - RNA, 20 nt, Chlamydophila pneumoniae J138
auaaaaucguuuuauuuuag

SEQ ID NO: 522225 - RNA, 19 nt, Chlamydophila pneumoniae J138
aguuguauccagcucaagg

SEQ ID NO: 522226 - RNA, 22 nt, Chlamydophila pneumoniae J138
auaaugguacaauacuggagag

SEQ ID NO: 522227 - RNA, 18 nt, Chlamydophila pneumoniae J138
auaaucucuuucauaaau

SEQ ID NO: 522228 - RNA, 23 nt, Chlamydophila pneumoniae J138
auaauuaaaucguauugacuuug

SEQ ID NO: 522229 - RNA, 16 nt, Chlamydophila pneumoniae J138
auacacucagcguucg

SEQ ID NO: 522230 - RNA, 13 nt, Chlamydophila pneumoniae J138
auaguauuuuuaa

SEQ ID NO: 522231 - RNA, 19 nt, Chlamydophila pneumoniae J138
auaucagcuucuugaugua

SEQ ID NO: 522232 - RNA, 15 nt, Chlamydophila pneumoniae J138
auaucagcagcuucu

SEQ ID NO: 522233 - RNA, 13 nt, Chlamydophila pneumoniae J138
auaccaucaaggu

SEQ ID NO: 522234 - RNA, 15 nt, Chlamydophila pneumoniae J138
aucaacauucuucug

SEQ ID NO: 522235 - RNA, 20 nt, Chlamydophila pneumoniae J138
aucaaacauuaccguucccu

SEQ ID NO: 522236 - RNA, 20 nt, Chlamydophila pneumoniae J138
auauucaagaggaccgagau

SEQ ID NO: 522237 - RNA, 20 nt, Chlamydophila pneumoniae J138
auauugcaaagcaucuugua

SEQ ID NO: 522238 - RNA, 22 nt, Chlamydophila pneumoniae J138
aucaauaaucggccgaguuucu

SEQ ID NO: 522239 - RNA, 17 nt, Chlamydophila pneumoniae J138
aucacuuauauuuucua

SEQ ID NO: 522240 - RNA, 15 nt, Chlamydophila pneumoniae J138
aucagaaugcaucuu

SEQ ID NO: 522241 - RNA, 15 nt, Chlamydophila pneumoniae J138
aucaguucaucuaga

SEQ ID NO: 522242 - RNA, 15 nt, Chlamydophila pneumoniae J138
aucauaggcuauaau

SEQ ID NO: 522243 - RNA, 15 nt, Chlamydophila pneumoniae J138
aucaugauaaaaauu

SEQ ID NO: 522244 - RNA, 14 nt, Chlamydophila pneumoniae J138
aucauuaagaagau

SEQ ID NO: 522245 - RNA, 16 nt, Chlamydophila pneumoniae J138
auccaacaaagaugac

SEQ ID NO: 522246 - RNA, 21 nt, Chlamydophila pneumoniae J138
aucccaucaaaggcaauagca

SEQ ID NO: 522247 - RNA, 17 nt, Chlamydophila pneumoniae J138
aucccuggauuucuucu

SEQ ID NO: 522248 - RNA, 17 nt, Chlamydophila pneumoniae J138
aucccugcacucuuuca

SEQ ID NO: 522249 - RNA, 19 nt, Chlamydophila pneumoniae J138
auccccuucauucuuucga

SEQ ID NO: 522250 - RNA, 19 nt, Chlamydophila pneumoniae J138
auccggaaggaguucuuuu

SEQ ID NO: 522251 - RNA, 12 nt, Chlamydophila pneumoniae J138
auccgaagacuc

SEQ ID NO: 522252 - RNA, 17 nt, Chlamydophila pneumoniae J138
auccugagaccauacac

SEQ ID NO: 522253 - RNA, 20 nt, Chlamydophila pneumoniae J138
auccugaguguaucuaggga

SEQ ID NO: 522254 - RNA, 23 nt, Chlamydophila pneumoniae J138
aucgugcuuagagccuucucauu

SEQ ID NO: 522255 - RNA, 12 nt, Chlamydophila pneumoniae J138
aucucucuuuaa

SEQ ID NO: 522256 - RNA, 13 nt, Chlamydophila pneumoniae J138
aucugaucucgua

SEQ ID NO: 522257 - RNA, 22 nt, Chlamydophila pneumoniae J138
aucguaccugcugcuucagaaa

SEQ ID NO: 522258 - RNA, 15 nt, Chlamydophila pneumoniae J138
augaaauuuucuaag

SEQ ID NO: 522259 - RNA, 18 nt, Chlamydophila pneumoniae J138
augacagggaaagaacag

SEQ ID NO: 522260 - RNA, 14 nt, Chlamydophila pneumoniae J138
augcaaauuccaga

SEQ ID NO: 522261 - RNA, 22 nt, Chlamydophila pneumoniae J138
augcacgcuuucgucuaaaaua

SEQ ID NO: 522262 - RNA, 15 nt, Chlamydophila pneumoniae J138
augcuacaaacucuu

SEQ ID NO: 522263 - RNA, 14 nt, Chlamydophila pneumoniae J138
auggagagcuuucg

SEQ ID NO: 522264 - RNA, 23 nt, Chlamydophila pneumoniae J138
auuacggcgugccuuuuuuucua

SEQ ID NO: 522265 - RNA, 22 nt, Chlamydophila pneumoniae J138
auuccaagauugaauucaucca

SEQ ID NO: 522266 - RNA, 19 nt, Chlamydophila pneumoniae J138
auuccagcaucuucucgaa

SEQ ID NO: 522267 - RNA, 18 nt, Chlamydophila pneumoniae J138
auuccagcugagcuaucu

SEQ ID NO: 522268 - RNA, 22 nt, Chlamydophila pneumoniae J138
auuccagcugagcuaucuucaa

SEQ ID NO: 522269 - RNA, 12 nt, Chlamydophila pneumoniae J138
auuccauccugu

SEQ ID NO: 522270 - RNA, 16 nt, Chlamydophila pneumoniae J138
auucccugacacagag

SEQ ID NO: 522271 - RNA, 22 nt, Chlamydophila pneumoniae J138
auucuaacgcuuuuucaaacug

SEQ ID NO: 522272 - RNA, 14 nt, Chlamydophila pneumoniae J138
auucguuauccucg

SEQ ID NO: 522273 - RNA, 15 nt, Chlamydophila pneumoniae J138
auuggcauagagccu

SEQ ID NO: 522274 - RNA, 13 nt, Chlamydophila pneumoniae J138
auuuccuuagaag

SEQ ID NO: 522275 - RNA, 13 nt, Chlamydophila pneumoniae J138
auuuccuucucca

SEQ ID NO: 522276 - RNA, 21 nt, Chlamydophila pneumoniae J138
auuucggaguuggaucaagga

SEQ ID NO: 522277 - RNA, 22 nt, Chlamydophila pneumoniae J138
auuucuccaguaucuucucuua

SEQ ID NO: 522278 - RNA, 15 nt, Chlamydophila pneumoniae J138
auuucuaguuguccu

SEQ ID NO: 522279 - RNA, 21 nt, Chlamydophila pneumoniae J138
auuucuaaaaaauagauaagu

SEQ ID NO: 522280 - RNA, 14 nt, Chlamydophila pneumoniae J138
auuuuacgaaucuu

SEQ ID NO: 522281 - RNA, 18 nt, Chlamydophila pneumoniae J138
auuuucccaauauccucu

SEQ ID NO: 522282 - RNA, 15 nt, Chlamydophila pneumoniae J138
auuuucaagcuuucg

SEQ ID NO: 522283 - RNA, 16 nt, Chlamydophila pneumoniae J138
auuugauuuuucaaau

SEQ ID NO: 522284 - RNA, 22 nt, Chlamydophila pneumoniae J138
auuucuuucacaucuuuagaau

SEQ ID NO: 522285 - RNA, 15 nt, Chlamydophila pneumoniae J138
auuucucuaucauca

SEQ ID NO: 522286 - RNA, 22 nt, Chlamydophila pneumoniae J138
caaaaauaaacauauucuccuu

SEQ ID NO: 522287 - RNA, 17 nt, Chlamydophila pneumoniae J138
caaaagaucauaugcac

SEQ ID NO: 522288 - RNA, 17 nt, Chlamydophila pneumoniae J138
auuuugacuugucccaa

SEQ ID NO: 522289 - RNA, 22 nt, Chlamydophila pneumoniae J138
auuuuugcuuuaaaauccagga

SEQ ID NO: 522290 - RNA, 17 nt, Chlamydophila pneumoniae J138
auuuuucaagaacuccu

SEQ ID NO: 522291 - RNA, 16 nt, Chlamydophila pneumoniae J138
caaaauaaucucgcag

SEQ ID NO: 522292 - RNA, 14 nt, Chlamydophila pneumoniae J138
caaagauaaagaag

SEQ ID NO: 522293 - RNA, 22 nt, Chlamydophila pneumoniae J138
caaagaugacgagcccuagaua

SEQ ID NO: 522294 - RNA, 19 nt, Chlamydophila pneumoniae J138
caaagaacugcauaaucuc

SEQ ID NO: 522295 - RNA, 16 nt, Chlamydophila pneumoniae J138
caaauuccagaaaaag

SEQ ID NO: 522296 - RNA, 13 nt, Chlamydophila pneumoniae J138
caauaaaaaagag

SEQ ID NO: 522297 - RNA, 19 nt, Chlamydophila pneumoniae J138
caaguucuaccuauauuuc

SEQ ID NO: 522298 - RNA, 21 nt, Chlamydophila pneumoniae J138
caaguguucgaguucuuuagc

SEQ ID NO: 522299 - RNA, 21 nt, Chlamydophila pneumoniae J138
caauaaucacuguuugauuau

SEQ ID NO: 522300 - RNA, 23 nt, Chlamydophila pneumoniae J138
caagaauauggguguaaauuuuu

SEQ ID NO: 522301 - RNA, 15 nt, Chlamydophila pneumoniae J138
caauaccagauaaag

SEQ ID NO: 522302 - RNA, 14 nt, Chlamydophila pneumoniae J138
caaugaagaaaaau

SEQ ID NO: 522303 - RNA, 18 nt, Chlamydophila pneumoniae J138
cacaauuccuaaaacaag

SEQ ID NO: 522304 - RNA, 17 nt, Chlamydophila pneumoniae J138
caauuggaggauaaaug

SEQ ID NO: 522305 - RNA, 22 nt, Chlamydophila pneumoniae J138
caauuguaucuguauccuuccu

SEQ ID NO: 522306 - RNA, 18 nt, Chlamydophila pneumoniae J138
caauguuaaucuaauuuu

SEQ ID NO: 522307 - RNA, 15 nt, Chlamydophila pneumoniae J138
cacagagaacaauaa

SEQ ID NO: 522308 - RNA, 23 nt, Chlamydophila pneumoniae J138
caccuuaauggcuccuacuccua

SEQ ID NO: 522309 - RNA, 18 nt, Chlamydophila pneumoniae J138
cacgaccucgaauuccuc

SEQ ID NO: 522310 - RNA, 21 nt, Chlamydophila pneumoniae J138
cacuauguguuuccuuuucuc

SEQ ID NO: 522311 - RNA, 17 nt, Chlamydophila pneumoniae J138
cacuuugacuauuggga

SEQ ID NO: 522312 - RNA, 18 nt, Chlamydophila pneumoniae J138
aaagaguuuguucacauu

SEQ ID NO: 522313 - RNA, 21 nt, Chlamydophila pneumoniae J138
aaagagcgucuaucgacucuu

SEQ ID NO: 522314 - RNA, 22 nt, Chlamydophila pneumoniae J138
aaagacaucuccugcagguuug

SEQ ID NO: 522315 - RNA, 15 nt, Chlamydophila pneumoniae J138
aaagacuugcuuccg

SEQ ID NO: 522316 - RNA, 22 nt, Chlamydophila pneumoniae J138
cagaucauaucggcagcagcau

SEQ ID NO: 522317 - RNA, 19 nt, Chlamydophila pneumoniae J138
caggauuacggaaaauaca

SEQ ID NO: 522318 - RNA, 18 nt, Chlamydophila pneumoniae J138
caucaggcggaugaccuu

SEQ ID NO: 522319 - RNA, 15 nt, Chlamydophila pneumoniae J138
caucacaaucgugau

SEQ ID NO: 522320 - RNA, 21 nt, Chlamydophila pneumoniae J138
caucaaucacucuaugaucua

SEQ ID NO: 522321 - RNA, 16 nt, Chlamydophila pneumoniae J138
cauauucucaggaacc

SEQ ID NO: 522322 - RNA, 17 nt, Chlamydophila pneumoniae J138
cauaaccuccucuucuu

SEQ ID NO: 522323 - RNA, 18 nt, Chlamydophila pneumoniae J138
cauaacauuuagauaaag

SEQ ID NO: 522324 - RNA, 15 nt, Chlamydophila pneumoniae J138
cagugugcugauuuu

SEQ ID NO: 522325 - RNA, 17 nt, Chlamydophila pneumoniae J138
caguuaaagagcauccu

SEQ ID NO: 522326 - RNA, 19 nt, Chlamydophila pneumoniae J138
caucuucuuggcuuucccc

SEQ ID NO: 522327 - RNA, 15 nt, Chlamydophila pneumoniae J138
caucuguauauucuc

SEQ ID NO: 522328 - RNA, 23 nt, Chlamydophila pneumoniae J138
caucucuggaauacauuccuagc

SEQ ID NO: 522329 - RNA, 16 nt, Chlamydophila pneumoniae J138
aaagccuaugauaaag

SEQ ID NO: 522330 - RNA, 22 nt, Chlamydophila pneumoniae J138
ccaaauagagugaccauagcau

SEQ ID NO: 522331 - RNA, 20 nt, Chlamydophila pneumoniae J138
aaagcuacggaugggcacuc

SEQ ID NO: 522332 - RNA, 16 nt, Chlamydophila pneumoniae J138
aaagcucuuucauaag

SEQ ID NO: 522333 - RNA, 15 nt, Chlamydophila pneumoniae J138
aaagcucuccuucag

SEQ ID NO: 522334 - RNA, 15 nt, Chlamydophila pneumoniae J138
aaaggaucauuaaag

SEQ ID NO: 522335 - RNA, 13 nt, Chlamydophila pneumoniae J138
aaaggaugcuuag

SEQ ID NO: 522336 - RNA, 21 nt, Chlamydophila pneumoniae J138
aaagcuuuuuucucuugcuuc

SEQ ID NO: 522337 - RNA, 22 nt, Chlamydophila pneumoniae J138
aaaggaacuucguuucgcuuug

SEQ ID NO: 522338 - RNA, 22 nt, Chlamydophila pneumoniae J138
aaaguuaaugcaagcaacucuu

SEQ ID NO: 522339 - RNA, 14 nt, Chlamydophila pneumoniae J138
aaaguaacuaucua

SEQ ID NO: 522340 - RNA, 15 nt, Chlamydophila pneumoniae J138
aaaggcccaacucuu

SEQ ID NO: 522341 - RNA, 20 nt, Chlamydophila pneumoniae J138
aaaucccgagauaugaagag

SEQ ID NO: 522342 - RNA, 19 nt, Chlamydophila pneumoniae J138
aaaucaucgcaaucaaaga

SEQ ID NO: 522343 - RNA, 22 nt, Chlamydophila pneumoniae J138
ccccaaacauggacaauauaga

SEQ ID NO: 522344 - RNA, 12 nt, Chlamydophila pneumoniae J138
cccaaagcagau

SEQ ID NO: 522345 - RNA, 14 nt, Chlamydophila pneumoniae J138
ccauucuugaagau

SEQ ID NO: 522346 - RNA, 11 nt, Chlamydophila pneumoniae J138
cccauuccugc

SEQ ID NO: 522347 - RNA, 22 nt, Chlamydophila pneumoniae J138
aaaucuggggcuuccagaaaca

SEQ ID NO: 522348 - RNA, 19 nt, Chlamydophila pneumoniae J138
aaaucucgagaagacccua

SEQ ID NO: 522349 - RNA, 18 nt, Chlamydophila pneumoniae J138
aaaucucgagcuaccuag

SEQ ID NO: 522350 - RNA, 14 nt, Chlamydophila pneumoniae J138
cccuggauuucuuc

SEQ ID NO: 522351 - RNA, 15 nt, Chlamydophila pneumoniae J138
ccgaaucucuccagc

SEQ ID NO: 522352 - RNA, 19 nt, Chlamydophila pneumoniae J138
ccggagcuucuaagaucuu

SEQ ID NO: 522353 - RNA, 20 nt, Chlamydophila pneumoniae J138
aaauuuccgcuguauuuuca

SEQ ID NO: 522354 - RNA, 19 nt, Chlamydophila pneumoniae J138
aaauuguuuguaucaaaga

SEQ ID NO: 522355 - RNA, 22 nt, Chlamydophila pneumoniae J138
ccucgcaauccaggaauagaaa

SEQ ID NO: 522356 - RNA, 12 nt, Chlamydophila pneumoniae J138
ccuccauuucua

SEQ ID NO: 522357 - RNA, 12 nt, Chlamydophila pneumoniae J138
ccuccaaaauca

SEQ ID NO: 522358 - RNA, 20 nt, Chlamydophila pneumoniae J138
ccugacucuuuuaagacaau

SEQ ID NO: 522359 - RNA, 15 nt, Chlamydophila pneumoniae J138
ccugaguauccgaau

SEQ ID NO: 522360 - RNA, 22 nt, Chlamydophila pneumoniae J138
cgacaagauggugagauuucua

SEQ ID NO: 522361 - RNA, 13 nt, Chlamydophila pneumoniae J138
ccuguauauucug

SEQ ID NO: 522362 - RNA, 17 nt, Chlamydophila pneumoniae J138
ccugucacuaucuucua

SEQ ID NO: 522363 - RNA, 17 nt, Chlamydophila pneumoniae J138
aacacccggcuuuucca

SEQ ID NO: 522364 - RNA, 13 nt, Chlamydophila pneumoniae J138
cgaguuucgauau

SEQ ID NO: 522365 - RNA, 18 nt, Chlamydophila pneumoniae J138
cgaguucuuuuugcagau

SEQ ID NO: 522366 - RNA, 20 nt, Chlamydophila pneumoniae J138
cgcuuucgggaauaauagga

SEQ ID NO: 522367 - RNA, 22 nt, Chlamydophila pneumoniae J138
aacaguucuuucugcuugucua

SEQ ID NO: 522368 - RNA, 23 nt, Chlamydophila pneumoniae J138
aaccacuguccaugcacgagauu

SEQ ID NO: 522369 - RNA, 20 nt, Chlamydophila pneumoniae J138
aaccacggauuuucucuaca

SEQ ID NO: 522370 - RNA, 17 nt, Chlamydophila pneumoniae J138
aaccagcauaaucagua

SEQ ID NO: 522371 - RNA, 20 nt, Chlamydophila pneumoniae J138
aaccauagagagccuuuccu

SEQ ID NO: 522372 - RNA, 21 nt, Chlamydophila pneumoniae J138
aaccauagagagccuuuccua

SEQ ID NO: 522373 - RNA, 14 nt, Chlamydophila pneumoniae J138
ggaacaaagcucuc

SEQ ID NO: 522374 - RNA, 21 nt, Chlamydophila pneumoniae J138
ggaaaucuaaacaguaggcga

SEQ ID NO: 522375 - RNA, 23 nt, Chlamydophila pneumoniae J138
ggauucuaaaagagcaagauggc

SEQ ID NO: 522376 - RNA, 19 nt, Chlamydophila pneumoniae J138
ggauugcuucgggaucuaa

SEQ ID NO: 522377 - RNA, 23 nt, Chlamydophila pneumoniae J138
ggcuccucguuaauaagaaccuc

SEQ ID NO: 522378 - RNA, 17 nt, Chlamydophila pneumoniae J138
gggaaaguaccuuuaac

SEQ ID NO: 522379 - RNA, 11 nt, Chlamydophila pneumoniae J138
gggaaaucuaa

SEQ ID NO: 522380 - RNA, 15 nt, Chlamydophila pneumoniae J138
gggaauuaaacuuuc

SEQ ID NO: 522381 - RNA, 17 nt, Chlamydophila pneumoniae J138
gguacgcuuuuucuuga

SEQ ID NO: 522382 - RNA, 23 nt, Chlamydophila pneumoniae J138
ggguuugucuccaaauguucucu

SEQ ID NO: 522383 - RNA, 19 nt, Chlamydophila pneumoniae J138
ggucuuuguucgcuccuaa

SEQ ID NO: 522384 - RNA, 16 nt, Chlamydophila pneumoniae J138
ggugauauuuucuugu

SEQ ID NO: 522385 - RNA, 13 nt, Chlamydophila pneumoniae J138
guacguuuucucu

SEQ ID NO: 522386 - RNA, 15 nt, Chlamydophila pneumoniae J138
guacgcaaaguacua

SEQ ID NO: 522387 - RNA, 16 nt, Chlamydophila pneumoniae J138
guaaagagcuucuucu

SEQ ID NO: 522388 - RNA, 19 nt, Chlamydophila pneumoniae J138
guaaccagagagcuuuuag

SEQ ID NO: 522389 - RNA, 14 nt, Chlamydophila pneumoniae J138
guaacuaaauucuu

SEQ ID NO: 522390 - RNA, 14 nt, Chlamydophila pneumoniae J138
guagagagaaucga

SEQ ID NO: 522391 - RNA, 12 nt, Chlamydophila pneumoniae J138
guagagguacuu

SEQ ID NO: 522392 - RNA, 13 nt, Chlamydophila pneumoniae J138
aagucuccauaau

SEQ ID NO: 522393 - RNA, 19 nt, Chlamydophila pneumoniae J138
ggugcuguuguaauaaaag

SEQ ID NO: 522394 - RNA, 19 nt, Chlamydophila pneumoniae J138
gguguauaguauuuuuaaa

SEQ ID NO: 522395 - RNA, 17 nt, Chlamydophila pneumoniae J138
gguucggucucuucucu

SEQ ID NO: 522396 - RNA, 17 nt, Chlamydophila pneumoniae J138
guccaagguucugggaa

SEQ ID NO: 522397 - RNA, 24 nt, Chlamydophila pneumoniae J138
gucuugcgccagcaaagauuaagg

SEQ ID NO: 522398 - RNA, 17 nt, Chlamydophila pneumoniae J138
gucugaguuagcuuuug

SEQ ID NO: 522399 - RNA, 18 nt, Chlamydophila pneumoniae J138
gugacgacaaaucacgac

SEQ ID NO: 522400 - RNA, 13 nt, Chlamydophila pneumoniae J138
gccuuuagggaaa

SEQ ID NO: 522401 - RNA, 18 nt, Chlamydophila pneumoniae J138
aaggaccacaauuccuaa

SEQ ID NO: 522402 - RNA, 17 nt, Chlamydophila pneumoniae J138
gcuccacggaaauauuc

SEQ ID NO: 522403 - RNA, 23 nt, Chlamydophila pneumoniae J138
gcuccacggaaauauucuuggaa

SEQ ID NO: 522404 - RNA, 14 nt, Chlamydophila pneumoniae J138
gcuccaaaauaauc

SEQ ID NO: 522405 - RNA, 18 nt, Chlamydophila pneumoniae J138
gcucccauuucuggagaa

SEQ ID NO: 522406 - RNA, 14 nt, Chlamydophila pneumoniae J138
gcucuccaaaggga

SEQ ID NO: 522407 - RNA, 22 nt, Chlamydophila pneumoniae J138
gcugaaagaaugccauucuuau

SEQ ID NO: 522408 - RNA, 15 nt, Chlamydophila pneumoniae J138
gcuuaauaaacauca

SEQ ID NO: 522409 - RNA, 20 nt, Chlamydophila pneumoniae J138
gcuuauuauugaauaagcuu

SEQ ID NO: 522410 - RNA, 20 nt, Chlamydophila pneumoniae J138
gcuucaucacauuaagcuca

SEQ ID NO: 522411 - RNA, 18 nt, Chlamydophila pneumoniae J138
ggaaaaagccuuucuuau

SEQ ID NO: 522412 - RNA, 23 nt, Chlamydophila pneumoniae J138
ggaaagcucuuucauaagauugc

SEQ ID NO: 522413 - RNA, 16 nt, Chlamydophila pneumoniae J138
gcuuuuguagauuagg

SEQ ID NO: 522414 - RNA, 20 nt, Chlamydophila pneumoniae J138
gacguaauuacgcucuccau

SEQ ID NO: 522415 - RNA, 14 nt, Chlamydophila pneumoniae J138
aacugauuaguuug

SEQ ID NO: 522416 - RNA, 14 nt, Chlamydophila pneumoniae J138
aacucuaucgaaga

SEQ ID NO: 522417 - RNA, 14 nt, Chlamydophila pneumoniae J138
gagcugaucuucua

SEQ ID NO: 522418 - RNA, 11 nt, Chlamydophila pneumoniae J138
gagcuaagucu

SEQ ID NO: 522419 - RNA, 21 nt, Chlamydophila pneumoniae J138
gagcuaccuagggucuucucg

SEQ ID NO: 522420 - RNA, 16 nt, Chlamydophila pneumoniae J138
gagcucgcaaaagcug

SEQ ID NO: 522421 - RNA, 15 nt, Chlamydophila pneumoniae J138
gaggagaagucgaaa

SEQ ID NO: 522422 - RNA, 23 nt, Chlamydophila pneumoniae J138
gaggaccgaaaaaccuucuccaa

SEQ ID NO: 522423 - RNA, 20 nt, Chlamydophila pneumoniae J138
gagcuuuuagguagagaauc

SEQ ID NO: 522424 - RNA, 22 nt, Chlamydophila pneumoniae J138
gagcuuccauuggaauccuuug

SEQ ID NO: 522425 - RNA, 17 nt, Chlamydophila pneumoniae J138
gagcuucaaguuucuuu

SEQ ID NO: 522426 - RNA, 20 nt, Chlamydophila pneumoniae J138
gaggucuuuucuuuuuagaa

SEQ ID NO: 522427 - RNA, 15 nt, Chlamydophila pneumoniae J138
gauaaauggaggaua

SEQ ID NO: 522428 - RNA, 23 nt, Chlamydophila pneumoniae J138
gaguaccgaccgaaucucuccag

SEQ ID NO: 522429 - RNA, 23 nt, Chlamydophila pneumoniae J138
gagucccuugucaacaaaagcua

SEQ ID NO: 522430 - RNA, 14 nt, Chlamydophila pneumoniae J138
gaguccuaaaauuu

SEQ ID NO: 522431 - RNA, 16 nt, Chlamydophila pneumoniae J138
gauaucaaagcauugc

SEQ ID NO: 522432 - RNA, 20 nt, Chlamydophila pneumoniae J138
gauauuacagauuucuucuu

SEQ ID NO: 522433 - RNA, 17 nt, Chlamydophila pneumoniae J138
gaucucuaguucuagaa

SEQ ID NO: 522434 - RNA, 20 nt, Chlamydophila pneumoniae J138
gaucuuuauuuuuaaaaaua

SEQ ID NO: 522435 - RNA, 16 nt, Chlamydophila pneumoniae J138
gaugcaucucuuaaaa

SEQ ID NO: 522436 - RNA, 16 nt, Chlamydophila pneumoniae J138
gauugauccacagauc

SEQ ID NO: 522437 - RNA, 23 nt, Chlamydophila pneumoniae J138
gcaaagaacucaacuuuuuuacu

SEQ ID NO: 522438 - RNA, 12 nt, Chlamydophila pneumoniae J138
gcaaagaaaauu

SEQ ID NO: 522439 - RNA, 18 nt, Chlamydophila pneumoniae J138
gcaaauaagccaguacua

SEQ ID NO: 522440 - RNA, 16 nt, Chlamydophila pneumoniae J138
gauuuauuuugucuuu

SEQ ID NO: 522441 - RNA, 15 nt, Chlamydophila pneumoniae J138
gauuuccauagaguu

SEQ ID NO: 522442 - RNA, 14 nt, Chlamydophila pneumoniae J138
gauuuuucaagacc

SEQ ID NO: 522443 - RNA, 13 nt, Chlamydophila pneumoniae J138
gauuuuuucuugg

SEQ ID NO: 522444 - RNA, 16 nt, Chlamydophila pneumoniae J138
gcaacagguaagacga

SEQ ID NO: 522445 - RNA, 17 nt, Chlamydophila pneumoniae J138
gcacaaucgcaucaaaa

SEQ ID NO: 522446 - RNA, 23 nt, Chlamydophila pneumoniae J138
gcacauucaagauucccugcgga

SEQ ID NO: 522447 - RNA, 12 nt, Chlamydophila pneumoniae J138
aacuuucuucuc

SEQ ID NO: 522448 - RNA, 16 nt, Chlamydophila pneumoniae J138
gcagauacuaaacucc

SEQ ID NO: 522449 - RNA, 20 nt, Chlamydophila pneumoniae J138
gcaggugugugguaaaaaua

SEQ ID NO: 522450 - RNA, 21 nt, Chlamydophila pneumoniae J138
aagaagaucaaagauuccuaa

SEQ ID NO: 522451 - RNA, 19 nt, Chlamydophila pneumoniae J138
aagaaaugcccugucacua

SEQ ID NO: 522452 - RNA, 22 nt, Chlamydophila pneumoniae J138
aagaacagaggaucuagaaaau

SEQ ID NO: 522453 - RNA, 15 nt, Chlamydophila pneumoniae J138
aagaagcucacucuu

SEQ ID NO: 522454 - RNA, 16 nt, Chlamydophila pneumoniae J138
aagaaagcuugucaua

SEQ ID NO: 522455 - RNA, 21 nt, Chlamydophila pneumoniae J138
aagacgacacucaaaucuuuc

SEQ ID NO: 522456 - RNA, 20 nt, Chlamydophila pneumoniae J138
gccauuccauggauauggaa

SEQ ID NO: 522457 - RNA, 22 nt, Chlamydophila pneumoniae J138
gcccaaaaacacucaaauucaa

SEQ ID NO: 522458 - RNA, 16 nt, Chlamydophila pneumoniae J138
gccaauuuuuguagac

SEQ ID NO: 522459 - RNA, 13 nt, Chlamydophila pneumoniae J138
aagauauucaaga

SEQ ID NO: 522460 - RNA, 13 nt, Chlamydophila pneumoniae J138
aagauuuuuucuu

SEQ ID NO: 522461 - RNA, 20 nt, Chlamydophila pneumoniae J138
aagcaaggcugccagagauu

SEQ ID NO: 522462 - RNA, 16 nt, Chlamydophila pneumoniae J138
aagauuuuuagaauag

SEQ ID NO: 522463 - RNA, 22 nt, Chlamydophila pneumoniae J138
aagauuuuaggggguuuuucua

SEQ ID NO: 522464 - RNA, 12 nt, Chlamydophila pneumoniae J138
aagcacuuaaaa

SEQ ID NO: 522465 - RNA, 21 nt, Chlamydophila pneumoniae J138
aagauguguuuuaacaacuag

SEQ ID NO: 522466 - RNA, 21 nt, Chlamydophila pneumoniae J138
cuggcuaaaggaucauuaaag

SEQ ID NO: 522467 - RNA, 17 nt, Chlamydophila pneumoniae J138
cugucagaacaagaagu

SEQ ID NO: 522468 - RNA, 17 nt, Chlamydophila pneumoniae J138
cuuaagaguuuuacauc

SEQ ID NO: 522469 - RNA, 13 nt, Chlamydophila pneumoniae J138
cuuaaccuccuca

SEQ ID NO: 522470 - RNA, 21 nt, Chlamydophila pneumoniae J138
cuuaauagauucguuauccuc

SEQ ID NO: 522471 - RNA, 12 nt, Chlamydophila pneumoniae J138
cuuaucucuuuc

SEQ ID NO: 522472 - RNA, 21 nt, Chlamydophila pneumoniae J138
cuuaucuaggucgauauccca

SEQ ID NO: 522473 - RNA, 16 nt, Chlamydophila pneumoniae J138
cuuaucuaaagaaaug

SEQ ID NO: 522474 - RNA, 23 nt, Chlamydophila pneumoniae J138
cuucaaugaagaaaaaucuacau

SEQ ID NO: 522475 - RNA, 18 nt, Chlamydophila pneumoniae J138
cuuauuucuguaguucuu

SEQ ID NO: 522476 - RNA, 15 nt, Chlamydophila pneumoniae J138
cuucauugcaaaaau

SEQ ID NO: 522477 - RNA, 13 nt, Chlamydophila pneumoniae J138
cuucaugcugcuu

SEQ ID NO: 522478 - RNA, 16 nt, Chlamydophila pneumoniae J138
cuucgggaucuaaaag

SEQ ID NO: 522479 - RNA, 18 nt, Chlamydophila pneumoniae J138
cuugcucaggagauacaa

SEQ ID NO: 522480 - RNA, 22 nt, Chlamydophila pneumoniae J138
cuucguuucuuugaguuaagca

SEQ ID NO: 522481 - RNA, 23 nt, Chlamydophila pneumoniae J138
cuuuaaauucgccaaacgaauuu

SEQ ID NO: 522482 - RNA, 11 nt, Chlamydophila pneumoniae J138
cuuuagggaag

SEQ ID NO: 522483 - RNA, 19 nt, Chlamydophila pneumoniae J138
cuuuagaaauuccaauuuu

SEQ ID NO: 522484 - RNA, 21 nt, Chlamydophila pneumoniae J138
cuuuaagguugcuuuucuagg

SEQ ID NO: 522485 - RNA, 15 nt, Chlamydophila pneumoniae J138
cuuuauuuuuaaaaa

SEQ ID NO: 522486 - RNA, 12 nt, Chlamydophila pneumoniae J138
cuuucagaaaag

SEQ ID NO: 522487 - RNA, 23 nt, Chlamydophila pneumoniae J138
cuuuccauaaagccccacccacu

SEQ ID NO: 522488 - RNA, 15 nt, Chlamydophila pneumoniae J138
cuuucguuuucuagc

SEQ ID NO: 522489 - RNA, 21 nt, Chlamydophila pneumoniae J138
cuuucuuuuuuaaucuagaac

SEQ ID NO: 522490 - RNA, 21 nt, Chlamydophila pneumoniae J138
cuuuuuaguauacuaagacug

SEQ ID NO: 522491 - RNA, 23 nt, Chlamydophila pneumoniae J138
cuuuugcugcagcaaaacuagga

SEQ ID NO: 522492 - RNA, 18 nt, Chlamydophila pneumoniae J138
cuuuucuuuuucuaggga

SEQ ID NO: 522493 - RNA, 14 nt, Chlamydophila pneumoniae J138
cuuuucguauagag

SEQ ID NO: 522494 - RNA, 13 nt, Chlamydophila pneumoniae J138
gaaaaaauaucuc

SEQ ID NO: 522495 - RNA, 20 nt, Chlamydophila pneumoniae J138
gaaaaagccuaugggaggaa

SEQ ID NO: 522496 - RNA, 19 nt, Chlamydophila pneumoniae J138
gaaaacucuuagagucgau

SEQ ID NO: 522497 - RNA, 11 nt, Chlamydophila pneumoniae J138
gaaaacuucaa

SEQ ID NO: 522498 - RNA, 13 nt, Chlamydophila pneumoniae J138
gaaaacuucaaaa

SEQ ID NO: 522499 - RNA, 14 nt, Chlamydophila pneumoniae J138
gaaauccacagaua

SEQ ID NO: 522500 - RNA, 20 nt, Chlamydophila pneumoniae J138
gaaauuaaguaggccuccuu

SEQ ID NO: 522501 - RNA, 21 nt, Chlamydophila pneumoniae J138
gaacaacgcugcuucucuacu

SEQ ID NO: 522502 - RNA, 13 nt, Chlamydophila pneumoniae J138
gaacuaacuguaa

SEQ ID NO: 522503 - RNA, 23 nt, Chlamydophila pneumoniae J138
gaacuauaggaagcucuucuacu

SEQ ID NO: 522504 - RNA, 17 nt, Chlamydophila pneumoniae J138
gaacguacucuucuuuu

SEQ ID NO: 522505 - RNA, 12 nt, Chlamydophila pneumoniae J138
gaccuucucuuc

SEQ ID NO: 522506 - RNA, 14 nt, Chlamydophila pneumoniae J138
gaccuguuuucuuu

SEQ ID NO: 522507 - RNA, 15 nt, Chlamydophila pneumoniae J138
gaccuucagguugau

SEQ ID NO: 522508 - RNA, 10 nt, Chlamydophila pneumoniae J138
gacgacucug

SEQ ID NO: 522509 - RNA, 17 nt, Chlamydophila pneumoniae J138
gacgcacuucuucaaga

SEQ ID NO: 522510 - RNA, 12 nt, Chlamydophila pneumoniae J138
aacgcuuuucua

SEQ ID NO: 522511 - RNA, 16 nt, Chlamydophila pneumoniae J138
gacauacaucaaaaug

SEQ ID NO: 522512 - RNA, 15 nt, Chlamydophila pneumoniae J138
gaauccuguucuaca

SEQ ID NO: 522513 - RNA, 17 nt, Chlamydophila pneumoniae J138
gaauucuuuaaaaucuu

SEQ ID NO: 522514 - RNA, 14 nt, Chlamydophila pneumoniae J138
gaauucugaugacc

SEQ ID NO: 522515 - RNA, 20 nt, Chlamydophila pneumoniae J138
gaauucucagaaagccuuug

SEQ ID NO: 522516 - RNA, 15 nt, Chlamydophila pneumoniae J138
gacaaaucucccaaa

SEQ ID NO: 522517 - RNA, 18 nt, Chlamydophila pneumoniae J138
aacccgauacauccucac

SEQ ID NO: 522518 - RNA, 23 nt, Chlamydophila pneumoniae J138
cguauccaaauugcaauuuucua

SEQ ID NO: 522519 - RNA, 14 nt, Chlamydophila pneumoniae J138
cguaccguauccuc

SEQ ID NO: 522520 - RNA, 21 nt, Chlamydophila pneumoniae J138
cguccuccccauacauaggga

SEQ ID NO: 522521 - RNA, 13 nt, Chlamydophila pneumoniae J138
aacccuauuuaag

SEQ ID NO: 522522 - RNA, 14 nt, Chlamydophila pneumoniae J138
cgugaacaaaaucg

SEQ ID NO: 522523 - RNA, 16 nt, Chlamydophila pneumoniae J138
cguuaaaaacuauccu

SEQ ID NO: 522524 - RNA, 20 nt, Chlamydophila pneumoniae J138
cgugggcccaagcaagaagu

SEQ ID NO: 522525 - RNA, 15 nt, Chlamydophila pneumoniae J138
cugacacagagcuuc

SEQ ID NO: 522526 - RNA, 17 nt, Chlamydophila pneumoniae J138
cugacaaauagaaagga

SEQ ID NO: 522527 - RNA, 20 nt, Chlamydophila pneumoniae J138
cugaaucagcuuaucuauag

SEQ ID NO: 522528 - RNA, 14 nt, Chlamydophila pneumoniae J138
cugaagauuuuuua

SEQ ID NO: 522529 - RNA, 23 nt, Chlamydophila pneumoniae J138
cugaacgagguaacccaauucuu

SEQ ID NO: 522530 - RNA, 16 nt, Chlamydophila pneumoniae J138
cucuaagaaucuauag

SEQ ID NO: 522531 - RNA, 18 nt, Chlamydophila pneumoniae J138
cucuugcgaacuauccua

SEQ ID NO: 522532 - RNA, 11 nt, Chlamydophila pneumoniae J138
cucuuuaaaaa

SEQ ID NO: 522533 - RNA, 15 nt, Chlamydophila pneumoniae J138
cugaacaucuccagc

SEQ ID NO: 522534 - RNA, 22 nt, Chlamydophila pneumoniae J138
cucuucagcagguucuugaauc

SEQ ID NO: 522535 - RNA, 18 nt, Chlamydophila pneumoniae J138
cugauacaucaucagaag

SEQ ID NO: 522536 - RNA, 20 nt, Chlamydophila pneumoniae J138
cugagagauagguuuuugua

SEQ ID NO: 522537 - RNA, 18 nt, Chlamydophila pneumoniae J138
cugagccugugauaguag

SEQ ID NO: 522538 - RNA, 22 nt, Chlamydophila pneumoniae J138
cugacguuguguagcugaaauc

SEQ ID NO: 522539 - RNA, 22 nt, Chlamydophila pneumoniae J138
cugagacguuguugcaauucuu

SEQ ID NO: 522540 - RNA, 19 nt, Chlamydophila pneumoniae J138
cugcagcguuucuagggac

SEQ ID NO: 522541 - RNA, 18 nt, Chlamydophila pneumoniae J138
cugcauaaucucaccaga

SEQ ID NO: 522542 - RNA, 18 nt, Chlamydophila pneumoniae J138
cuccauuuagacaagaca

SEQ ID NO: 522543 - RNA, 18 nt, Chlamydophila pneumoniae J138
cuccuccaaugagcucua

SEQ ID NO: 522544 - RNA, 22 nt, Chlamydophila pneumoniae J138
cuccuauuccggagcccucggu

SEQ ID NO: 522545 - RNA, 22 nt, Chlamydophila pneumoniae J138
cucggaaaucagggauauacaa

SEQ ID NO: 522546 - RNA, 16 nt, Chlamydophila pneumoniae J138
cuauccgcacucauag

SEQ ID NO: 522547 - RNA, 18 nt, Chlamydophila pneumoniae J138
cuaugagauaggaacuca

SEQ ID NO: 522548 - RNA, 15 nt, Chlamydophila pneumoniae J138
cuauuagauuuccuc

SEQ ID NO: 522549 - RNA, 18 nt, Chlamydophila pneumoniae J138
cuaugggaggaauuccuc

SEQ ID NO: 522550 - RNA, 14 nt, Chlamydophila pneumoniae J138
cucaagagcaugcu

SEQ ID NO: 522551 - RNA, 17 nt, Chlamydophila pneumoniae J138
cucaaacccucuccaga

SEQ ID NO: 522552 - RNA, 18 nt, Chlamydophila pneumoniae J138
cuauucgcugucuagaac

SEQ ID NO: 522553 - RNA, 15 nt, Chlamydophila pneumoniae J138
cuauaucauuaagaa

SEQ ID NO: 522554 - RNA, 14 nt, Chlamydophila pneumoniae J138
cuauaguagaagaa

SEQ ID NO: 522555 - RNA, 18 nt, Chlamydophila pneumoniae J138
cuagaggagcgaugacuu

SEQ ID NO: 522556 - RNA, 23 nt, Chlamydophila pneumoniae J138
cuccaagaauagcaggaaggaau

SEQ ID NO: 522557 - RNA, 15 nt, Chlamydophila pneumoniae J138
cucacaagcauccua

SEQ ID NO: 522558 - RNA, 23 nt, Chlamydophila pneumoniae J138
cucaccagaagcaacuaaacucu

SEQ ID NO: 522559 - RNA, 22 nt, Chlamydophila pneumoniae J138
acauaacgggguugucucuaca

SEQ ID NO: 522560 - RNA, 16 nt, Chlamydophila pneumoniae J138
accauauucucaggaa

SEQ ID NO: 522561 - RNA, 21 nt, Chlamydophila pneumoniae J138
aaaaugcacuuugaauaaugc

SEQ ID NO: 522562 - RNA, 13 nt, Chlamydophila pneumoniae J138
accaucaaugaga

SEQ ID NO: 522563 - RNA, 13 nt, Chlamydophila pneumoniae J138
accauuaagauau

SEQ ID NO: 522564 - RNA, 21 nt, Chlamydophila pneumoniae J138
accgcaaaaagcuucuuucuu

SEQ ID NO: 522565 - RNA, 18 nt, Chlamydophila pneumoniae J138
accguuaauuuuugcuaa

SEQ ID NO: 522566 - RNA, 15 nt, Chlamydophila pneumoniae J138
accucucaucaaagc

SEQ ID NO: 522567 - RNA, 13 nt, Chlamydophila pneumoniae J138
acgacauugaaga

SEQ ID NO: 522568 - RNA, 24 nt, Chlamydophila pneumoniae J138
acgaauuucuuguuccaauagagu

SEQ ID NO: 522569 - RNA, 21 nt, Chlamydophila pneumoniae J138
acgaacuuugaccagaugauu

SEQ ID NO: 522570 - RNA, 19 nt, Chlamydophila pneumoniae J138
accuuuccuaaaauaauuu

SEQ ID NO: 522571 - RNA, 11 nt, Chlamydophila pneumoniae J138
aaacaaaagca

SEQ ID NO: 522572 - RNA, 21 nt, Chlamydophila pneumoniae J138
aaacaaucuuguaaguuacgg

SEQ ID NO: 522573 - RNA, 18 nt, Chlamydophila pneumoniae J138
aaacaagaagaucaaaga

SEQ ID NO: 522574 - RNA, 18 nt, Chlamydophila pneumoniae J138
acgauacgucguuacagc

SEQ ID NO: 522575 - RNA, 18 nt, Chlamydophila pneumoniae J138
aaacauagagauucuaca

SEQ ID NO: 522576 - RNA, 21 nt, Chlamydophila pneumoniae J138
acggcggagaauaucaucuuc

SEQ ID NO: 522577 - RNA, 14 nt, Chlamydophila pneumoniae J138
acgggagcucuuuc

SEQ ID NO: 522578 - RNA, 17 nt, Chlamydophila pneumoniae J138
acuagaucccucaagcg

SEQ ID NO: 522579 - RNA, 17 nt, Chlamydophila pneumoniae J138
acuaaauucuuaacaau

SEQ ID NO: 522580 - RNA, 15 nt, Chlamydophila pneumoniae J138
acuaaaaguuuuuua

SEQ ID NO: 522581 - RNA, 13 nt, Chlamydophila pneumoniae J138
acguuuuuuuccu

SEQ ID NO: 522582 - RNA, 14 nt, Chlamydophila pneumoniae J138
acguuuaauuccuu

SEQ ID NO: 522583 - RNA, 16 nt, Chlamydophila pneumoniae J138
acuuagaucuuuucua

SEQ ID NO: 522584 - RNA, 20 nt, Chlamydophila pneumoniae J138
acuuaaguugaccuuuuuca

SEQ ID NO: 522585 - RNA, 19 nt, Chlamydophila pneumoniae J138
acuggcccagauucugaag

SEQ ID NO: 522586 - RNA, 22 nt, Chlamydophila pneumoniae J138
acugcaggaaauuauagaugau

SEQ ID NO: 522587 - RNA, 15 nt, Chlamydophila pneumoniae J138
acucuuuucuagaaa

SEQ ID NO: 522588 - RNA, 14 nt, Chlamydophila pneumoniae J138
acuuauauuuucua

SEQ ID NO: 522589 - RNA, 13 nt, Chlamydophila pneumoniae J138
acuuuguuuuuca

SEQ ID NO: 522590 - RNA, 21 nt, Chlamydophila pneumoniae J138
agaaauuagaguaugaggaga

SEQ ID NO: 522591 - RNA, 22 nt, Chlamydophila pneumoniae J138
agaacaaggcuccguugaauua

SEQ ID NO: 522592 - RNA, 21 nt, Chlamydophila pneumoniae J138
agaaacccgcaacucuuuagg

SEQ ID NO: 522593 - RNA, 23 nt, Chlamydophila pneumoniae J138
agaaaaucucuaagaaucuauag

SEQ ID NO: 522594 - RNA, 19 nt, Chlamydophila pneumoniae J138
agaaagauaucccaaagcu

SEQ ID NO: 522595 - RNA, 22 nt, Chlamydophila pneumoniae J138
agaaagaauuguaguucuuuga

SEQ ID NO: 522596 - RNA, 12 nt, Chlamydophila pneumoniae J138
agaaacugcucc

SEQ ID NO: 522597 - RNA, 15 nt, Chlamydophila pneumoniae J138
agaaacgcagcuuuc

SEQ ID NO: 522598 - RNA, 20 nt, Chlamydophila pneumoniae J138
agaagcaugaagcagaaacu

SEQ ID NO: 522599 - RNA, 19 nt, Chlamydophila pneumoniae J138
agaagcaugaagcagaaac

SEQ ID NO: 522600 - RNA, 15 nt, Chlamydophila pneumoniae J138
agaacuuuagggaag

SEQ ID NO: 522601 - RNA, 18 nt, Chlamydophila pneumoniae J138
agaaugcccuuuagggaa

SEQ ID NO: 522602 - RNA, 20 nt, Chlamydophila pneumoniae J138
agaaugacacagagaacaau

SEQ ID NO: 522603 - RNA, 22 nt, Chlamydophila pneumoniae J138
agaauccugaguaaaaucauag

SEQ ID NO: 522604 - RNA, 13 nt, Chlamydophila pneumoniae J138
agaaucauaacaa

SEQ ID NO: 522605 - RNA, 19 nt, Chlamydophila pneumoniae J138
agaaucuuuucuagaaaac

SEQ ID NO: 522606 - RNA, 13 nt, Chlamydophila pneumoniae J138
agaaucuuuucua

SEQ ID NO: 522607 - RNA, 13 nt, Chlamydophila pneumoniae J138
agaauauagacuu

SEQ ID NO: 522608 - RNA, 21 nt, Chlamydophila pneumoniae J138
agaauaacgcaagggcggaga

SEQ ID NO: 522609 - RNA, 22 nt, Chlamydophila pneumoniae J138
agaaguccuaucaaagcaaaag

SEQ ID NO: 522610 - RNA, 20 nt, Chlamydophila pneumoniae J138
agaagucgcuagaucacaag

SEQ ID NO: 522611 - RNA, 21 nt, Chlamydophila pneumoniae J138
agacaaugcgccuuguuuaga

SEQ ID NO: 522612 - RNA, 15 nt, Chlamydophila pneumoniae J138
agaauuuguccuuug

SEQ ID NO: 522613 - RNA, 13 nt, Chlamydophila pneumoniae J138
agagaaggaaaag

SEQ ID NO: 522614 - RNA, 21 nt, Chlamydophila pneumoniae J138
agagauuuuaaagccuccuca

SEQ ID NO: 522615 - RNA, 13 nt, Chlamydophila pneumoniae J138
agaucaaaaauag

SEQ ID NO: 522616 - RNA, 14 nt, Chlamydophila pneumoniae J138
agaucacaucaaga

SEQ ID NO: 522617 - RNA, 19 nt, Chlamydophila pneumoniae J138
agaucagaggaaucuaaga

SEQ ID NO: 522618 - RNA, 18 nt, Chlamydophila pneumoniae J138
agaguggucauugccuug

SEQ ID NO: 522619 - RNA, 21 nt, Chlamydophila pneumoniae J138
agagucucuuucagcucaagu

SEQ ID NO: 522620 - RNA, 21 nt, Chlamydophila pneumoniae J138
agagucuguguagccguaggg

SEQ ID NO: 522621 - RNA, 14 nt, Chlamydophila pneumoniae J138
agagguucccucaa

SEQ ID NO: 522622 - RNA, 23 nt, Chlamydophila pneumoniae J138
agaggcagguagucccuuucuau

SEQ ID NO: 522623 - RNA, 18 nt, Chlamydophila pneumoniae J138
agagcuucuaaaaacucu

SEQ ID NO: 522624 - RNA, 20 nt, Chlamydophila pneumoniae J138
agaugcuauuuacugaaaca

SEQ ID NO: 522625 - RNA, 15 nt, Chlamydophila pneumoniae J138
agauguuuucguaaa

SEQ ID NO: 522626 - RNA, 16 nt, Chlamydophila pneumoniae J138
agaucuuuauuuuuaa

SEQ ID NO: 522627 - RNA, 21 nt, Chlamydophila pneumoniae J138
agaucucuuuagcaaucucuu

SEQ ID NO: 522628 - RNA, 13 nt, Chlamydophila pneumoniae J138
aaccucuuuucuu

SEQ ID NO: 522629 - RNA, 15 nt, Chlamydophila pneumoniae J138
aacgcugcuucucua

SEQ ID NO: 522630 - RNA, 12 nt, Chlamydophila pneumoniae J138
aacucagagauu

SEQ ID NO: 522631 - RNA, 16 nt, Chlamydophila pneumoniae J138
aacucaaucucuuuga

SEQ ID NO: 522632 - RNA, 13 nt, Chlamydophila pneumoniae J138
aacucagcuuuca

SEQ ID NO: 522633 - RNA, 22 nt, Chlamydophila pneumoniae J138
aacuccgcacuugcucuuuaau

SEQ ID NO: 522634 - RNA, 15 nt, Chlamydophila pneumoniae J138
aacuauccaaagccg

SEQ ID NO: 522635 - RNA, 21 nt, Chlamydophila pneumoniae J138
aacugacguuuuucccuaccu

SEQ ID NO: 522636 - RNA, 20 nt, Chlamydophila pneumoniae J138
aacucuuuaggucuugucua

SEQ ID NO: 522637 - RNA, 15 nt, Chlamydophila pneumoniae J138
aagacaucuccugca

SEQ ID NO: 522638 - RNA, 21 nt, Chlamydophila pneumoniae J138
aagacaugagggcaugccuau

SEQ ID NO: 522639 - RNA, 19 nt, Chlamydophila pneumoniae J138
aagacauccuucuuuaccu

SEQ ID NO: 522640 - RNA, 16 nt, Chlamydophila pneumoniae J138
aacuuuuuuucuucuc

SEQ ID NO: 522641 - RNA, 15 nt, Chlamydophila pneumoniae J138
aacuuuuccaaauuc

SEQ ID NO: 522642 - RNA, 18 nt, Chlamydophila pneumoniae J138
aagaacucaacuuuuuua

SEQ ID NO: 522643 - RNA, 17 nt, Chlamydophila pneumoniae J138
aagaaauguaagaaggc

SEQ ID NO: 522644 - RNA, 20 nt, Chlamydophila pneumoniae J138
aagccuccucaagauaaauc

SEQ ID NO: 522645 - RNA, 19 nt, Chlamydophila pneumoniae J138
aagcauucugcuagagcuu

SEQ ID NO: 522646 - RNA, 17 nt, Chlamydophila pneumoniae J138
aagacucuugaauauuu

SEQ ID NO: 522647 - RNA, 16 nt, Chlamydophila pneumoniae J138
aaggcauggcacaguc

SEQ ID NO: 522648 - RNA, 14 nt, Chlamydophila pneumoniae J138
aaggcuaaaaccua

SEQ ID NO: 522649 - RNA, 17 nt, Chlamydophila pneumoniae J138
aaggucacagcauuuuc

SEQ ID NO: 522650 - RNA, 12 nt, Chlamydophila pneumoniae J138
aaggcuuuucuu

SEQ ID NO: 522651 - RNA, 15 nt, Chlamydophila pneumoniae J138
aagugacuuccucca

SEQ ID NO: 522652 - RNA, 17 nt, Chlamydophila pneumoniae J138
aauaaucaaccaaaaug

SEQ ID NO: 522653 - RNA, 18 nt, Chlamydophila pneumoniae J138
aauaaaggacauagacuu

SEQ ID NO: 522654 - RNA, 22 nt, Chlamydophila pneumoniae J138
aauauaucgcguguaaaagcuu

SEQ ID NO: 522655 - RNA, 13 nt, Chlamydophila pneumoniae J138
aaucaauccaaga

SEQ ID NO: 522656 - RNA, 23 nt, Chlamydophila pneumoniae J138
aauauuuuaccauugagauccau

SEQ ID NO: 522657 - RNA, 22 nt, Chlamydophila pneumoniae J138
aaugacagcugagaaauuccua

SEQ ID NO: 522658 - RNA, 16 nt, Chlamydophila pneumoniae J138
aauggaaacuuuucca

SEQ ID NO: 522659 - RNA, 21 nt, Chlamydophila pneumoniae J138
aaugcugagggaucuucucua

SEQ ID NO: 522660 - RNA, 21 nt, Chlamydophila pneumoniae J138
aauuccagaaaaagaacauaa

SEQ ID NO: 522661 - RNA, 16 nt, Chlamydophila pneumoniae J138
aauuguucuugaaguu

SEQ ID NO: 522662 - RNA, 15 nt, Chlamydophila pneumoniae J138
aauugugcucucuaa

SEQ ID NO: 522663 - RNA, 14 nt, Chlamydophila pneumoniae J138
acaacagaaauguu

SEQ ID NO: 522664 - RNA, 21 nt, Chlamydophila pneumoniae J138
acaaagcucuccuucagaguu

SEQ ID NO: 522665 - RNA, 15 nt, Chlamydophila pneumoniae J138
acaagaacugaagag

SEQ ID NO: 522666 - RNA, 17 nt, Chlamydophila pneumoniae J138
acaaugcuaucuccaga

SEQ ID NO: 522667 - RNA, 19 nt, Chlamydophila pneumoniae J138
acaaucucgcuauuccaua

SEQ ID NO: 522668 - RNA, 16 nt, Chlamydophila pneumoniae J138
acaccaacaacaauaa

SEQ ID NO: 522669 - RNA, 13 nt, Chlamydophila pneumoniae J138
acaccaucuuuaa

SEQ ID NO: 522670 - RNA, 14 nt, Chlamydophila pneumoniae J138
acacgaauuucuaa

SEQ ID NO: 522671 - RNA, 13 nt, Chlamydophila pneumoniae J138
acacucagagaug

SEQ ID NO: 522672 - RNA, 22 nt, Chlamydophila pneumoniae J138
acacuauguguuuccuuuucuc

SEQ ID NO: 522673 - RNA, 14 nt, Chlamydophila pneumoniae J138
acacucaaauucaa

SEQ ID NO: 522674 - RNA, 16 nt, Chlamydophila pneumoniae J138
acagaggaucuagaaa

SEQ ID NO: 522675 - RNA, 14 nt, Chlamydophila pneumoniae J138
acagcaucaggauu

SEQ ID NO: 522676 - RNA, 15 nt, Chlamydophila pneumoniae J138
acagcgguugccuuu

SEQ ID NO: 522677 - RNA, 21 nt, Chlamydophila pneumoniae J138
acaggaaguaagguuccaaaa

SEQ ID NO: 522678 - RNA, 18 nt, Chlamydophila pneumoniae J138
aaaaagcccauuccugca

SEQ ID NO: 522679 - RNA, 18 nt, Chlamydophila pneumoniae J138
aaaaacgguaaauaucuu

SEQ ID NO: 522680 - RNA, 13 nt, Chlamydophila pneumoniae J138
aaaaaccuucucc

SEQ ID NO: 522681 - RNA, 22 nt, Chlamydophila pneumoniae J138
aaaaacacugcgcaaagaacuc

SEQ ID NO: 522682 - RNA, 16 nt, Chlamydophila pneumoniae J138
aaaaucuccucucuca

SEQ ID NO: 522683 - RNA, 17 nt, Chlamydophila pneumoniae J138
aaaaucuucuggaggga

SEQ ID NO: 522684 - RNA, 16 nt, Chlamydophila pneumoniae J138
aaaagcugaauccagg

SEQ ID NO: 522685 - RNA, 23 nt, Chlamydophila pneumoniae J138
aaaagauuugcgaaucuaagaug

SEQ ID NO: 522686 - RNA, 14 nt, Chlamydophila pneumoniae J138
aaaaguaguuuuaa

SEQ ID NO: 522687 - RNA, 13 nt, Chlamydophila pneumoniae J138
aaaagagcucaaa

SEQ ID NO: 522688 - RNA, 13 nt, Chlamydophila pneumoniae J138
aaaagaccaaaua

SEQ ID NO: 522689 - RNA, 21 nt, Chlamydophila pneumoniae J138
aaaacuguguucaauagcaaa

SEQ ID NO: 522690 - RNA, 13 nt, Chlamydophila pneumoniae J138
aaaaagucugaau

SEQ ID NO: 522691 - RNA, 22 nt, Chlamydophila pneumoniae J138
aaaaaguuccauagaguaucua

SEQ ID NO: 522692 - RNA, 12 nt, Chlamydophila pneumoniae J138
aaacaucaaaga

SEQ ID NO: 522693 - RNA, 20 nt, Chlamydophila pneumoniae J138
aaaauuuucaggaacuuuac

SEQ ID NO: 522694 - RNA, 21 nt, Chlamydophila pneumoniae J138
aaacuuucgaagcgcucuaca

SEQ ID NO: 522695 - RNA, 15 nt, Chlamydophila pneumoniae J138
aaacuuucuucucua

SEQ ID NO: 522696 - RNA, 18 nt, Chlamydophila pneumoniae J138
aaagcaggagcaucauua

SEQ ID NO: 522697 - RNA, 22 nt, Chlamydophila pneumoniae J138
aaagcauaguguauaucagcaa

SEQ ID NO: 522698 - RNA, 16 nt, Chlamydophila pneumoniae J138
aaagagucucacucuu

SEQ ID NO: 522699 - RNA, 22 nt, Chlamydophila pneumoniae J138
aaagaaguuuacaaauaaaaug

SEQ ID NO: 522700 - RNA, 12 nt, Chlamydophila pneumoniae J138
aaagacgaucuu

SEQ ID NO: 522701 - RNA, 15 nt, Chlamydophila pneumoniae J138
aaagaagacgcucuu

SEQ ID NO: 522702 - RNA, 19 nt, Chlamydophila pneumoniae J138
aaacuuuuuuucuucucua

SEQ ID NO: 522703 - RNA, 14 nt, Chlamydophila pneumoniae J138
aaagguugcuaaga

SEQ ID NO: 522704 - RNA, 16 nt, Chlamydophila pneumoniae J138
aaaugcacuuugaaua

SEQ ID NO: 522705 - RNA, 21 nt, Chlamydophila pneumoniae J138
aaauaaaaaaacccucaaaga

SEQ ID NO: 522706 - RNA, 21 nt, Chlamydophila pneumoniae J138
aaauguuuaucgacucuucca

SEQ ID NO: 522707 - RNA, 20 nt, Chlamydophila pneumoniae J138
aaauuaccuugagacaaaga

SEQ ID NO: 522708 - RNA, 18 nt, Chlamydophila pneumoniae J138
aaaagaauuccuaaaacg

SEQ ID NO: 522709 - RNA, 11 nt, Chlamydophila pneumoniae J138
uuuuuucuauu

SEQ ID NO: 522710 - RNA, 12 nt, Chlamydophila pneumoniae J138
uuuuuucuaaau

SEQ ID NO: 522711 - RNA, 22 nt, Chlamydophila pneumoniae J138
uuuucuuuugcagcaacuuccc

SEQ ID NO: 522712 - RNA, 23 nt, Chlamydophila pneumoniae J138
uuuugaggaacuucagcuuugcu

SEQ ID NO: 522713 - RNA, 15 nt, Chlamydophila pneumoniae J138
uuuugagauucaaaa

SEQ ID NO: 522714 - RNA, 20 nt, Chlamydophila pneumoniae J138
uuuugcagugauaaaccaag

SEQ ID NO: 522715 - RNA, 20 nt, Chlamydophila pneumoniae J138
uuuugcaaaucuucgaauuu

SEQ ID NO: 522716 - RNA, 13 nt, Chlamydophila pneumoniae J138
uuuucucugagca

SEQ ID NO: 522717 - RNA, 16 nt, Chlamydophila pneumoniae J138
uuuucucgaauagaaa

SEQ ID NO: 522718 - RNA, 15 nt, Chlamydophila pneumoniae J138
uuuucgacgcuguug

SEQ ID NO: 522719 - RNA, 20 nt, Chlamydophila pneumoniae J138
uuuucgcuaacuuauccuca

SEQ ID NO: 522720 - RNA, 20 nt, Chlamydophila pneumoniae J138
uuuucuucuucggaucugua

SEQ ID NO: 522721 - RNA, 22 nt, Chlamydophila pneumoniae J138
uuuucuucuuuaagauuuccuu

SEQ ID NO: 522722 - RNA, 13 nt, Chlamydophila pneumoniae J138
uuuucuucuuuag

SEQ ID NO: 522723 - RNA, 17 nt, Chlamydophila pneumoniae J138
uuuucuugauuagagaa

SEQ ID NO: 522724 - RNA, 22 nt, Chlamydophila pneumoniae J138
uuuucuuguaagacuaaaaaag

SEQ ID NO: 522725 - RNA, 12 nt, Chlamydophila pneumoniae J138
uuuucaaauucu

SEQ ID NO: 522726 - RNA, 16 nt, Chlamydophila pneumoniae J138
uuuaccuuguuuuccu

SEQ ID NO: 522727 - RNA, 13 nt, Chlamydophila pneumoniae J138
uuuacgaaaacau

SEQ ID NO: 522728 - RNA, 15 nt, Chlamydophila pneumoniae J138
uuuucaggaacuuua

SEQ ID NO: 522729 - RNA, 14 nt, Chlamydophila pneumoniae J138
uuuucauacuuauc

SEQ ID NO: 522730 - RNA, 16 nt, Chlamydophila pneumoniae J138
uuuugcuuuucccaca

SEQ ID NO: 522731 - RNA, 19 nt, Chlamydophila pneumoniae J138
uuuuguaaucuaagaaucu

SEQ ID NO: 522732 - RNA, 17 nt, Chlamydophila pneumoniae J138
uuuugcuaaacaaugca

SEQ ID NO: 522733 - RNA, 16 nt, Chlamydophila pneumoniae J138
uuuugcugaagauuuu

SEQ ID NO: 522734 - RNA, 17 nt, Chlamydophila pneumoniae J138
uuuugcugaagauuuuu

SEQ ID NO: 522735 - RNA, 12 nt, Chlamydophila pneumoniae J138
uuuugcucucua

SEQ ID NO: 522736 - RNA, 14 nt, Chlamydophila pneumoniae J138
uuuugcgauuucag

SEQ ID NO: 522737 - RNA, 18 nt, Chlamydophila pneumoniae J138
uuuugccgugcucuuaug

SEQ ID NO: 522738 - RNA, 18 nt, Chlamydophila pneumoniae J138
uuuuguggcuuuucuaaa

SEQ ID NO: 522739 - RNA, 16 nt, Chlamydophila pneumoniae J138
uuuuguggcuuuucua

SEQ ID NO: 522740 - RNA, 13 nt, Chlamydophila pneumoniae J138
uuuugucuucauc

SEQ ID NO: 522741 - RNA, 13 nt, Chlamydophila pneumoniae J138
uuuuguacacaga

SEQ ID NO: 522742 - RNA, 14 nt, Chlamydophila pneumoniae J138
uuuuguaggaacau

SEQ ID NO: 522743 - RNA, 17 nt, Chlamydophila pneumoniae J138
uuuuguucccuacuucc

SEQ ID NO: 522744 - RNA, 12 nt, Chlamydophila pneumoniae J138
uuuuuaaauaca

SEQ ID NO: 522745 - RNA, 17 nt, Chlamydophila pneumoniae J138
uuuuuaaccucuuuucu

SEQ ID NO: 522746 - RNA, 21 nt, Chlamydophila pneumoniae J138
uuuuuagaagguguuuuggcu

SEQ ID NO: 522747 - RNA, 12 nt, Chlamydophila pneumoniae J138
uuuuuacaugua

SEQ ID NO: 522748 - RNA, 13 nt, Chlamydophila pneumoniae J138
uuuuuauuuaaaa

SEQ ID NO: 522749 - RNA, 16 nt, Chlamydophila pneumoniae J138
uuuuucaagguucucu

SEQ ID NO: 522750 - RNA, 16 nt, Chlamydophila pneumoniae J138
uuuuucaauccuuccu

SEQ ID NO: 522751 - RNA, 21 nt, Chlamydophila pneumoniae J138
uucuauacgcuuaacaugaaa

SEQ ID NO: 522752 - RNA, 14 nt, Chlamydophila pneumoniae J138
uucuauaacuacaa

SEQ ID NO: 522753 - RNA, 16 nt, Chlamydophila pneumoniae J138
uucuagguauuuguuu

SEQ ID NO: 522754 - RNA, 15 nt, Chlamydophila pneumoniae J138
uucucagaaagauau

SEQ ID NO: 522755 - RNA, 14 nt, Chlamydophila pneumoniae J138
uucucauagcuucc

SEQ ID NO: 522756 - RNA, 17 nt, Chlamydophila pneumoniae J138
uucucauagcuuccugu

SEQ ID NO: 522757 - RNA, 16 nt, Chlamydophila pneumoniae J138
uucucauccagacagg

SEQ ID NO: 522758 - RNA, 19 nt, Chlamydophila pneumoniae J138
uucuccaacuuccauauga

SEQ ID NO: 522759 - RNA, 13 nt, Chlamydophila pneumoniae J138
uucuccaaauaaa

SEQ ID NO: 522760 - RNA, 14 nt, Chlamydophila pneumoniae J138
uucuccacaugccc

SEQ ID NO: 522761 - RNA, 22 nt, Chlamydophila pneumoniae J138
uucuccugacucuuuuaagaca

SEQ ID NO: 522762 - RNA, 12 nt, Chlamydophila pneumoniae J138
uucucgaaaaau

SEQ ID NO: 522763 - RNA, 14 nt, Chlamydophila pneumoniae J138
uucuaagcaauauu

SEQ ID NO: 522764 - RNA, 19 nt, Chlamydophila pneumoniae J138
uucuaagcugaaagaacac

SEQ ID NO: 522765 - RNA, 24 nt, Chlamydophila pneumoniae J138
uucuaagcuuauuucuguaguucu

SEQ ID NO: 522766 - RNA, 12 nt, Chlamydophila pneumoniae J138
uucuaauacacc

SEQ ID NO: 522767 - RNA, 15 nt, Chlamydophila pneumoniae J138
uucuagaaugaugca

SEQ ID NO: 522768 - RNA, 16 nt, Chlamydophila pneumoniae J138
uucuagaaacugcucc

SEQ ID NO: 522769 - RNA, 16 nt, Chlamydophila pneumoniae J138
uucuagaaaagauucu

SEQ ID NO: 522770 - RNA, 18 nt, Chlamydophila pneumoniae J138
uucuagaguucauuuuag

SEQ ID NO: 522771 - RNA, 16 nt, Chlamydophila pneumoniae J138
uucuagcaaaucuaaa

SEQ ID NO: 522772 - RNA, 21 nt, Chlamydophila pneumoniae J138
uucuagcucauuaucaagaaa

SEQ ID NO: 522773 - RNA, 21 nt, Chlamydophila pneumoniae J138
uucuagcuaauaaugaagcag

SEQ ID NO: 522774 - RNA, 16 nt, Chlamydophila pneumoniae J138
uucuagcuaauaauga

SEQ ID NO: 522775 - RNA, 23 nt, Chlamydophila pneumoniae J138
uucuagggaucccaaaaaaugcc

SEQ ID NO: 522776 - RNA, 18 nt, Chlamydophila pneumoniae J138
uucuaggauuuagacuaa

SEQ ID NO: 522777 - RNA, 16 nt, Chlamydophila pneumoniae J138
uucuaggaauugcugu

SEQ ID NO: 522778 - RNA, 20 nt, Chlamydophila pneumoniae J138
uucuaggggagguaaaauaa

SEQ ID NO: 522779 - RNA, 19 nt, Chlamydophila pneumoniae J138
uucggaguuggaucaagga

SEQ ID NO: 522780 - RNA, 22 nt, Chlamydophila pneumoniae J138
uucguacaguuuuuuucuaaau

SEQ ID NO: 522781 - RNA, 19 nt, Chlamydophila pneumoniae J138
uucguaacgcuuuucuaau

SEQ ID NO: 522782 - RNA, 16 nt, Chlamydophila pneumoniae J138
uucgucuaaaauaacc

SEQ ID NO: 522783 - RNA, 20 nt, Chlamydophila pneumoniae J138
uucgucuaaaauaaccccuc

SEQ ID NO: 522784 - RNA, 22 nt, Chlamydophila pneumoniae J138
uucuaacgcuuuuucaaacugu

SEQ ID NO: 522785 - RNA, 17 nt, Chlamydophila pneumoniae J138
uucuaaauagaaaacau

SEQ ID NO: 522786 - RNA, 19 nt, Chlamydophila pneumoniae J138
uucugaaauugucuucagu

SEQ ID NO: 522787 - RNA, 16 nt, Chlamydophila pneumoniae J138
uucugaaaucaaaaaa

SEQ ID NO: 522788 - RNA, 15 nt, Chlamydophila pneumoniae J138
uucugaaacaaugca

SEQ ID NO: 522789 - RNA, 23 nt, Chlamydophila pneumoniae J138
uucugaaggaaaucccgaaugug

SEQ ID NO: 522790 - RNA, 14 nt, Chlamydophila pneumoniae J138
uucugaauagcucu

SEQ ID NO: 522791 - RNA, 14 nt, Chlamydophila pneumoniae J138
uucugacaauaaca

SEQ ID NO: 522792 - RNA, 17 nt, Chlamydophila pneumoniae J138
uucucuaagcagccucu

SEQ ID NO: 522793 - RNA, 22 nt, Chlamydophila pneumoniae J138
uucuguaaagugaaauugaacu

SEQ ID NO: 522794 - RNA, 15 nt, Chlamydophila pneumoniae J138
uucuggaauuuccca

SEQ ID NO: 522795 - RNA, 13 nt, Chlamydophila pneumoniae J138
uucuggauucaaa

SEQ ID NO: 522796 - RNA, 15 nt, Chlamydophila pneumoniae J138
uucugcuucuguaaa

SEQ ID NO: 522797 - RNA, 22 nt, Chlamydophila pneumoniae J138
uucugcuucuccaaauaaagca

SEQ ID NO: 522798 - RNA, 22 nt, Chlamydophila pneumoniae J138
uucugauuagagccccaacccu

SEQ ID NO: 522799 - RNA, 14 nt, Chlamydophila pneumoniae J138
uucugagcuugccu

SEQ ID NO: 522800 - RNA, 20 nt, Chlamydophila pneumoniae J138
uucuugauccaucugcucuu

SEQ ID NO: 522801 - RNA, 19 nt, Chlamydophila pneumoniae J138
uucuugaaguucuucaaga

SEQ ID NO: 522802 - RNA, 14 nt, Chlamydophila pneumoniae J138
uucuugaagaucuc

SEQ ID NO: 522803 - RNA, 20 nt, Chlamydophila pneumoniae J138
uucuuccuguuccauaucaa

SEQ ID NO: 522804 - RNA, 12 nt, Chlamydophila pneumoniae J138
uucuuccuucuu

SEQ ID NO: 522805 - RNA, 18 nt, Chlamydophila pneumoniae J138
uucuucagcacuuuuauu

SEQ ID NO: 522806 - RNA, 21 nt, Chlamydophila pneumoniae J138
uucuucagaguugucaaguaa

SEQ ID NO: 522807 - RNA, 23 nt, Chlamydophila pneumoniae J138
uucuuccaaagacugagcuucua

SEQ ID NO: 522808 - RNA, 18 nt, Chlamydophila pneumoniae J138
uucuuccaaagcuucuuu

SEQ ID NO: 522809 - RNA, 21 nt, Chlamydophila pneumoniae J138
uucuguaauuuuuuucaaagg

SEQ ID NO: 522810 - RNA, 23 nt, Chlamydophila pneumoniae J138
uucuuacuaaagaaagagucuca

SEQ ID NO: 522811 - RNA, 19 nt, Chlamydophila pneumoniae J138
uucuuagcgcauguauugu

SEQ ID NO: 522812 - RNA, 22 nt, Chlamydophila pneumoniae J138
uucuuagcgcauguauuguguu

SEQ ID NO: 522813 - RNA, 15 nt, Chlamydophila pneumoniae J138
uucuuagcgcaugua

SEQ ID NO: 522814 - RNA, 21 nt, Chlamydophila pneumoniae J138
uucuucaaagaacuuaaaauu

SEQ ID NO: 522815 - RNA, 17 nt, Chlamydophila pneumoniae J138
uucuucaaagcuacuaa

SEQ ID NO: 522816 - RNA, 16 nt, Chlamydophila pneumoniae J138
uucuucaagaaaugcc

SEQ ID NO: 522817 - RNA, 22 nt, Chlamydophila pneumoniae J138
uucuucaauaggaauuagagaa

SEQ ID NO: 522818 - RNA, 19 nt, Chlamydophila pneumoniae J138
uugaacguagcuacaaaau

SEQ ID NO: 522819 - RNA, 16 nt, Chlamydophila pneumoniae J138
uugaagaacaaaaaau

SEQ ID NO: 522820 - RNA, 18 nt, Chlamydophila pneumoniae J138
uugaagaaguacaaguga

SEQ ID NO: 522821 - RNA, 18 nt, Chlamydophila pneumoniae J138
uugacaauaggcacccaa

SEQ ID NO: 522822 - RNA, 19 nt, Chlamydophila pneumoniae J138
uugacaaucgcuguaaauu

SEQ ID NO: 522823 - RNA, 14 nt, Chlamydophila pneumoniae J138
uugacaauaagaaa

SEQ ID NO: 522824 - RNA, 22 nt, Chlamydophila pneumoniae J138
uucuugcgacauaaccaucgau

SEQ ID NO: 522825 - RNA, 15 nt, Chlamydophila pneumoniae J138
uucuugcaaagauaa

SEQ ID NO: 522826 - RNA, 21 nt, Chlamydophila pneumoniae J138
uucuuggaauauagguuuaga

SEQ ID NO: 522827 - RNA, 22 nt, Chlamydophila pneumoniae J138
uucuugcucugacaaguguguu

SEQ ID NO: 522828 - RNA, 21 nt, Chlamydophila pneumoniae J138
uucuugguguauaguauuuuu

SEQ ID NO: 522829 - RNA, 21 nt, Chlamydophila pneumoniae J138
uucuugguaggaugucgcuuu

SEQ ID NO: 522830 - RNA, 14 nt, Chlamydophila pneumoniae J138
uucuuguagcuccc

SEQ ID NO: 522831 - RNA, 20 nt, Chlamydophila pneumoniae J138
uucuuguaauaaaagaacau

SEQ ID NO: 522832 - RNA, 18 nt, Chlamydophila pneumoniae J138
uucuuguaauaaaagaac

SEQ ID NO: 522833 - RNA, 12 nt, Chlamydophila pneumoniae J138
uucuuucuuacu

SEQ ID NO: 522834 - RNA, 22 nt, Chlamydophila pneumoniae J138
uucuuggucggaguuuuuuucu

SEQ ID NO: 522835 - RNA, 12 nt, Chlamydophila pneumoniae J138
uucuuucuugcu

SEQ ID NO: 522836 - RNA, 22 nt, Chlamydophila pneumoniae J138
uucuuugaagaacaaaaaauca

SEQ ID NO: 522837 - RNA, 21 nt, Chlamydophila pneumoniae J138
uucuuugaagaacaaaaaauc

SEQ ID NO: 522838 - RNA, 20 nt, Chlamydophila pneumoniae J138
uugaaacgcccuucaggaca

SEQ ID NO: 522839 - RNA, 22 nt, Chlamydophila pneumoniae J138
uucuuuuuuuauaaagaagaaa

SEQ ID NO: 522840 - RNA, 14 nt, Chlamydophila pneumoniae J138
uugaucuacaaaaa

SEQ ID NO: 522841 - RNA, 18 nt, Chlamydophila pneumoniae J138
uugauccuuuccaagaag

SEQ ID NO: 522842 - RNA, 17 nt, Chlamydophila pneumoniae J138
uugauauuaucuuguaa

SEQ ID NO: 522843 - RNA, 23 nt, Chlamydophila pneumoniae J138
uugauaacuuugcaugaggagac

SEQ ID NO: 522844 - RNA, 15 nt, Chlamydophila pneumoniae J138
uugauaacaguagcg

SEQ ID NO: 522845 - RNA, 13 nt, Chlamydophila pneumoniae J138
uugauaaaacgcu

SEQ ID NO: 522846 - RNA, 15 nt, Chlamydophila pneumoniae J138
uugagcaucacggag

SEQ ID NO: 522847 - RNA, 19 nt, Chlamydophila pneumoniae J138
uugagcuaacgacauugaa

SEQ ID NO: 522848 - RNA, 13 nt, Chlamydophila pneumoniae J138
uugagcucucuag

SEQ ID NO: 522849 - RNA, 16 nt, Chlamydophila pneumoniae J138
uugagucuuuuucaga

SEQ ID NO: 522850 - RNA, 19 nt, Chlamydophila pneumoniae J138
uugaguuccgaauaggcau

SEQ ID NO: 522851 - RNA, 17 nt, Chlamydophila pneumoniae J138
uugaugagaaaaagaau

SEQ ID NO: 522852 - RNA, 16 nt, Chlamydophila pneumoniae J138
uugauugaacagucuu

SEQ ID NO: 522853 - RNA, 15 nt, Chlamydophila pneumoniae J138
uugauuccaaugacg

SEQ ID NO: 522854 - RNA, 14 nt, Chlamydophila pneumoniae J138
uugcaaucuuugaa

SEQ ID NO: 522855 - RNA, 21 nt, Chlamydophila pneumoniae J138
uugcaauaccaauugggcuag

SEQ ID NO: 522856 - RNA, 21 nt, Chlamydophila pneumoniae J138
uugcaauucuucaugcugcuu

SEQ ID NO: 522857 - RNA, 15 nt, Chlamydophila pneumoniae J138
uugcaauuuucuaaa

SEQ ID NO: 522858 - RNA, 20 nt, Chlamydophila pneumoniae J138
uugccgugaguugcaauugc

SEQ ID NO: 522859 - RNA, 18 nt, Chlamydophila pneumoniae J138
uugccgugaguugcaauu

SEQ ID NO: 522860 - RNA, 16 nt, Chlamydophila pneumoniae J138
uugcauagacaugcga

SEQ ID NO: 522861 - RNA, 12 nt, Chlamydophila pneumoniae J138
uugccagcagaa

SEQ ID NO: 522862 - RNA, 19 nt, Chlamydophila pneumoniae J138
uugcagcucggaaugcucu

SEQ ID NO: 522863 - RNA, 19 nt, Chlamydophila pneumoniae J138
uugcggauuugcauuaccu

SEQ ID NO: 522864 - RNA, 15 nt, Chlamydophila pneumoniae J138
uugcgccagcaaaga

SEQ ID NO: 522865 - RNA, 16 nt, Chlamydophila pneumoniae J138
uugcggaaauugaaua

SEQ ID NO: 522866 - RNA, 14 nt, Chlamydophila pneumoniae J138
uugcuacagcuucu

SEQ ID NO: 522867 - RNA, 18 nt, Chlamydophila pneumoniae J138
uugcuagaucuggagagg

SEQ ID NO: 522868 - RNA, 20 nt, Chlamydophila pneumoniae J138
uugcuaagagcucuuucccu

SEQ ID NO: 522869 - RNA, 18 nt, Chlamydophila pneumoniae J138
uugcugcggccacauuaa

SEQ ID NO: 522870 - RNA, 15 nt, Chlamydophila pneumoniae J138
uugcugaaaaugauu

SEQ ID NO: 522871 - RNA, 17 nt, Chlamydophila pneumoniae J138
uugcucuagucuuucaa

SEQ ID NO: 522872 - RNA, 23 nt, Chlamydophila pneumoniae J138
uugcucuaccaacugagcuauuu

SEQ ID NO: 522873 - RNA, 15 nt, Chlamydophila pneumoniae J138
uugcuauugaaaaau

SEQ ID NO: 522874 - RNA, 14 nt, Chlamydophila pneumoniae J138
uuggcaauagcuuu

SEQ ID NO: 522875 - RNA, 14 nt, Chlamydophila pneumoniae J138
uuggcacaauccuc

SEQ ID NO: 522876 - RNA, 15 nt, Chlamydophila pneumoniae J138
uuggauuucuucuuc

SEQ ID NO: 522877 - RNA, 15 nt, Chlamydophila pneumoniae J138
uuggaaaucagaauc

SEQ ID NO: 522878 - RNA, 22 nt, Chlamydophila pneumoniae J138
uugcuugcuauagggaucuccu

SEQ ID NO: 522879 - RNA, 15 nt, Chlamydophila pneumoniae J138
uugcugcucuccaaa

SEQ ID NO: 522880 - RNA, 19 nt, Chlamydophila pneumoniae J138
uugcuguagcgcuuccagc

SEQ ID NO: 522881 - RNA, 13 nt, Chlamydophila pneumoniae J138
uugggaggaggag

SEQ ID NO: 522882 - RNA, 19 nt, Chlamydophila pneumoniae J138
uugggagaugcuauuuacu

SEQ ID NO: 522883 - RNA, 16 nt, Chlamydophila pneumoniae J138
uugggauaaaaaguuu

SEQ ID NO: 522884 - RNA, 14 nt, Chlamydophila pneumoniae J138
uugggaaaagaaaa

SEQ ID NO: 522885 - RNA, 15 nt, Chlamydophila pneumoniae J138
uugggaaaagaaaag

SEQ ID NO: 522886 - RNA, 17 nt, Chlamydophila pneumoniae J138
uuggcuuuugagauuca

SEQ ID NO: 522887 - RNA, 14 nt, Chlamydophila pneumoniae J138
uugucugaggacag

SEQ ID NO: 522888 - RNA, 23 nt, Chlamydophila pneumoniae J138
uugucugaggacaguauucccuc

SEQ ID NO: 522889 - RNA, 13 nt, Chlamydophila pneumoniae J138
uugucuuccauaa

SEQ ID NO: 522890 - RNA, 23 nt, Chlamydophila pneumoniae J138
uugucuuccacgaaggaaucuga

SEQ ID NO: 522891 - RNA, 21 nt, Chlamydophila pneumoniae J138
uugugaaaaucgcaccuugac

SEQ ID NO: 522892 - RNA, 21 nt, Chlamydophila pneumoniae J138
uuguccuuugcuaagaacuag

SEQ ID NO: 522893 - RNA, 18 nt, Chlamydophila pneumoniae J138
uuguccuaggagagcuag

SEQ ID NO: 522894 - RNA, 17 nt, Chlamydophila pneumoniae J138
uugucaacaaaagcuau

SEQ ID NO: 522895 - RNA, 16 nt, Chlamydophila pneumoniae J138
uuguauucagugucuu

SEQ ID NO: 522896 - RNA, 23 nt, Chlamydophila pneumoniae J138
uuguauggaauucaaacuccuuu

SEQ ID NO: 522897 - RNA, 12 nt, Chlamydophila pneumoniae J138
uuguauucagug

SEQ ID NO: 522898 - RNA, 19 nt, Chlamydophila pneumoniae J138
uuguauggcagccuggaaa

SEQ ID NO: 522899 - RNA, 14 nt, Chlamydophila pneumoniae J138
uuguaaauacaaaa

SEQ ID NO: 522900 - RNA, 20 nt, Chlamydophila pneumoniae J138
uuguaaauaguauacaagcg

SEQ ID NO: 522901 - RNA, 21 nt, Chlamydophila pneumoniae J138
uuguaagcagugugcugauuu

SEQ ID NO: 522902 - RNA, 18 nt, Chlamydophila pneumoniae J138
uuguaacuucguuagaaa

SEQ ID NO: 522903 - RNA, 17 nt, Chlamydophila pneumoniae J138
uuguucuugaaguucuu

SEQ ID NO: 522904 - RNA, 18 nt, Chlamydophila pneumoniae J138
uuguuuaugcauacguua

SEQ ID NO: 522905 - RNA, 13 nt, Chlamydophila pneumoniae J138
uugugagcugcug

SEQ ID NO: 522906 - RNA, 22 nt, Chlamydophila pneumoniae J138
uuguggcuuuucuaaagcguuu

SEQ ID NO: 522907 - RNA, 16 nt, Chlamydophila pneumoniae J138
uuguggcuuuucuaaa

SEQ ID NO: 522908 - RNA, 17 nt, Chlamydophila pneumoniae J138
uugugauccuugcaaaa

SEQ ID NO: 522909 - RNA, 15 nt, Chlamydophila pneumoniae J138
uugugaguucuuccu

SEQ ID NO: 522910 - RNA, 13 nt, Chlamydophila pneumoniae J138
uuguuaucaggaa

SEQ ID NO: 522911 - RNA, 21 nt, Chlamydophila pneumoniae J138
uuguuagugagaucaaaaaua

SEQ ID NO: 522912 - RNA, 17 nt, Chlamydophila pneumoniae J138
uuuaaaaauagaaauaa

SEQ ID NO: 522913 - RNA, 21 nt, Chlamydophila pneumoniae J138
uuuaaaaacucuuucauaaga

SEQ ID NO: 522914 - RNA, 14 nt, Chlamydophila pneumoniae J138
uuguuuguaucaaa

SEQ ID NO: 522915 - RNA, 19 nt, Chlamydophila pneumoniae J138
uuuaaauuuuguuuuucca

SEQ ID NO: 522916 - RNA, 20 nt, Chlamydophila pneumoniae J138
uuuaaaguguguaaauguuu

SEQ ID NO: 522917 - RNA, 12 nt, Chlamydophila pneumoniae J138
uuuaagauuuuu

SEQ ID NO: 522918 - RNA, 18 nt, Chlamydophila pneumoniae J138
uuuaagacaauauaagca

SEQ ID NO: 522919 - RNA, 14 nt, Chlamydophila pneumoniae J138
uuuaagaccuucug

SEQ ID NO: 522920 - RNA, 18 nt, Chlamydophila pneumoniae J138
uuuaagaagaagaaaaau

SEQ ID NO: 522921 - RNA, 17 nt, Chlamydophila pneumoniae J138
uuuaacuucuaaaagca

SEQ ID NO: 522922 - RNA, 18 nt, Chlamydophila pneumoniae J138
uuuaagguugcuuuucua

SEQ ID NO: 522923 - RNA, 15 nt, Chlamydophila pneumoniae J138
uuuaaugaucacgug

SEQ ID NO: 522924 - RNA, 15 nt, Chlamydophila pneumoniae J138
uuuaauccaguuuuu

SEQ ID NO: 522925 - RNA, 23 nt, Chlamydophila pneumoniae J138
uuuaauccaaaaacuucuaacug

SEQ ID NO: 522926 - RNA, 13 nt, Chlamydophila pneumoniae J138
uuuaaucagagga

SEQ ID NO: 522927 - RNA, 17 nt, Chlamydophila pneumoniae J138
uuuaccagaaaugggca

SEQ ID NO: 522928 - RNA, 16 nt, Chlamydophila pneumoniae J138
uuuacaaucucugcga

SEQ ID NO: 522929 - RNA, 17 nt, Chlamydophila pneumoniae J138
uuccggguucauuucca

SEQ ID NO: 522930 - RNA, 22 nt, Chlamydophila pneumoniae J138
uuccuaaacgacguuuaauucc

SEQ ID NO: 522931 - RNA, 13 nt, Chlamydophila pneumoniae J138
uuccuaacuucug

SEQ ID NO: 522932 - RNA, 19 nt, Chlamydophila pneumoniae J138
uuccuaacuaucucuguuu

SEQ ID NO: 522933 - RNA, 21 nt, Chlamydophila pneumoniae J138
uuccuaacuaucucuguuuuu

SEQ ID NO: 522934 - RNA, 16 nt, Chlamydophila pneumoniae J138
uuccuaacuucugaag

SEQ ID NO: 522935 - RNA, 16 nt, Chlamydophila pneumoniae J138
uuccugacuauaaaau

SEQ ID NO: 522936 - RNA, 18 nt, Chlamydophila pneumoniae J138
uuccugacuauaaaaugc

SEQ ID NO: 522937 - RNA, 18 nt, Chlamydophila pneumoniae J138
uuccugaagcagcuucug

SEQ ID NO: 522938 - RNA, 17 nt, Chlamydophila pneumoniae J138
uuccucuucaauuucuu

SEQ ID NO: 522939 - RNA, 22 nt, Chlamydophila pneumoniae J138
uuccucgaguauggcaaauaaa

SEQ ID NO: 522940 - RNA, 17 nt, Chlamydophila pneumoniae J138
uuccucgagcuaccaga

SEQ ID NO: 522941 - RNA, 16 nt, Chlamydophila pneumoniae J138
uuccuacgacaugccu

SEQ ID NO: 522942 - RNA, 16 nt, Chlamydophila pneumoniae J138
uuccuacuucugcagg

SEQ ID NO: 522943 - RNA, 15 nt, Chlamydophila pneumoniae J138
uuccuaaguuagaga

SEQ ID NO: 522944 - RNA, 20 nt, Chlamydophila pneumoniae J138
uuccuacaucugugauuaau

SEQ ID NO: 522945 - RNA, 12 nt, Chlamydophila pneumoniae J138
uuccuaccuaua

SEQ ID NO: 522946 - RNA, 23 nt, Chlamydophila pneumoniae J138
uuccugcauggcuuugugagcug

SEQ ID NO: 522947 - RNA, 23 nt, Chlamydophila pneumoniae J138
uuccuuaaugagaguuucuaaug

SEQ ID NO: 522948 - RNA, 19 nt, Chlamydophila pneumoniae J138
uuccuuaaugguagcuuaa

SEQ ID NO: 522949 - RNA, 20 nt, Chlamydophila pneumoniae J138
uuccuuacaagcuuccuugg

SEQ ID NO: 522950 - RNA, 23 nt, Chlamydophila pneumoniae J138
uuccuguuguacuaucacagcca

SEQ ID NO: 522951 - RNA, 22 nt, Chlamydophila pneumoniae J138
uuccuuuuucugcuucuccaaa

SEQ ID NO: 522952 - RNA, 12 nt, Chlamydophila pneumoniae J138
uuccuuuucucc

SEQ ID NO: 522953 - RNA, 17 nt, Chlamydophila pneumoniae J138
uuccuugggaggaggag

SEQ ID NO: 522954 - RNA, 17 nt, Chlamydophila pneumoniae J138
uuccuuggauuucuucu

SEQ ID NO: 522955 - RNA, 22 nt, Chlamydophila pneumoniae J138
uuccuuggcauacucuauuaag

SEQ ID NO: 522956 - RNA, 22 nt, Chlamydophila pneumoniae J138
uuccuucuccagagcaagauuu

SEQ ID NO: 522957 - RNA, 12 nt, Chlamydophila pneumoniae J138
uuccuucuccug

SEQ ID NO: 522958 - RNA, 13 nt, Chlamydophila pneumoniae J138
uucgacucuccac

SEQ ID NO: 522959 - RNA, 19 nt, Chlamydophila pneumoniae J138
uucgacuauaagagguucu

SEQ ID NO: 522960 - RNA, 22 nt, Chlamydophila pneumoniae J138
uucgacaacaacauaaagaagg

SEQ ID NO: 522961 - RNA, 18 nt, Chlamydophila pneumoniae J138
uucgacaaccaaaacaga

SEQ ID NO: 522962 - RNA, 21 nt, Chlamydophila pneumoniae J138
uucgacaacaacauaaagaag

SEQ ID NO: 522963 - RNA, 23 nt, Chlamydophila pneumoniae J138
uucgcaaauauaguuuucauaau

SEQ ID NO: 522964 - RNA, 15 nt, Chlamydophila pneumoniae J138
uucgcaaauuuuucg

SEQ ID NO: 522965 - RNA, 18 nt, Chlamydophila pneumoniae J138
uucgauguuaaggcuucc

SEQ ID NO: 522966 - RNA, 21 nt, Chlamydophila pneumoniae J138
uucgccaaacgaauuucuugu

SEQ ID NO: 522967 - RNA, 17 nt, Chlamydophila pneumoniae J138
uucgcuacauaaaauga

SEQ ID NO: 522968 - RNA, 16 nt, Chlamydophila pneumoniae J138
uuccccuaauagggga

SEQ ID NO: 522969 - RNA, 18 nt, Chlamydophila pneumoniae J138
uucccaucuuguucuaaa

SEQ ID NO: 522970 - RNA, 22 nt, Chlamydophila pneumoniae J138
uucccaucuuguucuaaaauga

SEQ ID NO: 522971 - RNA, 17 nt, Chlamydophila pneumoniae J138
uuccccaaacuuagcuc

SEQ ID NO: 522972 - RNA, 16 nt, Chlamydophila pneumoniae J138
uuccauuuuuccuccu

SEQ ID NO: 522973 - RNA, 23 nt, Chlamydophila pneumoniae J138
uucccaagcugaaagaaugccau

SEQ ID NO: 522974 - RNA, 14 nt, Chlamydophila pneumoniae J138
uucccucuucuucc

SEQ ID NO: 522975 - RNA, 18 nt, Chlamydophila pneumoniae J138
uucccuguccgcaauagu

SEQ ID NO: 522976 - RNA, 21 nt, Chlamydophila pneumoniae J138
uucccuuguuaugaaaaucuu

SEQ ID NO: 522977 - RNA, 23 nt, Chlamydophila pneumoniae J138
uucccuuuaaaaguacgaccaac

SEQ ID NO: 522978 - RNA, 15 nt, Chlamydophila pneumoniae J138
uucccuauaaagcaa

SEQ ID NO: 522979 - RNA, 22 nt, Chlamydophila pneumoniae J138
uucccucuucuuccaauaauuu

SEQ ID NO: 522980 - RNA, 17 nt, Chlamydophila pneumoniae J138
uucccuaagaguuccaa

SEQ ID NO: 522981 - RNA, 15 nt, Chlamydophila pneumoniae J138
uuccgcggccaucau

SEQ ID NO: 522982 - RNA, 21 nt, Chlamydophila pneumoniae J138
uuccgauuaguaaugauguag

SEQ ID NO: 522983 - RNA, 20 nt, Chlamydophila pneumoniae J138
uuccgacccagucaaaauau

SEQ ID NO: 522984 - RNA, 20 nt, Chlamydophila pneumoniae J138
uuccaggacguaaaaagaaa

SEQ ID NO: 522985 - RNA, 18 nt, Chlamydophila pneumoniae J138
uuccauaucaaagaucug

SEQ ID NO: 522986 - RNA, 20 nt, Chlamydophila pneumoniae J138
uuccauagccaaggagcuau

SEQ ID NO: 522987 - RNA, 21 nt, Chlamydophila pneumoniae J138
uuccauagguuagaaaugaaa

SEQ ID NO: 522988 - RNA, 17 nt, Chlamydophila pneumoniae J138
uuccaagugaucagaaa

SEQ ID NO: 522989 - RNA, 12 nt, Chlamydophila pneumoniae J138
uuccaagugauc

SEQ ID NO: 522990 - RNA, 21 nt, Chlamydophila pneumoniae J138
uuccaacuuuugaagauccug

SEQ ID NO: 522991 - RNA, 14 nt, Chlamydophila pneumoniae J138
uuccaagaaaaauu

SEQ ID NO: 522992 - RNA, 13 nt, Chlamydophila pneumoniae J138
uuccaagagucuu

SEQ ID NO: 522993 - RNA, 21 nt, Chlamydophila pneumoniae J138
uuccaagacaauaaaaaagag

SEQ ID NO: 522994 - RNA, 16 nt, Chlamydophila pneumoniae J138
uuccaaaauaaaagga

SEQ ID NO: 522995 - RNA, 13 nt, Chlamydophila pneumoniae J138
uuccaaagacuga

SEQ ID NO: 522996 - RNA, 14 nt, Chlamydophila pneumoniae J138
uuccaaaggaaaau

SEQ ID NO: 522997 - RNA, 17 nt, Chlamydophila pneumoniae J138
uuccaauccauucugag

SEQ ID NO: 522998 - RNA, 20 nt, Chlamydophila pneumoniae J138
uuccaauccauucugagaaa

SEQ ID NO: 522999 - RNA, 17 nt, Chlamydophila pneumoniae J138
uuccaauacuaaaacua

SEQ ID NO: 523000 - RNA, 17 nt, Chlamydophila pneumoniae J138
uuccaauagagucucuu

SEQ ID NO: 523001 - RNA, 16 nt, Chlamydophila pneumoniae J138
uuccaauuguaaauca

SEQ ID NO: 523002 - RNA, 18 nt, Chlamydophila pneumoniae J138
uuccacagagaccuucuc

SEQ ID NO: 523003 - RNA, 13 nt, Chlamydophila pneumoniae J138
uucagcuuugcuu

SEQ ID NO: 523004 - RNA, 15 nt, Chlamydophila pneumoniae J138
uucagccgcaucaug

SEQ ID NO: 523005 - RNA, 14 nt, Chlamydophila pneumoniae J138
uucaggauuuagag

SEQ ID NO: 523006 - RNA, 16 nt, Chlamydophila pneumoniae J138
uucaggacaugccuua

SEQ ID NO: 523007 - RNA, 17 nt, Chlamydophila pneumoniae J138
uucaggacaugccuuag

SEQ ID NO: 523008 - RNA, 13 nt, Chlamydophila pneumoniae J138
uucaguuccucau

SEQ ID NO: 523009 - RNA, 20 nt, Chlamydophila pneumoniae J138
uucaguuuuaucggcaauug

SEQ ID NO: 523010 - RNA, 13 nt, Chlamydophila pneumoniae J138
uucauaagauugc

SEQ ID NO: 523011 - RNA, 16 nt, Chlamydophila pneumoniae J138
uucauagcauguucga

SEQ ID NO: 523012 - RNA, 13 nt, Chlamydophila pneumoniae J138
uucauacguuuuu

SEQ ID NO: 523013 - RNA, 15 nt, Chlamydophila pneumoniae J138
uucaucaaaacauaa

SEQ ID NO: 523014 - RNA, 16 nt, Chlamydophila pneumoniae J138
uucauauaaaguuucc

SEQ ID NO: 523015 - RNA, 18 nt, Chlamydophila pneumoniae J138
uucauuccaggauucuau

SEQ ID NO: 523016 - RNA, 15 nt, Chlamydophila pneumoniae J138
uucauucacagcagu

SEQ ID NO: 523017 - RNA, 13 nt, Chlamydophila pneumoniae J138
uucauucacagca

SEQ ID NO: 523018 - RNA, 15 nt, Chlamydophila pneumoniae J138
uucauucuuucgaua

SEQ ID NO: 523019 - RNA, 13 nt, Chlamydophila pneumoniae J138
uucauuaagaucc

SEQ ID NO: 523020 - RNA, 16 nt, Chlamydophila pneumoniae J138
uucauuaagaacaucu

SEQ ID NO: 523021 - RNA, 22 nt, Chlamydophila pneumoniae J138
uucauguccuccauggaaagaa

SEQ ID NO: 523022 - RNA, 17 nt, Chlamydophila pneumoniae J138
uucaucaggagaacggu

SEQ ID NO: 523023 - RNA, 19 nt, Chlamydophila pneumoniae J138
uucaucccuacccucauca

SEQ ID NO: 523024 - RNA, 14 nt, Chlamydophila pneumoniae J138
uucaucgauaggau

SEQ ID NO: 523025 - RNA, 14 nt, Chlamydophila pneumoniae J138
uucaucuagaugau

SEQ ID NO: 523026 - RNA, 15 nt, Chlamydophila pneumoniae J138
uucaucugucauuaa

SEQ ID NO: 523027 - RNA, 12 nt, Chlamydophila pneumoniae J138
uucaucuucuuu

SEQ ID NO: 523028 - RNA, 21 nt, Chlamydophila pneumoniae J138
uucacaucuuucucuaaaaua

SEQ ID NO: 523029 - RNA, 22 nt, Chlamydophila pneumoniae J138
uucacaucuuuagaaucaagag

SEQ ID NO: 523030 - RNA, 17 nt, Chlamydophila pneumoniae J138
uucacauacauucuauu

SEQ ID NO: 523031 - RNA, 17 nt, Chlamydophila pneumoniae J138
uucacauaguuuaauaa

SEQ ID NO: 523032 - RNA, 20 nt, Chlamydophila pneumoniae J138
uucaccagaagcauugagga

SEQ ID NO: 523033 - RNA, 13 nt, Chlamydophila pneumoniae J138
uucaccagaagca

SEQ ID NO: 523034 - RNA, 21 nt, Chlamydophila pneumoniae J138
uucacaagcugguagacuucu

SEQ ID NO: 523035 - RNA, 15 nt, Chlamydophila pneumoniae J138
uucacaagaaaacaa

SEQ ID NO: 523036 - RNA, 16 nt, Chlamydophila pneumoniae J138
uucacaaucuaaauaa

SEQ ID NO: 523037 - RNA, 23 nt, Chlamydophila pneumoniae J138
uucacaaaucuuccccuaaaaau

SEQ ID NO: 523038 - RNA, 19 nt, Chlamydophila pneumoniae J138
uucaagucgagaaacaaaa

SEQ ID NO: 523039 - RNA, 12 nt, Chlamydophila pneumoniae J138
uucaagcuuucg

SEQ ID NO: 523040 - RNA, 20 nt, Chlamydophila pneumoniae J138
uucaaggaacauuugagcaa

SEQ ID NO: 523041 - RNA, 20 nt, Chlamydophila pneumoniae J138
uucaauaaccagaagacucc

SEQ ID NO: 523042 - RNA, 23 nt, Chlamydophila pneumoniae J138
uucaauaauaucgguuccuauau

SEQ ID NO: 523043 - RNA, 23 nt, Chlamydophila pneumoniae J138
uucaauaggaauuagagaaauuu

SEQ ID NO: 523044 - RNA, 23 nt, Chlamydophila pneumoniae J138
uucaauccccugcaucucugcau

SEQ ID NO: 523045 - RNA, 15 nt, Chlamydophila pneumoniae J138
uucaaugauguguug

SEQ ID NO: 523046 - RNA, 21 nt, Chlamydophila pneumoniae J138
uucaaugauuucuuuagcuuu

SEQ ID NO: 523047 - RNA, 14 nt, Chlamydophila pneumoniae J138
uucaaugauguguu

SEQ ID NO: 523048 - RNA, 15 nt, Chlamydophila pneumoniae J138
uucaaugagcaucug

SEQ ID NO: 523049 - RNA, 13 nt, Chlamydophila pneumoniae J138
uucaaucucuccu

SEQ ID NO: 523050 - RNA, 20 nt, Chlamydophila pneumoniae J138
uucaaugacuucuggaucuu

SEQ ID NO: 523051 - RNA, 15 nt, Chlamydophila pneumoniae J138
uucaaugaagaaaaa

SEQ ID NO: 523052 - RNA, 13 nt, Chlamydophila pneumoniae J138
uucaaugaaagcu

SEQ ID NO: 523053 - RNA, 23 nt, Chlamydophila pneumoniae J138
uucaaucucuccuugacaaauaa

SEQ ID NO: 523054 - RNA, 15 nt, Chlamydophila pneumoniae J138
uucacgacauacauc

SEQ ID NO: 523055 - RNA, 23 nt, Chlamydophila pneumoniae J138
uucacgacauacaucaaaaugcu

SEQ ID NO: 523056 - RNA, 16 nt, Chlamydophila pneumoniae J138
uucaccuugaaguuuu

SEQ ID NO: 523057 - RNA, 22 nt, Chlamydophila pneumoniae J138
uucacccucauuaagaggaguc

SEQ ID NO: 523058 - RNA, 11 nt, Chlamydophila pneumoniae J138
uucacuucauc

SEQ ID NO: 523059 - RNA, 19 nt, Chlamydophila pneumoniae J138
uucacuauuaggcuuuuuu

SEQ ID NO: 523060 - RNA, 17 nt, Chlamydophila pneumoniae J138
uucacguauagguugaa

SEQ ID NO: 523061 - RNA, 23 nt, Chlamydophila pneumoniae J138
uucagaaagacgaucuugagcca

SEQ ID NO: 523062 - RNA, 19 nt, Chlamydophila pneumoniae J138
uucacuugguagcgucucu

SEQ ID NO: 523063 - RNA, 16 nt, Chlamydophila pneumoniae J138
uucagaaggaucugau

SEQ ID NO: 523064 - RNA, 19 nt, Chlamydophila pneumoniae J138
uucagaaugcccuuuaggg

SEQ ID NO: 523065 - RNA, 16 nt, Chlamydophila pneumoniae J138
uucagaguugauuguc

SEQ ID NO: 523066 - RNA, 17 nt, Chlamydophila pneumoniae J138
uucagaggcuagaaaau

SEQ ID NO: 523067 - RNA, 19 nt, Chlamydophila pneumoniae J138
uucagaguggucauugccu

SEQ ID NO: 523068 - RNA, 15 nt, Chlamydophila pneumoniae J138
uucagcaagaaaaua

SEQ ID NO: 523069 - RNA, 15 nt, Chlamydophila pneumoniae J138
uucagaugauuuuau

SEQ ID NO: 523070 - RNA, 19 nt, Chlamydophila pneumoniae J138
uucagaugauuuuaucugc

SEQ ID NO: 523071 - RNA, 23 nt, Chlamydophila pneumoniae J138
uucagcaagucgguaauaccuuu

SEQ ID NO: 523072 - RNA, 12 nt, Chlamydophila pneumoniae J138
uucagcacuuuu

SEQ ID NO: 523073 - RNA, 17 nt, Chlamydophila pneumoniae J138
ugggaauucuuuuccug

SEQ ID NO: 523074 - RNA, 22 nt, Chlamydophila pneumoniae J138
ugggaauucuuuuccugcagca

SEQ ID NO: 523075 - RNA, 18 nt, Chlamydophila pneumoniae J138
ugggaagccuggaaauga

SEQ ID NO: 523076 - RNA, 16 nt, Chlamydophila pneumoniae J138
uggcugucuugaccaa

SEQ ID NO: 523077 - RNA, 15 nt, Chlamydophila pneumoniae J138
uggcugagagaagca

SEQ ID NO: 523078 - RNA, 16 nt, Chlamydophila pneumoniae J138
uggcugagagauaggg

SEQ ID NO: 523079 - RNA, 23 nt, Chlamydophila pneumoniae J138
ugggaauuugauuuuucaaauuc

SEQ ID NO: 523080 - RNA, 20 nt, Chlamydophila pneumoniae J138
ugggaauuugauuuuucaaa

SEQ ID NO: 523081 - RNA, 15 nt, Chlamydophila pneumoniae J138
ugggcgucuucuucg

SEQ ID NO: 523082 - RNA, 15 nt, Chlamydophila pneumoniae J138
uggugaagaauaaua

SEQ ID NO: 523083 - RNA, 17 nt, Chlamydophila pneumoniae J138
uggugaagaauaauagc

SEQ ID NO: 523084 - RNA, 17 nt, Chlamydophila pneumoniae J138
uggucuuggguuuuaaa

SEQ ID NO: 523085 - RNA, 21 nt, Chlamydophila pneumoniae J138
uggucuucuguaauuuuuuuc

SEQ ID NO: 523086 - RNA, 18 nt, Chlamydophila pneumoniae J138
uggucuguauuuucuuca

SEQ ID NO: 523087 - RNA, 17 nt, Chlamydophila pneumoniae J138
uggucggaguuuuuuuc

SEQ ID NO: 523088 - RNA, 17 nt, Chlamydophila pneumoniae J138
uggggcuuccagaaaca

SEQ ID NO: 523089 - RNA, 18 nt, Chlamydophila pneumoniae J138
ugguccauaauuucuuuc

SEQ ID NO: 523090 - RNA, 23 nt, Chlamydophila pneumoniae J138
ugguccauaauuucuuucacauc

SEQ ID NO: 523091 - RNA, 16 nt, Chlamydophila pneumoniae J138
ugguagcuaaauuuag

SEQ ID NO: 523092 - RNA, 21 nt, Chlamydophila pneumoniae J138
ugguaggaugucgcuuuugcu

SEQ ID NO: 523093 - RNA, 16 nt, Chlamydophila pneumoniae J138
ugguuccugaaaagca

SEQ ID NO: 523094 - RNA, 13 nt, Chlamydophila pneumoniae J138
ugguuccuggauu

SEQ ID NO: 523095 - RNA, 18 nt, Chlamydophila pneumoniae J138
ugguuaggguaaggcuua

SEQ ID NO: 523096 - RNA, 13 nt, Chlamydophila pneumoniae J138
ugguuaaaauaga

SEQ ID NO: 523097 - RNA, 16 nt, Chlamydophila pneumoniae J138
uguaagcgugcaaguu

SEQ ID NO: 523098 - RNA, 15 nt, Chlamydophila pneumoniae J138
uguaaauuuuuccuu

SEQ ID NO: 523099 - RNA, 14 nt, Chlamydophila pneumoniae J138
uguaaauuucauuu

SEQ ID NO: 523100 - RNA, 15 nt, Chlamydophila pneumoniae J138
ugguuuucuccuucu

SEQ ID NO: 523101 - RNA, 16 nt, Chlamydophila pneumoniae J138
ugguuuuucuccucuu

SEQ ID NO: 523102 - RNA, 16 nt, Chlamydophila pneumoniae J138
uguacacagagaugcu

SEQ ID NO: 523103 - RNA, 13 nt, Chlamydophila pneumoniae J138
uguacacagagau

SEQ ID NO: 523104 - RNA, 17 nt, Chlamydophila pneumoniae J138
uguaaucuugaucagca

SEQ ID NO: 523105 - RNA, 13 nt, Chlamydophila pneumoniae J138
uguacagaacaau

SEQ ID NO: 523106 - RNA, 20 nt, Chlamydophila pneumoniae J138
uguacaguuuguaaaaagcc

SEQ ID NO: 523107 - RNA, 20 nt, Chlamydophila pneumoniae J138
uguacaguaaaguaugcaua

SEQ ID NO: 523108 - RNA, 23 nt, Chlamydophila pneumoniae J138
uguacaguuuguaaaaagccuau

SEQ ID NO: 523109 - RNA, 18 nt, Chlamydophila pneumoniae J138
uguaucuguauccuuccu

SEQ ID NO: 523110 - RNA, 16 nt, Chlamydophila pneumoniae J138
uguauggaauucaaac

SEQ ID NO: 523111 - RNA, 18 nt, Chlamydophila pneumoniae J138
uguauuguguucccucuu

SEQ ID NO: 523112 - RNA, 16 nt, Chlamydophila pneumoniae J138
uguauucugaagcugc

SEQ ID NO: 523113 - RNA, 20 nt, Chlamydophila pneumoniae J138
ugucaaguaagucuucgaaa

SEQ ID NO: 523114 - RNA, 18 nt, Chlamydophila pneumoniae J138
ugucaucggcuucuccaa

SEQ ID NO: 523115 - RNA, 15 nt, Chlamydophila pneumoniae J138
ugucaucacaucagu

SEQ ID NO: 523116 - RNA, 19 nt, Chlamydophila pneumoniae J138
ugucauuaaaaauuuaaaa

SEQ ID NO: 523117 - RNA, 15 nt, Chlamydophila pneumoniae J138
uguccaacuaaaaca

SEQ ID NO: 523118 - RNA, 20 nt, Chlamydophila pneumoniae J138
uguccauccaaauagaguga

SEQ ID NO: 523119 - RNA, 11 nt, Chlamydophila pneumoniae J138
uguccagagac

SEQ ID NO: 523120 - RNA, 13 nt, Chlamydophila pneumoniae J138
uguccuugcagcc

SEQ ID NO: 523121 - RNA, 13 nt, Chlamydophila pneumoniae J138
uguccguauuuuu

SEQ ID NO: 523122 - RNA, 17 nt, Chlamydophila pneumoniae J138
uguccgugagcaacaag

SEQ ID NO: 523123 - RNA, 18 nt, Chlamydophila pneumoniae J138
ugucuaggagcuucgccu

SEQ ID NO: 523124 - RNA, 22 nt, Chlamydophila pneumoniae J138
ugucuacagaggaaucuauccu

SEQ ID NO: 523125 - RNA, 14 nt, Chlamydophila pneumoniae J138
ugucuccaaagaua

SEQ ID NO: 523126 - RNA, 21 nt, Chlamydophila pneumoniae J138
ugucuccaaauguucucucca

SEQ ID NO: 523127 - RNA, 15 nt, Chlamydophila pneumoniae J138
ugucuccauacagcg

SEQ ID NO: 523128 - RNA, 19 nt, Chlamydophila pneumoniae J138
ugucucugaagaccccucu

SEQ ID NO: 523129 - RNA, 17 nt, Chlamydophila pneumoniae J138
ugucgcuuucauuugua

SEQ ID NO: 523130 - RNA, 17 nt, Chlamydophila pneumoniae J138
ugucguaauugcugaaa

SEQ ID NO: 523131 - RNA, 15 nt, Chlamydophila pneumoniae J138
ugugaguucuuccuu

SEQ ID NO: 523132 - RNA, 16 nt, Chlamydophila pneumoniae J138
ugugauguucugcugc

SEQ ID NO: 523133 - RNA, 19 nt, Chlamydophila pneumoniae J138
ugugauccuugcaaaacag

SEQ ID NO: 523134 - RNA, 13 nt, Chlamydophila pneumoniae J138
ugucuuaucuaaa

SEQ ID NO: 523135 - RNA, 17 nt, Chlamydophila pneumoniae J138
ugucugcaaagagcaaa

SEQ ID NO: 523136 - RNA, 15 nt, Chlamydophila pneumoniae J138
ugucuugcugauuuu

SEQ ID NO: 523137 - RNA, 12 nt, Chlamydophila pneumoniae J138
ugucuuuuuaag

SEQ ID NO: 523138 - RNA, 12 nt, Chlamydophila pneumoniae J138
ugucuuuccagg

SEQ ID NO: 523139 - RNA, 18 nt, Chlamydophila pneumoniae J138
ugugcugaagaccaugaa

SEQ ID NO: 523140 - RNA, 16 nt, Chlamydophila pneumoniae J138
ugugcauuuucuucuu

SEQ ID NO: 523141 - RNA, 15 nt, Chlamydophila pneumoniae J138
ugugccaauuuuugu

SEQ ID NO: 523142 - RNA, 19 nt, Chlamydophila pneumoniae J138
uguggugaggagcuauuaa

SEQ ID NO: 523143 - RNA, 14 nt, Chlamydophila pneumoniae J138
uguuaaucuaauuu

SEQ ID NO: 523144 - RNA, 22 nt, Chlamydophila pneumoniae J138
uguguuauggaaaucaccagca

SEQ ID NO: 523145 - RNA, 13 nt, Chlamydophila pneumoniae J138
uguuaaucuaauu

SEQ ID NO: 523146 - RNA, 11 nt, Chlamydophila pneumoniae J138
uguucugcugc

SEQ ID NO: 523147 - RNA, 17 nt, Chlamydophila pneumoniae J138
uguucugcacguggcuu

SEQ ID NO: 523148 - RNA, 21 nt, Chlamydophila pneumoniae J138
uguugauaaaagguauuucuc

SEQ ID NO: 523149 - RNA, 18 nt, Chlamydophila pneumoniae J138
uguugaucucuaaaugga

SEQ ID NO: 523150 - RNA, 17 nt, Chlamydophila pneumoniae J138
uguugauccuucuuaug

SEQ ID NO: 523151 - RNA, 19 nt, Chlamydophila pneumoniae J138
uguugauccuucuuauggu

SEQ ID NO: 523152 - RNA, 13 nt, Chlamydophila pneumoniae J138
uguucuuccaacu

SEQ ID NO: 523153 - RNA, 20 nt, Chlamydophila pneumoniae J138
uguucuucuucagucauucu

SEQ ID NO: 523154 - RNA, 14 nt, Chlamydophila pneumoniae J138
uguugaauaagauu

SEQ ID NO: 523155 - RNA, 18 nt, Chlamydophila pneumoniae J138
uuacugaggaaaucgcau

SEQ ID NO: 523156 - RNA, 12 nt, Chlamydophila pneumoniae J138
uuacugaggaaa

SEQ ID NO: 523157 - RNA, 21 nt, Chlamydophila pneumoniae J138
uuacugaagaaguaagcgauu

SEQ ID NO: 523158 - RNA, 18 nt, Chlamydophila pneumoniae J138
uuacugugguauacaucc

SEQ ID NO: 523159 - RNA, 20 nt, Chlamydophila pneumoniae J138
uuacuuucuuuuagcuacuu

SEQ ID NO: 523160 - RNA, 18 nt, Chlamydophila pneumoniae J138
uuacuuuaaucaagccua

SEQ ID NO: 523161 - RNA, 22 nt, Chlamydophila pneumoniae J138
uuacuuuaaucaagccuaaauc

SEQ ID NO: 523162 - RNA, 23 nt, Chlamydophila pneumoniae J138
uuagaaguaauccuaauuccuuc

SEQ ID NO: 523163 - RNA, 17 nt, Chlamydophila pneumoniae J138
uuagaauaagagcuaca

SEQ ID NO: 523164 - RNA, 21 nt, Chlamydophila pneumoniae J138
uuagaauagaagauccucaaa

SEQ ID NO: 523165 - RNA, 22 nt, Chlamydophila pneumoniae J138
uuagaaucaaaagucaugagga

SEQ ID NO: 523166 - RNA, 21 nt, Chlamydophila pneumoniae J138
uuagaaucuuuucuagaaaac

SEQ ID NO: 523167 - RNA, 14 nt, Chlamydophila pneumoniae J138
uuacgaugagguug

SEQ ID NO: 523168 - RNA, 21 nt, Chlamydophila pneumoniae J138
uuaccaucgucuccaaaaauu

SEQ ID NO: 523169 - RNA, 23 nt, Chlamydophila pneumoniae J138
uuacuaaagaaagagucucacuc

SEQ ID NO: 523170 - RNA, 19 nt, Chlamydophila pneumoniae J138
uuacuaaaggugaaaguac

SEQ ID NO: 523171 - RNA, 12 nt, Chlamydophila pneumoniae J138
uuacgcucucca

SEQ ID NO: 523172 - RNA, 15 nt, Chlamydophila pneumoniae J138
uuaauacuuugccaa

SEQ ID NO: 523173 - RNA, 17 nt, Chlamydophila pneumoniae J138
uuaaugguagcuuaaga

SEQ ID NO: 523174 - RNA, 16 nt, Chlamydophila pneumoniae J138
uuacagaucugcauaa

SEQ ID NO: 523175 - RNA, 20 nt, Chlamydophila pneumoniae J138
uuacagaugcaugauccuau

SEQ ID NO: 523176 - RNA, 18 nt, Chlamydophila pneumoniae J138
uuacagcaucuauagaau

SEQ ID NO: 523177 - RNA, 18 nt, Chlamydophila pneumoniae J138
uuacagccuauugcaggg

SEQ ID NO: 523178 - RNA, 15 nt, Chlamydophila pneumoniae J138
uuacaaauaaaauga

SEQ ID NO: 523179 - RNA, 19 nt, Chlamydophila pneumoniae J138
uguugcggauuugcauuac

SEQ ID NO: 523180 - RNA, 16 nt, Chlamydophila pneumoniae J138
uuaaacccuucaagca

SEQ ID NO: 523181 - RNA, 20 nt, Chlamydophila pneumoniae J138
uuaaacccaauucuuaaaaa

SEQ ID NO: 523182 - RNA, 15 nt, Chlamydophila pneumoniae J138
uuaaagagaaucucc

SEQ ID NO: 523183 - RNA, 15 nt, Chlamydophila pneumoniae J138
uuaaagguaaaacua

SEQ ID NO: 523184 - RNA, 15 nt, Chlamydophila pneumoniae J138
uuaaaguaaaaaaua

SEQ ID NO: 523185 - RNA, 17 nt, Chlamydophila pneumoniae J138
uuaaauuuccaaagauc

SEQ ID NO: 523186 - RNA, 16 nt, Chlamydophila pneumoniae J138
uuaaauauauaaagaa

SEQ ID NO: 523187 - RNA, 17 nt, Chlamydophila pneumoniae J138
uuaaauaucuaauaaaa

SEQ ID NO: 523188 - RNA, 19 nt, Chlamydophila pneumoniae J138
uuaacaaguaccaagaaaa

SEQ ID NO: 523189 - RNA, 23 nt, Chlamydophila pneumoniae J138
uuaacaacuagguuauuaucaaa

SEQ ID NO: 523190 - RNA, 13 nt, Chlamydophila pneumoniae J138
uuaacagagcgcc

SEQ ID NO: 523191 - RNA, 14 nt, Chlamydophila pneumoniae J138
uuaacccaccagaa

SEQ ID NO: 523192 - RNA, 15 nt, Chlamydophila pneumoniae J138
uuaacccaccagaag

SEQ ID NO: 523193 - RNA, 18 nt, Chlamydophila pneumoniae J138
uuaacccgcuugcaucuu

SEQ ID NO: 523194 - RNA, 13 nt, Chlamydophila pneumoniae J138
uuaacguuucuuc

SEQ ID NO: 523195 - RNA, 16 nt, Chlamydophila pneumoniae J138
uuaacgcuaagcucuu

SEQ ID NO: 523196 - RNA, 15 nt, Chlamydophila pneumoniae J138
uuaagauagacucuc

SEQ ID NO: 523197 - RNA, 18 nt, Chlamydophila pneumoniae J138
uuaagauagacucucacu

SEQ ID NO: 523198 - RNA, 20 nt, Chlamydophila pneumoniae J138
uuaagauaaacauuaaguga

SEQ ID NO: 523199 - RNA, 16 nt, Chlamydophila pneumoniae J138
uuaagauaaacagcac

SEQ ID NO: 523200 - RNA, 13 nt, Chlamydophila pneumoniae J138
uuaagaucucuuu

SEQ ID NO: 523201 - RNA, 14 nt, Chlamydophila pneumoniae J138
uuaagaggaaagca

SEQ ID NO: 523202 - RNA, 13 nt, Chlamydophila pneumoniae J138
uuaauaaaauuua

SEQ ID NO: 523203 - RNA, 22 nt, Chlamydophila pneumoniae J138
uuaagcucuaaguccaacauca

SEQ ID NO: 523204 - RNA, 14 nt, Chlamydophila pneumoniae J138
uuaaggaaacagug

SEQ ID NO: 523205 - RNA, 23 nt, Chlamydophila pneumoniae J138
uuaaggaaacagugguaugcuuu

SEQ ID NO: 523206 - RNA, 19 nt, Chlamydophila pneumoniae J138
uuaauaagaaccucuaauu

SEQ ID NO: 523207 - RNA, 20 nt, Chlamydophila pneumoniae J138
uuaauaagaaccucuaauuu

SEQ ID NO: 523208 - RNA, 18 nt, Chlamydophila pneumoniae J138
uuaauaaauuuaucugcu

SEQ ID NO: 523209 - RNA, 20 nt, Chlamydophila pneumoniae J138
uuaugaguuuuuaauuuucu

SEQ ID NO: 523210 - RNA, 13 nt, Chlamydophila pneumoniae J138
uuaugaccaagaa

SEQ ID NO: 523211 - RNA, 21 nt, Chlamydophila pneumoniae J138
uuauguuaaaaauaccaagau

SEQ ID NO: 523212 - RNA, 22 nt, Chlamydophila pneumoniae J138
uuauguuuucucgaagaaaaua

SEQ ID NO: 523213 - RNA, 11 nt, Chlamydophila pneumoniae J138
uuauuaaaauc

SEQ ID NO: 523214 - RNA, 16 nt, Chlamydophila pneumoniae J138
uuauguuuucucgaag

SEQ ID NO: 523215 - RNA, 19 nt, Chlamydophila pneumoniae J138
uuauccugaacaucuccag

SEQ ID NO: 523216 - RNA, 23 nt, Chlamydophila pneumoniae J138
uuaucgauaauaaaagcacccuc

SEQ ID NO: 523217 - RNA, 21 nt, Chlamydophila pneumoniae J138
uuauccugaacaucuccagca

SEQ ID NO: 523218 - RNA, 13 nt, Chlamydophila pneumoniae J138
uuaucuaaagaaa

SEQ ID NO: 523219 - RNA, 15 nt, Chlamydophila pneumoniae J138
uuaucuccaaagauc

SEQ ID NO: 523220 - RNA, 21 nt, Chlamydophila pneumoniae J138
uuaucuaggucgauaucccac

SEQ ID NO: 523221 - RNA, 16 nt, Chlamydophila pneumoniae J138
uuaucuaagacuucug

SEQ ID NO: 523222 - RNA, 19 nt, Chlamydophila pneumoniae J138
uuaucuaagaauauggaca

SEQ ID NO: 523223 - RNA, 13 nt, Chlamydophila pneumoniae J138
uuaucucccaaga

SEQ ID NO: 523224 - RNA, 19 nt, Chlamydophila pneumoniae J138
uuaucuccccauucacaaa

SEQ ID NO: 523225 - RNA, 19 nt, Chlamydophila pneumoniae J138
uuaucugcguuucuuucug

SEQ ID NO: 523226 - RNA, 15 nt, Chlamydophila pneumoniae J138
uuaucuguuaaaaac

SEQ ID NO: 523227 - RNA, 18 nt, Chlamydophila pneumoniae J138
uuaucuucuaaaacuuca

SEQ ID NO: 523228 - RNA, 13 nt, Chlamydophila pneumoniae J138
uuagagucugcag

SEQ ID NO: 523229 - RNA, 16 nt, Chlamydophila pneumoniae J138
uuagaaucuuuucuag

SEQ ID NO: 523230 - RNA, 23 nt, Chlamydophila pneumoniae J138
uuagagaaauuuuuaauuuuucu

SEQ ID NO: 523231 - RNA, 15 nt, Chlamydophila pneumoniae J138
uuagagaaaucugca

SEQ ID NO: 523232 - RNA, 16 nt, Chlamydophila pneumoniae J138
uuagagagaaacaucg

SEQ ID NO: 523233 - RNA, 21 nt, Chlamydophila pneumoniae J138
uuagagaucguaauguauccu

SEQ ID NO: 523234 - RNA, 22 nt, Chlamydophila pneumoniae J138
uuauagauagggccgugaagca

SEQ ID NO: 523235 - RNA, 18 nt, Chlamydophila pneumoniae J138
uuauacuuuuuuuauaua

SEQ ID NO: 523236 - RNA, 15 nt, Chlamydophila pneumoniae J138
uuauagauaugccuc

SEQ ID NO: 523237 - RNA, 15 nt, Chlamydophila pneumoniae J138
uuaucauagauguca

SEQ ID NO: 523238 - RNA, 17 nt, Chlamydophila pneumoniae J138
uuauauaccacuacuga

SEQ ID NO: 523239 - RNA, 19 nt, Chlamydophila pneumoniae J138
uuaucaugagaauuuucau

SEQ ID NO: 523240 - RNA, 18 nt, Chlamydophila pneumoniae J138
uuaucccagauaaagaca

SEQ ID NO: 523241 - RNA, 15 nt, Chlamydophila pneumoniae J138
uuauuuaaaauuucu

SEQ ID NO: 523242 - RNA, 22 nt, Chlamydophila pneumoniae J138
uuauuuuaggaggaguauagca

SEQ ID NO: 523243 - RNA, 22 nt, Chlamydophila pneumoniae J138
uuauuuguuucuuccauacagg

SEQ ID NO: 523244 - RNA, 18 nt, Chlamydophila pneumoniae J138
uuauuuguuucuuccaua

SEQ ID NO: 523245 - RNA, 13 nt, Chlamydophila pneumoniae J138
uuauuuuaaaguc

SEQ ID NO: 523246 - RNA, 19 nt, Chlamydophila pneumoniae J138
uuauugaauaagcuuuccu

SEQ ID NO: 523247 - RNA, 17 nt, Chlamydophila pneumoniae J138
uuauugauaaugauucc

SEQ ID NO: 523248 - RNA, 15 nt, Chlamydophila pneumoniae J138
uuauuaucaaaguga

SEQ ID NO: 523249 - RNA, 21 nt, Chlamydophila pneumoniae J138
uucaacuuuguuaauagaaga

SEQ ID NO: 523250 - RNA, 17 nt, Chlamydophila pneumoniae J138
uucaagaugauccgcau

SEQ ID NO: 523251 - RNA, 21 nt, Chlamydophila pneumoniae J138
uucaagauugugcucaauaca

SEQ ID NO: 523252 - RNA, 20 nt, Chlamydophila pneumoniae J138
uucaacucuaucgaagagcc

SEQ ID NO: 523253 - RNA, 18 nt, Chlamydophila pneumoniae J138
uucaaaucaucaaaaaga

SEQ ID NO: 523254 - RNA, 15 nt, Chlamydophila pneumoniae J138
uucaaaucaucaaaa

SEQ ID NO: 523255 - RNA, 17 nt, Chlamydophila pneumoniae J138
uucaaauuugcucuccu

SEQ ID NO: 523256 - RNA, 20 nt, Chlamydophila pneumoniae J138
uucaacaaaggcuccaaacg

SEQ ID NO: 523257 - RNA, 16 nt, Chlamydophila pneumoniae J138
uucaaccaaacgucag

SEQ ID NO: 523258 - RNA, 19 nt, Chlamydophila pneumoniae J138
uucaacauaacaugagaaa

SEQ ID NO: 523259 - RNA, 17 nt, Chlamydophila pneumoniae J138
uucaaaauagaagccac

SEQ ID NO: 523260 - RNA, 15 nt, Chlamydophila pneumoniae J138
uucaaaauagaagcc

SEQ ID NO: 523261 - RNA, 13 nt, Chlamydophila pneumoniae J138
uucaaacuccuuu

SEQ ID NO: 523262 - RNA, 18 nt, Chlamydophila pneumoniae J138
uucaaacuccuuuuaaaa

SEQ ID NO: 523263 - RNA, 13 nt, Chlamydophila pneumoniae J138
uucaaagaagucg

SEQ ID NO: 523264 - RNA, 15 nt, Chlamydophila pneumoniae J138
uuauuuucuacacug

SEQ ID NO: 523265 - RNA, 13 nt, Chlamydophila pneumoniae J138
uuauuuucuggug

SEQ ID NO: 523266 - RNA, 13 nt, Chlamydophila pneumoniae J138
uuauuuuuaaaua

SEQ ID NO: 523267 - RNA, 14 nt, Chlamydophila pneumoniae J138
uuauuuuuaaauaa

SEQ ID NO: 523268 - RNA, 13 nt, Chlamydophila pneumoniae J138
uucaaaagaaaag

SEQ ID NO: 523269 - RNA, 14 nt, Chlamydophila pneumoniae J138
uucaaaagaaaaga

SEQ ID NO: 523270 - RNA, 18 nt, Chlamydophila pneumoniae J138
ugcaguugcuguggcaua

SEQ ID NO: 523271 - RNA, 18 nt, Chlamydophila pneumoniae J138
ugcaguugaugagaaaaa

SEQ ID NO: 523272 - RNA, 17 nt, Chlamydophila pneumoniae J138
ugcauaauuuuucuuag

SEQ ID NO: 523273 - RNA, 13 nt, Chlamydophila pneumoniae J138
ugcauaaucucac

SEQ ID NO: 523274 - RNA, 13 nt, Chlamydophila pneumoniae J138
ugcauacccuucu

SEQ ID NO: 523275 - RNA, 22 nt, Chlamydophila pneumoniae J138
ugcauacguuaacaaggauuau

SEQ ID NO: 523276 - RNA, 23 nt, Chlamydophila pneumoniae J138
ugcauaguauggcauucuuuuuc

SEQ ID NO: 523277 - RNA, 18 nt, Chlamydophila pneumoniae J138
ugcaucuuauggaagaga

SEQ ID NO: 523278 - RNA, 12 nt, Chlamydophila pneumoniae J138
ugcaucuuauca

SEQ ID NO: 523279 - RNA, 18 nt, Chlamydophila pneumoniae J138
ugcaucccuggauuucuu

SEQ ID NO: 523280 - RNA, 24 nt, Chlamydophila pneumoniae J138
ugcaucccaccgacaagaugguga

SEQ ID NO: 523281 - RNA, 23 nt, Chlamydophila pneumoniae J138
ugcaucccccgcgccacaucaaa

SEQ ID NO: 523282 - RNA, 21 nt, Chlamydophila pneumoniae J138
ugcaucauuuucauagcagcu

SEQ ID NO: 523283 - RNA, 17 nt, Chlamydophila pneumoniae J138
ugcaugaauauagguua

SEQ ID NO: 523284 - RNA, 22 nt, Chlamydophila pneumoniae J138
ugcaucuugagguauuccuacc

SEQ ID NO: 523285 - RNA, 17 nt, Chlamydophila pneumoniae J138
ugcaucuuauggaagag

SEQ ID NO: 523286 - RNA, 17 nt, Chlamydophila pneumoniae J138
ugcaugaaucucuucug

SEQ ID NO: 523287 - RNA, 17 nt, Chlamydophila pneumoniae J138
ugcaugcaucuuaucaa

SEQ ID NO: 523288 - RNA, 22 nt, Chlamydophila pneumoniae J138
ugcauggauccuucaucagcuu

SEQ ID NO: 523289 - RNA, 22 nt, Chlamydophila pneumoniae J138
ugccacaacucauccuaaauua

SEQ ID NO: 523290 - RNA, 16 nt, Chlamydophila pneumoniae J138
ugccaauuuuuguaga

SEQ ID NO: 523291 - RNA, 15 nt, Chlamydophila pneumoniae J138
ugccaaugugcaaua

SEQ ID NO: 523292 - RNA, 18 nt, Chlamydophila pneumoniae J138
ugccagagauucuucaca

SEQ ID NO: 523293 - RNA, 20 nt, Chlamydophila pneumoniae J138
ugccaugaauccaugggauc

SEQ ID NO: 523294 - RNA, 20 nt, Chlamydophila pneumoniae J138
ugccaugcccacagaccaaa

SEQ ID NO: 523295 - RNA, 19 nt, Chlamydophila pneumoniae J138
ugcccuggauagcauacga

SEQ ID NO: 523296 - RNA, 15 nt, Chlamydophila pneumoniae J138
ugccgugcucuuaug

SEQ ID NO: 523297 - RNA, 20 nt, Chlamydophila pneumoniae J138
ugccucauugccguggugag

SEQ ID NO: 523298 - RNA, 13 nt, Chlamydophila pneumoniae J138
ugccugaaaacaa

SEQ ID NO: 523299 - RNA, 17 nt, Chlamydophila pneumoniae J138
ugccugaaaauucgaau

SEQ ID NO: 523300 - RNA, 16 nt, Chlamydophila pneumoniae J138
ugcgcccgagcuucca

SEQ ID NO: 523301 - RNA, 14 nt, Chlamydophila pneumoniae J138
ugcgcccgagcuuc

SEQ ID NO: 523302 - RNA, 18 nt, Chlamydophila pneumoniae J138
ugccuucuuaucuucuaa

SEQ ID NO: 523303 - RNA, 19 nt, Chlamydophila pneumoniae J138
ugccuucuuaucuucuaaa

SEQ ID NO: 523304 - RNA, 12 nt, Chlamydophila pneumoniae J138
ugccuucuuauc

SEQ ID NO: 523305 - RNA, 12 nt, Chlamydophila pneumoniae J138
ugccuucuucaa

SEQ ID NO: 523306 - RNA, 15 nt, Chlamydophila pneumoniae J138
ugcgggcucaaagaa

SEQ ID NO: 523307 - RNA, 18 nt, Chlamydophila pneumoniae J138
ugcgucuuuaauuaaaag

SEQ ID NO: 523308 - RNA, 16 nt, Chlamydophila pneumoniae J138
ugcggaaggcuaaaac

SEQ ID NO: 523309 - RNA, 14 nt, Chlamydophila pneumoniae J138
ugcggaacucauca

SEQ ID NO: 523310 - RNA, 23 nt, Chlamydophila pneumoniae J138
ugcggaugugccgugacuccaga

SEQ ID NO: 523311 - RNA, 20 nt, Chlamydophila pneumoniae J138
ugcggaccuuaagaugaggu

SEQ ID NO: 523312 - RNA, 15 nt, Chlamydophila pneumoniae J138
ugcucaguaaauauu

SEQ ID NO: 523313 - RNA, 18 nt, Chlamydophila pneumoniae J138
ugcguuugagcuaagucu

SEQ ID NO: 523314 - RNA, 15 nt, Chlamydophila pneumoniae J138
ugcuccucuucuucc

SEQ ID NO: 523315 - RNA, 23 nt, Chlamydophila pneumoniae J138
ugcuccuaagugauaaggaagaa

SEQ ID NO: 523316 - RNA, 16 nt, Chlamydophila pneumoniae J138
ugcucgugcgacugcu

SEQ ID NO: 523317 - RNA, 14 nt, Chlamydophila pneumoniae J138
ugcucuuucauuuc

SEQ ID NO: 523318 - RNA, 22 nt, Chlamydophila pneumoniae J138
ugcugaaccuuugguagaaaga

SEQ ID NO: 523319 - RNA, 17 nt, Chlamydophila pneumoniae J138
ugcugaagauuuuuucu

SEQ ID NO: 523320 - RNA, 21 nt, Chlamydophila pneumoniae J138
ugcugaagauuuuuucuuggu

SEQ ID NO: 523321 - RNA, 20 nt, Chlamydophila pneumoniae J138
ugcugagggaucuucucuau

SEQ ID NO: 523322 - RNA, 21 nt, Chlamydophila pneumoniae J138
ugcugagggaucuucucuaug

SEQ ID NO: 523323 - RNA, 15 nt, Chlamydophila pneumoniae J138
ugcugauuucuuuuu

SEQ ID NO: 523324 - RNA, 15 nt, Chlamydophila pneumoniae J138
ugcugccaugacaua

SEQ ID NO: 523325 - RNA, 10 nt, Chlamydophila pneumoniae J138
ugcugcccaa

SEQ ID NO: 523326 - RNA, 18 nt, Chlamydophila pneumoniae J138
ugcugcucuccaaaggga

SEQ ID NO: 523327 - RNA, 12 nt, Chlamydophila pneumoniae J138
ugcugcucucca

SEQ ID NO: 523328 - RNA, 13 nt, Chlamydophila pneumoniae J138
ugcuguuucuucu

SEQ ID NO: 523329 - RNA, 17 nt, Chlamydophila pneumoniae J138
ugcuguugauucaaugc

SEQ ID NO: 523330 - RNA, 20 nt, Chlamydophila pneumoniae J138
ugcuguagauuguuagugag

SEQ ID NO: 523331 - RNA, 20 nt, Chlamydophila pneumoniae J138
ugcuuagcgaucucucuucc

SEQ ID NO: 523332 - RNA, 12 nt, Chlamydophila pneumoniae J138
ugcuuauuuccc

SEQ ID NO: 523333 - RNA, 18 nt, Chlamydophila pneumoniae J138
ugcuuagcgaucucucuu

SEQ ID NO: 523334 - RNA, 15 nt, Chlamydophila pneumoniae J138
ugcuugaauauuucc

SEQ ID NO: 523335 - RNA, 21 nt, Chlamydophila pneumoniae J138
ugcuugaccucaucagaagug

SEQ ID NO: 523336 - RNA, 17 nt, Chlamydophila pneumoniae J138
ugcuucuuggcguucca

SEQ ID NO: 523337 - RNA, 15 nt, Chlamydophila pneumoniae J138
ugcuuuaauccugca

SEQ ID NO: 523338 - RNA, 14 nt, Chlamydophila pneumoniae J138
ugcuuuaacagaag

SEQ ID NO: 523339 - RNA, 13 nt, Chlamydophila pneumoniae J138
ugcuuuucauuuu

SEQ ID NO: 523340 - RNA, 23 nt, Chlamydophila pneumoniae J138
ugcuuuuagaucccgaagcaauc

SEQ ID NO: 523341 - RNA, 10 nt, Chlamydophila pneumoniae J138
ugcuuuuccc

SEQ ID NO: 523342 - RNA, 19 nt, Chlamydophila pneumoniae J138
ugcuuugugaguucuuccu

SEQ ID NO: 523343 - RNA, 20 nt, Chlamydophila pneumoniae J138
ugagcauccaaaaugucuuu

SEQ ID NO: 523344 - RNA, 23 nt, Chlamydophila pneumoniae J138
ugagccaacagguucacuucauc

SEQ ID NO: 523345 - RNA, 20 nt, Chlamydophila pneumoniae J138
ugaguuagcuuuugugauac

SEQ ID NO: 523346 - RNA, 14 nt, Chlamydophila pneumoniae J138
ugaguucuuccuuc

SEQ ID NO: 523347 - RNA, 12 nt, Chlamydophila pneumoniae J138
ugaguucuuccu

SEQ ID NO: 523348 - RNA, 21 nt, Chlamydophila pneumoniae J138
ugaguucuuuuguuugucuuc

SEQ ID NO: 523349 - RNA, 22 nt, Chlamydophila pneumoniae J138
ugaguucuuuuguuugucuucc

SEQ ID NO: 523350 - RNA, 14 nt, Chlamydophila pneumoniae J138
ugauaaaagauagu

SEQ ID NO: 523351 - RNA, 18 nt, Chlamydophila pneumoniae J138
ugauaaugcaggggcuuu

SEQ ID NO: 523352 - RNA, 19 nt, Chlamydophila pneumoniae J138
ugauaccaccuaaaaugca

SEQ ID NO: 523353 - RNA, 21 nt, Chlamydophila pneumoniae J138
ugauaccaccuaaaaugcagg

SEQ ID NO: 523354 - RNA, 17 nt, Chlamydophila pneumoniae J138
ugauacgugcagugaau

SEQ ID NO: 523355 - RNA, 18 nt, Chlamydophila pneumoniae J138
ugauaauuacagaaguuc

SEQ ID NO: 523356 - RNA, 22 nt, Chlamydophila pneumoniae J138
ugauacuuguaccguaaagaaa

SEQ ID NO: 523357 - RNA, 17 nt, Chlamydophila pneumoniae J138
ugaucaaaauuauccag

SEQ ID NO: 523358 - RNA, 15 nt, Chlamydophila pneumoniae J138
ugaucuuuccucuca

SEQ ID NO: 523359 - RNA, 18 nt, Chlamydophila pneumoniae J138
ugaugcccugacguuuug

SEQ ID NO: 523360 - RNA, 21 nt, Chlamydophila pneumoniae J138
ugaucugaaguugaaaugagu

SEQ ID NO: 523361 - RNA, 23 nt, Chlamydophila pneumoniae J138
ugaucugaaauagcaaagacauc

SEQ ID NO: 523362 - RNA, 21 nt, Chlamydophila pneumoniae J138
ugaucuacaaaaacuagaaua

SEQ ID NO: 523363 - RNA, 12 nt, Chlamydophila pneumoniae J138
ugauuguagaga

SEQ ID NO: 523364 - RNA, 15 nt, Chlamydophila pneumoniae J138
ugauuguauagcuua

SEQ ID NO: 523365 - RNA, 16 nt, Chlamydophila pneumoniae J138
ugcaaaaaugaaagaa

SEQ ID NO: 523366 - RNA, 18 nt, Chlamydophila pneumoniae J138
ugcaaaugaagggauggg

SEQ ID NO: 523367 - RNA, 22 nt, Chlamydophila pneumoniae J138
ugcaaaugaagggaugggaucg

SEQ ID NO: 523368 - RNA, 18 nt, Chlamydophila pneumoniae J138
ugcaaauccuguagaaac

SEQ ID NO: 523369 - RNA, 16 nt, Chlamydophila pneumoniae J138
ugcaaaugaaaagaga

SEQ ID NO: 523370 - RNA, 19 nt, Chlamydophila pneumoniae J138
ugcaaauaagccaguacua

SEQ ID NO: 523371 - RNA, 16 nt, Chlamydophila pneumoniae J138
ugauuaagaucuucgu

SEQ ID NO: 523372 - RNA, 15 nt, Chlamydophila pneumoniae J138
ugauuagagaauccg

SEQ ID NO: 523373 - RNA, 21 nt, Chlamydophila pneumoniae J138
ugauucccggaggcaaagauc

SEQ ID NO: 523374 - RNA, 13 nt, Chlamydophila pneumoniae J138
ugauucuguauaa

SEQ ID NO: 523375 - RNA, 22 nt, Chlamydophila pneumoniae J138
ugauugaaguucagacgugcuc

SEQ ID NO: 523376 - RNA, 16 nt, Chlamydophila pneumoniae J138
ugauugaaguucagac

SEQ ID NO: 523377 - RNA, 23 nt, Chlamydophila pneumoniae J138
ugauugaaacuuuuuuucuucuc

SEQ ID NO: 523378 - RNA, 21 nt, Chlamydophila pneumoniae J138
ugauugaaagucagcaaguca

SEQ ID NO: 523379 - RNA, 17 nt, Chlamydophila pneumoniae J138
ugauugaacagucuugc

SEQ ID NO: 523380 - RNA, 19 nt, Chlamydophila pneumoniae J138
ugcaacagagucagaagcu

SEQ ID NO: 523381 - RNA, 14 nt, Chlamydophila pneumoniae J138
ugcaaauuccagaa

SEQ ID NO: 523382 - RNA, 16 nt, Chlamydophila pneumoniae J138
ugcaauagcaauggcu

SEQ ID NO: 523383 - RNA, 13 nt, Chlamydophila pneumoniae J138
ugcaaucagugcu

SEQ ID NO: 523384 - RNA, 16 nt, Chlamydophila pneumoniae J138
ugcaaucagugcugcc

SEQ ID NO: 523385 - RNA, 14 nt, Chlamydophila pneumoniae J138
ugcaagcaacucuu

SEQ ID NO: 523386 - RNA, 20 nt, Chlamydophila pneumoniae J138
ugcacguuugacaaauuuau

SEQ ID NO: 523387 - RNA, 17 nt, Chlamydophila pneumoniae J138
ugcaauugccauaucau

SEQ ID NO: 523388 - RNA, 17 nt, Chlamydophila pneumoniae J138
ugcaauuccauagguua

SEQ ID NO: 523389 - RNA, 17 nt, Chlamydophila pneumoniae J138
ugcaauuccgaagaaga

SEQ ID NO: 523390 - RNA, 11 nt, Chlamydophila pneumoniae J138
ugacacagaga

SEQ ID NO: 523391 - RNA, 12 nt, Chlamydophila pneumoniae J138
ugacacagagaa

SEQ ID NO: 523392 - RNA, 13 nt, Chlamydophila pneumoniae J138
ugacacagagaac

SEQ ID NO: 523393 - RNA, 17 nt, Chlamydophila pneumoniae J138
ugacacagagaacaaua

SEQ ID NO: 523394 - RNA, 13 nt, Chlamydophila pneumoniae J138
ugacaucuccaag

SEQ ID NO: 523395 - RNA, 21 nt, Chlamydophila pneumoniae J138
ugacaucuccaagauaauuau

SEQ ID NO: 523396 - RNA, 21 nt, Chlamydophila pneumoniae J138
ugacgcaagagacaagaaaau

SEQ ID NO: 523397 - RNA, 22 nt, Chlamydophila pneumoniae J138
ugacgcaagagacaagaaaaua

SEQ ID NO: 523398 - RNA, 13 nt, Chlamydophila pneumoniae J138
ugacgcacuucuu

SEQ ID NO: 523399 - RNA, 15 nt, Chlamydophila pneumoniae J138
ugacgcacuucuuca

SEQ ID NO: 523400 - RNA, 19 nt, Chlamydophila pneumoniae J138
ugacgcacuucuucaagaa

SEQ ID NO: 523401 - RNA, 21 nt, Chlamydophila pneumoniae J138
ugacgcacuucuucaagaaau

SEQ ID NO: 523402 - RNA, 16 nt, Chlamydophila pneumoniae J138
ugaccugcuuuuuuuc

SEQ ID NO: 523403 - RNA, 17 nt, Chlamydophila pneumoniae J138
ugagacgaaagagauuu

SEQ ID NO: 523404 - RNA, 22 nt, Chlamydophila pneumoniae J138
ugagaguguuguuggagcagaa

SEQ ID NO: 523405 - RNA, 19 nt, Chlamydophila pneumoniae J138
ugagagcguuguggaagua

SEQ ID NO: 523406 - RNA, 17 nt, Chlamydophila pneumoniae J138
ugacuucuuguccuguu

SEQ ID NO: 523407 - RNA, 13 nt, Chlamydophila pneumoniae J138
ugacuucccgaag

SEQ ID NO: 523408 - RNA, 13 nt, Chlamydophila pneumoniae J138
ugagaaauauaaa

SEQ ID NO: 523409 - RNA, 21 nt, Chlamydophila pneumoniae J138
ugagaauuuucaugauauuuu

SEQ ID NO: 523410 - RNA, 15 nt, Chlamydophila pneumoniae J138
ugagaccauaaaauc

SEQ ID NO: 523411 - RNA, 18 nt, Chlamydophila pneumoniae J138
ugacgucuccaacagucu

SEQ ID NO: 523412 - RNA, 12 nt, Chlamydophila pneumoniae J138
ugacgugcauug

SEQ ID NO: 523413 - RNA, 20 nt, Chlamydophila pneumoniae J138
ugacguuaauaaagaggcuc

SEQ ID NO: 523414 - RNA, 21 nt, Chlamydophila pneumoniae J138
ugacuauagggagacucuuga

SEQ ID NO: 523415 - RNA, 23 nt, Chlamydophila pneumoniae J138
ugacuaugguaagcauuucuguu

SEQ ID NO: 523416 - RNA, 19 nt, Chlamydophila pneumoniae J138
ugacucuuuuaagacaaua

SEQ ID NO: 523417 - RNA, 11 nt, Chlamydophila pneumoniae J138
ugacugaaacu

SEQ ID NO: 523418 - RNA, 12 nt, Chlamydophila pneumoniae J138
ugacugaaacuc

SEQ ID NO: 523419 - RNA, 19 nt, Chlamydophila pneumoniae J138
ugaagacguucgacaacaa

SEQ ID NO: 523420 - RNA, 21 nt, Chlamydophila pneumoniae J138
ugaacguagcuacaaaauuau

SEQ ID NO: 523421 - RNA, 22 nt, Chlamydophila pneumoniae J138
ugaacuccaggguguuugcaua

SEQ ID NO: 523422 - RNA, 15 nt, Chlamydophila pneumoniae J138
ugaagccaugacaaa

SEQ ID NO: 523423 - RNA, 19 nt, Chlamydophila pneumoniae J138
ugaagcagggaaaaugcga

SEQ ID NO: 523424 - RNA, 20 nt, Chlamydophila pneumoniae J138
ugaagcagaggguuccaaga

SEQ ID NO: 523425 - RNA, 14 nt, Chlamydophila pneumoniae J138
ugaagcagaaacuu

SEQ ID NO: 523426 - RNA, 17 nt, Chlamydophila pneumoniae J138
ugaagcagaaacuuuaa

SEQ ID NO: 523427 - RNA, 17 nt, Chlamydophila pneumoniae J138
ugaagaucuccgaagac

SEQ ID NO: 523428 - RNA, 17 nt, Chlamydophila pneumoniae J138
ugaagagucaaacuuau

SEQ ID NO: 523429 - RNA, 19 nt, Chlamydophila pneumoniae J138
ugaagaucuccgaagacua

SEQ ID NO: 523430 - RNA, 22 nt, Chlamydophila pneumoniae J138
ugaaggaucauaccgacaagca

SEQ ID NO: 523431 - RNA, 13 nt, Chlamydophila pneumoniae J138
ugaaggaucauac

SEQ ID NO: 523432 - RNA, 23 nt, Chlamydophila pneumoniae J138
ugaauuacaggcccuaggacgua

SEQ ID NO: 523433 - RNA, 19 nt, Chlamydophila pneumoniae J138
ugaauuuuagcuccgaggc

SEQ ID NO: 523434 - RNA, 14 nt, Chlamydophila pneumoniae J138
ugaauccuucuaua

SEQ ID NO: 523435 - RNA, 23 nt, Chlamydophila pneumoniae J138
ugaauccaugggaucucaucaua

SEQ ID NO: 523436 - RNA, 13 nt, Chlamydophila pneumoniae J138
ugaauccuucuau

SEQ ID NO: 523437 - RNA, 21 nt, Chlamydophila pneumoniae J138
ugaauccuugaaagacucgcu

SEQ ID NO: 523438 - RNA, 14 nt, Chlamydophila pneumoniae J138
ugaaucccaucaaa

SEQ ID NO: 523439 - RNA, 18 nt, Chlamydophila pneumoniae J138
ugaauagcucuuuucaug

SEQ ID NO: 523440 - RNA, 23 nt, Chlamydophila pneumoniae J138
ugaauaguugugagacuuucuga

SEQ ID NO: 523441 - RNA, 15 nt, Chlamydophila pneumoniae J138
ugaauaagauuuuga

SEQ ID NO: 523442 - RNA, 12 nt, Chlamydophila pneumoniae J138
ugaauaagcuuu

SEQ ID NO: 523443 - RNA, 20 nt, Chlamydophila pneumoniae J138
ugaauaagcuuuccucucca

SEQ ID NO: 523444 - RNA, 18 nt, Chlamydophila pneumoniae J138
ugaaguccagacuuuccu

SEQ ID NO: 523445 - RNA, 16 nt, Chlamydophila pneumoniae J138
ugaaguacauuaucac

SEQ ID NO: 523446 - RNA, 21 nt, Chlamydophila pneumoniae J138
ugaaguacauuaucacagcaa

SEQ ID NO: 523447 - RNA, 22 nt, Chlamydophila pneumoniae J138
ugaaguuuuuucucucuuuauc

SEQ ID NO: 523448 - RNA, 16 nt, Chlamydophila pneumoniae J138
ugaaguuugucguaau

SEQ ID NO: 523449 - RNA, 13 nt, Chlamydophila pneumoniae J138
uccugcauggcuu

SEQ ID NO: 523450 - RNA, 15 nt, Chlamydophila pneumoniae J138
uccugcuccaaaaug

SEQ ID NO: 523451 - RNA, 13 nt, Chlamydophila pneumoniae J138
uccugcagcagcc

SEQ ID NO: 523452 - RNA, 19 nt, Chlamydophila pneumoniae J138
uccugcuucuauagagaca

SEQ ID NO: 523453 - RNA, 22 nt, Chlamydophila pneumoniae J138
uccuggaagaauuucauaagag

SEQ ID NO: 523454 - RNA, 17 nt, Chlamydophila pneumoniae J138
uccuggaacaguauaau

SEQ ID NO: 523455 - RNA, 15 nt, Chlamydophila pneumoniae J138
uccuguagagcaaga

SEQ ID NO: 523456 - RNA, 16 nt, Chlamydophila pneumoniae J138
uccuguauauucugaa

SEQ ID NO: 523457 - RNA, 24 nt, Chlamydophila pneumoniae J138
uccuucgaccuauuugcaacaauc

SEQ ID NO: 523458 - RNA, 11 nt, Chlamydophila pneumoniae J138
uccuuccuuaa

SEQ ID NO: 523459 - RNA, 14 nt, Chlamydophila pneumoniae J138
uccuucgaccuauu

SEQ ID NO: 523460 - RNA, 17 nt, Chlamydophila pneumoniae J138
uccuucauucacagcag

SEQ ID NO: 523461 - RNA, 18 nt, Chlamydophila pneumoniae J138
uccuucauucacagcagu

SEQ ID NO: 523462 - RNA, 21 nt, Chlamydophila pneumoniae J138
uccuuaaugagaguuucuaau

SEQ ID NO: 523463 - RNA, 14 nt, Chlamydophila pneumoniae J138
uccuuacucccaug

SEQ ID NO: 523464 - RNA, 22 nt, Chlamydophila pneumoniae J138
uccuuagcauuaggaaaguacc

SEQ ID NO: 523465 - RNA, 14 nt, Chlamydophila pneumoniae J138
uccuucaaagauau

SEQ ID NO: 523466 - RNA, 15 nt, Chlamydophila pneumoniae J138
uccuuaucuugcugc

SEQ ID NO: 523467 - RNA, 20 nt, Chlamydophila pneumoniae J138
uccuugagggcuauccacaa

SEQ ID NO: 523468 - RNA, 17 nt, Chlamydophila pneumoniae J138
uccuugagggcuaucca

SEQ ID NO: 523469 - RNA, 15 nt, Chlamydophila pneumoniae J138
uccuugacaaauaag

SEQ ID NO: 523470 - RNA, 18 nt, Chlamydophila pneumoniae J138
uccuugauaaaacgcuau

SEQ ID NO: 523471 - RNA, 20 nt, Chlamydophila pneumoniae J138
uccuugaacuaacugagcaa

SEQ ID NO: 523472 - RNA, 18 nt, Chlamydophila pneumoniae J138
uccuugaaauugcucuug

SEQ ID NO: 523473 - RNA, 19 nt, Chlamydophila pneumoniae J138
uccuugacaaauaaguccu

SEQ ID NO: 523474 - RNA, 15 nt, Chlamydophila pneumoniae J138
uccuucuguuuucac

SEQ ID NO: 523475 - RNA, 12 nt, Chlamydophila pneumoniae J138
uccuucuucuuc

SEQ ID NO: 523476 - RNA, 15 nt, Chlamydophila pneumoniae J138
uccuucuuucugcuc

SEQ ID NO: 523477 - RNA, 20 nt, Chlamydophila pneumoniae J138
uccuucuacagauugaugcu

SEQ ID NO: 523478 - RNA, 22 nt, Chlamydophila pneumoniae J138
uccuucuacaaugauauaaaag

SEQ ID NO: 523479 - RNA, 20 nt, Chlamydophila pneumoniae J138
uccuucucccucuaaacaua

SEQ ID NO: 523480 - RNA, 12 nt, Chlamydophila pneumoniae J138
uccuucuccugu

SEQ ID NO: 523481 - RNA, 22 nt, Chlamydophila pneumoniae J138
uccuuucuuuugcuuuucccac

SEQ ID NO: 523482 - RNA, 12 nt, Chlamydophila pneumoniae J138
uccuuuuaaaau

SEQ ID NO: 523483 - RNA, 22 nt, Chlamydophila pneumoniae J138
uccuuugcuaagaacuagcaug

SEQ ID NO: 523484 - RNA, 19 nt, Chlamydophila pneumoniae J138
uccuuguacuguauagaaa

SEQ ID NO: 523485 - RNA, 12 nt, Chlamydophila pneumoniae J138
uccuuguagaac

SEQ ID NO: 523486 - RNA, 20 nt, Chlamydophila pneumoniae J138
uccuuguagaacuucucaag

SEQ ID NO: 523487 - RNA, 14 nt, Chlamydophila pneumoniae J138
uccuuuaaauaaaa

SEQ ID NO: 523488 - RNA, 16 nt, Chlamydophila pneumoniae J138
uccuuuaaauaaaauc

SEQ ID NO: 523489 - RNA, 16 nt, Chlamydophila pneumoniae J138
ucgaaacacucaugaa

SEQ ID NO: 523490 - RNA, 18 nt, Chlamydophila pneumoniae J138
ucgaaaccacagcaaaga

SEQ ID NO: 523491 - RNA, 17 nt, Chlamydophila pneumoniae J138
ucgaaacucuuugagga

SEQ ID NO: 523492 - RNA, 22 nt, Chlamydophila pneumoniae J138
ucgaaagaucagaggaaucuaa

SEQ ID NO: 523493 - RNA, 21 nt, Chlamydophila pneumoniae J138
uccuuuuuaggacgcuauccu

SEQ ID NO: 523494 - RNA, 15 nt, Chlamydophila pneumoniae J138
ucgaaauccuaaaaa

SEQ ID NO: 523495 - RNA, 21 nt, Chlamydophila pneumoniae J138
ucgaacagagaugcaaauccu

SEQ ID NO: 523496 - RNA, 22 nt, Chlamydophila pneumoniae J138
ucgaaguugauuguagagacau

SEQ ID NO: 523497 - RNA, 15 nt, Chlamydophila pneumoniae J138
ucgaacucugaagua

SEQ ID NO: 523498 - RNA, 13 nt, Chlamydophila pneumoniae J138
ucgacagcagcau

SEQ ID NO: 523499 - RNA, 22 nt, Chlamydophila pneumoniae J138
ucgacagcagcauuuucuaaag

SEQ ID NO: 523500 - RNA, 12 nt, Chlamydophila pneumoniae J138
ucgacagcagca

SEQ ID NO: 523501 - RNA, 16 nt, Chlamydophila pneumoniae J138
ucgaccuauuugcaac

SEQ ID NO: 523502 - RNA, 17 nt, Chlamydophila pneumoniae J138
ucgacaacaacauaaag

SEQ ID NO: 523503 - RNA, 19 nt, Chlamydophila pneumoniae J138
ucgaaucuaaaaacuuccc

SEQ ID NO: 523504 - RNA, 18 nt, Chlamydophila pneumoniae J138
ucgaauagcucuggagau

SEQ ID NO: 523505 - RNA, 16 nt, Chlamydophila pneumoniae J138
ucgaguucuuuuugca

SEQ ID NO: 523506 - RNA, 22 nt, Chlamydophila pneumoniae J138
ucgauaucucuaccgaacagag

SEQ ID NO: 523507 - RNA, 13 nt, Chlamydophila pneumoniae J138
ucgaucaaggugu

SEQ ID NO: 523508 - RNA, 18 nt, Chlamydophila pneumoniae J138
ucgagcuuuaagaagaag

SEQ ID NO: 523509 - RNA, 16 nt, Chlamydophila pneumoniae J138
ucgcaauccaggaaua

SEQ ID NO: 523510 - RNA, 20 nt, Chlamydophila pneumoniae J138
ucgcacuacagcuucauuau

SEQ ID NO: 523511 - RNA, 23 nt, Chlamydophila pneumoniae J138
ucgcaaauuuuucgagaauauac

SEQ ID NO: 523512 - RNA, 23 nt, Chlamydophila pneumoniae J138
ucgcaacuuaagauacuucucca

SEQ ID NO: 523513 - RNA, 22 nt, Chlamydophila pneumoniae J138
ucgauuguaacuucguuagaaa

SEQ ID NO: 523514 - RNA, 14 nt, Chlamydophila pneumoniae J138
ucgcaguaaugcca

SEQ ID NO: 523515 - RNA, 17 nt, Chlamydophila pneumoniae J138
ucgcaguccaaagacuu

SEQ ID NO: 523516 - RNA, 20 nt, Chlamydophila pneumoniae J138
ucggaucuuuucuuucuaag

SEQ ID NO: 523517 - RNA, 17 nt, Chlamydophila pneumoniae J138
ucggauuucaugauucc

SEQ ID NO: 523518 - RNA, 18 nt, Chlamydophila pneumoniae J138
ucgcuguaaauucaguga

SEQ ID NO: 523519 - RNA, 14 nt, Chlamydophila pneumoniae J138
ucgcuuuugcuaga

SEQ ID NO: 523520 - RNA, 15 nt, Chlamydophila pneumoniae J138
ucgcuuaacaaacuu

SEQ ID NO: 523521 - RNA, 15 nt, Chlamydophila pneumoniae J138
ucggagauuguuuca

SEQ ID NO: 523522 - RNA, 17 nt, Chlamydophila pneumoniae J138
ucggagacucagagaaa

SEQ ID NO: 523523 - RNA, 16 nt, Chlamydophila pneumoniae J138
ucggagguucgaaucc

SEQ ID NO: 523524 - RNA, 13 nt, Chlamydophila pneumoniae J138
ucggaucuguaau

SEQ ID NO: 523525 - RNA, 16 nt, Chlamydophila pneumoniae J138
ucggggauugcaaaau

SEQ ID NO: 523526 - RNA, 15 nt, Chlamydophila pneumoniae J138
ucggcuaaagaaaag

SEQ ID NO: 523527 - RNA, 13 nt, Chlamydophila pneumoniae J138
ucgugaacaaaau

SEQ ID NO: 523528 - RNA, 19 nt, Chlamydophila pneumoniae J138
ucguaaucuuuuuuaaagc

SEQ ID NO: 523529 - RNA, 18 nt, Chlamydophila pneumoniae J138
ucguacaguuuuuuucua

SEQ ID NO: 523530 - RNA, 18 nt, Chlamydophila pneumoniae J138
ucguauagguacgcuuuu

SEQ ID NO: 523531 - RNA, 16 nt, Chlamydophila pneumoniae J138
ucguaccugcugcuuc

SEQ ID NO: 523532 - RNA, 15 nt, Chlamydophila pneumoniae J138
ucguaauaacuauaa

SEQ ID NO: 523533 - RNA, 21 nt, Chlamydophila pneumoniae J138
ucguaauagcgacaugagaaa

SEQ ID NO: 523534 - RNA, 21 nt, Chlamydophila pneumoniae J138
ucgguaaccugugaaaauuuu

SEQ ID NO: 523535 - RNA, 14 nt, Chlamydophila pneumoniae J138
ucgguagagcuaga

SEQ ID NO: 523536 - RNA, 12 nt, Chlamydophila pneumoniae J138
ucggucuuuucu

SEQ ID NO: 523537 - RNA, 16 nt, Chlamydophila pneumoniae J138
ucuaaguccaacauca

SEQ ID NO: 523538 - RNA, 12 nt, Chlamydophila pneumoniae J138
ucuaaggaaauu

SEQ ID NO: 523539 - RNA, 16 nt, Chlamydophila pneumoniae J138
ucuacaaaaacuagaa

SEQ ID NO: 523540 - RNA, 18 nt, Chlamydophila pneumoniae J138
ucuacaaaaacuagaaua

SEQ ID NO: 523541 - RNA, 12 nt, Chlamydophila pneumoniae J138
ucuacaaaugcg

SEQ ID NO: 523542 - RNA, 20 nt, Chlamydophila pneumoniae J138
ucuacaggauauugcggaaa

SEQ ID NO: 523543 - RNA, 17 nt, Chlamydophila pneumoniae J138
ucuacauagauccccuu

SEQ ID NO: 523544 - RNA, 17 nt, Chlamydophila pneumoniae J138
ucuaaaaaagauaaagc

SEQ ID NO: 523545 - RNA, 16 nt, Chlamydophila pneumoniae J138
ucuaaauagaaaacau

SEQ ID NO: 523546 - RNA, 16 nt, Chlamydophila pneumoniae J138
ucuaaagguuuuaaau

SEQ ID NO: 523547 - RNA, 18 nt, Chlamydophila pneumoniae J138
ucuaaaaaugcacuuuga

SEQ ID NO: 523548 - RNA, 14 nt, Chlamydophila pneumoniae J138
ucuaacucuuguag

SEQ ID NO: 523549 - RNA, 21 nt, Chlamydophila pneumoniae J138
ucuaacucuaaucugauucaa

SEQ ID NO: 523550 - RNA, 14 nt, Chlamydophila pneumoniae J138
ucuaagauauagag

SEQ ID NO: 523551 - RNA, 19 nt, Chlamydophila pneumoniae J138
ucuaagagaucuacaaaca

SEQ ID NO: 523552 - RNA, 21 nt, Chlamydophila pneumoniae J138
ucuaagaaaggcacuccaaaa

SEQ ID NO: 523553 - RNA, 21 nt, Chlamydophila pneumoniae J138
ucuaagcagccucuucucuac

SEQ ID NO: 523554 - RNA, 14 nt, Chlamydophila pneumoniae J138
ucuaagaucuuuug

SEQ ID NO: 523555 - RNA, 22 nt, Chlamydophila pneumoniae J138
ucuaagaaacuuccaaaacgau

SEQ ID NO: 523556 - RNA, 13 nt, Chlamydophila pneumoniae J138
ucguuauccucgu

SEQ ID NO: 523557 - RNA, 21 nt, Chlamydophila pneumoniae J138
ucguuauccucgucuucaaua

SEQ ID NO: 523558 - RNA, 14 nt, Chlamydophila pneumoniae J138
ucguuagagaagag

SEQ ID NO: 523559 - RNA, 16 nt, Chlamydophila pneumoniae J138
ucguuagagaagaggu

SEQ ID NO: 523560 - RNA, 20 nt, Chlamydophila pneumoniae J138
ucguuagaaaccaugaugca

SEQ ID NO: 523561 - RNA, 19 nt, Chlamydophila pneumoniae J138
ucguuuuuucuuaucugcu

SEQ ID NO: 523562 - RNA, 20 nt, Chlamydophila pneumoniae J138
ucguuuuugauaguagacau

SEQ ID NO: 523563 - RNA, 15 nt, Chlamydophila pneumoniae J138
ucugaucguacagga

SEQ ID NO: 523564 - RNA, 21 nt, Chlamydophila pneumoniae J138
ucugaucguacaggacuguuu

SEQ ID NO: 523565 - RNA, 18 nt, Chlamydophila pneumoniae J138
ucugcaacaaguugcauu

SEQ ID NO: 523566 - RNA, 21 nt, Chlamydophila pneumoniae J138
ucugagcauaacuugaagaag

SEQ ID NO: 523567 - RNA, 24 nt, Chlamydophila pneumoniae J138
ucucuuuuggaagaccuuuggauu

SEQ ID NO: 523568 - RNA, 15 nt, Chlamydophila pneumoniae J138
ucugaagauuuuuua

SEQ ID NO: 523569 - RNA, 22 nt, Chlamydophila pneumoniae J138
ucugaagauauauuuuuaaaga

SEQ ID NO: 523570 - RNA, 12 nt, Chlamydophila pneumoniae J138
ucugaagcugca

SEQ ID NO: 523571 - RNA, 23 nt, Chlamydophila pneumoniae J138
ucugaaucucauaaguauagaga

SEQ ID NO: 523572 - RNA, 17 nt, Chlamydophila pneumoniae J138
ucucuguagcacuucuc

SEQ ID NO: 523573 - RNA, 16 nt, Chlamydophila pneumoniae J138
ucucugccuaccaaag

SEQ ID NO: 523574 - RNA, 17 nt, Chlamydophila pneumoniae J138
ucucugcauauugcucu

SEQ ID NO: 523575 - RNA, 18 nt, Chlamydophila pneumoniae J138
ucucugcaacgcaguuua

SEQ ID NO: 523576 - RNA, 19 nt, Chlamydophila pneumoniae J138
ucucugauucucauaaagg

SEQ ID NO: 523577 - RNA, 21 nt, Chlamydophila pneumoniae J138
ucucuaugcacaaaauaaaac

SEQ ID NO: 523578 - RNA, 20 nt, Chlamydophila pneumoniae J138
ucucuaugaacgauuucuuu

SEQ ID NO: 523579 - RNA, 21 nt, Chlamydophila pneumoniae J138
ucucucaagucuauuugaaaa

SEQ ID NO: 523580 - RNA, 14 nt, Chlamydophila pneumoniae J138
ucucucaauaagau

SEQ ID NO: 523581 - RNA, 23 nt, Chlamydophila pneumoniae J138
ucucuccacagggucuaguucaa

SEQ ID NO: 523582 - RNA, 19 nt, Chlamydophila pneumoniae J138
ucucucgcauauucuuuug

SEQ ID NO: 523583 - RNA, 13 nt, Chlamydophila pneumoniae J138
ucucucuuuaaaa

SEQ ID NO: 523584 - RNA, 14 nt, Chlamydophila pneumoniae J138
ucucucuuccugcu

SEQ ID NO: 523585 - RNA, 14 nt, Chlamydophila pneumoniae J138
ucucucucugcagc

SEQ ID NO: 523586 - RNA, 16 nt, Chlamydophila pneumoniae J138
ucucuguuuuuugaaa

SEQ ID NO: 523587 - RNA, 17 nt, Chlamydophila pneumoniae J138
ucucuucacucuuuuau

SEQ ID NO: 523588 - RNA, 13 nt, Chlamydophila pneumoniae J138
ucucuuccaaaag

SEQ ID NO: 523589 - RNA, 15 nt, Chlamydophila pneumoniae J138
ucucuuccuucuccu

SEQ ID NO: 523590 - RNA, 14 nt, Chlamydophila pneumoniae J138
ucucuugauuccuu

SEQ ID NO: 523591 - RNA, 22 nt, Chlamydophila pneumoniae J138
ucucuugauuccuuaagucguc

SEQ ID NO: 523592 - RNA, 20 nt, Chlamydophila pneumoniae J138
ucucuugaagcacuuugacu

SEQ ID NO: 523593 - RNA, 19 nt, Chlamydophila pneumoniae J138
ucucuuuaacuucuaaaag

SEQ ID NO: 523594 - RNA, 17 nt, Chlamydophila pneumoniae J138
ucucuuuaacuucuaaa

SEQ ID NO: 523595 - RNA, 19 nt, Chlamydophila pneumoniae J138
ucucuuuaaaaauauaucu

SEQ ID NO: 523596 - RNA, 14 nt, Chlamydophila pneumoniae J138
ucucuuuaaaaauu

SEQ ID NO: 523597 - RNA, 13 nt, Chlamydophila pneumoniae J138
ucucuuucacaaa

SEQ ID NO: 523598 - RNA, 14 nt, Chlamydophila pneumoniae J138
ucuccucaucagaa

SEQ ID NO: 523599 - RNA, 15 nt, Chlamydophila pneumoniae J138
ucucccucacaagaa

SEQ ID NO: 523600 - RNA, 18 nt, Chlamydophila pneumoniae J138
ucucccgugagcaugcuc

SEQ ID NO: 523601 - RNA, 19 nt, Chlamydophila pneumoniae J138
ucucccgugagcaugcuca

SEQ ID NO: 523602 - RNA, 19 nt, Chlamydophila pneumoniae J138
ucucccucuaaacauaaag

SEQ ID NO: 523603 - RNA, 22 nt, Chlamydophila pneumoniae J138
ucucccuggucuguauuuucuu

SEQ ID NO: 523604 - RNA, 16 nt, Chlamydophila pneumoniae J138
ucucccuguauuaaag

SEQ ID NO: 523605 - RNA, 15 nt, Chlamydophila pneumoniae J138
ucucccuuaaggaaa

SEQ ID NO: 523606 - RNA, 16 nt, Chlamydophila pneumoniae J138
ucuccagguagcagag

SEQ ID NO: 523607 - RNA, 22 nt, Chlamydophila pneumoniae J138
ucucauugcggcaccaaagaug

SEQ ID NO: 523608 - RNA, 17 nt, Chlamydophila pneumoniae J138
ucucauuccagcaucuu

SEQ ID NO: 523609 - RNA, 19 nt, Chlamydophila pneumoniae J138
ucucauuccagcaucuucu

SEQ ID NO: 523610 - RNA, 15 nt, Chlamydophila pneumoniae J138
ucuaccaacugagcu

SEQ ID NO: 523611 - RNA, 14 nt, Chlamydophila pneumoniae J138
ucuacaugcucaag

SEQ ID NO: 523612 - RNA, 18 nt, Chlamydophila pneumoniae J138
ucuacaugcucaagaaga

SEQ ID NO: 523613 - RNA, 20 nt, Chlamydophila pneumoniae J138
ucuacaucccaagggccaga

SEQ ID NO: 523614 - RNA, 19 nt, Chlamydophila pneumoniae J138
ucuacaaacagauuuuuca

SEQ ID NO: 523615 - RNA, 17 nt, Chlamydophila pneumoniae J138
ucuacaucccaagggcc

SEQ ID NO: 523616 - RNA, 22 nt, Chlamydophila pneumoniae J138
ucucaugcggacuuuauucucu

SEQ ID NO: 523617 - RNA, 20 nt, Chlamydophila pneumoniae J138
ucucaugaaauuuucuaaga

SEQ ID NO: 523618 - RNA, 14 nt, Chlamydophila pneumoniae J138
ucucaugaaauuuu

SEQ ID NO: 523619 - RNA, 15 nt, Chlamydophila pneumoniae J138
ucucgugcauaauga

SEQ ID NO: 523620 - RNA, 17 nt, Chlamydophila pneumoniae J138
ucucgguuuaaggcaau

SEQ ID NO: 523621 - RNA, 19 nt, Chlamydophila pneumoniae J138
ucucgucauuaccugcuaa

SEQ ID NO: 523622 - RNA, 16 nt, Chlamydophila pneumoniae J138
ucucuaagcagccucu

SEQ ID NO: 523623 - RNA, 20 nt, Chlamydophila pneumoniae J138
ucucuaagaaucuauagaac

SEQ ID NO: 523624 - RNA, 18 nt, Chlamydophila pneumoniae J138
ucucuaagaaauuuucuc

SEQ ID NO: 523625 - RNA, 18 nt, Chlamydophila pneumoniae J138
ucucuaugcgcucuaaga

SEQ ID NO: 523626 - RNA, 17 nt, Chlamydophila pneumoniae J138
ucucuaguucuagaaag

SEQ ID NO: 523627 - RNA, 21 nt, Chlamydophila pneumoniae J138
ucucuagccaauauagaagcu

SEQ ID NO: 523628 - RNA, 21 nt, Chlamydophila pneumoniae J138
ucucuagcuguuaauucccgu

SEQ ID NO: 523629 - RNA, 22 nt, Chlamydophila pneumoniae J138
ucuccugaaccgcaaaaagcuu

SEQ ID NO: 523630 - RNA, 12 nt, Chlamydophila pneumoniae J138
ucuccugcaaaa

SEQ ID NO: 523631 - RNA, 21 nt, Chlamydophila pneumoniae J138
ucucgacacuauguguuuccu

SEQ ID NO: 523632 - RNA, 20 nt, Chlamydophila pneumoniae J138
ucucgaauagaaaagguauu

SEQ ID NO: 523633 - RNA, 19 nt, Chlamydophila pneumoniae J138
ucugcaauuccgaagaaga

SEQ ID NO: 523634 - RNA, 23 nt, Chlamydophila pneumoniae J138
ucugcaauuccgaagaagaaagg

SEQ ID NO: 523635 - RNA, 21 nt, Chlamydophila pneumoniae J138
ucugcgcugagguuauuuaau

SEQ ID NO: 523636 - RNA, 22 nt, Chlamydophila pneumoniae J138
ucugcgucuuuaauuaaaaguu

SEQ ID NO: 523637 - RNA, 15 nt, Chlamydophila pneumoniae J138
ucugcugaagggaca

SEQ ID NO: 523638 - RNA, 16 nt, Chlamydophila pneumoniae J138
ucugcguuucuuucug

SEQ ID NO: 523639 - RNA, 17 nt, Chlamydophila pneumoniae J138
ucugcuagagcuuucag

SEQ ID NO: 523640 - RNA, 15 nt, Chlamydophila pneumoniae J138
ucugcguuucuuucu

SEQ ID NO: 523641 - RNA, 22 nt, Chlamydophila pneumoniae J138
ucugcuccugaauaugcuuuuc

SEQ ID NO: 523642 - RNA, 21 nt, Chlamydophila pneumoniae J138
ucuggagaaaaaauaucuccg

SEQ ID NO: 523643 - RNA, 12 nt, Chlamydophila pneumoniae J138
ucuguguagccg

SEQ ID NO: 523644 - RNA, 14 nt, Chlamydophila pneumoniae J138
ucugucacuagaga

SEQ ID NO: 523645 - RNA, 20 nt, Chlamydophila pneumoniae J138
ucuguaagaacguggggaaa

SEQ ID NO: 523646 - RNA, 19 nt, Chlamydophila pneumoniae J138
ucuguaaagugaaauugaa

SEQ ID NO: 523647 - RNA, 17 nt, Chlamydophila pneumoniae J138
ucuguaauuuuuuucaa

SEQ ID NO: 523648 - RNA, 22 nt, Chlamydophila pneumoniae J138
ucuucaagagcuuuuacaaacc

SEQ ID NO: 523649 - RNA, 22 nt, Chlamydophila pneumoniae J138
ucuucaagguacugcucaauga

SEQ ID NO: 523650 - RNA, 13 nt, Chlamydophila pneumoniae J138
ucuucaagaaaug

SEQ ID NO: 523651 - RNA, 13 nt, Chlamydophila pneumoniae J138
ucuucaauuucuu

SEQ ID NO: 523652 - RNA, 13 nt, Chlamydophila pneumoniae J138
ucuucaagagcuu

SEQ ID NO: 523653 - RNA, 16 nt, Chlamydophila pneumoniae J138
ucuuauucacuggaau

SEQ ID NO: 523654 - RNA, 22 nt, Chlamydophila pneumoniae J138
ucuucaaagucaaauacuucuc

SEQ ID NO: 523655 - RNA, 13 nt, Chlamydophila pneumoniae J138
ucuucaaagaacu

SEQ ID NO: 523656 - RNA, 21 nt, Chlamydophila pneumoniae J138
ucuucaaagcuacuaaucacc

SEQ ID NO: 523657 - RNA, 13 nt, Chlamydophila pneumoniae J138
ucuucagcccacu

SEQ ID NO: 523658 - RNA, 19 nt, Chlamydophila pneumoniae J138
ucuucacuuauaagcugcu

SEQ ID NO: 523659 - RNA, 19 nt, Chlamydophila pneumoniae J138
ucuucagaguugucaagua

SEQ ID NO: 523660 - RNA, 19 nt, Chlamydophila pneumoniae J138
ucuucacgacauacaucaa

SEQ ID NO: 523661 - RNA, 22 nt, Chlamydophila pneumoniae J138
ucuucaucaauacgaucuuuug

SEQ ID NO: 523662 - RNA, 15 nt, Chlamydophila pneumoniae J138
ucuucaucaauacga

SEQ ID NO: 523663 - RNA, 16 nt, Chlamydophila pneumoniae J138
ucuucauccgaagacu

SEQ ID NO: 523664 - RNA, 13 nt, Chlamydophila pneumoniae J138
ucuucauccgaag

SEQ ID NO: 523665 - RNA, 14 nt, Chlamydophila pneumoniae J138
ucuguuaaaaacaa

SEQ ID NO: 523666 - RNA, 17 nt, Chlamydophila pneumoniae J138
ucuguuaaaaacaagau

SEQ ID NO: 523667 - RNA, 18 nt, Chlamydophila pneumoniae J138
ucuuagaagagaaaguag

SEQ ID NO: 523668 - RNA, 14 nt, Chlamydophila pneumoniae J138
ucuuagaauccaaa

SEQ ID NO: 523669 - RNA, 14 nt, Chlamydophila pneumoniae J138
ucuuaugaccaaga

SEQ ID NO: 523670 - RNA, 16 nt, Chlamydophila pneumoniae J138
ucuuaugggagaagcu

SEQ ID NO: 523671 - RNA, 17 nt, Chlamydophila pneumoniae J138
ucuuauggucagaagcu

SEQ ID NO: 523672 - RNA, 18 nt, Chlamydophila pneumoniae J138
ucuuauguuaaaaauacc

SEQ ID NO: 523673 - RNA, 18 nt, Chlamydophila pneumoniae J138
ucuuaugaaguccagacu

SEQ ID NO: 523674 - RNA, 13 nt, Chlamydophila pneumoniae J138
ucuuaucugcuau

SEQ ID NO: 523675 - RNA, 15 nt, Chlamydophila pneumoniae J138
ucuuaucuggagaug

SEQ ID NO: 523676 - RNA, 17 nt, Chlamydophila pneumoniae J138
ucuuauagggaauuuuu

SEQ ID NO: 523677 - RNA, 16 nt, Chlamydophila pneumoniae J138
ucuuaguaaagaauca

SEQ ID NO: 523678 - RNA, 16 nt, Chlamydophila pneumoniae J138
ucuuagccaaaauuuc

SEQ ID NO: 523679 - RNA, 12 nt, Chlamydophila pneumoniae J138
ucuuagccuagg

SEQ ID NO: 523680 - RNA, 18 nt, Chlamydophila pneumoniae J138
ucuuauagacagguacau

SEQ ID NO: 523681 - RNA, 14 nt, Chlamydophila pneumoniae J138
ucuuucauucccuu

SEQ ID NO: 523682 - RNA, 18 nt, Chlamydophila pneumoniae J138
ucuuuccauagccaagga

SEQ ID NO: 523683 - RNA, 16 nt, Chlamydophila pneumoniae J138
ucuuucuaggccggga

SEQ ID NO: 523684 - RNA, 15 nt, Chlamydophila pneumoniae J138
ucuuucuauagcucc

SEQ ID NO: 523685 - RNA, 16 nt, Chlamydophila pneumoniae J138
ucuuucuauagcuccu

SEQ ID NO: 523686 - RNA, 18 nt, Chlamydophila pneumoniae J138
ucuuucggugucucuaga

SEQ ID NO: 523687 - RNA, 14 nt, Chlamydophila pneumoniae J138
ucuuucuaagaaga

SEQ ID NO: 523688 - RNA, 11 nt, Chlamydophila pneumoniae J138
ucuuucuagaa

SEQ ID NO: 523689 - RNA, 14 nt, Chlamydophila pneumoniae J138
ucuuucuuaggaaa

SEQ ID NO: 523690 - RNA, 21 nt, Chlamydophila pneumoniae J138
ucuuuaucuagcucuucaagg

SEQ ID NO: 523691 - RNA, 15 nt, Chlamydophila pneumoniae J138
ucuuuaauuccaacu

SEQ ID NO: 523692 - RNA, 22 nt, Chlamydophila pneumoniae J138
ucuuuaauccaguuuuuuaaau

SEQ ID NO: 523693 - RNA, 19 nt, Chlamydophila pneumoniae J138
ucuuuaauugugcucucua

SEQ ID NO: 523694 - RNA, 14 nt, Chlamydophila pneumoniae J138
ucuuucauacuaaa

SEQ ID NO: 523695 - RNA, 14 nt, Chlamydophila pneumoniae J138
ucuuucagaaagaa

SEQ ID NO: 523696 - RNA, 20 nt, Chlamydophila pneumoniae J138
ucuuucaccaacuccucuaa

SEQ ID NO: 523697 - RNA, 19 nt, Chlamydophila pneumoniae J138
ucuuucacaucuuuagaau

SEQ ID NO: 523698 - RNA, 21 nt, Chlamydophila pneumoniae J138
ucuuucacaucuuuagaauca

SEQ ID NO: 523699 - RNA, 18 nt, Chlamydophila pneumoniae J138
ucuuucacaucuuuagaa

SEQ ID NO: 523700 - RNA, 14 nt, Chlamydophila pneumoniae J138
ucuuuaugagagag

SEQ ID NO: 523701 - RNA, 16 nt, Chlamydophila pneumoniae J138
ucuuccccccucacaa

SEQ ID NO: 523702 - RNA, 19 nt, Chlamydophila pneumoniae J138
ucuugcucaggagauacaa

SEQ ID NO: 523703 - RNA, 14 nt, Chlamydophila pneumoniae J138
ucuucccccagacc

SEQ ID NO: 523704 - RNA, 13 nt, Chlamydophila pneumoniae J138
ucuugcucugaca

SEQ ID NO: 523705 - RNA, 17 nt, Chlamydophila pneumoniae J138
ucuugcugauuuuugcu

SEQ ID NO: 523706 - RNA, 23 nt, Chlamydophila pneumoniae J138
ucuugcugcccaaauugagaaau

SEQ ID NO: 523707 - RNA, 19 nt, Chlamydophila pneumoniae J138
ucuugcuuauugucuuaaa

SEQ ID NO: 523708 - RNA, 16 nt, Chlamydophila pneumoniae J138
ucuugcuuauugucuu

SEQ ID NO: 523709 - RNA, 14 nt, Chlamydophila pneumoniae J138
ucuugcuuuuccgu

SEQ ID NO: 523710 - RNA, 17 nt, Chlamydophila pneumoniae J138
ucuucccagguaaacaa

SEQ ID NO: 523711 - RNA, 18 nt, Chlamydophila pneumoniae J138
ucuuggucggaguuuuuu

SEQ ID NO: 523712 - RNA, 18 nt, Chlamydophila pneumoniae J138
ucuugugguuuuucuccu

SEQ ID NO: 523713 - RNA, 14 nt, Chlamydophila pneumoniae J138
ucuuguucuaaaau

SEQ ID NO: 523714 - RNA, 19 nt, Chlamydophila pneumoniae J138
ucuuuaagauuuuuagaau

SEQ ID NO: 523715 - RNA, 16 nt, Chlamydophila pneumoniae J138
ucuuuaagauuuccuu

SEQ ID NO: 523716 - RNA, 21 nt, Chlamydophila pneumoniae J138
ucuuugacaucuaauuuuaaa

SEQ ID NO: 523717 - RNA, 19 nt, Chlamydophila pneumoniae J138
ucuuugaacaacuccuuaa

SEQ ID NO: 523718 - RNA, 22 nt, Chlamydophila pneumoniae J138
ucuuugaagaacaaaaaaucaa

SEQ ID NO: 523719 - RNA, 20 nt, Chlamydophila pneumoniae J138
ucuuugagaucuugaaugau

SEQ ID NO: 523720 - RNA, 18 nt, Chlamydophila pneumoniae J138
ucuuugaggauacgaaua

SEQ ID NO: 523721 - RNA, 20 nt, Chlamydophila pneumoniae J138
ucuuugaggauacgaauaag

SEQ ID NO: 523722 - RNA, 18 nt, Chlamydophila pneumoniae J138
ucuuugagaucuugaaug

SEQ ID NO: 523723 - RNA, 19 nt, Chlamydophila pneumoniae J138
ucuuugggauaaaaaguuu

SEQ ID NO: 523724 - RNA, 20 nt, Chlamydophila pneumoniae J138
ucuuuggcacaauccucacu

SEQ ID NO: 523725 - RNA, 22 nt, Chlamydophila pneumoniae J138
ucuuugauuuucaggagaccag

SEQ ID NO: 523726 - RNA, 17 nt, Chlamydophila pneumoniae J138
ucuuuuauauuaagaau

SEQ ID NO: 523727 - RNA, 18 nt, Chlamydophila pneumoniae J138
ucuuuuaugauguauaaa

SEQ ID NO: 523728 - RNA, 21 nt, Chlamydophila pneumoniae J138
ucuuuuaugauguauaaaguu

SEQ ID NO: 523729 - RNA, 23 nt, Chlamydophila pneumoniae J138
ucuuuuauauaccacuacugagc

SEQ ID NO: 523730 - RNA, 13 nt, Chlamydophila pneumoniae J138
ucuuuuucuaaga

SEQ ID NO: 523731 - RNA, 21 nt, Chlamydophila pneumoniae J138
ucuuuuucuagggaucccaaa

SEQ ID NO: 523732 - RNA, 13 nt, Chlamydophila pneumoniae J138
ugaaaaaauucua

SEQ ID NO: 523733 - RNA, 23 nt, Chlamydophila pneumoniae J138
ucuuuugguugugucaacccuuu

SEQ ID NO: 523734 - RNA, 16 nt, Chlamydophila pneumoniae J138
ucuuuugauaacuuug

SEQ ID NO: 523735 - RNA, 14 nt, Chlamydophila pneumoniae J138
ucuuuucugaagau

SEQ ID NO: 523736 - RNA, 17 nt, Chlamydophila pneumoniae J138
ucuuuucggaucagaau

SEQ ID NO: 523737 - RNA, 20 nt, Chlamydophila pneumoniae J138
ucuuuuuauugauaaugauu

SEQ ID NO: 523738 - RNA, 19 nt, Chlamydophila pneumoniae J138
ucuuuuuauugauaaugau

SEQ ID NO: 523739 - RNA, 16 nt, Chlamydophila pneumoniae J138
ucuuuuucagcuucua

SEQ ID NO: 523740 - RNA, 13 nt, Chlamydophila pneumoniae J138
ucuuuuucagaaa

SEQ ID NO: 523741 - RNA, 16 nt, Chlamydophila pneumoniae J138
ugaaaucguaucuuuu

SEQ ID NO: 523742 - RNA, 14 nt, Chlamydophila pneumoniae J138
ugaaaucaaaaaaa

SEQ ID NO: 523743 - RNA, 23 nt, Chlamydophila pneumoniae J138
ugaaauacuccacuuuuuucccu

SEQ ID NO: 523744 - RNA, 19 nt, Chlamydophila pneumoniae J138
ugaacaaaaaggacucuuu

SEQ ID NO: 523745 - RNA, 14 nt, Chlamydophila pneumoniae J138
ugaaauuucugaaa

SEQ ID NO: 523746 - RNA, 17 nt, Chlamydophila pneumoniae J138
ugaaauuucugaaacaa

SEQ ID NO: 523747 - RNA, 19 nt, Chlamydophila pneumoniae J138
ugaaauuucauucucacag

SEQ ID NO: 523748 - RNA, 20 nt, Chlamydophila pneumoniae J138
ugaacaucgguuuccaagac

SEQ ID NO: 523749 - RNA, 13 nt, Chlamydophila pneumoniae J138
ugaacauaauucg

SEQ ID NO: 523750 - RNA, 16 nt, Chlamydophila pneumoniae J138
ugaaccuuugguagaa

SEQ ID NO: 523751 - RNA, 19 nt, Chlamydophila pneumoniae J138
ugaaagaaugccauucuua

SEQ ID NO: 523752 - RNA, 22 nt, Chlamydophila pneumoniae J138
ugaaagauguguuuuaacaacu

SEQ ID NO: 523753 - RNA, 18 nt, Chlamydophila pneumoniae J138
ugaaacgcccuucaggac

SEQ ID NO: 523754 - RNA, 13 nt, Chlamydophila pneumoniae J138
ugaaacuuuagga

SEQ ID NO: 523755 - RNA, 18 nt, Chlamydophila pneumoniae J138
ugaaacuuuuuuucuucu

SEQ ID NO: 523756 - RNA, 20 nt, Chlamydophila pneumoniae J138
ugaaaagauuugcgaaucua

SEQ ID NO: 523757 - RNA, 18 nt, Chlamydophila pneumoniae J138
ugaaaaucaagaagagaa

SEQ ID NO: 523758 - RNA, 21 nt, Chlamydophila pneumoniae J138
ugaaaaucgcaccuugaccuc

SEQ ID NO: 523759 - RNA, 19 nt, Chlamydophila pneumoniae J138
ugaaaauucgaauucucag

SEQ ID NO: 523760 - RNA, 14 nt, Chlamydophila pneumoniae J138
gggaagaggaaugc

SEQ ID NO: 523761 - RNA, 19 nt, Chlamydophila pneumoniae J138
gggaagaaacuucucuagg

SEQ ID NO: 523762 - RNA, 18 nt, Chlamydophila pneumoniae J138
ggcuuuucuuuuucuagg

SEQ ID NO: 523763 - RNA, 15 nt, Chlamydophila pneumoniae J138
gggacauuuccccau

SEQ ID NO: 523764 - RNA, 18 nt, Chlamydophila pneumoniae J138
gggaauucuuuuccugca

SEQ ID NO: 523765 - RNA, 20 nt, Chlamydophila pneumoniae J138
gggauuguucuuuacuacau

SEQ ID NO: 523766 - RNA, 15 nt, Chlamydophila pneumoniae J138
gggauugauaacaau

SEQ ID NO: 523767 - RNA, 12 nt, Chlamydophila pneumoniae J138
gggagaugcuau

SEQ ID NO: 523768 - RNA, 14 nt, Chlamydophila pneumoniae J138
gggagagccauuuu

SEQ ID NO: 523769 - RNA, 14 nt, Chlamydophila pneumoniae J138
gggaucacagucuu

SEQ ID NO: 523770 - RNA, 21 nt, Chlamydophila pneumoniae J138
ggggaucuucagagagaacag

SEQ ID NO: 523771 - RNA, 14 nt, Chlamydophila pneumoniae J138
ggggagucuuggau

SEQ ID NO: 523772 - RNA, 15 nt, Chlamydophila pneumoniae J138
ggggauugauaacaa

SEQ ID NO: 523773 - RNA, 15 nt, Chlamydophila pneumoniae J138
ggggauuaucccaaa

SEQ ID NO: 523774 - RNA, 22 nt, Chlamydophila pneumoniae J138
ggggaucuuaggaaauuuggau

SEQ ID NO: 523775 - RNA, 14 nt, Chlamydophila pneumoniae J138
gggccucuucccaa

SEQ ID NO: 523776 - RNA, 13 nt, Chlamydophila pneumoniae J138
ggggcuuuccuuc

SEQ ID NO: 523777 - RNA, 12 nt, Chlamydophila pneumoniae J138
ggguaaguccac

SEQ ID NO: 523778 - RNA, 15 nt, Chlamydophila pneumoniae J138
gguauuucucuccac

SEQ ID NO: 523779 - RNA, 16 nt, Chlamydophila pneumoniae J138
gguauagaaacaccgu

SEQ ID NO: 523780 - RNA, 21 nt, Chlamydophila pneumoniae J138
ggucacuucaauuacaggagc

SEQ ID NO: 523781 - RNA, 18 nt, Chlamydophila pneumoniae J138
ggucucccucacaagaag

SEQ ID NO: 523782 - RNA, 14 nt, Chlamydophila pneumoniae J138
ggugcaucauuuuc

SEQ ID NO: 523783 - RNA, 19 nt, Chlamydophila pneumoniae J138
gguuccuuaaagaguuugu

SEQ ID NO: 523784 - RNA, 20 nt, Chlamydophila pneumoniae J138
gguuccucuuccuuuuugca

SEQ ID NO: 523785 - RNA, 11 nt, Chlamydophila pneumoniae J138
gguucaaaucc

SEQ ID NO: 523786 - RNA, 12 nt, Chlamydophila pneumoniae J138
gguuaucuuuuu

SEQ ID NO: 523787 - RNA, 21 nt, Chlamydophila pneumoniae J138
gguucuuccauaagaucaaua

SEQ ID NO: 523788 - RNA, 21 nt, Chlamydophila pneumoniae J138
gguucugaaauugucuucagu

SEQ ID NO: 523789 - RNA, 18 nt, Chlamydophila pneumoniae J138
gguuggcagcaaauccuu

SEQ ID NO: 523790 - RNA, 16 nt, Chlamydophila pneumoniae J138
gguuuugaagcuccuc

SEQ ID NO: 523791 - RNA, 15 nt, Chlamydophila pneumoniae J138
gguuuucuccuucuc

SEQ ID NO: 523792 - RNA, 14 nt, Chlamydophila pneumoniae J138
guaaaaauggcacu

SEQ ID NO: 523793 - RNA, 16 nt, Chlamydophila pneumoniae J138
guaaaaagccuaugau

SEQ ID NO: 523794 - RNA, 12 nt, Chlamydophila pneumoniae J138
gguuucuaaaua

SEQ ID NO: 523795 - RNA, 11 nt, Chlamydophila pneumoniae J138
gguuucuaggu

SEQ ID NO: 523796 - RNA, 19 nt, Chlamydophila pneumoniae J138
gguuugcaugccuauuaag

SEQ ID NO: 523797 - RNA, 16 nt, Chlamydophila pneumoniae J138
gguuucuuuuuuuuga

SEQ ID NO: 523798 - RNA, 23 nt, Chlamydophila pneumoniae J138
gguuucuuuuuuuugaagugcuu

SEQ ID NO: 523799 - RNA, 18 nt, Chlamydophila pneumoniae J138
guaauccagauuguucaa

SEQ ID NO: 523800 - RNA, 21 nt, Chlamydophila pneumoniae J138
guaaaagcccuaauucauauu

SEQ ID NO: 523801 - RNA, 16 nt, Chlamydophila pneumoniae J138
guaaugagcuggaaga

SEQ ID NO: 523802 - RNA, 14 nt, Chlamydophila pneumoniae J138
guaaucuguauaug

SEQ ID NO: 523803 - RNA, 23 nt, Chlamydophila pneumoniae J138
guacaguugcgcgcccucuucua

SEQ ID NO: 523804 - RNA, 16 nt, Chlamydophila pneumoniae J138
guacaguuuuuuucua

SEQ ID NO: 523805 - RNA, 15 nt, Chlamydophila pneumoniae J138
guacauagaggagau

SEQ ID NO: 523806 - RNA, 18 nt, Chlamydophila pneumoniae J138
guacaauuugcuccucca

SEQ ID NO: 523807 - RNA, 20 nt, Chlamydophila pneumoniae J138
guaauuucuagcuaauaaug

SEQ ID NO: 523808 - RNA, 22 nt, Chlamydophila pneumoniae J138
guaauuucuaaauagaaaacau

SEQ ID NO: 523809 - RNA, 20 nt, Chlamydophila pneumoniae J138
guacucuucuuuuuaucaug

SEQ ID NO: 523810 - RNA, 14 nt, Chlamydophila pneumoniae J138
guacuuuacacuau

SEQ ID NO: 523811 - RNA, 16 nt, Chlamydophila pneumoniae J138
guagaauccuucuccc

SEQ ID NO: 523812 - RNA, 18 nt, Chlamydophila pneumoniae J138
guagaauccuucucccuc

SEQ ID NO: 523813 - RNA, 13 nt, Chlamydophila pneumoniae J138
guagaauccuucu

SEQ ID NO: 523814 - RNA, 19 nt, Chlamydophila pneumoniae J138
guagacaauaccagauaaa

SEQ ID NO: 523815 - RNA, 16 nt, Chlamydophila pneumoniae J138
guagcagagccucacu

SEQ ID NO: 523816 - RNA, 18 nt, Chlamydophila pneumoniae J138
guagcauuucuuucucuu

SEQ ID NO: 523817 - RNA, 19 nt, Chlamydophila pneumoniae J138
guagcgcuuccagcuucuc

SEQ ID NO: 523818 - RNA, 21 nt, Chlamydophila pneumoniae J138
guauagacuccuuaacaaccg

SEQ ID NO: 523819 - RNA, 13 nt, Chlamydophila pneumoniae J138
guauaguauuuuu

SEQ ID NO: 523820 - RNA, 14 nt, Chlamydophila pneumoniae J138
guauaguauuuuua

SEQ ID NO: 523821 - RNA, 19 nt, Chlamydophila pneumoniae J138
guagcguacguuuucucuu

SEQ ID NO: 523822 - RNA, 16 nt, Chlamydophila pneumoniae J138
guauacgguaaugcca

SEQ ID NO: 523823 - RNA, 15 nt, Chlamydophila pneumoniae J138
guauacuaagacugu

SEQ ID NO: 523824 - RNA, 19 nt, Chlamydophila pneumoniae J138
guaggaacaugccaaauau

SEQ ID NO: 523825 - RNA, 19 nt, Chlamydophila pneumoniae J138
guaucaagaauaugggugu

SEQ ID NO: 523826 - RNA, 19 nt, Chlamydophila pneumoniae J138
guauccuccuucugcauga

SEQ ID NO: 523827 - RNA, 23 nt, Chlamydophila pneumoniae J138
guauccuucuacaaugauauaaa

SEQ ID NO: 523828 - RNA, 23 nt, Chlamydophila pneumoniae J138
guaucgacuuuuuuaagaguguc

SEQ ID NO: 523829 - RNA, 22 nt, Chlamydophila pneumoniae J138
guaucuucuucgguguagaucu

SEQ ID NO: 523830 - RNA, 14 nt, Chlamydophila pneumoniae J138
guaucuccggaacg

SEQ ID NO: 523831 - RNA, 16 nt, Chlamydophila pneumoniae J138
guaucuguauccuucc

SEQ ID NO: 523832 - RNA, 12 nt, Chlamydophila pneumoniae J138
guaucuucagua

SEQ ID NO: 523833 - RNA, 15 nt, Chlamydophila pneumoniae J138
guauuuuuaaauaca

SEQ ID NO: 523834 - RNA, 13 nt, Chlamydophila pneumoniae J138
guauuuucuucaa

SEQ ID NO: 523835 - RNA, 18 nt, Chlamydophila pneumoniae J138
guauuuaccuacagauau

SEQ ID NO: 523836 - RNA, 17 nt, Chlamydophila pneumoniae J138
guauugcaaauuucauu

SEQ ID NO: 523837 - RNA, 22 nt, Chlamydophila pneumoniae J138
guauuccuuggauuucuucuuc

SEQ ID NO: 523838 - RNA, 14 nt, Chlamydophila pneumoniae J138
guauucugaagcug

SEQ ID NO: 523839 - RNA, 21 nt, Chlamydophila pneumoniae J138
gucaauaagcuugccagcaga

SEQ ID NO: 523840 - RNA, 14 nt, Chlamydophila pneumoniae J138
gucacaaugaucuu

SEQ ID NO: 523841 - RNA, 21 nt, Chlamydophila pneumoniae J138
gucaaauucauuaagaacauc

SEQ ID NO: 523842 - RNA, 16 nt, Chlamydophila pneumoniae J138
gucaaagguuuuaaaa

SEQ ID NO: 523843 - RNA, 21 nt, Chlamydophila pneumoniae J138
gucaaacuuauacacuccaau

SEQ ID NO: 523844 - RNA, 19 nt, Chlamydophila pneumoniae J138
gucaccuuaauggcuccua

SEQ ID NO: 523845 - RNA, 13 nt, Chlamydophila pneumoniae J138
gucauauuuaaaa

SEQ ID NO: 523846 - RNA, 23 nt, Chlamydophila pneumoniae J138
gucaucaguggcgacugcaacag

SEQ ID NO: 523847 - RNA, 22 nt, Chlamydophila pneumoniae J138
gucaucccacgggucaggaggu

SEQ ID NO: 523848 - RNA, 17 nt, Chlamydophila pneumoniae J138
guccaagguucugggaa

SEQ ID NO: 523849 - RNA, 16 nt, Chlamydophila pneumoniae J138
guccagacuuuccucu

SEQ ID NO: 523850 - RNA, 16 nt, Chlamydophila pneumoniae J138
guccagccugcaccag

SEQ ID NO: 523851 - RNA, 12 nt, Chlamydophila pneumoniae J138
gucgacaugcag

SEQ ID NO: 523852 - RNA, 12 nt, Chlamydophila pneumoniae J138
gucgaagauuca

SEQ ID NO: 523853 - RNA, 20 nt, Chlamydophila pneumoniae J138
guccuuuauaauggugucuu

SEQ ID NO: 523854 - RNA, 24 nt, Chlamydophila pneumoniae J138
gucccugauuccauccugucuauu

SEQ ID NO: 523855 - RNA, 13 nt, Chlamydophila pneumoniae J138
gucccuuucagua

SEQ ID NO: 523856 - RNA, 22 nt, Chlamydophila pneumoniae J138
gucccucuaaugacagcugaga

SEQ ID NO: 523857 - RNA, 21 nt, Chlamydophila pneumoniae J138
gucccuagaaucaucugguau

SEQ ID NO: 523858 - RNA, 13 nt, Chlamydophila pneumoniae J138
guccauucugacc

SEQ ID NO: 523859 - RNA, 19 nt, Chlamydophila pneumoniae J138
guccuccauggaaagaaac

SEQ ID NO: 523860 - RNA, 17 nt, Chlamydophila pneumoniae J138
guccgucaggaacccug

SEQ ID NO: 523861 - RNA, 20 nt, Chlamydophila pneumoniae J138
gucgcuagaucacaagaaag

SEQ ID NO: 523862 - RNA, 18 nt, Chlamydophila pneumoniae J138
gucggagguucgaauccu

SEQ ID NO: 523863 - RNA, 20 nt, Chlamydophila pneumoniae J138
gucgcgacaagacaaugacu

SEQ ID NO: 523864 - RNA, 16 nt, Chlamydophila pneumoniae J138
gucgcgacaagacaau

SEQ ID NO: 523865 - RNA, 22 nt, Chlamydophila pneumoniae J138
gucggcuuuagaaaagugcccu

SEQ ID NO: 523866 - RNA, 14 nt, Chlamydophila pneumoniae J138
gucggcuuuagaaa

SEQ ID NO: 523867 - RNA, 21 nt, Chlamydophila pneumoniae J138
gucguaaacggacgcuagaga

SEQ ID NO: 523868 - RNA, 19 nt, Chlamydophila pneumoniae J138
gucguaaucuuuuuuaaag

SEQ ID NO: 523869 - RNA, 19 nt, Chlamydophila pneumoniae J138
gucgucuuuuaaagagcgc

SEQ ID NO: 523870 - RNA, 16 nt, Chlamydophila pneumoniae J138
gucuagaacacucaga

SEQ ID NO: 523871 - RNA, 22 nt, Chlamydophila pneumoniae J138
gucuacagaggaaucuauccuu

SEQ ID NO: 523872 - RNA, 12 nt, Chlamydophila pneumoniae J138
gucuaaaggagu

SEQ ID NO: 523873 - RNA, 21 nt, Chlamydophila pneumoniae J138
gucucccuggucuguauuuuc

SEQ ID NO: 523874 - RNA, 13 nt, Chlamydophila pneumoniae J138
gucucccucacaa

SEQ ID NO: 523875 - RNA, 16 nt, Chlamydophila pneumoniae J138
gucucaugaccuucag

SEQ ID NO: 523876 - RNA, 18 nt, Chlamydophila pneumoniae J138
gucuccagaagcaagaau

SEQ ID NO: 523877 - RNA, 15 nt, Chlamydophila pneumoniae J138
gucuccaaagauaca

SEQ ID NO: 523878 - RNA, 20 nt, Chlamydophila pneumoniae J138
gucuccaaauguucucucca

SEQ ID NO: 523879 - RNA, 14 nt, Chlamydophila pneumoniae J138
gucuauuugaaaag

SEQ ID NO: 523880 - RNA, 20 nt, Chlamydophila pneumoniae J138
gucuauucucuucauuuucu

SEQ ID NO: 523881 - RNA, 15 nt, Chlamydophila pneumoniae J138
gucuuaaaauuccug

SEQ ID NO: 523882 - RNA, 16 nt, Chlamydophila pneumoniae J138
gucuuagaauccucua

SEQ ID NO: 523883 - RNA, 13 nt, Chlamydophila pneumoniae J138
gucugugagaaau

SEQ ID NO: 523884 - RNA, 13 nt, Chlamydophila pneumoniae J138
gucuuccaucucu

SEQ ID NO: 523885 - RNA, 19 nt, Chlamydophila pneumoniae J138
gucuucauaugcucucccg

SEQ ID NO: 523886 - RNA, 20 nt, Chlamydophila pneumoniae J138
gucuuaucuaaagaaaugua

SEQ ID NO: 523887 - RNA, 13 nt, Chlamydophila pneumoniae J138
gucuguaaggaca

SEQ ID NO: 523888 - RNA, 14 nt, Chlamydophila pneumoniae J138
gucugcugaggaga

SEQ ID NO: 523889 - RNA, 22 nt, Chlamydophila pneumoniae J138
gucucuugcgucacauuuguug

SEQ ID NO: 523890 - RNA, 16 nt, Chlamydophila pneumoniae J138
gucucuuucagcucaa

SEQ ID NO: 523891 - RNA, 21 nt, Chlamydophila pneumoniae J138
gucucgaaacucuuugaggau

SEQ ID NO: 523892 - RNA, 15 nt, Chlamydophila pneumoniae J138
gucuuccguauaagu

SEQ ID NO: 523893 - RNA, 22 nt, Chlamydophila pneumoniae J138
gucuuccccccucacaauauaa

SEQ ID NO: 523894 - RNA, 16 nt, Chlamydophila pneumoniae J138
gucuuccuagaccuau

SEQ ID NO: 523895 - RNA, 20 nt, Chlamydophila pneumoniae J138
gucuucuguaauuuuuuuca

SEQ ID NO: 523896 - RNA, 21 nt, Chlamydophila pneumoniae J138
gucuucuguaauuuuuuucaa

SEQ ID NO: 523897 - RNA, 23 nt, Chlamydophila pneumoniae J138
gucuugcuuugugaguucuuccu

SEQ ID NO: 523898 - RNA, 19 nt, Chlamydophila pneumoniae J138
gucuugacguugcgaacag

SEQ ID NO: 523899 - RNA, 23 nt, Chlamydophila pneumoniae J138
gucuuuucuaagcaauauuucug

SEQ ID NO: 523900 - RNA, 14 nt, Chlamydophila pneumoniae J138
gugaaugagcuuca

SEQ ID NO: 523901 - RNA, 21 nt, Chlamydophila pneumoniae J138
gugaauauguacugaugugaa

SEQ ID NO: 523902 - RNA, 19 nt, Chlamydophila pneumoniae J138
gugaagcugcuucuucaga

SEQ ID NO: 523903 - RNA, 13 nt, Chlamydophila pneumoniae J138
gugaaaucugcuc

SEQ ID NO: 523904 - RNA, 19 nt, Chlamydophila pneumoniae J138
gugaaaguacaggaguucc

SEQ ID NO: 523905 - RNA, 16 nt, Chlamydophila pneumoniae J138
gugaaauauugaucuu

SEQ ID NO: 523906 - RNA, 20 nt, Chlamydophila pneumoniae J138
gugacucuuaucuggagaug

SEQ ID NO: 523907 - RNA, 12 nt, Chlamydophila pneumoniae J138
gugacuccuggu

SEQ ID NO: 523908 - RNA, 14 nt, Chlamydophila pneumoniae J138
gugaguucuuccuu

SEQ ID NO: 523909 - RNA, 19 nt, Chlamydophila pneumoniae J138
gugaucaaaauuauccaga

SEQ ID NO: 523910 - RNA, 14 nt, Chlamydophila pneumoniae J138
gugccaucuguaga

SEQ ID NO: 523911 - RNA, 13 nt, Chlamydophila pneumoniae J138
gugcaugcaucuu

SEQ ID NO: 523912 - RNA, 21 nt, Chlamydophila pneumoniae J138
gugccuguaauugauguuccu

SEQ ID NO: 523913 - RNA, 13 nt, Chlamydophila pneumoniae J138
gugccuguaauug

SEQ ID NO: 523914 - RNA, 21 nt, Chlamydophila pneumoniae J138
guggaaauugugaaaaaaaac

SEQ ID NO: 523915 - RNA, 14 nt, Chlamydophila pneumoniae J138
guggagguuaguau

SEQ ID NO: 523916 - RNA, 23 nt, Chlamydophila pneumoniae J138
guggagcuugucuaggagcuucg

SEQ ID NO: 523917 - RNA, 16 nt, Chlamydophila pneumoniae J138
guggacggggagagcc

SEQ ID NO: 523918 - RNA, 15 nt, Chlamydophila pneumoniae J138
guggaguaucuagcu

SEQ ID NO: 523919 - RNA, 14 nt, Chlamydophila pneumoniae J138
gugggaggaauccu

SEQ ID NO: 523920 - RNA, 12 nt, Chlamydophila pneumoniae J138
guggucuagaga

SEQ ID NO: 523921 - RNA, 16 nt, Chlamydophila pneumoniae J138
gugucauacgcagcac

SEQ ID NO: 523922 - RNA, 19 nt, Chlamydophila pneumoniae J138
guguggaucacguaagcuu

SEQ ID NO: 523923 - RNA, 15 nt, Chlamydophila pneumoniae J138
guuaagcaccauaau

SEQ ID NO: 523924 - RNA, 13 nt, Chlamydophila pneumoniae J138
guuaacuccuuca

SEQ ID NO: 523925 - RNA, 19 nt, Chlamydophila pneumoniae J138
guguuuuuggcauaaagac

SEQ ID NO: 523926 - RNA, 13 nt, Chlamydophila pneumoniae J138
guuaucaggaacu

SEQ ID NO: 523927 - RNA, 15 nt, Chlamydophila pneumoniae J138
guuauauagacaaug

SEQ ID NO: 523928 - RNA, 13 nt, Chlamydophila pneumoniae J138
guuauaagugacu

SEQ ID NO: 523929 - RNA, 15 nt, Chlamydophila pneumoniae J138
guuaggucuuaaagu

SEQ ID NO: 523930 - RNA, 20 nt, Chlamydophila pneumoniae J138
guuaucucccaagacgagaa

SEQ ID NO: 523931 - RNA, 14 nt, Chlamydophila pneumoniae J138
guuaugaagcuucu

SEQ ID NO: 523932 - RNA, 16 nt, Chlamydophila pneumoniae J138
guuauuaauaaauuua

SEQ ID NO: 523933 - RNA, 13 nt, Chlamydophila pneumoniae J138
guuauugaguguu

SEQ ID NO: 523934 - RNA, 22 nt, Chlamydophila pneumoniae J138
guucaacuuuguuaauagaaga

SEQ ID NO: 523935 - RNA, 15 nt, Chlamydophila pneumoniae J138
guuauuguuucuaug

SEQ ID NO: 523936 - RNA, 22 nt, Chlamydophila pneumoniae J138
guucaccacuaccgaauuuuca

SEQ ID NO: 523937 - RNA, 14 nt, Chlamydophila pneumoniae J138
guucacauuuucau

SEQ ID NO: 523938 - RNA, 15 nt, Chlamydophila pneumoniae J138
guuccacuugcucuu

SEQ ID NO: 523939 - RNA, 22 nt, Chlamydophila pneumoniae J138
guucaucuagaugauaacguuu

SEQ ID NO: 523940 - RNA, 21 nt, Chlamydophila pneumoniae J138
guuccgaauaggcauuacaca

SEQ ID NO: 523941 - RNA, 13 nt, Chlamydophila pneumoniae J138
guuccauuuucag

SEQ ID NO: 523942 - RNA, 18 nt, Chlamydophila pneumoniae J138
guucccacuggacuucgu

SEQ ID NO: 523943 - RNA, 17 nt, Chlamydophila pneumoniae J138
guucccaaauagaaaau

SEQ ID NO: 523944 - RNA, 17 nt, Chlamydophila pneumoniae J138
guucccuggaugaacuc

SEQ ID NO: 523945 - RNA, 22 nt, Chlamydophila pneumoniae J138
guuccauagaguaucuaaaacu

SEQ ID NO: 523946 - RNA, 15 nt, Chlamydophila pneumoniae J138
guuccauaucaaaga

SEQ ID NO: 523947 - RNA, 16 nt, Chlamydophila pneumoniae J138
guucggucucuucucu

SEQ ID NO: 523948 - RNA, 21 nt, Chlamydophila pneumoniae J138
guuccuguaguuugcagagag

SEQ ID NO: 523949 - RNA, 18 nt, Chlamydophila pneumoniae J138
guucucuccagcuguggu

SEQ ID NO: 523950 - RNA, 17 nt, Chlamydophila pneumoniae J138
guucucuaagacugugu

SEQ ID NO: 523951 - RNA, 15 nt, Chlamydophila pneumoniae J138
guucucaauaauaga

SEQ ID NO: 523952 - RNA, 19 nt, Chlamydophila pneumoniae J138
guucucaaagaucaucuac

SEQ ID NO: 523953 - RNA, 16 nt, Chlamydophila pneumoniae J138
guucuccacaugccca

SEQ ID NO: 523954 - RNA, 19 nt, Chlamydophila pneumoniae J138
guucucccgugaacaaaaa

SEQ ID NO: 523955 - RNA, 19 nt, Chlamydophila pneumoniae J138
guuucaaucucuccuugac

SEQ ID NO: 523956 - RNA, 23 nt, Chlamydophila pneumoniae J138
guuucacaggcuacauaguuuuu

SEQ ID NO: 523957 - RNA, 12 nt, Chlamydophila pneumoniae J138
guuucaaucucu

SEQ ID NO: 523958 - RNA, 21 nt, Chlamydophila pneumoniae J138
guuucaaauaggaucucucuu

SEQ ID NO: 523959 - RNA, 14 nt, Chlamydophila pneumoniae J138
guuuagauuuuucu

SEQ ID NO: 523960 - RNA, 16 nt, Chlamydophila pneumoniae J138
guuuagaaaaagaucu

SEQ ID NO: 523961 - RNA, 21 nt, Chlamydophila pneumoniae J138
guuucaggaaacucaaucucu

SEQ ID NO: 523962 - RNA, 15 nt, Chlamydophila pneumoniae J138
guuucaggucagcaa

SEQ ID NO: 523963 - RNA, 15 nt, Chlamydophila pneumoniae J138
guuucagaaggaucu

SEQ ID NO: 523964 - RNA, 14 nt, Chlamydophila pneumoniae J138
guuucaguuuuauc

SEQ ID NO: 523965 - RNA, 23 nt, Chlamydophila pneumoniae J138
guuucauuuaaagaguccgaagc

SEQ ID NO: 523966 - RNA, 21 nt, Chlamydophila pneumoniae J138
guuuccaagacaacaccuccc

SEQ ID NO: 523967 - RNA, 19 nt, Chlamydophila pneumoniae J138
guuuccaagacaacaccuc

SEQ ID NO: 523968 - RNA, 15 nt, Chlamydophila pneumoniae J138
guuucguacaguuuu

SEQ ID NO: 523969 - RNA, 23 nt, Chlamydophila pneumoniae J138
guuucuaaauacuuaggaauuuu

SEQ ID NO: 523970 - RNA, 18 nt, Chlamydophila pneumoniae J138
guuuaaguccuucuuccc

SEQ ID NO: 523971 - RNA, 13 nt, Chlamydophila pneumoniae J138
guuuaauuccuug

SEQ ID NO: 523972 - RNA, 12 nt, Chlamydophila pneumoniae J138
guucuucauucc

SEQ ID NO: 523973 - RNA, 16 nt, Chlamydophila pneumoniae J138
guucuuagaaagcgca

SEQ ID NO: 523974 - RNA, 22 nt, Chlamydophila pneumoniae J138
guucuuaucgggggugccaaaa

SEQ ID NO: 523975 - RNA, 17 nt, Chlamydophila pneumoniae J138
guuugucguaauugcug

SEQ ID NO: 523976 - RNA, 20 nt, Chlamydophila pneumoniae J138
guuuguccuaggagagcuag

SEQ ID NO: 523977 - RNA, 23 nt, Chlamydophila pneumoniae J138
guuuguaguaaggagagacugug

SEQ ID NO: 523978 - RNA, 18 nt, Chlamydophila pneumoniae J138
guuuguaguguugaauaa

SEQ ID NO: 523979 - RNA, 13 nt, Chlamydophila pneumoniae J138
guuuguagaggua

SEQ ID NO: 523980 - RNA, 14 nt, Chlamydophila pneumoniae J138
guuuguuuucuauc

SEQ ID NO: 523981 - RNA, 16 nt, Chlamydophila pneumoniae J138
guuuguucuaaagcug

SEQ ID NO: 523982 - RNA, 15 nt, Chlamydophila pneumoniae J138
guuuggagaagcuca

SEQ ID NO: 523983 - RNA, 22 nt, Chlamydophila pneumoniae J138
guuucuuccugaaucagcuuau

SEQ ID NO: 523984 - RNA, 21 nt, Chlamydophila pneumoniae J138
guuuuaucggcaauuguuaaa

SEQ ID NO: 523985 - RNA, 22 nt, Chlamydophila pneumoniae J138
guuuuauccaccaagacugaau

SEQ ID NO: 523986 - RNA, 21 nt, Chlamydophila pneumoniae J138
guuuuaucuuuagagucugca

SEQ ID NO: 523987 - RNA, 22 nt, Chlamydophila pneumoniae J138
guuuuaagaagguuuauuagaa

SEQ ID NO: 523988 - RNA, 15 nt, Chlamydophila pneumoniae J138
guuuucuaugauccg

SEQ ID NO: 523989 - RNA, 17 nt, Chlamydophila pneumoniae J138
guuuucguaagagaauu

SEQ ID NO: 523990 - RNA, 13 nt, Chlamydophila pneumoniae J138
guuuucacauggc

SEQ ID NO: 523991 - RNA, 18 nt, Chlamydophila pneumoniae J138
guuuucauaauccaagaa

SEQ ID NO: 523992 - RNA, 21 nt, Chlamydophila pneumoniae J138
guuuucagcuuguuuuugcaa

SEQ ID NO: 523993 - RNA, 23 nt, Chlamydophila pneumoniae J138
guuuucuucuuuaagauuuccuu

SEQ ID NO: 523994 - RNA, 12 nt, Chlamydophila pneumoniae J138
guuuucuuuucu

SEQ ID NO: 523995 - RNA, 15 nt, Chlamydophila pneumoniae J138
guuuugaaaucaaaa

SEQ ID NO: 523996 - RNA, 20 nt, Chlamydophila pneumoniae J138
guuuugauucccuccuuccu

SEQ ID NO: 523997 - RNA, 23 nt, Chlamydophila pneumoniae J138
guuuugauucccuccuuccuuaa

SEQ ID NO: 523998 - RNA, 19 nt, Chlamydophila pneumoniae J138
guuuuguggcuuuucuaaa

SEQ ID NO: 523999 - RNA, 15 nt, Chlamydophila pneumoniae J138
guuuuggauagaagc

SEQ ID NO: 524000 - RNA, 19 nt, Chlamydophila pneumoniae J138
guuuuggaaagaagagaau

SEQ ID NO: 524001 - RNA, 18 nt, Chlamydophila pneumoniae J138
guuuuucuccucuuucuu

SEQ ID NO: 524002 - RNA, 20 nt, Chlamydophila pneumoniae J138
guuuuucgaaucguuuuugg

SEQ ID NO: 524003 - RNA, 15 nt, Chlamydophila pneumoniae J138
guuuuucaguuguuu

SEQ ID NO: 524004 - RNA, 15 nt, Chlamydophila pneumoniae J138
guuuuuaucccagau

SEQ ID NO: 524005 - RNA, 20 nt, Chlamydophila pneumoniae J138
guuuuuacauguaaacaaaa

SEQ ID NO: 524006 - RNA, 18 nt, Chlamydophila pneumoniae J138
uaaaaaaagcuagucuuu

SEQ ID NO: 524007 - RNA, 17 nt, Chlamydophila pneumoniae J138
uaaaaaaagacaagaga

SEQ ID NO: 524008 - RNA, 16 nt, Chlamydophila pneumoniae J138
uaaaaaaacccucaaa

SEQ ID NO: 524009 - RNA, 19 nt, Chlamydophila pneumoniae J138
uaaaaaaacccucaaagaa

SEQ ID NO: 524010 - RNA, 17 nt, Chlamydophila pneumoniae J138
guuuuuugaaaacuuca

SEQ ID NO: 524011 - RNA, 19 nt, Chlamydophila pneumoniae J138
uaaaaaacuuccuaacuau

SEQ ID NO: 524012 - RNA, 19 nt, Chlamydophila pneumoniae J138
uaaaaaauacaggaaucuc

SEQ ID NO: 524013 - RNA, 18 nt, Chlamydophila pneumoniae J138
uaaaaauaggagaagccc

SEQ ID NO: 524014 - RNA, 23 nt, Chlamydophila pneumoniae J138
uaaaaaauuaucuccaaagauca

SEQ ID NO: 524015 - RNA, 15 nt, Chlamydophila pneumoniae J138
uaaaaaauuaucucc

SEQ ID NO: 524016 - RNA, 16 nt, Chlamydophila pneumoniae J138
uaaaaaauuaucucca

SEQ ID NO: 524017 - RNA, 21 nt, Chlamydophila pneumoniae J138
uaaaaaauuaucuccaaagau

SEQ ID NO: 524018 - RNA, 19 nt, Chlamydophila pneumoniae J138
uaaaacacaaauagcaaga

SEQ ID NO: 524019 - RNA, 16 nt, Chlamydophila pneumoniae J138
uaaaacaauuuccugc

SEQ ID NO: 524020 - RNA, 20 nt, Chlamydophila pneumoniae J138
uaaaacacaaauagcaagag

SEQ ID NO: 524021 - RNA, 23 nt, Chlamydophila pneumoniae J138
uaaaagaacgucaccauuaaauu

SEQ ID NO: 524022 - RNA, 22 nt, Chlamydophila pneumoniae J138
uaaaagaaagaaugacacagag

SEQ ID NO: 524023 - RNA, 24 nt, Chlamydophila pneumoniae J138
uaaaagaaagaaugacacagagaa

SEQ ID NO: 524024 - RNA, 23 nt, Chlamydophila pneumoniae J138
uaaaacuucaguuguugcuuucu

SEQ ID NO: 524025 - RNA, 21 nt, Chlamydophila pneumoniae J138
uaaaacaucagcaacauaaag

SEQ ID NO: 524026 - RNA, 20 nt, Chlamydophila pneumoniae J138
uaaaacagccuagcaaaacu

SEQ ID NO: 524027 - RNA, 13 nt, Chlamydophila pneumoniae J138
uaaaaccuagacu

SEQ ID NO: 524028 - RNA, 22 nt, Chlamydophila pneumoniae J138
uaaaagcauuuuugggaaaaga

SEQ ID NO: 524029 - RNA, 18 nt, Chlamydophila pneumoniae J138
uaaaagcacuuaaaaaac

SEQ ID NO: 524030 - RNA, 18 nt, Chlamydophila pneumoniae J138
uaaaagguauuucucucc

SEQ ID NO: 524031 - RNA, 23 nt, Chlamydophila pneumoniae J138
uaaaaguuuuuuauuuucuggug

SEQ ID NO: 524032 - RNA, 16 nt, Chlamydophila pneumoniae J138
uaaaaguuagguagau

SEQ ID NO: 524033 - RNA, 21 nt, Chlamydophila pneumoniae J138
uaaaaguuagguagauagaaa

SEQ ID NO: 524034 - RNA, 23 nt, Chlamydophila pneumoniae J138
uaaaaguuagguagauagaaauu

SEQ ID NO: 524035 - RNA, 16 nt, Chlamydophila pneumoniae J138
uaaaaguacgaccaac

SEQ ID NO: 524036 - RNA, 18 nt, Chlamydophila pneumoniae J138
uaaaaucaagccacagag

SEQ ID NO: 524037 - RNA, 17 nt, Chlamydophila pneumoniae J138
uaaaaucauaggcuaua

SEQ ID NO: 524038 - RNA, 14 nt, Chlamydophila pneumoniae J138
uaaaaucuccucuc

SEQ ID NO: 524039 - RNA, 13 nt, Chlamydophila pneumoniae J138
uaaaauagcccua

SEQ ID NO: 524040 - RNA, 15 nt, Chlamydophila pneumoniae J138
uaaaauagcccuaga

SEQ ID NO: 524041 - RNA, 21 nt, Chlamydophila pneumoniae J138
uaaccguggcuuuguaaaaau

SEQ ID NO: 524042 - RNA, 21 nt, Chlamydophila pneumoniae J138
uaaccgucacuguuuuccaga

SEQ ID NO: 524043 - RNA, 17 nt, Chlamydophila pneumoniae J138
uaaccgaaacuucucag

SEQ ID NO: 524044 - RNA, 21 nt, Chlamydophila pneumoniae J138
uaaccuuugacaacaccacag

SEQ ID NO: 524045 - RNA, 22 nt, Chlamydophila pneumoniae J138
uaacaugcgcagaauaaaaugg

SEQ ID NO: 524046 - RNA, 20 nt, Chlamydophila pneumoniae J138
uaacaugcgcagaauaaaau

SEQ ID NO: 524047 - RNA, 24 nt, Chlamydophila pneumoniae J138
uaacaugccaaaaguuuugaggau

SEQ ID NO: 524048 - RNA, 19 nt, Chlamydophila pneumoniae J138
uaacagagcgccuccaccu

SEQ ID NO: 524049 - RNA, 18 nt, Chlamydophila pneumoniae J138
uaacauuucguuuuuucu

SEQ ID NO: 524050 - RNA, 22 nt, Chlamydophila pneumoniae J138
uaacauuucguuuuuucuuauc

SEQ ID NO: 524051 - RNA, 24 nt, Chlamydophila pneumoniae J138
uaacccgcuugcaucuuauggaag

SEQ ID NO: 524052 - RNA, 14 nt, Chlamydophila pneumoniae J138
uaaauuaguaaaug

SEQ ID NO: 524053 - RNA, 13 nt, Chlamydophila pneumoniae J138
uaaauuaguaaau

SEQ ID NO: 524054 - RNA, 14 nt, Chlamydophila pneumoniae J138
uaaauuaaauaucu

SEQ ID NO: 524055 - RNA, 23 nt, Chlamydophila pneumoniae J138
uaaauuguauggaauucaaacuc

SEQ ID NO: 524056 - RNA, 12 nt, Chlamydophila pneumoniae J138
uaaauucuggaa

SEQ ID NO: 524057 - RNA, 21 nt, Chlamydophila pneumoniae J138
uaaauuugucaucacaucagu

SEQ ID NO: 524058 - RNA, 16 nt, Chlamydophila pneumoniae J138
uaaauuugucaucaca

SEQ ID NO: 524059 - RNA, 14 nt, Chlamydophila pneumoniae J138
uaacaaaguuuaug

SEQ ID NO: 524060 - RNA, 20 nt, Chlamydophila pneumoniae J138
uaacaccaaaagaauacuca

SEQ ID NO: 524061 - RNA, 15 nt, Chlamydophila pneumoniae J138
uaacaccaaaagaau

SEQ ID NO: 524062 - RNA, 11 nt, Chlamydophila pneumoniae J138
uaaauaaaauc

SEQ ID NO: 524063 - RNA, 14 nt, Chlamydophila pneumoniae J138
uaaaguuuguaaaa

SEQ ID NO: 524064 - RNA, 20 nt, Chlamydophila pneumoniae J138
uaaaguaacgauaagaagcu

SEQ ID NO: 524065 - RNA, 14 nt, Chlamydophila pneumoniae J138
uaaaguaaaaaaua

SEQ ID NO: 524066 - RNA, 15 nt, Chlamydophila pneumoniae J138
uaaagguugcuaaga

SEQ ID NO: 524067 - RNA, 18 nt, Chlamydophila pneumoniae J138
uaaagguuguaaggacga

SEQ ID NO: 524068 - RNA, 13 nt, Chlamydophila pneumoniae J138
uaaagguuuuaaa

SEQ ID NO: 524069 - RNA, 21 nt, Chlamydophila pneumoniae J138
uaaaguaauaucgguuucuuu

SEQ ID NO: 524070 - RNA, 21 nt, Chlamydophila pneumoniae J138
uaaauacaaaacaaaagccau

SEQ ID NO: 524071 - RNA, 23 nt, Chlamydophila pneumoniae J138
uaaauacuuaggaauuuuucuag

SEQ ID NO: 524072 - RNA, 14 nt, Chlamydophila pneumoniae J138
uaaauagaaaucuu

SEQ ID NO: 524073 - RNA, 18 nt, Chlamydophila pneumoniae J138
uaaauagaaaacauagag

SEQ ID NO: 524074 - RNA, 17 nt, Chlamydophila pneumoniae J138
uaaauagcucaguuggu

SEQ ID NO: 524075 - RNA, 18 nt, Chlamydophila pneumoniae J138
uaaauagcaucccuucuu

SEQ ID NO: 524076 - RNA, 14 nt, Chlamydophila pneumoniae J138
uaaauauuuuacca

SEQ ID NO: 524077 - RNA, 20 nt, Chlamydophila pneumoniae J138
uaaauaugaauuagggcuuu

SEQ ID NO: 524078 - RNA, 22 nt, Chlamydophila pneumoniae J138
uaaauaucuuaacgcuuagaga

SEQ ID NO: 524079 - RNA, 15 nt, Chlamydophila pneumoniae J138
uaaauaucuaauaaa

SEQ ID NO: 524080 - RNA, 17 nt, Chlamydophila pneumoniae J138
uaaaugccuuaaaugua

SEQ ID NO: 524081 - RNA, 18 nt, Chlamydophila pneumoniae J138
uaaaugccuuaaauguau

SEQ ID NO: 524082 - RNA, 21 nt, Chlamydophila pneumoniae J138
uaaauguuuugcgauaucuau

SEQ ID NO: 524083 - RNA, 21 nt, Chlamydophila pneumoniae J138
uaaauguugggaugaucucgu

SEQ ID NO: 524084 - RNA, 16 nt, Chlamydophila pneumoniae J138
uaaaugccucuuucau

SEQ ID NO: 524085 - RNA, 23 nt, Chlamydophila pneumoniae J138
uaaaccuaccucugggaagacuc

SEQ ID NO: 524086 - RNA, 13 nt, Chlamydophila pneumoniae J138
uaaacgagacugc

SEQ ID NO: 524087 - RNA, 22 nt, Chlamydophila pneumoniae J138
uaaacuucaaugaagaaaaauc

SEQ ID NO: 524088 - RNA, 22 nt, Chlamydophila pneumoniae J138
uaaagccuccucaagauaaauc

SEQ ID NO: 524089 - RNA, 19 nt, Chlamydophila pneumoniae J138
uaaagccuccucaagauaa

SEQ ID NO: 524090 - RNA, 23 nt, Chlamydophila pneumoniae J138
uaaagccccacccacuccagaaa

SEQ ID NO: 524091 - RNA, 19 nt, Chlamydophila pneumoniae J138
uaaagccacauucuucuga

SEQ ID NO: 524092 - RNA, 23 nt, Chlamydophila pneumoniae J138
uaaagcauacuuauauuggcuuu

SEQ ID NO: 524093 - RNA, 15 nt, Chlamydophila pneumoniae J138
uaaagagcauccugu

SEQ ID NO: 524094 - RNA, 15 nt, Chlamydophila pneumoniae J138
uaaacuuucuucucu

SEQ ID NO: 524095 - RNA, 17 nt, Chlamydophila pneumoniae J138
uaaacuuucuucucuag

SEQ ID NO: 524096 - RNA, 19 nt, Chlamydophila pneumoniae J138
uaaagaaguuuacaaauaa

SEQ ID NO: 524097 - RNA, 21 nt, Chlamydophila pneumoniae J138
uaaagaagguuucuagguucu

SEQ ID NO: 524098 - RNA, 16 nt, Chlamydophila pneumoniae J138
uaaagaagguuucuag

SEQ ID NO: 524099 - RNA, 13 nt, Chlamydophila pneumoniae J138
uaaagaagguuuc

SEQ ID NO: 524100 - RNA, 14 nt, Chlamydophila pneumoniae J138
uaaagaaucacucu

SEQ ID NO: 524101 - RNA, 15 nt, Chlamydophila pneumoniae J138
uaaagaaucacucuc

SEQ ID NO: 524102 - RNA, 19 nt, Chlamydophila pneumoniae J138
uaaagaauuuguaacucuu

SEQ ID NO: 524103 - RNA, 17 nt, Chlamydophila pneumoniae J138
uaaagacaucucuuuaa

SEQ ID NO: 524104 - RNA, 17 nt, Chlamydophila pneumoniae J138
uaaagacccuucuuucc

SEQ ID NO: 524105 - RNA, 18 nt, Chlamydophila pneumoniae J138
uaaagacccuucuuucca

SEQ ID NO: 524106 - RNA, 17 nt, Chlamydophila pneumoniae J138
uaaagacucucuuccaa

SEQ ID NO: 524107 - RNA, 18 nt, Chlamydophila pneumoniae J138
uaaagagaaucuccucau

SEQ ID NO: 524108 - RNA, 17 nt, Chlamydophila pneumoniae J138
uauuccuuggauuucuu

SEQ ID NO: 524109 - RNA, 17 nt, Chlamydophila pneumoniae J138
uauuccaucacaguuaa

SEQ ID NO: 524110 - RNA, 22 nt, Chlamydophila pneumoniae J138
uauucagugucuugaagagauu

SEQ ID NO: 524111 - RNA, 14 nt, Chlamydophila pneumoniae J138
uauuauuuuaaagu

SEQ ID NO: 524112 - RNA, 15 nt, Chlamydophila pneumoniae J138
uauucuagaguugcu

SEQ ID NO: 524113 - RNA, 15 nt, Chlamydophila pneumoniae J138
uauucugaagcugca

SEQ ID NO: 524114 - RNA, 17 nt, Chlamydophila pneumoniae J138
uauucugauaaucagag

SEQ ID NO: 524115 - RNA, 19 nt, Chlamydophila pneumoniae J138
uauucugaaauuucugaaa

SEQ ID NO: 524116 - RNA, 16 nt, Chlamydophila pneumoniae J138
uauucugaaauuucug

SEQ ID NO: 524117 - RNA, 14 nt, Chlamydophila pneumoniae J138
uauucucgaaaaau

SEQ ID NO: 524118 - RNA, 17 nt, Chlamydophila pneumoniae J138
uauucucgaaaaauuug

SEQ ID NO: 524119 - RNA, 13 nt, Chlamydophila pneumoniae J138
uauuccucuuagg

SEQ ID NO: 524120 - RNA, 18 nt, Chlamydophila pneumoniae J138
uauugaaaaaucccuguu

SEQ ID NO: 524121 - RNA, 13 nt, Chlamydophila pneumoniae J138
uauucuuggaaua

SEQ ID NO: 524122 - RNA, 17 nt, Chlamydophila pneumoniae J138
uauucuuaaugcgaugc

SEQ ID NO: 524123 - RNA, 17 nt, Chlamydophila pneumoniae J138
uauuaggcuuuuuucua

SEQ ID NO: 524124 - RNA, 19 nt, Chlamydophila pneumoniae J138
uauuaggcuuuuuucuauu

SEQ ID NO: 524125 - RNA, 17 nt, Chlamydophila pneumoniae J138
uauuaguuuugaaauca

SEQ ID NO: 524126 - RNA, 17 nt, Chlamydophila pneumoniae J138
uauuauaaauagaaauc

SEQ ID NO: 524127 - RNA, 18 nt, Chlamydophila pneumoniae J138
uauuaucuacagagagaa

SEQ ID NO: 524128 - RNA, 13 nt, Chlamydophila pneumoniae J138
uauugcaaagcau

SEQ ID NO: 524129 - RNA, 19 nt, Chlamydophila pneumoniae J138
uauugcggaaauugaauau

SEQ ID NO: 524130 - RNA, 20 nt, Chlamydophila pneumoniae J138
uauugcgaacuuuugggccc

SEQ ID NO: 524131 - RNA, 14 nt, Chlamydophila pneumoniae J138
uauugcucuuguau

SEQ ID NO: 524132 - RNA, 13 nt, Chlamydophila pneumoniae J138
uauugcucuugua

SEQ ID NO: 524133 - RNA, 15 nt, Chlamydophila pneumoniae J138
uauugccuucuucuu

SEQ ID NO: 524134 - RNA, 23 nt, Chlamydophila pneumoniae J138
uauugggaagaaacuucucuagg

SEQ ID NO: 524135 - RNA, 23 nt, Chlamydophila pneumoniae J138
uauuguguucccucuucuuccaa

SEQ ID NO: 524136 - RNA, 19 nt, Chlamydophila pneumoniae J138
uauuguguucccucuucuu

SEQ ID NO: 524137 - RNA, 14 nt, Chlamydophila pneumoniae J138
uauuguuuuucaau

SEQ ID NO: 524138 - RNA, 17 nt, Chlamydophila pneumoniae J138
uauuuagcauuucucua

SEQ ID NO: 524139 - RNA, 12 nt, Chlamydophila pneumoniae J138
uauuucuaaaaa

SEQ ID NO: 524140 - RNA, 21 nt, Chlamydophila pneumoniae J138
uauuucauauaaaguuuccaa

SEQ ID NO: 524141 - RNA, 12 nt, Chlamydophila pneumoniae J138
uauuugaaauag

SEQ ID NO: 524142 - RNA, 15 nt, Chlamydophila pneumoniae J138
uauuucucuaucauc

SEQ ID NO: 524143 - RNA, 15 nt, Chlamydophila pneumoniae J138
uauuugccaaaauaa

SEQ ID NO: 524144 - RNA, 20 nt, Chlamydophila pneumoniae J138
uauuugcagaagcauuguau

SEQ ID NO: 524145 - RNA, 19 nt, Chlamydophila pneumoniae J138
uauuugcaacaaucuuucu

SEQ ID NO: 524146 - RNA, 12 nt, Chlamydophila pneumoniae J138
ucaaaagaaaag

SEQ ID NO: 524147 - RNA, 18 nt, Chlamydophila pneumoniae J138
ucaaaagaaaucaaacau

SEQ ID NO: 524148 - RNA, 22 nt, Chlamydophila pneumoniae J138
ucaaaagucaugaggacugugg

SEQ ID NO: 524149 - RNA, 17 nt, Chlamydophila pneumoniae J138
ucaaaagguuuuauaaa

SEQ ID NO: 524150 - RNA, 13 nt, Chlamydophila pneumoniae J138
ucaaaaauucuuc

SEQ ID NO: 524151 - RNA, 13 nt, Chlamydophila pneumoniae J138
ucaaaaaauacau

SEQ ID NO: 524152 - RNA, 11 nt, Chlamydophila pneumoniae J138
ucaaaaaguuc

SEQ ID NO: 524153 - RNA, 15 nt, Chlamydophila pneumoniae J138
ucaaaaaacaacgau

SEQ ID NO: 524154 - RNA, 19 nt, Chlamydophila pneumoniae J138
uauuuugcaaaugaaaaga

SEQ ID NO: 524155 - RNA, 13 nt, Chlamydophila pneumoniae J138
uauuuuuccagaa

SEQ ID NO: 524156 - RNA, 12 nt, Chlamydophila pneumoniae J138
uauuuuuaaaua

SEQ ID NO: 524157 - RNA, 14 nt, Chlamydophila pneumoniae J138
uauuuuuaaauaca

SEQ ID NO: 524158 - RNA, 13 nt, Chlamydophila pneumoniae J138
uauuuuuaaauaa

SEQ ID NO: 524159 - RNA, 12 nt, Chlamydophila pneumoniae J138
uauuuuuaaaga

SEQ ID NO: 524160 - RNA, 19 nt, Chlamydophila pneumoniae J138
uauuuuuccagaaauggca

SEQ ID NO: 524161 - RNA, 20 nt, Chlamydophila pneumoniae J138
uauuuuuuaagcuaauaaga

SEQ ID NO: 524162 - RNA, 22 nt, Chlamydophila pneumoniae J138
ucaaagucaaauacuucuccug

SEQ ID NO: 524163 - RNA, 23 nt, Chlamydophila pneumoniae J138
ucaaaggcaacgcgauuuucaac

SEQ ID NO: 524164 - RNA, 19 nt, Chlamydophila pneumoniae J138
ucaaagacaggcucaugaa

SEQ ID NO: 524165 - RNA, 20 nt, Chlamydophila pneumoniae J138
ucaaagaacugcauaaucuc

SEQ ID NO: 524166 - RNA, 11 nt, Chlamydophila pneumoniae J138
ucaaagaaguc

SEQ ID NO: 524167 - RNA, 14 nt, Chlamydophila pneumoniae J138
ucaaagaaagugaa

SEQ ID NO: 524168 - RNA, 11 nt, Chlamydophila pneumoniae J138
ucaaagaacaa

SEQ ID NO: 524169 - RNA, 19 nt, Chlamydophila pneumoniae J138
ucaaagaacaauaaaaggc

SEQ ID NO: 524170 - RNA, 21 nt, Chlamydophila pneumoniae J138
ucaaacugauuaguuuguuuu

SEQ ID NO: 524171 - RNA, 21 nt, Chlamydophila pneumoniae J138
ucaaagacucaugaaauagug

SEQ ID NO: 524172 - RNA, 15 nt, Chlamydophila pneumoniae J138
ucaaagacucaugaa

SEQ ID NO: 524173 - RNA, 22 nt, Chlamydophila pneumoniae J138
ucaaagauauagauucaugaaa

SEQ ID NO: 524174 - RNA, 17 nt, Chlamydophila pneumoniae J138
ucaaagaugcagauacu

SEQ ID NO: 524175 - RNA, 21 nt, Chlamydophila pneumoniae J138
ucaaagauauagauucaugaa

SEQ ID NO: 524176 - RNA, 15 nt, Chlamydophila pneumoniae J138
ucaaagcauugcaaa

SEQ ID NO: 524177 - RNA, 14 nt, Chlamydophila pneumoniae J138
ucaaagauuccuaa

SEQ ID NO: 524178 - RNA, 12 nt, Chlamydophila pneumoniae J138
ucaaagauauaa

SEQ ID NO: 524179 - RNA, 15 nt, Chlamydophila pneumoniae J138
ucaaagauuccuaag

SEQ ID NO: 524180 - RNA, 17 nt, Chlamydophila pneumoniae J138
ucaaacccucuccagaa

SEQ ID NO: 524181 - RNA, 23 nt, Chlamydophila pneumoniae J138
ucaaaccacggauuuucucuaca

SEQ ID NO: 524182 - RNA, 20 nt, Chlamydophila pneumoniae J138
ucaaaccacggauuuucucu

SEQ ID NO: 524183 - RNA, 11 nt, Chlamydophila pneumoniae J138
ucaaacauuac

SEQ ID NO: 524184 - RNA, 18 nt, Chlamydophila pneumoniae J138
ucaaaauaucauucacua

SEQ ID NO: 524185 - RNA, 16 nt, Chlamydophila pneumoniae J138
ucaaaauagaagccac

SEQ ID NO: 524186 - RNA, 14 nt, Chlamydophila pneumoniae J138
ucaaaaugcugcuu

SEQ ID NO: 524187 - RNA, 18 nt, Chlamydophila pneumoniae J138
ucaaaauuuuuaguaauu

SEQ ID NO: 524188 - RNA, 21 nt, Chlamydophila pneumoniae J138
ucaagaacaagagcuuguucu

SEQ ID NO: 524189 - RNA, 13 nt, Chlamydophila pneumoniae J138
ucaagaacaagag

SEQ ID NO: 524190 - RNA, 18 nt, Chlamydophila pneumoniae J138
ucaagaacaguuugcucu

SEQ ID NO: 524191 - RNA, 20 nt, Chlamydophila pneumoniae J138
ucaagaaaugcccugucacu

SEQ ID NO: 524192 - RNA, 14 nt, Chlamydophila pneumoniae J138
ucaagaaauucuuc

SEQ ID NO: 524193 - RNA, 11 nt, Chlamydophila pneumoniae J138
ucaagaaaugc

SEQ ID NO: 524194 - RNA, 17 nt, Chlamydophila pneumoniae J138
ucaagaauaugaacugc

SEQ ID NO: 524195 - RNA, 19 nt, Chlamydophila pneumoniae J138
ucaagaauaugaacugccu

SEQ ID NO: 524196 - RNA, 22 nt, Chlamydophila pneumoniae J138
ucaagaauuucuucuuuccaua

SEQ ID NO: 524197 - RNA, 17 nt, Chlamydophila pneumoniae J138
ucaagacgacacucaaa

SEQ ID NO: 524198 - RNA, 20 nt, Chlamydophila pneumoniae J138
ucaagacgacacucaaaucu

SEQ ID NO: 524199 - RNA, 17 nt, Chlamydophila pneumoniae J138
ucaagcaaaucuccguu

SEQ ID NO: 524200 - RNA, 14 nt, Chlamydophila pneumoniae J138
ucaagccacagaga

SEQ ID NO: 524201 - RNA, 15 nt, Chlamydophila pneumoniae J138
ucaagccacagagaa

SEQ ID NO: 524202 - RNA, 23 nt, Chlamydophila pneumoniae J138
ucaagaguuucgaauucaaugag

SEQ ID NO: 524203 - RNA, 15 nt, Chlamydophila pneumoniae J138
ucaagauaaauccca

SEQ ID NO: 524204 - RNA, 13 nt, Chlamydophila pneumoniae J138
ucaagaucuucau

SEQ ID NO: 524205 - RNA, 18 nt, Chlamydophila pneumoniae J138
ucaagaucuucaucacaa

SEQ ID NO: 524206 - RNA, 21 nt, Chlamydophila pneumoniae J138
ucaacugguauagacuccuua

SEQ ID NO: 524207 - RNA, 16 nt, Chlamydophila pneumoniae J138
ucaacguuuguaguaa

SEQ ID NO: 524208 - RNA, 15 nt, Chlamydophila pneumoniae J138
ucaacuacaucucca

SEQ ID NO: 524209 - RNA, 19 nt, Chlamydophila pneumoniae J138
ucaacuacaucuccaagcc

SEQ ID NO: 524210 - RNA, 19 nt, Chlamydophila pneumoniae J138
ucaaauuccuucucagaaa

SEQ ID NO: 524211 - RNA, 15 nt, Chlamydophila pneumoniae J138
ucaaauuccuucuca

SEQ ID NO: 524212 - RNA, 12 nt, Chlamydophila pneumoniae J138
ucaaauucugaa

SEQ ID NO: 524213 - RNA, 17 nt, Chlamydophila pneumoniae J138
ucaaauucaaaauagaa

SEQ ID NO: 524214 - RNA, 16 nt, Chlamydophila pneumoniae J138
ucaaauuucaauaaga

SEQ ID NO: 524215 - RNA, 23 nt, Chlamydophila pneumoniae J138
ucaaauaggaucucucuuuccuu

SEQ ID NO: 524216 - RNA, 13 nt, Chlamydophila pneumoniae J138
ucaaauaguucau

SEQ ID NO: 524217 - RNA, 23 nt, Chlamydophila pneumoniae J138
ucaaauaguucaucauauuuuuc

SEQ ID NO: 524218 - RNA, 17 nt, Chlamydophila pneumoniae J138
ucaaauaguucaucaua

SEQ ID NO: 524219 - RNA, 18 nt, Chlamydophila pneumoniae J138
ucaaauagauuuuuacuu

SEQ ID NO: 524220 - RNA, 15 nt, Chlamydophila pneumoniae J138
ucaaaucaucaaaaa

SEQ ID NO: 524221 - RNA, 22 nt, Chlamydophila pneumoniae J138
ucaaaucuuucaaggaacauuu

SEQ ID NO: 524222 - RNA, 21 nt, Chlamydophila pneumoniae J138
ucaacacccggcuuuuccaga

SEQ ID NO: 524223 - RNA, 16 nt, Chlamydophila pneumoniae J138
ucaaccaagguugcuc

SEQ ID NO: 524224 - RNA, 23 nt, Chlamydophila pneumoniae J138
ucaacauucuucugucuguauuu

SEQ ID NO: 524225 - RNA, 18 nt, Chlamydophila pneumoniae J138
ucaagucgagaaacaaaa

SEQ ID NO: 524226 - RNA, 23 nt, Chlamydophila pneumoniae J138
ucaagucuauuugaaaagaaaga

SEQ ID NO: 524227 - RNA, 14 nt, Chlamydophila pneumoniae J138
ucaaggaguuuuaa

SEQ ID NO: 524228 - RNA, 15 nt, Chlamydophila pneumoniae J138
ucaaggaacauuuga

SEQ ID NO: 524229 - RNA, 20 nt, Chlamydophila pneumoniae J138
ucaaggccuauagauuuugu

SEQ ID NO: 524230 - RNA, 15 nt, Chlamydophila pneumoniae J138
ucaagguacuuuaua

SEQ ID NO: 524231 - RNA, 21 nt, Chlamydophila pneumoniae J138
ucaagguacuuuauagaaagu

SEQ ID NO: 524232 - RNA, 21 nt, Chlamydophila pneumoniae J138
ucaauaaguagauuaaaggca

SEQ ID NO: 524233 - RNA, 21 nt, Chlamydophila pneumoniae J138
ucaauaagcuugccagcagaa

SEQ ID NO: 524234 - RNA, 19 nt, Chlamydophila pneumoniae J138
ucaauaaccagaagacucc

SEQ ID NO: 524235 - RNA, 23 nt, Chlamydophila pneumoniae J138
ucaauaauuucaaagaugcagau

SEQ ID NO: 524236 - RNA, 14 nt, Chlamydophila pneumoniae J138
ucaaucaauaaaau

SEQ ID NO: 524237 - RNA, 18 nt, Chlamydophila pneumoniae J138
ucaauagguaaggaaacg

SEQ ID NO: 524238 - RNA, 13 nt, Chlamydophila pneumoniae J138
ucaauuucuucau

SEQ ID NO: 524239 - RNA, 22 nt, Chlamydophila pneumoniae J138
ucaauuugcguugcauguccau

SEQ ID NO: 524240 - RNA, 19 nt, Chlamydophila pneumoniae J138
ucaauuuuaccacuuccag

SEQ ID NO: 524241 - RNA, 19 nt, Chlamydophila pneumoniae J138
ucacaaacaacagaaaugu

SEQ ID NO: 524242 - RNA, 16 nt, Chlamydophila pneumoniae J138
ucacaaacaacagaaa

SEQ ID NO: 524243 - RNA, 19 nt, Chlamydophila pneumoniae J138
ucacaaagaauucagagaa

SEQ ID NO: 524244 - RNA, 21 nt, Chlamydophila pneumoniae J138
ucacaaagaauucagagaaag

SEQ ID NO: 524245 - RNA, 14 nt, Chlamydophila pneumoniae J138
ucaauugaaucaga

SEQ ID NO: 524246 - RNA, 18 nt, Chlamydophila pneumoniae J138
ucaaugaagaaaaaucua

SEQ ID NO: 524247 - RNA, 13 nt, Chlamydophila pneumoniae J138
ucaaugaaagcug

SEQ ID NO: 524248 - RNA, 19 nt, Chlamydophila pneumoniae J138
ucaauccaagaauagccau

SEQ ID NO: 524249 - RNA, 15 nt, Chlamydophila pneumoniae J138
ucaauccaacaaaga

SEQ ID NO: 524250 - RNA, 15 nt, Chlamydophila pneumoniae J138
ucaaugacuguaucu

SEQ ID NO: 524251 - RNA, 14 nt, Chlamydophila pneumoniae J138
ucaaugccuugcgu

SEQ ID NO: 524252 - RNA, 23 nt, Chlamydophila pneumoniae J138
ucacagagucugggauguucaaa

SEQ ID NO: 524253 - RNA, 22 nt, Chlamydophila pneumoniae J138
ucacagagucugggauguucaa

SEQ ID NO: 524254 - RNA, 16 nt, Chlamydophila pneumoniae J138
ucacagcauuuucucu

SEQ ID NO: 524255 - RNA, 22 nt, Chlamydophila pneumoniae J138
ucacagcauuuucucugagcag

SEQ ID NO: 524256 - RNA, 15 nt, Chlamydophila pneumoniae J138
ucacagauguaaucu

SEQ ID NO: 524257 - RNA, 19 nt, Chlamydophila pneumoniae J138
ucacacguaagaaaggaug

SEQ ID NO: 524258 - RNA, 22 nt, Chlamydophila pneumoniae J138
ucacacgaauaauuaaaucgua

SEQ ID NO: 524259 - RNA, 16 nt, Chlamydophila pneumoniae J138
ucacacugcgagagaa

SEQ ID NO: 524260 - RNA, 17 nt, Chlamydophila pneumoniae J138
ucacaccaaauccugca

SEQ ID NO: 524261 - RNA, 22 nt, Chlamydophila pneumoniae J138
ucacaauaccaucucuuucuau

SEQ ID NO: 524262 - RNA, 17 nt, Chlamydophila pneumoniae J138
ucacaaucuaaauaaga

SEQ ID NO: 524263 - RNA, 16 nt, Chlamydophila pneumoniae J138
ucacaauauaaaugcu

SEQ ID NO: 524264 - RNA, 17 nt, Chlamydophila pneumoniae J138
ucacaauauaaaugcua

SEQ ID NO: 524265 - RNA, 16 nt, Chlamydophila pneumoniae J138
ucacaaguccugcguu

SEQ ID NO: 524266 - RNA, 14 nt, Chlamydophila pneumoniae J138
ucacaagaaagaau

SEQ ID NO: 524267 - RNA, 18 nt, Chlamydophila pneumoniae J138
ucacauuccaagaaaaau

SEQ ID NO: 524268 - RNA, 17 nt, Chlamydophila pneumoniae J138
ucacauuccaagaaaaa

SEQ ID NO: 524269 - RNA, 15 nt, Chlamydophila pneumoniae J138
ucacauguuucacuu

SEQ ID NO: 524270 - RNA, 13 nt, Chlamydophila pneumoniae J138
ucacauuuucaug

SEQ ID NO: 524271 - RNA, 18 nt, Chlamydophila pneumoniae J138
ucaccacaaaccucuaaa

SEQ ID NO: 524272 - RNA, 19 nt, Chlamydophila pneumoniae J138
ucacaguuaagacgcagaa

SEQ ID NO: 524273 - RNA, 17 nt, Chlamydophila pneumoniae J138
ucacagggacaauggca

SEQ ID NO: 524274 - RNA, 23 nt, Chlamydophila pneumoniae J138
ucacaguauuccaucacaguuaa

SEQ ID NO: 524275 - RNA, 22 nt, Chlamydophila pneumoniae J138
ucacauacauucuauucuauac

SEQ ID NO: 524276 - RNA, 20 nt, Chlamydophila pneumoniae J138
ucacauacauucuauucuau

SEQ ID NO: 524277 - RNA, 14 nt, Chlamydophila pneumoniae J138
ucacaucaguucca

SEQ ID NO: 524278 - RNA, 20 nt, Chlamydophila pneumoniae J138
ucaccauuaagauaucugcu

SEQ ID NO: 524279 - RNA, 13 nt, Chlamydophila pneumoniae J138
ucaccauuaaauu

SEQ ID NO: 524280 - RNA, 18 nt, Chlamydophila pneumoniae J138
ucaccauccaaagcuauu

SEQ ID NO: 524281 - RNA, 15 nt, Chlamydophila pneumoniae J138
ucaccagaagcauug

SEQ ID NO: 524282 - RNA, 20 nt, Chlamydophila pneumoniae J138
ucaccuugaaguuuuuucuc

SEQ ID NO: 524283 - RNA, 13 nt, Chlamydophila pneumoniae J138
ucaccuuaggcuu

SEQ ID NO: 524284 - RNA, 22 nt, Chlamydophila pneumoniae J138
ucaccuuacauccaauuuuguu

SEQ ID NO: 524285 - RNA, 18 nt, Chlamydophila pneumoniae J138
ucaccuacaucagacuga

SEQ ID NO: 524286 - RNA, 16 nt, Chlamydophila pneumoniae J138
ucaccuacaucagacu

SEQ ID NO: 524287 - RNA, 19 nt, Chlamydophila pneumoniae J138
ucaccugagcuauaaucua

SEQ ID NO: 524288 - RNA, 21 nt, Chlamydophila pneumoniae J138
ucacgagucccuucuuucaau

SEQ ID NO: 524289 - RNA, 17 nt, Chlamydophila pneumoniae J138
ucacgaggagcuuuuac

SEQ ID NO: 524290 - RNA, 20 nt, Chlamydophila pneumoniae J138
ucacgagucccuucuuucaa

SEQ ID NO: 524291 - RNA, 20 nt, Chlamydophila pneumoniae J138
ucacgaggagcuuuuaccuu

SEQ ID NO: 524292 - RNA, 17 nt, Chlamydophila pneumoniae J138
ucacgaaaaggagaaua

SEQ ID NO: 524293 - RNA, 13 nt, Chlamydophila pneumoniae J138
ucacgaaaaggag

SEQ ID NO: 524294 - RNA, 16 nt, Chlamydophila pneumoniae J138
ucacgcaccauuccuu

SEQ ID NO: 524295 - RNA, 14 nt, Chlamydophila pneumoniae J138
ucacuucaauuaca

SEQ ID NO: 524296 - RNA, 18 nt, Chlamydophila pneumoniae J138
ucacuuaauaauguuuua

SEQ ID NO: 524297 - RNA, 18 nt, Chlamydophila pneumoniae J138
ucacuguuuuucguaagc

SEQ ID NO: 524298 - RNA, 12 nt, Chlamydophila pneumoniae J138
ucacucuuuuau

SEQ ID NO: 524299 - RNA, 14 nt, Chlamydophila pneumoniae J138
ucacucuuuaaaaa

SEQ ID NO: 524300 - RNA, 13 nt, Chlamydophila pneumoniae J138
ucacucuuuaaaa

SEQ ID NO: 524301 - RNA, 19 nt, Chlamydophila pneumoniae J138
ucacucguugccaaucuuu

SEQ ID NO: 524302 - RNA, 13 nt, Chlamydophila pneumoniae J138
ucacuaucaugga

SEQ ID NO: 524303 - RNA, 16 nt, Chlamydophila pneumoniae J138
ucacuaucuucuaaaa

SEQ ID NO: 524304 - RNA, 13 nt, Chlamydophila pneumoniae J138
ucacuauuaauac

SEQ ID NO: 524305 - RNA, 21 nt, Chlamydophila pneumoniae J138
ucacguucugcaacaaguugc

SEQ ID NO: 524306 - RNA, 21 nt, Chlamydophila pneumoniae J138
ucagaaauuccuaaaauuucc

SEQ ID NO: 524307 - RNA, 13 nt, Chlamydophila pneumoniae J138
ucagaacaagaag

SEQ ID NO: 524308 - RNA, 19 nt, Chlamydophila pneumoniae J138
ucagaacaagaaguaggaa

SEQ ID NO: 524309 - RNA, 20 nt, Chlamydophila pneumoniae J138
ucagaauccugaguaaaauc

SEQ ID NO: 524310 - RNA, 19 nt, Chlamydophila pneumoniae J138
ucagaauccauuuugccca

SEQ ID NO: 524311 - RNA, 20 nt, Chlamydophila pneumoniae J138
ucagaauccauuuugcccac

SEQ ID NO: 524312 - RNA, 16 nt, Chlamydophila pneumoniae J138
ucagaagugaucuuga

SEQ ID NO: 524313 - RNA, 15 nt, Chlamydophila pneumoniae J138
ucagaagcuccugag

SEQ ID NO: 524314 - RNA, 16 nt, Chlamydophila pneumoniae J138
ucagaaucuuugugau

SEQ ID NO: 524315 - RNA, 19 nt, Chlamydophila pneumoniae J138
ucagaaugcccuuuaggga

SEQ ID NO: 524316 - RNA, 19 nt, Chlamydophila pneumoniae J138
ucagacgugcucucuacuu

SEQ ID NO: 524317 - RNA, 14 nt, Chlamydophila pneumoniae J138
ucagauuagaguua

SEQ ID NO: 524318 - RNA, 14 nt, Chlamydophila pneumoniae J138
ucagauuuuuuaac

SEQ ID NO: 524319 - RNA, 19 nt, Chlamydophila pneumoniae J138
ucagaguugucaaguaagu

SEQ ID NO: 524320 - RNA, 16 nt, Chlamydophila pneumoniae J138
ucagauaaucuucgau

SEQ ID NO: 524321 - RNA, 20 nt, Chlamydophila pneumoniae J138
ucagaggagccuccauaaug

SEQ ID NO: 524322 - RNA, 18 nt, Chlamydophila pneumoniae J138
ucagagauugccaggaga

SEQ ID NO: 524323 - RNA, 13 nt, Chlamydophila pneumoniae J138
ucagagagaacag

SEQ ID NO: 524324 - RNA, 20 nt, Chlamydophila pneumoniae J138
ucagagacaaguucaucaaa

SEQ ID NO: 524325 - RNA, 13 nt, Chlamydophila pneumoniae J138
ucagccugucuau

SEQ ID NO: 524326 - RNA, 17 nt, Chlamydophila pneumoniae J138
ucagccaagacaaaaaa

SEQ ID NO: 524327 - RNA, 16 nt, Chlamydophila pneumoniae J138
ucagcccacuguuuug

SEQ ID NO: 524328 - RNA, 15 nt, Chlamydophila pneumoniae J138
ucagcacccaccauu

SEQ ID NO: 524329 - RNA, 21 nt, Chlamydophila pneumoniae J138
ucagcaaccuuuccuaaaaua

SEQ ID NO: 524330 - RNA, 13 nt, Chlamydophila pneumoniae J138
ucagcaagaaaau

SEQ ID NO: 524331 - RNA, 13 nt, Chlamydophila pneumoniae J138
ucagcaacauaaa

SEQ ID NO: 524332 - RNA, 21 nt, Chlamydophila pneumoniae J138
ucagcaacaucguuaauauaa

SEQ ID NO: 524333 - RNA, 13 nt, Chlamydophila pneumoniae J138
ucagcaaggaagu

SEQ ID NO: 524334 - RNA, 19 nt, Chlamydophila pneumoniae J138
ucagcagcugucaauccaa

SEQ ID NO: 524335 - RNA, 15 nt, Chlamydophila pneumoniae J138
ucagcauagagagaa

SEQ ID NO: 524336 - RNA, 18 nt, Chlamydophila pneumoniae J138
ucagcauagagagaagga

SEQ ID NO: 524337 - RNA, 17 nt, Chlamydophila pneumoniae J138
uaucaaccauaaagaau

SEQ ID NO: 524338 - RNA, 19 nt, Chlamydophila pneumoniae J138
uaucaaagacucaugaaau

SEQ ID NO: 524339 - RNA, 15 nt, Chlamydophila pneumoniae J138
uaucaaagcauugca

SEQ ID NO: 524340 - RNA, 22 nt, Chlamydophila pneumoniae J138
uauauguaauuucccuaauucu

SEQ ID NO: 524341 - RNA, 21 nt, Chlamydophila pneumoniae J138
uauaugcuacaaacucuucca

SEQ ID NO: 524342 - RNA, 13 nt, Chlamydophila pneumoniae J138
uauaguauuuuua

SEQ ID NO: 524343 - RNA, 14 nt, Chlamydophila pneumoniae J138
uauaguauuuuuaa

SEQ ID NO: 524344 - RNA, 16 nt, Chlamydophila pneumoniae J138
uauaguauuuuuaaau

SEQ ID NO: 524345 - RNA, 18 nt, Chlamydophila pneumoniae J138
uauaguauuuuuaaauac

SEQ ID NO: 524346 - RNA, 23 nt, Chlamydophila pneumoniae J138
uauagucuguuuuggaaagaaga

SEQ ID NO: 524347 - RNA, 14 nt, Chlamydophila pneumoniae J138
uauaucauuaagaa

SEQ ID NO: 524348 - RNA, 11 nt, Chlamydophila pneumoniae J138
uauauaaaggu

SEQ ID NO: 524349 - RNA, 14 nt, Chlamydophila pneumoniae J138
uauauaaaacauag

SEQ ID NO: 524350 - RNA, 15 nt, Chlamydophila pneumoniae J138
uaucagcaaaaaacu

SEQ ID NO: 524351 - RNA, 21 nt, Chlamydophila pneumoniae J138
uauccacaaucucuuuaaaaa

SEQ ID NO: 524352 - RNA, 23 nt, Chlamydophila pneumoniae J138
uauccaaagccggcccacucaaa

SEQ ID NO: 524353 - RNA, 13 nt, Chlamydophila pneumoniae J138
uauccauacggua

SEQ ID NO: 524354 - RNA, 22 nt, Chlamydophila pneumoniae J138
uauccauggaauggcuacuuua

SEQ ID NO: 524355 - RNA, 15 nt, Chlamydophila pneumoniae J138
uaucuauuaagccgc

SEQ ID NO: 524356 - RNA, 13 nt, Chlamydophila pneumoniae J138
uaucuaaaacuuc

SEQ ID NO: 524357 - RNA, 18 nt, Chlamydophila pneumoniae J138
uaucuccguuaccaaaaa

SEQ ID NO: 524358 - RNA, 20 nt, Chlamydophila pneumoniae J138
uaucuccgccauaacacuuu

SEQ ID NO: 524359 - RNA, 12 nt, Chlamydophila pneumoniae J138
uaucgugacucu

SEQ ID NO: 524360 - RNA, 19 nt, Chlamydophila pneumoniae J138
uaucgggggugccaaaaaa

SEQ ID NO: 524361 - RNA, 23 nt, Chlamydophila pneumoniae J138
uaucgccuuccuuaacaacauca

SEQ ID NO: 524362 - RNA, 18 nt, Chlamydophila pneumoniae J138
uauccugaacaucuccag

SEQ ID NO: 524363 - RNA, 14 nt, Chlamydophila pneumoniae J138
uauccugcuccaaa

SEQ ID NO: 524364 - RNA, 20 nt, Chlamydophila pneumoniae J138
uauuaaaaauagcuuacuuu

SEQ ID NO: 524365 - RNA, 19 nt, Chlamydophila pneumoniae J138
uauguuuucucgaagaaaa

SEQ ID NO: 524366 - RNA, 19 nt, Chlamydophila pneumoniae J138
uauguauaacaucuaaaaa

SEQ ID NO: 524367 - RNA, 15 nt, Chlamydophila pneumoniae J138
uauguacuagauagu

SEQ ID NO: 524368 - RNA, 18 nt, Chlamydophila pneumoniae J138
uauguacugaugugaagc

SEQ ID NO: 524369 - RNA, 19 nt, Chlamydophila pneumoniae J138
uauggcagccuggaaagcu

SEQ ID NO: 524370 - RNA, 13 nt, Chlamydophila pneumoniae J138
uaugggaggaauu

SEQ ID NO: 524371 - RNA, 21 nt, Chlamydophila pneumoniae J138
uauggaagagagcaagauaau

SEQ ID NO: 524372 - RNA, 22 nt, Chlamydophila pneumoniae J138
uauggaaggcggcuuuuugcaa

SEQ ID NO: 524373 - RNA, 19 nt, Chlamydophila pneumoniae J138
uaugcuguugcuccaagag

SEQ ID NO: 524374 - RNA, 21 nt, Chlamydophila pneumoniae J138
uaugcuguugcuccaagaguu

SEQ ID NO: 524375 - RNA, 18 nt, Chlamydophila pneumoniae J138
uaugcugaauuccucuga

SEQ ID NO: 524376 - RNA, 20 nt, Chlamydophila pneumoniae J138
uaugcucauuaauaauaucu

SEQ ID NO: 524377 - RNA, 22 nt, Chlamydophila pneumoniae J138
uaugcucauuaauaauaucuaa

SEQ ID NO: 524378 - RNA, 15 nt, Chlamydophila pneumoniae J138
uaugauguauaaagu

SEQ ID NO: 524379 - RNA, 17 nt, Chlamydophila pneumoniae J138
uaugaugccucauugcc

SEQ ID NO: 524380 - RNA, 21 nt, Chlamydophila pneumoniae J138
uaugaugccucauugccgugg

SEQ ID NO: 524381 - RNA, 22 nt, Chlamydophila pneumoniae J138
uaugcaaaacaacauucguuag

SEQ ID NO: 524382 - RNA, 16 nt, Chlamydophila pneumoniae J138
uaugcacaaaauaaaa

SEQ ID NO: 524383 - RNA, 23 nt, Chlamydophila pneumoniae J138
uaugcacgcuuucgucuaaaaua

SEQ ID NO: 524384 - RNA, 14 nt, Chlamydophila pneumoniae J138
uaugcacaaaauaa

SEQ ID NO: 524385 - RNA, 12 nt, Chlamydophila pneumoniae J138
uaugcaucaaug

SEQ ID NO: 524386 - RNA, 19 nt, Chlamydophila pneumoniae J138
uaugacggauccuagaaua

SEQ ID NO: 524387 - RNA, 21 nt, Chlamydophila pneumoniae J138
uaugacacagcuaaucaaucc

SEQ ID NO: 524388 - RNA, 16 nt, Chlamydophila pneumoniae J138
uaugagcuccaaaaua

SEQ ID NO: 524389 - RNA, 18 nt, Chlamydophila pneumoniae J138
uaugagauaggaacucac

SEQ ID NO: 524390 - RNA, 17 nt, Chlamydophila pneumoniae J138
uaugaggagauaaagau

SEQ ID NO: 524391 - RNA, 22 nt, Chlamydophila pneumoniae J138
uaugauccaauagccaaagacu

SEQ ID NO: 524392 - RNA, 17 nt, Chlamydophila pneumoniae J138
uaugauccgaaaacucu

SEQ ID NO: 524393 - RNA, 19 nt, Chlamydophila pneumoniae J138
uaugaauuagggcuuuuac

SEQ ID NO: 524394 - RNA, 16 nt, Chlamydophila pneumoniae J138
uaugaaucacaucuaa

SEQ ID NO: 524395 - RNA, 16 nt, Chlamydophila pneumoniae J138
uaugaaugacugcaga

SEQ ID NO: 524396 - RNA, 17 nt, Chlamydophila pneumoniae J138
uaugaaugauuuccaua

SEQ ID NO: 524397 - RNA, 18 nt, Chlamydophila pneumoniae J138
uaugaacugccugagaaa

SEQ ID NO: 524398 - RNA, 14 nt, Chlamydophila pneumoniae J138
uaucuuuaagauuu

SEQ ID NO: 524399 - RNA, 16 nt, Chlamydophila pneumoniae J138
uaucuuuauuuaaaua

SEQ ID NO: 524400 - RNA, 13 nt, Chlamydophila pneumoniae J138
uaucuucuaaaac

SEQ ID NO: 524401 - RNA, 16 nt, Chlamydophila pneumoniae J138
uaucuucguaauaacu

SEQ ID NO: 524402 - RNA, 15 nt, Chlamydophila pneumoniae J138
uaucugcguuucuuu

SEQ ID NO: 524403 - RNA, 18 nt, Chlamydophila pneumoniae J138
uaucugcguuucuuucug

SEQ ID NO: 524404 - RNA, 10 nt, Chlamydophila pneumoniae J138
uaucugcuau

SEQ ID NO: 524405 - RNA, 15 nt, Chlamydophila pneumoniae J138
uaucugcucccuccu

SEQ ID NO: 524406 - RNA, 16 nt, Chlamydophila pneumoniae J138
uaucugcgacaaaaau

SEQ ID NO: 524407 - RNA, 19 nt, Chlamydophila pneumoniae J138
uagaucuucugaaaucaaa

SEQ ID NO: 524408 - RNA, 22 nt, Chlamydophila pneumoniae J138
uagaucuucugaaaucaaaaaa

SEQ ID NO: 524409 - RNA, 14 nt, Chlamydophila pneumoniae J138
uagaucuugaaaag

SEQ ID NO: 524410 - RNA, 10 nt, Chlamydophila pneumoniae J138
uagaaaagau

SEQ ID NO: 524411 - RNA, 21 nt, Chlamydophila pneumoniae J138
uagaaaagauucuaaaucaac

SEQ ID NO: 524412 - RNA, 21 nt, Chlamydophila pneumoniae J138
uagaaaagguauuaggaagua

SEQ ID NO: 524413 - RNA, 19 nt, Chlamydophila pneumoniae J138
uagauguaaucauaaaaaa

SEQ ID NO: 524414 - RNA, 14 nt, Chlamydophila pneumoniae J138
uagaugaucacagg

SEQ ID NO: 524415 - RNA, 15 nt, Chlamydophila pneumoniae J138
uagauuccccaaacu

SEQ ID NO: 524416 - RNA, 14 nt, Chlamydophila pneumoniae J138
uagauuaggaagau

SEQ ID NO: 524417 - RNA, 24 nt, Chlamydophila pneumoniae J138
uagauugccuuugaucaggagucu

SEQ ID NO: 524418 - RNA, 17 nt, Chlamydophila pneumoniae J138
uagauuguuagugagau

SEQ ID NO: 524419 - RNA, 14 nt, Chlamydophila pneumoniae J138
uagauuguuaguga

SEQ ID NO: 524420 - RNA, 19 nt, Chlamydophila pneumoniae J138
uagauuuuuacuugcccaa

SEQ ID NO: 524421 - RNA, 13 nt, Chlamydophila pneumoniae J138
uagauuuuuacuu

SEQ ID NO: 524422 - RNA, 14 nt, Chlamydophila pneumoniae J138
uagauuuuccgcaa

SEQ ID NO: 524423 - RNA, 21 nt, Chlamydophila pneumoniae J138
uagcagcccgcacaucaugcu

SEQ ID NO: 524424 - RNA, 16 nt, Chlamydophila pneumoniae J138
uagcaagcgcuagugc

SEQ ID NO: 524425 - RNA, 22 nt, Chlamydophila pneumoniae J138
uagcagaaguccuaucaaagca

SEQ ID NO: 524426 - RNA, 18 nt, Chlamydophila pneumoniae J138
uagauuuuucuuuuagag

SEQ ID NO: 524427 - RNA, 14 nt, Chlamydophila pneumoniae J138
uagcaaagacaucu

SEQ ID NO: 524428 - RNA, 17 nt, Chlamydophila pneumoniae J138
uagcaaacggaacuaaa

SEQ ID NO: 524429 - RNA, 11 nt, Chlamydophila pneumoniae J138
uagcaaaggca

SEQ ID NO: 524430 - RNA, 16 nt, Chlamydophila pneumoniae J138
uagccccauagagccu

SEQ ID NO: 524431 - RNA, 13 nt, Chlamydophila pneumoniae J138
uagccccauagag

SEQ ID NO: 524432 - RNA, 19 nt, Chlamydophila pneumoniae J138
uagccauuagaaucucugc

SEQ ID NO: 524433 - RNA, 14 nt, Chlamydophila pneumoniae J138
uagcaucucucucc

SEQ ID NO: 524434 - RNA, 16 nt, Chlamydophila pneumoniae J138
uagcaucccaaguucu

SEQ ID NO: 524435 - RNA, 20 nt, Chlamydophila pneumoniae J138
uagcaucccuucuucuuuua

SEQ ID NO: 524436 - RNA, 22 nt, Chlamydophila pneumoniae J138
uagcagggggccugccaugaau

SEQ ID NO: 524437 - RNA, 21 nt, Chlamydophila pneumoniae J138
uagcaucaucuccugaagcca

SEQ ID NO: 524438 - RNA, 22 nt, Chlamydophila pneumoniae J138
uagcgguacuugcgaaagaucc

SEQ ID NO: 524439 - RNA, 14 nt, Chlamydophila pneumoniae J138
uagcgucucuucuu

SEQ ID NO: 524440 - RNA, 22 nt, Chlamydophila pneumoniae J138
uagcuacggagagguuauguac

SEQ ID NO: 524441 - RNA, 17 nt, Chlamydophila pneumoniae J138
uagcgcuuuuuuaaagu

SEQ ID NO: 524442 - RNA, 11 nt, Chlamydophila pneumoniae J138
uagcccuugca

SEQ ID NO: 524443 - RNA, 19 nt, Chlamydophila pneumoniae J138
uagcccuacgaauccaaaa

SEQ ID NO: 524444 - RNA, 19 nt, Chlamydophila pneumoniae J138
uagccgacaugcuuuccuu

SEQ ID NO: 524445 - RNA, 22 nt, Chlamydophila pneumoniae J138
uaggcaagauuaugaugccuca

SEQ ID NO: 524446 - RNA, 12 nt, Chlamydophila pneumoniae J138
uaggauuugcau

SEQ ID NO: 524447 - RNA, 18 nt, Chlamydophila pneumoniae J138
uaggauuugcauagaggg

SEQ ID NO: 524448 - RNA, 19 nt, Chlamydophila pneumoniae J138
uaggauucaguuccucauc

SEQ ID NO: 524449 - RNA, 16 nt, Chlamydophila pneumoniae J138
uaggcauacaguagaa

SEQ ID NO: 524450 - RNA, 13 nt, Chlamydophila pneumoniae J138
uaggcauuaauaa

SEQ ID NO: 524451 - RNA, 20 nt, Chlamydophila pneumoniae J138
uaggcccugacuuagagucu

SEQ ID NO: 524452 - RNA, 22 nt, Chlamydophila pneumoniae J138
uaggaccuacugggaaaucuaa

SEQ ID NO: 524453 - RNA, 21 nt, Chlamydophila pneumoniae J138
uaggagaaaucacacuuaaag

SEQ ID NO: 524454 - RNA, 15 nt, Chlamydophila pneumoniae J138
uagcuuacuuucuuu

SEQ ID NO: 524455 - RNA, 17 nt, Chlamydophila pneumoniae J138
uaggaauugcuguucca

SEQ ID NO: 524456 - RNA, 16 nt, Chlamydophila pneumoniae J138
uagcuauuuuugagga

SEQ ID NO: 524457 - RNA, 17 nt, Chlamydophila pneumoniae J138
uagcuaugaguugcuug

SEQ ID NO: 524458 - RNA, 15 nt, Chlamydophila pneumoniae J138
uagcuauucucaaau

SEQ ID NO: 524459 - RNA, 15 nt, Chlamydophila pneumoniae J138
uagcuacuucuucuu

SEQ ID NO: 524460 - RNA, 22 nt, Chlamydophila pneumoniae J138
uagcuagcguuuguaucacccg

SEQ ID NO: 524461 - RNA, 17 nt, Chlamydophila pneumoniae J138
uagcuuacuuucuuuua

SEQ ID NO: 524462 - RNA, 16 nt, Chlamydophila pneumoniae J138
uauaagagcaagguaa

SEQ ID NO: 524463 - RNA, 15 nt, Chlamydophila pneumoniae J138
uauaagagguucucu

SEQ ID NO: 524464 - RNA, 19 nt, Chlamydophila pneumoniae J138
uauaagugacuuuucuucu

SEQ ID NO: 524465 - RNA, 15 nt, Chlamydophila pneumoniae J138
uauaacaucuaaaaa

SEQ ID NO: 524466 - RNA, 21 nt, Chlamydophila pneumoniae J138
uauaacuccaggggauaaaac

SEQ ID NO: 524467 - RNA, 17 nt, Chlamydophila pneumoniae J138
uauaacucucuagagga

SEQ ID NO: 524468 - RNA, 20 nt, Chlamydophila pneumoniae J138
uauaacuacaaaauccacau

SEQ ID NO: 524469 - RNA, 21 nt, Chlamydophila pneumoniae J138
uaguuguugcggauuugcauu

SEQ ID NO: 524470 - RNA, 16 nt, Chlamydophila pneumoniae J138
uaguuguccuuuauaa

SEQ ID NO: 524471 - RNA, 18 nt, Chlamydophila pneumoniae J138
uaguugugagacuuucug

SEQ ID NO: 524472 - RNA, 21 nt, Chlamydophila pneumoniae J138
uauaaacuucaaugaagaaaa

SEQ ID NO: 524473 - RNA, 21 nt, Chlamydophila pneumoniae J138
uaguugcaugacuauuuucau

SEQ ID NO: 524474 - RNA, 15 nt, Chlamydophila pneumoniae J138
uaguucuucuuuacu

SEQ ID NO: 524475 - RNA, 21 nt, Chlamydophila pneumoniae J138
uaguucauuagcuaaaucaaa

SEQ ID NO: 524476 - RNA, 17 nt, Chlamydophila pneumoniae J138
uaguucguucaucuguc

SEQ ID NO: 524477 - RNA, 22 nt, Chlamydophila pneumoniae J138
uaguucguucaucugucauuaa

SEQ ID NO: 524478 - RNA, 16 nt, Chlamydophila pneumoniae J138
uagugagauagucuug

SEQ ID NO: 524479 - RNA, 19 nt, Chlamydophila pneumoniae J138
uagugauacuuuagaaucc

SEQ ID NO: 524480 - RNA, 14 nt, Chlamydophila pneumoniae J138
uaguccaucccugc

SEQ ID NO: 524481 - RNA, 13 nt, Chlamydophila pneumoniae J138
uaguauuuuuaaa

SEQ ID NO: 524482 - RNA, 12 nt, Chlamydophila pneumoniae J138
uagucaaaaauu

SEQ ID NO: 524483 - RNA, 14 nt, Chlamydophila pneumoniae J138
uaguauuuuuaaau

SEQ ID NO: 524484 - RNA, 16 nt, Chlamydophila pneumoniae J138
uaguauuuuuaaauac

SEQ ID NO: 524485 - RNA, 21 nt, Chlamydophila pneumoniae J138
uaguauggcauucuuuuucua

SEQ ID NO: 524486 - RNA, 23 nt, Chlamydophila pneumoniae J138
uaguauggcauucuuuuucuauu

SEQ ID NO: 524487 - RNA, 19 nt, Chlamydophila pneumoniae J138
uaguaaggagagacugugu

SEQ ID NO: 524488 - RNA, 22 nt, Chlamydophila pneumoniae J138
uaguaauaucuccgccauaaca

SEQ ID NO: 524489 - RNA, 20 nt, Chlamydophila pneumoniae J138
uaguaaaugccucuuucaua

SEQ ID NO: 524490 - RNA, 12 nt, Chlamydophila pneumoniae J138
uaguaaagaauc

SEQ ID NO: 524491 - RNA, 16 nt, Chlamydophila pneumoniae J138
uagguuucaauagaag

SEQ ID NO: 524492 - RNA, 22 nt, Chlamydophila pneumoniae J138
uaggugauauuuucuugucucu

SEQ ID NO: 524493 - RNA, 21 nt, Chlamydophila pneumoniae J138
uaggucuaauccccaauuaua

SEQ ID NO: 524494 - RNA, 21 nt, Chlamydophila pneumoniae J138
uaggucuugucuauucucuuc

SEQ ID NO: 524495 - RNA, 20 nt, Chlamydophila pneumoniae J138
uaggugaaauauugaucuuu

SEQ ID NO: 524496 - RNA, 22 nt, Chlamydophila pneumoniae J138
uagguccguuuuuucagaugau

SEQ ID NO: 524497 - RNA, 20 nt, Chlamydophila pneumoniae J138
uacccaaauuucuucuggau

SEQ ID NO: 524498 - RNA, 17 nt, Chlamydophila pneumoniae J138
uacccuccgagucgaca

SEQ ID NO: 524499 - RNA, 22 nt, Chlamydophila pneumoniae J138
uacccucggagacucagagaaa

SEQ ID NO: 524500 - RNA, 13 nt, Chlamydophila pneumoniae J138
uacauagaggaga

SEQ ID NO: 524501 - RNA, 16 nt, Chlamydophila pneumoniae J138
uaccaccuaaaaugca

SEQ ID NO: 524502 - RNA, 20 nt, Chlamydophila pneumoniae J138
uacgcuauucuuaagcuacc

SEQ ID NO: 524503 - RNA, 13 nt, Chlamydophila pneumoniae J138
uacgauguuuucu

SEQ ID NO: 524504 - RNA, 22 nt, Chlamydophila pneumoniae J138
uacguccugaugccuuuuucuu

SEQ ID NO: 524505 - RNA, 21 nt, Chlamydophila pneumoniae J138
uacggaugggcacucuuccac

SEQ ID NO: 524506 - RNA, 16 nt, Chlamydophila pneumoniae J138
uacggcuaaauaaacc

SEQ ID NO: 524507 - RNA, 12 nt, Chlamydophila pneumoniae J138
uaccuuucuaag

SEQ ID NO: 524508 - RNA, 15 nt, Chlamydophila pneumoniae J138
uaccuuucuaagaau

SEQ ID NO: 524509 - RNA, 13 nt, Chlamydophila pneumoniae J138
uacgaaaacaucu

SEQ ID NO: 524510 - RNA, 19 nt, Chlamydophila pneumoniae J138
uacgaauccaaaaaagagc

SEQ ID NO: 524511 - RNA, 17 nt, Chlamydophila pneumoniae J138
uacgaauccaaaaaaga

SEQ ID NO: 524512 - RNA, 14 nt, Chlamydophila pneumoniae J138
uacgaauaaguuuu

SEQ ID NO: 524513 - RNA, 14 nt, Chlamydophila pneumoniae J138
uaccuugagacaaa

SEQ ID NO: 524514 - RNA, 14 nt, Chlamydophila pneumoniae J138
uaccuuguuuuccu

SEQ ID NO: 524515 - RNA, 16 nt, Chlamydophila pneumoniae J138
uaccuucgacuauaag

SEQ ID NO: 524516 - RNA, 19 nt, Chlamydophila pneumoniae J138
uaccuagggucuucucgag

SEQ ID NO: 524517 - RNA, 15 nt, Chlamydophila pneumoniae J138
uaccguaaagaaaag

SEQ ID NO: 524518 - RNA, 15 nt, Chlamydophila pneumoniae J138
uacuccauuggcaua

SEQ ID NO: 524519 - RNA, 16 nt, Chlamydophila pneumoniae J138
uacucauauuuugucu

SEQ ID NO: 524520 - RNA, 15 nt, Chlamydophila pneumoniae J138
uacguuuuuuuccuu

SEQ ID NO: 524521 - RNA, 13 nt, Chlamydophila pneumoniae J138
uacuaaaaucuca

SEQ ID NO: 524522 - RNA, 17 nt, Chlamydophila pneumoniae J138
uacuaaaaucucauuuc

SEQ ID NO: 524523 - RNA, 22 nt, Chlamydophila pneumoniae J138
uacugaggaaaucgcauuacaa

SEQ ID NO: 524524 - RNA, 18 nt, Chlamydophila pneumoniae J138
uacugaggaaaucgcauu

SEQ ID NO: 524525 - RNA, 19 nt, Chlamydophila pneumoniae J138
uacugcugcuaagccaaau

SEQ ID NO: 524526 - RNA, 20 nt, Chlamydophila pneumoniae J138
uacucugaacaggaauagaa

SEQ ID NO: 524527 - RNA, 16 nt, Chlamydophila pneumoniae J138
uacucuugcuugcuag

SEQ ID NO: 524528 - RNA, 17 nt, Chlamydophila pneumoniae J138
uacugaaaccuucucuc

SEQ ID NO: 524529 - RNA, 12 nt, Chlamydophila pneumoniae J138
uacucucugcuu

SEQ ID NO: 524530 - RNA, 15 nt, Chlamydophila pneumoniae J138
uacuugggagaugcu

SEQ ID NO: 524531 - RNA, 16 nt, Chlamydophila pneumoniae J138
uacuugggagaugcua

SEQ ID NO: 524532 - RNA, 14 nt, Chlamydophila pneumoniae J138
uacuuuaagaccua

SEQ ID NO: 524533 - RNA, 16 nt, Chlamydophila pneumoniae J138
uacuuuaaucaagccu

SEQ ID NO: 524534 - RNA, 12 nt, Chlamydophila pneumoniae J138
uacuucuccuga

SEQ ID NO: 524535 - RNA, 24 nt, Chlamydophila pneumoniae J138
uacuucuccacagcuucuucguaa

SEQ ID NO: 524536 - RNA, 16 nt, Chlamydophila pneumoniae J138
uacuuuuacugaaauu

SEQ ID NO: 524537 - RNA, 12 nt, Chlamydophila pneumoniae J138
uagaaaaagauc

SEQ ID NO: 524538 - RNA, 18 nt, Chlamydophila pneumoniae J138
uacuucguuaugaagcuu

SEQ ID NO: 524539 - RNA, 15 nt, Chlamydophila pneumoniae J138
uacuuacaagaacaa

SEQ ID NO: 524540 - RNA, 20 nt, Chlamydophila pneumoniae J138
uacuuacaagaacaaggcuc

SEQ ID NO: 524541 - RNA, 18 nt, Chlamydophila pneumoniae J138
uacuuaggaauuuuucua

SEQ ID NO: 524542 - RNA, 21 nt, Chlamydophila pneumoniae J138
uacuggagagguaaccagaga

SEQ ID NO: 524543 - RNA, 23 nt, Chlamydophila pneumoniae J138
uacuggagagguaaccagagagc

SEQ ID NO: 524544 - RNA, 15 nt, Chlamydophila pneumoniae J138
uaauaggauaagaaa

SEQ ID NO: 524545 - RNA, 16 nt, Chlamydophila pneumoniae J138
uaauaggauaagaaau

SEQ ID NO: 524546 - RNA, 19 nt, Chlamydophila pneumoniae J138
uaauaggauaagaaauuaa

SEQ ID NO: 524547 - RNA, 14 nt, Chlamydophila pneumoniae J138
uaacguugauugga

SEQ ID NO: 524548 - RNA, 13 nt, Chlamydophila pneumoniae J138
uaacgcuuuucua

SEQ ID NO: 524549 - RNA, 19 nt, Chlamydophila pneumoniae J138
uaacgcuuuuucaaacugu

SEQ ID NO: 524550 - RNA, 19 nt, Chlamydophila pneumoniae J138
uaacguagucaaaaauucu

SEQ ID NO: 524551 - RNA, 14 nt, Chlamydophila pneumoniae J138
uaauauaaaagaag

SEQ ID NO: 524552 - RNA, 15 nt, Chlamydophila pneumoniae J138
uaaucagaggagccu

SEQ ID NO: 524553 - RNA, 21 nt, Chlamydophila pneumoniae J138
uaaucagaggagccuccauaa

SEQ ID NO: 524554 - RNA, 21 nt, Chlamydophila pneumoniae J138
uaaucagaagugaucuugaga

SEQ ID NO: 524555 - RNA, 14 nt, Chlamydophila pneumoniae J138
uaaucagaggagcc

SEQ ID NO: 524556 - RNA, 12 nt, Chlamydophila pneumoniae J138
uaaucaccuuag

SEQ ID NO: 524557 - RNA, 16 nt, Chlamydophila pneumoniae J138
uaaucauuaagacuca

SEQ ID NO: 524558 - RNA, 19 nt, Chlamydophila pneumoniae J138
uaaucaugauaaaaauuuu

SEQ ID NO: 524559 - RNA, 16 nt, Chlamydophila pneumoniae J138
uaaucaugauaaaaau

SEQ ID NO: 524560 - RNA, 18 nt, Chlamydophila pneumoniae J138
uaauccucgauacuguug

SEQ ID NO: 524561 - RNA, 16 nt, Chlamydophila pneumoniae J138
uaauccucgauacugu

SEQ ID NO: 524562 - RNA, 12 nt, Chlamydophila pneumoniae J138
uaauccuccaaa

SEQ ID NO: 524563 - RNA, 15 nt, Chlamydophila pneumoniae J138
uaauccuugagggcu

SEQ ID NO: 524564 - RNA, 14 nt, Chlamydophila pneumoniae J138
uaauccuucuuucu

SEQ ID NO: 524565 - RNA, 21 nt, Chlamydophila pneumoniae J138
uaauccuguugucacuaagau

SEQ ID NO: 524566 - RNA, 23 nt, Chlamydophila pneumoniae J138
uaauccugaauggcucugucacu

SEQ ID NO: 524567 - RNA, 21 nt, Chlamydophila pneumoniae J138
uaauccuucuuucugcucuuc

SEQ ID NO: 524568 - RNA, 22 nt, Chlamydophila pneumoniae J138
uaauccuguugucacuaagaua

SEQ ID NO: 524569 - RNA, 23 nt, Chlamydophila pneumoniae J138
uaaugcagauagcuuacagagaa

SEQ ID NO: 524570 - RNA, 23 nt, Chlamydophila pneumoniae J138
uaaugccgagaauacagagucug

SEQ ID NO: 524571 - RNA, 20 nt, Chlamydophila pneumoniae J138
uaaucgagagaagaaauucu

SEQ ID NO: 524572 - RNA, 21 nt, Chlamydophila pneumoniae J138
uaaugaagcagggaaaaugcg

SEQ ID NO: 524573 - RNA, 13 nt, Chlamydophila pneumoniae J138
uaaugaacucagg

SEQ ID NO: 524574 - RNA, 18 nt, Chlamydophila pneumoniae J138
uaaugaaguuugcaugca

SEQ ID NO: 524575 - RNA, 15 nt, Chlamydophila pneumoniae J138
uaaugacagugucca

SEQ ID NO: 524576 - RNA, 15 nt, Chlamydophila pneumoniae J138
uaauucaaaaagaga

SEQ ID NO: 524577 - RNA, 13 nt, Chlamydophila pneumoniae J138
uaauucaaaaaga

SEQ ID NO: 524578 - RNA, 17 nt, Chlamydophila pneumoniae J138
uaauucagaaagacgau

SEQ ID NO: 524579 - RNA, 14 nt, Chlamydophila pneumoniae J138
uaauuacagaaucc

SEQ ID NO: 524580 - RNA, 15 nt, Chlamydophila pneumoniae J138
uaauuacagaucugc

SEQ ID NO: 524581 - RNA, 15 nt, Chlamydophila pneumoniae J138
uaauuauguagaucu

SEQ ID NO: 524582 - RNA, 12 nt, Chlamydophila pneumoniae J138
uaauuaaaaacu

SEQ ID NO: 524583 - RNA, 22 nt, Chlamydophila pneumoniae J138
uaaugcuaucccacuaacaaga

SEQ ID NO: 524584 - RNA, 20 nt, Chlamydophila pneumoniae J138
uaauggugucuuacaaaccc

SEQ ID NO: 524585 - RNA, 20 nt, Chlamydophila pneumoniae J138
uaauuucuaaauagaaaaca

SEQ ID NO: 524586 - RNA, 21 nt, Chlamydophila pneumoniae J138
uaauuuccuucaggauuuucc

SEQ ID NO: 524587 - RNA, 22 nt, Chlamydophila pneumoniae J138
uaauuuccuucaggauuuucca

SEQ ID NO: 524588 - RNA, 17 nt, Chlamydophila pneumoniae J138
uaauuucuccgucaaga

SEQ ID NO: 524589 - RNA, 22 nt, Chlamydophila pneumoniae J138
uaauuucuuucacaucuuuaga

SEQ ID NO: 524590 - RNA, 15 nt, Chlamydophila pneumoniae J138
uaauuucaaagaugc

SEQ ID NO: 524591 - RNA, 17 nt, Chlamydophila pneumoniae J138
uaauuuuaaauuuuguu

SEQ ID NO: 524592 - RNA, 19 nt, Chlamydophila pneumoniae J138
uaauuuuagaacuucaaug

SEQ ID NO: 524593 - RNA, 15 nt, Chlamydophila pneumoniae J138
uaauuuucuguuaau

SEQ ID NO: 524594 - RNA, 16 nt, Chlamydophila pneumoniae J138
uacaaaaaauaaaauc

SEQ ID NO: 524595 - RNA, 19 nt, Chlamydophila pneumoniae J138
uaauuuuugcuaaacaaug

SEQ ID NO: 524596 - RNA, 12 nt, Chlamydophila pneumoniae J138
uacaaacaagaa

SEQ ID NO: 524597 - RNA, 16 nt, Chlamydophila pneumoniae J138
uacaaacaagaagcgu

SEQ ID NO: 524598 - RNA, 13 nt, Chlamydophila pneumoniae J138
uacaaaauuauua

SEQ ID NO: 524599 - RNA, 11 nt, Chlamydophila pneumoniae J138
uacaaacccau

SEQ ID NO: 524600 - RNA, 16 nt, Chlamydophila pneumoniae J138
uacaaacccauauuug

SEQ ID NO: 524601 - RNA, 18 nt, Chlamydophila pneumoniae J138
uacaaacccauauuugaa

SEQ ID NO: 524602 - RNA, 15 nt, Chlamydophila pneumoniae J138
uacaaaauuauuaaa

SEQ ID NO: 524603 - RNA, 14 nt, Chlamydophila pneumoniae J138
uacaaaacaaaagc

SEQ ID NO: 524604 - RNA, 13 nt, Chlamydophila pneumoniae J138
uacaaaaaauaaa

SEQ ID NO: 524605 - RNA, 23 nt, Chlamydophila pneumoniae J138
uacaaacccauauuugaauaaag

SEQ ID NO: 524606 - RNA, 14 nt, Chlamydophila pneumoniae J138
uacaaacucuucca

SEQ ID NO: 524607 - RNA, 19 nt, Chlamydophila pneumoniae J138
uacaagcaauacuaagaag

SEQ ID NO: 524608 - RNA, 20 nt, Chlamydophila pneumoniae J138
uacaagcuucaucaaaacau

SEQ ID NO: 524609 - RNA, 18 nt, Chlamydophila pneumoniae J138
uacaagugaagacaagua

SEQ ID NO: 524610 - RNA, 12 nt, Chlamydophila pneumoniae J138
uacaaguugaga

SEQ ID NO: 524611 - RNA, 23 nt, Chlamydophila pneumoniae J138
uacaauuagagauucauaaaacu

SEQ ID NO: 524612 - RNA, 13 nt, Chlamydophila pneumoniae J138
uacaauuaaaaaa

SEQ ID NO: 524613 - RNA, 17 nt, Chlamydophila pneumoniae J138
uacaaguugagagagag

SEQ ID NO: 524614 - RNA, 13 nt, Chlamydophila pneumoniae J138
uacaauaaacaac

SEQ ID NO: 524615 - RNA, 18 nt, Chlamydophila pneumoniae J138
uacacauugucucuuuua

SEQ ID NO: 524616 - RNA, 15 nt, Chlamydophila pneumoniae J138
uacaccauagaacug

SEQ ID NO: 524617 - RNA, 17 nt, Chlamydophila pneumoniae J138
uacaguagcuugugcua

SEQ ID NO: 524618 - RNA, 17 nt, Chlamydophila pneumoniae J138
uacagcuucauuaucuu

SEQ ID NO: 524619 - RNA, 18 nt, Chlamydophila pneumoniae J138
uacaguuuuuuucuaaau

SEQ ID NO: 524620 - RNA, 15 nt, Chlamydophila pneumoniae J138
uacaggacuguuugu

SEQ ID NO: 524621 - RNA, 19 nt, Chlamydophila pneumoniae J138
uacaggacuguuuguuuau

SEQ ID NO: 524622 - RNA, 13 nt, Chlamydophila pneumoniae J138
uacaggagaaucc

SEQ ID NO: 524623 - RNA, 16 nt, Chlamydophila pneumoniae J138
uacaggaaaacgcccu

SEQ ID NO: 524624 - RNA, 18 nt, Chlamydophila pneumoniae J138
uacacuccaauaagacga

SEQ ID NO: 524625 - RNA, 21 nt, Chlamydophila pneumoniae J138
uacacugguagcuaaauuuag

SEQ ID NO: 524626 - RNA, 16 nt, Chlamydophila pneumoniae J138
uacacuauaagacauu

SEQ ID NO: 524627 - RNA, 15 nt, Chlamydophila pneumoniae J138
uacagcauaaaaauu

SEQ ID NO: 524628 - RNA, 18 nt, Chlamydophila pneumoniae J138
uacagcaucggcaaccag

SEQ ID NO: 524629 - RNA, 22 nt, Chlamydophila pneumoniae J138
uacagcauaaaaauucucauaa

SEQ ID NO: 524630 - RNA, 14 nt, Chlamydophila pneumoniae J138
uacagccagcagaa

SEQ ID NO: 524631 - RNA, 19 nt, Chlamydophila pneumoniae J138
uacacuguuguaauaaaau

SEQ ID NO: 524632 - RNA, 15 nt, Chlamydophila pneumoniae J138
uacacuucuaauaca

SEQ ID NO: 524633 - RNA, 16 nt, Chlamydophila pneumoniae J138
gcugauuucuuuuuca

SEQ ID NO: 524634 - RNA, 14 nt, Chlamydophila pneumoniae J138
gcugauuucuuuuu

SEQ ID NO: 524635 - RNA, 22 nt, Chlamydophila pneumoniae J138
gcugcaaucucaaaaucaaaua

SEQ ID NO: 524636 - RNA, 15 nt, Chlamydophila pneumoniae J138
gcugcuagagcagcu

SEQ ID NO: 524637 - RNA, 22 nt, Chlamydophila pneumoniae J138
gcuggaggccaaagaacagcac

SEQ ID NO: 524638 - RNA, 13 nt, Chlamydophila pneumoniae J138
gcuggaucuucug

SEQ ID NO: 524639 - RNA, 14 nt, Chlamydophila pneumoniae J138
gcugcuucucuacu

SEQ ID NO: 524640 - RNA, 19 nt, Chlamydophila pneumoniae J138
gcugcuuuuguuguuuuug

SEQ ID NO: 524641 - RNA, 15 nt, Chlamydophila pneumoniae J138
gcuggaagacuugcu

SEQ ID NO: 524642 - RNA, 16 nt, Chlamydophila pneumoniae J138
gcugcugcuaaacagg

SEQ ID NO: 524643 - RNA, 20 nt, Chlamydophila pneumoniae J138
gcuguacagaacaaugguuu

SEQ ID NO: 524644 - RNA, 12 nt, Chlamydophila pneumoniae J138
gcuguacagaac

SEQ ID NO: 524645 - RNA, 21 nt, Chlamydophila pneumoniae J138
gcuguacuugauauuguucuu

SEQ ID NO: 524646 - RNA, 16 nt, Chlamydophila pneumoniae J138
gcuguccagucuauag

SEQ ID NO: 524647 - RNA, 18 nt, Chlamydophila pneumoniae J138
gcuguguuauggaaauca

SEQ ID NO: 524648 - RNA, 13 nt, Chlamydophila pneumoniae J138
gcugugcauuuuc

SEQ ID NO: 524649 - RNA, 19 nt, Chlamydophila pneumoniae J138
gcugugcauuuucuucuug

SEQ ID NO: 524650 - RNA, 20 nt, Chlamydophila pneumoniae J138
gcugucuagaacacucagag

SEQ ID NO: 524651 - RNA, 17 nt, Chlamydophila pneumoniae J138
gcugucuugaccaauac

SEQ ID NO: 524652 - RNA, 13 nt, Chlamydophila pneumoniae J138
gcuguuccaagag

SEQ ID NO: 524653 - RNA, 22 nt, Chlamydophila pneumoniae J138
gcuguuucuucugaauagcucu

SEQ ID NO: 524654 - RNA, 14 nt, Chlamydophila pneumoniae J138
gcuuauagagagaa

SEQ ID NO: 524655 - RNA, 17 nt, Chlamydophila pneumoniae J138
gcuuauagagagaauga

SEQ ID NO: 524656 - RNA, 21 nt, Chlamydophila pneumoniae J138
gcuuagcgaucucucuuccug

SEQ ID NO: 524657 - RNA, 14 nt, Chlamydophila pneumoniae J138
gcuuagccauggca

SEQ ID NO: 524658 - RNA, 20 nt, Chlamydophila pneumoniae J138
gcuuagccauggcaucuaag

SEQ ID NO: 524659 - RNA, 20 nt, Chlamydophila pneumoniae J138
gcuuauccaaguguucgagu

SEQ ID NO: 524660 - RNA, 16 nt, Chlamydophila pneumoniae J138
gcuucacaucuuucuc

SEQ ID NO: 524661 - RNA, 18 nt, Chlamydophila pneumoniae J138
gcuucaccauuaagauau

SEQ ID NO: 524662 - RNA, 21 nt, Chlamydophila pneumoniae J138
gcuucagaguggucauugccu

SEQ ID NO: 524663 - RNA, 20 nt, Chlamydophila pneumoniae J138
gcuucauuccuacaucugug

SEQ ID NO: 524664 - RNA, 18 nt, Chlamydophila pneumoniae J138
gcuucauuaucuucguaa

SEQ ID NO: 524665 - RNA, 17 nt, Chlamydophila pneumoniae J138
gcuucaucaaaacauaa

SEQ ID NO: 524666 - RNA, 22 nt, Chlamydophila pneumoniae J138
gcuuccauagcuuuagaagccc

SEQ ID NO: 524667 - RNA, 19 nt, Chlamydophila pneumoniae J138
gcuuccccuaauaggggac

SEQ ID NO: 524668 - RNA, 13 nt, Chlamydophila pneumoniae J138
gcuuccuguagug

SEQ ID NO: 524669 - RNA, 19 nt, Chlamydophila pneumoniae J138
gcuuccugcuccucuucuu

SEQ ID NO: 524670 - RNA, 16 nt, Chlamydophila pneumoniae J138
gcuucgcaaucuuuga

SEQ ID NO: 524671 - RNA, 23 nt, Chlamydophila pneumoniae J138
gcuucuggauucaaauuugcucu

SEQ ID NO: 524672 - RNA, 20 nt, Chlamydophila pneumoniae J138
gcuucuggagaaaaaauauc

SEQ ID NO: 524673 - RNA, 16 nt, Chlamydophila pneumoniae J138
gcuucuacagcaucgg

SEQ ID NO: 524674 - RNA, 22 nt, Chlamydophila pneumoniae J138
gcuucuaagaaacuuccaaaac

SEQ ID NO: 524675 - RNA, 15 nt, Chlamydophila pneumoniae J138
gcuucuccaaauaaa

SEQ ID NO: 524676 - RNA, 17 nt, Chlamydophila pneumoniae J138
gcuucuccaaauaaagc

SEQ ID NO: 524677 - RNA, 16 nt, Chlamydophila pneumoniae J138
gcuucuauuuuagaau

SEQ ID NO: 524678 - RNA, 17 nt, Chlamydophila pneumoniae J138
gcuucuaagaaacuucc

SEQ ID NO: 524679 - RNA, 11 nt, Chlamydophila pneumoniae J138
gcuucuuucuu

SEQ ID NO: 524680 - RNA, 20 nt, Chlamydophila pneumoniae J138
gcuucuuucucggucuuucu

SEQ ID NO: 524681 - RNA, 15 nt, Chlamydophila pneumoniae J138
gcuucuuucaaagcc

SEQ ID NO: 524682 - RNA, 14 nt, Chlamydophila pneumoniae J138
gcuucuuucaaagc

SEQ ID NO: 524683 - RNA, 17 nt, Chlamydophila pneumoniae J138
gcuucuuuuuuuuucuu

SEQ ID NO: 524684 - RNA, 12 nt, Chlamydophila pneumoniae J138
gcuucuuuucca

SEQ ID NO: 524685 - RNA, 15 nt, Chlamydophila pneumoniae J138
gcuugaccucaucag

SEQ ID NO: 524686 - RNA, 12 nt, Chlamydophila pneumoniae J138
gcuucuguaaag

SEQ ID NO: 524687 - RNA, 18 nt, Chlamydophila pneumoniae J138
gcuucuuguuuuugugga

SEQ ID NO: 524688 - RNA, 22 nt, Chlamydophila pneumoniae J138
gcuucuucuauagaauccacua

SEQ ID NO: 524689 - RNA, 15 nt, Chlamydophila pneumoniae J138
gcuugcguuuccuag

SEQ ID NO: 524690 - RNA, 13 nt, Chlamydophila pneumoniae J138
gcuugcgcagcuu

SEQ ID NO: 524691 - RNA, 15 nt, Chlamydophila pneumoniae J138
gcuugcgagcuucuu

SEQ ID NO: 524692 - RNA, 16 nt, Chlamydophila pneumoniae J138
gcuugccagcagaagu

SEQ ID NO: 524693 - RNA, 21 nt, Chlamydophila pneumoniae J138
gcuugugcaugcaucuuauca

SEQ ID NO: 524694 - RNA, 21 nt, Chlamydophila pneumoniae J138
gcuugucuacagaggaaucua

SEQ ID NO: 524695 - RNA, 13 nt, Chlamydophila pneumoniae J138
gcuugucuaggag

SEQ ID NO: 524696 - RNA, 21 nt, Chlamydophila pneumoniae J138
gcuuggggguggucuagagau

SEQ ID NO: 524697 - RNA, 15 nt, Chlamydophila pneumoniae J138
gcuuuaaguguuucu

SEQ ID NO: 524698 - RNA, 14 nt, Chlamydophila pneumoniae J138
gcuuuaaauuuuuu

SEQ ID NO: 524699 - RNA, 15 nt, Chlamydophila pneumoniae J138
gcuuuaaauuuuuua

SEQ ID NO: 524700 - RNA, 21 nt, Chlamydophila pneumoniae J138
gcuuuaaauuuuuuaggaucu

SEQ ID NO: 524701 - RNA, 17 nt, Chlamydophila pneumoniae J138
gcuuguugguuaaaaua

SEQ ID NO: 524702 - RNA, 13 nt, Chlamydophila pneumoniae J138
gcuuguuuuugca

SEQ ID NO: 524703 - RNA, 16 nt, Chlamydophila pneumoniae J138
gcuuuagaaaagugcc

SEQ ID NO: 524704 - RNA, 14 nt, Chlamydophila pneumoniae J138
gcuuuagaagcccg

SEQ ID NO: 524705 - RNA, 18 nt, Chlamydophila pneumoniae J138
gcuuuacgaugagguuga

SEQ ID NO: 524706 - RNA, 19 nt, Chlamydophila pneumoniae J138
gcuuugccgccucagcacc

SEQ ID NO: 524707 - RNA, 21 nt, Chlamydophila pneumoniae J138
gcuuugugagcugcugguccu

SEQ ID NO: 524708 - RNA, 18 nt, Chlamydophila pneumoniae J138
gcuuugugaguucuuccu

SEQ ID NO: 524709 - RNA, 20 nt, Chlamydophila pneumoniae J138
gcuuuucauuuuuaggaucu

SEQ ID NO: 524710 - RNA, 14 nt, Chlamydophila pneumoniae J138
gcuuuuguuguuuu

SEQ ID NO: 524711 - RNA, 19 nt, Chlamydophila pneumoniae J138
gcuuuucuuuuucuaggga

SEQ ID NO: 524712 - RNA, 12 nt, Chlamydophila pneumoniae J138
gcuuuucuucuu

SEQ ID NO: 524713 - RNA, 10 nt, Chlamydophila pneumoniae J138
gcuuuuugcu

SEQ ID NO: 524714 - RNA, 13 nt, Chlamydophila pneumoniae J138
ggaaaauaaucuu

SEQ ID NO: 524715 - RNA, 17 nt, Chlamydophila pneumoniae J138
ggaaaauaaucuucaaa

SEQ ID NO: 524716 - RNA, 12 nt, Chlamydophila pneumoniae J138
ggaaaagaaaag

SEQ ID NO: 524717 - RNA, 12 nt, Chlamydophila pneumoniae J138
ggaaaaagccuu

SEQ ID NO: 524718 - RNA, 16 nt, Chlamydophila pneumoniae J138
ggaaaaaggaggaugu

SEQ ID NO: 524719 - RNA, 15 nt, Chlamydophila pneumoniae J138
gcuuuuuuucuagag

SEQ ID NO: 524720 - RNA, 18 nt, Chlamydophila pneumoniae J138
gcuuuuuugaaagcugga

SEQ ID NO: 524721 - RNA, 19 nt, Chlamydophila pneumoniae J138
ggaaagacucaucuuugaa

SEQ ID NO: 524722 - RNA, 15 nt, Chlamydophila pneumoniae J138
ggaaagcucuuucau

SEQ ID NO: 524723 - RNA, 14 nt, Chlamydophila pneumoniae J138
ggaaagcacauaca

SEQ ID NO: 524724 - RNA, 21 nt, Chlamydophila pneumoniae J138
ggaacaaagcucuccuucaga

SEQ ID NO: 524725 - RNA, 11 nt, Chlamydophila pneumoniae J138
ggaacaacugu

SEQ ID NO: 524726 - RNA, 15 nt, Chlamydophila pneumoniae J138
ggaaauuauggaggg

SEQ ID NO: 524727 - RNA, 23 nt, Chlamydophila pneumoniae J138
ggaaauuagguaguggccacaua

SEQ ID NO: 524728 - RNA, 22 nt, Chlamydophila pneumoniae J138
ggaaaguugcaacucucuuuaa

SEQ ID NO: 524729 - RNA, 23 nt, Chlamydophila pneumoniae J138
ggaaaguugcaacucucuuuaaa

SEQ ID NO: 524730 - RNA, 16 nt, Chlamydophila pneumoniae J138
ggaaaguucacaagca

SEQ ID NO: 524731 - RNA, 14 nt, Chlamydophila pneumoniae J138
ggaacaguauaauc

SEQ ID NO: 524732 - RNA, 20 nt, Chlamydophila pneumoniae J138
ggaacauaucgauaggauuc

SEQ ID NO: 524733 - RNA, 21 nt, Chlamydophila pneumoniae J138
ggaacuaaaaguuuuuuauuu

SEQ ID NO: 524734 - RNA, 21 nt, Chlamydophila pneumoniae J138
ggaagaaaggauuggaugaga

SEQ ID NO: 524735 - RNA, 16 nt, Chlamydophila pneumoniae J138
ggaagcaaagaaaauu

SEQ ID NO: 524736 - RNA, 17 nt, Chlamydophila pneumoniae J138
ggaagaaauuaacaaca

SEQ ID NO: 524737 - RNA, 21 nt, Chlamydophila pneumoniae J138
ggaagaauuucauaagagaac

SEQ ID NO: 524738 - RNA, 13 nt, Chlamydophila pneumoniae J138
ggaagacucucau

SEQ ID NO: 524739 - RNA, 15 nt, Chlamydophila pneumoniae J138
ggaagccagucuuca

SEQ ID NO: 524740 - RNA, 22 nt, Chlamydophila pneumoniae J138
ggaauaucaggacaaugaagaa

SEQ ID NO: 524741 - RNA, 14 nt, Chlamydophila pneumoniae J138
ggaagcucuucuac

SEQ ID NO: 524742 - RNA, 19 nt, Chlamydophila pneumoniae J138
ggaauggcuuuuguuuugu

SEQ ID NO: 524743 - RNA, 22 nt, Chlamydophila pneumoniae J138
ggaauuagagaaauuuuuaauu

SEQ ID NO: 524744 - RNA, 17 nt, Chlamydophila pneumoniae J138
ggacacaacucuuuaau

SEQ ID NO: 524745 - RNA, 15 nt, Chlamydophila pneumoniae J138
ggacaaugaagaacu

SEQ ID NO: 524746 - RNA, 14 nt, Chlamydophila pneumoniae J138
ggacaauauagaga

SEQ ID NO: 524747 - RNA, 20 nt, Chlamydophila pneumoniae J138
ggacuaaacaagaaaaagca

SEQ ID NO: 524748 - RNA, 13 nt, Chlamydophila pneumoniae J138
ggacuacugaaac

SEQ ID NO: 524749 - RNA, 16 nt, Chlamydophila pneumoniae J138
ggacuaaacaagaaaa

SEQ ID NO: 524750 - RNA, 18 nt, Chlamydophila pneumoniae J138
ggacgcuaauccuccucg

SEQ ID NO: 524751 - RNA, 20 nt, Chlamydophila pneumoniae J138
ggagagcuugguuuucuccu

SEQ ID NO: 524752 - RNA, 17 nt, Chlamydophila pneumoniae J138
ggagagcuuucgcuccu

SEQ ID NO: 524753 - RNA, 15 nt, Chlamydophila pneumoniae J138
ggagagcgaaauaga

SEQ ID NO: 524754 - RNA, 13 nt, Chlamydophila pneumoniae J138
ggagagggaagga

SEQ ID NO: 524755 - RNA, 16 nt, Chlamydophila pneumoniae J138
ggagacucagagaaaa

SEQ ID NO: 524756 - RNA, 18 nt, Chlamydophila pneumoniae J138
ggagacucagagaaaauc

SEQ ID NO: 524757 - RNA, 18 nt, Chlamydophila pneumoniae J138
ggagaagucgaaagauca

SEQ ID NO: 524758 - RNA, 23 nt, Chlamydophila pneumoniae J138
ggagaaguuguuuauuuagcauu

SEQ ID NO: 524759 - RNA, 13 nt, Chlamydophila pneumoniae J138
ggagaauugaaaa

SEQ ID NO: 524760 - RNA, 19 nt, Chlamydophila pneumoniae J138
ggagaccuuuauagauaug

SEQ ID NO: 524761 - RNA, 10 nt, Chlamydophila pneumoniae J138
ggagaagccc

SEQ ID NO: 524762 - RNA, 11 nt, Chlamydophila pneumoniae J138
ggagaagcccc

SEQ ID NO: 524763 - RNA, 19 nt, Chlamydophila pneumoniae J138
ggagcucuuucuuggauug

SEQ ID NO: 524764 - RNA, 17 nt, Chlamydophila pneumoniae J138
ggagcucuuucuuggau

SEQ ID NO: 524765 - RNA, 13 nt, Chlamydophila pneumoniae J138
ggagcuaaagcug

SEQ ID NO: 524766 - RNA, 15 nt, Chlamydophila pneumoniae J138
ggagcucgcuaaaca

SEQ ID NO: 524767 - RNA, 17 nt, Chlamydophila pneumoniae J138
ggauaaaaaguuuuugu

SEQ ID NO: 524768 - RNA, 16 nt, Chlamydophila pneumoniae J138
ggaggaacaauacucu

SEQ ID NO: 524769 - RNA, 17 nt, Chlamydophila pneumoniae J138
ggagcuugucuaggagc

SEQ ID NO: 524770 - RNA, 11 nt, Chlamydophila pneumoniae J138
ggagggaaaca

SEQ ID NO: 524771 - RNA, 22 nt, Chlamydophila pneumoniae J138
ggauaucuucuggguucuccac

SEQ ID NO: 524772 - RNA, 17 nt, Chlamydophila pneumoniae J138
ggauauugauaaauccc

SEQ ID NO: 524773 - RNA, 17 nt, Chlamydophila pneumoniae J138
ggauaccauaaggagau

SEQ ID NO: 524774 - RNA, 12 nt, Chlamydophila pneumoniae J138
ggauccaggagu

SEQ ID NO: 524775 - RNA, 15 nt, Chlamydophila pneumoniae J138
ggauccaucggcauu

SEQ ID NO: 524776 - RNA, 17 nt, Chlamydophila pneumoniae J138
ggaucauguagcagagc

SEQ ID NO: 524777 - RNA, 14 nt, Chlamydophila pneumoniae J138
ggaucauugaguuc

SEQ ID NO: 524778 - RNA, 15 nt, Chlamydophila pneumoniae J138
ggaucccguaaaaga

SEQ ID NO: 524779 - RNA, 13 nt, Chlamydophila pneumoniae J138
ggaucccaucauc

SEQ ID NO: 524780 - RNA, 17 nt, Chlamydophila pneumoniae J138
ggauccuagaauaggaa

SEQ ID NO: 524781 - RNA, 20 nt, Chlamydophila pneumoniae J138
ggaucgcucucuccaugagc

SEQ ID NO: 524782 - RNA, 13 nt, Chlamydophila pneumoniae J138
ggaugcuaauaaa

SEQ ID NO: 524783 - RNA, 20 nt, Chlamydophila pneumoniae J138
ggaucuuuucuuucuaagau

SEQ ID NO: 524784 - RNA, 20 nt, Chlamydophila pneumoniae J138
ggaucuucaucccuacccuc

SEQ ID NO: 524785 - RNA, 17 nt, Chlamydophila pneumoniae J138
ggaucuuuucuuucuaa

SEQ ID NO: 524786 - RNA, 18 nt, Chlamydophila pneumoniae J138
ggaucuucagagagaaca

SEQ ID NO: 524787 - RNA, 23 nt, Chlamydophila pneumoniae J138
ggaucuucuucuggcugagagaa

SEQ ID NO: 524788 - RNA, 15 nt, Chlamydophila pneumoniae J138
ggaucuaaagcauca

SEQ ID NO: 524789 - RNA, 18 nt, Chlamydophila pneumoniae J138
ggaucggucuuuucuaag

SEQ ID NO: 524790 - RNA, 11 nt, Chlamydophila pneumoniae J138
ggaugugaugu

SEQ ID NO: 524791 - RNA, 16 nt, Chlamydophila pneumoniae J138
ggauucugucuauaag

SEQ ID NO: 524792 - RNA, 17 nt, Chlamydophila pneumoniae J138
ggcauacaguagaaaca

SEQ ID NO: 524793 - RNA, 17 nt, Chlamydophila pneumoniae J138
ggcaggaaugagcggca

SEQ ID NO: 524794 - RNA, 23 nt, Chlamydophila pneumoniae J138
ggcaggacucuuuaagcaagagc

SEQ ID NO: 524795 - RNA, 15 nt, Chlamydophila pneumoniae J138
ggcauguuuaauauc

SEQ ID NO: 524796 - RNA, 23 nt, Chlamydophila pneumoniae J138
ggccaguuacugucugcaaagag

SEQ ID NO: 524797 - RNA, 18 nt, Chlamydophila pneumoniae J138
ggcccugacuuagagucu

SEQ ID NO: 524798 - RNA, 16 nt, Chlamydophila pneumoniae J138
gccuaaagagauguag

SEQ ID NO: 524799 - RNA, 21 nt, Chlamydophila pneumoniae J138
gcgaaacauuagucaauguau

SEQ ID NO: 524800 - RNA, 17 nt, Chlamydophila pneumoniae J138
gcgaaugucguuaaaaa

SEQ ID NO: 524801 - RNA, 15 nt, Chlamydophila pneumoniae J138
gcgaaugucguuaaa

SEQ ID NO: 524802 - RNA, 16 nt, Chlamydophila pneumoniae J138
gcgacaugagaaaucu

SEQ ID NO: 524803 - RNA, 23 nt, Chlamydophila pneumoniae J138
gcgagccauagaggaaugauccc

SEQ ID NO: 524804 - RNA, 16 nt, Chlamydophila pneumoniae J138
gcgauaucuauaaaug

SEQ ID NO: 524805 - RNA, 16 nt, Chlamydophila pneumoniae J138
gcgaguaccucaucuc

SEQ ID NO: 524806 - RNA, 18 nt, Chlamydophila pneumoniae J138
gcgcaccccaagcucaag

SEQ ID NO: 524807 - RNA, 16 nt, Chlamydophila pneumoniae J138
gcgcauaugcuccaga

SEQ ID NO: 524808 - RNA, 15 nt, Chlamydophila pneumoniae J138
gcgcuuccagcuucu

SEQ ID NO: 524809 - RNA, 17 nt, Chlamydophila pneumoniae J138
gcggaguccuucuugca

SEQ ID NO: 524810 - RNA, 15 nt, Chlamydophila pneumoniae J138
gcggacuuuagcgcu

SEQ ID NO: 524811 - RNA, 12 nt, Chlamydophila pneumoniae J138
gcggcuaauuuc

SEQ ID NO: 524812 - RNA, 21 nt, Chlamydophila pneumoniae J138
gcgguagcgucuagcuagugu

SEQ ID NO: 524813 - RNA, 12 nt, Chlamydophila pneumoniae J138
gcgggcucaaag

SEQ ID NO: 524814 - RNA, 15 nt, Chlamydophila pneumoniae J138
gcgggcucaaagaaa

SEQ ID NO: 524815 - RNA, 23 nt, Chlamydophila pneumoniae J138
gcgucaauaagcuugccagcaga

SEQ ID NO: 524816 - RNA, 20 nt, Chlamydophila pneumoniae J138
gcgucaauaagcuugccagc

SEQ ID NO: 524817 - RNA, 19 nt, Chlamydophila pneumoniae J138
gcgucaauaagcuugccag

SEQ ID NO: 524818 - RNA, 17 nt, Chlamydophila pneumoniae J138
gcgucaugcauagaaua

SEQ ID NO: 524819 - RNA, 14 nt, Chlamydophila pneumoniae J138
gcguugcuaagcau

SEQ ID NO: 524820 - RNA, 22 nt, Chlamydophila pneumoniae J138
gcguucauacaccccauagagc

SEQ ID NO: 524821 - RNA, 13 nt, Chlamydophila pneumoniae J138
gcgugccuuuuuu

SEQ ID NO: 524822 - RNA, 20 nt, Chlamydophila pneumoniae J138
gcuaucccacuaacaagaua

SEQ ID NO: 524823 - RNA, 18 nt, Chlamydophila pneumoniae J138
gcuaucccacuaacaaga

SEQ ID NO: 524824 - RNA, 16 nt, Chlamydophila pneumoniae J138
gcuaucaacauccccc

SEQ ID NO: 524825 - RNA, 20 nt, Chlamydophila pneumoniae J138
gcuaucaaagacucaugaaa

SEQ ID NO: 524826 - RNA, 18 nt, Chlamydophila pneumoniae J138
gcuauagccuuguaaaua

SEQ ID NO: 524827 - RNA, 21 nt, Chlamydophila pneumoniae J138
gcuauagauacuuugcaauac

SEQ ID NO: 524828 - RNA, 18 nt, Chlamydophila pneumoniae J138
gcuauagauacuuugcaa

SEQ ID NO: 524829 - RNA, 17 nt, Chlamydophila pneumoniae J138
gcuauaccuauauagag

SEQ ID NO: 524830 - RNA, 14 nt, Chlamydophila pneumoniae J138
gcuaguuuaauagu

SEQ ID NO: 524831 - RNA, 16 nt, Chlamydophila pneumoniae J138
gcuagugcgaugggaa

SEQ ID NO: 524832 - RNA, 19 nt, Chlamydophila pneumoniae J138
gcuagagcacauagaaaca

SEQ ID NO: 524833 - RNA, 17 nt, Chlamydophila pneumoniae J138
gcuagaggcaaacaggu

SEQ ID NO: 524834 - RNA, 16 nt, Chlamydophila pneumoniae J138
gcuagaucacaagaaa

SEQ ID NO: 524835 - RNA, 13 nt, Chlamydophila pneumoniae J138
gcuaugaugagaa

SEQ ID NO: 524836 - RNA, 14 nt, Chlamydophila pneumoniae J138
gcuauugaaaaauc

SEQ ID NO: 524837 - RNA, 21 nt, Chlamydophila pneumoniae J138
gcucaaaaaguuccauagagu

SEQ ID NO: 524838 - RNA, 19 nt, Chlamydophila pneumoniae J138
gcucaaaauuuccucgacu

SEQ ID NO: 524839 - RNA, 20 nt, Chlamydophila pneumoniae J138
gcucaaaucucauuccagca

SEQ ID NO: 524840 - RNA, 18 nt, Chlamydophila pneumoniae J138
gcucaagagcaugcuuga

SEQ ID NO: 524841 - RNA, 21 nt, Chlamydophila pneumoniae J138
gcucacgagucccuucuuuca

SEQ ID NO: 524842 - RNA, 13 nt, Chlamydophila pneumoniae J138
gcucaggaaaacu

SEQ ID NO: 524843 - RNA, 22 nt, Chlamydophila pneumoniae J138
gcucagcuaauuuaaaugccuu

SEQ ID NO: 524844 - RNA, 21 nt, Chlamydophila pneumoniae J138
gcuccagaaacgcagcuuucc

SEQ ID NO: 524845 - RNA, 18 nt, Chlamydophila pneumoniae J138
gcuccagaaacgcagcuu

SEQ ID NO: 524846 - RNA, 21 nt, Chlamydophila pneumoniae J138
gcuccuuggcuauggaaagag

SEQ ID NO: 524847 - RNA, 22 nt, Chlamydophila pneumoniae J138
gcugaaccuuugguagaaagac

SEQ ID NO: 524848 - RNA, 11 nt, Chlamydophila pneumoniae J138
gcugaagauuu

SEQ ID NO: 524849 - RNA, 16 nt, Chlamydophila pneumoniae J138
gcugaagauuuuuucu

SEQ ID NO: 524850 - RNA, 17 nt, Chlamydophila pneumoniae J138
gcugaagauuuuuucuu

SEQ ID NO: 524851 - RNA, 15 nt, Chlamydophila pneumoniae J138
gcugaggacgcagag

SEQ ID NO: 524852 - RNA, 17 nt, Chlamydophila pneumoniae J138
gcugagacauauugaag

SEQ ID NO: 524853 - RNA, 20 nt, Chlamydophila pneumoniae J138
gcugagacauauugaagaua

SEQ ID NO: 524854 - RNA, 13 nt, Chlamydophila pneumoniae J138
gcugagagaagca

SEQ ID NO: 524855 - RNA, 21 nt, Chlamydophila pneumoniae J138
gcugauccucggcaucuuugg

SEQ ID NO: 524856 - RNA, 19 nt, Chlamydophila pneumoniae J138
gcucuucuauguguucucg

SEQ ID NO: 524857 - RNA, 23 nt, Chlamydophila pneumoniae J138
gcucuuugggauaaaaaguuuuu

SEQ ID NO: 524858 - RNA, 21 nt, Chlamydophila pneumoniae J138
gcucuuuaauaaggcuuuucu

SEQ ID NO: 524859 - RNA, 19 nt, Chlamydophila pneumoniae J138
gcucuggauugaaagagcu

SEQ ID NO: 524860 - RNA, 15 nt, Chlamydophila pneumoniae J138
gcucuggagauugcu

SEQ ID NO: 524861 - RNA, 17 nt, Chlamydophila pneumoniae J138
gcucuuacuucuggucc

SEQ ID NO: 524862 - RNA, 12 nt, Chlamydophila pneumoniae J138
gcucguacuguu

SEQ ID NO: 524863 - RNA, 15 nt, Chlamydophila pneumoniae J138
gcucguauugauauu

SEQ ID NO: 524864 - RNA, 19 nt, Chlamydophila pneumoniae J138
gcucuaaacucucuuccuu

SEQ ID NO: 524865 - RNA, 18 nt, Chlamydophila pneumoniae J138
gcucuaaacucucuuccu

SEQ ID NO: 524866 - RNA, 23 nt, Chlamydophila pneumoniae J138
gcucuaaacucucuuccuucucc

SEQ ID NO: 524867 - RNA, 18 nt, Chlamydophila pneumoniae J138
gcucuagauauucugauu

SEQ ID NO: 524868 - RNA, 22 nt, Chlamydophila pneumoniae J138
gcucuaagcugugcauuuucuu

SEQ ID NO: 524869 - RNA, 15 nt, Chlamydophila pneumoniae J138
gcucuaagagcccuu

SEQ ID NO: 524870 - RNA, 22 nt, Chlamydophila pneumoniae J138
gcucucaaggucacagcauuuu

SEQ ID NO: 524871 - RNA, 12 nt, Chlamydophila pneumoniae J138
gcucucuagauu

SEQ ID NO: 524872 - RNA, 22 nt, Chlamydophila pneumoniae J138
gcucucgcuaagcaaagcggcu

SEQ ID NO: 524873 - RNA, 23 nt, Chlamydophila pneumoniae J138
gcucucuucuucucaggauccca

SEQ ID NO: 524874 - RNA, 14 nt, Chlamydophila pneumoniae J138
gcucuccauggcuu

SEQ ID NO: 524875 - RNA, 21 nt, Chlamydophila pneumoniae J138
gcucuccuagacgaucuucag

SEQ ID NO: 524876 - RNA, 16 nt, Chlamydophila pneumoniae J138
gcucuccugcaaaaag

SEQ ID NO: 524877 - RNA, 18 nt, Chlamydophila pneumoniae J138
gcucuccugcaaaaaguu

SEQ ID NO: 524878 - RNA, 12 nt, Chlamydophila pneumoniae J138
gcucuccuucag

SEQ ID NO: 524879 - RNA, 16 nt, Chlamydophila pneumoniae J138
gcaucgccuuaagcuc

SEQ ID NO: 524880 - RNA, 14 nt, Chlamydophila pneumoniae J138
gcaucuagagucuc

SEQ ID NO: 524881 - RNA, 13 nt, Chlamydophila pneumoniae J138
gcaucuaagccag

SEQ ID NO: 524882 - RNA, 13 nt, Chlamydophila pneumoniae J138
gcaucucucuuua

SEQ ID NO: 524883 - RNA, 20 nt, Chlamydophila pneumoniae J138
gcaucuugagguauuccuac

SEQ ID NO: 524884 - RNA, 15 nt, Chlamydophila pneumoniae J138
gcaucuuauggaaga

SEQ ID NO: 524885 - RNA, 15 nt, Chlamydophila pneumoniae J138
gcaugaaucucuucu

SEQ ID NO: 524886 - RNA, 16 nt, Chlamydophila pneumoniae J138
gcaugacuauuuucau

SEQ ID NO: 524887 - RNA, 21 nt, Chlamydophila pneumoniae J138
gcaugacgcuuuuccaaagca

SEQ ID NO: 524888 - RNA, 12 nt, Chlamydophila pneumoniae J138
gcaugaggagac

SEQ ID NO: 524889 - RNA, 22 nt, Chlamydophila pneumoniae J138
gcaugccauaaucuauaggauu

SEQ ID NO: 524890 - RNA, 23 nt, Chlamydophila pneumoniae J138
gcaugccuacaggcaaggagagc

SEQ ID NO: 524891 - RNA, 21 nt, Chlamydophila pneumoniae J138
gcauggcuuugugagcugcug

SEQ ID NO: 524892 - RNA, 23 nt, Chlamydophila pneumoniae J138
gcauggcguaaugcuccacggaa

SEQ ID NO: 524893 - RNA, 16 nt, Chlamydophila pneumoniae J138
gcauggauccuucauc

SEQ ID NO: 524894 - RNA, 16 nt, Chlamydophila pneumoniae J138
gcauggacuccaagaa

SEQ ID NO: 524895 - RNA, 14 nt, Chlamydophila pneumoniae J138
gcauuaccuuaucg

SEQ ID NO: 524896 - RNA, 22 nt, Chlamydophila pneumoniae J138
gcauuacgguuucugggaugca

SEQ ID NO: 524897 - RNA, 19 nt, Chlamydophila pneumoniae J138
gcauuaagauaaacagcac

SEQ ID NO: 524898 - RNA, 22 nt, Chlamydophila pneumoniae J138
gcauguauuguguucccucuuc

SEQ ID NO: 524899 - RNA, 23 nt, Chlamydophila pneumoniae J138
gcauuuaaaacggcuguacuucc

SEQ ID NO: 524900 - RNA, 13 nt, Chlamydophila pneumoniae J138
gcauuuaaaacgg

SEQ ID NO: 524901 - RNA, 22 nt, Chlamydophila pneumoniae J138
gcauugcuugcgcagcuucugg

SEQ ID NO: 524902 - RNA, 18 nt, Chlamydophila pneumoniae J138
gcauuggaaaucuuauaa

SEQ ID NO: 524903 - RNA, 18 nt, Chlamydophila pneumoniae J138
gcauugccauaauaaagg

SEQ ID NO: 524904 - RNA, 22 nt, Chlamydophila pneumoniae J138
gcauuccgagcugcaaacacaa

SEQ ID NO: 524905 - RNA, 22 nt, Chlamydophila pneumoniae J138
gcauuccaggacguaaaaagaa

SEQ ID NO: 524906 - RNA, 22 nt, Chlamydophila pneumoniae J138
gcauucuguaauuuugagaagu

SEQ ID NO: 524907 - RNA, 16 nt, Chlamydophila pneumoniae J138
gcauucuguaauuuug

SEQ ID NO: 524908 - RNA, 15 nt, Chlamydophila pneumoniae J138
gccaagagagcuugu

SEQ ID NO: 524909 - RNA, 15 nt, Chlamydophila pneumoniae J138
gccaagaagauguag

SEQ ID NO: 524910 - RNA, 13 nt, Chlamydophila pneumoniae J138
gccaagaaauaua

SEQ ID NO: 524911 - RNA, 12 nt, Chlamydophila pneumoniae J138
gccaacucucua

SEQ ID NO: 524912 - RNA, 16 nt, Chlamydophila pneumoniae J138
gccaaacgaauuucuu

SEQ ID NO: 524913 - RNA, 22 nt, Chlamydophila pneumoniae J138
gccaaaaguuuugaggauuucu

SEQ ID NO: 524914 - RNA, 17 nt, Chlamydophila pneumoniae J138
gccaaaaggcacagcaa

SEQ ID NO: 524915 - RNA, 15 nt, Chlamydophila pneumoniae J138
gccaaauaucucugg

SEQ ID NO: 524916 - RNA, 16 nt, Chlamydophila pneumoniae J138
gccaaagaacagcacu

SEQ ID NO: 524917 - RNA, 21 nt, Chlamydophila pneumoniae J138
gcauuuccuaguguuagauga

SEQ ID NO: 524918 - RNA, 21 nt, Chlamydophila pneumoniae J138
gcauuugccccuuccaauacu

SEQ ID NO: 524919 - RNA, 19 nt, Chlamydophila pneumoniae J138
gcauuuuacgaaucuuuuu

SEQ ID NO: 524920 - RNA, 19 nt, Chlamydophila pneumoniae J138
gcauuuucucugagcagcu

SEQ ID NO: 524921 - RNA, 12 nt, Chlamydophila pneumoniae J138
gccaaggucuuc

SEQ ID NO: 524922 - RNA, 19 nt, Chlamydophila pneumoniae J138
gccaagggcuuggcuccug

SEQ ID NO: 524923 - RNA, 21 nt, Chlamydophila pneumoniae J138
gccaauuuucaggcccaccag

SEQ ID NO: 524924 - RNA, 17 nt, Chlamydophila pneumoniae J138
gccaaucuuccuuaacc

SEQ ID NO: 524925 - RNA, 18 nt, Chlamydophila pneumoniae J138
gccacccuuggcagagcc

SEQ ID NO: 524926 - RNA, 23 nt, Chlamydophila pneumoniae J138
gccagcagcgaggaguuuuccaa

SEQ ID NO: 524927 - RNA, 17 nt, Chlamydophila pneumoniae J138
gccagagauucuucaca

SEQ ID NO: 524928 - RNA, 20 nt, Chlamydophila pneumoniae J138
gccauuccauggauauggaa

SEQ ID NO: 524929 - RNA, 11 nt, Chlamydophila pneumoniae J138
gccauuagaau

SEQ ID NO: 524930 - RNA, 20 nt, Chlamydophila pneumoniae J138
gccauuugguaguuuuucag

SEQ ID NO: 524931 - RNA, 16 nt, Chlamydophila pneumoniae J138
gccccuccgauugcua

SEQ ID NO: 524932 - RNA, 17 nt, Chlamydophila pneumoniae J138
gcccgaaauucauuaaa

SEQ ID NO: 524933 - RNA, 19 nt, Chlamydophila pneumoniae J138
gcccuagauagcaaaucaa

SEQ ID NO: 524934 - RNA, 15 nt, Chlamydophila pneumoniae J138
gcccuagauagcaaa

SEQ ID NO: 524935 - RNA, 15 nt, Chlamydophila pneumoniae J138
gcccuacgaauccaa

SEQ ID NO: 524936 - RNA, 14 nt, Chlamydophila pneumoniae J138
gcccuucaggacau

SEQ ID NO: 524937 - RNA, 22 nt, Chlamydophila pneumoniae J138
gcccuuucugcaaucugaaugc

SEQ ID NO: 524938 - RNA, 16 nt, Chlamydophila pneumoniae J138
gccgaaccaaaaugag

SEQ ID NO: 524939 - RNA, 15 nt, Chlamydophila pneumoniae J138
gccgaccaucauaau

SEQ ID NO: 524940 - RNA, 19 nt, Chlamydophila pneumoniae J138
gccgacucuacaucuucuu

SEQ ID NO: 524941 - RNA, 17 nt, Chlamydophila pneumoniae J138
gccggcgguggaaaagg

SEQ ID NO: 524942 - RNA, 16 nt, Chlamydophila pneumoniae J138
gccgugcucuuauguu

SEQ ID NO: 524943 - RNA, 19 nt, Chlamydophila pneumoniae J138
gaauuucggacgauauuua

SEQ ID NO: 524944 - RNA, 17 nt, Chlamydophila pneumoniae J138
gaauuugccugaaaucc

SEQ ID NO: 524945 - RNA, 18 nt, Chlamydophila pneumoniae J138
gaauuuguccuuugcuaa

SEQ ID NO: 524946 - RNA, 20 nt, Chlamydophila pneumoniae J138
gagucacuggcaucagugga

SEQ ID NO: 524947 - RNA, 16 nt, Chlamydophila pneumoniae J138
gaguauggcaaauaaa

SEQ ID NO: 524948 - RNA, 14 nt, Chlamydophila pneumoniae J138
gaguaugaggagau

SEQ ID NO: 524949 - RNA, 19 nt, Chlamydophila pneumoniae J138
gaguaugaggagauaaaga

SEQ ID NO: 524950 - RNA, 15 nt, Chlamydophila pneumoniae J138
gaguaucuagcuuug

SEQ ID NO: 524951 - RNA, 20 nt, Chlamydophila pneumoniae J138
gaguaucuagcuuugucucu

SEQ ID NO: 524952 - RNA, 15 nt, Chlamydophila pneumoniae J138
gagugccuucuucaa

SEQ ID NO: 524953 - RNA, 14 nt, Chlamydophila pneumoniae J138
gagucucuugauuc

SEQ ID NO: 524954 - RNA, 19 nt, Chlamydophila pneumoniae J138
gagucucuuucagcucaag

SEQ ID NO: 524955 - RNA, 18 nt, Chlamydophila pneumoniae J138
gagucagguaaagagcuu

SEQ ID NO: 524956 - RNA, 18 nt, Chlamydophila pneumoniae J138
gaguccaagguucuggga

SEQ ID NO: 524957 - RNA, 16 nt, Chlamydophila pneumoniae J138
gagucgugcaggagaa

SEQ ID NO: 524958 - RNA, 16 nt, Chlamydophila pneumoniae J138
gaguucuuccuucuuc

SEQ ID NO: 524959 - RNA, 14 nt, Chlamydophila pneumoniae J138
gaguucuugauucu

SEQ ID NO: 524960 - RNA, 20 nt, Chlamydophila pneumoniae J138
gaguucgcgaccugugauuu

SEQ ID NO: 524961 - RNA, 19 nt, Chlamydophila pneumoniae J138
gaguucgcggaucuucuuc

SEQ ID NO: 524962 - RNA, 23 nt, Chlamydophila pneumoniae J138
gaguucgcacuaauuuccuucag

SEQ ID NO: 524963 - RNA, 21 nt, Chlamydophila pneumoniae J138
gaguucgcacuaauuuccuuc

SEQ ID NO: 524964 - RNA, 15 nt, Chlamydophila pneumoniae J138
gaguucuuccuucuu

SEQ ID NO: 524965 - RNA, 17 nt, Chlamydophila pneumoniae J138
gaguucuuguaauaaaa

SEQ ID NO: 524966 - RNA, 12 nt, Chlamydophila pneumoniae J138
gaguguuuucug

SEQ ID NO: 524967 - RNA, 13 nt, Chlamydophila pneumoniae J138
gaguuagcuuuug

SEQ ID NO: 524968 - RNA, 19 nt, Chlamydophila pneumoniae J138
gauaaaggcauaacugugc

SEQ ID NO: 524969 - RNA, 16 nt, Chlamydophila pneumoniae J138
gauaaaagguauuucu

SEQ ID NO: 524970 - RNA, 16 nt, Chlamydophila pneumoniae J138
gauaaagccugcacga

SEQ ID NO: 524971 - RNA, 19 nt, Chlamydophila pneumoniae J138
gauaaaagguauuucucuc

SEQ ID NO: 524972 - RNA, 13 nt, Chlamydophila pneumoniae J138
gauaaaacuauaa

SEQ ID NO: 524973 - RNA, 19 nt, Chlamydophila pneumoniae J138
gauaaaacgcuauuguuug

SEQ ID NO: 524974 - RNA, 19 nt, Chlamydophila pneumoniae J138
gauaaucuguaagaaaaug

SEQ ID NO: 524975 - RNA, 19 nt, Chlamydophila pneumoniae J138
gauaaucagaggagccucc

SEQ ID NO: 524976 - RNA, 12 nt, Chlamydophila pneumoniae J138
gauaaucagagg

SEQ ID NO: 524977 - RNA, 12 nt, Chlamydophila pneumoniae J138
gauaauagagaa

SEQ ID NO: 524978 - RNA, 17 nt, Chlamydophila pneumoniae J138
gauacccaaagagggga

SEQ ID NO: 524979 - RNA, 16 nt, Chlamydophila pneumoniae J138
gauacccaucuagaaa

SEQ ID NO: 524980 - RNA, 20 nt, Chlamydophila pneumoniae J138
gauaccaagaugaagaaacu

SEQ ID NO: 524981 - RNA, 16 nt, Chlamydophila pneumoniae J138
gauaccaccuaaaaug

SEQ ID NO: 524982 - RNA, 19 nt, Chlamydophila pneumoniae J138
gauacauccucacuagaga

SEQ ID NO: 524983 - RNA, 13 nt, Chlamydophila pneumoniae J138
gauacuucuucca

SEQ ID NO: 524984 - RNA, 20 nt, Chlamydophila pneumoniae J138
gauacuguuuuuuaucuccu

SEQ ID NO: 524985 - RNA, 15 nt, Chlamydophila pneumoniae J138
gauacuuaucuuuaa

SEQ ID NO: 524986 - RNA, 13 nt, Chlamydophila pneumoniae J138
gauagcaaaucaa

SEQ ID NO: 524987 - RNA, 13 nt, Chlamydophila pneumoniae J138
gauagagauucuu

SEQ ID NO: 524988 - RNA, 18 nt, Chlamydophila pneumoniae J138
gauacucugaacaggaau

SEQ ID NO: 524989 - RNA, 20 nt, Chlamydophila pneumoniae J138
gauaucucuaccgaacagag

SEQ ID NO: 524990 - RNA, 17 nt, Chlamydophila pneumoniae J138
gauaucuauaaauguag

SEQ ID NO: 524991 - RNA, 17 nt, Chlamydophila pneumoniae J138
gauaucugcucccuccu

SEQ ID NO: 524992 - RNA, 19 nt, Chlamydophila pneumoniae J138
gauaucccacagaaauguc

SEQ ID NO: 524993 - RNA, 17 nt, Chlamydophila pneumoniae J138
gauagcaaugauguuuu

SEQ ID NO: 524994 - RNA, 22 nt, Chlamydophila pneumoniae J138
gauauguccgugagcaacaagc

SEQ ID NO: 524995 - RNA, 14 nt, Chlamydophila pneumoniae J138
gauauugcggaaau

SEQ ID NO: 524996 - RNA, 16 nt, Chlamydophila pneumoniae J138
gauauugcggaaauug

SEQ ID NO: 524997 - RNA, 13 nt, Chlamydophila pneumoniae J138
gauauugucaaga

SEQ ID NO: 524998 - RNA, 15 nt, Chlamydophila pneumoniae J138
gauaugaagagacgu

SEQ ID NO: 524999 - RNA, 15 nt, Chlamydophila pneumoniae J138
gauaugcugaauucc

SEQ ID NO: 525000 - RNA, 21 nt, Chlamydophila pneumoniae J138
gaucauuaaaguccaagauca

SEQ ID NO: 525001 - RNA, 15 nt, Chlamydophila pneumoniae J138
gauauuguucuucca

SEQ ID NO: 525002 - RNA, 17 nt, Chlamydophila pneumoniae J138
gaucaaauuccuucuca

SEQ ID NO: 525003 - RNA, 21 nt, Chlamydophila pneumoniae J138
gauccuucaucagcuucccaa

SEQ ID NO: 525004 - RNA, 14 nt, Chlamydophila pneumoniae J138
gauccuagaauagg

SEQ ID NO: 525005 - RNA, 15 nt, Chlamydophila pneumoniae J138
gauccuagaauagga

SEQ ID NO: 525006 - RNA, 15 nt, Chlamydophila pneumoniae J138
gauccgaaaagaacc

SEQ ID NO: 525007 - RNA, 18 nt, Chlamydophila pneumoniae J138
gaucccuaacgaugcagg

SEQ ID NO: 525008 - RNA, 18 nt, Chlamydophila pneumoniae J138
gaucccgggaguuuucag

SEQ ID NO: 525009 - RNA, 20 nt, Chlamydophila pneumoniae J138
gauccagcccccaggcugca

SEQ ID NO: 525010 - RNA, 21 nt, Chlamydophila pneumoniae J138
gauccacagacugcaggaaau

SEQ ID NO: 525011 - RNA, 21 nt, Chlamydophila pneumoniae J138
gaucggaguuaucaaaaggau

SEQ ID NO: 525012 - RNA, 14 nt, Chlamydophila pneumoniae J138
gaugccaagaaaua

SEQ ID NO: 525013 - RNA, 15 nt, Chlamydophila pneumoniae J138
gaugccaagaaauau

SEQ ID NO: 525014 - RNA, 19 nt, Chlamydophila pneumoniae J138
gaugcaucucuuaaaacau

SEQ ID NO: 525015 - RNA, 18 nt, Chlamydophila pneumoniae J138
gaugcaucucuuaaaaca

SEQ ID NO: 525016 - RNA, 14 nt, Chlamydophila pneumoniae J138
gaugcaggccagga

SEQ ID NO: 525017 - RNA, 16 nt, Chlamydophila pneumoniae J138
gaugcaggccaggaga

SEQ ID NO: 525018 - RNA, 17 nt, Chlamydophila pneumoniae J138
gaucgucaguaaaacac

SEQ ID NO: 525019 - RNA, 15 nt, Chlamydophila pneumoniae J138
gaugacuuucagagc

SEQ ID NO: 525020 - RNA, 17 nt, Chlamydophila pneumoniae J138
gaugacagggaaagaac

SEQ ID NO: 525021 - RNA, 17 nt, Chlamydophila pneumoniae J138
gaugcuaaagagucuuc

SEQ ID NO: 525022 - RNA, 19 nt, Chlamydophila pneumoniae J138
gaugcuuagcaaaggcaac

SEQ ID NO: 525023 - RNA, 14 nt, Chlamydophila pneumoniae J138
gauggcaaggaaaa

SEQ ID NO: 525024 - RNA, 21 nt, Chlamydophila pneumoniae J138
gauggaguuucuuauucacug

SEQ ID NO: 525025 - RNA, 17 nt, Chlamydophila pneumoniae J138
gauggucauaccaaccu

SEQ ID NO: 525026 - RNA, 15 nt, Chlamydophila pneumoniae J138
gauggucaggaagaa

SEQ ID NO: 525027 - RNA, 13 nt, Chlamydophila pneumoniae J138
gaugguugcuucu

SEQ ID NO: 525028 - RNA, 21 nt, Chlamydophila pneumoniae J138
gaugguugcuucuaagaaacu

SEQ ID NO: 525029 - RNA, 12 nt, Chlamydophila pneumoniae J138
gauguagagucg

SEQ ID NO: 525030 - RNA, 15 nt, Chlamydophila pneumoniae J138
gauguaggugauauu

SEQ ID NO: 525031 - RNA, 19 nt, Chlamydophila pneumoniae J138
gauguacaagcuucaucaa

SEQ ID NO: 525032 - RNA, 23 nt, Chlamydophila pneumoniae J138
gauguaacuaguaacuuaaucaa

SEQ ID NO: 525033 - RNA, 23 nt, Chlamydophila pneumoniae J138
gauuaugaauccuugaaagacuc

SEQ ID NO: 525034 - RNA, 15 nt, Chlamydophila pneumoniae J138
gauuaugaugccuca

SEQ ID NO: 525035 - RNA, 16 nt, Chlamydophila pneumoniae J138
gauguuuaauacaaaa

SEQ ID NO: 525036 - RNA, 16 nt, Chlamydophila pneumoniae J138
gauuaaagagacugug

SEQ ID NO: 525037 - RNA, 20 nt, Chlamydophila pneumoniae J138
gauuggaugauagcuaugag

SEQ ID NO: 525038 - RNA, 15 nt, Chlamydophila pneumoniae J138
gauugugcucaauac

SEQ ID NO: 525039 - RNA, 17 nt, Chlamydophila pneumoniae J138
gauuguuauugaguguu

SEQ ID NO: 525040 - RNA, 22 nt, Chlamydophila pneumoniae J138
gauuuaaaagguuuugaagcuc

SEQ ID NO: 525041 - RNA, 15 nt, Chlamydophila pneumoniae J138
gauuuauguuuucuc

SEQ ID NO: 525042 - RNA, 21 nt, Chlamydophila pneumoniae J138
gauugaggauaaguucuucca

SEQ ID NO: 525043 - RNA, 18 nt, Chlamydophila pneumoniae J138
gauugaggauaaguucuu

SEQ ID NO: 525044 - RNA, 14 nt, Chlamydophila pneumoniae J138
gauuggaugagaau

SEQ ID NO: 525045 - RNA, 15 nt, Chlamydophila pneumoniae J138
gauuggaugagaauu

SEQ ID NO: 525046 - RNA, 17 nt, Chlamydophila pneumoniae J138
gauucuuaucacaaauu

SEQ ID NO: 525047 - RNA, 15 nt, Chlamydophila pneumoniae J138
gauucuuuaaucuau

SEQ ID NO: 525048 - RNA, 13 nt, Chlamydophila pneumoniae J138
gauucugcccaaa

SEQ ID NO: 525049 - RNA, 20 nt, Chlamydophila pneumoniae J138
gauucucucugccuaccaaa

SEQ ID NO: 525050 - RNA, 21 nt, Chlamydophila pneumoniae J138
gauucucucugccuaccaaag

SEQ ID NO: 525051 - RNA, 17 nt, Chlamydophila pneumoniae J138
gauucuccgucccccgg

SEQ ID NO: 525052 - RNA, 14 nt, Chlamydophila pneumoniae J138
gauuauucuagagu

SEQ ID NO: 525053 - RNA, 17 nt, Chlamydophila pneumoniae J138
gcaaaaaugaaagaaac

SEQ ID NO: 525054 - RNA, 17 nt, Chlamydophila pneumoniae J138
gcaaaaaguuucaaucu

SEQ ID NO: 525055 - RNA, 11 nt, Chlamydophila pneumoniae J138
gauuuugugag

SEQ ID NO: 525056 - RNA, 20 nt, Chlamydophila pneumoniae J138
gauuuuuagaauagaagauc

SEQ ID NO: 525057 - RNA, 20 nt, Chlamydophila pneumoniae J138
gauuucuuuuucagcuucua

SEQ ID NO: 525058 - RNA, 14 nt, Chlamydophila pneumoniae J138
gauuucuuuuucag

SEQ ID NO: 525059 - RNA, 20 nt, Chlamydophila pneumoniae J138
gauuuuacucccugaaguug

SEQ ID NO: 525060 - RNA, 15 nt, Chlamydophila pneumoniae J138
gauuucuucuucaga

SEQ ID NO: 525061 - RNA, 16 nt, Chlamydophila pneumoniae J138
gauuucuucuucagag

SEQ ID NO: 525062 - RNA, 21 nt, Chlamydophila pneumoniae J138
gcaaacgcaaugauuucucua

SEQ ID NO: 525063 - RNA, 17 nt, Chlamydophila pneumoniae J138
gcaaacggagagcauuu

SEQ ID NO: 525064 - RNA, 19 nt, Chlamydophila pneumoniae J138
gcaaagacauccaagccuc

SEQ ID NO: 525065 - RNA, 14 nt, Chlamydophila pneumoniae J138
gcaaagaucaguuu

SEQ ID NO: 525066 - RNA, 14 nt, Chlamydophila pneumoniae J138
gcaaagauaaagaa

SEQ ID NO: 525067 - RNA, 14 nt, Chlamydophila pneumoniae J138
gcaaacagguauuu

SEQ ID NO: 525068 - RNA, 21 nt, Chlamydophila pneumoniae J138
gcaaaaugcgaggaaaaagga

SEQ ID NO: 525069 - RNA, 15 nt, Chlamydophila pneumoniae J138
gcaaaggaaaagaua

SEQ ID NO: 525070 - RNA, 22 nt, Chlamydophila pneumoniae J138
gcaaaggaccacaauuccuaaa

SEQ ID NO: 525071 - RNA, 18 nt, Chlamydophila pneumoniae J138
gcaaagcccccuccccca

SEQ ID NO: 525072 - RNA, 16 nt, Chlamydophila pneumoniae J138
gcaaaguaucaacguu

SEQ ID NO: 525073 - RNA, 17 nt, Chlamydophila pneumoniae J138
gcaaauaaaguccucca

SEQ ID NO: 525074 - RNA, 21 nt, Chlamydophila pneumoniae J138
gcaaaucuuacauaaaccuuu

SEQ ID NO: 525075 - RNA, 15 nt, Chlamydophila pneumoniae J138
gcaaaucuaaaaccu

SEQ ID NO: 525076 - RNA, 19 nt, Chlamydophila pneumoniae J138
gcaaauccuguagaaacau

SEQ ID NO: 525077 - RNA, 23 nt, Chlamydophila pneumoniae J138
gcaaauccugcucguaaaucugg

SEQ ID NO: 525078 - RNA, 11 nt, Chlamydophila pneumoniae J138
gcaaauauagu

SEQ ID NO: 525079 - RNA, 13 nt, Chlamydophila pneumoniae J138
gcagcagccuugg

SEQ ID NO: 525080 - RNA, 20 nt, Chlamydophila pneumoniae J138
gcacuuaucucuuucuugaa

SEQ ID NO: 525081 - RNA, 16 nt, Chlamydophila pneumoniae J138
gcagcaaauacuccag

SEQ ID NO: 525082 - RNA, 23 nt, Chlamydophila pneumoniae J138
gcagcaaauccuuuauguauaac

SEQ ID NO: 525083 - RNA, 14 nt, Chlamydophila pneumoniae J138
gcaggccaggagac

SEQ ID NO: 525084 - RNA, 15 nt, Chlamydophila pneumoniae J138
gcaggccaggagacu

SEQ ID NO: 525085 - RNA, 14 nt, Chlamydophila pneumoniae J138
gcaggccaacucuc

SEQ ID NO: 525086 - RNA, 22 nt, Chlamydophila pneumoniae J138
gcagguuugggugcuaaguugu

SEQ ID NO: 525087 - RNA, 14 nt, Chlamydophila pneumoniae J138
gcagggaaaaugcg

SEQ ID NO: 525088 - RNA, 14 nt, Chlamydophila pneumoniae J138
gcauaauuuuucuu

SEQ ID NO: 525089 - RNA, 16 nt, Chlamydophila pneumoniae J138
gcauaaucuuuaacaa

SEQ ID NO: 525090 - RNA, 21 nt, Chlamydophila pneumoniae J138
gcauaauccugaauggcucug

SEQ ID NO: 525091 - RNA, 17 nt, Chlamydophila pneumoniae J138
gcauaaucucaccagaa

SEQ ID NO: 525092 - RNA, 17 nt, Chlamydophila pneumoniae J138
gcauacucuauuaagga

SEQ ID NO: 525093 - RNA, 21 nt, Chlamydophila pneumoniae J138
gcauacucuauuaaggauucc

SEQ ID NO: 525094 - RNA, 19 nt, Chlamydophila pneumoniae J138
gcauaguauuaaucuuauu

SEQ ID NO: 525095 - RNA, 21 nt, Chlamydophila pneumoniae J138
gcauaguauggcauucuuuuu

SEQ ID NO: 525096 - RNA, 20 nt, Chlamydophila pneumoniae J138
gcauaguguuccaaaacagg

SEQ ID NO: 525097 - RNA, 15 nt, Chlamydophila pneumoniae J138
gcauaguguuccaaa

SEQ ID NO: 525098 - RNA, 22 nt, Chlamydophila pneumoniae J138
gcauaguggcucaguguauugu

SEQ ID NO: 525099 - RNA, 22 nt, Chlamydophila pneumoniae J138
gcauagagagaaggaauuaaaa

SEQ ID NO: 525100 - RNA, 21 nt, Chlamydophila pneumoniae J138
gcauaaggauucugagaaguu

SEQ ID NO: 525101 - RNA, 18 nt, Chlamydophila pneumoniae J138
gcauaaacaaagcgucua

SEQ ID NO: 525102 - RNA, 15 nt, Chlamydophila pneumoniae J138
gcauaaguuagccug

SEQ ID NO: 525103 - RNA, 13 nt, Chlamydophila pneumoniae J138
gcauaauccugaa

SEQ ID NO: 525104 - RNA, 15 nt, Chlamydophila pneumoniae J138
gcauaauccugaaug

SEQ ID NO: 525105 - RNA, 22 nt, Chlamydophila pneumoniae J138
gcauauucuaagcuuauuucug

SEQ ID NO: 525106 - RNA, 18 nt, Chlamydophila pneumoniae J138
gcauauugccuucuucuu

SEQ ID NO: 525107 - RNA, 16 nt, Chlamydophila pneumoniae J138
gcaucacgaaaaggag

SEQ ID NO: 525108 - RNA, 14 nt, Chlamydophila pneumoniae J138
gcaucccuucuucu

SEQ ID NO: 525109 - RNA, 19 nt, Chlamydophila pneumoniae J138
gcaucccuucuucuuuuag

SEQ ID NO: 525110 - RNA, 21 nt, Chlamydophila pneumoniae J138
gcaucccccgcgccacaucaa

SEQ ID NO: 525111 - RNA, 13 nt, Chlamydophila pneumoniae J138
gcaucauugaaac

SEQ ID NO: 525112 - RNA, 22 nt, Chlamydophila pneumoniae J138
gcauccuguagagcaagauucu

SEQ ID NO: 525113 - RNA, 15 nt, Chlamydophila pneumoniae J138
gcacgagagccucgg

SEQ ID NO: 525114 - RNA, 18 nt, Chlamydophila pneumoniae J138
gcaccuuuaggaagcugu

SEQ ID NO: 525115 - RNA, 19 nt, Chlamydophila pneumoniae J138
gcacggauucuaaaagagc

SEQ ID NO: 525116 - RNA, 22 nt, Chlamydophila pneumoniae J138
gcacugacuuuaugaucucccg

SEQ ID NO: 525117 - RNA, 22 nt, Chlamydophila pneumoniae J138
gcacuggcauggaaugccaaau

SEQ ID NO: 525118 - RNA, 14 nt, Chlamydophila pneumoniae J138
gcacgucugcaccu

SEQ ID NO: 525119 - RNA, 15 nt, Chlamydophila pneumoniae J138
gcacuaaaagggaag

SEQ ID NO: 525120 - RNA, 18 nt, Chlamydophila pneumoniae J138
gcaauuucuccuaggucu

SEQ ID NO: 525121 - RNA, 21 nt, Chlamydophila pneumoniae J138
gcacaagaaccuguuuuucua

SEQ ID NO: 525122 - RNA, 16 nt, Chlamydophila pneumoniae J138
gcaauuguuaaaagaa

SEQ ID NO: 525123 - RNA, 18 nt, Chlamydophila pneumoniae J138
gcaauuguuaaaagaagg

SEQ ID NO: 525124 - RNA, 20 nt, Chlamydophila pneumoniae J138
gcacacugcuuacaauugaa

SEQ ID NO: 525125 - RNA, 23 nt, Chlamydophila pneumoniae J138
gcaccaacacuuuuaaagauaag

SEQ ID NO: 525126 - RNA, 17 nt, Chlamydophila pneumoniae J138
gcaagccgcaaaccauc

SEQ ID NO: 525127 - RNA, 21 nt, Chlamydophila pneumoniae J138
gcaagguaacauccauagaga

SEQ ID NO: 525128 - RNA, 17 nt, Chlamydophila pneumoniae J138
gcaagcgcuagugcaag

SEQ ID NO: 525129 - RNA, 18 nt, Chlamydophila pneumoniae J138
gcaaauuucauuuagaca

SEQ ID NO: 525130 - RNA, 21 nt, Chlamydophila pneumoniae J138
gcaauaggacucgaugaaacu

SEQ ID NO: 525131 - RNA, 19 nt, Chlamydophila pneumoniae J138
gcaauagacacuugcuuaa

SEQ ID NO: 525132 - RNA, 17 nt, Chlamydophila pneumoniae J138
gcaagucgguaauaccu

SEQ ID NO: 525133 - RNA, 14 nt, Chlamydophila pneumoniae J138
gcaagucauaaaga

SEQ ID NO: 525134 - RNA, 13 nt, Chlamydophila pneumoniae J138
gcaaguaaagaaa

SEQ ID NO: 525135 - RNA, 19 nt, Chlamydophila pneumoniae J138
gcaaucguuucuauagacu

SEQ ID NO: 525136 - RNA, 18 nt, Chlamydophila pneumoniae J138
gcaaucuuugaagcucga

SEQ ID NO: 525137 - RNA, 22 nt, Chlamydophila pneumoniae J138
cuuuuaaagagcgcguuucaaa

SEQ ID NO: 525138 - RNA, 14 nt, Chlamydophila pneumoniae J138
cuuuuaagacaaua

SEQ ID NO: 525139 - RNA, 16 nt, Chlamydophila pneumoniae J138
cuuuuaauguguucuu

SEQ ID NO: 525140 - RNA, 18 nt, Chlamydophila pneumoniae J138
cuuuuaaaaacucuuuca

SEQ ID NO: 525141 - RNA, 16 nt, Chlamydophila pneumoniae J138
cuuugugaguucuucc

SEQ ID NO: 525142 - RNA, 16 nt, Chlamydophila pneumoniae J138
cuuugugauuacagca

SEQ ID NO: 525143 - RNA, 11 nt, Chlamydophila pneumoniae J138
cuuucuucucu

SEQ ID NO: 525144 - RNA, 13 nt, Chlamydophila pneumoniae J138
cuuucuuggauug

SEQ ID NO: 525145 - RNA, 18 nt, Chlamydophila pneumoniae J138
cuuucuuuuagcuacuuc

SEQ ID NO: 525146 - RNA, 21 nt, Chlamydophila pneumoniae J138
cuuuuccggggagaacuucaa

SEQ ID NO: 525147 - RNA, 20 nt, Chlamydophila pneumoniae J138
cuuuuccggggagaacuuca

SEQ ID NO: 525148 - RNA, 18 nt, Chlamydophila pneumoniae J138
cuuuuccguuucagaagu

SEQ ID NO: 525149 - RNA, 17 nt, Chlamydophila pneumoniae J138
cuuuucauuuuuaggau

SEQ ID NO: 525150 - RNA, 13 nt, Chlamydophila pneumoniae J138
cuuuucauuuuua

SEQ ID NO: 525151 - RNA, 15 nt, Chlamydophila pneumoniae J138
cuuuucagauuuuuu

SEQ ID NO: 525152 - RNA, 12 nt, Chlamydophila pneumoniae J138
cuuuucaaaaga

SEQ ID NO: 525153 - RNA, 17 nt, Chlamydophila pneumoniae J138
cuuuuagagccuuuuca

SEQ ID NO: 525154 - RNA, 23 nt, Chlamydophila pneumoniae J138
cuuuuagagccuuuucagauuuu

SEQ ID NO: 525155 - RNA, 15 nt, Chlamydophila pneumoniae J138
cuuuuauuaagggaa

SEQ ID NO: 525156 - RNA, 13 nt, Chlamydophila pneumoniae J138
cuuuuaugaugua

SEQ ID NO: 525157 - RNA, 16 nt, Chlamydophila pneumoniae J138
cuuuuaucuguuaaaa

SEQ ID NO: 525158 - RNA, 22 nt, Chlamydophila pneumoniae J138
cuuuuagacgugcucucuucuu

SEQ ID NO: 525159 - RNA, 16 nt, Chlamydophila pneumoniae J138
cuuuuauauuaagaau

SEQ ID NO: 525160 - RNA, 19 nt, Chlamydophila pneumoniae J138
cuuuucuacaugcucaaga

SEQ ID NO: 525161 - RNA, 15 nt, Chlamydophila pneumoniae J138
cuuuucuacaugcuc

SEQ ID NO: 525162 - RNA, 16 nt, Chlamydophila pneumoniae J138
cuuuucuacaugcuca

SEQ ID NO: 525163 - RNA, 23 nt, Chlamydophila pneumoniae J138
cuuuucuagaaacugcuccugaa

SEQ ID NO: 525164 - RNA, 19 nt, Chlamydophila pneumoniae J138
cuuuuccuucuguagauuu

SEQ ID NO: 525165 - RNA, 15 nt, Chlamydophila pneumoniae J138
cuuuucgcagauacu

SEQ ID NO: 525166 - RNA, 18 nt, Chlamydophila pneumoniae J138
cuuuucugaagauuuuuu

SEQ ID NO: 525167 - RNA, 21 nt, Chlamydophila pneumoniae J138
cuuuucugaaucuuuuguuuu

SEQ ID NO: 525168 - RNA, 15 nt, Chlamydophila pneumoniae J138
cuuuucugcuccuga

SEQ ID NO: 525169 - RNA, 14 nt, Chlamydophila pneumoniae J138
cuuuuguagauuag

SEQ ID NO: 525170 - RNA, 13 nt, Chlamydophila pneumoniae J138
cuuuuguauuaaa

SEQ ID NO: 525171 - RNA, 17 nt, Chlamydophila pneumoniae J138
cuuuuguuugucuucca

SEQ ID NO: 525172 - RNA, 18 nt, Chlamydophila pneumoniae J138
cuuuuguuguuuuugcug

SEQ ID NO: 525173 - RNA, 17 nt, Chlamydophila pneumoniae J138
cuuuugugaagauaaga

SEQ ID NO: 525174 - RNA, 14 nt, Chlamydophila pneumoniae J138
cuuuugcugcagca

SEQ ID NO: 525175 - RNA, 13 nt, Chlamydophila pneumoniae J138
cuuuugcuacagc

SEQ ID NO: 525176 - RNA, 23 nt, Chlamydophila pneumoniae J138
cuuuugcuacagcuucuuuucca

SEQ ID NO: 525177 - RNA, 18 nt, Chlamydophila pneumoniae J138
cuuuuuauugauaaugau

SEQ ID NO: 525178 - RNA, 16 nt, Chlamydophila pneumoniae J138
cuuuuucaauagcagu

SEQ ID NO: 525179 - RNA, 20 nt, Chlamydophila pneumoniae J138
cuuuuuaggaaaggauaucu

SEQ ID NO: 525180 - RNA, 18 nt, Chlamydophila pneumoniae J138
cuuuuguuuuagcucuuu

SEQ ID NO: 525181 - RNA, 14 nt, Chlamydophila pneumoniae J138
cuuuuucagcuucu

SEQ ID NO: 525182 - RNA, 19 nt, Chlamydophila pneumoniae J138
cuuuuucagcuucuacagc

SEQ ID NO: 525183 - RNA, 19 nt, Chlamydophila pneumoniae J138
cuuuuucuugauuagagaa

SEQ ID NO: 525184 - RNA, 20 nt, Chlamydophila pneumoniae J138
cuuuuucuugauuagagaau

SEQ ID NO: 525185 - RNA, 11 nt, Chlamydophila pneumoniae J138
cuuuuucuagg

SEQ ID NO: 525186 - RNA, 23 nt, Chlamydophila pneumoniae J138
cuuuuucuugaaaaauccugaga

SEQ ID NO: 525187 - RNA, 22 nt, Chlamydophila pneumoniae J138
cuuuuugcauagccuuccuguu

SEQ ID NO: 525188 - RNA, 14 nt, Chlamydophila pneumoniae J138
cuuuuugcagaucu

SEQ ID NO: 525189 - RNA, 12 nt, Chlamydophila pneumoniae J138
gaaaaaauagau

SEQ ID NO: 525190 - RNA, 15 nt, Chlamydophila pneumoniae J138
cuuuuuuucuagagu

SEQ ID NO: 525191 - RNA, 20 nt, Chlamydophila pneumoniae J138
cuuuuuuacuaucuccuaga

SEQ ID NO: 525192 - RNA, 23 nt, Chlamydophila pneumoniae J138
cuuuuuuauguccguauuuuuua

SEQ ID NO: 525193 - RNA, 23 nt, Chlamydophila pneumoniae J138
cuuuuuggaaguuguuuuuugag

SEQ ID NO: 525194 - RNA, 21 nt, Chlamydophila pneumoniae J138
cuuuuuggaaguuguuuuuug

SEQ ID NO: 525195 - RNA, 14 nt, Chlamydophila pneumoniae J138
gaaaacaaggcaaa

SEQ ID NO: 525196 - RNA, 17 nt, Chlamydophila pneumoniae J138
gaaaacgcccucuagaa

SEQ ID NO: 525197 - RNA, 19 nt, Chlamydophila pneumoniae J138
gaaaacaucuguauauucu

SEQ ID NO: 525198 - RNA, 14 nt, Chlamydophila pneumoniae J138
gaaaacauagagau

SEQ ID NO: 525199 - RNA, 17 nt, Chlamydophila pneumoniae J138
gaaaacaucuguauauu

SEQ ID NO: 525200 - RNA, 19 nt, Chlamydophila pneumoniae J138
gaaaaccaugaguuuuuca

SEQ ID NO: 525201 - RNA, 16 nt, Chlamydophila pneumoniae J138
gaaaaagcccauuccu

SEQ ID NO: 525202 - RNA, 16 nt, Chlamydophila pneumoniae J138
gaaaaagaaucucuga

SEQ ID NO: 525203 - RNA, 23 nt, Chlamydophila pneumoniae J138
gaaaaaucuacauguaaagcaag

SEQ ID NO: 525204 - RNA, 18 nt, Chlamydophila pneumoniae J138
gaaaaaucuacauguaaa

SEQ ID NO: 525205 - RNA, 16 nt, Chlamydophila pneumoniae J138
gaaaaaucccuguucu

SEQ ID NO: 525206 - RNA, 16 nt, Chlamydophila pneumoniae J138
gaaaagugugaggaga

SEQ ID NO: 525207 - RNA, 12 nt, Chlamydophila pneumoniae J138
gaaaauaaucuu

SEQ ID NO: 525208 - RNA, 16 nt, Chlamydophila pneumoniae J138
gaaaauaagaagcagc

SEQ ID NO: 525209 - RNA, 10 nt, Chlamydophila pneumoniae J138
gaaaacuuca

SEQ ID NO: 525210 - RNA, 13 nt, Chlamydophila pneumoniae J138
gaaaagaaagaau

SEQ ID NO: 525211 - RNA, 14 nt, Chlamydophila pneumoniae J138
gaaaagaaagaaua

SEQ ID NO: 525212 - RNA, 14 nt, Chlamydophila pneumoniae J138
gaaaagaaccuagg

SEQ ID NO: 525213 - RNA, 13 nt, Chlamydophila pneumoniae J138
gaaaagaaugugc

SEQ ID NO: 525214 - RNA, 19 nt, Chlamydophila pneumoniae J138
gaaaagauucuaaaucaac

SEQ ID NO: 525215 - RNA, 22 nt, Chlamydophila pneumoniae J138
gaaaagauuugcgaaucuaaga

SEQ ID NO: 525216 - RNA, 16 nt, Chlamydophila pneumoniae J138
gaaaaggaugcaucuc

SEQ ID NO: 525217 - RNA, 20 nt, Chlamydophila pneumoniae J138
gaaaaggauugcacucaucu

SEQ ID NO: 525218 - RNA, 21 nt, Chlamydophila pneumoniae J138
gaaaaggcccccuacagcaga

SEQ ID NO: 525219 - RNA, 22 nt, Chlamydophila pneumoniae J138
gaaaaggcccccuacagcagaa

SEQ ID NO: 525220 - RNA, 19 nt, Chlamydophila pneumoniae J138
gaaaauucaguauaagaug

SEQ ID NO: 525221 - RNA, 12 nt, Chlamydophila pneumoniae J138
gaaacaacugaa

SEQ ID NO: 525222 - RNA, 23 nt, Chlamydophila pneumoniae J138
gaaaaucaacucuccauccucag

SEQ ID NO: 525223 - RNA, 11 nt, Chlamydophila pneumoniae J138
gaaaaucacac

SEQ ID NO: 525224 - RNA, 20 nt, Chlamydophila pneumoniae J138
gaaaauccuaacaaaaggau

SEQ ID NO: 525225 - RNA, 17 nt, Chlamydophila pneumoniae J138
gaaaauccuuaggggcg

SEQ ID NO: 525226 - RNA, 24 nt, Chlamydophila pneumoniae J138
gaaaaucuacacgcuauagcaaca

SEQ ID NO: 525227 - RNA, 19 nt, Chlamydophila pneumoniae J138
gaaaaugauucauaacauu

SEQ ID NO: 525228 - RNA, 22 nt, Chlamydophila pneumoniae J138
gaaaaucuuuaagguugcuuuu

SEQ ID NO: 525229 - RNA, 17 nt, Chlamydophila pneumoniae J138
gaaacaugaaguuguug

SEQ ID NO: 525230 - RNA, 19 nt, Chlamydophila pneumoniae J138
gaaaccauauugcaaagca

SEQ ID NO: 525231 - RNA, 23 nt, Chlamydophila pneumoniae J138
gaaaccauuuaccccaggaauca

SEQ ID NO: 525232 - RNA, 16 nt, Chlamydophila pneumoniae J138
gaaaccuucucucuua

SEQ ID NO: 525233 - RNA, 17 nt, Chlamydophila pneumoniae J138
gaaaccuucucucuuaa

SEQ ID NO: 525234 - RNA, 13 nt, Chlamydophila pneumoniae J138
gaaaccuucagau

SEQ ID NO: 525235 - RNA, 16 nt, Chlamydophila pneumoniae J138
gaaaccuucagaucga

SEQ ID NO: 525236 - RNA, 20 nt, Chlamydophila pneumoniae J138
gaaaccggacugacuucuau

SEQ ID NO: 525237 - RNA, 13 nt, Chlamydophila pneumoniae J138
gaaaccuucucuc

SEQ ID NO: 525238 - RNA, 13 nt, Chlamydophila pneumoniae J138
gaaacgaaagcag

SEQ ID NO: 525239 - RNA, 13 nt, Chlamydophila pneumoniae J138
gaaagaacuacuu

SEQ ID NO: 525240 - RNA, 12 nt, Chlamydophila pneumoniae J138
gaaagaaacaaa

SEQ ID NO: 525241 - RNA, 14 nt, Chlamydophila pneumoniae J138
gaaagaaugacaca

SEQ ID NO: 525242 - RNA, 19 nt, Chlamydophila pneumoniae J138
gaaagaauaucuuuugaau

SEQ ID NO: 525243 - RNA, 16 nt, Chlamydophila pneumoniae J138
gaaagaaugccauucu

SEQ ID NO: 525244 - RNA, 23 nt, Chlamydophila pneumoniae J138
gaaagaaguccuagggagugagg

SEQ ID NO: 525245 - RNA, 18 nt, Chlamydophila pneumoniae J138
gaaagacucaucuuugaa

SEQ ID NO: 525246 - RNA, 22 nt, Chlamydophila pneumoniae J138
gaaagagucucacucuuuucua

SEQ ID NO: 525247 - RNA, 18 nt, Chlamydophila pneumoniae J138
gaaagagugccaagagca

SEQ ID NO: 525248 - RNA, 15 nt, Chlamydophila pneumoniae J138
gaaagagucccugau

SEQ ID NO: 525249 - RNA, 16 nt, Chlamydophila pneumoniae J138
gaaagagucccugauu

SEQ ID NO: 525250 - RNA, 13 nt, Chlamydophila pneumoniae J138
gaaagacucgcuc

SEQ ID NO: 525251 - RNA, 19 nt, Chlamydophila pneumoniae J138
gaaagaauuguaguucuuu

SEQ ID NO: 525252 - RNA, 16 nt, Chlamydophila pneumoniae J138
gaaacugcuccugaag

SEQ ID NO: 525253 - RNA, 21 nt, Chlamydophila pneumoniae J138
gaaacuuaguuuugaaaagau

SEQ ID NO: 525254 - RNA, 20 nt, Chlamydophila pneumoniae J138
gaaacuuuuuuucuucucua

SEQ ID NO: 525255 - RNA, 22 nt, Chlamydophila pneumoniae J138
gaaacuuuuuuucuucucuaag

SEQ ID NO: 525256 - RNA, 18 nt, Chlamydophila pneumoniae J138
gaaacuuuuuuucuucuc

SEQ ID NO: 525257 - RNA, 22 nt, Chlamydophila pneumoniae J138
gaaacuuuuccaaauuccuuca

SEQ ID NO: 525258 - RNA, 23 nt, Chlamydophila pneumoniae J138
gaaacuuuugucgcaauaacaaa

SEQ ID NO: 525259 - RNA, 15 nt, Chlamydophila pneumoniae J138
gaaacuuuaggauuc

SEQ ID NO: 525260 - RNA, 17 nt, Chlamydophila pneumoniae J138
gaaacuucugacccugu

SEQ ID NO: 525261 - RNA, 21 nt, Chlamydophila pneumoniae J138
gaaacuucucagauaaaaaga

SEQ ID NO: 525262 - RNA, 14 nt, Chlamydophila pneumoniae J138
gaaagauaaugucu

SEQ ID NO: 525263 - RNA, 20 nt, Chlamydophila pneumoniae J138
gaaagauaucccaaagcuag

SEQ ID NO: 525264 - RNA, 21 nt, Chlamydophila pneumoniae J138
gaaaggcuuuucuuuuucuag

SEQ ID NO: 525265 - RNA, 17 nt, Chlamydophila pneumoniae J138
gaaaggaccuccucaca

SEQ ID NO: 525266 - RNA, 18 nt, Chlamydophila pneumoniae J138
gaaaggcugauaagauca

SEQ ID NO: 525267 - RNA, 18 nt, Chlamydophila pneumoniae J138
gaaagcuggagggucgcu

SEQ ID NO: 525268 - RNA, 20 nt, Chlamydophila pneumoniae J138
gaaaggcacuccaaaacuca

SEQ ID NO: 525269 - RNA, 17 nt, Chlamydophila pneumoniae J138
gaaagcuucuggauuca

SEQ ID NO: 525270 - RNA, 15 nt, Chlamydophila pneumoniae J138
gaaaguauuccucuu

SEQ ID NO: 525271 - RNA, 16 nt, Chlamydophila pneumoniae J138
gaaagguaguuuucuu

SEQ ID NO: 525272 - RNA, 15 nt, Chlamydophila pneumoniae J138
gaaaguucacaagca

SEQ ID NO: 525273 - RNA, 22 nt, Chlamydophila pneumoniae J138
gaaauaccacagcuguacagaa

SEQ ID NO: 525274 - RNA, 20 nt, Chlamydophila pneumoniae J138
gaaauaauuuucagucuucc

SEQ ID NO: 525275 - RNA, 14 nt, Chlamydophila pneumoniae J138
gaaauauacugcca

SEQ ID NO: 525276 - RNA, 19 nt, Chlamydophila pneumoniae J138
gaaauauuaacccaccaga

SEQ ID NO: 525277 - RNA, 22 nt, Chlamydophila pneumoniae J138
gaaaugcaguucuuguuaaagu

SEQ ID NO: 525278 - RNA, 22 nt, Chlamydophila pneumoniae J138
gaaaugcaaaccaaaaaaguaa

SEQ ID NO: 525279 - RNA, 20 nt, Chlamydophila pneumoniae J138
gaaauccugggcaaugauca

SEQ ID NO: 525280 - RNA, 14 nt, Chlamydophila pneumoniae J138
gaaauccugggcaa

SEQ ID NO: 525281 - RNA, 18 nt, Chlamydophila pneumoniae J138
gaaauccguaaagguugu

SEQ ID NO: 525282 - RNA, 16 nt, Chlamydophila pneumoniae J138
gaaaucgcauuacaaa

SEQ ID NO: 525283 - RNA, 23 nt, Chlamydophila pneumoniae J138
gaaaucgacaggggaguuuucaa

SEQ ID NO: 525284 - RNA, 18 nt, Chlamydophila pneumoniae J138
gaaaucguaucuuuuugc

SEQ ID NO: 525285 - RNA, 14 nt, Chlamydophila pneumoniae J138
gaaauugcucuugc

SEQ ID NO: 525286 - RNA, 22 nt, Chlamydophila pneumoniae J138
gaaauugucuucagugcaaugu

SEQ ID NO: 525287 - RNA, 14 nt, Chlamydophila pneumoniae J138
gaaauuucauucuc

SEQ ID NO: 525288 - RNA, 21 nt, Chlamydophila pneumoniae J138
gaacaaaaaaucaaucuugau

SEQ ID NO: 525289 - RNA, 20 nt, Chlamydophila pneumoniae J138
gaacaaagcucuccuucaga

SEQ ID NO: 525290 - RNA, 15 nt, Chlamydophila pneumoniae J138
gaaauuagguagugg

SEQ ID NO: 525291 - RNA, 23 nt, Chlamydophila pneumoniae J138
gaaauuauagaugaucacaggcu

SEQ ID NO: 525292 - RNA, 13 nt, Chlamydophila pneumoniae J138
gaaauuaaagcua

SEQ ID NO: 525293 - RNA, 21 nt, Chlamydophila pneumoniae J138
gaaauugaacucucaguuaaa

SEQ ID NO: 525294 - RNA, 22 nt, Chlamydophila pneumoniae J138
gaacacccccgcagcuucucua

SEQ ID NO: 525295 - RNA, 16 nt, Chlamydophila pneumoniae J138
gaacaccauaaaacaa

SEQ ID NO: 525296 - RNA, 22 nt, Chlamydophila pneumoniae J138
gaacaagucggcaggagaggua

SEQ ID NO: 525297 - RNA, 15 nt, Chlamydophila pneumoniae J138
gaacaacugugguuu

SEQ ID NO: 525298 - RNA, 19 nt, Chlamydophila pneumoniae J138
gaacaacgcugcuucucua

SEQ ID NO: 525299 - RNA, 19 nt, Chlamydophila pneumoniae J138
gaacaaguuuuuucaaucc

SEQ ID NO: 525300 - RNA, 15 nt, Chlamydophila pneumoniae J138
gaacaauacucucug

SEQ ID NO: 525301 - RNA, 20 nt, Chlamydophila pneumoniae J138
gaacaaguuuuuucaauccu

SEQ ID NO: 525302 - RNA, 14 nt, Chlamydophila pneumoniae J138
gaacaaucaacacc

SEQ ID NO: 525303 - RNA, 17 nt, Chlamydophila pneumoniae J138
gaacaauagaaagacca

SEQ ID NO: 525304 - RNA, 13 nt, Chlamydophila pneumoniae J138
gaacagagaugca

SEQ ID NO: 525305 - RNA, 15 nt, Chlamydophila pneumoniae J138
gaacagcacucucug

SEQ ID NO: 525306 - RNA, 18 nt, Chlamydophila pneumoniae J138
gaacagccucugugguuu

SEQ ID NO: 525307 - RNA, 18 nt, Chlamydophila pneumoniae J138
gaacaggagagagaaggc

SEQ ID NO: 525308 - RNA, 20 nt, Chlamydophila pneumoniae J138
gaacaggagagagaaggcuc

SEQ ID NO: 525309 - RNA, 21 nt, Chlamydophila pneumoniae J138
gaacaggagguguauccguag

SEQ ID NO: 525310 - RNA, 18 nt, Chlamydophila pneumoniae J138
gaacaguauaaucagaag

SEQ ID NO: 525311 - RNA, 17 nt, Chlamydophila pneumoniae J138
gaacaguuugcucugga

SEQ ID NO: 525312 - RNA, 19 nt, Chlamydophila pneumoniae J138
gaacagucuugcgccagca

SEQ ID NO: 525313 - RNA, 14 nt, Chlamydophila pneumoniae J138
gaacaugccaaaua

SEQ ID NO: 525314 - RNA, 16 nt, Chlamydophila pneumoniae J138
gaacaucuucccaccc

SEQ ID NO: 525315 - RNA, 23 nt, Chlamydophila pneumoniae J138
gaacaugcccccacaaaaccugg

SEQ ID NO: 525316 - RNA, 16 nt, Chlamydophila pneumoniae J138
gaaccaaaaugaguuc

SEQ ID NO: 525317 - RNA, 22 nt, Chlamydophila pneumoniae J138
gaauaucgaguucuuuuugcag

SEQ ID NO: 525318 - RNA, 16 nt, Chlamydophila pneumoniae J138
gaauauguacugaugu

SEQ ID NO: 525319 - RNA, 14 nt, Chlamydophila pneumoniae J138
gaauaugcuuuuca

SEQ ID NO: 525320 - RNA, 21 nt, Chlamydophila pneumoniae J138
gaauaguugugagacuuucug

SEQ ID NO: 525321 - RNA, 19 nt, Chlamydophila pneumoniae J138
gaauagcuucugacucugu

SEQ ID NO: 525322 - RNA, 22 nt, Chlamydophila pneumoniae J138
gaauauaauuccaauugccaug

SEQ ID NO: 525323 - RNA, 18 nt, Chlamydophila pneumoniae J138
gaauagaauguaugugaa

SEQ ID NO: 525324 - RNA, 18 nt, Chlamydophila pneumoniae J138
gaauagcaagcacuuucg

SEQ ID NO: 525325 - RNA, 16 nt, Chlamydophila pneumoniae J138
gaauaaaggacauaga

SEQ ID NO: 525326 - RNA, 19 nt, Chlamydophila pneumoniae J138
gaauaaaggacauagacuu

SEQ ID NO: 525327 - RNA, 17 nt, Chlamydophila pneumoniae J138
gaauaacaccaaaagaa

SEQ ID NO: 525328 - RNA, 23 nt, Chlamydophila pneumoniae J138
gaauaaucucuuucauaaauuca

SEQ ID NO: 525329 - RNA, 12 nt, Chlamydophila pneumoniae J138
gaauaaucaacc

SEQ ID NO: 525330 - RNA, 14 nt, Chlamydophila pneumoniae J138
gaauaaucaaccaa

SEQ ID NO: 525331 - RNA, 19 nt, Chlamydophila pneumoniae J138
gaauaagagcuacaauccc

SEQ ID NO: 525332 - RNA, 14 nt, Chlamydophila pneumoniae J138
gaauaagauuuuga

SEQ ID NO: 525333 - RNA, 20 nt, Chlamydophila pneumoniae J138
gaauaagauuuugaaaauug

SEQ ID NO: 525334 - RNA, 20 nt, Chlamydophila pneumoniae J138
gaauaaguuuugauuuugca

SEQ ID NO: 525335 - RNA, 21 nt, Chlamydophila pneumoniae J138
gaauaaguuuugauuuugcag

SEQ ID NO: 525336 - RNA, 17 nt, Chlamydophila pneumoniae J138
gaauaccucaagaugca

SEQ ID NO: 525337 - RNA, 17 nt, Chlamydophila pneumoniae J138
gaauaccguuuuaggaa

SEQ ID NO: 525338 - RNA, 20 nt, Chlamydophila pneumoniae J138
gaauaccguuucaggaaacu

SEQ ID NO: 525339 - RNA, 18 nt, Chlamydophila pneumoniae J138
gaauaccguuucaggaaa

SEQ ID NO: 525340 - RNA, 21 nt, Chlamydophila pneumoniae J138
gaauacucuagguuuucucuu

SEQ ID NO: 525341 - RNA, 15 nt, Chlamydophila pneumoniae J138
gaauacauuccuagc

SEQ ID NO: 525342 - RNA, 16 nt, Chlamydophila pneumoniae J138
gaaggcuuguuucugu

SEQ ID NO: 525343 - RNA, 20 nt, Chlamydophila pneumoniae J138
gaagggauguuuaauacaaa

SEQ ID NO: 525344 - RNA, 22 nt, Chlamydophila pneumoniae J138
gaagguaaauuuuuaaaacucc

SEQ ID NO: 525345 - RNA, 18 nt, Chlamydophila pneumoniae J138
gaaggggaagaggaaugc

SEQ ID NO: 525346 - RNA, 23 nt, Chlamydophila pneumoniae J138
gaaggggagauuccccagggaga

SEQ ID NO: 525347 - RNA, 21 nt, Chlamydophila pneumoniae J138
gaaggcggcuuuuugcaagcu

SEQ ID NO: 525348 - RNA, 16 nt, Chlamydophila pneumoniae J138
gaaguacaagugaaga

SEQ ID NO: 525349 - RNA, 20 nt, Chlamydophila pneumoniae J138
gaaguaaucgucacugcgca

SEQ ID NO: 525350 - RNA, 23 nt, Chlamydophila pneumoniae J138
gaaguaguggacuauagaugcca

SEQ ID NO: 525351 - RNA, 18 nt, Chlamydophila pneumoniae J138
gaagucacaaauuuuugc

SEQ ID NO: 525352 - RNA, 13 nt, Chlamydophila pneumoniae J138
gaagugcuuugag

SEQ ID NO: 525353 - RNA, 16 nt, Chlamydophila pneumoniae J138
gaagucuucaggugaa

SEQ ID NO: 525354 - RNA, 16 nt, Chlamydophila pneumoniae J138
gaagucuucuugcuga

SEQ ID NO: 525355 - RNA, 20 nt, Chlamydophila pneumoniae J138
gaagucuucuugcugauccu

SEQ ID NO: 525356 - RNA, 13 nt, Chlamydophila pneumoniae J138
gaagucuucaggu

SEQ ID NO: 525357 - RNA, 23 nt, Chlamydophila pneumoniae J138
gaagugaucuugagaaaagaaca

SEQ ID NO: 525358 - RNA, 18 nt, Chlamydophila pneumoniae J138
gaagugaggagaauagca

SEQ ID NO: 525359 - RNA, 17 nt, Chlamydophila pneumoniae J138
gaagucccacaaaugau

SEQ ID NO: 525360 - RNA, 21 nt, Chlamydophila pneumoniae J138
gaaguccauguacagaaaaua

SEQ ID NO: 525361 - RNA, 22 nt, Chlamydophila pneumoniae J138
gaaguccuggauuuuaaagcaa

SEQ ID NO: 525362 - RNA, 21 nt, Chlamydophila pneumoniae J138
gaagucguuuagauuuuucuu

SEQ ID NO: 525363 - RNA, 14 nt, Chlamydophila pneumoniae J138
gaaguuccuucagg

SEQ ID NO: 525364 - RNA, 13 nt, Chlamydophila pneumoniae J138
gaaguguuucuuu

SEQ ID NO: 525365 - RNA, 20 nt, Chlamydophila pneumoniae J138
gaaguuuuuuaagugcuuuu

SEQ ID NO: 525366 - RNA, 22 nt, Chlamydophila pneumoniae J138
gaaguuuuuuaagugcuuuuag

SEQ ID NO: 525367 - RNA, 15 nt, Chlamydophila pneumoniae J138
gaaguuuugcucucu

SEQ ID NO: 525368 - RNA, 17 nt, Chlamydophila pneumoniae J138
gaaguuuacaaauaaaa

SEQ ID NO: 525369 - RNA, 13 nt, Chlamydophila pneumoniae J138
gaaguuuuuucuc

SEQ ID NO: 525370 - RNA, 19 nt, Chlamydophila pneumoniae J138
gaauaaagcccuuuugaau

SEQ ID NO: 525371 - RNA, 19 nt, Chlamydophila pneumoniae J138
gaaucacuguaucagcaag

SEQ ID NO: 525372 - RNA, 22 nt, Chlamydophila pneumoniae J138
gaaucacuguaucagcaagccc

SEQ ID NO: 525373 - RNA, 16 nt, Chlamydophila pneumoniae J138
gaaucacguucccacg

SEQ ID NO: 525374 - RNA, 15 nt, Chlamydophila pneumoniae J138
gaaucagauuagagu

SEQ ID NO: 525375 - RNA, 14 nt, Chlamydophila pneumoniae J138
gaauccaaagacuu

SEQ ID NO: 525376 - RNA, 16 nt, Chlamydophila pneumoniae J138
gaauccaaaaaagagc

SEQ ID NO: 525377 - RNA, 21 nt, Chlamydophila pneumoniae J138
gaauccccccuucuaauacuu

SEQ ID NO: 525378 - RNA, 17 nt, Chlamydophila pneumoniae J138
gaauccccaauguuuuc

SEQ ID NO: 525379 - RNA, 18 nt, Chlamydophila pneumoniae J138
gaauccucuauccaucau

SEQ ID NO: 525380 - RNA, 11 nt, Chlamydophila pneumoniae J138
gaauccuucuc

SEQ ID NO: 525381 - RNA, 16 nt, Chlamydophila pneumoniae J138
gaauccuugaaagacu

SEQ ID NO: 525382 - RNA, 12 nt, Chlamydophila pneumoniae J138
gaaucucuucug

SEQ ID NO: 525383 - RNA, 19 nt, Chlamydophila pneumoniae J138
gaaucuauccauagcgaua

SEQ ID NO: 525384 - RNA, 12 nt, Chlamydophila pneumoniae J138
gaaucuaagaug

SEQ ID NO: 525385 - RNA, 23 nt, Chlamydophila pneumoniae J138
gaaucgccgcuugaggaggauug

SEQ ID NO: 525386 - RNA, 14 nt, Chlamydophila pneumoniae J138
gaaucuuuauuucu

SEQ ID NO: 525387 - RNA, 17 nt, Chlamydophila pneumoniae J138
gaaucuuuuguuuuagc

SEQ ID NO: 525388 - RNA, 19 nt, Chlamydophila pneumoniae J138
gaaucuuaugggagaagcu

SEQ ID NO: 525389 - RNA, 17 nt, Chlamydophila pneumoniae J138
gaaugacacagagaaca

SEQ ID NO: 525390 - RNA, 23 nt, Chlamydophila pneumoniae J138
gaaugaucccuaacgaugcaggc

SEQ ID NO: 525391 - RNA, 14 nt, Chlamydophila pneumoniae J138
gaauggauguugcg

SEQ ID NO: 525392 - RNA, 19 nt, Chlamydophila pneumoniae J138
gaauguaugugaaagauua

SEQ ID NO: 525393 - RNA, 19 nt, Chlamydophila pneumoniae J138
gaauguagccaauccuucc

SEQ ID NO: 525394 - RNA, 18 nt, Chlamydophila pneumoniae J138
gaauuaaacuuucuucuc

SEQ ID NO: 525395 - RNA, 20 nt, Chlamydophila pneumoniae J138
gaauuaaacuuucuucucua

SEQ ID NO: 525396 - RNA, 17 nt, Chlamydophila pneumoniae J138
gaauuagagaaauuuuu

SEQ ID NO: 525397 - RNA, 14 nt, Chlamydophila pneumoniae J138
gaauucaaacuccu

SEQ ID NO: 525398 - RNA, 21 nt, Chlamydophila pneumoniae J138
gaauucaaacuccuuuuaaaa

SEQ ID NO: 525399 - RNA, 16 nt, Chlamydophila pneumoniae J138
gaauuccucugauucc

SEQ ID NO: 525400 - RNA, 23 nt, Chlamydophila pneumoniae J138
gaauugcuugcgcaucagcagcu

SEQ ID NO: 525401 - RNA, 14 nt, Chlamydophila pneumoniae J138
gaauucucaaguaa

SEQ ID NO: 525402 - RNA, 10 nt, Chlamydophila pneumoniae J138
gaauuccucu

SEQ ID NO: 525403 - RNA, 13 nt, Chlamydophila pneumoniae J138
gaacccuggauga

SEQ ID NO: 525404 - RNA, 17 nt, Chlamydophila pneumoniae J138
gaaccucuaauuugaug

SEQ ID NO: 525405 - RNA, 20 nt, Chlamydophila pneumoniae J138
gaaccuccaccaggagcucc

SEQ ID NO: 525406 - RNA, 21 nt, Chlamydophila pneumoniae J138
gaaccgucgagcucgcaaaag

SEQ ID NO: 525407 - RNA, 19 nt, Chlamydophila pneumoniae J138
gaacgaagacuuguucuuc

SEQ ID NO: 525408 - RNA, 16 nt, Chlamydophila pneumoniae J138
gaacgccccccccucu

SEQ ID NO: 525409 - RNA, 19 nt, Chlamydophila pneumoniae J138
gaacgccccccccucucuc

SEQ ID NO: 525410 - RNA, 19 nt, Chlamydophila pneumoniae J138
gaacgccaucuccacagcc

SEQ ID NO: 525411 - RNA, 15 nt, Chlamydophila pneumoniae J138
gaacgcugaguguau

SEQ ID NO: 525412 - RNA, 20 nt, Chlamydophila pneumoniae J138
gaacuauccuguuucaacau

SEQ ID NO: 525413 - RNA, 21 nt, Chlamydophila pneumoniae J138
gaacuauccuguuucaacaua

SEQ ID NO: 525414 - RNA, 21 nt, Chlamydophila pneumoniae J138
gaacucacaaacaacagaaau

SEQ ID NO: 525415 - RNA, 17 nt, Chlamydophila pneumoniae J138
gaacuacuuaaauccua

SEQ ID NO: 525416 - RNA, 22 nt, Chlamydophila pneumoniae J138
gaacuacgggcaauauauccag

SEQ ID NO: 525417 - RNA, 19 nt, Chlamydophila pneumoniae J138
gaacuaaaaguuuuuuauu

SEQ ID NO: 525418 - RNA, 14 nt, Chlamydophila pneumoniae J138
gaacuaaagagauc

SEQ ID NO: 525419 - RNA, 18 nt, Chlamydophila pneumoniae J138
gaacuaaaggaacugugc

SEQ ID NO: 525420 - RNA, 13 nt, Chlamydophila pneumoniae J138
gaacgugcugcga

SEQ ID NO: 525421 - RNA, 21 nt, Chlamydophila pneumoniae J138
gaacguauacgucccacaaaa

SEQ ID NO: 525422 - RNA, 23 nt, Chlamydophila pneumoniae J138
gaacguagcagaggcagguaguc

SEQ ID NO: 525423 - RNA, 18 nt, Chlamydophila pneumoniae J138
gaacugggcauaguggcu

SEQ ID NO: 525424 - RNA, 16 nt, Chlamydophila pneumoniae J138
gaacuuaaaauucaaa

SEQ ID NO: 525425 - RNA, 15 nt, Chlamydophila pneumoniae J138
gaacuguacgaauuu

SEQ ID NO: 525426 - RNA, 14 nt, Chlamydophila pneumoniae J138
gaacuuaaaauuca

SEQ ID NO: 525427 - RNA, 15 nt, Chlamydophila pneumoniae J138
gaacuuccugauucu

SEQ ID NO: 525428 - RNA, 18 nt, Chlamydophila pneumoniae J138
gaacuucagcaagaaaau

SEQ ID NO: 525429 - RNA, 19 nt, Chlamydophila pneumoniae J138
gaacuucagcaagaaaaua

SEQ ID NO: 525430 - RNA, 13 nt, Chlamydophila pneumoniae J138
gaacugaagaguc

SEQ ID NO: 525431 - RNA, 15 nt, Chlamydophila pneumoniae J138
gaacucuuuaaaagg

SEQ ID NO: 525432 - RNA, 12 nt, Chlamydophila pneumoniae J138
gaacucugaagu

SEQ ID NO: 525433 - RNA, 17 nt, Chlamydophila pneumoniae J138
gaacuccuuugagucuu

SEQ ID NO: 525434 - RNA, 16 nt, Chlamydophila pneumoniae J138
gaacuccauucagaug

SEQ ID NO: 525435 - RNA, 14 nt, Chlamydophila pneumoniae J138
gaagcaucuucgau

SEQ ID NO: 525436 - RNA, 23 nt, Chlamydophila pneumoniae J138
gaagcauucccgacucaaucaaa

SEQ ID NO: 525437 - RNA, 16 nt, Chlamydophila pneumoniae J138
gaagccaccaucuguu

SEQ ID NO: 525438 - RNA, 23 nt, Chlamydophila pneumoniae J138
gaagccagucuucauaagaguag

SEQ ID NO: 525439 - RNA, 19 nt, Chlamydophila pneumoniae J138
gaagcgccgcauuacaggg

SEQ ID NO: 525440 - RNA, 15 nt, Chlamydophila pneumoniae J138
gaagcggagcaucuu

SEQ ID NO: 525441 - RNA, 14 nt, Chlamydophila pneumoniae J138
gaagcguagcaaag

SEQ ID NO: 525442 - RNA, 12 nt, Chlamydophila pneumoniae J138
gaagcugcuucu

SEQ ID NO: 525443 - RNA, 19 nt, Chlamydophila pneumoniae J138
gaagcugucguccuaauuu

SEQ ID NO: 525444 - RNA, 20 nt, Chlamydophila pneumoniae J138
gaagcugagaauacaacccu

SEQ ID NO: 525445 - RNA, 15 nt, Chlamydophila pneumoniae J138
gaagcucuaucuuug

SEQ ID NO: 525446 - RNA, 22 nt, Chlamydophila pneumoniae J138
gaagcuauuccacggcggagaa

SEQ ID NO: 525447 - RNA, 19 nt, Chlamydophila pneumoniae J138
gaagcuccucacaucuccu

SEQ ID NO: 525448 - RNA, 12 nt, Chlamydophila pneumoniae J138
gaaggaagaucu

SEQ ID NO: 525449 - RNA, 20 nt, Chlamydophila pneumoniae J138
gaaggaagaucuugaacaga

SEQ ID NO: 525450 - RNA, 15 nt, Chlamydophila pneumoniae J138
gaaggacaacuagac

SEQ ID NO: 525451 - RNA, 17 nt, Chlamydophila pneumoniae J138
gaaggaggaguccuucu

SEQ ID NO: 525452 - RNA, 23 nt, Chlamydophila pneumoniae J138
gaagcugucgcaaaugcagucuc

SEQ ID NO: 525453 - RNA, 13 nt, Chlamydophila pneumoniae J138
gaaggaaaucaca

SEQ ID NO: 525454 - RNA, 23 nt, Chlamydophila pneumoniae J138
gaaggcaccaacacuuuuaaaga

SEQ ID NO: 525455 - RNA, 21 nt, Chlamydophila pneumoniae J138
gaaggaucauaccgacaagca

SEQ ID NO: 525456 - RNA, 12 nt, Chlamydophila pneumoniae J138
gaaggcagagaa

SEQ ID NO: 525457 - RNA, 19 nt, Chlamydophila pneumoniae J138
gaagaucgucggaagacuu

SEQ ID NO: 525458 - RNA, 20 nt, Chlamydophila pneumoniae J138
gaagauccugaguauuuugc

SEQ ID NO: 525459 - RNA, 16 nt, Chlamydophila pneumoniae J138
gaagaucccugagccu

SEQ ID NO: 525460 - RNA, 16 nt, Chlamydophila pneumoniae J138
gaagauccuagagaau

SEQ ID NO: 525461 - RNA, 13 nt, Chlamydophila pneumoniae J138
gaagaugauugga

SEQ ID NO: 525462 - RNA, 17 nt, Chlamydophila pneumoniae J138
gaagaucuugaacagag

SEQ ID NO: 525463 - RNA, 18 nt, Chlamydophila pneumoniae J138
gaagagcauuuaaaacgg

SEQ ID NO: 525464 - RNA, 13 nt, Chlamydophila pneumoniae J138
gaagaggaaugcc

SEQ ID NO: 525465 - RNA, 15 nt, Chlamydophila pneumoniae J138
gaagauucaaagaag

SEQ ID NO: 525466 - RNA, 18 nt, Chlamydophila pneumoniae J138
gaagauggcaaggaaaau

SEQ ID NO: 525467 - RNA, 16 nt, Chlamydophila pneumoniae J138
gaagauuuagggaaga

SEQ ID NO: 525468 - RNA, 20 nt, Chlamydophila pneumoniae J138
gaagcaacuaaacucuccaa

SEQ ID NO: 525469 - RNA, 18 nt, Chlamydophila pneumoniae J138
gaagcaacuaaacucucc

SEQ ID NO: 525470 - RNA, 12 nt, Chlamydophila pneumoniae J138
gaagcagaaacu

SEQ ID NO: 525471 - RNA, 18 nt, Chlamydophila pneumoniae J138
gaagcagaaacuuuaaaa

SEQ ID NO: 525472 - RNA, 14 nt, Chlamydophila pneumoniae J138
gaagacaaguaaac

SEQ ID NO: 525473 - RNA, 14 nt, Chlamydophila pneumoniae J138
gaagacacagggga

SEQ ID NO: 525474 - RNA, 20 nt, Chlamydophila pneumoniae J138
gaagaauuucauaagagaac

SEQ ID NO: 525475 - RNA, 16 nt, Chlamydophila pneumoniae J138
gaagaaggacaacuag

SEQ ID NO: 525476 - RNA, 23 nt, Chlamydophila pneumoniae J138
gaagaaguacaagugaagacaag

SEQ ID NO: 525477 - RNA, 17 nt, Chlamydophila pneumoniae J138
gaagacuuguucuucau

SEQ ID NO: 525478 - RNA, 22 nt, Chlamydophila pneumoniae J138
gaagacucucaucagcaaaacu

SEQ ID NO: 525479 - RNA, 16 nt, Chlamydophila pneumoniae J138
gaagacuuguucuuca

SEQ ID NO: 525480 - RNA, 15 nt, Chlamydophila pneumoniae J138
gaagagaaaguagag

SEQ ID NO: 525481 - RNA, 14 nt, Chlamydophila pneumoniae J138
gaagacucucauca

SEQ ID NO: 525482 - RNA, 19 nt, Chlamydophila pneumoniae J138
gaagacucucaucagcaaa

SEQ ID NO: 525483 - RNA, 18 nt, Chlamydophila pneumoniae J138
gaagacccucgaaccacu

SEQ ID NO: 525484 - RNA, 19 nt, Chlamydophila pneumoniae J138
gaagaaacuucucuaggaa

SEQ ID NO: 525485 - RNA, 15 nt, Chlamydophila pneumoniae J138
gaagaaaggaccauu

SEQ ID NO: 525486 - RNA, 14 nt, Chlamydophila pneumoniae J138
gaagaaauuaacaa

SEQ ID NO: 525487 - RNA, 16 nt, Chlamydophila pneumoniae J138
gaacuuucgucuuugc

SEQ ID NO: 525488 - RNA, 20 nt, Chlamydophila pneumoniae J138
gaacuuuagggaagaaauua

SEQ ID NO: 525489 - RNA, 11 nt, Chlamydophila pneumoniae J138
cuucuccugaa

SEQ ID NO: 525490 - RNA, 23 nt, Chlamydophila pneumoniae J138
cuucuccugaaccgcaaaaagcu

SEQ ID NO: 525491 - RNA, 13 nt, Chlamydophila pneumoniae J138
cuucuccucgcaa

SEQ ID NO: 525492 - RNA, 16 nt, Chlamydophila pneumoniae J138
cuucucccgcuaauua

SEQ ID NO: 525493 - RNA, 13 nt, Chlamydophila pneumoniae J138
cuucucccucuaa

SEQ ID NO: 525494 - RNA, 19 nt, Chlamydophila pneumoniae J138
cuucucccucuaaacauaa

SEQ ID NO: 525495 - RNA, 18 nt, Chlamydophila pneumoniae J138
cuucucuaguuguaauuu

SEQ ID NO: 525496 - RNA, 14 nt, Chlamydophila pneumoniae J138
cuucucuacuaaaa

SEQ ID NO: 525497 - RNA, 14 nt, Chlamydophila pneumoniae J138
cuucucuaagaaau

SEQ ID NO: 525498 - RNA, 18 nt, Chlamydophila pneumoniae J138
cuucucuaagaaauuuuc

SEQ ID NO: 525499 - RNA, 22 nt, Chlamydophila pneumoniae J138
cuucucuaguuguaauuucuug

SEQ ID NO: 525500 - RNA, 22 nt, Chlamydophila pneumoniae J138
cuucucuguugggagcuuccuc

SEQ ID NO: 525501 - RNA, 19 nt, Chlamydophila pneumoniae J138
cuucucuguugggagcuuc

SEQ ID NO: 525502 - RNA, 13 nt, Chlamydophila pneumoniae J138
cuucucuguaucg

SEQ ID NO: 525503 - RNA, 21 nt, Chlamydophila pneumoniae J138
cuucucuuaugaaguccagac

SEQ ID NO: 525504 - RNA, 16 nt, Chlamydophila pneumoniae J138
cuucugaaaucaaaaa

SEQ ID NO: 525505 - RNA, 17 nt, Chlamydophila pneumoniae J138
cuucugauacaucauca

SEQ ID NO: 525506 - RNA, 15 nt, Chlamydophila pneumoniae J138
cuucuggagaaaaaa

SEQ ID NO: 525507 - RNA, 23 nt, Chlamydophila pneumoniae J138
cuucuggauacguuuuucccuuu

SEQ ID NO: 525508 - RNA, 18 nt, Chlamydophila pneumoniae J138
cuucuggauacguuuuuc

SEQ ID NO: 525509 - RNA, 21 nt, Chlamydophila pneumoniae J138
cuucuggauacguuuuucccu

SEQ ID NO: 525510 - RNA, 15 nt, Chlamydophila pneumoniae J138
cuucugcaggauuug

SEQ ID NO: 525511 - RNA, 15 nt, Chlamydophila pneumoniae J138
cuucuguaggaacaa

SEQ ID NO: 525512 - RNA, 20 nt, Chlamydophila pneumoniae J138
cuucuguaguuuguucacuu

SEQ ID NO: 525513 - RNA, 19 nt, Chlamydophila pneumoniae J138
cuucuguaucgacuguaca

SEQ ID NO: 525514 - RNA, 18 nt, Chlamydophila pneumoniae J138
cuucuggguucuccacau

SEQ ID NO: 525515 - RNA, 12 nt, Chlamydophila pneumoniae J138
cuucugugcauc

SEQ ID NO: 525516 - RNA, 14 nt, Chlamydophila pneumoniae J138
cuucugucuguauu

SEQ ID NO: 525517 - RNA, 18 nt, Chlamydophila pneumoniae J138
cuucuuagaagagaaagu

SEQ ID NO: 525518 - RNA, 12 nt, Chlamydophila pneumoniae J138
cuucuucagagu

SEQ ID NO: 525519 - RNA, 14 nt, Chlamydophila pneumoniae J138
cuucuuaucuucua

SEQ ID NO: 525520 - RNA, 15 nt, Chlamydophila pneumoniae J138
cuucuucaaagucaa

SEQ ID NO: 525521 - RNA, 18 nt, Chlamydophila pneumoniae J138
cuucuucccagccuugau

SEQ ID NO: 525522 - RNA, 20 nt, Chlamydophila pneumoniae J138
cuucuucccuuucaaaggca

SEQ ID NO: 525523 - RNA, 17 nt, Chlamydophila pneumoniae J138
cuucuucgccuacaagu

SEQ ID NO: 525524 - RNA, 15 nt, Chlamydophila pneumoniae J138
cuucuucuauagaau

SEQ ID NO: 525525 - RNA, 20 nt, Chlamydophila pneumoniae J138
cuucuucguaagcugcaauc

SEQ ID NO: 525526 - RNA, 16 nt, Chlamydophila pneumoniae J138
cuucuugcaaagauaa

SEQ ID NO: 525527 - RNA, 14 nt, Chlamydophila pneumoniae J138
cuucuugauuaaga

SEQ ID NO: 525528 - RNA, 13 nt, Chlamydophila pneumoniae J138
cuucuucuucaaa

SEQ ID NO: 525529 - RNA, 15 nt, Chlamydophila pneumoniae J138
cuucuucuuguucuu

SEQ ID NO: 525530 - RNA, 21 nt, Chlamydophila pneumoniae J138
cuucuuggcguuccagcuccu

SEQ ID NO: 525531 - RNA, 14 nt, Chlamydophila pneumoniae J138
cuucuuguuuuugu

SEQ ID NO: 525532 - RNA, 21 nt, Chlamydophila pneumoniae J138
cuucuuguguuagugcuucag

SEQ ID NO: 525533 - RNA, 15 nt, Chlamydophila pneumoniae J138
cuucuugugauccuu

SEQ ID NO: 525534 - RNA, 18 nt, Chlamydophila pneumoniae J138
cuugaacagagacuuccu

SEQ ID NO: 525535 - RNA, 15 nt, Chlamydophila pneumoniae J138
cuugaaauugcucuu

SEQ ID NO: 525536 - RNA, 14 nt, Chlamydophila pneumoniae J138
cuugaacagagacu

SEQ ID NO: 525537 - RNA, 15 nt, Chlamydophila pneumoniae J138
cuugagcauccaaaa

SEQ ID NO: 525538 - RNA, 15 nt, Chlamydophila pneumoniae J138
cuugaggaauucuuu

SEQ ID NO: 525539 - RNA, 17 nt, Chlamydophila pneumoniae J138
cuucuuuuuuuuucuua

SEQ ID NO: 525540 - RNA, 20 nt, Chlamydophila pneumoniae J138
cuucuuuaggguaaagaaau

SEQ ID NO: 525541 - RNA, 22 nt, Chlamydophila pneumoniae J138
cuucuuuaggguaaagaaauau

SEQ ID NO: 525542 - RNA, 16 nt, Chlamydophila pneumoniae J138
cuucuuuacucaagug

SEQ ID NO: 525543 - RNA, 17 nt, Chlamydophila pneumoniae J138
cuucuuguuuuugugga

SEQ ID NO: 525544 - RNA, 12 nt, Chlamydophila pneumoniae J138
cuucuuucaaag

SEQ ID NO: 525545 - RNA, 19 nt, Chlamydophila pneumoniae J138
cuucuuuaucuagcucuuc

SEQ ID NO: 525546 - RNA, 17 nt, Chlamydophila pneumoniae J138
cuugauaaaagauagug

SEQ ID NO: 525547 - RNA, 15 nt, Chlamydophila pneumoniae J138
cuugagguauuccua

SEQ ID NO: 525548 - RNA, 15 nt, Chlamydophila pneumoniae J138
cuugauucucuucca

SEQ ID NO: 525549 - RNA, 15 nt, Chlamydophila pneumoniae J138
cuugauuccuuaagu

SEQ ID NO: 525550 - RNA, 19 nt, Chlamydophila pneumoniae J138
cuugauuaagaucuucguc

SEQ ID NO: 525551 - RNA, 18 nt, Chlamydophila pneumoniae J138
cuugcagcccugcauagu

SEQ ID NO: 525552 - RNA, 18 nt, Chlamydophila pneumoniae J138
cuugcagcgacaacacgc

SEQ ID NO: 525553 - RNA, 22 nt, Chlamydophila pneumoniae J138
cuugcugauccucggcaucuuu

SEQ ID NO: 525554 - RNA, 17 nt, Chlamydophila pneumoniae J138
cuugcucuuuaauaagg

SEQ ID NO: 525555 - RNA, 18 nt, Chlamydophila pneumoniae J138
cuuguaccguaaagaaaa

SEQ ID NO: 525556 - RNA, 15 nt, Chlamydophila pneumoniae J138
cuuggaaaucagaau

SEQ ID NO: 525557 - RNA, 21 nt, Chlamydophila pneumoniae J138
cuugcuuugugaguucuuccu

SEQ ID NO: 525558 - RNA, 13 nt, Chlamydophila pneumoniae J138
cuuguuaugaaaa

SEQ ID NO: 525559 - RNA, 22 nt, Chlamydophila pneumoniae J138
cuuguuaugaugauccacugcu

SEQ ID NO: 525560 - RNA, 14 nt, Chlamydophila pneumoniae J138
cuugugagaugaac

SEQ ID NO: 525561 - RNA, 13 nt, Chlamydophila pneumoniae J138
cuugugagaugaa

SEQ ID NO: 525562 - RNA, 15 nt, Chlamydophila pneumoniae J138
cuuguuucuguuuuc

SEQ ID NO: 525563 - RNA, 18 nt, Chlamydophila pneumoniae J138
cuuguugguuaaaauaga

SEQ ID NO: 525564 - RNA, 16 nt, Chlamydophila pneumoniae J138
cuuguugcaugggaau

SEQ ID NO: 525565 - RNA, 15 nt, Chlamydophila pneumoniae J138
cuuguugcaauugcc

SEQ ID NO: 525566 - RNA, 18 nt, Chlamydophila pneumoniae J138
cuuguuggauugaaaagc

SEQ ID NO: 525567 - RNA, 16 nt, Chlamydophila pneumoniae J138
cuuguuggcauagcga

SEQ ID NO: 525568 - RNA, 19 nt, Chlamydophila pneumoniae J138
cuuguucuucuugauuaag

SEQ ID NO: 525569 - RNA, 22 nt, Chlamydophila pneumoniae J138
cuuguucuucuugauuaagauc

SEQ ID NO: 525570 - RNA, 16 nt, Chlamydophila pneumoniae J138
cuuguucuaaaaugaa

SEQ ID NO: 525571 - RNA, 13 nt, Chlamydophila pneumoniae J138
cuuguucuguaac

SEQ ID NO: 525572 - RNA, 17 nt, Chlamydophila pneumoniae J138
cuuuaaaagcauagugu

SEQ ID NO: 525573 - RNA, 13 nt, Chlamydophila pneumoniae J138
cuuuaaaaaccca

SEQ ID NO: 525574 - RNA, 17 nt, Chlamydophila pneumoniae J138
cuuuaaagauuccccau

SEQ ID NO: 525575 - RNA, 14 nt, Chlamydophila pneumoniae J138
cuuuaaauaaaauc

SEQ ID NO: 525576 - RNA, 18 nt, Chlamydophila pneumoniae J138
cuuuaaauuuuuuaggau

SEQ ID NO: 525577 - RNA, 20 nt, Chlamydophila pneumoniae J138
cuuuaaauucgccaaacgaa

SEQ ID NO: 525578 - RNA, 12 nt, Chlamydophila pneumoniae J138
cuuuaaauuuuu

SEQ ID NO: 525579 - RNA, 17 nt, Chlamydophila pneumoniae J138
cuuuaauccaguuuuuu

SEQ ID NO: 525580 - RNA, 15 nt, Chlamydophila pneumoniae J138
cuuuaauccugcaau

SEQ ID NO: 525581 - RNA, 13 nt, Chlamydophila pneumoniae J138
cuuuaaucaagcc

SEQ ID NO: 525582 - RNA, 14 nt, Chlamydophila pneumoniae J138
cuuuaccagaaaug

SEQ ID NO: 525583 - RNA, 15 nt, Chlamydophila pneumoniae J138
cuuuauagaaaguac

SEQ ID NO: 525584 - RNA, 16 nt, Chlamydophila pneumoniae J138
cuuuauagaaaguaca

SEQ ID NO: 525585 - RNA, 13 nt, Chlamydophila pneumoniae J138
cuuuauagauaug

SEQ ID NO: 525586 - RNA, 22 nt, Chlamydophila pneumoniae J138
cuuuauagauaugccucagguc

SEQ ID NO: 525587 - RNA, 20 nt, Chlamydophila pneumoniae J138
cuuucacgauaucuaccaaa

SEQ ID NO: 525588 - RNA, 14 nt, Chlamydophila pneumoniae J138
cuuuauguuuucuu

SEQ ID NO: 525589 - RNA, 15 nt, Chlamydophila pneumoniae J138
cuuuauguauaacau

SEQ ID NO: 525590 - RNA, 16 nt, Chlamydophila pneumoniae J138
cuuuauguauaacauc

SEQ ID NO: 525591 - RNA, 12 nt, Chlamydophila pneumoniae J138
cuuucauucccu

SEQ ID NO: 525592 - RNA, 23 nt, Chlamydophila pneumoniae J138
cuuucauaagauagagcgacuuc

SEQ ID NO: 525593 - RNA, 11 nt, Chlamydophila pneumoniae J138
cuuuccucucu

SEQ ID NO: 525594 - RNA, 21 nt, Chlamydophila pneumoniae J138
cuuuccggguaaguacacauu

SEQ ID NO: 525595 - RNA, 21 nt, Chlamydophila pneumoniae J138
cuuuccucucuuuauauuuuu

SEQ ID NO: 525596 - RNA, 17 nt, Chlamydophila pneumoniae J138
cuuucuaggaucucuag

SEQ ID NO: 525597 - RNA, 11 nt, Chlamydophila pneumoniae J138
cuucauucaca

SEQ ID NO: 525598 - RNA, 23 nt, Chlamydophila pneumoniae J138
cuuccauaugagguaauccucga

SEQ ID NO: 525599 - RNA, 23 nt, Chlamydophila pneumoniae J138
cuuccauacaggcuccucugcua

SEQ ID NO: 525600 - RNA, 21 nt, Chlamydophila pneumoniae J138
cuuccauagcuuuagaagccc

SEQ ID NO: 525601 - RNA, 11 nt, Chlamydophila pneumoniae J138
cuuccauacag

SEQ ID NO: 525602 - RNA, 19 nt, Chlamydophila pneumoniae J138
cuuccaaaaguaggggcag

SEQ ID NO: 525603 - RNA, 17 nt, Chlamydophila pneumoniae J138
cuuccaaaaguaggggc

SEQ ID NO: 525604 - RNA, 19 nt, Chlamydophila pneumoniae J138
cuuccaaaacgauccuguu

SEQ ID NO: 525605 - RNA, 18 nt, Chlamydophila pneumoniae J138
cuucauuuucuuuuaaga

SEQ ID NO: 525606 - RNA, 20 nt, Chlamydophila pneumoniae J138
cuucccaagcagaagacccu

SEQ ID NO: 525607 - RNA, 20 nt, Chlamydophila pneumoniae J138
cuuccaucucuuuaaauguu

SEQ ID NO: 525608 - RNA, 22 nt, Chlamydophila pneumoniae J138
cuucgccuuggguuugucucca

SEQ ID NO: 525609 - RNA, 16 nt, Chlamydophila pneumoniae J138
cuuccucuuuuauaua

SEQ ID NO: 525610 - RNA, 20 nt, Chlamydophila pneumoniae J138
cuuccugaaucagcuuaucu

SEQ ID NO: 525611 - RNA, 15 nt, Chlamydophila pneumoniae J138
cuucgcaaauuuuuc

SEQ ID NO: 525612 - RNA, 17 nt, Chlamydophila pneumoniae J138
cuucgauuguaacuucg

SEQ ID NO: 525613 - RNA, 19 nt, Chlamydophila pneumoniae J138
cuucgauguuauaagugac

SEQ ID NO: 525614 - RNA, 19 nt, Chlamydophila pneumoniae J138
cuucgaugucuuuccaggc

SEQ ID NO: 525615 - RNA, 17 nt, Chlamydophila pneumoniae J138
cuuccugauucuguaua

SEQ ID NO: 525616 - RNA, 15 nt, Chlamydophila pneumoniae J138
cuucagucugaugua

SEQ ID NO: 525617 - RNA, 15 nt, Chlamydophila pneumoniae J138
cuucaguuguugcuu

SEQ ID NO: 525618 - RNA, 16 nt, Chlamydophila pneumoniae J138
cuucaggauuacggaa

SEQ ID NO: 525619 - RNA, 13 nt, Chlamydophila pneumoniae J138
cuucagcuuuuuc

SEQ ID NO: 525620 - RNA, 17 nt, Chlamydophila pneumoniae J138
cuucaugcugcuuugac

SEQ ID NO: 525621 - RNA, 15 nt, Chlamydophila pneumoniae J138
cuucaucauaacuag

SEQ ID NO: 525622 - RNA, 21 nt, Chlamydophila pneumoniae J138
cuucauauaaaacgaucccua

SEQ ID NO: 525623 - RNA, 12 nt, Chlamydophila pneumoniae J138
cuucaucagaag

SEQ ID NO: 525624 - RNA, 21 nt, Chlamydophila pneumoniae J138
cuucaucagaagguaaauuuu

SEQ ID NO: 525625 - RNA, 17 nt, Chlamydophila pneumoniae J138
cuuauuauugaauaagc

SEQ ID NO: 525626 - RNA, 15 nt, Chlamydophila pneumoniae J138
cuucacaaagaacca

SEQ ID NO: 525627 - RNA, 14 nt, Chlamydophila pneumoniae J138
cuuaucuaaagaaa

SEQ ID NO: 525628 - RNA, 17 nt, Chlamydophila pneumoniae J138
cuuaucuaaagaaaugu

SEQ ID NO: 525629 - RNA, 23 nt, Chlamydophila pneumoniae J138
cuuaucgggggugccaaaaaauu

SEQ ID NO: 525630 - RNA, 15 nt, Chlamydophila pneumoniae J138
cuuauuacagaaagg

SEQ ID NO: 525631 - RNA, 22 nt, Chlamydophila pneumoniae J138
cuuauuacagaaaggcuuuucu

SEQ ID NO: 525632 - RNA, 23 nt, Chlamydophila pneumoniae J138
cuucagagauuuuaaagccuccu

SEQ ID NO: 525633 - RNA, 16 nt, Chlamydophila pneumoniae J138
cuucagagagaacagg

SEQ ID NO: 525634 - RNA, 20 nt, Chlamydophila pneumoniae J138
cuucagauccgauauacuua

SEQ ID NO: 525635 - RNA, 22 nt, Chlamydophila pneumoniae J138
cuucagcccacuguuuugcuuc

SEQ ID NO: 525636 - RNA, 17 nt, Chlamydophila pneumoniae J138
cuucagcaacuaaagca

SEQ ID NO: 525637 - RNA, 22 nt, Chlamydophila pneumoniae J138
cuucagcauagagagaaggaau

SEQ ID NO: 525638 - RNA, 20 nt, Chlamydophila pneumoniae J138
cuuauccugaacaucuccag

SEQ ID NO: 525639 - RNA, 21 nt, Chlamydophila pneumoniae J138
cuuauccgucagccuuagcag

SEQ ID NO: 525640 - RNA, 18 nt, Chlamydophila pneumoniae J138
cuuaucaugaaaaggauu

SEQ ID NO: 525641 - RNA, 14 nt, Chlamydophila pneumoniae J138
cuuacugaagaagu

SEQ ID NO: 525642 - RNA, 19 nt, Chlamydophila pneumoniae J138
cuuagagucuucgacaagg

SEQ ID NO: 525643 - RNA, 14 nt, Chlamydophila pneumoniae J138
cuuagaucuuuucu

SEQ ID NO: 525644 - RNA, 16 nt, Chlamydophila pneumoniae J138
cuuauacccacaaaga

SEQ ID NO: 525645 - RNA, 15 nt, Chlamydophila pneumoniae J138
cuuagcagcacccau

SEQ ID NO: 525646 - RNA, 16 nt, Chlamydophila pneumoniae J138
cuuagcaaucaguaaa

SEQ ID NO: 525647 - RNA, 13 nt, Chlamydophila pneumoniae J138
cuuauacacucca

SEQ ID NO: 525648 - RNA, 19 nt, Chlamydophila pneumoniae J138
cuuauacacuccaauaaga

SEQ ID NO: 525649 - RNA, 17 nt, Chlamydophila pneumoniae J138
cuuagcauuaggaaagu

SEQ ID NO: 525650 - RNA, 13 nt, Chlamydophila pneumoniae J138
cuuaauuaaaaac

SEQ ID NO: 525651 - RNA, 16 nt, Chlamydophila pneumoniae J138
cuuaauauaaaagaag

SEQ ID NO: 525652 - RNA, 18 nt, Chlamydophila pneumoniae J138
cuuaauauaaaagaagac

SEQ ID NO: 525653 - RNA, 22 nt, Chlamydophila pneumoniae J138
cuuaauagggccauuagcaauc

SEQ ID NO: 525654 - RNA, 20 nt, Chlamydophila pneumoniae J138
cuuaaagagaaucuccucau

SEQ ID NO: 525655 - RNA, 16 nt, Chlamydophila pneumoniae J138
cuuaaagcuugagaaa

SEQ ID NO: 525656 - RNA, 17 nt, Chlamydophila pneumoniae J138
cuuaauuuccuucucca

SEQ ID NO: 525657 - RNA, 13 nt, Chlamydophila pneumoniae J138
cuuaauuuccuuc

SEQ ID NO: 525658 - RNA, 18 nt, Chlamydophila pneumoniae J138
cuuacaagcuuccuuggu

SEQ ID NO: 525659 - RNA, 19 nt, Chlamydophila pneumoniae J138
cuuacggccccuggaauuu

SEQ ID NO: 525660 - RNA, 23 nt, Chlamydophila pneumoniae J138
cuuacggccccuggaauuucucc

SEQ ID NO: 525661 - RNA, 14 nt, Chlamydophila pneumoniae J138
cuguugaucuucua

SEQ ID NO: 525662 - RNA, 19 nt, Chlamydophila pneumoniae J138
cuguugggagcuuccucca

SEQ ID NO: 525663 - RNA, 17 nt, Chlamydophila pneumoniae J138
cuguuggucucuauuua

SEQ ID NO: 525664 - RNA, 18 nt, Chlamydophila pneumoniae J138
cuguuguaauaaaagaaa

SEQ ID NO: 525665 - RNA, 20 nt, Chlamydophila pneumoniae J138
cuguuguaauaaaagaaaga

SEQ ID NO: 525666 - RNA, 23 nt, Chlamydophila pneumoniae J138
cuguuguacuaucacagccaucg

SEQ ID NO: 525667 - RNA, 13 nt, Chlamydophila pneumoniae J138
cuguuuacagaug

SEQ ID NO: 525668 - RNA, 19 nt, Chlamydophila pneumoniae J138
cugucguccuaauuuuccu

SEQ ID NO: 525669 - RNA, 18 nt, Chlamydophila pneumoniae J138
cugucuagaacacucaga

SEQ ID NO: 525670 - RNA, 18 nt, Chlamydophila pneumoniae J138
cuguuuucacauggccaa

SEQ ID NO: 525671 - RNA, 14 nt, Chlamydophila pneumoniae J138
cuguuuuggaaaga

SEQ ID NO: 525672 - RNA, 15 nt, Chlamydophila pneumoniae J138
cuguuuucuuuucug

SEQ ID NO: 525673 - RNA, 13 nt, Chlamydophila pneumoniae J138
cuguuuguuuauu

SEQ ID NO: 525674 - RNA, 19 nt, Chlamydophila pneumoniae J138
cuuaaaagagaacauguuu

SEQ ID NO: 525675 - RNA, 16 nt, Chlamydophila pneumoniae J138
cuuaaaaaacuuccua

SEQ ID NO: 525676 - RNA, 15 nt, Chlamydophila pneumoniae J138
cuguuuuuugaaaac

SEQ ID NO: 525677 - RNA, 17 nt, Chlamydophila pneumoniae J138
cuuaaaaaacuuccuaa

SEQ ID NO: 525678 - RNA, 17 nt, Chlamydophila pneumoniae J138
cuguuuuucguaagcug

SEQ ID NO: 525679 - RNA, 17 nt, Chlamydophila pneumoniae J138
cuguuuuucuuccacac

SEQ ID NO: 525680 - RNA, 23 nt, Chlamydophila pneumoniae J138
cugcuagagcuuucagaaaagaa

SEQ ID NO: 525681 - RNA, 17 nt, Chlamydophila pneumoniae J138
cugcuacuuuaaagugg

SEQ ID NO: 525682 - RNA, 23 nt, Chlamydophila pneumoniae J138
cugcuacgugaucaaaauuaucc

SEQ ID NO: 525683 - RNA, 14 nt, Chlamydophila pneumoniae J138
cugcucaaugacac

SEQ ID NO: 525684 - RNA, 14 nt, Chlamydophila pneumoniae J138
cugcuuuuuuucua

SEQ ID NO: 525685 - RNA, 20 nt, Chlamydophila pneumoniae J138
cugcuuuuuuucuagaguuc

SEQ ID NO: 525686 - RNA, 18 nt, Chlamydophila pneumoniae J138
cugcuuuuguuguuuuug

SEQ ID NO: 525687 - RNA, 14 nt, Chlamydophila pneumoniae J138
cugcuuuuguuguu

SEQ ID NO: 525688 - RNA, 24 nt, Chlamydophila pneumoniae J138
cugcuuugacgacucugccauguc

SEQ ID NO: 525689 - RNA, 15 nt, Chlamydophila pneumoniae J138
cugcuugucuacaga

SEQ ID NO: 525690 - RNA, 22 nt, Chlamydophila pneumoniae J138
cugcuugugaggcuauagcaua

SEQ ID NO: 525691 - RNA, 17 nt, Chlamydophila pneumoniae J138
cuggagagguaaccaga

SEQ ID NO: 525692 - RNA, 21 nt, Chlamydophila pneumoniae J138
cuggagacaacuauguuaucc

SEQ ID NO: 525693 - RNA, 21 nt, Chlamydophila pneumoniae J138
cuggagaaugccccuucguua

SEQ ID NO: 525694 - RNA, 18 nt, Chlamydophila pneumoniae J138
cuggaagaauuucauaag

SEQ ID NO: 525695 - RNA, 15 nt, Chlamydophila pneumoniae J138
cuggaaugacuaaau

SEQ ID NO: 525696 - RNA, 14 nt, Chlamydophila pneumoniae J138
cuggaaagccaagc

SEQ ID NO: 525697 - RNA, 12 nt, Chlamydophila pneumoniae J138
cuggaaagccaa

SEQ ID NO: 525698 - RNA, 17 nt, Chlamydophila pneumoniae J138
cuggaggcuguguaaaa

SEQ ID NO: 525699 - RNA, 17 nt, Chlamydophila pneumoniae J138
cuggauacguuuuuccc

SEQ ID NO: 525700 - RNA, 18 nt, Chlamydophila pneumoniae J138
cuggucuguauuuucuuc

SEQ ID NO: 525701 - RNA, 17 nt, Chlamydophila pneumoniae J138
cugguacuuauguacug

SEQ ID NO: 525702 - RNA, 18 nt, Chlamydophila pneumoniae J138
cugguccuaaaaaaagac

SEQ ID NO: 525703 - RNA, 16 nt, Chlamydophila pneumoniae J138
cuguaccacauacucu

SEQ ID NO: 525704 - RNA, 13 nt, Chlamydophila pneumoniae J138
cuguacgguaaau

SEQ ID NO: 525705 - RNA, 16 nt, Chlamydophila pneumoniae J138
cuguagugauacuuua

SEQ ID NO: 525706 - RNA, 13 nt, Chlamydophila pneumoniae J138
cuguaaagauucu

SEQ ID NO: 525707 - RNA, 16 nt, Chlamydophila pneumoniae J138
cuguaaauuucauuug

SEQ ID NO: 525708 - RNA, 20 nt, Chlamydophila pneumoniae J138
cuguaacacccucccucaua

SEQ ID NO: 525709 - RNA, 12 nt, Chlamydophila pneumoniae J138
cugucagaacaa

SEQ ID NO: 525710 - RNA, 17 nt, Chlamydophila pneumoniae J138
cugucacuaucuucuaa

SEQ ID NO: 525711 - RNA, 15 nt, Chlamydophila pneumoniae J138
cuguauuuucagcac

SEQ ID NO: 525712 - RNA, 22 nt, Chlamydophila pneumoniae J138
cuguauuaaagaaucuaacucu

SEQ ID NO: 525713 - RNA, 19 nt, Chlamydophila pneumoniae J138
cugucaauccaacaaagau

SEQ ID NO: 525714 - RNA, 16 nt, Chlamydophila pneumoniae J138
cugcauaaucucacca

SEQ ID NO: 525715 - RNA, 23 nt, Chlamydophila pneumoniae J138
cugcccauuuuuggaaaaccaug

SEQ ID NO: 525716 - RNA, 22 nt, Chlamydophila pneumoniae J138
cugcgugauuauuuaagaccaa

SEQ ID NO: 525717 - RNA, 17 nt, Chlamydophila pneumoniae J138
cugcgugauuauuuaag

SEQ ID NO: 525718 - RNA, 20 nt, Chlamydophila pneumoniae J138
cugcgugauuauuuaagacc

SEQ ID NO: 525719 - RNA, 17 nt, Chlamydophila pneumoniae J138
cugcguuaaacccuuca

SEQ ID NO: 525720 - RNA, 18 nt, Chlamydophila pneumoniae J138
cugcuaaacuuuuuuuca

SEQ ID NO: 525721 - RNA, 16 nt, Chlamydophila pneumoniae J138
cugcguuucuuucuga

SEQ ID NO: 525722 - RNA, 15 nt, Chlamydophila pneumoniae J138
cugcggaaggcuaaa

SEQ ID NO: 525723 - RNA, 16 nt, Chlamydophila pneumoniae J138
cugcgguagccuggag

SEQ ID NO: 525724 - RNA, 17 nt, Chlamydophila pneumoniae J138
cugauguuuuauagaua

SEQ ID NO: 525725 - RNA, 22 nt, Chlamydophila pneumoniae J138
cugauguugcccuacaauuucc

SEQ ID NO: 525726 - RNA, 21 nt, Chlamydophila pneumoniae J138
cugauuucuuuuucagcuucu

SEQ ID NO: 525727 - RNA, 21 nt, Chlamydophila pneumoniae J138
cugcaaagcccccucccccac

SEQ ID NO: 525728 - RNA, 16 nt, Chlamydophila pneumoniae J138
cugauuucuuuuucag

SEQ ID NO: 525729 - RNA, 20 nt, Chlamydophila pneumoniae J138
cugcacguggcuuuuguauu

SEQ ID NO: 525730 - RNA, 20 nt, Chlamydophila pneumoniae J138
cugcaguauuauaaauagaa

SEQ ID NO: 525731 - RNA, 19 nt, Chlamydophila pneumoniae J138
cugcaguauuauaaauaga

SEQ ID NO: 525732 - RNA, 21 nt, Chlamydophila pneumoniae J138
cugcaguauuauaaauagaaa

SEQ ID NO: 525733 - RNA, 20 nt, Chlamydophila pneumoniae J138
cugcagcaaaacuaggaaaa

SEQ ID NO: 525734 - RNA, 17 nt, Chlamydophila pneumoniae J138
cugcagagaaauucaug

SEQ ID NO: 525735 - RNA, 15 nt, Chlamydophila pneumoniae J138
cugaucccuuagaaa

SEQ ID NO: 525736 - RNA, 21 nt, Chlamydophila pneumoniae J138
cugauccucggcaucuuuggc

SEQ ID NO: 525737 - RNA, 19 nt, Chlamydophila pneumoniae J138
cugauacgcagcuagaggc

SEQ ID NO: 525738 - RNA, 21 nt, Chlamydophila pneumoniae J138
cugauagccuccauuuagaca

SEQ ID NO: 525739 - RNA, 15 nt, Chlamydophila pneumoniae J138
cugauaagaucauag

SEQ ID NO: 525740 - RNA, 23 nt, Chlamydophila pneumoniae J138
cugagucauaagcucuauuucug

SEQ ID NO: 525741 - RNA, 22 nt, Chlamydophila pneumoniae J138
cugaggcuauagaauacacagc

SEQ ID NO: 525742 - RNA, 17 nt, Chlamydophila pneumoniae J138
cugaguauuuugcaaau

SEQ ID NO: 525743 - RNA, 21 nt, Chlamydophila pneumoniae J138
cugagucauaagcucuauuuc

SEQ ID NO: 525744 - RNA, 16 nt, Chlamydophila pneumoniae J138
cugagcuaucuucaag

SEQ ID NO: 525745 - RNA, 14 nt, Chlamydophila pneumoniae J138
cugagcuaucuuca

SEQ ID NO: 525746 - RNA, 21 nt, Chlamydophila pneumoniae J138
cugaggaaaucgcauuacaaa

SEQ ID NO: 525747 - RNA, 12 nt, Chlamydophila pneumoniae J138
cugaggaaaucg

SEQ ID NO: 525748 - RNA, 19 nt, Chlamydophila pneumoniae J138
cucuauauuuuuucccaca

SEQ ID NO: 525749 - RNA, 17 nt, Chlamydophila pneumoniae J138
cucuauauuuuuuccca

SEQ ID NO: 525750 - RNA, 12 nt, Chlamydophila pneumoniae J138
cucuacucuaca

SEQ ID NO: 525751 - RNA, 23 nt, Chlamydophila pneumoniae J138
cucauuucguagacgcucuaaac

SEQ ID NO: 525752 - RNA, 18 nt, Chlamydophila pneumoniae J138
cuccaaaagaccaaaaau

SEQ ID NO: 525753 - RNA, 15 nt, Chlamydophila pneumoniae J138
cuccaaaacucaagg

SEQ ID NO: 525754 - RNA, 16 nt, Chlamydophila pneumoniae J138
cuccaaaaauucccau

SEQ ID NO: 525755 - RNA, 16 nt, Chlamydophila pneumoniae J138
cuccagaaauuuuuac

SEQ ID NO: 525756 - RNA, 20 nt, Chlamydophila pneumoniae J138
cuccagaaacgcagcuuucc

SEQ ID NO: 525757 - RNA, 14 nt, Chlamydophila pneumoniae J138
cuccagagcaagau

SEQ ID NO: 525758 - RNA, 12 nt, Chlamydophila pneumoniae J138
cuccagaagcaa

SEQ ID NO: 525759 - RNA, 16 nt, Chlamydophila pneumoniae J138
cuccagaagcaagaau

SEQ ID NO: 525760 - RNA, 13 nt, Chlamydophila pneumoniae J138
cuccagcauaagg

SEQ ID NO: 525761 - RNA, 23 nt, Chlamydophila pneumoniae J138
cuccagguagcagaguuuuuccc

SEQ ID NO: 525762 - RNA, 22 nt, Chlamydophila pneumoniae J138
cuccaggguguuugcauaguau

SEQ ID NO: 525763 - RNA, 17 nt, Chlamydophila pneumoniae J138
cuccaggggauaaaacu

SEQ ID NO: 525764 - RNA, 17 nt, Chlamydophila pneumoniae J138
cuccaguaucuucucuu

SEQ ID NO: 525765 - RNA, 23 nt, Chlamydophila pneumoniae J138
cuccaucggaauuugccugaaau

SEQ ID NO: 525766 - RNA, 15 nt, Chlamydophila pneumoniae J138
cuccauaagcuuuuc

SEQ ID NO: 525767 - RNA, 13 nt, Chlamydophila pneumoniae J138
cuccauacagcgc

SEQ ID NO: 525768 - RNA, 13 nt, Chlamydophila pneumoniae J138
cuccauuuagaau

SEQ ID NO: 525769 - RNA, 13 nt, Chlamydophila pneumoniae J138
cuccauuucuagg

SEQ ID NO: 525770 - RNA, 15 nt, Chlamydophila pneumoniae J138
cuccauuucuaggaa

SEQ ID NO: 525771 - RNA, 20 nt, Chlamydophila pneumoniae J138
cuccugacucuuauugcaga

SEQ ID NO: 525772 - RNA, 12 nt, Chlamydophila pneumoniae J138
cuccucaaaaga

SEQ ID NO: 525773 - RNA, 21 nt, Chlamydophila pneumoniae J138
cuccuaagucguuaacaucaa

SEQ ID NO: 525774 - RNA, 14 nt, Chlamydophila pneumoniae J138
cuccuagacagccu

SEQ ID NO: 525775 - RNA, 12 nt, Chlamydophila pneumoniae J138
cuccuaggggaa

SEQ ID NO: 525776 - RNA, 19 nt, Chlamydophila pneumoniae J138
cuccuaaaccaucacuucc

SEQ ID NO: 525777 - RNA, 21 nt, Chlamydophila pneumoniae J138
cuccuaaaccaucacuuccug

SEQ ID NO: 525778 - RNA, 18 nt, Chlamydophila pneumoniae J138
cuccgcccgucuuagaau

SEQ ID NO: 525779 - RNA, 22 nt, Chlamydophila pneumoniae J138
cucgacguauuugccaaaauaa

SEQ ID NO: 525780 - RNA, 20 nt, Chlamydophila pneumoniae J138
cucgacguauuugccaaaau

SEQ ID NO: 525781 - RNA, 18 nt, Chlamydophila pneumoniae J138
cucgacaccgauucgcua

SEQ ID NO: 525782 - RNA, 23 nt, Chlamydophila pneumoniae J138
cuccugcagggggcauucccuga

SEQ ID NO: 525783 - RNA, 21 nt, Chlamydophila pneumoniae J138
cuccugacucuuuuaagacaa

SEQ ID NO: 525784 - RNA, 21 nt, Chlamydophila pneumoniae J138
cucgccaaaccaugaggcugc

SEQ ID NO: 525785 - RNA, 14 nt, Chlamydophila pneumoniae J138
cucgcaaaagcugu

SEQ ID NO: 525786 - RNA, 17 nt, Chlamydophila pneumoniae J138
cucgauuugaucuugcu

SEQ ID NO: 525787 - RNA, 23 nt, Chlamydophila pneumoniae J138
cucgcuaaaguagaauccuucuc

SEQ ID NO: 525788 - RNA, 18 nt, Chlamydophila pneumoniae J138
cucgcuguuucaacaccu

SEQ ID NO: 525789 - RNA, 15 nt, Chlamydophila pneumoniae J138
cucggaaaucaggga

SEQ ID NO: 525790 - RNA, 13 nt, Chlamydophila pneumoniae J138
cucgggagaacau

SEQ ID NO: 525791 - RNA, 17 nt, Chlamydophila pneumoniae J138
cucguaauccuucuuuc

SEQ ID NO: 525792 - RNA, 16 nt, Chlamydophila pneumoniae J138
cucguacguggaaagu

SEQ ID NO: 525793 - RNA, 19 nt, Chlamydophila pneumoniae J138
cucgguuauuuuuccagaa

SEQ ID NO: 525794 - RNA, 14 nt, Chlamydophila pneumoniae J138
cucgugcauaauga

SEQ ID NO: 525795 - RNA, 21 nt, Chlamydophila pneumoniae J138
cucuaaaaacccuaguucauu

SEQ ID NO: 525796 - RNA, 21 nt, Chlamydophila pneumoniae J138
cucuaaaaaagauaaagcuac

SEQ ID NO: 525797 - RNA, 21 nt, Chlamydophila pneumoniae J138
cucuaaacauaaagacccuuc

SEQ ID NO: 525798 - RNA, 16 nt, Chlamydophila pneumoniae J138
cucuacaggagaagcg

SEQ ID NO: 525799 - RNA, 19 nt, Chlamydophila pneumoniae J138
cucuaccccacgcuaaacu

SEQ ID NO: 525800 - RNA, 16 nt, Chlamydophila pneumoniae J138
cucuaccaacugagcu

SEQ ID NO: 525801 - RNA, 15 nt, Chlamydophila pneumoniae J138
cucuaccaucaugaa

SEQ ID NO: 525802 - RNA, 22 nt, Chlamydophila pneumoniae J138
cucuacgcuauucuuaagcuac

SEQ ID NO: 525803 - RNA, 18 nt, Chlamydophila pneumoniae J138
cucuacuaaaaucucauu

SEQ ID NO: 525804 - RNA, 20 nt, Chlamydophila pneumoniae J138
cucuacuaaaaucucauuuc

SEQ ID NO: 525805 - RNA, 14 nt, Chlamydophila pneumoniae J138
cuaccuauauuuuu

SEQ ID NO: 525806 - RNA, 20 nt, Chlamydophila pneumoniae J138
cuaccguucgguuauuugcu

SEQ ID NO: 525807 - RNA, 24 nt, Chlamydophila pneumoniae J138
cuaccucugggaagacucucauca

SEQ ID NO: 525808 - RNA, 17 nt, Chlamydophila pneumoniae J138
cuaauacaucaccacug

SEQ ID NO: 525809 - RNA, 15 nt, Chlamydophila pneumoniae J138
cuaauacuuuaggag

SEQ ID NO: 525810 - RNA, 23 nt, Chlamydophila pneumoniae J138
cuaccuguguaaugagcuggaag

SEQ ID NO: 525811 - RNA, 16 nt, Chlamydophila pneumoniae J138
cuagaaaacgcucucc

SEQ ID NO: 525812 - RNA, 16 nt, Chlamydophila pneumoniae J138
cuacgugaucaaaauu

SEQ ID NO: 525813 - RNA, 19 nt, Chlamydophila pneumoniae J138
cuagaaagauuuauuuugu

SEQ ID NO: 525814 - RNA, 14 nt, Chlamydophila pneumoniae J138
cuagaaacugcucc

SEQ ID NO: 525815 - RNA, 18 nt, Chlamydophila pneumoniae J138
cuagaaacugcuccugaa

SEQ ID NO: 525816 - RNA, 12 nt, Chlamydophila pneumoniae J138
cuagaaauauac

SEQ ID NO: 525817 - RNA, 16 nt, Chlamydophila pneumoniae J138
cuagaacacucagaga

SEQ ID NO: 525818 - RNA, 18 nt, Chlamydophila pneumoniae J138
cuagaacacucagagaug

SEQ ID NO: 525819 - RNA, 23 nt, Chlamydophila pneumoniae J138
cuagagcuucaaguuucuuuugc

SEQ ID NO: 525820 - RNA, 18 nt, Chlamydophila pneumoniae J138
cuagagcucugaaauaaa

SEQ ID NO: 525821 - RNA, 20 nt, Chlamydophila pneumoniae J138
cuagagcauuccgagcugca

SEQ ID NO: 525822 - RNA, 20 nt, Chlamydophila pneumoniae J138
cuagagcacauagaaacagu

SEQ ID NO: 525823 - RNA, 16 nt, Chlamydophila pneumoniae J138
cuagagcacauagaaa

SEQ ID NO: 525824 - RNA, 19 nt, Chlamydophila pneumoniae J138
cuagagcacauagaaacag

SEQ ID NO: 525825 - RNA, 21 nt, Chlamydophila pneumoniae J138
cuagagauuguaauuuccuua

SEQ ID NO: 525826 - RNA, 16 nt, Chlamydophila pneumoniae J138
cuagagauuguaauuu

SEQ ID NO: 525827 - RNA, 15 nt, Chlamydophila pneumoniae J138
cuagagauccaauga

SEQ ID NO: 525828 - RNA, 20 nt, Chlamydophila pneumoniae J138
cuagagaucuuuuuauuaaa

SEQ ID NO: 525829 - RNA, 18 nt, Chlamydophila pneumoniae J138
cuagaagacauucauuuu

SEQ ID NO: 525830 - RNA, 17 nt, Chlamydophila pneumoniae J138
cuagagguauuuccuuc

SEQ ID NO: 525831 - RNA, 19 nt, Chlamydophila pneumoniae J138
cuagagcuuucagaaaaga

SEQ ID NO: 525832 - RNA, 15 nt, Chlamydophila pneumoniae J138
cuagaggaucuucaa

SEQ ID NO: 525833 - RNA, 22 nt, Chlamydophila pneumoniae J138
cuagaguccaagguucugggaa

SEQ ID NO: 525834 - RNA, 13 nt, Chlamydophila pneumoniae J138
cuagaguccaagg

SEQ ID NO: 525835 - RNA, 21 nt, Chlamydophila pneumoniae J138
cuagaguccaagguucuggga

SEQ ID NO: 525836 - RNA, 14 nt, Chlamydophila pneumoniae J138
cuagagucucuuuc

SEQ ID NO: 525837 - RNA, 14 nt, Chlamydophila pneumoniae J138
cuagaguucauuuu

SEQ ID NO: 525838 - RNA, 14 nt, Chlamydophila pneumoniae J138
cuagcagagaaauu

SEQ ID NO: 525839 - RNA, 22 nt, Chlamydophila pneumoniae J138
cuauccuucgaccuauuugcaa

SEQ ID NO: 525840 - RNA, 13 nt, Chlamydophila pneumoniae J138
cuauccuauuuua

SEQ ID NO: 525841 - RNA, 16 nt, Chlamydophila pneumoniae J138
cuauauccacaaucuc

SEQ ID NO: 525842 - RNA, 20 nt, Chlamydophila pneumoniae J138
cuauacucucuguagcacuu

SEQ ID NO: 525843 - RNA, 21 nt, Chlamydophila pneumoniae J138
cuauaucgccguuaaagacuu

SEQ ID NO: 525844 - RNA, 20 nt, Chlamydophila pneumoniae J138
cuaucgauagccauuagaau

SEQ ID NO: 525845 - RNA, 14 nt, Chlamydophila pneumoniae J138
cuaucgaagagccc

SEQ ID NO: 525846 - RNA, 16 nt, Chlamydophila pneumoniae J138
cuaucucuguuuuuug

SEQ ID NO: 525847 - RNA, 19 nt, Chlamydophila pneumoniae J138
cuaugauccgaaaacucuu

SEQ ID NO: 525848 - RNA, 21 nt, Chlamydophila pneumoniae J138
cuaugaucgggguuucagaag

SEQ ID NO: 525849 - RNA, 15 nt, Chlamydophila pneumoniae J138
cuaugauaucaccag

SEQ ID NO: 525850 - RNA, 19 nt, Chlamydophila pneumoniae J138
cuaugggaggaauuccucu

SEQ ID NO: 525851 - RNA, 19 nt, Chlamydophila pneumoniae J138
cuauggucucccucacaag

SEQ ID NO: 525852 - RNA, 21 nt, Chlamydophila pneumoniae J138
cuaugggaggaauuccucuca

SEQ ID NO: 525853 - RNA, 20 nt, Chlamydophila pneumoniae J138
cuaugggaggaauuccucuc

SEQ ID NO: 525854 - RNA, 20 nt, Chlamydophila pneumoniae J138
cuaugguaagggauccauga

SEQ ID NO: 525855 - RNA, 23 nt, Chlamydophila pneumoniae J138
cuaucuuuauuuaaauaaaacca

SEQ ID NO: 525856 - RNA, 13 nt, Chlamydophila pneumoniae J138
cuaucgaagagcc

SEQ ID NO: 525857 - RNA, 23 nt, Chlamydophila pneumoniae J138
cuaugaggacgacgcaucuccuc

SEQ ID NO: 525858 - RNA, 17 nt, Chlamydophila pneumoniae J138
cuauaaagcaaaugccu

SEQ ID NO: 525859 - RNA, 20 nt, Chlamydophila pneumoniae J138
cuaggccgggauuuuaauuc

SEQ ID NO: 525860 - RNA, 19 nt, Chlamydophila pneumoniae J138
cuaggacagcacauagagu

SEQ ID NO: 525861 - RNA, 17 nt, Chlamydophila pneumoniae J138
cuaggaaucuuuuagag

SEQ ID NO: 525862 - RNA, 15 nt, Chlamydophila pneumoniae J138
cuauaacuacaaaau

SEQ ID NO: 525863 - RNA, 17 nt, Chlamydophila pneumoniae J138
cuauaauuaauccuuga

SEQ ID NO: 525864 - RNA, 22 nt, Chlamydophila pneumoniae J138
cuauagaauacacagcuaugau

SEQ ID NO: 525865 - RNA, 14 nt, Chlamydophila pneumoniae J138
cucaaggcaucuag

SEQ ID NO: 525866 - RNA, 21 nt, Chlamydophila pneumoniae J138
cucaaguaagaagucuucagg

SEQ ID NO: 525867 - RNA, 21 nt, Chlamydophila pneumoniae J138
cucaagucuauuugaaaagaa

SEQ ID NO: 525868 - RNA, 20 nt, Chlamydophila pneumoniae J138
cucaaggucacagcauuuuc

SEQ ID NO: 525869 - RNA, 16 nt, Chlamydophila pneumoniae J138
cucacauguuucacuu

SEQ ID NO: 525870 - RNA, 20 nt, Chlamydophila pneumoniae J138
cuauuucuuaauuuccuucu

SEQ ID NO: 525871 - RNA, 13 nt, Chlamydophila pneumoniae J138
cuauuugaaaaga

SEQ ID NO: 525872 - RNA, 21 nt, Chlamydophila pneumoniae J138
cuauuugcaacaaucuuucuu

SEQ ID NO: 525873 - RNA, 18 nt, Chlamydophila pneumoniae J138
cuauuucauauaaaguuu

SEQ ID NO: 525874 - RNA, 14 nt, Chlamydophila pneumoniae J138
cuauuguuuguccu

SEQ ID NO: 525875 - RNA, 15 nt, Chlamydophila pneumoniae J138
cuauuacuagauccc

SEQ ID NO: 525876 - RNA, 15 nt, Chlamydophila pneumoniae J138
cuauuaauacuuugc

SEQ ID NO: 525877 - RNA, 18 nt, Chlamydophila pneumoniae J138
cuauuaaggauuccuuga

SEQ ID NO: 525878 - RNA, 14 nt, Chlamydophila pneumoniae J138
cucaaagaaagucu

SEQ ID NO: 525879 - RNA, 20 nt, Chlamydophila pneumoniae J138
cucaaagaaagucucucuaa

SEQ ID NO: 525880 - RNA, 15 nt, Chlamydophila pneumoniae J138
cucauauuuugucuu

SEQ ID NO: 525881 - RNA, 23 nt, Chlamydophila pneumoniae J138
cucaucagaaguggccuugccag

SEQ ID NO: 525882 - RNA, 21 nt, Chlamydophila pneumoniae J138
cucaucagaagccaccaaaaa

SEQ ID NO: 525883 - RNA, 19 nt, Chlamydophila pneumoniae J138
cucaucacaauuuuaaaau

SEQ ID NO: 525884 - RNA, 17 nt, Chlamydophila pneumoniae J138
cucaucagcaaaacucc

SEQ ID NO: 525885 - RNA, 16 nt, Chlamydophila pneumoniae J138
cucauccucaucauca

SEQ ID NO: 525886 - RNA, 23 nt, Chlamydophila pneumoniae J138
cucaucgaaucuugauauugaaa

SEQ ID NO: 525887 - RNA, 16 nt, Chlamydophila pneumoniae J138
cucaucuagaaagauu

SEQ ID NO: 525888 - RNA, 21 nt, Chlamydophila pneumoniae J138
cucaucuaacgucagcugucc

SEQ ID NO: 525889 - RNA, 17 nt, Chlamydophila pneumoniae J138
cucaucggaucuuuucu

SEQ ID NO: 525890 - RNA, 19 nt, Chlamydophila pneumoniae J138
cucaucggaucuuuucuuu

SEQ ID NO: 525891 - RNA, 16 nt, Chlamydophila pneumoniae J138
cucaucggaucuuuuc

SEQ ID NO: 525892 - RNA, 19 nt, Chlamydophila pneumoniae J138
cucaugucuaagucagagg

SEQ ID NO: 525893 - RNA, 15 nt, Chlamydophila pneumoniae J138
cucauggauuacuga

SEQ ID NO: 525894 - RNA, 15 nt, Chlamydophila pneumoniae J138
cucaggaaaacuuaa

SEQ ID NO: 525895 - RNA, 23 nt, Chlamydophila pneumoniae J138
cucaggaccuaagggcucuccua

SEQ ID NO: 525896 - RNA, 13 nt, Chlamydophila pneumoniae J138
cucaggaaaacuu

SEQ ID NO: 525897 - RNA, 16 nt, Chlamydophila pneumoniae J138
cucagcuaauuuaaau

SEQ ID NO: 525898 - RNA, 14 nt, Chlamydophila pneumoniae J138
cucagcaaagacau

SEQ ID NO: 525899 - RNA, 22 nt, Chlamydophila pneumoniae J138
cucagcaaagacauccaagccu

SEQ ID NO: 525900 - RNA, 20 nt, Chlamydophila pneumoniae J138
cucagaauccauuuugccca

SEQ ID NO: 525901 - RNA, 18 nt, Chlamydophila pneumoniae J138
cguggcuuccauaacgag

SEQ ID NO: 525902 - RNA, 17 nt, Chlamydophila pneumoniae J138
cguggcuuuguaaaaau

SEQ ID NO: 525903 - RNA, 18 nt, Chlamydophila pneumoniae J138
cgugguaucccugagcac

SEQ ID NO: 525904 - RNA, 14 nt, Chlamydophila pneumoniae J138
cgugcucugcaauc

SEQ ID NO: 525905 - RNA, 14 nt, Chlamydophila pneumoniae J138
cgugcucucuucuu

SEQ ID NO: 525906 - RNA, 13 nt, Chlamydophila pneumoniae J138
cguggagcaucau

SEQ ID NO: 525907 - RNA, 15 nt, Chlamydophila pneumoniae J138
cguuaauaagaaccu

SEQ ID NO: 525908 - RNA, 15 nt, Chlamydophila pneumoniae J138
cguuaccaaaaacug

SEQ ID NO: 525909 - RNA, 14 nt, Chlamydophila pneumoniae J138
cguuaaaaacuauc

SEQ ID NO: 525910 - RNA, 17 nt, Chlamydophila pneumoniae J138
cguuagaacucgaauug

SEQ ID NO: 525911 - RNA, 18 nt, Chlamydophila pneumoniae J138
cuaaagagaucacaggga

SEQ ID NO: 525912 - RNA, 20 nt, Chlamydophila pneumoniae J138
cuaaagcaggagcaucauua

SEQ ID NO: 525913 - RNA, 22 nt, Chlamydophila pneumoniae J138
cuaaagaauuuguaacucuuaa

SEQ ID NO: 525914 - RNA, 22 nt, Chlamydophila pneumoniae J138
cuaaacgacguuuaauuccuug

SEQ ID NO: 525915 - RNA, 12 nt, Chlamydophila pneumoniae J138
cuaaacuuuuuu

SEQ ID NO: 525916 - RNA, 16 nt, Chlamydophila pneumoniae J138
cuaaagaagauucaag

SEQ ID NO: 525917 - RNA, 23 nt, Chlamydophila pneumoniae J138
cuaaagaaagagucucacucuuu

SEQ ID NO: 525918 - RNA, 16 nt, Chlamydophila pneumoniae J138
cuaaauuaguaaaugc

SEQ ID NO: 525919 - RNA, 20 nt, Chlamydophila pneumoniae J138
cuaaauuaguaaaugccucu

SEQ ID NO: 525920 - RNA, 18 nt, Chlamydophila pneumoniae J138
cuaaauuugucaucacau

SEQ ID NO: 525921 - RNA, 19 nt, Chlamydophila pneumoniae J138
cuaacaagauaaccugaga

SEQ ID NO: 525922 - RNA, 13 nt, Chlamydophila pneumoniae J138
cuaacaacuucug

SEQ ID NO: 525923 - RNA, 16 nt, Chlamydophila pneumoniae J138
cuaacaacuucugaca

SEQ ID NO: 525924 - RNA, 18 nt, Chlamydophila pneumoniae J138
cuaacaagauaaccugag

SEQ ID NO: 525925 - RNA, 20 nt, Chlamydophila pneumoniae J138
cuaacgaagccucacagaau

SEQ ID NO: 525926 - RNA, 23 nt, Chlamydophila pneumoniae J138
cuaacgaagugaggagaauagca

SEQ ID NO: 525927 - RNA, 15 nt, Chlamydophila pneumoniae J138
cuaacgacauugaag

SEQ ID NO: 525928 - RNA, 15 nt, Chlamydophila pneumoniae J138
cuaacuuauccucag

SEQ ID NO: 525929 - RNA, 16 nt, Chlamydophila pneumoniae J138
cuaacuuagagcgaau

SEQ ID NO: 525930 - RNA, 15 nt, Chlamydophila pneumoniae J138
cuaacgcaacaucca

SEQ ID NO: 525931 - RNA, 20 nt, Chlamydophila pneumoniae J138
cuaacgaugcaggccaggag

SEQ ID NO: 525932 - RNA, 16 nt, Chlamydophila pneumoniae J138
cuaagcauucgacucu

SEQ ID NO: 525933 - RNA, 21 nt, Chlamydophila pneumoniae J138
cuaagaagcucacucuuuaaa

SEQ ID NO: 525934 - RNA, 14 nt, Chlamydophila pneumoniae J138
cuaagaaugagaac

SEQ ID NO: 525935 - RNA, 20 nt, Chlamydophila pneumoniae J138
cuaagaaucuauaaauucaa

SEQ ID NO: 525936 - RNA, 21 nt, Chlamydophila pneumoniae J138
cuaagcucuuaauuucugcug

SEQ ID NO: 525937 - RNA, 20 nt, Chlamydophila pneumoniae J138
cuaagcugugcauuuucuuc

SEQ ID NO: 525938 - RNA, 20 nt, Chlamydophila pneumoniae J138
cuaagucuccauaauucugc

SEQ ID NO: 525939 - RNA, 22 nt, Chlamydophila pneumoniae J138
cguuuguuuugcuuuuugaaug

SEQ ID NO: 525940 - RNA, 19 nt, Chlamydophila pneumoniae J138
cguuuccgaucauuuuugc

SEQ ID NO: 525941 - RNA, 16 nt, Chlamydophila pneumoniae J138
cguuuuuuuugauuuc

SEQ ID NO: 525942 - RNA, 14 nt, Chlamydophila pneumoniae J138
cuaaaacuucuugu

SEQ ID NO: 525943 - RNA, 17 nt, Chlamydophila pneumoniae J138
cuaaaagcacuuaaaaa

SEQ ID NO: 525944 - RNA, 17 nt, Chlamydophila pneumoniae J138
cuaaaccuaaaauggug

SEQ ID NO: 525945 - RNA, 19 nt, Chlamydophila pneumoniae J138
cuaaacccuguccaacuaa

SEQ ID NO: 525946 - RNA, 15 nt, Chlamydophila pneumoniae J138
cuaaaaccacagaau

SEQ ID NO: 525947 - RNA, 18 nt, Chlamydophila pneumoniae J138
cuaaaaaggucagcccug

SEQ ID NO: 525948 - RNA, 17 nt, Chlamydophila pneumoniae J138
cuaaaaacuucccaucu

SEQ ID NO: 525949 - RNA, 13 nt, Chlamydophila pneumoniae J138
cguuuagcuauuu

SEQ ID NO: 525950 - RNA, 18 nt, Chlamydophila pneumoniae J138
cguuuaauuccuuggauu

SEQ ID NO: 525951 - RNA, 18 nt, Chlamydophila pneumoniae J138
cguucuuucaauaacaga

SEQ ID NO: 525952 - RNA, 17 nt, Chlamydophila pneumoniae J138
cgucgcuaaugcuaucc

SEQ ID NO: 525953 - RNA, 20 nt, Chlamydophila pneumoniae J138
cguccaguucuucauuccag

SEQ ID NO: 525954 - RNA, 18 nt, Chlamydophila pneumoniae J138
cguccagccugcaccaga

SEQ ID NO: 525955 - RNA, 14 nt, Chlamydophila pneumoniae J138
cguacuucacuucu

SEQ ID NO: 525956 - RNA, 17 nt, Chlamydophila pneumoniae J138
cgucuauuagauuuccu

SEQ ID NO: 525957 - RNA, 22 nt, Chlamydophila pneumoniae J138
cgucuaaaauaaccccuccaaa

SEQ ID NO: 525958 - RNA, 14 nt, Chlamydophila pneumoniae J138
cgucuccaacaguc

SEQ ID NO: 525959 - RNA, 20 nt, Chlamydophila pneumoniae J138
cgucuuagaauccaaagacu

SEQ ID NO: 525960 - RNA, 17 nt, Chlamydophila pneumoniae J138
cgucuucaauagaacga

SEQ ID NO: 525961 - RNA, 15 nt, Chlamydophila pneumoniae J138
cgucuucucugcauc

SEQ ID NO: 525962 - RNA, 16 nt, Chlamydophila pneumoniae J138
cgucuuugcuuucuag

SEQ ID NO: 525963 - RNA, 18 nt, Chlamydophila pneumoniae J138
cgugaauaucaucacuaa

SEQ ID NO: 525964 - RNA, 16 nt, Chlamydophila pneumoniae J138
cgugaagcagaggguu

SEQ ID NO: 525965 - RNA, 23 nt, Chlamydophila pneumoniae J138
cgugaauauguacugaugugaag

SEQ ID NO: 525966 - RNA, 20 nt, Chlamydophila pneumoniae J138
cgugacugcguugauguauu

SEQ ID NO: 525967 - RNA, 19 nt, Chlamydophila pneumoniae J138
cgugagaggaucgugaagu

SEQ ID NO: 525968 - RNA, 13 nt, Chlamydophila pneumoniae J138
cgugcaggagaac

SEQ ID NO: 525969 - RNA, 17 nt, Chlamydophila pneumoniae J138
cgcgggauggacugaug

SEQ ID NO: 525970 - RNA, 17 nt, Chlamydophila pneumoniae J138
cgcuaccauaucuugag

SEQ ID NO: 525971 - RNA, 19 nt, Chlamydophila pneumoniae J138
cgcguuggugaugauuuga

SEQ ID NO: 525972 - RNA, 22 nt, Chlamydophila pneumoniae J138
cgcguuccuguaguuugcagag

SEQ ID NO: 525973 - RNA, 15 nt, Chlamydophila pneumoniae J138
cgcuagccauagugu

SEQ ID NO: 525974 - RNA, 21 nt, Chlamydophila pneumoniae J138
cgcucuugauagcuaagagca

SEQ ID NO: 525975 - RNA, 20 nt, Chlamydophila pneumoniae J138
cgcuuccgacggagagagau

SEQ ID NO: 525976 - RNA, 12 nt, Chlamydophila pneumoniae J138
cgcuucuuuuug

SEQ ID NO: 525977 - RNA, 19 nt, Chlamydophila pneumoniae J138
cgcuuugauaauagucuuc

SEQ ID NO: 525978 - RNA, 22 nt, Chlamydophila pneumoniae J138
cgcuuucuuuuauuaagggaag

SEQ ID NO: 525979 - RNA, 16 nt, Chlamydophila pneumoniae J138
cgcuuucgggaauaau

SEQ ID NO: 525980 - RNA, 17 nt, Chlamydophila pneumoniae J138
cggaacaacuuugaggc

SEQ ID NO: 525981 - RNA, 19 nt, Chlamydophila pneumoniae J138
cggaaggaguucuuuuuua

SEQ ID NO: 525982 - RNA, 15 nt, Chlamydophila pneumoniae J138
cggacgcuagagaca

SEQ ID NO: 525983 - RNA, 12 nt, Chlamydophila pneumoniae J138
cggagaccaaaa

SEQ ID NO: 525984 - RNA, 19 nt, Chlamydophila pneumoniae J138
cggagaacuuccugauucu

SEQ ID NO: 525985 - RNA, 17 nt, Chlamydophila pneumoniae J138
cggagacucagagaaaa

SEQ ID NO: 525986 - RNA, 22 nt, Chlamydophila pneumoniae J138
cggacuccgucuccuaucagag

SEQ ID NO: 525987 - RNA, 23 nt, Chlamydophila pneumoniae J138
cggaguccuucuugcaaagauaa

SEQ ID NO: 525988 - RNA, 21 nt, Chlamydophila pneumoniae J138
cggaguccuucuugcaaagau

SEQ ID NO: 525989 - RNA, 16 nt, Chlamydophila pneumoniae J138
cggaguuaucaaaagg

SEQ ID NO: 525990 - RNA, 17 nt, Chlamydophila pneumoniae J138
cggaguaacuaauaauc

SEQ ID NO: 525991 - RNA, 14 nt, Chlamydophila pneumoniae J138
cggccaucauuaag

SEQ ID NO: 525992 - RNA, 21 nt, Chlamydophila pneumoniae J138
cggcugcgguagccuggaggc

SEQ ID NO: 525993 - RNA, 14 nt, Chlamydophila pneumoniae J138
cggcucucuucauu

SEQ ID NO: 525994 - RNA, 16 nt, Chlamydophila pneumoniae J138
cgggguuguauuuccu

SEQ ID NO: 525995 - RNA, 17 nt, Chlamydophila pneumoniae J138
cggguguggcaaaggac

SEQ ID NO: 525996 - RNA, 13 nt, Chlamydophila pneumoniae J138
cguaacugaggca

SEQ ID NO: 525997 - RNA, 23 nt, Chlamydophila pneumoniae J138
cguaauacggacuucacaaagaa

SEQ ID NO: 525998 - RNA, 23 nt, Chlamydophila pneumoniae J138
cguaauagcgacaugagaaaucu

SEQ ID NO: 525999 - RNA, 17 nt, Chlamydophila pneumoniae J138
cgguucggucucuucuc

SEQ ID NO: 526000 - RNA, 14 nt, Chlamydophila pneumoniae J138
cguaaaaagaaaga

SEQ ID NO: 526001 - RNA, 18 nt, Chlamydophila pneumoniae J138
cguaauccuucuuucugc

SEQ ID NO: 526002 - RNA, 18 nt, Chlamydophila pneumoniae J138
cguaaugcuuagccaugg

SEQ ID NO: 526003 - RNA, 15 nt, Chlamydophila pneumoniae J138
cguaaucuuuuuuaa

SEQ ID NO: 526004 - RNA, 17 nt, Chlamydophila pneumoniae J138
cguaaucuuuuuuaaag

SEQ ID NO: 526005 - RNA, 18 nt, Chlamydophila pneumoniae J138
cguacgcaaguaaagaaa

SEQ ID NO: 526006 - RNA, 12 nt, Chlamydophila pneumoniae J138
cggucucuucuc

SEQ ID NO: 526007 - RNA, 11 nt, Chlamydophila pneumoniae J138
cggucuuucuu

SEQ ID NO: 526008 - RNA, 11 nt, Chlamydophila pneumoniae J138
cccucuucauc

SEQ ID NO: 526009 - RNA, 23 nt, Chlamydophila pneumoniae J138
cccucuucauccgaagacucaaa

SEQ ID NO: 526010 - RNA, 12 nt, Chlamydophila pneumoniae J138
cccucuucuucc

SEQ ID NO: 526011 - RNA, 14 nt, Chlamydophila pneumoniae J138
cccucuccagaagu

SEQ ID NO: 526012 - RNA, 23 nt, Chlamydophila pneumoniae J138
cccucgguuauuuuuccagaaau

SEQ ID NO: 526013 - RNA, 18 nt, Chlamydophila pneumoniae J138
cccugaaugcaacagagu

SEQ ID NO: 526014 - RNA, 18 nt, Chlamydophila pneumoniae J138
cccugcaccaauugcagu

SEQ ID NO: 526015 - RNA, 17 nt, Chlamydophila pneumoniae J138
cccuggucuguauuuuc

SEQ ID NO: 526016 - RNA, 14 nt, Chlamydophila pneumoniae J138
cccuguauuaaaga

SEQ ID NO: 526017 - RNA, 19 nt, Chlamydophila pneumoniae J138
cccuuacgguaauccccaa

SEQ ID NO: 526018 - RNA, 12 nt, Chlamydophila pneumoniae J138
ccgaacagagcg

SEQ ID NO: 526019 - RNA, 17 nt, Chlamydophila pneumoniae J138
ccgaagcauucccgacu

SEQ ID NO: 526020 - RNA, 13 nt, Chlamydophila pneumoniae J138
ccgaagcauuccc

SEQ ID NO: 526021 - RNA, 16 nt, Chlamydophila pneumoniae J138
ccgaucauuuuugcua

SEQ ID NO: 526022 - RNA, 19 nt, Chlamydophila pneumoniae J138
ccgcacucauaggguaguu

SEQ ID NO: 526023 - RNA, 16 nt, Chlamydophila pneumoniae J138
ccgccguggaauagcu

SEQ ID NO: 526024 - RNA, 23 nt, Chlamydophila pneumoniae J138
ccgcucuaagcugugcauuuucu

SEQ ID NO: 526025 - RNA, 17 nt, Chlamydophila pneumoniae J138
ccggcgguggaaaagga

SEQ ID NO: 526026 - RNA, 14 nt, Chlamydophila pneumoniae J138
ccgggaaacaucag

SEQ ID NO: 526027 - RNA, 17 nt, Chlamydophila pneumoniae J138
ccggcuuguaggaucug

SEQ ID NO: 526028 - RNA, 16 nt, Chlamydophila pneumoniae J138
ccguauaacuuuaugu

SEQ ID NO: 526029 - RNA, 20 nt, Chlamydophila pneumoniae J138
ccguaggguauccugcucca

SEQ ID NO: 526030 - RNA, 21 nt, Chlamydophila pneumoniae J138
ccguaggguagccauccacga

SEQ ID NO: 526031 - RNA, 18 nt, Chlamydophila pneumoniae J138
ccguaaagaaaagcaauc

SEQ ID NO: 526032 - RNA, 15 nt, Chlamydophila pneumoniae J138
ccgugacuccagaag

SEQ ID NO: 526033 - RNA, 16 nt, Chlamydophila pneumoniae J138
ccguggaauagcuucu

SEQ ID NO: 526034 - RNA, 14 nt, Chlamydophila pneumoniae J138
ccguuuccuccucu

SEQ ID NO: 526035 - RNA, 13 nt, Chlamydophila pneumoniae J138
ccguuugucccuu

SEQ ID NO: 526036 - RNA, 21 nt, Chlamydophila pneumoniae J138
ccuacaggcaggccacuuccu

SEQ ID NO: 526037 - RNA, 14 nt, Chlamydophila pneumoniae J138
ccuacaucugugau

SEQ ID NO: 526038 - RNA, 17 nt, Chlamydophila pneumoniae J138
ccuacauggaucccugu

SEQ ID NO: 526039 - RNA, 19 nt, Chlamydophila pneumoniae J138
ccuaauucucgagcagcug

SEQ ID NO: 526040 - RNA, 23 nt, Chlamydophila pneumoniae J138
ccuaacuaucucuguuuuuugaa

SEQ ID NO: 526041 - RNA, 15 nt, Chlamydophila pneumoniae J138
ccuaacggcuugccu

SEQ ID NO: 526042 - RNA, 16 nt, Chlamydophila pneumoniae J138
ccuaacuaucucuguu

SEQ ID NO: 526043 - RNA, 13 nt, Chlamydophila pneumoniae J138
ccucaucaucaga

SEQ ID NO: 526044 - RNA, 17 nt, Chlamydophila pneumoniae J138
ccucauccccucagaaa

SEQ ID NO: 526045 - RNA, 23 nt, Chlamydophila pneumoniae J138
ccucaucagaagccaccaaaaau

SEQ ID NO: 526046 - RNA, 19 nt, Chlamydophila pneumoniae J138
ccucauccccucagaaagg

SEQ ID NO: 526047 - RNA, 16 nt, Chlamydophila pneumoniae J138
ccucauucaaggcgcc

SEQ ID NO: 526048 - RNA, 22 nt, Chlamydophila pneumoniae J138
ccuacgacaugccuaaauagcu

SEQ ID NO: 526049 - RNA, 11 nt, Chlamydophila pneumoniae J138
ccuaccugcua

SEQ ID NO: 526050 - RNA, 18 nt, Chlamydophila pneumoniae J138
ccuaccucugggaagacu

SEQ ID NO: 526051 - RNA, 14 nt, Chlamydophila pneumoniae J138
ccuacccaauuugu

SEQ ID NO: 526052 - RNA, 14 nt, Chlamydophila pneumoniae J138
ccuccaccaggagc

SEQ ID NO: 526053 - RNA, 15 nt, Chlamydophila pneumoniae J138
ccuccaccagaagca

SEQ ID NO: 526054 - RNA, 21 nt, Chlamydophila pneumoniae J138
ccuccaaaaucaucagcuccg

SEQ ID NO: 526055 - RNA, 22 nt, Chlamydophila pneumoniae J138
ccuccaaaagaccaaaaauaaa

SEQ ID NO: 526056 - RNA, 17 nt, Chlamydophila pneumoniae J138
ccuccauaaugcugaga

SEQ ID NO: 526057 - RNA, 22 nt, Chlamydophila pneumoniae J138
ccuccgaggagggaaacaccgu

SEQ ID NO: 526058 - RNA, 21 nt, Chlamydophila pneumoniae J138
ccuccgauugcuaaucccuuc

SEQ ID NO: 526059 - RNA, 21 nt, Chlamydophila pneumoniae J138
ccuccgaggagggaaacaccg

SEQ ID NO: 526060 - RNA, 22 nt, Chlamydophila pneumoniae J138
ccuccugcagggggcauucccu

SEQ ID NO: 526061 - RNA, 11 nt, Chlamydophila pneumoniae J138
ccuccucuucu

SEQ ID NO: 526062 - RNA, 20 nt, Chlamydophila pneumoniae J138
ccuccucuucuauucugaua

SEQ ID NO: 526063 - RNA, 21 nt, Chlamydophila pneumoniae J138
ccucgguuauuuuuccagaaa

SEQ ID NO: 526064 - RNA, 13 nt, Chlamydophila pneumoniae J138
ccugaaaaaacag

SEQ ID NO: 526065 - RNA, 19 nt, Chlamydophila pneumoniae J138
ccucuuuuauauaccacua

SEQ ID NO: 526066 - RNA, 17 nt, Chlamydophila pneumoniae J138
ccugaagccaugacaaa

SEQ ID NO: 526067 - RNA, 13 nt, Chlamydophila pneumoniae J138
ccugaagcagcuu

SEQ ID NO: 526068 - RNA, 16 nt, Chlamydophila pneumoniae J138
ccugaaauccugggca

SEQ ID NO: 526069 - RNA, 23 nt, Chlamydophila pneumoniae J138
ccugaaaguacagaaaggaccuc

SEQ ID NO: 526070 - RNA, 19 nt, Chlamydophila pneumoniae J138
ccucugauuauuucuaaaa

SEQ ID NO: 526071 - RNA, 22 nt, Chlamydophila pneumoniae J138
ccucuaaacauaaagacccuuc

SEQ ID NO: 526072 - RNA, 18 nt, Chlamydophila pneumoniae J138
ccucucacauuugcagac

SEQ ID NO: 526073 - RNA, 14 nt, Chlamydophila pneumoniae J138
ccucucccuuggga

SEQ ID NO: 526074 - RNA, 22 nt, Chlamydophila pneumoniae J138
ccugcaguauuauaaauagaaa

SEQ ID NO: 526075 - RNA, 14 nt, Chlamydophila pneumoniae J138
ccuggauuuaggau

SEQ ID NO: 526076 - RNA, 16 nt, Chlamydophila pneumoniae J138
ccugcuaaacuuuuuu

SEQ ID NO: 526077 - RNA, 21 nt, Chlamydophila pneumoniae J138
ccuggaggcgguggcaugcca

SEQ ID NO: 526078 - RNA, 23 nt, Chlamydophila pneumoniae J138
ccugggcucacucuaagcgaaac

SEQ ID NO: 526079 - RNA, 21 nt, Chlamydophila pneumoniae J138
ccugggcuuauuauugaauaa

SEQ ID NO: 526080 - RNA, 22 nt, Chlamydophila pneumoniae J138
ccugggcuuauuauugaauaag

SEQ ID NO: 526081 - RNA, 19 nt, Chlamydophila pneumoniae J138
ccuguacgguaaauccauu

SEQ ID NO: 526082 - RNA, 22 nt, Chlamydophila pneumoniae J138
ccuguaccacauacucuucauc

SEQ ID NO: 526083 - RNA, 20 nt, Chlamydophila pneumoniae J138
ccuguaauugauguuccuug

SEQ ID NO: 526084 - RNA, 21 nt, Chlamydophila pneumoniae J138
ccuguccaacuaaaacagccu

SEQ ID NO: 526085 - RNA, 19 nt, Chlamydophila pneumoniae J138
ccugucacaauaccaucuc

SEQ ID NO: 526086 - RNA, 18 nt, Chlamydophila pneumoniae J138
ccuguagcgaagagagua

SEQ ID NO: 526087 - RNA, 13 nt, Chlamydophila pneumoniae J138
ccuguagaaacau

SEQ ID NO: 526088 - RNA, 19 nt, Chlamydophila pneumoniae J138
ccuguaguaaaauaagaaa

SEQ ID NO: 526089 - RNA, 23 nt, Chlamydophila pneumoniae J138
ccuguauauucugaaauuucuga

SEQ ID NO: 526090 - RNA, 22 nt, Chlamydophila pneumoniae J138
ccuguaguuucuaaaacagaaa

SEQ ID NO: 526091 - RNA, 23 nt, Chlamydophila pneumoniae J138
ccuguaguuucuaaaacagaaau

SEQ ID NO: 526092 - RNA, 18 nt, Chlamydophila pneumoniae J138
cgacuacaucuuguucug

SEQ ID NO: 526093 - RNA, 18 nt, Chlamydophila pneumoniae J138
cgacguuugaucuucucu

SEQ ID NO: 526094 - RNA, 22 nt, Chlamydophila pneumoniae J138
cgacuguacaaaugcaucucua

SEQ ID NO: 526095 - RNA, 18 nt, Chlamydophila pneumoniae J138
cgacuucaccuugaaguu

SEQ ID NO: 526096 - RNA, 19 nt, Chlamydophila pneumoniae J138
cgacuugccaaucuuccuu

SEQ ID NO: 526097 - RNA, 16 nt, Chlamydophila pneumoniae J138
cgagacugcaaaggaa

SEQ ID NO: 526098 - RNA, 15 nt, Chlamydophila pneumoniae J138
cgagacuauuuugga

SEQ ID NO: 526099 - RNA, 22 nt, Chlamydophila pneumoniae J138
cgagaaaauccguauuuggcuu

SEQ ID NO: 526100 - RNA, 18 nt, Chlamydophila pneumoniae J138
cgagaacguagcagaggc

SEQ ID NO: 526101 - RNA, 16 nt, Chlamydophila pneumoniae J138
cgagaagcuucaauga

SEQ ID NO: 526102 - RNA, 20 nt, Chlamydophila pneumoniae J138
cgagaucauuagcaucaucu

SEQ ID NO: 526103 - RNA, 17 nt, Chlamydophila pneumoniae J138
cgagcugaucuucuaaa

SEQ ID NO: 526104 - RNA, 20 nt, Chlamydophila pneumoniae J138
cgagcuuuuugcuuuucccu

SEQ ID NO: 526105 - RNA, 14 nt, Chlamydophila pneumoniae J138
cgaggaaaaaggag

SEQ ID NO: 526106 - RNA, 19 nt, Chlamydophila pneumoniae J138
cgaggaaaaaggaggaugu

SEQ ID NO: 526107 - RNA, 10 nt, Chlamydophila pneumoniae J138
cgagcuucca

SEQ ID NO: 526108 - RNA, 18 nt, Chlamydophila pneumoniae J138
cgagcuuuaagaagaaga

SEQ ID NO: 526109 - RNA, 18 nt, Chlamydophila pneumoniae J138
cgaggucuuuucuuuuua

SEQ ID NO: 526110 - RNA, 19 nt, Chlamydophila pneumoniae J138
cgaguaccucaucucugga

SEQ ID NO: 526111 - RNA, 17 nt, Chlamydophila pneumoniae J138
cgauaucuauaaaugua

SEQ ID NO: 526112 - RNA, 19 nt, Chlamydophila pneumoniae J138
cgauaugggcuuugcuaac

SEQ ID NO: 526113 - RNA, 19 nt, Chlamydophila pneumoniae J138
cgaguucgcggaucuucuu

SEQ ID NO: 526114 - RNA, 21 nt, Chlamydophila pneumoniae J138
cgauaacguugccuguuuuau

SEQ ID NO: 526115 - RNA, 13 nt, Chlamydophila pneumoniae J138
cgaugucuuucca

SEQ ID NO: 526116 - RNA, 20 nt, Chlamydophila pneumoniae J138
cgauauuuagagagaaacau

SEQ ID NO: 526117 - RNA, 21 nt, Chlamydophila pneumoniae J138
cgauauuuagagagaaacauc

SEQ ID NO: 526118 - RNA, 22 nt, Chlamydophila pneumoniae J138
cgaucaaauuccuucucagaaa

SEQ ID NO: 526119 - RNA, 14 nt, Chlamydophila pneumoniae J138
cgauuccugaggcu

SEQ ID NO: 526120 - RNA, 18 nt, Chlamydophila pneumoniae J138
cgauuugaacaugaggau

SEQ ID NO: 526121 - RNA, 18 nt, Chlamydophila pneumoniae J138
cgauuugaucuugcucag

SEQ ID NO: 526122 - RNA, 15 nt, Chlamydophila pneumoniae J138
cgauuuggaagauug

SEQ ID NO: 526123 - RNA, 19 nt, Chlamydophila pneumoniae J138
cgcaaaaagcuucuuucuu

SEQ ID NO: 526124 - RNA, 21 nt, Chlamydophila pneumoniae J138
cgcaauccaggaauagaaaga

SEQ ID NO: 526125 - RNA, 21 nt, Chlamydophila pneumoniae J138
cgcaguggacggggagagcca

SEQ ID NO: 526126 - RNA, 20 nt, Chlamydophila pneumoniae J138
cgcaucaaaaaauacauagg

SEQ ID NO: 526127 - RNA, 23 nt, Chlamydophila pneumoniae J138
cgccaaacgaauuucuuguucca

SEQ ID NO: 526128 - RNA, 17 nt, Chlamydophila pneumoniae J138
cgccaaacgaauuucuu

SEQ ID NO: 526129 - RNA, 18 nt, Chlamydophila pneumoniae J138
cgcauggcggucuuuguu

SEQ ID NO: 526130 - RNA, 19 nt, Chlamydophila pneumoniae J138
ccuuccaagugcucaguaa

SEQ ID NO: 526131 - RNA, 12 nt, Chlamydophila pneumoniae J138
ccuuccaauacu

SEQ ID NO: 526132 - RNA, 16 nt, Chlamydophila pneumoniae J138
ccuguguguuuuuucc

SEQ ID NO: 526133 - RNA, 23 nt, Chlamydophila pneumoniae J138
ccuuccauacggacaacaacagc

SEQ ID NO: 526134 - RNA, 14 nt, Chlamydophila pneumoniae J138
ccuuccaagugcuc

SEQ ID NO: 526135 - RNA, 14 nt, Chlamydophila pneumoniae J138
ccuucgauuccagg

SEQ ID NO: 526136 - RNA, 11 nt, Chlamydophila pneumoniae J138
ccuucggcuuc

SEQ ID NO: 526137 - RNA, 18 nt, Chlamydophila pneumoniae J138
ccuucuacagauugaugc

SEQ ID NO: 526138 - RNA, 15 nt, Chlamydophila pneumoniae J138
ccuucuuaguaaaga

SEQ ID NO: 526139 - RNA, 22 nt, Chlamydophila pneumoniae J138
ccuucuggaugcccuggauagc

SEQ ID NO: 526140 - RNA, 14 nt, Chlamydophila pneumoniae J138
ccuucuuuccauaa

SEQ ID NO: 526141 - RNA, 15 nt, Chlamydophila pneumoniae J138
ccuucuuuccauaaa

SEQ ID NO: 526142 - RNA, 20 nt, Chlamydophila pneumoniae J138
ccuucuuucaauagcuucca

SEQ ID NO: 526143 - RNA, 21 nt, Chlamydophila pneumoniae J138
ccuucuugcaaagauaaccau

SEQ ID NO: 526144 - RNA, 15 nt, Chlamydophila pneumoniae J138
ccuucuucuuuuaga

SEQ ID NO: 526145 - RNA, 23 nt, Chlamydophila pneumoniae J138
ccuucuucuuguucuucuugauu

SEQ ID NO: 526146 - RNA, 21 nt, Chlamydophila pneumoniae J138
ccuugaaagacucgcucuccu

SEQ ID NO: 526147 - RNA, 14 nt, Chlamydophila pneumoniae J138
ccuugaaaaucaag

SEQ ID NO: 526148 - RNA, 22 nt, Chlamydophila pneumoniae J138
ccuugaaaaucaagaagagaaa

SEQ ID NO: 526149 - RNA, 22 nt, Chlamydophila pneumoniae J138
ccuugaaucauagagauaucau

SEQ ID NO: 526150 - RNA, 13 nt, Chlamydophila pneumoniae J138
ccuugcauuagau

SEQ ID NO: 526151 - RNA, 21 nt, Chlamydophila pneumoniae J138
ccuugcagcgacaacacgccc

SEQ ID NO: 526152 - RNA, 21 nt, Chlamydophila pneumoniae J138
ccuugagcuaacgacauugaa

SEQ ID NO: 526153 - RNA, 18 nt, Chlamydophila pneumoniae J138
ccuuggguuugucuccaa

SEQ ID NO: 526154 - RNA, 15 nt, Chlamydophila pneumoniae J138
ccuuguauaagagca

SEQ ID NO: 526155 - RNA, 23 nt, Chlamydophila pneumoniae J138
ccuugggauuccuuaaugguagc

SEQ ID NO: 526156 - RNA, 13 nt, Chlamydophila pneumoniae J138
ccuuggcagagcc

SEQ ID NO: 526157 - RNA, 15 nt, Chlamydophila pneumoniae J138
ccuugugagaggguc

SEQ ID NO: 526158 - RNA, 13 nt, Chlamydophila pneumoniae J138
ccuuguuuuccug

SEQ ID NO: 526159 - RNA, 16 nt, Chlamydophila pneumoniae J138
ccuuuaaauaaaaucg

SEQ ID NO: 526160 - RNA, 22 nt, Chlamydophila pneumoniae J138
ccuuuuaaaauuuugauaccuc

SEQ ID NO: 526161 - RNA, 21 nt, Chlamydophila pneumoniae J138
ccuuugcaaaccaaucuugag

SEQ ID NO: 526162 - RNA, 19 nt, Chlamydophila pneumoniae J138
ccuuugagucuuuuucaga

SEQ ID NO: 526163 - RNA, 18 nt, Chlamydophila pneumoniae J138
ccuuucuuuugcuuuucc

SEQ ID NO: 526164 - RNA, 22 nt, Chlamydophila pneumoniae J138
ccuuuauauaaagguuacaagc

SEQ ID NO: 526165 - RNA, 16 nt, Chlamydophila pneumoniae J138
ccuuuaggaagcugua

SEQ ID NO: 526166 - RNA, 15 nt, Chlamydophila pneumoniae J138
ccuuuagcugcugaa

SEQ ID NO: 526167 - RNA, 23 nt, Chlamydophila pneumoniae J138
ccuuuagagacgcuuuuaucugu

SEQ ID NO: 526168 - RNA, 22 nt, Chlamydophila pneumoniae J138
ccuuuauacuguuuuucuucca

SEQ ID NO: 526169 - RNA, 13 nt, Chlamydophila pneumoniae J138
ccuuuucuccuuc

SEQ ID NO: 526170 - RNA, 22 nt, Chlamydophila pneumoniae J138
ccuuuugaauucugaugaccuc

SEQ ID NO: 526171 - RNA, 19 nt, Chlamydophila pneumoniae J138
ccuuuuucauugaugcuua

SEQ ID NO: 526172 - RNA, 15 nt, Chlamydophila pneumoniae J138
cgaaaaaccuucucc

SEQ ID NO: 526173 - RNA, 15 nt, Chlamydophila pneumoniae J138
cgaaaaauaccucag

SEQ ID NO: 526174 - RNA, 21 nt, Chlamydophila pneumoniae J138
cgaaacaacuuuuuucguuug

SEQ ID NO: 526175 - RNA, 20 nt, Chlamydophila pneumoniae J138
cgaaaccacagcaaagacua

SEQ ID NO: 526176 - RNA, 14 nt, Chlamydophila pneumoniae J138
cgaaauccuaaaaa

SEQ ID NO: 526177 - RNA, 13 nt, Chlamydophila pneumoniae J138
cgaaauccuaaaa

SEQ ID NO: 526178 - RNA, 21 nt, Chlamydophila pneumoniae J138
cgaaauccuaaaaaggguucc

SEQ ID NO: 526179 - RNA, 23 nt, Chlamydophila pneumoniae J138
cgaaagaacuacuuaaauccuaa

SEQ ID NO: 526180 - RNA, 18 nt, Chlamydophila pneumoniae J138
cgaaagcuacagcuaacg

SEQ ID NO: 526181 - RNA, 15 nt, Chlamydophila pneumoniae J138
cgaacagcuccugga

SEQ ID NO: 526182 - RNA, 21 nt, Chlamydophila pneumoniae J138
cgacaugccuaaauagcucag

SEQ ID NO: 526183 - RNA, 22 nt, Chlamydophila pneumoniae J138
cgaccuaggagaaaucacacuu

SEQ ID NO: 526184 - RNA, 18 nt, Chlamydophila pneumoniae J138
cgaccucgaauuccuccc

SEQ ID NO: 526185 - RNA, 22 nt, Chlamydophila pneumoniae J138
cgaccugagguaucaauaauga

SEQ ID NO: 526186 - RNA, 23 nt, Chlamydophila pneumoniae J138
cgaccugagguaucaauaaugac

SEQ ID NO: 526187 - RNA, 15 nt, Chlamydophila pneumoniae J138
cgacgagaaggaaga

SEQ ID NO: 526188 - RNA, 21 nt, Chlamydophila pneumoniae J138
cgaacuauagcaauccauagu

SEQ ID NO: 526189 - RNA, 21 nt, Chlamydophila pneumoniae J138
cgaacuguacgaauuucacac

SEQ ID NO: 526190 - RNA, 21 nt, Chlamydophila pneumoniae J138
cgaacuccgcccgucuuagaa

SEQ ID NO: 526191 - RNA, 19 nt, Chlamydophila pneumoniae J138
cgaagauucaaagaagucg

SEQ ID NO: 526192 - RNA, 17 nt, Chlamydophila pneumoniae J138
cgaagauccuagagaau

SEQ ID NO: 526193 - RNA, 20 nt, Chlamydophila pneumoniae J138
cgaagacuuguucuucauua

SEQ ID NO: 526194 - RNA, 19 nt, Chlamydophila pneumoniae J138
cgaagcggagcaucuuuuc

SEQ ID NO: 526195 - RNA, 19 nt, Chlamydophila pneumoniae J138
cgaaggggaagaggaaugc

SEQ ID NO: 526196 - RNA, 23 nt, Chlamydophila pneumoniae J138
cgaagggaguuucccgacauuua

SEQ ID NO: 526197 - RNA, 15 nt, Chlamydophila pneumoniae J138
cgacacucaaaucuu

SEQ ID NO: 526198 - RNA, 22 nt, Chlamydophila pneumoniae J138
cgacacuauguguuuccuuuuc

SEQ ID NO: 526199 - RNA, 20 nt, Chlamydophila pneumoniae J138
cgacagcagcauuuucuaaa

SEQ ID NO: 526200 - RNA, 14 nt, Chlamydophila pneumoniae J138
cgacaaaaaugccu

SEQ ID NO: 526201 - RNA, 18 nt, Chlamydophila pneumoniae J138
cgaauuucaacagcuuca

SEQ ID NO: 526202 - RNA, 13 nt, Chlamydophila pneumoniae J138
cgacaaggaagcc

SEQ ID NO: 526203 - RNA, 17 nt, Chlamydophila pneumoniae J138
cgaauagcucuggagau

SEQ ID NO: 526204 - RNA, 22 nt, Chlamydophila pneumoniae J138
cgaauaggcauuacacaacucu

SEQ ID NO: 526205 - RNA, 21 nt, Chlamydophila pneumoniae J138
cgaauaaguuuugauuuugca

SEQ ID NO: 526206 - RNA, 18 nt, Chlamydophila pneumoniae J138
cgaauaaggcuugaggau

SEQ ID NO: 526207 - RNA, 22 nt, Chlamydophila pneumoniae J138
cgaaucuaaaaacuucccaucu

SEQ ID NO: 526208 - RNA, 18 nt, Chlamydophila pneumoniae J138
cgaaugucguuaaaaacu

SEQ ID NO: 526209 - RNA, 21 nt, Chlamydophila pneumoniae J138
cgaauguagccaauccuucca

SEQ ID NO: 526210 - RNA, 13 nt, Chlamydophila pneumoniae J138
cgaauucucagaa

SEQ ID NO: 526211 - RNA, 20 nt, Chlamydophila pneumoniae J138
ccaaagucacucaaacccuc

SEQ ID NO: 526212 - RNA, 17 nt, Chlamydophila pneumoniae J138
ccaaaguuuguagcauu

SEQ ID NO: 526213 - RNA, 16 nt, Chlamydophila pneumoniae J138
ccaaauacgaacugua

SEQ ID NO: 526214 - RNA, 13 nt, Chlamydophila pneumoniae J138
ccaaauccuccgc

SEQ ID NO: 526215 - RNA, 23 nt, Chlamydophila pneumoniae J138
ccaaagcuauuucucuaucauca

SEQ ID NO: 526216 - RNA, 19 nt, Chlamydophila pneumoniae J138
ccaaagcaguguauaacgu

SEQ ID NO: 526217 - RNA, 17 nt, Chlamydophila pneumoniae J138
ccaaagcagauccugcu

SEQ ID NO: 526218 - RNA, 16 nt, Chlamydophila pneumoniae J138
ccaaagaucaucuuca

SEQ ID NO: 526219 - RNA, 15 nt, Chlamydophila pneumoniae J138
ccaaagaacagcacu

SEQ ID NO: 526220 - RNA, 21 nt, Chlamydophila pneumoniae J138
ccaaagaggggagcuauaaau

SEQ ID NO: 526221 - RNA, 11 nt, Chlamydophila pneumoniae J138
ccaaagaacag

SEQ ID NO: 526222 - RNA, 21 nt, Chlamydophila pneumoniae J138
ccaaacgucaggcuccugacg

SEQ ID NO: 526223 - RNA, 13 nt, Chlamydophila pneumoniae J138
ccaaaagaccaaa

SEQ ID NO: 526224 - RNA, 20 nt, Chlamydophila pneumoniae J138
ccaaaagaauuaagaagaag

SEQ ID NO: 526225 - RNA, 23 nt, Chlamydophila pneumoniae J138
ccaaaagaauuaagaagaagcug

SEQ ID NO: 526226 - RNA, 13 nt, Chlamydophila pneumoniae J138
cauuucguuuuuu

SEQ ID NO: 526227 - RNA, 21 nt, Chlamydophila pneumoniae J138
cauuucguuuuuucuuaucug

SEQ ID NO: 526228 - RNA, 18 nt, Chlamydophila pneumoniae J138
cauuucucaccacggaag

SEQ ID NO: 526229 - RNA, 22 nt, Chlamydophila pneumoniae J138
cauuucuggagaaugccccuuc

SEQ ID NO: 526230 - RNA, 22 nt, Chlamydophila pneumoniae J138
ccaaaaaaugcccguccccucu

SEQ ID NO: 526231 - RNA, 20 nt, Chlamydophila pneumoniae J138
ccaaaaaaugcccguccccu

SEQ ID NO: 526232 - RNA, 16 nt, Chlamydophila pneumoniae J138
ccaaaauaaaaggagc

SEQ ID NO: 526233 - RNA, 16 nt, Chlamydophila pneumoniae J138
ccaaaaugucuuuuuc

SEQ ID NO: 526234 - RNA, 11 nt, Chlamydophila pneumoniae J138
ccaaacaugga

SEQ ID NO: 526235 - RNA, 19 nt, Chlamydophila pneumoniae J138
ccaaaccucuuagcuauca

SEQ ID NO: 526236 - RNA, 16 nt, Chlamydophila pneumoniae J138
ccaaaccaugaggcug

SEQ ID NO: 526237 - RNA, 16 nt, Chlamydophila pneumoniae J138
ccaaauguucucucca

SEQ ID NO: 526238 - RNA, 21 nt, Chlamydophila pneumoniae J138
ccaaauguucucuccagcugu

SEQ ID NO: 526239 - RNA, 16 nt, Chlamydophila pneumoniae J138
ccaaauuccuucauac

SEQ ID NO: 526240 - RNA, 13 nt, Chlamydophila pneumoniae J138
ccaacaaagauga

SEQ ID NO: 526241 - RNA, 23 nt, Chlamydophila pneumoniae J138
ccaacacgcacaaacuaacauag

SEQ ID NO: 526242 - RNA, 21 nt, Chlamydophila pneumoniae J138
ccaacuaaaacagccuagcaa

SEQ ID NO: 526243 - RNA, 11 nt, Chlamydophila pneumoniae J138
ccaacuagaau

SEQ ID NO: 526244 - RNA, 22 nt, Chlamydophila pneumoniae J138
ccaacucccgcuagaucaaaac

SEQ ID NO: 526245 - RNA, 12 nt, Chlamydophila pneumoniae J138
ccaacugagcua

SEQ ID NO: 526246 - RNA, 15 nt, Chlamydophila pneumoniae J138
ccaacugagcuauuu

SEQ ID NO: 526247 - RNA, 22 nt, Chlamydophila pneumoniae J138
ccaacuuuugaagauccugagu

SEQ ID NO: 526248 - RNA, 22 nt, Chlamydophila pneumoniae J138
ccaagacaauggaaauagagaa

SEQ ID NO: 526249 - RNA, 21 nt, Chlamydophila pneumoniae J138
ccaagaaugaaucgaagaaca

SEQ ID NO: 526250 - RNA, 13 nt, Chlamydophila pneumoniae J138
ccaagacaaaaaa

SEQ ID NO: 526251 - RNA, 21 nt, Chlamydophila pneumoniae J138
ccaagacgcggaacucucuuc

SEQ ID NO: 526252 - RNA, 16 nt, Chlamydophila pneumoniae J138
ccaagaaauauacugc

SEQ ID NO: 526253 - RNA, 22 nt, Chlamydophila pneumoniae J138
ccaagagucuuugaugcuaaac

SEQ ID NO: 526254 - RNA, 22 nt, Chlamydophila pneumoniae J138
ccaagcaggugugugguaaaaa

SEQ ID NO: 526255 - RNA, 22 nt, Chlamydophila pneumoniae J138
ccaagggagggacgacaaggag

SEQ ID NO: 526256 - RNA, 22 nt, Chlamydophila pneumoniae J138
ccaaggggcguucuugaaaaaa

SEQ ID NO: 526257 - RNA, 22 nt, Chlamydophila pneumoniae J138
ccaaguguugccagcccauguc

SEQ ID NO: 526258 - RNA, 18 nt, Chlamydophila pneumoniae J138
ccaaguuguagugaauga

SEQ ID NO: 526259 - RNA, 14 nt, Chlamydophila pneumoniae J138
ccaaguacaguauc

SEQ ID NO: 526260 - RNA, 19 nt, Chlamydophila pneumoniae J138
ccaaucgauaacguugccu

SEQ ID NO: 526261 - RNA, 12 nt, Chlamydophila pneumoniae J138
ccaaucugcuga

SEQ ID NO: 526262 - RNA, 17 nt, Chlamydophila pneumoniae J138
ccaaugacgggagcucu

SEQ ID NO: 526263 - RNA, 12 nt, Chlamydophila pneumoniae J138
ccaaucuuucau

SEQ ID NO: 526264 - RNA, 20 nt, Chlamydophila pneumoniae J138
ccaauaaccgaaacuucuca

SEQ ID NO: 526265 - RNA, 22 nt, Chlamydophila pneumoniae J138
ccaauaaccgaaacuucucaga

SEQ ID NO: 526266 - RNA, 15 nt, Chlamydophila pneumoniae J138
ccaauaaauccaaaa

SEQ ID NO: 526267 - RNA, 20 nt, Chlamydophila pneumoniae J138
ccaauauccagaaauacguc

SEQ ID NO: 526268 - RNA, 21 nt, Chlamydophila pneumoniae J138
ccaauaugcucugccauuucu

SEQ ID NO: 526269 - RNA, 20 nt, Chlamydophila pneumoniae J138
ccaauauagaagcugcugcu

SEQ ID NO: 526270 - RNA, 13 nt, Chlamydophila pneumoniae J138
ccaauacagcaua

SEQ ID NO: 526271 - RNA, 23 nt, Chlamydophila pneumoniae J138
ccaaugggaauuugauuuuucaa

SEQ ID NO: 526272 - RNA, 14 nt, Chlamydophila pneumoniae J138
ccacaagcuuuucg

SEQ ID NO: 526273 - RNA, 23 nt, Chlamydophila pneumoniae J138
ccacaacuaaacgagcuguccag

SEQ ID NO: 526274 - RNA, 17 nt, Chlamydophila pneumoniae J138
ccaauuguaucuguauc

SEQ ID NO: 526275 - RNA, 21 nt, Chlamydophila pneumoniae J138
ccacagagaccuucucuucag

SEQ ID NO: 526276 - RNA, 13 nt, Chlamydophila pneumoniae J138
ccacagcuucuuc

SEQ ID NO: 526277 - RNA, 23 nt, Chlamydophila pneumoniae J138
ccacaucuugagcuucaaaaagc

SEQ ID NO: 526278 - RNA, 15 nt, Chlamydophila pneumoniae J138
ccaccaacaguccug

SEQ ID NO: 526279 - RNA, 19 nt, Chlamydophila pneumoniae J138
ccaccaggagcuccuccuu

SEQ ID NO: 526280 - RNA, 21 nt, Chlamydophila pneumoniae J138
ccaccagggguuucuaaauac

SEQ ID NO: 526281 - RNA, 12 nt, Chlamydophila pneumoniae J138
ccaccaggagcu

SEQ ID NO: 526282 - RNA, 16 nt, Chlamydophila pneumoniae J138
ccaccaggagcuccuc

SEQ ID NO: 526283 - RNA, 21 nt, Chlamydophila pneumoniae J138
ccacgggucaggagguggugg

SEQ ID NO: 526284 - RNA, 15 nt, Chlamydophila pneumoniae J138
ccacggauuuucucu

SEQ ID NO: 526285 - RNA, 18 nt, Chlamydophila pneumoniae J138
ccacccuuggcagagccg

SEQ ID NO: 526286 - RNA, 14 nt, Chlamydophila pneumoniae J138
ccacgagauucugc

SEQ ID NO: 526287 - RNA, 13 nt, Chlamydophila pneumoniae J138
ccacgaaauguua

SEQ ID NO: 526288 - RNA, 23 nt, Chlamydophila pneumoniae J138
ccagaaagauucugcccaaagcu

SEQ ID NO: 526289 - RNA, 21 nt, Chlamydophila pneumoniae J138
ccagaaacgcagcuuuccuuu

SEQ ID NO: 526290 - RNA, 22 nt, Chlamydophila pneumoniae J138
ccagaagcaacuaaacucucca

SEQ ID NO: 526291 - RNA, 16 nt, Chlamydophila pneumoniae J138
ccagaagcaugaauga

SEQ ID NO: 526292 - RNA, 16 nt, Chlamydophila pneumoniae J138
ccacuuuuuucccucc

SEQ ID NO: 526293 - RNA, 22 nt, Chlamydophila pneumoniae J138
ccacuuuuuucccuccaccaga

SEQ ID NO: 526294 - RNA, 22 nt, Chlamydophila pneumoniae J138
ccacuuuuaauuucuuacaaga

SEQ ID NO: 526295 - RNA, 23 nt, Chlamydophila pneumoniae J138
ccagagagcuuuuagguagagaa

SEQ ID NO: 526296 - RNA, 16 nt, Chlamydophila pneumoniae J138
ccagacuuuccucucu

SEQ ID NO: 526297 - RNA, 17 nt, Chlamydophila pneumoniae J138
ccagagaauguucccaa

SEQ ID NO: 526298 - RNA, 19 nt, Chlamydophila pneumoniae J138
ccagacuuuccucucuuua

SEQ ID NO: 526299 - RNA, 14 nt, Chlamydophila pneumoniae J138
ccagaugauuuuuu

SEQ ID NO: 526300 - RNA, 15 nt, Chlamydophila pneumoniae J138
ccagcaucuucucga

SEQ ID NO: 526301 - RNA, 14 nt, Chlamydophila pneumoniae J138
ccagcaucuucucg

SEQ ID NO: 526302 - RNA, 22 nt, Chlamydophila pneumoniae J138
ccagcauuaagauaaacagcac

SEQ ID NO: 526303 - RNA, 22 nt, Chlamydophila pneumoniae J138
ccaggagagcuaacagcacgua

SEQ ID NO: 526304 - RNA, 19 nt, Chlamydophila pneumoniae J138
ccaggagagcuaacagcac

SEQ ID NO: 526305 - RNA, 18 nt, Chlamydophila pneumoniae J138
ccaggagagcuaacagca

SEQ ID NO: 526306 - RNA, 20 nt, Chlamydophila pneumoniae J138
ccaggguguuugcauaguau

SEQ ID NO: 526307 - RNA, 19 nt, Chlamydophila pneumoniae J138
ccagguguagguuccugcu

SEQ ID NO: 526308 - RNA, 20 nt, Chlamydophila pneumoniae J138
ccauaaaaauguaauuuuuu

SEQ ID NO: 526309 - RNA, 19 nt, Chlamydophila pneumoniae J138
ccauaagaucaauauagag

SEQ ID NO: 526310 - RNA, 18 nt, Chlamydophila pneumoniae J138
ccauauuugaauaaagga

SEQ ID NO: 526311 - RNA, 17 nt, Chlamydophila pneumoniae J138
ccaucacauaaaucaac

SEQ ID NO: 526312 - RNA, 15 nt, Chlamydophila pneumoniae J138
ccauauaauagauau

SEQ ID NO: 526313 - RNA, 22 nt, Chlamydophila pneumoniae J138
ccauacgguaaggaggaaucuu

SEQ ID NO: 526314 - RNA, 20 nt, Chlamydophila pneumoniae J138
ccauaaugagacagacaguc

SEQ ID NO: 526315 - RNA, 22 nt, Chlamydophila pneumoniae J138
ccauaaugagacagacagucug

SEQ ID NO: 526316 - RNA, 12 nt, Chlamydophila pneumoniae J138
ccauagcaaugc

SEQ ID NO: 526317 - RNA, 14 nt, Chlamydophila pneumoniae J138
ccauagagcugcca

SEQ ID NO: 526318 - RNA, 19 nt, Chlamydophila pneumoniae J138
ccauagcgauagcuaaacc

SEQ ID NO: 526319 - RNA, 18 nt, Chlamydophila pneumoniae J138
ccauacugauauacaguu

SEQ ID NO: 526320 - RNA, 18 nt, Chlamydophila pneumoniae J138
ccauccacgaccugcaaa

SEQ ID NO: 526321 - RNA, 13 nt, Chlamydophila pneumoniae J138
ccauccacgaccu

SEQ ID NO: 526322 - RNA, 17 nt, Chlamydophila pneumoniae J138
ccauccacgaccucgaa

SEQ ID NO: 526323 - RNA, 17 nt, Chlamydophila pneumoniae J138
ccauccacgaccugcaa

SEQ ID NO: 526324 - RNA, 22 nt, Chlamydophila pneumoniae J138
ccauccugucuauuucuuaauu

SEQ ID NO: 526325 - RNA, 15 nt, Chlamydophila pneumoniae J138
ccaucuaauccuguu

SEQ ID NO: 526326 - RNA, 15 nt, Chlamydophila pneumoniae J138
ccaugagcucaggca

SEQ ID NO: 526327 - RNA, 19 nt, Chlamydophila pneumoniae J138
ccaugacuugacacaggag

SEQ ID NO: 526328 - RNA, 22 nt, Chlamydophila pneumoniae J138
ccaugcagccugcgacuacaag

SEQ ID NO: 526329 - RNA, 15 nt, Chlamydophila pneumoniae J138
ccaugucuaaagauu

SEQ ID NO: 526330 - RNA, 19 nt, Chlamydophila pneumoniae J138
ccaugucuaaagauuggaa

SEQ ID NO: 526331 - RNA, 21 nt, Chlamydophila pneumoniae J138
ccaugucuaaagauuggaaua

SEQ ID NO: 526332 - RNA, 15 nt, Chlamydophila pneumoniae J138
ccaugucuaaaggag

SEQ ID NO: 526333 - RNA, 18 nt, Chlamydophila pneumoniae J138
ccauguacaugcaggcga

SEQ ID NO: 526334 - RNA, 17 nt, Chlamydophila pneumoniae J138
ccauggcuggaaagcca

SEQ ID NO: 526335 - RNA, 13 nt, Chlamydophila pneumoniae J138
ccauuaaggaauc

SEQ ID NO: 526336 - RNA, 17 nt, Chlamydophila pneumoniae J138
ccauuaauaucccaguu

SEQ ID NO: 526337 - RNA, 18 nt, Chlamydophila pneumoniae J138
ccauuaauaucccaguuu

SEQ ID NO: 526338 - RNA, 16 nt, Chlamydophila pneumoniae J138
ccauguuucuuccuga

SEQ ID NO: 526339 - RNA, 14 nt, Chlamydophila pneumoniae J138
ccauuauacuuuuu

SEQ ID NO: 526340 - RNA, 14 nt, Chlamydophila pneumoniae J138
ccauuccauaucca

SEQ ID NO: 526341 - RNA, 22 nt, Chlamydophila pneumoniae J138
cccaaguuguagugaaugagcu

SEQ ID NO: 526342 - RNA, 15 nt, Chlamydophila pneumoniae J138
cccaauauccagaaa

SEQ ID NO: 526343 - RNA, 18 nt, Chlamydophila pneumoniae J138
cccaaucaguucaucuag

SEQ ID NO: 526344 - RNA, 14 nt, Chlamydophila pneumoniae J138
cccaauuucuuuuu

SEQ ID NO: 526345 - RNA, 23 nt, Chlamydophila pneumoniae J138
cccaauucuuaaaaagcuaaaca

SEQ ID NO: 526346 - RNA, 13 nt, Chlamydophila pneumoniae J138
cccagauuuuuuu

SEQ ID NO: 526347 - RNA, 13 nt, Chlamydophila pneumoniae J138
cccauagcaaugc

SEQ ID NO: 526348 - RNA, 13 nt, Chlamydophila pneumoniae J138
cccauagcaugag

SEQ ID NO: 526349 - RNA, 22 nt, Chlamydophila pneumoniae J138
ccccaguuucuugauauuuguc

SEQ ID NO: 526350 - RNA, 13 nt, Chlamydophila pneumoniae J138
ccccauaaaaauu

SEQ ID NO: 526351 - RNA, 12 nt, Chlamydophila pneumoniae J138
cccauuccugca

SEQ ID NO: 526352 - RNA, 20 nt, Chlamydophila pneumoniae J138
ccccggguuguccagagaca

SEQ ID NO: 526353 - RNA, 20 nt, Chlamydophila pneumoniae J138
ccccguucguggagcaucau

SEQ ID NO: 526354 - RNA, 15 nt, Chlamydophila pneumoniae J138
ccccuccaacaaaca

SEQ ID NO: 526355 - RNA, 21 nt, Chlamydophila pneumoniae J138
cagcuaaucauagccaucaua

SEQ ID NO: 526356 - RNA, 20 nt, Chlamydophila pneumoniae J138
cagcuaaucaauccaagaau

SEQ ID NO: 526357 - RNA, 19 nt, Chlamydophila pneumoniae J138
cagcuaaucaauccaagaa

SEQ ID NO: 526358 - RNA, 13 nt, Chlamydophila pneumoniae J138
cagcuaaucaauc

SEQ ID NO: 526359 - RNA, 15 nt, Chlamydophila pneumoniae J138
cagcuaacgaaguga

SEQ ID NO: 526360 - RNA, 20 nt, Chlamydophila pneumoniae J138
cagcguugcuaagcauagcc

SEQ ID NO: 526361 - RNA, 14 nt, Chlamydophila pneumoniae J138
cagcucgagaucuu

SEQ ID NO: 526362 - RNA, 21 nt, Chlamydophila pneumoniae J138
cagcuaauuuaaaugccuuaa

SEQ ID NO: 526363 - RNA, 17 nt, Chlamydophila pneumoniae J138
cagcugauauccuugcu

SEQ ID NO: 526364 - RNA, 23 nt, Chlamydophila pneumoniae J138
cagcucucuugauugcuaucaaa

SEQ ID NO: 526365 - RNA, 20 nt, Chlamydophila pneumoniae J138
cagcugagcuaucuucaagu

SEQ ID NO: 526366 - RNA, 19 nt, Chlamydophila pneumoniae J138
cagcuuugcuuauuucccc

SEQ ID NO: 526367 - RNA, 17 nt, Chlamydophila pneumoniae J138
cagcuuuaucaggaucu

SEQ ID NO: 526368 - RNA, 22 nt, Chlamydophila pneumoniae J138
cagcuuuaucaggaucuugauu

SEQ ID NO: 526369 - RNA, 20 nt, Chlamydophila pneumoniae J138
cagcuuguuuuugcaaggca

SEQ ID NO: 526370 - RNA, 18 nt, Chlamydophila pneumoniae J138
cagcuucgcaaucuuuga

SEQ ID NO: 526371 - RNA, 15 nt, Chlamydophila pneumoniae J138
cagcuucgcaaucuu

SEQ ID NO: 526372 - RNA, 17 nt, Chlamydophila pneumoniae J138
cagcuucuggagaaaaa

SEQ ID NO: 526373 - RNA, 22 nt, Chlamydophila pneumoniae J138
cagcuucuggagaaaaaauauc

SEQ ID NO: 526374 - RNA, 17 nt, Chlamydophila pneumoniae J138
caggauauugcggaaau

SEQ ID NO: 526375 - RNA, 22 nt, Chlamydophila pneumoniae J138
caggauacucugaacaggaaua

SEQ ID NO: 526376 - RNA, 17 nt, Chlamydophila pneumoniae J138
caggaacccuggaugaa

SEQ ID NO: 526377 - RNA, 17 nt, Chlamydophila pneumoniae J138
caggauaccauaaggag

SEQ ID NO: 526378 - RNA, 21 nt, Chlamydophila pneumoniae J138
caggaaauaauuuguuuagaa

SEQ ID NO: 526379 - RNA, 23 nt, Chlamydophila pneumoniae J138
cagggaaagaacagcagaaacgg

SEQ ID NO: 526380 - RNA, 17 nt, Chlamydophila pneumoniae J138
cagggaaagaacagcag

SEQ ID NO: 526381 - RNA, 14 nt, Chlamydophila pneumoniae J138
cagggaaagaacag

SEQ ID NO: 526382 - RNA, 23 nt, Chlamydophila pneumoniae J138
caggcugaaccaaaucuaucugc

SEQ ID NO: 526383 - RNA, 14 nt, Chlamydophila pneumoniae J138
caggcugaaccaaa

SEQ ID NO: 526384 - RNA, 17 nt, Chlamydophila pneumoniae J138
cagguaagggaugcucu

SEQ ID NO: 526385 - RNA, 12 nt, Chlamydophila pneumoniae J138
cagggauauuuu

SEQ ID NO: 526386 - RNA, 14 nt, Chlamydophila pneumoniae J138
cagggaucuucauc

SEQ ID NO: 526387 - RNA, 24 nt, Chlamydophila pneumoniae J138
cagggauauuuugagcuacaagaa

SEQ ID NO: 526388 - RNA, 16 nt, Chlamydophila pneumoniae J138
cagguagucccuuucu

SEQ ID NO: 526389 - RNA, 22 nt, Chlamydophila pneumoniae J138
cagguagucccuuucuauuuca

SEQ ID NO: 526390 - RNA, 18 nt, Chlamydophila pneumoniae J138
caggucugcugaggagag

SEQ ID NO: 526391 - RNA, 19 nt, Chlamydophila pneumoniae J138
caguauggcguuuuuuuug

SEQ ID NO: 526392 - RNA, 20 nt, Chlamydophila pneumoniae J138
caguauggcguuuuuuuuga

SEQ ID NO: 526393 - RNA, 21 nt, Chlamydophila pneumoniae J138
caguaucguaacuuccuuuuu

SEQ ID NO: 526394 - RNA, 15 nt, Chlamydophila pneumoniae J138
caguaucguaacuuc

SEQ ID NO: 526395 - RNA, 14 nt, Chlamydophila pneumoniae J138
caguagguaagaag

SEQ ID NO: 526396 - RNA, 19 nt, Chlamydophila pneumoniae J138
caguagguaagaagcuguc

SEQ ID NO: 526397 - RNA, 22 nt, Chlamydophila pneumoniae J138
caguaggagcagcggcacccuc

SEQ ID NO: 526398 - RNA, 15 nt, Chlamydophila pneumoniae J138
caguagccuucuucu

SEQ ID NO: 526399 - RNA, 21 nt, Chlamydophila pneumoniae J138
cagguucugaaauugucuuca

SEQ ID NO: 526400 - RNA, 18 nt, Chlamydophila pneumoniae J138
cagguucugaaauugucu

SEQ ID NO: 526401 - RNA, 18 nt, Chlamydophila pneumoniae J138
cagguucacuucaucgac

SEQ ID NO: 526402 - RNA, 20 nt, Chlamydophila pneumoniae J138
cagguuguccuauagagaau

SEQ ID NO: 526403 - RNA, 14 nt, Chlamydophila pneumoniae J138
caguaauuccaaaa

SEQ ID NO: 526404 - RNA, 21 nt, Chlamydophila pneumoniae J138
cagugauuccugucauuccua

SEQ ID NO: 526405 - RNA, 18 nt, Chlamydophila pneumoniae J138
caguggcuuauagagaga

SEQ ID NO: 526406 - RNA, 20 nt, Chlamydophila pneumoniae J138
caguuccuaaagcuuuugcu

SEQ ID NO: 526407 - RNA, 15 nt, Chlamydophila pneumoniae J138
caguuccuaaauuca

SEQ ID NO: 526408 - RNA, 17 nt, Chlamydophila pneumoniae J138
caguuccgauaaagaua

SEQ ID NO: 526409 - RNA, 17 nt, Chlamydophila pneumoniae J138
cauaauagucucuguaa

SEQ ID NO: 526410 - RNA, 13 nt, Chlamydophila pneumoniae J138
cauaauccaagau

SEQ ID NO: 526411 - RNA, 14 nt, Chlamydophila pneumoniae J138
cauaagcuuuucuu

SEQ ID NO: 526412 - RNA, 16 nt, Chlamydophila pneumoniae J138
cauaagauuuccccaa

SEQ ID NO: 526413 - RNA, 20 nt, Chlamydophila pneumoniae J138
cauaagauugccauguacau

SEQ ID NO: 526414 - RNA, 21 nt, Chlamydophila pneumoniae J138
cauaagauugccauguacaug

SEQ ID NO: 526415 - RNA, 14 nt, Chlamydophila pneumoniae J138
cauaacuugaagaa

SEQ ID NO: 526416 - RNA, 20 nt, Chlamydophila pneumoniae J138
cauaaaguauauugacaaca

SEQ ID NO: 526417 - RNA, 22 nt, Chlamydophila pneumoniae J138
cauaacuugaagaaguacaagu

SEQ ID NO: 526418 - RNA, 14 nt, Chlamydophila pneumoniae J138
cauaagagaacuuu

SEQ ID NO: 526419 - RNA, 19 nt, Chlamydophila pneumoniae J138
cauaagaucaauauagaga

SEQ ID NO: 526420 - RNA, 21 nt, Chlamydophila pneumoniae J138
caguuuuaucggcaauuguua

SEQ ID NO: 526421 - RNA, 22 nt, Chlamydophila pneumoniae J138
cauaaagccccacccacuccag

SEQ ID NO: 526422 - RNA, 15 nt, Chlamydophila pneumoniae J138
caguuuuccauccac

SEQ ID NO: 526423 - RNA, 18 nt, Chlamydophila pneumoniae J138
caguuuuuuucuaaauuu

SEQ ID NO: 526424 - RNA, 12 nt, Chlamydophila pneumoniae J138
caucucuggaau

SEQ ID NO: 526425 - RNA, 23 nt, Chlamydophila pneumoniae J138
caucucuggaauacauuccuagc

SEQ ID NO: 526426 - RNA, 14 nt, Chlamydophila pneumoniae J138
caucucucuccaaa

SEQ ID NO: 526427 - RNA, 13 nt, Chlamydophila pneumoniae J138
caucucucuuuaa

SEQ ID NO: 526428 - RNA, 17 nt, Chlamydophila pneumoniae J138
caugaagcagaaacuuu

SEQ ID NO: 526429 - RNA, 15 nt, Chlamydophila pneumoniae J138
caugaaucugguucc

SEQ ID NO: 526430 - RNA, 18 nt, Chlamydophila pneumoniae J138
caugaaucugguuccuua

SEQ ID NO: 526431 - RNA, 18 nt, Chlamydophila pneumoniae J138
caugacuugacacaggag

SEQ ID NO: 526432 - RNA, 15 nt, Chlamydophila pneumoniae J138
caugacgcuuuucca

SEQ ID NO: 526433 - RNA, 19 nt, Chlamydophila pneumoniae J138
caugacauaggcaaauccu

SEQ ID NO: 526434 - RNA, 15 nt, Chlamydophila pneumoniae J138
caugacauaggcaaa

SEQ ID NO: 526435 - RNA, 17 nt, Chlamydophila pneumoniae J138
caugagcucaggcaaca

SEQ ID NO: 526436 - RNA, 23 nt, Chlamydophila pneumoniae J138
caugaggcugcuacgugaucaaa

SEQ ID NO: 526437 - RNA, 20 nt, Chlamydophila pneumoniae J138
caugagaaauacgcuuuucu

SEQ ID NO: 526438 - RNA, 15 nt, Chlamydophila pneumoniae J138
caugaucuuuaggaa

SEQ ID NO: 526439 - RNA, 20 nt, Chlamydophila pneumoniae J138
caugaguuuuucagauguac

SEQ ID NO: 526440 - RNA, 20 nt, Chlamydophila pneumoniae J138
caugauauuuuuauuuaaaa

SEQ ID NO: 526441 - RNA, 13 nt, Chlamydophila pneumoniae J138
caugcauagcuga

SEQ ID NO: 526442 - RNA, 17 nt, Chlamydophila pneumoniae J138
caugcauagaauaaaga

SEQ ID NO: 526443 - RNA, 12 nt, Chlamydophila pneumoniae J138
caugccaaauau

SEQ ID NO: 526444 - RNA, 14 nt, Chlamydophila pneumoniae J138
caugaugccauuga

SEQ ID NO: 526445 - RNA, 19 nt, Chlamydophila pneumoniae J138
caugccgcauuucuucaau

SEQ ID NO: 526446 - RNA, 20 nt, Chlamydophila pneumoniae J138
caugccaaauaucucuggca

SEQ ID NO: 526447 - RNA, 12 nt, Chlamydophila pneumoniae J138
cauguaaacaaa

SEQ ID NO: 526448 - RNA, 15 nt, Chlamydophila pneumoniae J138
cauggcguaaugcuc

SEQ ID NO: 526449 - RNA, 18 nt, Chlamydophila pneumoniae J138
cauguacaguuuguaaaa

SEQ ID NO: 526450 - RNA, 15 nt, Chlamydophila pneumoniae J138
cauguaacugaaagu

SEQ ID NO: 526451 - RNA, 20 nt, Chlamydophila pneumoniae J138
cauguauuguguucccucuu

SEQ ID NO: 526452 - RNA, 21 nt, Chlamydophila pneumoniae J138
cauguccuccauggaaagaaa

SEQ ID NO: 526453 - RNA, 15 nt, Chlamydophila pneumoniae J138
cauuauuaaacgaau

SEQ ID NO: 526454 - RNA, 13 nt, Chlamydophila pneumoniae J138
cauuauucccuaa

SEQ ID NO: 526455 - RNA, 17 nt, Chlamydophila pneumoniae J138
cauuagggcauucugua

SEQ ID NO: 526456 - RNA, 19 nt, Chlamydophila pneumoniae J138
cauuagggcauucuguaau

SEQ ID NO: 526457 - RNA, 15 nt, Chlamydophila pneumoniae J138
cauuagggcauucug

SEQ ID NO: 526458 - RNA, 20 nt, Chlamydophila pneumoniae J138
cauguuaagcguauagaaua

SEQ ID NO: 526459 - RNA, 15 nt, Chlamydophila pneumoniae J138
cauuaccguucccua

SEQ ID NO: 526460 - RNA, 20 nt, Chlamydophila pneumoniae J138
cauuaccguucccuaaagua

SEQ ID NO: 526461 - RNA, 22 nt, Chlamydophila pneumoniae J138
cauuaccugcuaaacuuuuuuu

SEQ ID NO: 526462 - RNA, 14 nt, Chlamydophila pneumoniae J138
cauuccgagcugca

SEQ ID NO: 526463 - RNA, 15 nt, Chlamydophila pneumoniae J138
cauuccagcaucuuc

SEQ ID NO: 526464 - RNA, 12 nt, Chlamydophila pneumoniae J138
cauuccugcagu

SEQ ID NO: 526465 - RNA, 12 nt, Chlamydophila pneumoniae J138
cauucauuuuuu

SEQ ID NO: 526466 - RNA, 19 nt, Chlamydophila pneumoniae J138
cauucauuuuuuaauaaaa

SEQ ID NO: 526467 - RNA, 14 nt, Chlamydophila pneumoniae J138
cauuccaggauucu

SEQ ID NO: 526468 - RNA, 20 nt, Chlamydophila pneumoniae J138
cauuccaggacguaaaaaga

SEQ ID NO: 526469 - RNA, 17 nt, Chlamydophila pneumoniae J138
cauuccagcaucuucuc

SEQ ID NO: 526470 - RNA, 13 nt, Chlamydophila pneumoniae J138
cauucacuaaaua

SEQ ID NO: 526471 - RNA, 18 nt, Chlamydophila pneumoniae J138
cauugccauaauaaaggu

SEQ ID NO: 526472 - RNA, 16 nt, Chlamydophila pneumoniae J138
cauugcuauugaaaaa

SEQ ID NO: 526473 - RNA, 16 nt, Chlamydophila pneumoniae J138
cauuuagaaguaaucc

SEQ ID NO: 526474 - RNA, 16 nt, Chlamydophila pneumoniae J138
cauuuccccaugaaaa

SEQ ID NO: 526475 - RNA, 23 nt, Chlamydophila pneumoniae J138
cauuucgauaacacuucuuucuu

SEQ ID NO: 526476 - RNA, 14 nt, Chlamydophila pneumoniae J138
caucaggauucucu

SEQ ID NO: 526477 - RNA, 22 nt, Chlamydophila pneumoniae J138
cauccauucuuaauauaaaaga

SEQ ID NO: 526478 - RNA, 17 nt, Chlamydophila pneumoniae J138
caucccauucaauaauu

SEQ ID NO: 526479 - RNA, 18 nt, Chlamydophila pneumoniae J138
cauccauucuuaauauaa

SEQ ID NO: 526480 - RNA, 21 nt, Chlamydophila pneumoniae J138
caucccgaacgcuagggaaac

SEQ ID NO: 526481 - RNA, 19 nt, Chlamydophila pneumoniae J138
caucccuggauuucuucug

SEQ ID NO: 526482 - RNA, 17 nt, Chlamydophila pneumoniae J138
caucccuucuucuuuua

SEQ ID NO: 526483 - RNA, 22 nt, Chlamydophila pneumoniae J138
caucgccgaccaucauaauuug

SEQ ID NO: 526484 - RNA, 22 nt, Chlamydophila pneumoniae J138
cauccuguagagcaagauucuu

SEQ ID NO: 526485 - RNA, 22 nt, Chlamydophila pneumoniae J138
caucggcauuucuccacaugcc

SEQ ID NO: 526486 - RNA, 14 nt, Chlamydophila pneumoniae J138
caucguuaauauaa

SEQ ID NO: 526487 - RNA, 21 nt, Chlamydophila pneumoniae J138
caucuccaagauaauuaugua

SEQ ID NO: 526488 - RNA, 13 nt, Chlamydophila pneumoniae J138
caucuaagccaga

SEQ ID NO: 526489 - RNA, 20 nt, Chlamydophila pneumoniae J138
caucuaauuuuaaauuuugu

SEQ ID NO: 526490 - RNA, 14 nt, Chlamydophila pneumoniae J138
cauauuugaauaaa

SEQ ID NO: 526491 - RNA, 16 nt, Chlamydophila pneumoniae J138
cauauuugaauaaagg

SEQ ID NO: 526492 - RNA, 16 nt, Chlamydophila pneumoniae J138
cauauuuauuuaaacc

SEQ ID NO: 526493 - RNA, 15 nt, Chlamydophila pneumoniae J138
caucaaucacucuau

SEQ ID NO: 526494 - RNA, 14 nt, Chlamydophila pneumoniae J138
cauauugccuucuu

SEQ ID NO: 526495 - RNA, 22 nt, Chlamydophila pneumoniae J138
cauauugagcagcguagacagg

SEQ ID NO: 526496 - RNA, 12 nt, Chlamydophila pneumoniae J138
cauauugcaaag

SEQ ID NO: 526497 - RNA, 18 nt, Chlamydophila pneumoniae J138
cauauucuaagcuuauuu

SEQ ID NO: 526498 - RNA, 17 nt, Chlamydophila pneumoniae J138
cauauccauggaauggc

SEQ ID NO: 526499 - RNA, 19 nt, Chlamydophila pneumoniae J138
cauaucaucgauaucuaag

SEQ ID NO: 526500 - RNA, 23 nt, Chlamydophila pneumoniae J138
caucacuaagauacgaaguccca

SEQ ID NO: 526501 - RNA, 19 nt, Chlamydophila pneumoniae J138
caucagcaaaacucccgac

SEQ ID NO: 526502 - RNA, 18 nt, Chlamydophila pneumoniae J138
caucagagaacucuuaaa

SEQ ID NO: 526503 - RNA, 18 nt, Chlamydophila pneumoniae J138
caucagaaguggccuugc

SEQ ID NO: 526504 - RNA, 21 nt, Chlamydophila pneumoniae J138
caucagaaguggccuugccag

SEQ ID NO: 526505 - RNA, 14 nt, Chlamydophila pneumoniae J138
caucagaagcuccu

SEQ ID NO: 526506 - RNA, 21 nt, Chlamydophila pneumoniae J138
cauauacguggcuuccauaac

SEQ ID NO: 526507 - RNA, 20 nt, Chlamydophila pneumoniae J138
cauauacguggcuuccauaa

SEQ ID NO: 526508 - RNA, 18 nt, Chlamydophila pneumoniae J138
cauauacuguuaacaagu

SEQ ID NO: 526509 - RNA, 15 nt, Chlamydophila pneumoniae J138
cauaguuuuuauuuu

SEQ ID NO: 526510 - RNA, 14 nt, Chlamydophila pneumoniae J138
cauaguguuccaaa

SEQ ID NO: 526511 - RNA, 17 nt, Chlamydophila pneumoniae J138
cauagucguuuucucga

SEQ ID NO: 526512 - RNA, 16 nt, Chlamydophila pneumoniae J138
cauagcugaggcaucu

SEQ ID NO: 526513 - RNA, 20 nt, Chlamydophila pneumoniae J138
cauaguauggcauucuuuuu

SEQ ID NO: 526514 - RNA, 15 nt, Chlamydophila pneumoniae J138
cauaguauggcauuc

SEQ ID NO: 526515 - RNA, 16 nt, Chlamydophila pneumoniae J138
cauagguuagaaauga

SEQ ID NO: 526516 - RNA, 20 nt, Chlamydophila pneumoniae J138
cauagguaauacgagaggaa

SEQ ID NO: 526517 - RNA, 11 nt, Chlamydophila pneumoniae J138
cauagaauaaa

SEQ ID NO: 526518 - RNA, 15 nt, Chlamydophila pneumoniae J138
cauagacucuuccuu

SEQ ID NO: 526519 - RNA, 13 nt, Chlamydophila pneumoniae J138
cauaauucugcac

SEQ ID NO: 526520 - RNA, 14 nt, Chlamydophila pneumoniae J138
cauagcgagaacac

SEQ ID NO: 526521 - RNA, 20 nt, Chlamydophila pneumoniae J138
cauagcaacuacagagggcu

SEQ ID NO: 526522 - RNA, 14 nt, Chlamydophila pneumoniae J138
cauagcaacuacag

SEQ ID NO: 526523 - RNA, 16 nt, Chlamydophila pneumoniae J138
cauagcagcuauacgu

SEQ ID NO: 526524 - RNA, 17 nt, Chlamydophila pneumoniae J138
cauagccaucauagcaa

SEQ ID NO: 526525 - RNA, 16 nt, Chlamydophila pneumoniae J138
cauagaguaucuaaaa

SEQ ID NO: 526526 - RNA, 21 nt, Chlamydophila pneumoniae J138
cauagagauaucaucaaaaga

SEQ ID NO: 526527 - RNA, 15 nt, Chlamydophila pneumoniae J138
cauagauacaaacau

SEQ ID NO: 526528 - RNA, 18 nt, Chlamydophila pneumoniae J138
cauagagagccuuuccua

SEQ ID NO: 526529 - RNA, 14 nt, Chlamydophila pneumoniae J138
caaucaguucaucu

SEQ ID NO: 526530 - RNA, 18 nt, Chlamydophila pneumoniae J138
caauuagagauucauaaa

SEQ ID NO: 526531 - RNA, 20 nt, Chlamydophila pneumoniae J138
caauuccauagguuagaaau

SEQ ID NO: 526532 - RNA, 18 nt, Chlamydophila pneumoniae J138
caauuccgaagaagaaag

SEQ ID NO: 526533 - RNA, 15 nt, Chlamydophila pneumoniae J138
caauucgguagagcu

SEQ ID NO: 526534 - RNA, 17 nt, Chlamydophila pneumoniae J138
caauucgagauauggaa

SEQ ID NO: 526535 - RNA, 18 nt, Chlamydophila pneumoniae J138
caauuccuaaaacaagaa

SEQ ID NO: 526536 - RNA, 15 nt, Chlamydophila pneumoniae J138
caauucucucucugc

SEQ ID NO: 526537 - RNA, 15 nt, Chlamydophila pneumoniae J138
caauucuuaaaaagc

SEQ ID NO: 526538 - RNA, 17 nt, Chlamydophila pneumoniae J138
caauugagccucgauuu

SEQ ID NO: 526539 - RNA, 20 nt, Chlamydophila pneumoniae J138
caauugaaucagauuagagu

SEQ ID NO: 526540 - RNA, 15 nt, Chlamydophila pneumoniae J138
caauugaaucagauu

SEQ ID NO: 526541 - RNA, 12 nt, Chlamydophila pneumoniae J138
caauugagcucu

SEQ ID NO: 526542 - RNA, 20 nt, Chlamydophila pneumoniae J138
caauugccaugcccacagac

SEQ ID NO: 526543 - RNA, 14 nt, Chlamydophila pneumoniae J138
cacaacucuuuaau

SEQ ID NO: 526544 - RNA, 15 nt, Chlamydophila pneumoniae J138
cacaacucuuuaauu

SEQ ID NO: 526545 - RNA, 16 nt, Chlamydophila pneumoniae J138
cacaaagaauucagag

SEQ ID NO: 526546 - RNA, 19 nt, Chlamydophila pneumoniae J138
cacaaagaauucagagaaa

SEQ ID NO: 526547 - RNA, 17 nt, Chlamydophila pneumoniae J138
cacaaaccucuaaaaac

SEQ ID NO: 526548 - RNA, 15 nt, Chlamydophila pneumoniae J138
cacaaacaacagaaa

SEQ ID NO: 526549 - RNA, 19 nt, Chlamydophila pneumoniae J138
cacaaacaacagaaauguu

SEQ ID NO: 526550 - RNA, 15 nt, Chlamydophila pneumoniae J138
cacaaaauaaaaccc

SEQ ID NO: 526551 - RNA, 12 nt, Chlamydophila pneumoniae J138
cacaaaauaaaa

SEQ ID NO: 526552 - RNA, 18 nt, Chlamydophila pneumoniae J138
caauuuuaccacuuccag

SEQ ID NO: 526553 - RNA, 23 nt, Chlamydophila pneumoniae J138
caauuuguuucuucugugcauca

SEQ ID NO: 526554 - RNA, 23 nt, Chlamydophila pneumoniae J138
caauuuguauauccacgaucuag

SEQ ID NO: 526555 - RNA, 23 nt, Chlamydophila pneumoniae J138
caauuuucuucagcacuuuuauu

SEQ ID NO: 526556 - RNA, 13 nt, Chlamydophila pneumoniae J138
cacaaaaccugga

SEQ ID NO: 526557 - RNA, 17 nt, Chlamydophila pneumoniae J138
caauuuuuauaauauuu

SEQ ID NO: 526558 - RNA, 15 nt, Chlamydophila pneumoniae J138
caauuugcuccucca

SEQ ID NO: 526559 - RNA, 15 nt, Chlamydophila pneumoniae J138
cacaagugcauuauc

SEQ ID NO: 526560 - RNA, 21 nt, Chlamydophila pneumoniae J138
cacaagcuuuucgcagauacu

SEQ ID NO: 526561 - RNA, 15 nt, Chlamydophila pneumoniae J138
cacaauauaaaugcu

SEQ ID NO: 526562 - RNA, 22 nt, Chlamydophila pneumoniae J138
cacaaucgugauugcugucaga

SEQ ID NO: 526563 - RNA, 16 nt, Chlamydophila pneumoniae J138
cacaauuuuaaaaucu

SEQ ID NO: 526564 - RNA, 15 nt, Chlamydophila pneumoniae J138
cacacgaucuucgga

SEQ ID NO: 526565 - RNA, 19 nt, Chlamydophila pneumoniae J138
cacacuuaaagguaaaacu

SEQ ID NO: 526566 - RNA, 13 nt, Chlamydophila pneumoniae J138
cacacuccauuuc

SEQ ID NO: 526567 - RNA, 16 nt, Chlamydophila pneumoniae J138
cacagaaugauaagaa

SEQ ID NO: 526568 - RNA, 17 nt, Chlamydophila pneumoniae J138
cacagacugcaggaaau

SEQ ID NO: 526569 - RNA, 21 nt, Chlamydophila pneumoniae J138
cacagagaacaauaaacgaga

SEQ ID NO: 526570 - RNA, 14 nt, Chlamydophila pneumoniae J138
cacagagaauugca

SEQ ID NO: 526571 - RNA, 18 nt, Chlamydophila pneumoniae J138
cacagagaugcuucuaaa

SEQ ID NO: 526572 - RNA, 15 nt, Chlamydophila pneumoniae J138
cacagacuugaggaa

SEQ ID NO: 526573 - RNA, 17 nt, Chlamydophila pneumoniae J138
cacagcuaugauugaaa

SEQ ID NO: 526574 - RNA, 14 nt, Chlamydophila pneumoniae J138
cacagcuguacaga

SEQ ID NO: 526575 - RNA, 18 nt, Chlamydophila pneumoniae J138
cacagcuaaucaauccaa

SEQ ID NO: 526576 - RNA, 13 nt, Chlamydophila pneumoniae J138
cacagcaugcacg

SEQ ID NO: 526577 - RNA, 13 nt, Chlamydophila pneumoniae J138
cacagcauuuucu

SEQ ID NO: 526578 - RNA, 15 nt, Chlamydophila pneumoniae J138
cacagcauuuucucu

SEQ ID NO: 526579 - RNA, 23 nt, Chlamydophila pneumoniae J138
cacagcauuuucucugagcagcu

SEQ ID NO: 526580 - RNA, 20 nt, Chlamydophila pneumoniae J138
cacaguauuccaucacaguu

SEQ ID NO: 526581 - RNA, 13 nt, Chlamydophila pneumoniae J138
cacauaaaauaau

SEQ ID NO: 526582 - RNA, 23 nt, Chlamydophila pneumoniae J138
cacaguuaagacgcagaaacacu

SEQ ID NO: 526583 - RNA, 14 nt, Chlamydophila pneumoniae J138
cacauagaaacagu

SEQ ID NO: 526584 - RNA, 20 nt, Chlamydophila pneumoniae J138
cacauacaguacgcaaagua

SEQ ID NO: 526585 - RNA, 17 nt, Chlamydophila pneumoniae J138
cacauaaagaucuuuau

SEQ ID NO: 526586 - RNA, 21 nt, Chlamydophila pneumoniae J138
cacaggaaugaaaccuucaga

SEQ ID NO: 526587 - RNA, 19 nt, Chlamydophila pneumoniae J138
cacaggggaacgcucucua

SEQ ID NO: 526588 - RNA, 20 nt, Chlamydophila pneumoniae J138
cacaggggaacgcucucuag

SEQ ID NO: 526589 - RNA, 22 nt, Chlamydophila pneumoniae J138
cacauccuuguagaacuucuca

SEQ ID NO: 526590 - RNA, 14 nt, Chlamydophila pneumoniae J138
cacaucuuucucua

SEQ ID NO: 526591 - RNA, 16 nt, Chlamydophila pneumoniae J138
cacaucuuuagaauca

SEQ ID NO: 526592 - RNA, 17 nt, Chlamydophila pneumoniae J138
cacaucuccuuucaaga

SEQ ID NO: 526593 - RNA, 15 nt, Chlamydophila pneumoniae J138
cacaugacaaauaaa

SEQ ID NO: 526594 - RNA, 16 nt, Chlamydophila pneumoniae J138
cacaugcccaaacauc

SEQ ID NO: 526595 - RNA, 12 nt, Chlamydophila pneumoniae J138
caccaaaagaau

SEQ ID NO: 526596 - RNA, 17 nt, Chlamydophila pneumoniae J138
cacauucaagauucccu

SEQ ID NO: 526597 - RNA, 18 nt, Chlamydophila pneumoniae J138
cacauugcgggcucaaag

SEQ ID NO: 526598 - RNA, 14 nt, Chlamydophila pneumoniae J138
cacauucuucugau

SEQ ID NO: 526599 - RNA, 19 nt, Chlamydophila pneumoniae J138
caccaaugauaauuucauu

SEQ ID NO: 526600 - RNA, 21 nt, Chlamydophila pneumoniae J138
caccagaaggaagguucucaa

SEQ ID NO: 526601 - RNA, 19 nt, Chlamydophila pneumoniae J138
caccagaagcaacuaaacu

SEQ ID NO: 526602 - RNA, 23 nt, Chlamydophila pneumoniae J138
caccacgaacuucagcaagaaaa

SEQ ID NO: 526603 - RNA, 13 nt, Chlamydophila pneumoniae J138
caccauauucuca

SEQ ID NO: 526604 - RNA, 22 nt, Chlamydophila pneumoniae J138
caccauauccaugacuuuuguu

SEQ ID NO: 526605 - RNA, 19 nt, Chlamydophila pneumoniae J138
caccaucacauccuguagu

SEQ ID NO: 526606 - RNA, 18 nt, Chlamydophila pneumoniae J138
caccaggagcuccuccuu

SEQ ID NO: 526607 - RNA, 17 nt, Chlamydophila pneumoniae J138
caccaggagcuccuccu

SEQ ID NO: 526608 - RNA, 21 nt, Chlamydophila pneumoniae J138
caccaggaguuggagaauuga

SEQ ID NO: 526609 - RNA, 15 nt, Chlamydophila pneumoniae J138
cacccgcaagcacuu

SEQ ID NO: 526610 - RNA, 22 nt, Chlamydophila pneumoniae J138
cacccaaacugaugccaagaaa

SEQ ID NO: 526611 - RNA, 14 nt, Chlamydophila pneumoniae J138
cacccacuccagaa

SEQ ID NO: 526612 - RNA, 12 nt, Chlamydophila pneumoniae J138
cacccucccuca

SEQ ID NO: 526613 - RNA, 12 nt, Chlamydophila pneumoniae J138
cacccugacagg

SEQ ID NO: 526614 - RNA, 15 nt, Chlamydophila pneumoniae J138
caccuaaaaugcagg

SEQ ID NO: 526615 - RNA, 16 nt, Chlamydophila pneumoniae J138
caccuaaaguuugagc

SEQ ID NO: 526616 - RNA, 12 nt, Chlamydophila pneumoniae J138
caccugcccauu

SEQ ID NO: 526617 - RNA, 21 nt, Chlamydophila pneumoniae J138
caccuugaaguuuuuucucuc

SEQ ID NO: 526618 - RNA, 20 nt, Chlamydophila pneumoniae J138
caccuuagagugacucauca

SEQ ID NO: 526619 - RNA, 20 nt, Chlamydophila pneumoniae J138
caccuuaauggcuccuacuc

SEQ ID NO: 526620 - RNA, 13 nt, Chlamydophila pneumoniae J138
cacgaaaaggaga

SEQ ID NO: 526621 - RNA, 22 nt, Chlamydophila pneumoniae J138
cacgaauccguaccagcugaua

SEQ ID NO: 526622 - RNA, 15 nt, Chlamydophila pneumoniae J138
cacgacauacaucaa

SEQ ID NO: 526623 - RNA, 15 nt, Chlamydophila pneumoniae J138
cacgagauucugcuu

SEQ ID NO: 526624 - RNA, 23 nt, Chlamydophila pneumoniae J138
cacgaguucgcggaucuucuucu

SEQ ID NO: 526625 - RNA, 16 nt, Chlamydophila pneumoniae J138
cacgagucccuucuuu

SEQ ID NO: 526626 - RNA, 17 nt, Chlamydophila pneumoniae J138
cacgagucccuucuuuc

SEQ ID NO: 526627 - RNA, 18 nt, Chlamydophila pneumoniae J138
cacgccacaaguuauccu

SEQ ID NO: 526628 - RNA, 17 nt, Chlamydophila pneumoniae J138
cacgaucuagaagauga

SEQ ID NO: 526629 - RNA, 23 nt, Chlamydophila pneumoniae J138
cacggcggagaauaucaucuucc

SEQ ID NO: 526630 - RNA, 14 nt, Chlamydophila pneumoniae J138
cacggacuccgucu

SEQ ID NO: 526631 - RNA, 17 nt, Chlamydophila pneumoniae J138
cacgccuccuucaaaga

SEQ ID NO: 526632 - RNA, 18 nt, Chlamydophila pneumoniae J138
cacgccuccuucaaagau

SEQ ID NO: 526633 - RNA, 20 nt, Chlamydophila pneumoniae J138
cacgccuccuucaaagauau

SEQ ID NO: 526634 - RNA, 12 nt, Chlamydophila pneumoniae J138
cacgccuauaga

SEQ ID NO: 526635 - RNA, 23 nt, Chlamydophila pneumoniae J138
cacuaaucucaggcauucuucau

SEQ ID NO: 526636 - RNA, 17 nt, Chlamydophila pneumoniae J138
cacuaaaagggaagcuu

SEQ ID NO: 526637 - RNA, 20 nt, Chlamydophila pneumoniae J138
cacuaaacgaucaaauuccu

SEQ ID NO: 526638 - RNA, 14 nt, Chlamydophila pneumoniae J138
cacuaaaagggaag

SEQ ID NO: 526639 - RNA, 22 nt, Chlamydophila pneumoniae J138
cacuaaagauacuuaucuuuaa

SEQ ID NO: 526640 - RNA, 17 nt, Chlamydophila pneumoniae J138
cacuaagauaucuccag

SEQ ID NO: 526641 - RNA, 16 nt, Chlamydophila pneumoniae J138
cacguaggcauacagu

SEQ ID NO: 526642 - RNA, 13 nt, Chlamydophila pneumoniae J138
cacguaagguguc

SEQ ID NO: 526643 - RNA, 21 nt, Chlamydophila pneumoniae J138
cacgggucaggagguggugga

SEQ ID NO: 526644 - RNA, 17 nt, Chlamydophila pneumoniae J138
cacucaaacccucucca

SEQ ID NO: 526645 - RNA, 19 nt, Chlamydophila pneumoniae J138
cacucaaacccucuccaga

SEQ ID NO: 526646 - RNA, 14 nt, Chlamydophila pneumoniae J138
cacucaaacccucu

SEQ ID NO: 526647 - RNA, 12 nt, Chlamydophila pneumoniae J138
cacucaaaagaa

SEQ ID NO: 526648 - RNA, 14 nt, Chlamydophila pneumoniae J138
cacuccaaaacuca

SEQ ID NO: 526649 - RNA, 22 nt, Chlamydophila pneumoniae J138
cacuccagaaaguauuccucuu

SEQ ID NO: 526650 - RNA, 21 nt, Chlamydophila pneumoniae J138
cacuaggcaugguaggagccg

SEQ ID NO: 526651 - RNA, 21 nt, Chlamydophila pneumoniae J138
cacuauguguuuccuuuucuc

SEQ ID NO: 526652 - RNA, 18 nt, Chlamydophila pneumoniae J138
cacuauguguuuccuuuu

SEQ ID NO: 526653 - RNA, 13 nt, Chlamydophila pneumoniae J138
cacuauuaucugc

SEQ ID NO: 526654 - RNA, 16 nt, Chlamydophila pneumoniae J138
cacuauuaucugcaga

SEQ ID NO: 526655 - RNA, 19 nt, Chlamydophila pneumoniae J138
cacuauuaucugcagaaac

SEQ ID NO: 526656 - RNA, 13 nt, Chlamydophila pneumoniae J138
cacuaucuguaau

SEQ ID NO: 526657 - RNA, 12 nt, Chlamydophila pneumoniae J138
cacuaucuucua

SEQ ID NO: 526658 - RNA, 21 nt, Chlamydophila pneumoniae J138
cacuauccggaaggaguucuu

SEQ ID NO: 526659 - RNA, 20 nt, Chlamydophila pneumoniae J138
cacucuaucauaucuucaaa

SEQ ID NO: 526660 - RNA, 18 nt, Chlamydophila pneumoniae J138
cacucguugccaaucuuu

SEQ ID NO: 526661 - RNA, 13 nt, Chlamydophila pneumoniae J138
cacucuaagcgaa

SEQ ID NO: 526662 - RNA, 14 nt, Chlamydophila pneumoniae J138
cacuccugaaggga

SEQ ID NO: 526663 - RNA, 12 nt, Chlamydophila pneumoniae J138
cacucccuaggu

SEQ ID NO: 526664 - RNA, 21 nt, Chlamydophila pneumoniae J138
cacucucugcagggaauccug

SEQ ID NO: 526665 - RNA, 12 nt, Chlamydophila pneumoniae J138
cacucuuuaaaa

SEQ ID NO: 526666 - RNA, 22 nt, Chlamydophila pneumoniae J138
caaccuucgauuccaggcucua

SEQ ID NO: 526667 - RNA, 12 nt, Chlamydophila pneumoniae J138
caacaucaugaa

SEQ ID NO: 526668 - RNA, 12 nt, Chlamydophila pneumoniae J138
caacauccauuc

SEQ ID NO: 526669 - RNA, 19 nt, Chlamydophila pneumoniae J138
caacgaucgucaguaaaac

SEQ ID NO: 526670 - RNA, 19 nt, Chlamydophila pneumoniae J138
caacgcaugacgcuuuucc

SEQ ID NO: 526671 - RNA, 14 nt, Chlamydophila pneumoniae J138
caacuaaacuggga

SEQ ID NO: 526672 - RNA, 16 nt, Chlamydophila pneumoniae J138
caacuaaagcauacuu

SEQ ID NO: 526673 - RNA, 16 nt, Chlamydophila pneumoniae J138
caacuaaacucuccaa

SEQ ID NO: 526674 - RNA, 20 nt, Chlamydophila pneumoniae J138
caacuaaaccuucaaugauu

SEQ ID NO: 526675 - RNA, 20 nt, Chlamydophila pneumoniae J138
caacuaaacgagcuguccag

SEQ ID NO: 526676 - RNA, 15 nt, Chlamydophila pneumoniae J138
caagaacugaagagu

SEQ ID NO: 526677 - RNA, 18 nt, Chlamydophila pneumoniae J138
caagaacaguuugcucug

SEQ ID NO: 526678 - RNA, 19 nt, Chlamydophila pneumoniae J138
caagaaauucuucccaggu

SEQ ID NO: 526679 - RNA, 23 nt, Chlamydophila pneumoniae J138
caagaaaaauucuucgagagcau

SEQ ID NO: 526680 - RNA, 23 nt, Chlamydophila pneumoniae J138
caagaaaauaggugacuucuuug

SEQ ID NO: 526681 - RNA, 11 nt, Chlamydophila pneumoniae J138
caagaagaugu

SEQ ID NO: 526682 - RNA, 17 nt, Chlamydophila pneumoniae J138
caagaagagaaaagaua

SEQ ID NO: 526683 - RNA, 16 nt, Chlamydophila pneumoniae J138
caagaagaucaaagau

SEQ ID NO: 526684 - RNA, 22 nt, Chlamydophila pneumoniae J138
caagaagaugauuggacaagug

SEQ ID NO: 526685 - RNA, 17 nt, Chlamydophila pneumoniae J138
caagaagcguacuuuac

SEQ ID NO: 526686 - RNA, 18 nt, Chlamydophila pneumoniae J138
caagaauagcaggaagga

SEQ ID NO: 526687 - RNA, 21 nt, Chlamydophila pneumoniae J138
caacucucccauguaguaaau

SEQ ID NO: 526688 - RNA, 22 nt, Chlamydophila pneumoniae J138
caacucucccauguaguaaauu

SEQ ID NO: 526689 - RNA, 14 nt, Chlamydophila pneumoniae J138
caacuucugacaau

SEQ ID NO: 526690 - RNA, 23 nt, Chlamydophila pneumoniae J138
caacuucugacaauaacaugcgc

SEQ ID NO: 526691 - RNA, 15 nt, Chlamydophila pneumoniae J138
caacucuccauccuc

SEQ ID NO: 526692 - RNA, 19 nt, Chlamydophila pneumoniae J138
caacuuuguuaauagaaga

SEQ ID NO: 526693 - RNA, 21 nt, Chlamydophila pneumoniae J138
caacuuuuuuacuaucuccua

SEQ ID NO: 526694 - RNA, 23 nt, Chlamydophila pneumoniae J138
caacuuuguuaauagaagaucau

SEQ ID NO: 526695 - RNA, 12 nt, Chlamydophila pneumoniae J138
caagagacaaga

SEQ ID NO: 526696 - RNA, 15 nt, Chlamydophila pneumoniae J138
caagacuauagaaaa

SEQ ID NO: 526697 - RNA, 19 nt, Chlamydophila pneumoniae J138
caagacuauagaaaaggau

SEQ ID NO: 526698 - RNA, 16 nt, Chlamydophila pneumoniae J138
caagacgcggaacucu

SEQ ID NO: 526699 - RNA, 21 nt, Chlamydophila pneumoniae J138
caagacgaaagcacauaagau

SEQ ID NO: 526700 - RNA, 14 nt, Chlamydophila pneumoniae J138
caagacgagaacau

SEQ ID NO: 526701 - RNA, 20 nt, Chlamydophila pneumoniae J138
caagagcaucacaaacuaaa

SEQ ID NO: 526702 - RNA, 17 nt, Chlamydophila pneumoniae J138
caagagacaagaaaaua

SEQ ID NO: 526703 - RNA, 16 nt, Chlamydophila pneumoniae J138
caagaguucucuuuga

SEQ ID NO: 526704 - RNA, 16 nt, Chlamydophila pneumoniae J138
caagauaaaucccacu

SEQ ID NO: 526705 - RNA, 22 nt, Chlamydophila pneumoniae J138
caagaggucgaagauucaaaga

SEQ ID NO: 526706 - RNA, 23 nt, Chlamydophila pneumoniae J138
caagagcucguaauccuucuuuc

SEQ ID NO: 526707 - RNA, 16 nt, Chlamydophila pneumoniae J138
caagagcuugucuucc

SEQ ID NO: 526708 - RNA, 22 nt, Chlamydophila pneumoniae J138
caagaggcuguccuugcagccc

SEQ ID NO: 526709 - RNA, 15 nt, Chlamydophila pneumoniae J138
caagaggucgaagau

SEQ ID NO: 526710 - RNA, 17 nt, Chlamydophila pneumoniae J138
caagauacuacuuacaa

SEQ ID NO: 526711 - RNA, 22 nt, Chlamydophila pneumoniae J138
caagauagugguagcaaucugu

SEQ ID NO: 526712 - RNA, 14 nt, Chlamydophila pneumoniae J138
caauaccagauaaa

SEQ ID NO: 526713 - RNA, 16 nt, Chlamydophila pneumoniae J138
caauacccuaucuauu

SEQ ID NO: 526714 - RNA, 18 nt, Chlamydophila pneumoniae J138
caauacagcauaaaaauu

SEQ ID NO: 526715 - RNA, 17 nt, Chlamydophila pneumoniae J138
caauacagcauaaaaau

SEQ ID NO: 526716 - RNA, 23 nt, Chlamydophila pneumoniae J138
caauacagauguaaaugcuccuu

SEQ ID NO: 526717 - RNA, 23 nt, Chlamydophila pneumoniae J138
caauaaucggccgaguuucuccg

SEQ ID NO: 526718 - RNA, 13 nt, Chlamydophila pneumoniae J138
caaguucaucaaa

SEQ ID NO: 526719 - RNA, 19 nt, Chlamydophila pneumoniae J138
caaguugacgcacuucuuc

SEQ ID NO: 526720 - RNA, 21 nt, Chlamydophila pneumoniae J138
caaguuguugauaauuacaga

SEQ ID NO: 526721 - RNA, 19 nt, Chlamydophila pneumoniae J138
caauaaccgaaacuucuca

SEQ ID NO: 526722 - RNA, 13 nt, Chlamydophila pneumoniae J138
caaucaauaaaau

SEQ ID NO: 526723 - RNA, 15 nt, Chlamydophila pneumoniae J138
caaucacauaaagau

SEQ ID NO: 526724 - RNA, 16 nt, Chlamydophila pneumoniae J138
caauauagaagcugcu

SEQ ID NO: 526725 - RNA, 20 nt, Chlamydophila pneumoniae J138
caauauagaagcugcugcua

SEQ ID NO: 526726 - RNA, 13 nt, Chlamydophila pneumoniae J138
caauauagagaac

SEQ ID NO: 526727 - RNA, 22 nt, Chlamydophila pneumoniae J138
caauauagagaacuccauucag

SEQ ID NO: 526728 - RNA, 22 nt, Chlamydophila pneumoniae J138
caauaccuguacgguaaaucca

SEQ ID NO: 526729 - RNA, 13 nt, Chlamydophila pneumoniae J138
caauagcagcagc

SEQ ID NO: 526730 - RNA, 19 nt, Chlamydophila pneumoniae J138
caauagcaauggcuuuuuu

SEQ ID NO: 526731 - RNA, 16 nt, Chlamydophila pneumoniae J138
caauagcaaagauuuc

SEQ ID NO: 526732 - RNA, 21 nt, Chlamydophila pneumoniae J138
caagcgcgcuaaaaaaaggcu

SEQ ID NO: 526733 - RNA, 19 nt, Chlamydophila pneumoniae J138
caagcucaagagcaugcuu

SEQ ID NO: 526734 - RNA, 15 nt, Chlamydophila pneumoniae J138
caagauucucagcuu

SEQ ID NO: 526735 - RNA, 22 nt, Chlamydophila pneumoniae J138
caagauucucagcuucaucaga

SEQ ID NO: 526736 - RNA, 20 nt, Chlamydophila pneumoniae J138
caagauucccugcggacaga

SEQ ID NO: 526737 - RNA, 17 nt, Chlamydophila pneumoniae J138
caagauuaugaugccuc

SEQ ID NO: 526738 - RNA, 23 nt, Chlamydophila pneumoniae J138
caagaugucuccaaagauacauu

SEQ ID NO: 526739 - RNA, 15 nt, Chlamydophila pneumoniae J138
caagaugucuccaaa

SEQ ID NO: 526740 - RNA, 14 nt, Chlamydophila pneumoniae J138
caagauuaucuuua

SEQ ID NO: 526741 - RNA, 22 nt, Chlamydophila pneumoniae J138
caagauuaucuuuacgaaucac

SEQ ID NO: 526742 - RNA, 13 nt, Chlamydophila pneumoniae J138
caagauuuuguag

SEQ ID NO: 526743 - RNA, 16 nt, Chlamydophila pneumoniae J138
caagcaacucuucagc

SEQ ID NO: 526744 - RNA, 21 nt, Chlamydophila pneumoniae J138
caagcaacugauguuuuauag

SEQ ID NO: 526745 - RNA, 12 nt, Chlamydophila pneumoniae J138
caagcucgcgua

SEQ ID NO: 526746 - RNA, 22 nt, Chlamydophila pneumoniae J138
caagcucuggauugaaagagcu

SEQ ID NO: 526747 - RNA, 14 nt, Chlamydophila pneumoniae J138
caagcuucaucaaa

SEQ ID NO: 526748 - RNA, 19 nt, Chlamydophila pneumoniae J138
caaggauuaugaauccuug

SEQ ID NO: 526749 - RNA, 15 nt, Chlamydophila pneumoniae J138
caaggauuaugaauc

SEQ ID NO: 526750 - RNA, 14 nt, Chlamydophila pneumoniae J138
caaggcaaaaaguu

SEQ ID NO: 526751 - RNA, 22 nt, Chlamydophila pneumoniae J138
caaggcaucuucuuugccaaug

SEQ ID NO: 526752 - RNA, 22 nt, Chlamydophila pneumoniae J138
caagugcucaguaaauauuuua

SEQ ID NO: 526753 - RNA, 19 nt, Chlamydophila pneumoniae J138
caagugugcggucucaugu

SEQ ID NO: 526754 - RNA, 21 nt, Chlamydophila pneumoniae J138
caagugugcggucucauguaa

SEQ ID NO: 526755 - RNA, 12 nt, Chlamydophila pneumoniae J138
caagucuguaag

SEQ ID NO: 526756 - RNA, 18 nt, Chlamydophila pneumoniae J138
caagucgagaaacaaaau

SEQ ID NO: 526757 - RNA, 20 nt, Chlamydophila pneumoniae J138
caaguccugcguuaaacccu

SEQ ID NO: 526758 - RNA, 21 nt, Chlamydophila pneumoniae J138
caagucugcuugggacauuuc

SEQ ID NO: 526759 - RNA, 15 nt, Chlamydophila pneumoniae J138
caagggaaagaaacu

SEQ ID NO: 526760 - RNA, 15 nt, Chlamydophila pneumoniae J138
caagggaagagaaaa

SEQ ID NO: 526761 - RNA, 16 nt, Chlamydophila pneumoniae J138
caaguccgugagagga

SEQ ID NO: 526762 - RNA, 15 nt, Chlamydophila pneumoniae J138
caaguaaagaaauuc

SEQ ID NO: 526763 - RNA, 16 nt, Chlamydophila pneumoniae J138
auuuuuauaauauuuu

SEQ ID NO: 526764 - RNA, 13 nt, Chlamydophila pneumoniae J138
caaaauaaaagga

SEQ ID NO: 526765 - RNA, 19 nt, Chlamydophila pneumoniae J138
caaaaguuuugaggauuuc

SEQ ID NO: 526766 - RNA, 18 nt, Chlamydophila pneumoniae J138
auuuuucaauaaccagaa

SEQ ID NO: 526767 - RNA, 21 nt, Chlamydophila pneumoniae J138
caaaagguuuuauaaagaucg

SEQ ID NO: 526768 - RNA, 20 nt, Chlamydophila pneumoniae J138
caaaaguaaucacuucagca

SEQ ID NO: 526769 - RNA, 15 nt, Chlamydophila pneumoniae J138
caaaauauucuuuca

SEQ ID NO: 526770 - RNA, 14 nt, Chlamydophila pneumoniae J138
caaaauguuuaucg

SEQ ID NO: 526771 - RNA, 18 nt, Chlamydophila pneumoniae J138
caaaaugggauccugcaa

SEQ ID NO: 526772 - RNA, 16 nt, Chlamydophila pneumoniae J138
caaaaugggauccugc

SEQ ID NO: 526773 - RNA, 18 nt, Chlamydophila pneumoniae J138
caaaaugcgaggaaaaag

SEQ ID NO: 526774 - RNA, 12 nt, Chlamydophila pneumoniae J138
caaaaucucuau

SEQ ID NO: 526775 - RNA, 19 nt, Chlamydophila pneumoniae J138
caaaauucaugcaaaacaa

SEQ ID NO: 526776 - RNA, 18 nt, Chlamydophila pneumoniae J138
caaaauuauguauaaacu

SEQ ID NO: 526777 - RNA, 22 nt, Chlamydophila pneumoniae J138
caaaauuauguauaaacuccac

SEQ ID NO: 526778 - RNA, 17 nt, Chlamydophila pneumoniae J138
caaaauuauguauaaac

SEQ ID NO: 526779 - RNA, 21 nt, Chlamydophila pneumoniae J138
caaaauuaccguuuccuccuc

SEQ ID NO: 526780 - RNA, 12 nt, Chlamydophila pneumoniae J138
caaaccaaaaaa

SEQ ID NO: 526781 - RNA, 12 nt, Chlamydophila pneumoniae J138
caaacauuuuua

SEQ ID NO: 526782 - RNA, 22 nt, Chlamydophila pneumoniae J138
caaacauggacaauauagagau

SEQ ID NO: 526783 - RNA, 17 nt, Chlamydophila pneumoniae J138
caaacaucacucaggau

SEQ ID NO: 526784 - RNA, 15 nt, Chlamydophila pneumoniae J138
caaaccacggauuuu

SEQ ID NO: 526785 - RNA, 19 nt, Chlamydophila pneumoniae J138
caaaccauccgacuuuccu

SEQ ID NO: 526786 - RNA, 23 nt, Chlamydophila pneumoniae J138
caaaccaucugcguuuaaggguu

SEQ ID NO: 526787 - RNA, 19 nt, Chlamydophila pneumoniae J138
caaacccugggcucacucu

SEQ ID NO: 526788 - RNA, 15 nt, Chlamydophila pneumoniae J138
caaacaucaaagaga

SEQ ID NO: 526789 - RNA, 22 nt, Chlamydophila pneumoniae J138
caaacugauuaguuuguuuuaa

SEQ ID NO: 526790 - RNA, 14 nt, Chlamydophila pneumoniae J138
caaacugaucugaa

SEQ ID NO: 526791 - RNA, 16 nt, Chlamydophila pneumoniae J138
caaacugaucugaaau

SEQ ID NO: 526792 - RNA, 22 nt, Chlamydophila pneumoniae J138
caaacuccccaguuuuccaucc

SEQ ID NO: 526793 - RNA, 19 nt, Chlamydophila pneumoniae J138
caaacuaacauagauaagg

SEQ ID NO: 526794 - RNA, 21 nt, Chlamydophila pneumoniae J138
caaacgcaaugauuucucuaa

SEQ ID NO: 526795 - RNA, 18 nt, Chlamydophila pneumoniae J138
caaacgcaaugauuucuc

SEQ ID NO: 526796 - RNA, 15 nt, Chlamydophila pneumoniae J138
caaaccucuaaaaac

SEQ ID NO: 526797 - RNA, 12 nt, Chlamydophila pneumoniae J138
caaacgaauuuc

SEQ ID NO: 526798 - RNA, 14 nt, Chlamydophila pneumoniae J138
caacaaaagggcau

SEQ ID NO: 526799 - RNA, 16 nt, Chlamydophila pneumoniae J138
caaauuuuucgagaau

SEQ ID NO: 526800 - RNA, 14 nt, Chlamydophila pneumoniae J138
caaauuccuucuca

SEQ ID NO: 526801 - RNA, 22 nt, Chlamydophila pneumoniae J138
caaauuccuucucagaaagaua

SEQ ID NO: 526802 - RNA, 23 nt, Chlamydophila pneumoniae J138
caaauuccuucucagaaagauau

SEQ ID NO: 526803 - RNA, 15 nt, Chlamydophila pneumoniae J138
caaauguucucucca

SEQ ID NO: 526804 - RNA, 18 nt, Chlamydophila pneumoniae J138
caaauucaaaauagaagc

SEQ ID NO: 526805 - RNA, 14 nt, Chlamydophila pneumoniae J138
caaauucaaccaaa

SEQ ID NO: 526806 - RNA, 15 nt, Chlamydophila pneumoniae J138
caaauucaaaauaga

SEQ ID NO: 526807 - RNA, 23 nt, Chlamydophila pneumoniae J138
caaaucuucgaauuuuuguuuua

SEQ ID NO: 526808 - RNA, 19 nt, Chlamydophila pneumoniae J138
caaaucuuccccuaaaaau

SEQ ID NO: 526809 - RNA, 14 nt, Chlamydophila pneumoniae J138
caaaugaaaagaga

SEQ ID NO: 526810 - RNA, 21 nt, Chlamydophila pneumoniae J138
caaauccugcauacccuucuu

SEQ ID NO: 526811 - RNA, 19 nt, Chlamydophila pneumoniae J138
caaaucuuacauaaaccuu

SEQ ID NO: 526812 - RNA, 22 nt, Chlamydophila pneumoniae J138
caacaaaugugacgcaagagac

SEQ ID NO: 526813 - RNA, 18 nt, Chlamydophila pneumoniae J138
caacaagggaaagaaacu

SEQ ID NO: 526814 - RNA, 13 nt, Chlamydophila pneumoniae J138
caacaccucccac

SEQ ID NO: 526815 - RNA, 17 nt, Chlamydophila pneumoniae J138
caacacccggcuuuucc

SEQ ID NO: 526816 - RNA, 13 nt, Chlamydophila pneumoniae J138
caacaguaauuau

SEQ ID NO: 526817 - RNA, 12 nt, Chlamydophila pneumoniae J138
caacauaaagaa

SEQ ID NO: 526818 - RNA, 15 nt, Chlamydophila pneumoniae J138
caacaguucuuucug

SEQ ID NO: 526819 - RNA, 22 nt, Chlamydophila pneumoniae J138
caacauacaccccaguuucuug

SEQ ID NO: 526820 - RNA, 19 nt, Chlamydophila pneumoniae J138
caacauaacaugagaaaua

SEQ ID NO: 526821 - RNA, 20 nt, Chlamydophila pneumoniae J138
caacauaacaugagaaauac

SEQ ID NO: 526822 - RNA, 15 nt, Chlamydophila pneumoniae J138
caacagcaacacucg

SEQ ID NO: 526823 - RNA, 19 nt, Chlamydophila pneumoniae J138
caaaggagcgggauaggca

SEQ ID NO: 526824 - RNA, 15 nt, Chlamydophila pneumoniae J138
caaaggagaaagaau

SEQ ID NO: 526825 - RNA, 22 nt, Chlamydophila pneumoniae J138
caaaggaagggauguuuaauac

SEQ ID NO: 526826 - RNA, 11 nt, Chlamydophila pneumoniae J138
caaaggaaggg

SEQ ID NO: 526827 - RNA, 12 nt, Chlamydophila pneumoniae J138
caaaggcaacaa

SEQ ID NO: 526828 - RNA, 15 nt, Chlamydophila pneumoniae J138
caaaggcaaccucug

SEQ ID NO: 526829 - RNA, 21 nt, Chlamydophila pneumoniae J138
caaaggcaauagcagcagcgu

SEQ ID NO: 526830 - RNA, 17 nt, Chlamydophila pneumoniae J138
caaaggguuucuuucca

SEQ ID NO: 526831 - RNA, 16 nt, Chlamydophila pneumoniae J138
caaauaaagcaacugu

SEQ ID NO: 526832 - RNA, 19 nt, Chlamydophila pneumoniae J138
caaauaaguccuguuugaa

SEQ ID NO: 526833 - RNA, 21 nt, Chlamydophila pneumoniae J138
caaauaaguccuguuugaaaa

SEQ ID NO: 526834 - RNA, 21 nt, Chlamydophila pneumoniae J138
caaauaaggcugcuaucaaca

SEQ ID NO: 526835 - RNA, 14 nt, Chlamydophila pneumoniae J138
caaaucccugaugc

SEQ ID NO: 526836 - RNA, 18 nt, Chlamydophila pneumoniae J138
caaauauugcgaacuuuu

SEQ ID NO: 526837 - RNA, 13 nt, Chlamydophila pneumoniae J138
caaagacuuuugc

SEQ ID NO: 526838 - RNA, 18 nt, Chlamydophila pneumoniae J138
caaagacuagagucacua

SEQ ID NO: 526839 - RNA, 23 nt, Chlamydophila pneumoniae J138
caaagacuagagucacuagcaga

SEQ ID NO: 526840 - RNA, 20 nt, Chlamydophila pneumoniae J138
caaagacguaggugccugaa

SEQ ID NO: 526841 - RNA, 14 nt, Chlamydophila pneumoniae J138
caaagacauccaag

SEQ ID NO: 526842 - RNA, 14 nt, Chlamydophila pneumoniae J138
caaacuucuucucg

SEQ ID NO: 526843 - RNA, 22 nt, Chlamydophila pneumoniae J138
caaagcuaggcgauaguaaaca

SEQ ID NO: 526844 - RNA, 20 nt, Chlamydophila pneumoniae J138
caaagcuauuucucuaucau

SEQ ID NO: 526845 - RNA, 17 nt, Chlamydophila pneumoniae J138
caaagcucuccuucaga

SEQ ID NO: 526846 - RNA, 15 nt, Chlamydophila pneumoniae J138
caaagaucacugaga

SEQ ID NO: 526847 - RNA, 13 nt, Chlamydophila pneumoniae J138
caaagaucacuga

SEQ ID NO: 526848 - RNA, 23 nt, Chlamydophila pneumoniae J138
caaagaucaguuuuuucuucuga

SEQ ID NO: 526849 - RNA, 15 nt, Chlamydophila pneumoniae J138
caaagaguuuuuuag

SEQ ID NO: 526850 - RNA, 20 nt, Chlamydophila pneumoniae J138
caaagaugcagauacuaaac

SEQ ID NO: 526851 - RNA, 20 nt, Chlamydophila pneumoniae J138
auuuacuuuuaauccuuuca

SEQ ID NO: 526852 - RNA, 22 nt, Chlamydophila pneumoniae J138
auuuacuuuuaauccuuucaca

SEQ ID NO: 526853 - RNA, 20 nt, Chlamydophila pneumoniae J138
auuuaggagggguaaaccaa

SEQ ID NO: 526854 - RNA, 23 nt, Chlamydophila pneumoniae J138
auuuaggaugaauccaaaauaaa

SEQ ID NO: 526855 - RNA, 20 nt, Chlamydophila pneumoniae J138
auuuacaaggauuuugagac

SEQ ID NO: 526856 - RNA, 23 nt, Chlamydophila pneumoniae J138
auuuaagauaucgaccuuaaaau

SEQ ID NO: 526857 - RNA, 11 nt, Chlamydophila pneumoniae J138
auuguuuuguu

SEQ ID NO: 526858 - RNA, 15 nt, Chlamydophila pneumoniae J138
auugguaaggagagu

SEQ ID NO: 526859 - RNA, 13 nt, Chlamydophila pneumoniae J138
auuucauuugaaa

SEQ ID NO: 526860 - RNA, 15 nt, Chlamydophila pneumoniae J138
auuucauuugaaaua

SEQ ID NO: 526861 - RNA, 16 nt, Chlamydophila pneumoniae J138
auuuccaaauucuugc

SEQ ID NO: 526862 - RNA, 18 nt, Chlamydophila pneumoniae J138
auuucauaagagaacuuu

SEQ ID NO: 526863 - RNA, 20 nt, Chlamydophila pneumoniae J138
auuuauguuuucucgaagaa

SEQ ID NO: 526864 - RNA, 17 nt, Chlamydophila pneumoniae J138
auuuccaguauucugug

SEQ ID NO: 526865 - RNA, 17 nt, Chlamydophila pneumoniae J138
auuucccauauagcucg

SEQ ID NO: 526866 - RNA, 16 nt, Chlamydophila pneumoniae J138
auuuccuucuccagag

SEQ ID NO: 526867 - RNA, 14 nt, Chlamydophila pneumoniae J138
auuuccuucuuuua

SEQ ID NO: 526868 - RNA, 19 nt, Chlamydophila pneumoniae J138
auuuccuucaggauuuucc

SEQ ID NO: 526869 - RNA, 20 nt, Chlamydophila pneumoniae J138
auuuccuucaggauuuucca

SEQ ID NO: 526870 - RNA, 19 nt, Chlamydophila pneumoniae J138
auuuccuagguucuuuucg

SEQ ID NO: 526871 - RNA, 18 nt, Chlamydophila pneumoniae J138
auuuccuagguucuuuuc

SEQ ID NO: 526872 - RNA, 22 nt, Chlamydophila pneumoniae J138
auuucgauaacacuucuuucuu

SEQ ID NO: 526873 - RNA, 15 nt, Chlamydophila pneumoniae J138
auuuuacgaauuuca

SEQ ID NO: 526874 - RNA, 21 nt, Chlamydophila pneumoniae J138
auuuuagggaugguuuccucu

SEQ ID NO: 526875 - RNA, 20 nt, Chlamydophila pneumoniae J138
auuuuacgaaucuuuuucau

SEQ ID NO: 526876 - RNA, 14 nt, Chlamydophila pneumoniae J138
auuuuagcauaauc

SEQ ID NO: 526877 - RNA, 13 nt, Chlamydophila pneumoniae J138
auuuuaguuuuca

SEQ ID NO: 526878 - RNA, 17 nt, Chlamydophila pneumoniae J138
auuuucccaauauccuc

SEQ ID NO: 526879 - RNA, 15 nt, Chlamydophila pneumoniae J138
auuuucccaauaucc

SEQ ID NO: 526880 - RNA, 20 nt, Chlamydophila pneumoniae J138
auuuugacguaaugcagaua

SEQ ID NO: 526881 - RNA, 21 nt, Chlamydophila pneumoniae J138
auuuucuauucgcugucuaga

SEQ ID NO: 526882 - RNA, 15 nt, Chlamydophila pneumoniae J138
auuuucucauagcuu

SEQ ID NO: 526883 - RNA, 21 nt, Chlamydophila pneumoniae J138
auuuucucauagcuuccugua

SEQ ID NO: 526884 - RNA, 22 nt, Chlamydophila pneumoniae J138
auuuuggugagaucaucuccca

SEQ ID NO: 526885 - RNA, 20 nt, Chlamydophila pneumoniae J138
auuuuuaauuuuucuaagaa

SEQ ID NO: 526886 - RNA, 18 nt, Chlamydophila pneumoniae J138
auuuuuaggaucuuuguu

SEQ ID NO: 526887 - RNA, 12 nt, Chlamydophila pneumoniae J138
auuuuuagaaua

SEQ ID NO: 526888 - RNA, 23 nt, Chlamydophila pneumoniae J138
auuugcaagagccggaacuucag

SEQ ID NO: 526889 - RNA, 16 nt, Chlamydophila pneumoniae J138
auuugauuuuucaaau

SEQ ID NO: 526890 - RNA, 23 nt, Chlamydophila pneumoniae J138
auuugcuuccaacggacauuuuc

SEQ ID NO: 526891 - RNA, 15 nt, Chlamydophila pneumoniae J138
auuugcugcauccca

SEQ ID NO: 526892 - RNA, 22 nt, Chlamydophila pneumoniae J138
auuugcauuaccuuaucgccaa

SEQ ID NO: 526893 - RNA, 22 nt, Chlamydophila pneumoniae J138
auuucguauagcuggcaaugau

SEQ ID NO: 526894 - RNA, 18 nt, Chlamydophila pneumoniae J138
auuucggacgauauuuag

SEQ ID NO: 526895 - RNA, 16 nt, Chlamydophila pneumoniae J138
auuucucuaucaucaa

SEQ ID NO: 526896 - RNA, 14 nt, Chlamydophila pneumoniae J138
auuucucuccacag

SEQ ID NO: 526897 - RNA, 19 nt, Chlamydophila pneumoniae J138
auuucuauagagcaucaua

SEQ ID NO: 526898 - RNA, 16 nt, Chlamydophila pneumoniae J138
auuucuagcuaauaau

SEQ ID NO: 526899 - RNA, 14 nt, Chlamydophila pneumoniae J138
auuucuuaauuucc

SEQ ID NO: 526900 - RNA, 17 nt, Chlamydophila pneumoniae J138
auuucuguaguucuugc

SEQ ID NO: 526901 - RNA, 20 nt, Chlamydophila pneumoniae J138
auuucuguaguucuugccaa

SEQ ID NO: 526902 - RNA, 16 nt, Chlamydophila pneumoniae J138
auuucuuucacaucuu

SEQ ID NO: 526903 - RNA, 21 nt, Chlamydophila pneumoniae J138
auuucuuaauuuccuucucca

SEQ ID NO: 526904 - RNA, 14 nt, Chlamydophila pneumoniae J138
auuucuuucucuuc

SEQ ID NO: 526905 - RNA, 17 nt, Chlamydophila pneumoniae J138
auucuuguuggauugaa

SEQ ID NO: 526906 - RNA, 21 nt, Chlamydophila pneumoniae J138
auucuuuauccccagaucucu

SEQ ID NO: 526907 - RNA, 14 nt, Chlamydophila pneumoniae J138
auucuuuauaaaua

SEQ ID NO: 526908 - RNA, 13 nt, Chlamydophila pneumoniae J138
auucuuugccaag

SEQ ID NO: 526909 - RNA, 14 nt, Chlamydophila pneumoniae J138
auucuuucgauauc

SEQ ID NO: 526910 - RNA, 20 nt, Chlamydophila pneumoniae J138
auugaacguagcuacaaaau

SEQ ID NO: 526911 - RNA, 23 nt, Chlamydophila pneumoniae J138
auucuuuuguaaucuaagaaucu

SEQ ID NO: 526912 - RNA, 13 nt, Chlamydophila pneumoniae J138
auucuuuuccugc

SEQ ID NO: 526913 - RNA, 14 nt, Chlamydophila pneumoniae J138
auucuuuuccugca

SEQ ID NO: 526914 - RNA, 14 nt, Chlamydophila pneumoniae J138
auucuucgagagca

SEQ ID NO: 526915 - RNA, 21 nt, Chlamydophila pneumoniae J138
auucuugagaguccugggguu

SEQ ID NO: 526916 - RNA, 19 nt, Chlamydophila pneumoniae J138
auucugaugaccucaucuc

SEQ ID NO: 526917 - RNA, 18 nt, Chlamydophila pneumoniae J138
auucugagaaagaagucc

SEQ ID NO: 526918 - RNA, 20 nt, Chlamydophila pneumoniae J138
auucugcccaaagcuaaaau

SEQ ID NO: 526919 - RNA, 18 nt, Chlamydophila pneumoniae J138
auucugcaaggcaaugau

SEQ ID NO: 526920 - RNA, 20 nt, Chlamydophila pneumoniae J138
auucuagaguugcuuuaugg

SEQ ID NO: 526921 - RNA, 13 nt, Chlamydophila pneumoniae J138
auucucagcuuca

SEQ ID NO: 526922 - RNA, 15 nt, Chlamydophila pneumoniae J138
auucucagaaagccu

SEQ ID NO: 526923 - RNA, 15 nt, Chlamydophila pneumoniae J138
auucucagauugcuu

SEQ ID NO: 526924 - RNA, 16 nt, Chlamydophila pneumoniae J138
auucucaauucuguau

SEQ ID NO: 526925 - RNA, 14 nt, Chlamydophila pneumoniae J138
auucugaagcugca

SEQ ID NO: 526926 - RNA, 23 nt, Chlamydophila pneumoniae J138
auucugaagauauauuuuuaaag

SEQ ID NO: 526927 - RNA, 15 nt, Chlamydophila pneumoniae J138
auucugaagagagaa

SEQ ID NO: 526928 - RNA, 23 nt, Chlamydophila pneumoniae J138
auucucugacacuccucagaauc

SEQ ID NO: 526929 - RNA, 18 nt, Chlamydophila pneumoniae J138
auucucaucggcauaacu

SEQ ID NO: 526930 - RNA, 22 nt, Chlamydophila pneumoniae J138
auucuaaaucaacuacacuuau

SEQ ID NO: 526931 - RNA, 14 nt, Chlamydophila pneumoniae J138
auugaucuuuccuc

SEQ ID NO: 526932 - RNA, 13 nt, Chlamydophila pneumoniae J138
auugaucagaauc

SEQ ID NO: 526933 - RNA, 13 nt, Chlamydophila pneumoniae J138
auugauaaugauu

SEQ ID NO: 526934 - RNA, 14 nt, Chlamydophila pneumoniae J138
auugaagauauuau

SEQ ID NO: 526935 - RNA, 16 nt, Chlamydophila pneumoniae J138
auugaugcuuaagagu

SEQ ID NO: 526936 - RNA, 15 nt, Chlamydophila pneumoniae J138
auugauguuccuuga

SEQ ID NO: 526937 - RNA, 15 nt, Chlamydophila pneumoniae J138
auugcauuuaaacua

SEQ ID NO: 526938 - RNA, 19 nt, Chlamydophila pneumoniae J138
auugcauuaagauaaacau

SEQ ID NO: 526939 - RNA, 14 nt, Chlamydophila pneumoniae J138
auugcauucuuaau

SEQ ID NO: 526940 - RNA, 22 nt, Chlamydophila pneumoniae J138
auugcauuuaaacuaagaauac

SEQ ID NO: 526941 - RNA, 16 nt, Chlamydophila pneumoniae J138
auugcugaaaaugauu

SEQ ID NO: 526942 - RNA, 17 nt, Chlamydophila pneumoniae J138
auugcggaaauugaaua

SEQ ID NO: 526943 - RNA, 13 nt, Chlamydophila pneumoniae J138
auugcugcugcua

SEQ ID NO: 526944 - RNA, 14 nt, Chlamydophila pneumoniae J138
auuggcauagagcc

SEQ ID NO: 526945 - RNA, 16 nt, Chlamydophila pneumoniae J138
auucauuaagaacauc

SEQ ID NO: 526946 - RNA, 19 nt, Chlamydophila pneumoniae J138
auucauuaagauccuuuaa

SEQ ID NO: 526947 - RNA, 18 nt, Chlamydophila pneumoniae J138
auucaugccgcauuucuu

SEQ ID NO: 526948 - RNA, 20 nt, Chlamydophila pneumoniae J138
auucaugccgcauuucuuca

SEQ ID NO: 526949 - RNA, 23 nt, Chlamydophila pneumoniae J138
auucaucuaggggagcuauuacu

SEQ ID NO: 526950 - RNA, 19 nt, Chlamydophila pneumoniae J138
auucauauuuacgaaaaca

SEQ ID NO: 526951 - RNA, 13 nt, Chlamydophila pneumoniae J138
auucauccagauu

SEQ ID NO: 526952 - RNA, 23 nt, Chlamydophila pneumoniae J138
auucauaaagaggaaugaagaga

SEQ ID NO: 526953 - RNA, 17 nt, Chlamydophila pneumoniae J138
auucaguuccucauccu

SEQ ID NO: 526954 - RNA, 23 nt, Chlamydophila pneumoniae J138
auuccaagaucuccgccuacaau

SEQ ID NO: 526955 - RNA, 16 nt, Chlamydophila pneumoniae J138
auuccaacuacauaau

SEQ ID NO: 526956 - RNA, 16 nt, Chlamydophila pneumoniae J138
auuccaaagcuaggcg

SEQ ID NO: 526957 - RNA, 15 nt, Chlamydophila pneumoniae J138
auuccaauuuuugca

SEQ ID NO: 526958 - RNA, 14 nt, Chlamydophila pneumoniae J138
auuccaacagggau

SEQ ID NO: 526959 - RNA, 21 nt, Chlamydophila pneumoniae J138
auuccaggacguaaaaagaaa

SEQ ID NO: 526960 - RNA, 17 nt, Chlamydophila pneumoniae J138
auuccaggauucuauaa

SEQ ID NO: 526961 - RNA, 23 nt, Chlamydophila pneumoniae J138
auuccagcugagcuaucuucaag

SEQ ID NO: 526962 - RNA, 19 nt, Chlamydophila pneumoniae J138
auuccagcaucuucucgaa

SEQ ID NO: 526963 - RNA, 15 nt, Chlamydophila pneumoniae J138
auuccagaaaaagaa

SEQ ID NO: 526964 - RNA, 21 nt, Chlamydophila pneumoniae J138
auuccauaggggaugauuuuc

SEQ ID NO: 526965 - RNA, 21 nt, Chlamydophila pneumoniae J138
auuccauccugucuauuucuu

SEQ ID NO: 526966 - RNA, 12 nt, Chlamydophila pneumoniae J138
auuccauggaua

SEQ ID NO: 526967 - RNA, 13 nt, Chlamydophila pneumoniae J138
auucccuccgcag

SEQ ID NO: 526968 - RNA, 22 nt, Chlamydophila pneumoniae J138
auucccggaggcaaagaucagu

SEQ ID NO: 526969 - RNA, 18 nt, Chlamydophila pneumoniae J138
auucccggaggcaaagau

SEQ ID NO: 526970 - RNA, 14 nt, Chlamydophila pneumoniae J138
auuccccguguuug

SEQ ID NO: 526971 - RNA, 19 nt, Chlamydophila pneumoniae J138
auuccccuuuaaagccugu

SEQ ID NO: 526972 - RNA, 14 nt, Chlamydophila pneumoniae J138
auuccccaaacuua

SEQ ID NO: 526973 - RNA, 14 nt, Chlamydophila pneumoniae J138
auucccaagaacuu

SEQ ID NO: 526974 - RNA, 20 nt, Chlamydophila pneumoniae J138
auuccguacgcuauaaauaa

SEQ ID NO: 526975 - RNA, 23 nt, Chlamydophila pneumoniae J138
auuccguacgcuauaaauaauua

SEQ ID NO: 526976 - RNA, 19 nt, Chlamydophila pneumoniae J138
auuccuaaguuagagacac

SEQ ID NO: 526977 - RNA, 13 nt, Chlamydophila pneumoniae J138
auuccuaaaauuu

SEQ ID NO: 526978 - RNA, 12 nt, Chlamydophila pneumoniae J138
auuccuacaucu

SEQ ID NO: 526979 - RNA, 14 nt, Chlamydophila pneumoniae J138
auuccuaugaucag

SEQ ID NO: 526980 - RNA, 15 nt, Chlamydophila pneumoniae J138
auucggaccaaugau

SEQ ID NO: 526981 - RNA, 14 nt, Chlamydophila pneumoniae J138
auucgcuacauaaa

SEQ ID NO: 526982 - RNA, 16 nt, Chlamydophila pneumoniae J138
auuccuucucagaaag

SEQ ID NO: 526983 - RNA, 13 nt, Chlamydophila pneumoniae J138
auuccugagguug

SEQ ID NO: 526984 - RNA, 20 nt, Chlamydophila pneumoniae J138
auuccugaggcuauagaaua

SEQ ID NO: 526985 - RNA, 15 nt, Chlamydophila pneumoniae J138
auuccugucauuccu

SEQ ID NO: 526986 - RNA, 21 nt, Chlamydophila pneumoniae J138
auucgaaaaacgguaaauauc

SEQ ID NO: 526987 - RNA, 19 nt, Chlamydophila pneumoniae J138
auucgaauucucagaaagc

SEQ ID NO: 526988 - RNA, 17 nt, Chlamydophila pneumoniae J138
auucgauguuaaggcuu

SEQ ID NO: 526989 - RNA, 16 nt, Chlamydophila pneumoniae J138
auucgacucuccacga

SEQ ID NO: 526990 - RNA, 12 nt, Chlamydophila pneumoniae J138
aucuggagaugc

SEQ ID NO: 526991 - RNA, 17 nt, Chlamydophila pneumoniae J138
aucugcuucuacgguaa

SEQ ID NO: 526992 - RNA, 21 nt, Chlamydophila pneumoniae J138
aucuacaaaaacuagaauaug

SEQ ID NO: 526993 - RNA, 21 nt, Chlamydophila pneumoniae J138
aucuaacuucaccauauaaua

SEQ ID NO: 526994 - RNA, 23 nt, Chlamydophila pneumoniae J138
aucuaagccagaggcccgaagca

SEQ ID NO: 526995 - RNA, 16 nt, Chlamydophila pneumoniae J138
aucuaaggcuuugccu

SEQ ID NO: 526996 - RNA, 15 nt, Chlamydophila pneumoniae J138
aucuguauccuuccu

SEQ ID NO: 526997 - RNA, 17 nt, Chlamydophila pneumoniae J138
aucuguaguaggcacuu

SEQ ID NO: 526998 - RNA, 14 nt, Chlamydophila pneumoniae J138
aucuguaguaggca

SEQ ID NO: 526999 - RNA, 15 nt, Chlamydophila pneumoniae J138
aucugucauuaaaaa

SEQ ID NO: 527000 - RNA, 14 nt, Chlamydophila pneumoniae J138
aucuguuaaaaaca

SEQ ID NO: 527001 - RNA, 15 nt, Chlamydophila pneumoniae J138
aucuguuaaaaacaa

SEQ ID NO: 527002 - RNA, 17 nt, Chlamydophila pneumoniae J138
aucuguaagaaaaugag

SEQ ID NO: 527003 - RNA, 23 nt, Chlamydophila pneumoniae J138
aucuguaauagcaggaguuuuca

SEQ ID NO: 527004 - RNA, 15 nt, Chlamydophila pneumoniae J138
aucuuaucaagagcu

SEQ ID NO: 527005 - RNA, 17 nt, Chlamydophila pneumoniae J138
aucuuaguccaugaauc

SEQ ID NO: 527006 - RNA, 12 nt, Chlamydophila pneumoniae J138
aucuuacauaaa

SEQ ID NO: 527007 - RNA, 17 nt, Chlamydophila pneumoniae J138
aucuuacauaaaccuuu

SEQ ID NO: 527008 - RNA, 22 nt, Chlamydophila pneumoniae J138
aucuuaugccuuuguuuuaucu

SEQ ID NO: 527009 - RNA, 20 nt, Chlamydophila pneumoniae J138
aucuuauugacuagcucucu

SEQ ID NO: 527010 - RNA, 23 nt, Chlamydophila pneumoniae J138
aucuucaccacaaaccucuaaaa

SEQ ID NO: 527011 - RNA, 15 nt, Chlamydophila pneumoniae J138
aucuucaagaccacu

SEQ ID NO: 527012 - RNA, 21 nt, Chlamydophila pneumoniae J138
aucuucacgacauacaucaaa

SEQ ID NO: 527013 - RNA, 17 nt, Chlamydophila pneumoniae J138
aucuucacgacauacau

SEQ ID NO: 527014 - RNA, 16 nt, Chlamydophila pneumoniae J138
aucuucagggucuaag

SEQ ID NO: 527015 - RNA, 16 nt, Chlamydophila pneumoniae J138
aucuucagagagaaca

SEQ ID NO: 527016 - RNA, 15 nt, Chlamydophila pneumoniae J138
aucuucagagagaac

SEQ ID NO: 527017 - RNA, 13 nt, Chlamydophila pneumoniae J138
aucuucauaacca

SEQ ID NO: 527018 - RNA, 17 nt, Chlamydophila pneumoniae J138
aucuuccccuaaaaauu

SEQ ID NO: 527019 - RNA, 19 nt, Chlamydophila pneumoniae J138
aucuucuaaaaccacagaa

SEQ ID NO: 527020 - RNA, 17 nt, Chlamydophila pneumoniae J138
aucuucuaaaacuucag

SEQ ID NO: 527021 - RNA, 14 nt, Chlamydophila pneumoniae J138
aucuucgucccuag

SEQ ID NO: 527022 - RNA, 14 nt, Chlamydophila pneumoniae J138
aucuucuaaaacac

SEQ ID NO: 527023 - RNA, 15 nt, Chlamydophila pneumoniae J138
aucuuguucuaaaau

SEQ ID NO: 527024 - RNA, 13 nt, Chlamydophila pneumoniae J138
aucuuuauuuaaa

SEQ ID NO: 527025 - RNA, 14 nt, Chlamydophila pneumoniae J138
aucuuuauuuuuaa

SEQ ID NO: 527026 - RNA, 18 nt, Chlamydophila pneumoniae J138
aucuuuauuuaaauaaaa

SEQ ID NO: 527027 - RNA, 15 nt, Chlamydophila pneumoniae J138
aucuuucaaaagaaa

SEQ ID NO: 527028 - RNA, 22 nt, Chlamydophila pneumoniae J138
aucuuuaguuuaccugaaaaaa

SEQ ID NO: 527029 - RNA, 23 nt, Chlamydophila pneumoniae J138
aucuuguucuaaaaugaaauacu

SEQ ID NO: 527030 - RNA, 14 nt, Chlamydophila pneumoniae J138
aucuuuagaauaag

SEQ ID NO: 527031 - RNA, 22 nt, Chlamydophila pneumoniae J138
aucuuuuucauggcccgauaca

SEQ ID NO: 527032 - RNA, 17 nt, Chlamydophila pneumoniae J138
aucuuuggcacaauccu

SEQ ID NO: 527033 - RNA, 20 nt, Chlamydophila pneumoniae J138
aucuuugagaucuugaauga

SEQ ID NO: 527034 - RNA, 20 nt, Chlamydophila pneumoniae J138
augaaauuuucuaagagguu

SEQ ID NO: 527035 - RNA, 23 nt, Chlamydophila pneumoniae J138
augaaauuucauucucacagcau

SEQ ID NO: 527036 - RNA, 18 nt, Chlamydophila pneumoniae J138
augaaauuucauucucac

SEQ ID NO: 527037 - RNA, 17 nt, Chlamydophila pneumoniae J138
augaaaaggauugcacu

SEQ ID NO: 527038 - RNA, 13 nt, Chlamydophila pneumoniae J138
aucuuuuuuaaag

SEQ ID NO: 527039 - RNA, 16 nt, Chlamydophila pneumoniae J138
aucuuuuugccaguuc

SEQ ID NO: 527040 - RNA, 12 nt, Chlamydophila pneumoniae J138
augaacgugcau

SEQ ID NO: 527041 - RNA, 19 nt, Chlamydophila pneumoniae J138
augacacagagaacaauaa

SEQ ID NO: 527042 - RNA, 20 nt, Chlamydophila pneumoniae J138
augacacagagaacaauaaa

SEQ ID NO: 527043 - RNA, 14 nt, Chlamydophila pneumoniae J138
augacaacagagac

SEQ ID NO: 527044 - RNA, 20 nt, Chlamydophila pneumoniae J138
augacaaaggguuucuuucc

SEQ ID NO: 527045 - RNA, 17 nt, Chlamydophila pneumoniae J138
augacggauccuagaau

SEQ ID NO: 527046 - RNA, 18 nt, Chlamydophila pneumoniae J138
augacagggaaagaacag

SEQ ID NO: 527047 - RNA, 17 nt, Chlamydophila pneumoniae J138
augacagggaaagaaca

SEQ ID NO: 527048 - RNA, 14 nt, Chlamydophila pneumoniae J138
augaccgcaaggag

SEQ ID NO: 527049 - RNA, 22 nt, Chlamydophila pneumoniae J138
augacuauuuucauuccaagau

SEQ ID NO: 527050 - RNA, 13 nt, Chlamydophila pneumoniae J138
augacuauuuuca

SEQ ID NO: 527051 - RNA, 20 nt, Chlamydophila pneumoniae J138
augacguuaauaaagaggcu

SEQ ID NO: 527052 - RNA, 13 nt, Chlamydophila pneumoniae J138
augauaucaccag

SEQ ID NO: 527053 - RNA, 23 nt, Chlamydophila pneumoniae J138
augauauccucaauuuguuucuu

SEQ ID NO: 527054 - RNA, 18 nt, Chlamydophila pneumoniae J138
augaggauacacuucuaa

SEQ ID NO: 527055 - RNA, 15 nt, Chlamydophila pneumoniae J138
augauuacaucuaac

SEQ ID NO: 527056 - RNA, 17 nt, Chlamydophila pneumoniae J138
augaugcauauugccuu

SEQ ID NO: 527057 - RNA, 21 nt, Chlamydophila pneumoniae J138
augaucgggguuucagaagga

SEQ ID NO: 527058 - RNA, 16 nt, Chlamydophila pneumoniae J138
augauccgaaaacucu

SEQ ID NO: 527059 - RNA, 22 nt, Chlamydophila pneumoniae J138
augauccaauagccaaagacuc

SEQ ID NO: 527060 - RNA, 17 nt, Chlamydophila pneumoniae J138
augcaccauaauauaau

SEQ ID NO: 527061 - RNA, 15 nt, Chlamydophila pneumoniae J138
augcaaaccaaaaaa

SEQ ID NO: 527062 - RNA, 14 nt, Chlamydophila pneumoniae J138
augauuuuuugaau

SEQ ID NO: 527063 - RNA, 23 nt, Chlamydophila pneumoniae J138
augcaaaacaacaucacuaucau

SEQ ID NO: 527064 - RNA, 17 nt, Chlamydophila pneumoniae J138
augcaaaauaauuacuu

SEQ ID NO: 527065 - RNA, 12 nt, Chlamydophila pneumoniae J138
augauucauaac

SEQ ID NO: 527066 - RNA, 20 nt, Chlamydophila pneumoniae J138
augcagauacuaaacuccau

SEQ ID NO: 527067 - RNA, 12 nt, Chlamydophila pneumoniae J138
augcagaucaua

SEQ ID NO: 527068 - RNA, 15 nt, Chlamydophila pneumoniae J138
augcaucaaugaagu

SEQ ID NO: 527069 - RNA, 17 nt, Chlamydophila pneumoniae J138
auggcgauaaaugcuga

SEQ ID NO: 527070 - RNA, 16 nt, Chlamydophila pneumoniae J138
auggcgauaaaugcug

SEQ ID NO: 527071 - RNA, 20 nt, Chlamydophila pneumoniae J138
auggauuucuccagcagcuu

SEQ ID NO: 527072 - RNA, 16 nt, Chlamydophila pneumoniae J138
augggguccauucuga

SEQ ID NO: 527073 - RNA, 18 nt, Chlamydophila pneumoniae J138
auggcugucacggaagaa

SEQ ID NO: 527074 - RNA, 19 nt, Chlamydophila pneumoniae J138
auggucaggaagaaaggau

SEQ ID NO: 527075 - RNA, 22 nt, Chlamydophila pneumoniae J138
augguauucccuaacaggaaag

SEQ ID NO: 527076 - RNA, 18 nt, Chlamydophila pneumoniae J138
augguugcuucuaagaaa

SEQ ID NO: 527077 - RNA, 16 nt, Chlamydophila pneumoniae J138
auggucccuauagaac

SEQ ID NO: 527078 - RNA, 17 nt, Chlamydophila pneumoniae J138
auguucucgcaaugcuu

SEQ ID NO: 527079 - RNA, 18 nt, Chlamydophila pneumoniae J138
auguuaugaguuuuuaau

SEQ ID NO: 527080 - RNA, 15 nt, Chlamydophila pneumoniae J138
auguuaugaguuuuu

SEQ ID NO: 527081 - RNA, 13 nt, Chlamydophila pneumoniae J138
auguuaugaguuu

SEQ ID NO: 527082 - RNA, 16 nt, Chlamydophila pneumoniae J138
augugucuugcugauu

SEQ ID NO: 527083 - RNA, 19 nt, Chlamydophila pneumoniae J138
augugcgcacaagggauuc

SEQ ID NO: 527084 - RNA, 24 nt, Chlamydophila pneumoniae J138
augugguucccccuaagguagcua

SEQ ID NO: 527085 - RNA, 14 nt, Chlamydophila pneumoniae J138
augugcugaagacc

SEQ ID NO: 527086 - RNA, 14 nt, Chlamydophila pneumoniae J138
augucuaaaggagu

SEQ ID NO: 527087 - RNA, 13 nt, Chlamydophila pneumoniae J138
augucuccauaca

SEQ ID NO: 527088 - RNA, 15 nt, Chlamydophila pneumoniae J138
augucaguaucaaua

SEQ ID NO: 527089 - RNA, 22 nt, Chlamydophila pneumoniae J138
augucaguaucaauaaucggcc

SEQ ID NO: 527090 - RNA, 17 nt, Chlamydophila pneumoniae J138
augucgcuaccauaucu

SEQ ID NO: 527091 - RNA, 22 nt, Chlamydophila pneumoniae J138
auguacccagcgaugucuuuga

SEQ ID NO: 527092 - RNA, 11 nt, Chlamydophila pneumoniae J138
auguagagucg

SEQ ID NO: 527093 - RNA, 14 nt, Chlamydophila pneumoniae J138
auguagaucuacaa

SEQ ID NO: 527094 - RNA, 13 nt, Chlamydophila pneumoniae J138
auguagcagagcc

SEQ ID NO: 527095 - RNA, 16 nt, Chlamydophila pneumoniae J138
auguacaguaaaguau

SEQ ID NO: 527096 - RNA, 19 nt, Chlamydophila pneumoniae J138
augcuugaaguucucaaag

SEQ ID NO: 527097 - RNA, 14 nt, Chlamydophila pneumoniae J138
augcuucuuucaaa

SEQ ID NO: 527098 - RNA, 20 nt, Chlamydophila pneumoniae J138
augcuucaaggcaucuucuu

SEQ ID NO: 527099 - RNA, 17 nt, Chlamydophila pneumoniae J138
augcuuagcaaaggcaa

SEQ ID NO: 527100 - RNA, 16 nt, Chlamydophila pneumoniae J138
augcuuagccauggca

SEQ ID NO: 527101 - RNA, 15 nt, Chlamydophila pneumoniae J138
augcuguugauucaa

SEQ ID NO: 527102 - RNA, 16 nt, Chlamydophila pneumoniae J138
augcugaaccuuuggu

SEQ ID NO: 527103 - RNA, 16 nt, Chlamydophila pneumoniae J138
augcugcacaguucac

SEQ ID NO: 527104 - RNA, 14 nt, Chlamydophila pneumoniae J138
auggaaagaaacaa

SEQ ID NO: 527105 - RNA, 22 nt, Chlamydophila pneumoniae J138
auggaaagagucccugauucca

SEQ ID NO: 527106 - RNA, 14 nt, Chlamydophila pneumoniae J138
auggaaauagagaa

SEQ ID NO: 527107 - RNA, 17 nt, Chlamydophila pneumoniae J138
auggaauggcuuuuguu

SEQ ID NO: 527108 - RNA, 23 nt, Chlamydophila pneumoniae J138
auggacagcguauaggaaacugu

SEQ ID NO: 527109 - RNA, 14 nt, Chlamydophila pneumoniae J138
auggacaagcaaaa

SEQ ID NO: 527110 - RNA, 18 nt, Chlamydophila pneumoniae J138
auggagaaggacacuaga

SEQ ID NO: 527111 - RNA, 20 nt, Chlamydophila pneumoniae J138
auggauccuucaucagcuuc

SEQ ID NO: 527112 - RNA, 15 nt, Chlamydophila pneumoniae J138
auggaucccuguagu

SEQ ID NO: 527113 - RNA, 17 nt, Chlamydophila pneumoniae J138
augcauuuguuuggaaa

SEQ ID NO: 527114 - RNA, 23 nt, Chlamydophila pneumoniae J138
augcauuuguuuggaaaugagag

SEQ ID NO: 527115 - RNA, 16 nt, Chlamydophila pneumoniae J138
augcaucucuagccaa

SEQ ID NO: 527116 - RNA, 17 nt, Chlamydophila pneumoniae J138
augcgaagggaggagaa

SEQ ID NO: 527117 - RNA, 12 nt, Chlamydophila pneumoniae J138
augcaucucuua

SEQ ID NO: 527118 - RNA, 18 nt, Chlamydophila pneumoniae J138
augcaucucuuaaaacau

SEQ ID NO: 527119 - RNA, 21 nt, Chlamydophila pneumoniae J138
augcaucucuuaaaacaugag

SEQ ID NO: 527120 - RNA, 16 nt, Chlamydophila pneumoniae J138
augcggaccuuaagau

SEQ ID NO: 527121 - RNA, 21 nt, Chlamydophila pneumoniae J138
augcuaaagagucuuccuaga

SEQ ID NO: 527122 - RNA, 21 nt, Chlamydophila pneumoniae J138
augcuaaauuugucaucacau

SEQ ID NO: 527123 - RNA, 17 nt, Chlamydophila pneumoniae J138
augcuauuuuccucuau

SEQ ID NO: 527124 - RNA, 22 nt, Chlamydophila pneumoniae J138
augcuauagcuggaucuucuga

SEQ ID NO: 527125 - RNA, 16 nt, Chlamydophila pneumoniae J138
augcuaagcaucagaa

SEQ ID NO: 527126 - RNA, 21 nt, Chlamydophila pneumoniae J138
augcuaauuggauauagggag

SEQ ID NO: 527127 - RNA, 18 nt, Chlamydophila pneumoniae J138
augcucauuaauaauauc

SEQ ID NO: 527128 - RNA, 16 nt, Chlamydophila pneumoniae J138
aucagugcugccauga

SEQ ID NO: 527129 - RNA, 16 nt, Chlamydophila pneumoniae J138
aucaguuaacugugua

SEQ ID NO: 527130 - RNA, 15 nt, Chlamydophila pneumoniae J138
aucauaacuagggua

SEQ ID NO: 527131 - RNA, 22 nt, Chlamydophila pneumoniae J138
aucauagaugucaguaucaaua

SEQ ID NO: 527132 - RNA, 19 nt, Chlamydophila pneumoniae J138
aucauagccaucauagcaa

SEQ ID NO: 527133 - RNA, 20 nt, Chlamydophila pneumoniae J138
aucauagccaucauagcaaa

SEQ ID NO: 527134 - RNA, 17 nt, Chlamydophila pneumoniae J138
aucaggacaaugaagaa

SEQ ID NO: 527135 - RNA, 22 nt, Chlamydophila pneumoniae J138
aucaauccuauggcagcaggaa

SEQ ID NO: 527136 - RNA, 18 nt, Chlamydophila pneumoniae J138
aucaggauggucauacca

SEQ ID NO: 527137 - RNA, 21 nt, Chlamydophila pneumoniae J138
aucauguagugcuucuucuau

SEQ ID NO: 527138 - RNA, 14 nt, Chlamydophila pneumoniae J138
aucaugauaaaaau

SEQ ID NO: 527139 - RNA, 16 nt, Chlamydophila pneumoniae J138
aucaugagaauuuuca

SEQ ID NO: 527140 - RNA, 20 nt, Chlamydophila pneumoniae J138
aucaugauaaaaauuuucag

SEQ ID NO: 527141 - RNA, 16 nt, Chlamydophila pneumoniae J138
aucaugauauugcguu

SEQ ID NO: 527142 - RNA, 14 nt, Chlamydophila pneumoniae J138
aucaugaaaaggau

SEQ ID NO: 527143 - RNA, 21 nt, Chlamydophila pneumoniae J138
aucaucucccaaauagcuaca

SEQ ID NO: 527144 - RNA, 21 nt, Chlamydophila pneumoniae J138
aucaucuacgauguuuucuua

SEQ ID NO: 527145 - RNA, 12 nt, Chlamydophila pneumoniae J138
aucauauuuuuc

SEQ ID NO: 527146 - RNA, 23 nt, Chlamydophila pneumoniae J138
auccaaaagcggcccagaucacc

SEQ ID NO: 527147 - RNA, 19 nt, Chlamydophila pneumoniae J138
aucauuuucauagcagcua

SEQ ID NO: 527148 - RNA, 12 nt, Chlamydophila pneumoniae J138
auccaaagacuu

SEQ ID NO: 527149 - RNA, 19 nt, Chlamydophila pneumoniae J138
auccaaagcuauuucucua

SEQ ID NO: 527150 - RNA, 21 nt, Chlamydophila pneumoniae J138
auccaaacgguuaaugaacuc

SEQ ID NO: 527151 - RNA, 22 nt, Chlamydophila pneumoniae J138
auccaaauugcaauuuucuaaa

SEQ ID NO: 527152 - RNA, 14 nt, Chlamydophila pneumoniae J138
auccaagaauagcc

SEQ ID NO: 527153 - RNA, 15 nt, Chlamydophila pneumoniae J138
auccaagaaugaauc

SEQ ID NO: 527154 - RNA, 14 nt, Chlamydophila pneumoniae J138
auccaagauaccau

SEQ ID NO: 527155 - RNA, 21 nt, Chlamydophila pneumoniae J138
auccagauuagaaaagauaaa

SEQ ID NO: 527156 - RNA, 15 nt, Chlamydophila pneumoniae J138
auccagauuagaaaa

SEQ ID NO: 527157 - RNA, 23 nt, Chlamydophila pneumoniae J138
auccagaaucuccauuuagaaug

SEQ ID NO: 527158 - RNA, 18 nt, Chlamydophila pneumoniae J138
auccacauccuuguagaa

SEQ ID NO: 527159 - RNA, 20 nt, Chlamydophila pneumoniae J138
auccacagaucguaaucugu

SEQ ID NO: 527160 - RNA, 18 nt, Chlamydophila pneumoniae J138
auccaauagccaaagacu

SEQ ID NO: 527161 - RNA, 14 nt, Chlamydophila pneumoniae J138
auccaaugacaauc

SEQ ID NO: 527162 - RNA, 16 nt, Chlamydophila pneumoniae J138
auccaaugacaauccg

SEQ ID NO: 527163 - RNA, 22 nt, Chlamydophila pneumoniae J138
auccaaguguucgaguucuuua

SEQ ID NO: 527164 - RNA, 14 nt, Chlamydophila pneumoniae J138
auccagcuccauaa

SEQ ID NO: 527165 - RNA, 15 nt, Chlamydophila pneumoniae J138
auccaggaauagaaa

SEQ ID NO: 527166 - RNA, 17 nt, Chlamydophila pneumoniae J138
auccagguuguccuaua

SEQ ID NO: 527167 - RNA, 17 nt, Chlamydophila pneumoniae J138
auccaucggcauuucuc

SEQ ID NO: 527168 - RNA, 21 nt, Chlamydophila pneumoniae J138
auccaucggcauuucuccaca

SEQ ID NO: 527169 - RNA, 15 nt, Chlamydophila pneumoniae J138
auccaugaacagcau

SEQ ID NO: 527170 - RNA, 17 nt, Chlamydophila pneumoniae J138
auccaugcuagaagaca

SEQ ID NO: 527171 - RNA, 16 nt, Chlamydophila pneumoniae J138
auccaugacuugacac

SEQ ID NO: 527172 - RNA, 20 nt, Chlamydophila pneumoniae J138
auccaugacuugacacagga

SEQ ID NO: 527173 - RNA, 12 nt, Chlamydophila pneumoniae J138
auccauucuuaa

SEQ ID NO: 527174 - RNA, 13 nt, Chlamydophila pneumoniae J138
auccauuuugccc

SEQ ID NO: 527175 - RNA, 16 nt, Chlamydophila pneumoniae J138
aucccaaguauggucc

SEQ ID NO: 527176 - RNA, 19 nt, Chlamydophila pneumoniae J138
aucccacgggucaggaggu

SEQ ID NO: 527177 - RNA, 16 nt, Chlamydophila pneumoniae J138
aucccaccgacaagau

SEQ ID NO: 527178 - RNA, 16 nt, Chlamydophila pneumoniae J138
aucccaucaaaggcaa

SEQ ID NO: 527179 - RNA, 19 nt, Chlamydophila pneumoniae J138
aucccuaagguuuccauga

SEQ ID NO: 527180 - RNA, 17 nt, Chlamydophila pneumoniae J138
aucccuagggaaagcau

SEQ ID NO: 527181 - RNA, 15 nt, Chlamydophila pneumoniae J138
aucccgaguccuaaa

SEQ ID NO: 527182 - RNA, 15 nt, Chlamydophila pneumoniae J138
aucccgaacaaucaa

SEQ ID NO: 527183 - RNA, 18 nt, Chlamydophila pneumoniae J138
aucccgaagcaauccagu

SEQ ID NO: 527184 - RNA, 12 nt, Chlamydophila pneumoniae J138
auccccucagaa

SEQ ID NO: 527185 - RNA, 14 nt, Chlamydophila pneumoniae J138
auccccucagaaag

SEQ ID NO: 527186 - RNA, 18 nt, Chlamydophila pneumoniae J138
auccccucagaaaggaga

SEQ ID NO: 527187 - RNA, 17 nt, Chlamydophila pneumoniae J138
auccccguccuguacca

SEQ ID NO: 527188 - RNA, 14 nt, Chlamydophila pneumoniae J138
auccgauauacuua

SEQ ID NO: 527189 - RNA, 16 nt, Chlamydophila pneumoniae J138
auccgacuuuccucaa

SEQ ID NO: 527190 - RNA, 18 nt, Chlamydophila pneumoniae J138
aucccuguaguuucuaaa

SEQ ID NO: 527191 - RNA, 15 nt, Chlamydophila pneumoniae J138
aucccuggauuucuu

SEQ ID NO: 527192 - RNA, 18 nt, Chlamydophila pneumoniae J138
auccgaagacucaaagaa

SEQ ID NO: 527193 - RNA, 24 nt, Chlamydophila pneumoniae J138
auccgucagccuuagcagcaccca

SEQ ID NO: 527194 - RNA, 21 nt, Chlamydophila pneumoniae J138
auccgucagccuuagcagcac

SEQ ID NO: 527195 - RNA, 15 nt, Chlamydophila pneumoniae J138
auccuaauuccuuca

SEQ ID NO: 527196 - RNA, 12 nt, Chlamydophila pneumoniae J138
auccuaaaaagg

SEQ ID NO: 527197 - RNA, 16 nt, Chlamydophila pneumoniae J138
auccuauuuuagcaua

SEQ ID NO: 527198 - RNA, 12 nt, Chlamydophila pneumoniae J138
auccucaaagag

SEQ ID NO: 527199 - RNA, 14 nt, Chlamydophila pneumoniae J138
auccucagucucuc

SEQ ID NO: 527200 - RNA, 16 nt, Chlamydophila pneumoniae J138
auccucagucucucua

SEQ ID NO: 527201 - RNA, 17 nt, Chlamydophila pneumoniae J138
auccuauaguaauuucu

SEQ ID NO: 527202 - RNA, 19 nt, Chlamydophila pneumoniae J138
auccuacgagcgcuuucuu

SEQ ID NO: 527203 - RNA, 15 nt, Chlamydophila pneumoniae J138
auccugaaaguacag

SEQ ID NO: 527204 - RNA, 14 nt, Chlamydophila pneumoniae J138
auccugaaaguaca

SEQ ID NO: 527205 - RNA, 22 nt, Chlamydophila pneumoniae J138
auccugagaccauacacaaauc

SEQ ID NO: 527206 - RNA, 18 nt, Chlamydophila pneumoniae J138
auccugcaauccacgcuc

SEQ ID NO: 527207 - RNA, 13 nt, Chlamydophila pneumoniae J138
auccucaucauca

SEQ ID NO: 527208 - RNA, 16 nt, Chlamydophila pneumoniae J138
auccucaucaucagaa

SEQ ID NO: 527209 - RNA, 24 nt, Chlamydophila pneumoniae J138
auccugcucguaaaucuggaauga

SEQ ID NO: 527210 - RNA, 16 nt, Chlamydophila pneumoniae J138
auccugcuccaaaaug

SEQ ID NO: 527211 - RNA, 15 nt, Chlamydophila pneumoniae J138
auccuggagcaugag

SEQ ID NO: 527212 - RNA, 21 nt, Chlamydophila pneumoniae J138
auccuguaacacccucccuca

SEQ ID NO: 527213 - RNA, 22 nt, Chlamydophila pneumoniae J138
auccuguagagcaagauucuuc

SEQ ID NO: 527214 - RNA, 15 nt, Chlamydophila pneumoniae J138
auccuguagagcaag

SEQ ID NO: 527215 - RNA, 17 nt, Chlamydophila pneumoniae J138
auccuguagcuuuaugc

SEQ ID NO: 527216 - RNA, 11 nt, Chlamydophila pneumoniae J138
auccugggcaa

SEQ ID NO: 527217 - RNA, 14 nt, Chlamydophila pneumoniae J138
aucgcgaagcuuuc

SEQ ID NO: 527218 - RNA, 19 nt, Chlamydophila pneumoniae J138
aucgcuguaaauucaguga

SEQ ID NO: 527219 - RNA, 19 nt, Chlamydophila pneumoniae J138
aucgcucucuccaugagcu

SEQ ID NO: 527220 - RNA, 16 nt, Chlamydophila pneumoniae J138
aucggcagcagcauaa

SEQ ID NO: 527221 - RNA, 21 nt, Chlamydophila pneumoniae J138
aucguaauguauccuucuaca

SEQ ID NO: 527222 - RNA, 22 nt, Chlamydophila pneumoniae J138
aucguaagccggcgguggaaaa

SEQ ID NO: 527223 - RNA, 16 nt, Chlamydophila pneumoniae J138
aucguacuucacuucu

SEQ ID NO: 527224 - RNA, 19 nt, Chlamydophila pneumoniae J138
aucuaaaagcacuuaaaaa

SEQ ID NO: 527225 - RNA, 18 nt, Chlamydophila pneumoniae J138
aucuaaaaacuucccauc

SEQ ID NO: 527226 - RNA, 20 nt, Chlamydophila pneumoniae J138
aucuaaaagcacuuaaaaaa

SEQ ID NO: 527227 - RNA, 22 nt, Chlamydophila pneumoniae J138
aucgugacucuuaucuggagau

SEQ ID NO: 527228 - RNA, 15 nt, Chlamydophila pneumoniae J138
auccuuccaagugcu

SEQ ID NO: 527229 - RNA, 15 nt, Chlamydophila pneumoniae J138
auccuuuccaagaag

SEQ ID NO: 527230 - RNA, 18 nt, Chlamydophila pneumoniae J138
auccuuuccaagaaguca

SEQ ID NO: 527231 - RNA, 19 nt, Chlamydophila pneumoniae J138
auccuugauuuuaaaauga

SEQ ID NO: 527232 - RNA, 16 nt, Chlamydophila pneumoniae J138
auccuugcaaaacagc

SEQ ID NO: 527233 - RNA, 21 nt, Chlamydophila pneumoniae J138
auccuucuacaaugauauaaa

SEQ ID NO: 527234 - RNA, 22 nt, Chlamydophila pneumoniae J138
auccuugaaagacucgcucucc

SEQ ID NO: 527235 - RNA, 13 nt, Chlamydophila pneumoniae J138
auccuucuuuacc

SEQ ID NO: 527236 - RNA, 21 nt, Chlamydophila pneumoniae J138
aucgacaggggaguuuucaaa

SEQ ID NO: 527237 - RNA, 16 nt, Chlamydophila pneumoniae J138
aucgacaaguaccuuc

SEQ ID NO: 527238 - RNA, 15 nt, Chlamydophila pneumoniae J138
auccuuucacaaaga

SEQ ID NO: 527239 - RNA, 20 nt, Chlamydophila pneumoniae J138
aucgaagagcccucuucacu

SEQ ID NO: 527240 - RNA, 22 nt, Chlamydophila pneumoniae J138
aucgaaucuugauauugaaaga

SEQ ID NO: 527241 - RNA, 16 nt, Chlamydophila pneumoniae J138
auaaugacucuagagu

SEQ ID NO: 527242 - RNA, 15 nt, Chlamydophila pneumoniae J138
auaaucuguaagaaa

SEQ ID NO: 527243 - RNA, 17 nt, Chlamydophila pneumoniae J138
auaaucuguaagaaaau

SEQ ID NO: 527244 - RNA, 19 nt, Chlamydophila pneumoniae J138
auaaucuccaaacauuuuu

SEQ ID NO: 527245 - RNA, 15 nt, Chlamydophila pneumoniae J138
auaaucucaccagaa

SEQ ID NO: 527246 - RNA, 22 nt, Chlamydophila pneumoniae J138
auaaucucaccagaagcaacua

SEQ ID NO: 527247 - RNA, 23 nt, Chlamydophila pneumoniae J138
auaaucauuaagacucaauacuu

SEQ ID NO: 527248 - RNA, 16 nt, Chlamydophila pneumoniae J138
auaaucccuacccccu

SEQ ID NO: 527249 - RNA, 14 nt, Chlamydophila pneumoniae J138
auaauucgugucau

SEQ ID NO: 527250 - RNA, 18 nt, Chlamydophila pneumoniae J138
auaauucugcacauccgu

SEQ ID NO: 527251 - RNA, 15 nt, Chlamydophila pneumoniae J138
auaaugguacaauac

SEQ ID NO: 527252 - RNA, 18 nt, Chlamydophila pneumoniae J138
auaauuucaaagaugcag

SEQ ID NO: 527253 - RNA, 21 nt, Chlamydophila pneumoniae J138
auaauuggcguaauaauucca

SEQ ID NO: 527254 - RNA, 16 nt, Chlamydophila pneumoniae J138
auacaaacaucgaaac

SEQ ID NO: 527255 - RNA, 22 nt, Chlamydophila pneumoniae J138
auacaaacaagaagcguacuuu

SEQ ID NO: 527256 - RNA, 15 nt, Chlamydophila pneumoniae J138
auacaaacaucgaaa

SEQ ID NO: 527257 - RNA, 12 nt, Chlamydophila pneumoniae J138
auacaaaaaaua

SEQ ID NO: 527258 - RNA, 18 nt, Chlamydophila pneumoniae J138
auacaaaacaaaagccau

SEQ ID NO: 527259 - RNA, 17 nt, Chlamydophila pneumoniae J138
auacaagcgaaagcagc

SEQ ID NO: 527260 - RNA, 17 nt, Chlamydophila pneumoniae J138
auacaauccagaaucuc

SEQ ID NO: 527261 - RNA, 21 nt, Chlamydophila pneumoniae J138
auacacccgcaagcacuuguu

SEQ ID NO: 527262 - RNA, 14 nt, Chlamydophila pneumoniae J138
auacacaaaucauu

SEQ ID NO: 527263 - RNA, 14 nt, Chlamydophila pneumoniae J138
auacauucuauucu

SEQ ID NO: 527264 - RNA, 22 nt, Chlamydophila pneumoniae J138
auacaucuuaagagcaaacauc

SEQ ID NO: 527265 - RNA, 13 nt, Chlamydophila pneumoniae J138
auacauagggaaa

SEQ ID NO: 527266 - RNA, 22 nt, Chlamydophila pneumoniae J138
auacauaucuccuuuaaauaaa

SEQ ID NO: 527267 - RNA, 18 nt, Chlamydophila pneumoniae J138
auacauccucacuagaga

SEQ ID NO: 527268 - RNA, 22 nt, Chlamydophila pneumoniae J138
auacaguuggcguuuucuagaa

SEQ ID NO: 527269 - RNA, 19 nt, Chlamydophila pneumoniae J138
auacaguuggcguuuucua

SEQ ID NO: 527270 - RNA, 22 nt, Chlamydophila pneumoniae J138
auacaggcuccucugcuaagca

SEQ ID NO: 527271 - RNA, 21 nt, Chlamydophila pneumoniae J138
auacaggccugaugucuccau

SEQ ID NO: 527272 - RNA, 22 nt, Chlamydophila pneumoniae J138
auacagauguaaaugcuccuug

SEQ ID NO: 527273 - RNA, 22 nt, Chlamydophila pneumoniae J138
auacagcgcgaucacuuuccug

SEQ ID NO: 527274 - RNA, 16 nt, Chlamydophila pneumoniae J138
auacagccagcagaag

SEQ ID NO: 527275 - RNA, 16 nt, Chlamydophila pneumoniae J138
auacagcauaaaaauu

SEQ ID NO: 527276 - RNA, 20 nt, Chlamydophila pneumoniae J138
auacagauguuuucguaaau

SEQ ID NO: 527277 - RNA, 22 nt, Chlamydophila pneumoniae J138
auacagauguuuucguaaauau

SEQ ID NO: 527278 - RNA, 15 nt, Chlamydophila pneumoniae J138
auacccaucuagaaa

SEQ ID NO: 527279 - RNA, 16 nt, Chlamydophila pneumoniae J138
auacccaucuagaaac

SEQ ID NO: 527280 - RNA, 13 nt, Chlamydophila pneumoniae J138
auacccuucuucu

SEQ ID NO: 527281 - RNA, 22 nt, Chlamydophila pneumoniae J138
auacccucggagacucagagaa

SEQ ID NO: 527282 - RNA, 17 nt, Chlamydophila pneumoniae J138
auaccaucucuuucuau

SEQ ID NO: 527283 - RNA, 14 nt, Chlamydophila pneumoniae J138
auaccagaagcaaa

SEQ ID NO: 527284 - RNA, 17 nt, Chlamydophila pneumoniae J138
auaccacuacugagcuu
